United States Patent 7,795,419 (VIRAL AND VIRAL ASSOCIATED MIRNAS AND USES THEREOF) - sequence listing, part 11

SEQ ID NO: 302975 - RNA, 64 nt, Human
ugguagacaagaacugugaaagagagagagaaaaaaccucaacuguguauuuugucacggcgga

SEQ ID NO: 302976 - RNA, 64 nt, Human
gguuucguucccgucuucagcaaaacgaccuuggaaccucaaugggggcugcuuugcuuuggga

SEQ ID NO: 302977 - RNA, 64 nt, Human
gaacuuuaaccugaaaucuguugaugauuuaaagaaccucaauacuacugcaguuaccaaaggg

SEQ ID NO: 302978 - RNA, 64 nt, Human
uaagaccaaauguaguuuuguauacagagaagaaaaccucaaguaauaggcauuuuaaguaaaa

SEQ ID NO: 302979 - RNA, 64 nt, Human
aaucuguugaaaagugcaguuacuucuggaaauuaaccucaauauuaggucagcaugugaaaug

SEQ ID NO: 302980 - RNA, 64 nt, Human
cccugaggccgaggagaugaaggccacauacaucaaccucaagccagccagaaaguaccgcuuc

SEQ ID NO: 302981 - RNA, 64 nt, Human
uucaauaacuucacauaaacuuccuguucuccaaaaccucaaagagauagaguuaaugaguugu

SEQ ID NO: 302982 - RNA, 64 nt, Human
uuaucaauuuuuuucuccucaagauucuguaauaaaccucaaagucugguguagaaugguauuu

SEQ ID NO: 302983 - RNA, 64 nt, Human
aagagaaauuuuugcuguuaaugccagaaugagcaaccucaaggaauugaacacuucuuggaaa

SEQ ID NO: 302984 - RNA, 64 nt, Human
gugugaggcauaaaugcuuccuucuacguaggccaaccucaaaacuuucaguaggaauguugcu

SEQ ID NO: 302985 - RNA, 64 nt, Human
uuagcuccuuagagugaagcaaaagcaagacuucaaccucaaccuaucuuuauguuuuaaaugu

SEQ ID NO: 302986 - RNA, 64 nt, Human
gagcuggacuggaugacucuggaggccccuuccaaaccucaaguguccggcgcuuugauugccu

SEQ ID NO: 302987 - RNA, 64 nt, Human
ucuuuuuauguggaaacugcuagacaacuguugaaaccucaaauucauuuccauuucaauaaac

SEQ ID NO: 302988 - RNA, 64 nt, Human
uacuuuuuauuggguaaaaauggaauugaacagcaaccucaacauaagauuuuuuuucuaguag

SEQ ID NO: 302989 - RNA, 64 nt, Human
ggcauauugaucauuuuagacacugggagaagagaaccucaaacuaggaggaaaagacagagcc

SEQ ID NO: 302990 - RNA, 64 nt, Human
cuagccaaauuguccuugaauuuggguuuuccacaaccucaaaggguuauuugaaaucuuuugu

SEQ ID NO: 302991 - RNA, 64 nt, Human
agagaugaagacgaguuggggauuguuuaaucacaaccucaaguguuaaaacaaaaacaaacaa

SEQ ID NO: 302992 - RNA, 64 nt, Human
uucuauuuaucaauaaauucauagaccuaaaauaaaccucaacaggucuuuuaauauaaauucu

SEQ ID NO: 302993 - RNA, 64 nt, Human
auacuaguuuggauaucuuuaggguuuagaaucuaaccucaagaauaagaaauacaaguacaaa

SEQ ID NO: 302994 - RNA, 64 nt, Human
augauaaugacaguuuauuuuuauguuauauaaaaaccucaacaaauuuuccaaacaacuacca

SEQ ID NO: 302995 - RNA, 59 nt, Human
gcucaggaccaaccgcauagcugccuaugcccccgcagaacuggcugcugcgugugaac

SEQ ID NO: 302996 - RNA, 62 nt, Human
acgauuuagcuguggcucccuccuccuguccucccccgcacccccucccuucugggaaacaa

SEQ ID NO: 302997 - RNA, 62 nt, Human
uggaagggccggcuucugccuggggugcauuucccccgcagugcauaccggacuugucacac

SEQ ID NO: 302998 - RNA, 62 nt, Human
cugacagaagagguacccuugggacagaguaucccccgcaggcggaaguagcugagggcaag

SEQ ID NO: 302999 - RNA, 64 nt, Human
caaaauccuacuuuucagagccuuccagcucuggaaccucaaacauccucaugcucucucccag

SEQ ID NO: 303000 - RNA, 64 nt, Human
aauguuaacaacacguuuagaggaggaaaaguucaaccucaaguuaaaugguuugacuuauucu

SEQ ID NO: 303001 - RNA, 64 nt, Human
uggcaacagaaacaggcacaacuggaagacuuggaaccucaaagcuuguauuccaucugcugua

SEQ ID NO: 303002 - RNA, 64 nt, Human
gaguguuuuuacauauuguaaaauuuuauuuccuaaccucaaauuguucugauuuucagaugug

SEQ ID NO: 303003 - RNA, 64 nt, Human
cuuuuauggcaaaaguaaucauguuuuaauguagaaccucaaacaggauggaacaucaguggau

SEQ ID NO: 303004 - RNA, 64 nt, Human
agagaacauuauguuuguaucauuucuuucauaaaaccucaagagcauuuuuaagcccuuuuca

SEQ ID NO: 303005 - RNA, 64 nt, Human
auuuauaacuguguuuucaugguugcgaagaccuaaccucaaaugcaucugcuagaaagcguac

SEQ ID NO: 303006 - RNA, 64 nt, Human
gaaaacaccuauuuuucuacuacccagcccaagaaaccucaaaagcaugccuuguuucuauccu

SEQ ID NO: 303007 - RNA, 64 nt, Human
cuacgagaccagagagacuguaguucccuauuuuaaccucaauuaugcauuugucccccaaccc

SEQ ID NO: 303008 - RNA, 64 nt, Human
aacagcaauugugucccaaagaugaagauacuauaaccucaaauggugcagauccagaacuggg

SEQ ID NO: 303009 - RNA, 64 nt, Human
uuuuccuuuauucuuaauggccuuccucuguugcaaccucaauaaacagcacaaucucauggcu

SEQ ID NO: 303010 - RNA, 64 nt, Human
cccuaauauccccagccccagccagaagcugugaaaccucaaguccuauggaggggagaaggac

SEQ ID NO: 303011 - RNA, 64 nt, Human
guuuugaaguuucuaaaggagauagaaugauuuuaaccucaaugaguugcccuguaaauuuaaa

SEQ ID NO: 303012 - RNA, 64 nt, Human
agccuauuucuaaagucgccuuuucugucagauaaaccucaaaacuuuuaauuuuauuugagau

SEQ ID NO: 303013 - RNA, 64 nt, Human
uccuuuuuuugauucagcuuauacccgggcugaaaaccucaauuuauguucaugacagugggga

SEQ ID NO: 303014 - RNA, 64 nt, Human
uuaauaaauauggcagaacuauauaugugucuuaaaccucaaaguaaauuuuccuugagaaaua

SEQ ID NO: 303015 - RNA, 64 nt, Human
gcuggagugcagugacgcaauccuaacugacuguaaccucaaacuccuggacucaagccaucuc

SEQ ID NO: 303016 - RNA, 64 nt, Human
ccaaucuaagccagucucacugugaaccacacgaaaccucaacugggggagugaggggcuggcc

SEQ ID NO: 303017 - RNA, 64 nt, Human
caguugcuucugagccagaccagcuguaagcugaaaccucaaugaauaacaagaaaagacucca

SEQ ID NO: 303018 - RNA, 64 nt, Human
aauccacuaagaaggccugucuacacugcaggggaaccucaagaacuuuucauugcacuucuaa

SEQ ID NO: 303019 - RNA, 64 nt, Human
uugauaucacugacucuugaaaucacuaacagugaaccucaaauuugguuaugauguuaacaga

SEQ ID NO: 303020 - RNA, 64 nt, Human
cuucaaaaggaagagccuuuuaaaaacauuugccaaccucaagaauaaauacugaaagucuuga

SEQ ID NO: 303021 - RNA, 64 nt, Human
uuggguacacuucucuuaaguggucuagucaaggaaccucaagucaugcuuuugcuaucaccaa

SEQ ID NO: 303022 - RNA, 64 nt, Human
uuccagaaagcgcuuuacccugcaggguuuugcuaaccucaaaggucagaaagguaaaaguagu

SEQ ID NO: 303023 - RNA, 64 nt, Human
cucuugauagaauguugauucaacauacuguuuaaaccucaaggaaaaaaacaaacgcagaauu

SEQ ID NO: 303024 - RNA, 64 nt, Human
uuugucuaauacaauaaaaacuggcauuaauacaaaccucaaaaacgugagcguaucuuccagg

SEQ ID NO: 303025 - RNA, 62 nt, Human
ggggcucagcccccuccaggaugcagcccccucccccgcaccccggaaccggcgucgcuggc

SEQ ID NO: 303026 - RNA, 62 nt, Human
ugacauuuugccaacuuaaacgagaaaaagaccccccgcacccggcacacucccccuuccuc

SEQ ID NO: 303027 - RNA, 62 nt, Human
gaaagcagguucugugggaccccccgccccgccccccgcacuccuucauagcagcaguagug

SEQ ID NO: 303028 - RNA, 62 nt, Human
aguuggcagagaaggccucuugugcucacgcucccccgcaguccccagcccuucugccuuuc

SEQ ID NO: 303029 - RNA, 64 nt, Human
cucgaggaaggaaauaauucucuccuuuguuuugaaccucaaacuagauaaacccuaggaauug

SEQ ID NO: 303030 - RNA, 64 nt, Human
ucaagccuuuaggauagugugauguguaacaaacaaccucaaaugugaaugccuugauuuuauu

SEQ ID NO: 303031 - RNA, 64 nt, Human
aacuauuucaaaaauuacugccuuuaaaaaaaacaaccucaagcuauauuuguauucauaauug

SEQ ID NO: 303032 - RNA, 64 nt, Human
gaaggaaauaaauguaaaaaugcugcaaauuaaaaaccucaaagaagggaaauaauugcaacaa

SEQ ID NO: 303033 - RNA, 64 nt, Human
caaccucgaccucccgaagcucagaugguccuccaaccucaaccucaguuuuuuuuuucuuucu

SEQ ID NO: 303034 - RNA, 64 nt, Human
cuacccuaggcugagauugcacucgccuucuaagaaccucaauaaagagacucuggggugucug

SEQ ID NO: 303035 - RNA, 64 nt, Human
cauucaaggcuuaucucugcccccauugauuuuuaaccucaaaaugguguugagauuuacgugg

SEQ ID NO: 303036 - RNA, 64 nt, Human
uguuuuuuuaacgucagccagauauuuagaaaauaaccucaaaaguguuuauauggucagugag

SEQ ID NO: 303037 - RNA, 64 nt, Human
uucccacuggaaaguaaacaaaaccaucccucccaaccucaaagcuaggccacacucuauuuca

SEQ ID NO: 303038 - RNA, 64 nt, Human
ccaaaauaaacguguccccauuuuaccagaaccaaaccucaacacagcgaagcuguacugucuu

SEQ ID NO: 303039 - RNA, 64 nt, Human
aaauuuagugcaagcuuuaacagacuaaguugcuaaccucaauuuauguuaacagaugauccau

SEQ ID NO: 303040 - RNA, 64 nt, Human
cauuuucagaccacaguugaccacagguaacggaaaccucaaucacagaaaguaaagccgugga

SEQ ID NO: 303041 - RNA, 64 nt, Human
cuugcugccuacccuuuucucuccucugguucucaaccucaacgaguucaaaucaguuguccuu

SEQ ID NO: 303042 - RNA, 62 nt, Human
aggggcaguauugggggacugugcuagcuuuacccccgcaggacauacacaggagccuuuga

SEQ ID NO: 303043 - RNA, 62 nt, Human
gaaagcgguccucugaaaugguuuccucccaacccccgcauuuaaagggacucaaggugccu

SEQ ID NO: 303044 - RNA, 62 nt, Human
auucaaaaaguacaucuucccccccccccccccccccgcaaaauaauucuguggcagggcaa

SEQ ID NO: 303045 - RNA, 62 nt, Human
uggucuucaagccuggcccagugagagugaggcccccgcacgcaagccucagccacucccag

SEQ ID NO: 303046 - RNA, 64 nt, Human
agagagccgggcugcucgugagaaagagagcuucaaccucaagagggcucaggugugugcaggg

SEQ ID NO: 303047 - RNA, 64 nt, Human
ucccuguuuuauaaacauaaucacaacaguaauaaaccucaaguaguggcuaguguuuaguaua

SEQ ID NO: 303048 - RNA, 64 nt, Human
auugguaagcuauaggagacucaggaucugggccaaccucaaggugggggcuucagaggguggg

SEQ ID NO: 303049 - RNA, 64 nt, Human
ccugggaugcagugaugugaucauagcucacuguaaccucaaacucuggggcucaagcaguucu

SEQ ID NO: 303050 - RNA, 64 nt, Human
uugccaaaauuggauaaaugcccaucuuagcuaaaaccucaaauugcuagaaaauucacaggga

SEQ ID NO: 303051 - RNA, 64 nt, Human
agucgaccuaaagucagugauucaacuggaaggaaaccucaaugcugccuccagagcuuuuugg

SEQ ID NO: 303052 - RNA, 64 nt, Human
uaauuuuugagaccagaauaagccuuuuaagguaaaccucaaaauuaucauuuuaugguaauac

SEQ ID NO: 303053 - RNA, 64 nt, Human
cccugccacacacacagacacguaauaccagaccaaccucaauccccgcaaacuaaagcaaagc

SEQ ID NO: 303054 - RNA, 64 nt, Human
cccaguggggcuggaauguggcccagccggcuggaaccucaagggccccacccaccgagauugc

SEQ ID NO: 303055 - RNA, 64 nt, Human
cucccucuucacugguacucccaaucaaucaaagaaccucaaaauuuaaacugauguggauggg

SEQ ID NO: 303056 - RNA, 64 nt, Human
uucaccaugucucccaggcuggucucaaacuccuaaccucaagugauucgccugccucggccuc

SEQ ID NO: 303057 - RNA, 64 nt, Human
uaguaguagggacugacagaauacacuuaacacaaaccucaagcuuuacugacuucaauuaucu

SEQ ID NO: 303058 - RNA, 64 nt, Human
aaaccccugcucugcuuuuggccuuggauauggaaaccucaaccacuuuguucuccuaccaccu

SEQ ID NO: 303059 - RNA, 62 nt, Human
cgcccugcccgcccccccccccaccaguccugcccccgcauggagcccccgugauuaguagc

SEQ ID NO: 303060 - RNA, 62 nt, Human
gaaagacguuuuugugcugugggcagcacccucccccgcagcgggguagggaagaaaacuau

SEQ ID NO: 303061 - RNA, 62 nt, Human
aaugauggcccauucuacuugcucuggaccugcccccgcauccccugccuccauccuaguaa

SEQ ID NO: 303062 - RNA, 62 nt, Human
agcacaagggcagugccuggacggacccggagcccccgcauaucagcaguucacccaguacu

SEQ ID NO: 303063 - RNA, 64 nt, Human
ggagauaggaagauagggcgugggccugggccuuaaccucaaucuugugucugccucagucuuu

SEQ ID NO: 303064 - RNA, 64 nt, Human
ucagaacucacaagccauugcuccccagcuggggaaccucaaccuccccccugccucgguuggu

SEQ ID NO: 303065 - RNA, 64 nt, Human
gcuuuccuuuagcauuguuccaagucuaaauguuaaccucaagcuacugcaauuuagacaauga

SEQ ID NO: 303066 - RNA, 64 nt, Human
ugggcagcgccuauguuucucuggagauuccugcaaccucaagagacuucccaggcgcucaggc

SEQ ID NO: 303067 - RNA, 64 nt, Human
ccauauagacauggacauaucauuuguaccuggaaaccucaaaauuaugcuuuugguucuuacu

SEQ ID NO: 303068 - RNA, 64 nt, Human
aagaccguuuaucauuuuuuauuuaaaaaaaucaaaccucaaaaaagucauuuucagagaacac

SEQ ID NO: 303069 - RNA, 64 nt, Human
gauugaauuaccauuuagaauguccuucuccuccaaccucaaccacuauggcaugacccaugua

SEQ ID NO: 303070 - RNA, 64 nt, Human
acuugaaauuguuuuacaauaaucagaacauccaaaccucaaggcucaggaucccauagaccag

SEQ ID NO: 303071 - RNA, 64 nt, Human
acugugagaacucugaggacaaagcagcggauacaaccucaaaagacgucugucuacauugaau

SEQ ID NO: 303072 - RNA, 64 nt, Human
gggcaggccugcaggguguggggaaggaggacacaaccucaagaaaggaagcgugaaccccagg

SEQ ID NO: 303073 - RNA, 64 nt, Human
gaucccgcauggguucgaggugaggccgcuucagaaccucaaaugaaagacugucuccucgugg

SEQ ID NO: 303074 - RNA, 64 nt, Human
uaaaguacaauagugaaauauuugaguuguucggaaccucaauuaauccuguuuuacauuucag

SEQ ID NO: 303075 - RNA, 64 nt, Human
auggaaacuccucccucauucagaugaaccuuaaaaccucaaaccuaguaauuuuuuguugauc

SEQ ID NO: 303076 - RNA, 62 nt, Human
cuaacugaggagcuaguguuaauccagagaaccccccgcaaugugcuuccgagauucagacu

SEQ ID NO: 303077 - RNA, 62 nt, Human
ggaccagccaugcacccgcccagccaccacgucccccgcaugaauguacuguacacuuucaa

SEQ ID NO: 303078 - RNA, 62 nt, Human
gcccugcugcgaaaguucuuggugguggaugacccccgcaaguuugcacucuuugagcgcgc

SEQ ID NO: 303079 - RNA, 62 nt, Human
ccaggcggggaaccugcuuccugccuucacugcccccgcagcacucacagacaucucccugg

SEQ ID NO: 303080 - RNA, 64 nt, Human
uacacuagacauauguccuaaugugcugcccagaaaccucaacuguuccccagcuacugagggg

SEQ ID NO: 303081 - RNA, 64 nt, Human
gugcuucccagcccagaacagggguggauuccccaaccucaaccuccuuucuucucugcuccca

SEQ ID NO: 303082 - RNA, 64 nt, Human
gaccaugacgagcucuagcuggaugggcgcagagaaccucaagaaggcaugaagccagccccug

SEQ ID NO: 303083 - RNA, 64 nt, Human
cauauacauagauggaaaaacccaguauuauaaaaaccucaauucugaaaaucuauagacugaa

SEQ ID NO: 303084 - RNA, 64 nt, Human
cccauccccacccucaaccccaagcucaacccauaaccucaaccacaucuuauccuccacccca

SEQ ID NO: 303085 - RNA, 64 nt, Human
uugggagccugggccccaugguagaugcaagggaaaccucaaggccagcucaaugccugguauc

SEQ ID NO: 303086 - RNA, 64 nt, Human
uuacgauguuuuuaaaagacaaaaaaaaaaaaaaaaccucaaaaguuuuuuuaaagugggggaa

SEQ ID NO: 303087 - RNA, 64 nt, Human
gaccgaccuacgccacuggaaacacacccaccgcaaccucaagaaccagacugugcagagggca

SEQ ID NO: 303088 - RNA, 64 nt, Human
uucaccaugauggccaggcugaucucgaacuccuaaccucaagugauccucccaccucagccuc

SEQ ID NO: 303089 - RNA, 64 nt, Human
agcaaagcugggagaaccgaggacucaccccaggaaccucaacuuccccuaaguuuguaaaaau

SEQ ID NO: 303090 - RNA, 64 nt, Human
cuacuaguuccuccaauuccaucuucucccauggaaccucaaagagcaagacccacucuguucc

SEQ ID NO: 303091 - RNA, 64 nt, Human
gaggguaacaacagagugucagauaugucaucucaaccucaaacuuuuacguaacaucucaggg

SEQ ID NO: 303092 - RNA, 64 nt, Human
uuuaaaaagcuacauaugccccucccaaaccgggaaccucaagaucuccacccuaaaauaguuc

SEQ ID NO: 303093 - RNA, 62 nt, Human
gguuucuagaguuguuuucuuccucccccccccccccgcaccauugguuguguaucacuuuc

SEQ ID NO: 303094 - RNA, 62 nt, Human
gcacuucagaaaauacacaacagccccuucugcccccgcacagaaaugcugcagaguauaua

SEQ ID NO: 303095 - RNA, 64 nt, Human
cugcggauaccgcccggcaaugggaccugcucuuaaccucaaaccuaggaccgucuugcuuugu

SEQ ID NO: 303096 - RNA, 64 nt, Human
cuucucugaguguuuagggaaauagcuucuuuaaaaccucaaaaccaugaccauccugucaaag

SEQ ID NO: 303097 - RNA, 64 nt, Human
gguugcacucaucaggcuaauugaucccauauuuaaccucaaggagaaauaucaaccagacacu

SEQ ID NO: 303098 - RNA, 64 nt, Human
ugaguuuuguucacaauuagguuccuaggagcaaaaccucaaggauugauuuauuguuuucaac

SEQ ID NO: 303099 - RNA, 64 nt, Human
uccuuacuagccugaggguaaaagauuaagcuccaaccucaagucauuuaccuggucuugguaa

SEQ ID NO: 303100 - RNA, 64 nt, Human
cucguauguguguuuaccuaaacuauaugccauaaaccucaaguuauucauuuuauuuuguuuu

SEQ ID NO: 303101 - RNA, 64 nt, Human
cuaaauauaaaaguccacacuucguuugugcuauaaccucaaacuuugauuucuaaugucacac

SEQ ID NO: 303102 - RNA, 64 nt, Human
ccucaggcaggagggcacugaccacaccccacacaaccucaaagggucagugcgucagugccuu

SEQ ID NO: 303103 - RNA, 64 nt, Human
aacuugaugucagcaacucauggacuugacagcaaaccucaaucuccucuggucugccccuuuu

SEQ ID NO: 303104 - RNA, 64 nt, Human
guuucuuguuaagugcuuuuaaacuggagaggcuaaccucaaaauauuuuuuuuaacugcauuc

SEQ ID NO: 303105 - RNA, 64 nt, Human
cuugcuauguugccuaggcugaucuugaacuccuaaccucaagcaauccucccaccucggccuu

SEQ ID NO: 303106 - RNA, 64 nt, Human
uucugaaauacacuaagagcagccacaaaacuguaaccucaaggaaaccauaaagcuuggagug

SEQ ID NO: 303107 - RNA, 64 nt, Human
uccaguacacagucugauaaggacuuaacguccuaaccucaauuguauuaaauagcauugggga

SEQ ID NO: 303108 - RNA, 62 nt, Human
uauuaauacaugccuuuuccucccauccaccucccccgcacacacacaaagaugaccuggga

SEQ ID NO: 303109 - RNA, 62 nt, Human
uugcccuacaggcccacagggccaccagcacacccccgcacgcugggcaccaacagagccac

SEQ ID NO: 303110 - RNA, 62 nt, Human
aggcuguacugccaggcugcgaugcgugcuggcccccgcacaggcuccugugugcagggacu

SEQ ID NO: 303111 - RNA, 62 nt, Human
ucucagcugugguacugcccuguaagaaccugcccccgcaaaacucuggagucccugggaca

SEQ ID NO: 303112 - RNA, 64 nt, Human
cccagacuugauguuuugggauuguccuuauuuuaaccucaaggucucgcaugguggggccccu

SEQ ID NO: 303113 - RNA, 64 nt, Human
aacucucgaggaguuuccucaccaauaaacagacaaccucaacugccagugcccugcagccucg

SEQ ID NO: 303114 - RNA, 64 nt, Human
aucacauucgugauuuaccauuuaauuaacugguaaccucaaaauucguggccugucuucccau

SEQ ID NO: 303115 - RNA, 64 nt, Human
gggaggugggcaucaggccccagccuuggccugaaaccucaagggccucugaggaccagcaagu

SEQ ID NO: 303116 - RNA, 64 nt, Human
auauggaccggaaaggguuaauuuaaagggggggaaccucaaaaguuuuuuuaaaaaagaaacu

SEQ ID NO: 303117 - RNA, 64 nt, Human
ggacauuguaaucauaaaauaacaguaaauuccaaaccucaaaaacuauuauggccugagcaca

SEQ ID NO: 303118 - RNA, 64 nt, Human
uuuaaauguccaccaauaugauuucugagugguaaaccucaaauaugaauuuuaaacuggugaa

SEQ ID NO: 303119 - RNA, 64 nt, Human
uguaaggauuuaaacuugcugaauguaaagauugaaccucaagucacuguagcuuuaguaauug

SEQ ID NO: 303120 - RNA, 64 nt, Human
uaccauguuaaaggaggaaagagcuagaaaaaaaaaccucaaaaaaguuaaucauugguagaug

SEQ ID NO: 303121 - RNA, 64 nt, Human
acugauuuuuacaaaucuuacaguccaaggcauuaaccucaaggcccucccagcaccccauucu

SEQ ID NO: 303122 - RNA, 64 nt, Human
gauacauagccgacuguauacagagguucaucucaaccucaacacuauugacuuuuggggcugg

SEQ ID NO: 303123 - RNA, 64 nt, Human
uucucuccuccacucugagcccccugaccuuccaaaccucaauaaacuagccucuucgaguucg

SEQ ID NO: 303124 - RNA, 64 nt, Human
aacucuugaugaaagaacuuuaaaaagaaauguaaaccucaaauuaccucuggaucucuuagcc

SEQ ID NO: 303125 - RNA, 64 nt, Human
ugggggugucccagggacucugucagugccuucagcccaccagcaggagcuuggaguuugggga

SEQ ID NO: 303126 - RNA, 64 nt, Human
acaagaccucuuuucuuuagauggugccaccuaugcccaccacaacagagauuuuacauggaaa

SEQ ID NO: 303127 - RNA, 64 nt, Human
guucccugggaggcugacagggucaagccacccugcccaccacccucccacuuccccuccccuu

SEQ ID NO: 303128 - RNA, 57 nt, Human
caacuugugucguccaguaaagaagauaaccucaaucauggccauaccgagcagguu

SEQ ID NO: 303129 - RNA, 64 nt, Human
caaagggaugcuuuauacacauaauacugaauuuaaccucaagaggcaaaucuguuuuguaccc

SEQ ID NO: 303130 - RNA, 64 nt, Human
aagaaaagcagacgcagcagcugggaccccucccaaccucaaugcccugccauuaaauccgcaa

SEQ ID NO: 303131 - RNA, 64 nt, Human
agacccuguuccaaaaaaaaaaaaaaacccaaaaaaccucaauggcuuuuugcuuuugaaggug

SEQ ID NO: 303132 - RNA, 64 nt, Human; identical to SEQ ID NO: 52329

SEQ ID NO: 303133 - RNA, 64 nt, Human; identical to SEQ ID NO: 52330

SEQ ID NO: 303134 - RNA, 64 nt, Human; identical to SEQ ID NO: 52331

SEQ ID NO: 303135 - RNA, 64 nt, Human; identical to SEQ ID NO: 52332

SEQ ID NO: 303136 - RNA, 64 nt, Human; identical to SEQ ID NO: 52333

SEQ ID NO: 303137 - RNA, 64 nt, Human; identical to SEQ ID NO: 52334

SEQ ID NO: 303138 - RNA, 64 nt, Human; identical to SEQ ID NO: 52335

SEQ ID NO: 303139 - RNA, 64 nt, Human; identical to SEQ ID NO: 52336

SEQ ID NO: 303140 - RNA, 64 nt, Human; identical to SEQ ID NO: 52337

SEQ ID NO: 303141 - RNA, 64 nt, Human; identical to SEQ ID NO: 52338

SEQ ID NO: 303142 - RNA, 64 nt, Human; identical to SEQ ID NO: 52339

SEQ ID NO: 303143 - RNA, 64 nt, Human; identical to SEQ ID NO: 52340

SEQ ID NO: 303144 - RNA, 64 nt, Human; identical to SEQ ID NO: 52341

SEQ ID NO: 303145 - RNA, 62 nt, Human
gcccaguagagcaaggcagacagugaccuccacccccgcagcccucuuaaaaggccaguacu

SEQ ID NO: 303146 - RNA, 62 nt, Human
aagggggcuaguccccuucuuuuggcccuccgcccccgcaggcuucugugugcugcuaacug

SEQ ID NO: 303147 - RNA, 62 nt, Human
gccacagagauagagcugaggaguccuguguucccccgcaaggagcaccccgggaucauuuu

SEQ ID NO: 303148 - RNA, 62 nt, Human
uaccuuggcucuuccuuuuuuucuccugcuuccccccgcaccuuguggggaagcuucagggg

SEQ ID NO: 303149 - RNA, 62 nt, Human
gccgagugacagccagcccuggaaccccccgacccccgcagcugcugcagccagugugccag

SEQ ID NO: 303150 - RNA, 64 nt, Human
auuauuacaguuccacaucaaggccgagugcaccgcccaccacugccacggccuuugaccaucu

SEQ ID NO: 303151 - RNA, 64 nt, Human
ugccucagccucccgaguagcugggaccacaggggcccaccaccgcgcccggcuaauuuuuugu

SEQ ID NO: 303152 - RNA, 61 nt, Human
cagggacagaaaggggauaguggaguuaugggcccaccaggcaagccugggccuucugguc

SEQ ID NO: 303153 - RNA, 64 nt, Human
agcuguuccuggacugacugcuggcuggcgaggaggcugcgagcguggaaucggaagcgaccgc

SEQ ID NO: 303154 - RNA, 64 nt, Human
cugcagggaguaccgaccuaucccaguugugugaggcugcgagagaaagggagugcaugugcgc

SEQ ID NO: 303155 - RNA, 64 nt, Human
auugccagcugcagagcauauuguggauuggaaaggcugcgacagccccccaaacaggaaagac

SEQ ID NO: 303156 - RNA, 64 nt, Human
cgggcguccccgaagugagggccaggcccuucccggcugcgaggacgcccagagaccgcgggcg

SEQ ID NO: 303157 - RNA, 64 nt, Human
gagcauucuucccucuaccgcuuaagccacugauggcugcgagcuugaagagagggauucugag

SEQ ID NO: 303158 - RNA, 64 nt, Human
aaaagaggaaagaauaaucauuucuagauacugaggcugcgaacuaguucuguggcaguggacu

SEQ ID NO: 303159 - RNA, 64 nt, Human
cuccccuuggcugccuguacgcccacagccuucuggcugcgacauuauagaaucggccgugucc

SEQ ID NO: 303160 - RNA, 64 nt, Human
ccaccucugccuccaagccccagaugguucuggaggcugcgagagcagcuggcacugucagccc

SEQ ID NO: 303161 - RNA, 64 nt, Human
agacgguuucuccuuugcacccaggaggaacuuuggcugcgagaauggggggauguaucccuca

SEQ ID NO: 303162 - RNA, 64 nt, Human
aggcccacagauggacugagugcugggaaggggcggcugcgagggguaucaaccccccgagucu

SEQ ID NO: 303163 - RNA, 63 nt, Human
ucgacucggugggcaagugauggcccgguuuggggcugcgaaaacguugaccccuuuccccca

SEQ ID NO: 303164 - RNA, 64 nt, Human
ucccggcccgcugccgccacccaccucuccugcaggcugcgaccugcaguggcccgucucaggc

SEQ ID NO: 303165 - RNA, 64 nt, Human
gacugaacgguuagugaagacaaaugucuuaagaggcugcgaugucuagguugggcuugugacu

SEQ ID NO: 303166 - RNA, 64 nt, Human
aaaaccaacguuuccacccacagacccuuucucuggcugcgaugcuguuugaacucuuuuucac

SEQ ID NO: 303167 - RNA, 64 nt, Human
ucucuuaccuucugaggacagaaacagcugacaagaguaccauuuggggucucaguucacucuu

SEQ ID NO: 303168 - RNA, 64 nt, Human
uaugggaauuuaguucauucauccagcaaacauugaguaccaauuauuugcuagguccugugca

SEQ ID NO: 303169 - RNA, 61 nt, Human
aaacagauccuaagccauagacaggcuaauugcccaccacucccaggaauauugaaauagc

SEQ ID NO: 303170 - RNA, 64 nt, Human
cauaccaaucucuacgggaaagagagguaggagaggcugcgaggaagcuuggguucaagcguca

SEQ ID NO: 303171 - RNA, 64 nt, Human
gugcuucccgaguguccacugcguuccugggaagggcugcgaggccugcccuccaaaccugacu

SEQ ID NO: 303172 - RNA, 64 nt, Human
cacagcaaucgagaugagacgccaugcagaucccggcugcgagagagggagacacccggaggag

SEQ ID NO: 303173 - RNA, 64 nt, Human
uccagguggccaggccucugccggcggcuccaguggcugcgauuaucggguucgguaaaugccc

SEQ ID NO: 303174 - RNA, 64 nt, Human
ccacuaugacagaggauuguggucacaacuugauggcugcgaagaccuacccuccguuuuucua

SEQ ID NO: 303175 - RNA, 64 nt, Human
ccauaggugcaguuugcuucuacaugaugcuaaaggcugcgaaugggauccugauggaacuaag

SEQ ID NO: 303176 - RNA, 64 nt, Human
gacaaguagaaagauuugaaacaguuggcauggaggcugcgacugaugaaggcaugccuaaaag

SEQ ID NO: 303177 - RNA, 64 nt, Human
ccggaggcauggaaaagcacaggcuguacugccaggcugcgaugcgugcuggcccccgcacagg

SEQ ID NO: 303178 - RNA, 64 nt, Human
cacaccauccauccuggaggcacaaggccuggcuggcugcgagcucaggaggccgccugaggac

SEQ ID NO: 303179 - RNA, 64 nt, Human
uuuccuccucugacuuggggaccuuuugggggagggcugcgacgcuugcucuguuuguggggug

SEQ ID NO: 303180 - RNA, 64 nt, Human
auuuucagaagacaaaagaaccaagaugccaacuggcugcgaaugcucuaucuccagucugucu

SEQ ID NO: 303181 - RNA, 64 nt, Human
gauccuuccaucuucuugaagucgccuuuaggguggcugcgagguagaggguuggggguuggug

SEQ ID NO: 303182 - RNA, 64 nt, Human
ccuuggcuucccucccagucccagcccugcuuccggcugcgaaugucccugagucaacaccaau

SEQ ID NO: 303183 - RNA, 64 nt, Human
cagcagcuggggccaaagagguguuagguucaaaggcugcgaagagaauaggcuacuggaaaac

SEQ ID NO: 303184 - RNA, 64 nt, Human
aagucccagccacccaagcauacuuaccaguacugcccaccaccacccacugcccaccucuaag

SEQ ID NO: 303185 - RNA, 64 nt, Human
agcaucacaggauguuccagugucccuggucucugcccaccagaugccagcacucccaccauuc

SEQ ID NO: 303186 - RNA, 64 nt, Human
cuaauugucaacuuuauuaaggauuacuuugucugcccaccaccuaguguaaaauaaaaucaag

SEQ ID NO: 303187 - RNA, 64 nt, Human
aggggcagaggcugggacacaaggggcuggcgagggcugcgaggccagggaagcccugaguuuc

SEQ ID NO: 303188 - RNA, 64 nt, Human
cugggagagaaggagaucagggcaacucggagagggcugcgagcauuucccucccgggagagga

SEQ ID NO: 303189 - RNA, 64 nt, Human
agaguagucuccauggugggccugucccagcccuggcugcgaggacagguugucuuucucuccc

SEQ ID NO: 303190 - RNA, 64 nt, Human
acugaggccggcugugcauccccgcuggugccucggcugcgacguguccaggcguggagaguuu

SEQ ID NO: 303191 - RNA, 64 nt, Human
cuugugauacacagccccagccacccugcacgggggcugcgagcaccagcaacuuugauuuaua

SEQ ID NO: 303192 - RNA, 64 nt, Human
aggcccugccuccagugucagggaauggaggcugggcugcgagaguguugcugcccccuguguc

SEQ ID NO: 303193 - RNA, 64 nt, Human
cgcgccggacgcgccgucucccgggacaagcgcaggcugcgauccgaggggcugacacacacuc

SEQ ID NO: 303194 - RNA, 64 nt, Human
aaaaggaauagucauuaaggauaccuguuaccauggcugcgauuguuagcacuucaucuacaca

SEQ ID NO: 303195 - RNA, 64 nt, Human
ccacuccaccugggcgccugcccucaggagccugggcugcgaggcuccauaggagggcuggugg

SEQ ID NO: 303196 - RNA, 64 nt, Human
gugaccgcauaugugagaggcagagagggcgaguggcugcgagagagaaugagccucccgccag

SEQ ID NO: 303197 - RNA, 64 nt, Human
uuuuuuaauaaacauaauugcaauauuuuaggugggcugcgagcugcagucagccuucacgucu

SEQ ID NO: 303198 - RNA, 64 nt, Human
agugcccgccccguggagauaccgccccagcgggggcugcgacauccauggccaccauggggca

SEQ ID NO: 303199 - RNA, 64 nt, Human
cgccagagcaccugaagaagcaggccgugagcgaggcugcgagugcccugggcgccguuucuca

SEQ ID NO: 303200 - RNA, 64 nt, Human
uaagcaugaccaauuaaugucacucuagugcuuaggcugcgauccuaugguagcaauucugugc

SEQ ID NO: 303201 - RNA, 64 nt, Human
ugcaucagccucccgaguagcuggcauuacaggcgcccaccaccacgcucggcuaaauuuuuuu

SEQ ID NO: 303202 - RNA, 64 nt, Human
aauggaaugaugacuuugaaaaccacuggcuuacgcccaccauuuccgagguccuguccacggc

SEQ ID NO: 303203 - RNA, 64 nt, Human
agguugggcuggcuggacugagcccaggccuguugcccaccaagucuccauagguucuagucug

SEQ ID NO: 303204 - RNA, 64 nt, Human
cugguccacaaacccuucccuauagaaguucaauggcugcgaaagaauuuguaguaaaccaggc

SEQ ID NO: 303205 - RNA, 64 nt, Human
ccaauaagaaugaagaauggaaauggaaaaggguggcugcgacucaagaauaauaugggagccc

SEQ ID NO: 303206 - RNA, 64 nt, Human
caaagguugagagaacauuuaguucguuuugaaaggcugcgacgagcaauggaacuucgaaggu

SEQ ID NO: 303207 - RNA, 64 nt, Human
gucacccuuguggggccuggacaugacgcacgcuggcugcgacuaggagcagggcugccucuuc

SEQ ID NO: 303208 - RNA, 56 nt, Human
uuccucucucagcagguuagcgcaauggcugcgauuugcgaaagaaucuuggaaau

SEQ ID NO: 303209 - RNA, 64 nt, Human
ccugaggcacggacucguagcaccaggguuuggaggcugcgaccgccccggagagcagcuucac

SEQ ID NO: 303210 - RNA, 64 nt, Human
gaagcggcugcccugagccccaggucuugugggaggcugcgaggacgagagccuggcuggagcc

SEQ ID NO: 303211 - RNA, 64 nt, Human
gaucuuuguuucugcccuuaccccucaguaguggggcugcgagguaguagacaggaugcccagu

SEQ ID NO: 303212 - RNA, 64 nt, Human
cgcauguguguaucacccucagcuggcggaaccuggcugcgaacugugcaguuacguugcaucc

SEQ ID NO: 303213 - RNA, 64 nt, Human
gcugugacgcuggccaccuuuucucagcuucugaggcugcgaugccucaggaacuccaguuuac

SEQ ID NO: 303214 - RNA, 50 nt, Human
gucucuccugggacaacuagggcugcgaaucuagaggagggggcaggcug

SEQ ID NO: 303215 - RNA, 64 nt, Human
aaaaguuuauaauuuuaugaaaauuaaguacagaggcugcgaucuuagaaauaaugaaggugcc

SEQ ID NO: 303216 - RNA, 64 nt, Human
aggacgagcaaggacgggacggaaaagcacgucuggcugcgagggcacacagggccggggagga

SEQ ID NO: 303217 - RNA, 64 nt, Human
ucacuggauacagcuggauacuggggaggacgugggcugcgaggagaagcuguacuuuggcuug

SEQ ID NO: 303218 - RNA, 64 nt, Human
gagcaaucuuugcuaaggaguaagugaaugugaagaguaccaacuacaacaauucuacagauaa

SEQ ID NO: 303219 - RNA, 64 nt, Human
ccccaugugcuuuuuuguugguuuaguguaaacugaguaccacuuuauauuuucucuuccauag

SEQ ID NO: 303220 - RNA, 64 nt, Human
agcuaacuacucccuauggagguuuaugcaagcagaguaccagggguuccaucauaucaaccug

SEQ ID NO: 303221 - RNA, 64 nt, Human
gacguaggaggguugcuugagacugagaguuggaggcugcgaugagccaugaaugccccacugc

SEQ ID NO: 303222 - RNA, 64 nt, Human
uuuacccucuguaugaaugaagagaacgcuggaaggcugcgagaggacucuaguaugagucucc

SEQ ID NO: 303223 - RNA, 64 nt, Human
uucugacagucgguguuuccugggccuuuggaguggcugcgaggccugaacgccuuguggaucc

SEQ ID NO: 303224 - RNA, 64 nt, Human
cugcaggaucaugcagcuggggcgcggcggccgcggcugcgacaccccaaccccagcccucuaa

SEQ ID NO: 303225 - RNA, 64 nt, Human
cugggguccccacucccuguccauccccaguuggggcugcgaccgccagauucucccuuaagga

SEQ ID NO: 303226 - RNA, 64 nt, Human
ccaaccuaacuggcuuacuuccuagucuacuugaggcugcgaucacacugaggaacucacaauu

SEQ ID NO: 303227 - RNA, 64 nt, Human
uccaguugaaccccuuuuucuguguggccccuggggcugcgagaccaaaauccaugaguucugu

SEQ ID NO: 303228 - RNA, 64 nt, Human
cccccagugccagaucgugguacagaagaaggacggcugcgacuggauccgcugcaccgucugc

SEQ ID NO: 303229 - RNA, 64 nt, Human
aaucccaagacugcuuccgccucagaggcgucccggcugcgauucgcugcccuguugucaguga

SEQ ID NO: 303230 - RNA, 64 nt, Human
uaucaauauuggauggcgaggacagcguggcacuggcugcgaguguuccugagaguugaaagug

SEQ ID NO: 303231 - RNA, 64 nt, Human
cuuuggcuguaucagccgaaccaggagaggccugggcugcgacuaaggagaaagaaaucggggg

SEQ ID NO: 303232 - RNA, 64 nt, Human
ucugugauuugcaacaggucuuccacuggcucgaggcugcgaggcugaccgacaggggcgccca

SEQ ID NO: 303233 - RNA, 64 nt, Human
uuacuccacagggagccucccuugccaggaccagggcugcgacggccaugcuggggcaggugag

SEQ ID NO: 303234 - RNA, 64 nt, Human
auauuaccuucuccaggaacccuccaguggggaaggcugcgauauuagauuuccuuguaugcaa

SEQ ID NO: 303235 - RNA, 64 nt, Human
acaggagcuagcugccugggaggaauuguuaacugaguaccaggguaccuuuaaagaagacccu

SEQ ID NO: 303236 - RNA, 64 nt, Human
caacuaucaguucugcugaggaguugacgacagggaguaccacucuccccucccacaaacuuca

SEQ ID NO: 303237 - RNA, 64 nt, Human
agggcgcaccagagaacccagccagagggguugugaguaccagugguguugcuuccacccugca

SEQ ID NO: 303238 - RNA, 64 nt, Human
uagguauagggaagggcauucguugggaaauugaugaccggaaacuagaaagccccuauaaugu

SEQ ID NO: 303239 - RNA, 64 nt, Human
auucuuuuuggaaacacaagcauuucuuuaaggaugaccggauguugccguauguauuuauggc

SEQ ID NO: 303240 - RNA, 64 nt, Human
gccuucgcuucuugccucugugcugugugugacgugaccggacuuuucugcaaacaccaacaug

SEQ ID NO: 303241 - RNA, 64 nt, Human
gcaggggagagacccagcggcacugaucgccuugugaccggaagagugaccuguuaaaagccac

SEQ ID NO: 303242 - RNA, 64 nt, Human
augcacaaagaccaugaagacuuauccaagugcaugaccggauuuuugugguuuuguucauuuu

SEQ ID NO: 303243 - RNA, 50 nt, Human
uugagcucuuuggccccugaugaccggaacacagcugaggacccuugucc

SEQ ID NO: 303244 - RNA, 64 nt, Human
ggcccuguuccccaccaggcugcuauuuugauggugaccggagcuggcgggcagcggguacgcg

SEQ ID NO: 303245 - RNA, 64 nt, Human
cuagagcggugccggcagcaagcaggccuccuggugaccggagagaaagaggagcccucccgcu

SEQ ID NO: 303246 - RNA, 64 nt, Human
auuacgaccacuggaagccagcacccaaggaagaugaccggagaacaucugccaucaaggcccu

SEQ ID NO: 303247 - RNA, 64 nt, Human
agccagaacagguggcugagcuguggggccggggugaccggaucgaaucucucagcgaccaggu

SEQ ID NO: 303248 - RNA, 64 nt, Human
ccucugcccuggccacguucacagauccuucucuugaccggaaacccugggacccuaagaaccc

SEQ ID NO: 303249 - RNA, 64 nt, Human
auacacuuaaacuugcacauuugaauucauuugcugaccggaauggucaaaucucuccaccucu

SEQ ID NO: 303250 - RNA, 63 nt, Human
aagagaugcagaaugcauaagaugaacauugcaugaccggaucauuuuagugucuuugcguua

SEQ ID NO: 303251 - RNA, 64 nt, Human
ggcaaaaucaaaugauuucugucucuauuuucuugaguaccaauuguaaaaacugaaauuaggu

SEQ ID NO: 303252 - RNA, 64 nt, Human
acaacuuaaaccugagcuuucuauugaaucauuugaguaccaagauaaacuuacaccacauacu

SEQ ID NO: 303253 - RNA, 64 nt, Human
cuaguuucucuauucuaccaucaaagaagcuuuugaguaccaccuguuaaugagcuuuccuauu

SEQ ID NO: 303254 - RNA, 64 nt, Human
cugcuucuguggcucuucacagaccucacggaugugaccggagaugagugccgaugaccacguu

SEQ ID NO: 303255 - RNA, 64 nt, Human
guggcauuuucggcacuuuucauuacuuucugcuugaccggaaguugaggcuuagcuauguuuc

SEQ ID NO: 303256 - RNA, 64 nt, Human
ucugccagcggacgcggacccugacaccuacagcugaccggacugguggccucagcccgccugg

SEQ ID NO: 303257 - RNA, 64 nt, Human
ugccugugaaguggauggcacccgaggcauuauuugaccggaucuacacccaccagagugaugu

SEQ ID NO: 303258 - RNA, 64 nt, Human
gucauuucauuccuucagucaucuucuguguaggugaccggagcacugagaggcagcucugaug

SEQ ID NO: 303259 - RNA, 64 nt, Human
aguuaaaaucggggcuggaggugcagacggugucugaccggaggauguggccgugcccgccgag

SEQ ID NO: 303260 - RNA, 64 nt, Human
ucacuccguggauagagaggcacacugucagaggugaccggagaacugaguugcaaaauauauu

SEQ ID NO: 303261 - RNA, 64 nt, Human
aaaaaaaguuuuuuucauucaaagaauugguaauugaccggaggaaggcaugccucaauaaaug

SEQ ID NO: 303262 - RNA, 64 nt, Human
acucccuggagcccaagcagcuccccuaggggacugaccggaccugaccuccccucccuguguc

SEQ ID NO: 303263 - RNA, 64 nt, Human
agaggguuguuuugguuucggacgacccuugcucugaccggaagagaagucccuaucccacacc

SEQ ID NO: 303264 - RNA, 64 nt, Human
caguggcuucugcacauaaugccucugucaaaugugaccggaugcgcucccagaagcuccgccg

SEQ ID NO: 303265 - RNA, 64 nt, Human
agugacgcuguggugugagguguucugagcucacugaccggaagguccaggugaaucucgucau

SEQ ID NO: 303266 - RNA, 64 nt, Human
gcuucaacuauugcccuuucaacaguuuugccacugaccggauagaaacgguuucagucucugg

SEQ ID NO: 303267 - RNA, 64 nt, Human
cucgagucucgagagggccacggggugguuuuuaugaccggaaucccgcuuccucccucacguc

SEQ ID NO: 303268 - RNA, 64 nt, Human
augcagaacaggaccuuggcucuaaauuaaugguugaccggaagggauuggaggcggcagaacc

SEQ ID NO: 303269 - RNA, 64 nt, Human
gaucuccuucauugggauaguuggagagggauuggaguaccacuuuccuuccacuguuaccugg

SEQ ID NO: 303270 - RNA, 64 nt, Human
gacaggacuuucaugacccaauauggaacaauuugaguaccagaauaggagauuauggccuauu

SEQ ID NO: 303271 - RNA, 64 nt, Human
caaucagguagcuuaauggauguaauacauuucugaguaccauuaucuuaucuaguaauguaga

SEQ ID NO: 303272 - RNA, 64 nt, Human
agcaggggcauuggggacugucuugagacccugagggggucaagccccuccuuccccagcugcc

SEQ ID NO: 303273 - RNA, 64 nt, Human
guauaagaaagaaucaaauaucuugcuuuugggucuucuccaaaguaaauugcauggacuucuu

SEQ ID NO: 303274 - RNA, 64 nt, Human
gugugcuuaucuguuacggccuccuuuuaucucucuucuccaauauuaaaaaaaauggaaauca

SEQ ID NO: 303275 - RNA, 64 nt, Human
agaaugauaugugaggccagcagucagaauaucacuucuccauuaacaaaaugguuuggagauc

SEQ ID NO: 303276 - RNA, 64 nt, Human
gaggggcguuuucgaggaagaaccugucccaggucuucuccaaggggcccagcucacguguauu

SEQ ID NO: 303277 - RNA, 64 nt, Human
ggaggaaguucuccagcuucagcucaacucacagcuucuccaagcaucacccugggaguuuccu

SEQ ID NO: 303278 - RNA, 64 nt, Human
cuguguagccuuuucuuugaagacacacucggcucuucuccacagcaagcguccagggcagaug

SEQ ID NO: 303279 - RNA, 64 nt, Human
ggcuagcacacggguguaucgccugggccccaggcuucuccauggccacauggguccugggugu

SEQ ID NO: 303280 - RNA, 64 nt, Human
uggaagcugagcuuucuuuauucaaccucauucccuucuccaaauaagccacuuguguaguugg

SEQ ID NO: 303281 - RNA, 64 nt, Human
aaauaaauguguauauuuaauguuuuauuguuagcuucuccagaaaauugaugcaaauucuggu

SEQ ID NO: 303282 - RNA, 64 nt, Human
gucuuuguaucuuccauauuuggaagaaaaaaaucuucuccagauuuuucggaggccccacuga

SEQ ID NO: 303283 - RNA, 64 nt, Human
cuaaggggaggaagaauuccugccaugccccagccuucuccaggacaaccugcuggaacgcagu

SEQ ID NO: 303284 - RNA, 64 nt, Human
ccuggacuuuugggcaagggugagaaacuagaggcuucuccaguguugccauaucccccuaggu

SEQ ID NO: 303285 - RNA, 64 nt, Human
accagcuauauucauuugccaagaucaacagcuccuucuccaaacaacucaagcccccaauucc

SEQ ID NO: 303286 - RNA, 64 nt, Human
gucuugggcuguaggcuagaaugcccgggcuggugcccaccaggggcuggggagaaggaggggu

SEQ ID NO: 303287 - RNA, 64 nt, Human
acuccucuuugugcagagaccagcccaccccugugcccaccaugacccucuuccucaugcugaa

SEQ ID NO: 303288 - RNA, 64 nt, Human
gaggacuccacuucuggggacgccugguucguucgcccaccaggccuaggcuacgcuccaugcu

SEQ ID NO: 303289 - RNA, 64 nt, Human
ggguaaugauguaggggccaagcagugcccagcugggggucaauaaaguuacccuuguacuugc

SEQ ID NO: 303290 - RNA, 64 nt, Human
auucauguuauuuucaagugaaacaagacauuuugggggucaagucucuuuggguguuuuguuu

SEQ ID NO: 303291 - RNA, 64 nt, Human
guaugggggcaucugggcccagggcagcuggggagggggucagagugacaugggacacuccuuu

SEQ ID NO: 303292 - RNA, 64 nt, Human
aauuucccauuucugcauuaaauaaacagaggaggggggucaagugauacuuagauauuggcac

SEQ ID NO: 303293 - RNA, 64 nt, Human
auuugugcugauuuggucccugugccagggcacagggggucaggcacuguggaaagaagggacu

SEQ ID NO: 303294 - RNA, 55 nt, Human
uucaccaggucacacgauagcucuugggggucacggccuggacaagaaaggcuug

SEQ ID NO: 303295 - RNA, 64 nt, Human
gggauuucagggaguucccucauuuguaaaaugagggggucagagcaggugauauccauguuuc

SEQ ID NO: 303296 - RNA, 64 nt, Human
gucuagcucaucuaguuccucuucuuaaggggaugggggucaggggcuaggggagggggcugag

SEQ ID NO: 303297 - RNA, 64 nt, Human
uccuucuguguaccacuuccugaggccucauuuugggggucaucuuggaaaggggaggagcuuc

SEQ ID NO: 303298 - RNA, 64 nt, Human
acuuguuauuucacucaucucuaauaaaggauuggggggucaguuuccagugguuucauuuaug

SEQ ID NO: 303299 - RNA, 64 nt, Human
uugcccuuccacugccacucacuggggugaggcugggggucagcuuggugaggauuggggcuuc

SEQ ID NO: 303300 - RNA, 64 nt, Human
uuuacucugggaacuuacauccugaaucccaagagggggucacaguuuggaaaaagucaucagg

SEQ ID NO: 303301 - RNA, 64 nt, Human
cuauaucauggacaacaccuuuggggaaaagggugggggucagccuccccaaaaucacauggau

SEQ ID NO: 303302 - RNA, 64 nt, Human
uccacgcucaaucucaggucuucacgcggggggugggggucagaugcacugaaguagccaacag

SEQ ID NO: 303303 - RNA, 64 nt, Human
cuaggauagcgcuccccuuaccccagucacuucugggggucacugggaugccucuugcaggguc

SEQ ID NO: 303304 - RNA, 64 nt, Human
acccauggaggaauucugaagccauugucuccuugaguaccaacagggucagggaagacugggc

SEQ ID NO: 303305 - RNA, 64 nt, Human
caacauccuccacgccuccgccagccucccgcccgaguaccagaaccgcacggaggggcuccug

SEQ ID NO: 303306 - RNA, 64 nt, Human
uuagguuagcagauggagaugagaggacuggguagaguaccauggcagaucucagagagaagaa

SEQ ID NO: 303307 - RNA, 64 nt, Human
cuaccccuugccccuccauucuccuggcccuucugggggucagcuggucucuaugaauaugcug

SEQ ID NO: 303308 - RNA, 64 nt, Human
cgccagcuucuccugcgccccgcccacacccucggggggucacaggcccagaaggguagcuggg

SEQ ID NO: 303309 - RNA, 64 nt, Human
gagagggggcugaggagguagugcuguaggcccagggggucagggaaagggaggggggcaugug

SEQ ID NO: 303310 - RNA, 64 nt, Human
gugaucacuggaacggagugaccacugagaugcugggggucacugggccuggaagaccauccca

SEQ ID NO: 303311 - RNA, 64 nt, Human
uggaggcuuaaaggcugagcugcaggggcuuucagggggucaugucaggagccuggccaggccg

SEQ ID NO: 303312 - RNA, 64 nt, Human
aacucauggaauggaugggcauuugaugaccccugggggucaucuuggcccucugaccuggugc

SEQ ID NO: 303313 - RNA, 64 nt, Human
cgcccggcagccacccaguccgggagggaggugggggggucagucccccguccggccagccgcc

SEQ ID NO: 303314 - RNA, 64 nt, Human
gccccgccagccaccccguccgggagggaggugggggggucagccccccgcccggccagccgcc

SEQ ID NO: 303315 - RNA, 64 nt, Human
gcccggccagccgccccguccaggagggaggugggggggucagccccccgcccggccagccgcc

SEQ ID NO: 303316 - RNA, 64 nt, Human
gcccggccagccgcccgguccgggagggaggugggggggucagccccccgcccggccagccgcc

SEQ ID NO: 303317 - RNA, 64 nt, Human
uuuucuuagccuguuaauuuaaaaauccagacuugggggucauuguguugcuacccaagagaaa

SEQ ID NO: 303318 - RNA, 64 nt, Human
auccacugguccccaggguuucagucaugcuuuugggggucauuggguauuagagaaguaagua

SEQ ID NO: 303319 - RNA, 64 nt, Human
acuaaucagauuuucaauagagugaaguuaaauugggggucauaaaagcauuggauugacauau

SEQ ID NO: 303320 - RNA, 64 nt, Human
uuaauggcugugugacacacguaaggaaaggaaagggggucacgcacaucauguacuggaauga

SEQ ID NO: 303321 - RNA, 64 nt, Human
gacaccaauguccgagggccacccaggacaggacgggggucagccccaagcugagagucugguc

SEQ ID NO: 303322 - RNA, 64 nt, Human
agaaggggagcagaaaggaaacguuguuacugaugaguaccacagacucaucuuaaaaaaaacu

SEQ ID NO: 303323 - RNA, 64 nt, Human
gccuccuagugaaacuuaaccagcuagaccauuugaguaccagcauuuaguuacaaacgucaaa

SEQ ID NO: 303324 - RNA, 64 nt, Human
ggcugaguuuguauuauuacugauaugaagaauagaguaccaaugucauuaauugauuuuucuu

SEQ ID NO: 303325 - RNA, 64 nt, Human
gugggagugacuggcauuaacaagacuggaaaucgggggucaaaguaaaauaucuuuguuuugc

SEQ ID NO: 303326 - RNA, 64 nt, Human
aggacugugagccaggagaucugggcuggagcuagggggucaauggaugcucaggaagagcugg

SEQ ID NO: 303327 - RNA, 64 nt, Human
cugaaaagaaggacggguuggggccgggcacauugggggucaccggccgauggagacaccaacc

SEQ ID NO: 303328 - RNA, 64 nt, Human
auaaccaggguuuuaggcuuuuaaaggccauuuugggggucagcccugccccugaaccuguuca

SEQ ID NO: 303329 - RNA, 64 nt, Human
uagaaagucaccaucaucuguagugauggaggaagggggucacuuauauaaagaugggacacuu

SEQ ID NO: 303330 - RNA, 64 nt, Human
gcacgguggcucacgccuguaauccuagcaccuugggggucaagguggguggaucacuugaggu

SEQ ID NO: 303331 - RNA, 64 nt, Human
cugugaccacuaggcaggcacugcucucugcagagggggucauuccaggcccuccagugugugu

SEQ ID NO: 303332 - RNA, 60 nt, Human
cccgugucggccacugcugagccugagagagggggucacagugauagggccacccuggau

SEQ ID NO: 303333 - RNA, 64 nt, Human
gaggaggcuggauccaagucuugauugccuuucagggggucaaggugguaagcugugcagugaa

SEQ ID NO: 303334 - RNA, 64 nt, Human
ccuaaaggacaccccucgcccccaucuucauggagggggucauuucagagcccucggagccaau

SEQ ID NO: 303335 - RNA, 64 nt, Human
guuaguguaagucuauaggaauauaggggggugggggggucaccuuuugccuugaaaugggaag

SEQ ID NO: 303336 - RNA, 64 nt, Human
auauucauuggcacaugauucugugccuguuucugggggucauucccaugagaagagcagguag

SEQ ID NO: 303337 - RNA, 64 nt, Human
uuugauggacccacgaacgcucuuagcuuucucagggggucagcagaguuauugaaucuuaauu

SEQ ID NO: 303338 - RNA, 64 nt, Human
cuggaccuaacuuugcguguguguguguguaguagggggucauuucuuuuuggguaaugggaaa

SEQ ID NO: 303339 - RNA, 64 nt, Human
ugcagcaugagaagcuggcugcuaagaugucacugggggucacuaaagcugaagccugaaggaa

SEQ ID NO: 303340 - RNA, 64 nt, Human
cuacuaggaugucuuccagccuccugcagucaaggaguaccacuguauugauuagccuguaugu

SEQ ID NO: 303341 - RNA, 64 nt, Human
ucuaaggcaugcacacauaucuccuguucucugagaguaccaugguguuccuuaaaagaagaaa

SEQ ID NO: 303342 - RNA, 64 nt, Human
aauauauuccuucuuuauaaugcuaaaucuauaugaguaccauauuuuuauaagucaguggucu

SEQ ID NO: 303343 - RNA, 64 nt, Human
uagagugcccaggagagggucugaggggugggaugggggucaggacaauuuugcaaaagaagua

SEQ ID NO: 303344 - RNA, 64 nt, Human
ucugagacuguggugaaacuccuuccaaggcugagggggucaguaggugcucuggagggacucg

SEQ ID NO: 303345 - RNA, 61 nt, Human
ccaaugaugcguguacauaaucccagggggagggggucaggugucgaaccagcaggcaagg

SEQ ID NO: 303346 - RNA, 64 nt, Human
gugucuguguagacugggcacagcccuguggccggggggucaggugagugguugggugaugggc

SEQ ID NO: 303347 - RNA, 64 nt, Human
ggcuggagggaaaaggaguggcuccuagaguccugggggucaccccagggcuuuugcugacucu

SEQ ID NO: 303348 - RNA, 64 nt, Human
aguuacaaugaaauauucaaccccugcugugcaggggggucauuuuaauguaacaccacacccc

SEQ ID NO: 303349 - RNA, 64 nt, Human
ugaagcaaggccauauacccuaaacuuccauccugggggucagcugggcuccugggagauucca

SEQ ID NO: 303350 - RNA, 64 nt, Human
ggccggguauucugggcugggcucuucuggaguagggggucagcaaacauugucugcaaagggc

SEQ ID NO: 303351 - RNA, 64 nt, Human
cauccguggaugcuuuccugcagcuaugugguaugggggucauuccugccucuuggcaccaggu

SEQ ID NO: 303352 - RNA, 64 nt, Human
aauggaagaaauaccuuaugaauguaagaauguagggggucauggcuuguaauuuacacagugu

SEQ ID NO: 303353 - RNA, 64 nt, Human
ggguggggucugggagggggugagaggcaggaaugggggucagaagaagugggagcagcuucuu

SEQ ID NO: 303354 - RNA, 64 nt, Human
gagaggugggggagggaaagugggccaguggggagggggucaccuaggggacugccucugugcc

SEQ ID NO: 303355 - RNA, 64 nt, Human
cauaagaugucuucagguggccuuguccaaggaugggggucaggcauuuuauaucaagggugcu

SEQ ID NO: 303356 - RNA, 64 nt, Human
cuauaauguggagguaaaugauuuuauaugcauugggggucauauauaaaacuucaauguaauu

SEQ ID NO: 303357 - RNA, 64 nt, Human
agacccaagggucccuggaacguagggaggggcugggggucaguccagcccgggccucccagaa

SEQ ID NO: 303358 - RNA, 64 nt, Human
cuggacauagagugauuugcagccccuccuuucagaguaccacaucccucucaaguguuccaca

SEQ ID NO: 303359 - RNA, 64 nt, Human
ugcuauucuaugcugaagagccugcuuagaggaggaguaccaggagggagccagcauuucagau

SEQ ID NO: 303360 - RNA, 64 nt, Human
gcuuuauuauaucgcaaaugagugucagauuuuugaguaccaaugaucaugcuuccauuuuuuu

SEQ ID NO: 303361 - RNA, 64 nt, Human
cugggaaauuugccgauuuccuaagcuguuggaagggggucacuuaaggggggaugucuugaga

SEQ ID NO: 303362 - RNA, 64 nt, Human
gaugcacagagaagcuggggaggagcuuuguuuugggggucaggcagccagugagaugagggau

SEQ ID NO: 303363 - RNA, 64 nt, Human
ccugcugaggcagugugguuauguucccagcagugggggucagacgcccuuccucagaacuuuc

SEQ ID NO: 303364 - RNA, 64 nt, Human
aguuuaguggauaaaacuuuaaguccaauaacuugggggucaaaugcuaauguuuuauucaaug

SEQ ID NO: 303365 - RNA, 64 nt, Human
cgcacagggcaagcaggaagaggcgagggcacuugggggucauuauuugagaucguaagucuug

SEQ ID NO: 303366 - RNA, 64 nt, Human
ccggcugagugggggaggggaagcaagaagggaugggggucaagcugcucucucuucccagugc

SEQ ID NO: 303367 - RNA, 64 nt, Human
ggcauuuucaaugugaucaguucuagaccuagaagggggucaggcugcuuuacagaauucuauu

SEQ ID NO: 303368 - RNA, 64 nt, Human
ugaucucccuccuagaggcucagugaggugaucggggggucaguguguuuucagagucccagcu

SEQ ID NO: 303369 - RNA, 64 nt, Human
uaauuaccgugagugacauagccucauguucugugggggucaucagggaggguuaggaaaacca

SEQ ID NO: 303370 - RNA, 64 nt, Human
ggugucuuggagguggucccccagaucugcgccugggggucaggacagggccugauuugagccu

SEQ ID NO: 303371 - RNA, 64 nt, Human
caaaacuguggugguucugaccaccugugacgaggggggucauaauacuuccagugauccuuuu

SEQ ID NO: 303372 - RNA, 64 nt, Human
caggagcacccaguccucagcugcucucuuaggugggggucagagguggggauagagcugcaca

SEQ ID NO: 303373 - RNA, 64 nt, Human
aaguuugauugaacaaugauacacagcugcaccggggggucaccuuuucacaaauguagaccuc

SEQ ID NO: 303374 - RNA, 64 nt, Human
aaacccugacguauguacuagauggcagggcacugggggucaggcugaaggcugagcaacaccu

SEQ ID NO: 303375 - RNA, 64 nt, Human
gucugcuuggcaguggcuuugauaagcgaugcuugggggucagaccacccccuagaggagccac

SEQ ID NO: 303376 - RNA, 64 nt, Human
agugcgggcagaacaacuggucugguuuccacuggaguaccacucugagcucuucaagguaucu

SEQ ID NO: 303377 - RNA, 64 nt, Human
gcucagccccagacacccagcaaucaagccagaugaguaccacaaaacaguguguccccagcag

SEQ ID NO: 303378 - RNA, 64 nt, Human
guaaucuuucugcuguuuguuguccugcuugguugaguaccacaauuaaagauuaugcuccccu

SEQ ID NO: 303379 - RNA, 64 nt, Human
cauuugccaaauguauuaccgaugccucugaaaagggggucacugggucucauagacugauaug

SEQ ID NO: 303380 - RNA, 64 nt, Human
uacugaacuugauucaggcagaggaccauaaccugggggucaggggaaggcaugggggggacca

SEQ ID NO: 303381 - RNA, 64 nt, Human
ugaaaaacuugaaucguucacauuucucagcucugggggucauuuaccaguuuguuguagaaga

SEQ ID NO: 303382 - RNA, 64 nt, Human
uaauuuaagaaugaaacuauaaauccugaugccugggggucaaguauuuuaagauaagaggggg

SEQ ID NO: 303383 - RNA, 64 nt, Human
ccauaaaaccuucauuacacauaaagauacacgugggggucagugaaucugcuugccuuuccug

SEQ ID NO: 303384 - RNA, 64 nt, Human
agcucuuugacaaugucaucuagcccccaggagagggggucaguguuuccuggggggaccaugc

SEQ ID NO: 303385 - RNA, 64 nt, Human
gggagaaaaccucuuagcaaagcccugugaguuugggggucagguucaagaaagaugugggaag

SEQ ID NO: 303386 - RNA, 64 nt, Human
gagcagacagagacaucuuggccugucccugccugggggucauggagaccaugucuucuuagag

SEQ ID NO: 303387 - RNA, 64 nt, Human
ucacucugaguguuuuaugagaaagccuucuuuugggggucaacaguuuuccuaugcuuugaaa

SEQ ID NO: 303388 - RNA, 64 nt, Human
gcccggggguugacccugggcgugccgggggcgagggggucacgguggagacggacacgggcgu

SEQ ID NO: 303389 - RNA, 64 nt, Human
cugcucccugacaaccacagccauuucucugcacgggggucauucauaggacuaauguauuuca

SEQ ID NO: 303390 - RNA, 64 nt, Human
ugcuuugcuggguagugagcucuuauuuuucacugggggucagcuauaacuaaaaacucaagug

SEQ ID NO: 303391 - RNA, 64 nt, Human
caugaccucuugaugucuccauggugaccuccuugggggucacugacccugcuugguggggucc

SEQ ID NO: 303392 - RNA, 64 nt, Human
guaccuucucaccugugagaccaaauugagcuaggggggucagccagcccucuucugacacuaa

SEQ ID NO: 303393 - RNA, 64 nt, Human
uuguagauuuaaaagauuucugguuaagggaggugggggucacuguucaucacucuuaaaauau

SEQ ID NO: 303394 - RNA, 64 nt, Human
cagacccugcuucugauacuaaggacguauccaggaguaccacaaccaccaccagugcuaccac

SEQ ID NO: 303395 - RNA, 64 nt, Human
ccuccagggacuggccaggucuccccccuuuccugaguaccaacuaucauauccccaaagauga

SEQ ID NO: 303396 - RNA, 64 nt, Human
accuuucccucuuuccaagaaggaagguuugacugaguaccaauuugcuucuuguuuacuuuuu

SEQ ID NO: 303397 - RNA, 64 nt, Human
ugggagggcccuguagaccacaucaggguggggugggggucacuuggcaaaaagggccgagguc

SEQ ID NO: 303398 - RNA, 64 nt, Human
aagaucaauucccucucucagcacagccuggggagggggucauuguucuccucguccaucaggg

SEQ ID NO: 303399 - RNA, 64 nt, Human
uaggggagguugugaggccaccaucaccugaccugggggucaaggcaggaggacuccgaaggug

SEQ ID NO: 303400 - RNA, 64 nt, Human
caccuagcugccugcaccugcccuucagggagaugggggucauuaaaggaaacugaacauugaa

SEQ ID NO: 303401 - RNA, 64 nt, Human
ugcccuagggcuuagagcauggaccuccugcccugggggucaucuggggccagggcucucugga

SEQ ID NO: 303402 - RNA, 64 nt, Human
ugccucaguuuccccagggaccccaccccccuuugggggucaggaacacuacacugcacaggaa

SEQ ID NO: 303403 - RNA, 64 nt, Human
uugauuguacagaaaucaugcugccaugcugggggggggucaccccgaccccucaggcccaccu

SEQ ID NO: 303404 - RNA, 64 nt, Human
cagguguccuuugcaucucuuaaauguugggggugggggucagagccaguuauccggcuucugu

SEQ ID NO: 303405 - RNA, 64 nt, Human
gcccagcccaggcaaauuguauuuaaagaauccugggggucauuauggcauuuuacaaacugug

SEQ ID NO: 303406 - RNA, 64 nt, Human
ugccacuggccuccuacccccuacucuggggcuugggggucaacuccccccaggacuuaccuuc

SEQ ID NO: 303407 - RNA, 64 nt, Human
agcagcuuaggcagcucucccagcacgccaugaagggggucauccgugugaaguuugucaauga

SEQ ID NO: 303408 - RNA, 64 nt, Human
ccacucuccucugggcuccuccuugccuaaugcagggggucaccgcuggagaagaaccaccacu

SEQ ID NO: 303409 - RNA, 64 nt, Human
gagacacagcaugggcagugccuucccugccugugggggucaugcugccacuuuuaaugggucc

SEQ ID NO: 303410 - RNA, 64 nt, Human
auaguacaccuuagcgcugagacugagccagcuugggggucagguagguagacccuguuaggga

SEQ ID NO: 303411 - RNA, 64 nt, Human
ugggggugguggugcugcaggggcagggcugggugggggucaccagacuuuuucugcccuuagg

SEQ ID NO: 303412 - RNA, 64 nt, Human
auccacugaggcuucccaggccauuuaaagccuggaguaccagcgcauaucaucucaugggguc

SEQ ID NO: 303413 - RNA, 64 nt, Human
uuuucagguauugaguuuagaugccuacuuuuaugaguaccaucagcuggacacagugucucau

SEQ ID NO: 303414 - RNA, 64 nt, Human
auuauggauauauguugaggucauucagcuuccugaguaccacauuccccagcuacuuagacac

SEQ ID NO: 303415 - RNA, 64 nt, Human
aaaguaucuaccuggaaacagcuuuagggguggugggggucagguggacucugggauguguagc

SEQ ID NO: 303416 - RNA, 64 nt, Human
aauaagauucccauuggcucccuguguucucuuggggggucagggugcuguccccuccccucug

SEQ ID NO: 303417 - RNA, 64 nt, Human
uuuuguguuaugcacuuaauuuuaugacugccgggggggucagcuggagugcugcuuaacaagu

SEQ ID NO: 303418 - RNA, 64 nt, Human
acgugccucuuccuggcccccagcaggcaaggaggggggucacaggccuugcccucgagcaugg

SEQ ID NO: 303419 - RNA, 64 nt, Human
cccuccccgcugccugcaccgccuggagcagcaugggggucagaccccugcuccagggccacuu

SEQ ID NO: 303420 - RNA, 64 nt, Human
agcuggguccugggcugggauucgagcccugggcgggggucagucaagccgugguccagcaaac

SEQ ID NO: 303421 - RNA, 64 nt, Human
augugcacuuuuguuuacugaaagagagaaaggggggggucacagcaacaugcccuggccuuuc

SEQ ID NO: 303422 - RNA, 64 nt, Human
uccaagccaucucagaaagucuaaaagguuggcagggggucagcugaagaccucacuggagugg

SEQ ID NO: 303423 - RNA, 64 nt, Human
ugagaaaagccauuguggagccaacuccagggcugggggucaggaguccuaggcucccauuccu

SEQ ID NO: 303424 - RNA, 64 nt, Human
cacgccaccauuaccucacucagugugaccuggagggggucagacagacgggagaguccagaaa

SEQ ID NO: 303425 - RNA, 64 nt, Human
gggccugcagcagacucaaggcuccgagugcccugggggucaccccuccccuccccuccucaga

SEQ ID NO: 303426 - RNA, 64 nt, Human
ccccacucacucagauguccugaaauuccaccacgggggucacccugggggguuagggaccuau

SEQ ID NO: 303427 - RNA, 64 nt, Human
ccucguuggagaaacccaauagcaggggaagcuggggggucaagcaccaucgcaccaacacucc

SEQ ID NO: 303428 - RNA, 64 nt, Human
augagagcagguguggggacagcaauacccccuugggggucaccucucugcuuccccccucccc

SEQ ID NO: 303429 - RNA, 64 nt, Human
uuuaccugcucaggcccccaucucugggguguuugggggucagggagcagggagcacuggccgu

SEQ ID NO: 303430 - RNA, 64 nt, Human
gauuuuauaugcuauuuauuaaguauuuuauuaggaguaccauaauucugguagcuaaauauau

SEQ ID NO: 303431 - RNA, 64 nt, Human
agugaucugauauuuggaaacaaguauccuuguugaguaccaagugcuacagaaaccauaagau

SEQ ID NO: 303432 - RNA, 64 nt, Human
uguaggacaaccaaccuggaguuuugccucucuagaguaccacccaguaagucuggcugagcau

SEQ ID NO: 303433 - RNA, 64 nt, Human
agccauggcauggcugcacuguaaacgccaaucggggggucaccaggaucaaccgcaggcuuuc

SEQ ID NO: 303434 - RNA, 64 nt, Human
gguggaaagauaaaccuuuugaggugaagagccagggggucaggaaauauggccuaucugccag

SEQ ID NO: 303435 - RNA, 64 nt, Human
gcgcucccgggaggggugcuggguccucaggguggggggucauagccacaggggagggcaguuc

SEQ ID NO: 303436 - RNA, 64 nt, Human
cccgcuagcauguggccaggggugcaggguggcggggggucagcagcaugucccugggcaggcc

SEQ ID NO: 303437 - RNA, 64 nt, Human
gccaccggcuugccuggugguuugcacauuucaggggggucaggagaguuaaggagguuguggg

SEQ ID NO: 303438 - RNA, 64 nt, Human
cgccuuccucauguguuguucuaccugcugggaugggggucagccucucuuuggugacgucacg

SEQ ID NO: 303439 - RNA, 64 nt, Human
cuuuuggggauuauacaccucagccgccugagaugggggucagcucuuuauauaaagggaaacc

SEQ ID NO: 303440 - RNA, 64 nt, Human
uuugggggaagccaggcaacaguggccucugggagggggucaggaagaggcgaacagcucaggc

SEQ ID NO: 303441 - RNA, 64 nt, Human
ggggcagcagacaugcugcuucccaucagccagagggggucagggcugcccuguugccaaacaa

SEQ ID NO: 303442 - RNA, 64 nt, Human
gccggcuccccccuugaauguaccagacccuggggggggucacugggcccuagauuuuuggggg

SEQ ID NO: 303443 - RNA, 64 nt, Human
acccuggggggggucacugggcccuagauuuuuggggggucaccagccacuccaggggcaggga

SEQ ID NO: 303444 - RNA, 64 nt, Human
cugaccccuaggucugguccugccagccugggaugggggucaauguaugcuacacaucuugggc

SEQ ID NO: 303445 - RNA, 64 nt, Human
gcccgggcagcugccccguccgggagggaggugggggggucagccccccgcccggccagccgcc

SEQ ID NO: 303446 - RNA, 64 nt, Human
cuggcagcugagagcccugcugugggagagcgaagggggucaaaggaagacuugaagcacagag

SEQ ID NO: 303447 - RNA, 64 nt, Human
cucuggagccaccugucccaccucaaaugggucugggggucaggaggcaggguuuuaucucugu

SEQ ID NO: 303448 - RNA, 64 nt, Human
gccuagaaucaaaugugacacguaggcuggaacugaguaccauucagaauaggaucugaagaga

SEQ ID NO: 303449 - RNA, 64 nt, Human
uaguugagaaauuauaccucaccaguauauaggagaguaccauuaggaauucuuaaugggauga

SEQ ID NO: 303450 - RNA, 64 nt, Human
caccccaauaccuggucuuccuucccggcuuaaggaguaccauguacuuagccacaggcagaau

SEQ ID NO: 303451 - RNA, 64 nt, Human
ccuucugggacuucagcucagagagcaccaucccgggggucagggccuccccacaggagcccug

SEQ ID NO: 303452 - RNA, 60 nt, Human
ucauccucuucgccaugugaggcuccaugggggggucaccggccuguugcuacugcaacu

SEQ ID NO: 303453 - RNA, 64 nt, Human
cccagcuuucucaccagguucagcaaggaggccugggggucagacaccaauguugagcaccucc

SEQ ID NO: 303454 - RNA, 64 nt, Human
ccucccugucuccccauuuuggauaguuacauuugggggucaucucggugauuuuuguaacuuu

SEQ ID NO: 303455 - RNA, 64 nt, Human
cucuugugagagggguggcuaccagugugugugugggggucaucacugccuuggggaggagugg

SEQ ID NO: 303456 - RNA, 52 nt, Human
aggggggcccaggugcauaaaugggggucagggagggaaaggaggagggaga

SEQ ID NO: 303457 - RNA, 64 nt, Human
gucauguuugaaagagguauugguguucuggagugggggucaaccccuccccagucucugugcu

SEQ ID NO: 303458 - RNA, 64 nt, Human
ugcuuguuggcuuccgugugucaucaggguuggugggggucagucacuugaaaucuuugcagca

SEQ ID NO: 303459 - RNA, 64 nt, Human
ggauuggaugggaaaccuucuggaagaggcagaugggggucaaaccacugccuuggccccagga

SEQ ID NO: 303460 - RNA, 64 nt, Human
gaucacuugagcccgggagguugaggcugcaguggggggucauaaucaugccacuguacuccag

SEQ ID NO: 303461 - RNA, 64 nt, Human
gagaccucgcucucuguuccagcaacccugguuggggggucagacuugauacacuuucagguug

SEQ ID NO: 303462 - RNA, 64 nt, Human
cauggcucuugcaacaucuccccuucguuuuugagggggucaugccgggggagccaccagcccc

SEQ ID NO: 303463 - RNA, 64 nt, Human
ucucacgcagaguucugccaggagggugugcugugggggucagacuccugaggcucucccuucc

SEQ ID NO: 303464 - RNA, 64 nt, Human
ccgggcugggaggcggcggcggcggcucgggcuggggggucagguggacgccgcccuccggggc

SEQ ID NO: 303465 - RNA, 64 nt, Human
cagggugcccugggggggaggcauagagggcccugggggucaugggaagcgagcacgcagcagg

SEQ ID NO: 303466 - RNA, 64 nt, Human
ugcuuguaaaccaucgcgugcaaugagccagauggaguaccaugaggguugcuauuuguuguuu

SEQ ID NO: 303467 - RNA, 64 nt, Human
gggucucuuagaccuuaccucucaacucccucaagaguaccagucucugaaguuauaaugcuuu

SEQ ID NO: 303468 - RNA, 64 nt, Human
cuuaacuaguuaaauggaauguugguaugguacagaguaccauauugcuaagaaaacugucuua

SEQ ID NO: 303469 - RNA, 64 nt, Human
gaaucguaaacagagucuaaacuaaaggcuuuuugggggucacagccacagaguggaguuuuau

SEQ ID NO: 303470 - RNA, 64 nt, Human
caggcgggggucugagaucagggugucgcggguggggggucacugcugaggccgugaggggaau

SEQ ID NO: 303471 - RNA, 64 nt, Human
cccacccgggguguccuggggacccaaggggugggggggucacaccagagagaggcagggggcc

SEQ ID NO: 303472 - RNA, 64 nt, Human
ugucuggagcaguggggcacaccccggaggaggcgggggucagggcugucggccuuggcccccu

SEQ ID NO: 303473 - RNA, 64 nt, Human
ccaggcaaggcugucagguuguuuugggggaagagggggucauggauggcugagcagagagcgg

SEQ ID NO: 303474 - RNA, 64 nt, Human
gucacuugcugcuuggagccuuaacuccagaugggggggucaccaagagggagugggcacccug

SEQ ID NO: 303475 - RNA, 64 nt, Human
aagcgggcgggugccccugcugcccuugucccuugggggucacacccauccccuggugggcucc

SEQ ID NO: 303476 - RNA, 54 nt, Human
ccgcacccccgggaccauagccaagggggucaucggccccgcgcuguacagccu

SEQ ID NO: 303477 - RNA, 64 nt, Human
ccacugggggucccucuuaacaucugcuuguugcgggggucagucaugagugccagggucuggc

SEQ ID NO: 303478 - RNA, 64 nt, Human
uccgcuuccugccccgcugaaggggcugagggaagggggucaaaggauuccagggucauucagu

SEQ ID NO: 303479 - RNA, 64 nt, Human
gccuaaagacuggagaaucugggggacugggagugggggucagagaggcagauuccuuccccuc

SEQ ID NO: 303480 - RNA, 64 nt, Human
uuuauuuuggggaaucaggggugaggaggguugggggggucauaucuguguuuccagguucugg

SEQ ID NO: 303481 - RNA, 64 nt, Human
ccuuagcagagaccccugggguuuagcugacucugggggucagggguuccuguccccaaacuuc

SEQ ID NO: 303482 - RNA, 64 nt, Human
ucacauugagguuuggaacuucauaugaaauuuggggggucacugugugugugugugugugugu

SEQ ID NO: 303483 - RNA, 64 nt, Human
ucccucugucucccuggggccuuggguucuguuugggggucaugaccuuccuaguuuccugacg

SEQ ID NO: 303484 - RNA, 58 nt, Human
uugcagaaucaggacuuuaguagagacugaguaccaggccacgggcugcagauccuga

SEQ ID NO: 303485 - RNA, 64 nt, Human
ccuucaaaccucgacagugaugcaaggacacagagaguaccagauagguagcagagaccaaggc

SEQ ID NO: 303486 - RNA, 64 nt, Human
gaagguaucuagaaaugccuuuaaaauaaauucagaguaccagaaaggguauggggauccuagu

SEQ ID NO: 303487 - RNA, 64 nt, Human
auggcggcugugacucagggcccagggaucacaugggggucacugcugccaucagcagucaggc

SEQ ID NO: 303488 - RNA, 64 nt, Human
cugggcuuccccuuggggcggaacucacugcgaugggggucaccaggugaccagugggagcccc

SEQ ID NO: 303489 - RNA, 59 nt, Human
gccgaaggauaccccacuagcaccccugagggggucauguggucaauaaaaguccuuag

SEQ ID NO: 303490 - RNA, 64 nt, Human
gggugaggccugcacugauuggggccuggggcaggggggucaaggagaggguuuuggccgcucc

SEQ ID NO: 303491 - RNA, 64 nt, Human
aaccucggaauuucuaugagaccucccccagggagggggucaguugggcccccaucccuccccu

SEQ ID NO: 303492 - RNA, 64 nt, Human
aaaguggugguagggggagggagggggaaguuaagggggucaccuccauucuggggaauuuaua

SEQ ID NO: 303493 - RNA, 64 nt, Human
ggccccuaggcuacaaaaccaggucuuguggggagggggucaguuucugggaaggguggggggg

SEQ ID NO: 303494 - RNA, 64 nt, Human
ggagugccgcgggccacagugggcagguggcaccgggggucagcaugcaggggcgccagaggcc

SEQ ID NO: 303495 - RNA, 64 nt, Human
gagaggaggccggcccagcuccuucuuucagggugggggucauucagccuccacugugucuguc

SEQ ID NO: 303496 - RNA, 64 nt, Human
cucugggccucaguuucccuccucugcaaaacgagggggucagcccaagauucuucagucugga

SEQ ID NO: 303497 - RNA, 64 nt, Human
cuuuucugaguaccauguuuccaggaggggccaugggggucagggugguuuugagagagcaggg

SEQ ID NO: 303498 - RNA, 64 nt, Human
ccggcccaacccaaccacucggggcccccaucuugggggucacccauggccucagaugaugggg

SEQ ID NO: 303499 - RNA, 64 nt, Human
gaacaugagggcagaggacaccgggaggcuguuagggggucacugaaucccaggagccaaccuc

SEQ ID NO: 303500 - RNA, 64 nt, Human
aaaugauagaaucaggauucauagcaucacuauagggggucaauauuuacacaaaaaaggaaag

SEQ ID NO: 303501 - RNA, 64 nt, Human
ggccggguucccuuccccuagggcacauuacuaagggggucaggcacugcaugcucguuccagc

SEQ ID NO: 303502 - RNA, 64 nt, Human
gaacaugguguucaaccugugcucuaaacagugggaguaccaaagaaauuauaaacaagauaaa

SEQ ID NO: 303503 - RNA, 64 nt, Human
aaggacaugauaaugggaccaggaugguuuuuuggaguaccaagcaaggggaauggagcacuuu

SEQ ID NO: 303504 - RNA, 64 nt, Human
aaagcauauggaguguuucaccgcaggcacuucugaguaccauuccauggcuuccagaauuuua

SEQ ID NO: 303505 - RNA, 64 nt, Human
ccccgcccccuucucaauguuucuagcuagcuuugggggucauuuugucaucagagcauucugu

SEQ ID NO: 303506 - RNA, 64 nt, Human
acagacagagcagcccccacccgggagccuugaugggggucaggcagaggccagccugcacugg

SEQ ID NO: 303507 - RNA, 64 nt, Human
caccauucugccuggggcacuggaacacauuccugggggucaccgauggucagagucacuagaa

SEQ ID NO: 303508 - RNA, 64 nt, Human
gcuccucuacgucauggaaaagauugaggcucuugggggucacugcucugcugcccccugcaac

SEQ ID NO: 303509 - RNA, 64 nt, Human
uccucagaaaugaugcuggguccuuucuaccucugggggucacucucacuuggcaccugccccu

SEQ ID NO: 303510 - RNA, 64 nt, Human
ugaauaaccaaggacugcugaguuuuucuucauggggggucagcuggucucaaaacuggccacu

SEQ ID NO: 303511 - RNA, 64 nt, Human
uugaguucugcagcaugcagcgguaugacccuacgggggucaggagagcccugcggcccccacc

SEQ ID NO: 303512 - RNA, 64 nt, Human
uuccuauugugacugaugagaaaagugaccacgugggggucagucgggggcaaggggcucagcc

SEQ ID NO: 303513 - RNA, 64 nt, Human
gcccggucacauugccuccuugagccuuaguccagggggucacuccucccaccccaccuaccuc

SEQ ID NO: 303514 - RNA, 64 nt, Human
ggggagugaaggagggggcccuggggcaaggcucgggggucaggagcucagcguccgcuacuca

SEQ ID NO: 303515 - RNA, 64 nt, Human
gcccugggcaaggaagcuuuggaagcagcaaggugggggucaggcuacaggugccccaccuccc

SEQ ID NO: 303516 - RNA, 64 nt, Human
cuuggcuuaacuugaaggccugcugucuccuucugggggucagggacgcagcuccacccucacc

SEQ ID NO: 303517 - RNA, 64 nt, Human
gugauggcaggaggauggagaagugccagcagcugggggucaagacguccccugaggacccagg

SEQ ID NO: 303518 - RNA, 64 nt, Human
gcacucacucugugcugggucccgggaagggugagggggucagacacaggcccugccccugccc

SEQ ID NO: 303519 - RNA, 64 nt, Human
gccccucccuugccugccacuuuggggacuugaggggggucauauucccuccucagccugccca

SEQ ID NO: 303520 - RNA, 64 nt, Human
gugaguugaagccaaagcccuuuggugacucacugaguaccaugguucuguucuccucuggaga

SEQ ID NO: 303521 - RNA, 64 nt, Human
uagaaacuuuuuuuaccccaacuacugaauccaggaguaccaaauaauauauaguaaaacuaag

SEQ ID NO: 303522 - RNA, 64 nt, Human
caaauucacugccuccucccaugcacgugguagagaguaccaguaucaacauggcccuguuuuc

SEQ ID NO: 303523 - RNA, 64 nt, Human
gagaauggccuggagcaggcccaaugcugcuuuugggggucagcauccagugugagauacugug

SEQ ID NO: 303524 - RNA, 64 nt, Human
guuugcccaaaucugccuauugcagcugggagaagggggucaaagcaaggaucuuucacccaca

SEQ ID NO: 303525 - RNA, 64 nt, Human
cuuuuuucuuuuuuuuuuuuuuugguggggggcugggggucagagucuuguucuguugccuggg

SEQ ID NO: 303526 - RNA, 64 nt, Human
uagcauucugcugccaucuuagcuguggacaaaggggggucagcuggcaugagaauauuuuuuu

SEQ ID NO: 303527 - RNA, 64 nt, Human
ucagcaaccaagaccaccuggcaacaggcucagugggggucagguccagguccccgaagaggug

SEQ ID NO: 303528 - RNA, 64 nt, Human
ggcaaaugcuggccuuuauggacgagcacaauucgggggucagaccugguucaaauucuagcug

SEQ ID NO: 303529 - RNA, 64 nt, Human
gaggucauguucaggaggggcauuccuuuccccugggggucauggguguccccaugcccacaua

SEQ ID NO: 303530 - RNA, 64 nt, Human
agcuucacuucugacucuuccccaggaagggaaggggggucagaagagagggugaguccuccag

SEQ ID NO: 303531 - RNA, 64 nt, Human
acagugcaggacacagccauguacaccaagaagagaguaccaaguagucuuuuguucagcuuuu

SEQ ID NO: 303532 - RNA, 64 nt, Human
uccauguuuguacuccugugcuggacuguuuccugaguaccagcaggucccuuuuugucucuca

SEQ ID NO: 303533 - RNA, 64 nt, Human
gagcauggauuagauguuuccugggaggugccuugaguaccauuaugugcaagcuacauaauua

SEQ ID NO: 303534 - RNA, 64 nt, Human
guucccuacccgugcccccagugucuucccugcugaguaccaggagagguccugccccauccuc

SEQ ID NO: 303535 - RNA, 64 nt, Human
cuuggucaaguauuucucacaucuuuuguuaucagaguaccauuccaaucucuuaacuugcagu

SEQ ID NO: 303536 - RNA, 64 nt, Human
aguggaaaccguguaaauaccugucaauacuauggaguaccauguggcaacggaagaaugagac

SEQ ID NO: 303537 - RNA, 64 nt, Human
uauaccuaaauguuuauuaaaaguuagaagaaaugaguaccaacaggaaggaauggaagagagg

SEQ ID NO: 303538 - RNA, 64 nt, Human
aaagauguuuccaguggugcucuugaagaggaaugaguaccaguuuuaaauugcccauuggcau

SEQ ID NO: 303539 - RNA, 64 nt, Human
ccgcugccuucuugucugugcuaauauaaauacugaguaccagcauguccauuugaacaugcag

SEQ ID NO: 303540 - RNA, 64 nt, Human
ggaggcccugggguugguagggcagcugguagaggaguaccagcuggugugccaauuccccagg

SEQ ID NO: 303541 - RNA, 64 nt, Human
cccuuuucuucaguaucgacaaagauuacauucugaguaccaaccaaacccuaaauugaaagac

SEQ ID NO: 303542 - RNA, 64 nt, Human
cauucguagugccagcacaguccuaaaagggcuggaguaccacaccaacacagguaggggugca

SEQ ID NO: 303543 - RNA, 64 nt, Human
cauauuaccuuauuugaacaaguuuuccuuuauugaguaccaagccauguaaugguaacuugga

SEQ ID NO: 303544 - RNA, 64 nt, Human
agggcucuugcuccugucucugccucugggucaugaguaccacccugccugccuccccaacacc

SEQ ID NO: 303545 - RNA, 64 nt, Human
ugacaugcggucagauaagucccgucuuguuugugaguaccacagaaacgccugagagucacuu

SEQ ID NO: 303546 - RNA, 64 nt, Human
gaaucaaguucugugcugucccgugagugugucugaguaccauucacuggaguugcugcuuagg

SEQ ID NO: 303547 - RNA, 64 nt, Human
ugggacaucccugauagguucacaucccugggcagaguaccaggcugcugacccucagcagggc

SEQ ID NO: 303548 - RNA, 64 nt, Human
cgagauccgcugcgaccuggagcgacagaaccaggaguaccaggugcuccuggacgugaaggcc

SEQ ID NO: 303549 - RNA, 64 nt, Human
cagagcccucuccuccucuggagucagguggugggaguaccagccccccagcccacccacuugg

SEQ ID NO: 303550 - RNA, 57 nt, Human
aaaaagaugacaagaacuaacgcuccugaguaccagccccugucacaucugacugug

SEQ ID NO: 303551 - RNA, 64 nt, Human
gcaggcggaccuggaauguguuggagggaagggggaguaccaccugagucuccagcuucuccgg

SEQ ID NO: 303552 - RNA, 64 nt, Human
ccacgagcugcugcgggaggccaccgaggccgccgaguaccaggaggcccuggagggcuggacg

SEQ ID NO: 303553 - RNA, 64 nt, Human
ucuaacuaaggccacugugccacugugcacccuugaguaccauugauccaaagcuuucccacag

SEQ ID NO: 303554 - RNA, 64 nt, Human
cuuuguucuguaaauaugaucaguguuuauaucagaguaccaggugucccgguucucaagaugu

SEQ ID NO: 303555 - RNA, 64 nt, Human
cacuuugccagccacugguggucccugcuuuucugaguaccauguuuccaggaggggccauggg

SEQ ID NO: 303556 - RNA, 64 nt, Human
cccucauccuuuuacuuuuugccccuuccacuuugaguaccaaauccacaagccauuuuuugag

SEQ ID NO: 303557 - RNA, 64 nt, Human
aauccacaagccauuuuuugaggagagugaaagagaguaccaugcuggcggcgcagagggaagg

SEQ ID NO: 303558 - RNA, 64 nt, Human
ugaaggagugcgugccugcuacgaacgcuccaacgaguaccagcugauugacugugcccaguag

SEQ ID NO: 303559 - RNA, 64 nt, Human
caaacuuaguggacaauggagucauuucuaccuagaguaccaguaaacaucucccagugugcua

SEQ ID NO: 303560 - RNA, 64 nt, Human
gauuuggaaguuccagcgccaugaccugaucgaggaguaccacggccgccccgccgcgccgccc

SEQ ID NO: 303561 - RNA, 64 nt, Human
ugucugcacuuucuuguuuacuguuugaagggacgaguaccaagccacaagaacacuucuuuug

SEQ ID NO: 303562 - RNA, 64 nt, Human
acccuucugcaucagggagcccccucugccucuugaguaccagaccucaugggaccagaccccu

SEQ ID NO: 303563 - RNA, 64 nt, Human
uaccuuaauaccaauaaccuaaugguacuuaggcgaguaccauuugcacaaucacuguuuuacu

SEQ ID NO: 303564 - RNA, 64 nt, Human
agaguuaaaaaaaaaaaaaaaaaucuguaugccugaguaccauccuggaugaaucuagaaggua

SEQ ID NO: 303565 - RNA, 64 nt, Human
guuuaauaauuuuguaaaucaugcucuuuacacagaguaccacuuauuuaauaagacgggaugu

SEQ ID NO: 303566 - RNA, 64 nt, Human
uuucucuuucuuaaacuuaccugacacuuaaccagaguaccaguucucgugaugugaauuaauu

SEQ ID NO: 303567 - RNA, 64 nt, Human
agcagaggagacaucuugaagugucagauuacaggaguaccagugggagauggcauuuucuucu

SEQ ID NO: 303568 - RNA, 64 nt, Human
uuuaauuguaaauuguuaucaaucaaacuauuguagcagcuacaaaguaauucaccagcaugac

SEQ ID NO: 303569 - RNA, 64 nt, Human
gucauuuguuaaaauacaguucugucauauguuaagcagcuaaauuuucugaaacugcauaagu

SEQ ID NO: 303570 - RNA, 64 nt, Human
aagaaaaaaauuuggaaaaaaaaaucaggcucauagcagcuacuguguagaaaauucccccuac

SEQ ID NO: 303571 - RNA, 64 nt, Human
augggcuggugggagugggauagucucccauuuaagcagcuaauaaauaauuuuuaugauaaaa

SEQ ID NO: 303572 - RNA, 64 nt, Human
ucauaauccauucacccguucaucauguguacugagcagcuaccauguucaagguaauaugcca

SEQ ID NO: 303573 - RNA, 64 nt, Human
ugggcugccaugugaagagggagaagcaugaaaaagcagcuaccagguguucuacacucaucuu

SEQ ID NO: 303574 - RNA, 64 nt, Human
uuagcaacaaaaucccguaauucuuuuggccaacagcagcuauuuuggggagcagcuguggcug

SEQ ID NO: 303575 - RNA, 64 nt, Human
uucgggcaccuccagggccagagagcaggcucagagcagcuaguguggagcucagcauccccac

SEQ ID NO: 303576 - RNA, 64 nt, Human
caggaagagaugcugauaguuugaucuagaaaccagcagcuacuggcucaaauucagguucugg

SEQ ID NO: 303577 - RNA, 64 nt, Human
ggcagaggggcagccgcuaggagagacugaaagcagcagcuaggacugaggaguggguuuuauu

SEQ ID NO: 303578 - RNA, 64 nt, Human
uuacucagaaaaaaugucccuuacaggaaccggcagcagcuaggcagucaccggcccgccucca

SEQ ID NO: 303579 - RNA, 64 nt, Human
ugcacccaaggggccucuccaugccuucuuaggaagcagcuaugaauccauuguccuuguaguu

SEQ ID NO: 303580 - RNA, 64 nt, Human
aacagauaugaaaaccuuuucagugcuugcccucagcagcuaagaagacagacaguagagaaug

SEQ ID NO: 303581 - RNA, 64 nt, Human
ugggcucaaaugagcacccuggcuggcugcaagcagcagcuacacaacacuacagagggcagcc

SEQ ID NO: 303582 - RNA, 64 nt, Human
cccauccccacaaaccagguaaugccaguuugccagcagcuauuugccuauagagaugagucug

SEQ ID NO: 303583 - RNA, 64 nt, Human
gggcuagcccaccgcagcagccucccucccucucagcagcuagaugcauggccugaggcagggu

SEQ ID NO: 303584 - RNA, 64 nt, Human
uaaaacggaguaacaacuaugcaaagguuucuauagcagcuaggugaguuuguuuuccgggucu

SEQ ID NO: 303585 - RNA, 64 nt, Human
cagaccccccaggcccagcagaagagccuccuucagcagcuacugacugaauaaccacuuuuaa

SEQ ID NO: 303586 - RNA, 64 nt, Human
agcaucagccaguuucuaaaacccacaggccaucagcagcuagagguggcuggcuuuggccaga

SEQ ID NO: 303587 - RNA, 64 nt, Human
cuauauaugcauguuauccauuauaaaugcacucagcagcuaagagaaauuugagaggaaaagu

SEQ ID NO: 303588 - RNA, 64 nt, Human
ggaaauuuuuauacugaaaacaaacaaacaaacuagcagcuacuaaaauagagaagaaauugag

SEQ ID NO: 303589 - RNA, 64 nt, Human
gucaguucuaugacagugaauuuugcacaggagaagcagcuaccugauuucuuacuuucucucu

SEQ ID NO: 303590 - RNA, 64 nt, Human
gaaguauuagauuuuacaucauaacacaaaguccagcagcuacaucuguggaaacugugcaguu

SEQ ID NO: 303591 - RNA, 64 nt, Human
gagcauuuuauguuuuaagaacaggcugacacgcagcagcuacaacaacagcugagaucacuua

SEQ ID NO: 303592 - RNA, 64 nt, Human
gcuucauccccccacccaggaccuagugcaugccagcagcuaucuggggcccugggaaaaaugu

SEQ ID NO: 303593 - RNA, 64 nt, Human
ggagggcuuggggagcgugggcacuuuucucaugagcagcuacugcggcguuggcaggacucgc

SEQ ID NO: 303594 - RNA, 64 nt, Human
aguuugggacuucaggaaaaaucaacccagcaccagcagcuaccaaccaccauuccaucucuuc

SEQ ID NO: 303595 - RNA, 64 nt, Human
aggcauacacuguaguuuuugaaaauuaugcaaaagcagcuaaauguaacuuauuccaagugca

SEQ ID NO: 303596 - RNA, 64 nt, Human
agccauaaauguaugauauuagugcccaugaugcagcagcuaauuucaaaccuaccacugcaug

SEQ ID NO: 303597 - RNA, 64 nt, Human
acuuugguaacaauccaaagacccugagggucugagcagcuagaaguccuagacaaagaacuug

SEQ ID NO: 303598 - RNA, 64 nt, Human
uggguggguggacccaggcucccuuugcacacagagcagcuacuucuaagccauaucgacuguu

SEQ ID NO: 303599 - RNA, 64 nt, Human
aggaagggauggggugagcgcaaggccuguggucagcagcuacugaugguuuuuucugccuuaa

SEQ ID NO: 303600 - RNA, 64 nt, Human
aaauuaaucacaaauuucacuuauaccugcuaucagcagcuagaaaacauuuuuuuuuuaaauc

SEQ ID NO: 303601 - RNA, 64 nt, Human
auauauauucaaagugagacaaaggcaaauaaaaagcagcuauuuucaugaauagacaaaguug

SEQ ID NO: 303602 - RNA, 64 nt, Human
uuaauuacuauaguguuauguagagauuugauugagcagcuaauguuucugaacuuuacuuacu

SEQ ID NO: 303603 - RNA, 64 nt, Human
gccccucacuacuggcuugguuuggucuacuggaagcagcuaucaaccgacuuuguucuuccaa

SEQ ID NO: 303604 - RNA, 64 nt, Human
uuaggaauccuagaccauauuuucaagucaucuuagcagcuaggauucucaaauggaaguguua

SEQ ID NO: 303605 - RNA, 64 nt, Human
uagcugagggaaguucuuugccugcugucagaggagcagcuaucugauuggaaaccugccgacu

SEQ ID NO: 303606 - RNA, 64 nt, Human
gcuauuuuuuuaagcuaucagcaauacucaucagagcagcuagcucuuuggucuauuuucugca

SEQ ID NO: 303607 - RNA, 64 nt, Human
auuuucaagguguguagagaaauaauauggaauuagcagcuaugacuccaacagacaggauugu

SEQ ID NO: 303608 - RNA, 64 nt, Human
uaacgcauucaugaauuuccaguguucaguaaauagcagcuaugugugugcaaaauaaaagaau

SEQ ID NO: 303609 - RNA, 64 nt, Human
uccugcuuagaauuaaccauugcuaauuuaaaggagcagcuagcugcuuuucugucagucugaa

SEQ ID NO: 303610 - RNA, 64 nt, Human
uuuucucuuuuuaauuucuuuuacccuuuugugaagcagcuauacguggcauacauguauuuaa

SEQ ID NO: 303611 - RNA, 64 nt, Human
aauugauuucuuugagugguauuucucuugauugagcagcuagacaaaauaaucugcaaauuua

SEQ ID NO: 303612 - RNA, 64 nt, Human
cugaugauagacuucgaaaacagaugagaagacuagcagcuagcaagggugcuuguggucacac

SEQ ID NO: 303613 - RNA, 64 nt, Human
ggaaauguagcagacagcauggaggcugggacccagcagcuacuuugggucaugucuuuacugu

SEQ ID NO: 303614 - RNA, 64 nt, Human
ucaaagcacugaugugaggaaguacuugccccguagcagcuauucacucuaccaguguaaacaa

SEQ ID NO: 303615 - RNA, 64 nt, Human
uguagaagacccugaggacuccugggcuagugugagcagcuauucugcaugggugcagauggcu

SEQ ID NO: 303616 - RNA, 64 nt, Human
gacuaucauuacugaugcagaccuggcuguggagagcagcuaauguguggcccagagagccugu

SEQ ID NO: 303617 - RNA, 64 nt, Human
ccccagcccgaggcccccaccagcaguuggcgguagcagcuacuccgagcgccguuuacaguuu

SEQ ID NO: 303618 - RNA, 64 nt, Human
uuugaucacuaccaccauuaucagcaccagacugagcagcuauauccuuuuauuaaucaugguc

SEQ ID NO: 303619 - RNA, 64 nt, Human
agauugugugucggcugcagcagugauuccaacaagcagcuauugggggggaaacacagcauuu

SEQ ID NO: 303620 - RNA, 64 nt, Human
ugaucucuuugcagguaaccaaggagcagugaacagcagcuacuacaguaguggaagccgugca

SEQ ID NO: 303621 - RNA, 64 nt, Human
gggagccagaaaugggcaguucucccagggagugagcagcuacuguaacuuuuuuaaauuaaga

SEQ ID NO: 303622 - RNA, 64 nt, Human
ugauucaaggagaucaggcugugucucugacuggagcagcuacacuccccaucuguaauuugau

SEQ ID NO: 303623 - RNA, 64 nt, Human
accuguuucagacugggcaugaagaagggagcacagcagcuacuagaccccauuagcaccucau

SEQ ID NO: 303624 - RNA, 64 nt, Human
gauaauacagaccaacuaggcuacaucugugaugagcagcuagcaaagccgcuggucuucuccu

SEQ ID NO: 303625 - RNA, 64 nt, Human
cccugaggccagaauugacucuuugggccuaaauagcagcuauaaacaucuucaguaacuugcc

SEQ ID NO: 303626 - RNA, 64 nt, Human
ggaccuccuuugucaguaccccuucuuuuuucuaagcagcuaauaagagguugggugaaagagu

SEQ ID NO: 303627 - RNA, 53 nt, Human
ggaagauuuucagguuuuaauaaagcagcuauggaggccaagaacaugccaga

SEQ ID NO: 303628 - RNA, 64 nt, Human
uaauuuuaaugcuguuuuaaugggguugaaaacaagcagcuacuguauguauguagcuaacuga

SEQ ID NO: 303629 - RNA, 64 nt, Human
acuuguugaccacacgccccucaccaaacaaugcagcagcuacuggaccacccugagcagcacu

SEQ ID NO: 303630 - RNA, 64 nt, Human
gaacaugccaccuuuuuucucaugguuucaguagagcagcuaccacauguugcaugaguucaua

SEQ ID NO: 303631 - RNA, 64 nt, Human
uacuuacugugauacugaaaagcuguccugcugaagcagcuauauuugaaauauuaaguaugaa

SEQ ID NO: 303632 - RNA, 64 nt, Human
aaucuaagcauuuuuauggaaauauuuuuaaugcagcagcuauugcacuucagccaaauguuua

SEQ ID NO: 303633 - RNA, 64 nt, Human
auuguggugaaaguauuuuuauauugcugagaguagcagcuaaucacaguuacaugcuucagag

SEQ ID NO: 303634 - RNA, 64 nt, Human
ugggcucaagagauccuuuugcuucagccucccaagcagcuaggacuacaggcacaugccacca

SEQ ID NO: 303635 - RNA, 64 nt, Human
acuaaaacuauuacucaucagucauucacugaucagcagcuaaaguccaugagaccaaaugguu

SEQ ID NO: 303636 - RNA, 64 nt, Human
guugcuucgaucuucagccacaugcuguccuugaagcagcuauuugaagauguguuuucugagg

SEQ ID NO: 303637 - RNA, 64 nt, Human
aaauuagccaggcaugauggcacaugcugguaauagcagcuacugagguggcugaggcacaaga

SEQ ID NO: 303638 - RNA, 64 nt, Human
ccucgcuuggaauggaaugccagaaaugcauggcagcagcuaauaaguaaagcugauuaacuau

SEQ ID NO: 303639 - RNA, 64 nt, Human
ggcagagaugaugaacagaaguguauguaaauacagcagcuagugggagagcaccaguugggcc

SEQ ID NO: 303640 - RNA, 64 nt, Human
ccugcugaaaacccccauaagccagugaacacagagcagcuagaggcuccuccucugcuggcuu

SEQ ID NO: 303641 - RNA, 64 nt, Human
aggggcuggcuggugcccuauuuccagccaccccagcagcuagggaggcaaagcaggcugcagu

SEQ ID NO: 303642 - RNA, 64 nt, Human
ucacaacuauucaguucugcuaguauagcgugaaagcagcuauacacaauacagaaaugaauga

SEQ ID NO: 303643 - RNA, 64 nt, Human
gcugcggauguaauuuuuuuuaaaaaaguccaaaagcagcuaugggcaguugacaaaagaaaau

SEQ ID NO: 303644 - RNA, 64 nt, Human
cuuguaacucuaugaacuuagaguuuacuauuuuagcagcuaaaaaugcaucacauauucauau

SEQ ID NO: 303645 - RNA, 64 nt, Human
cauccugaauaccgacuaccucuucacuugcuaaagcagcuaaacugugaagcucuaagugguu

SEQ ID NO: 303646 - RNA, 64 nt, Human
gaagaaaugguggacuguaucucucacguucugaagcagcuaauccucuuucccacauagccau

SEQ ID NO: 303647 - RNA, 64 nt, Human
uuaaaagucaucuuugaaaugauaaucaagaaacagcagcuaugaagccuugaauuuugaaaaa

SEQ ID NO: 303648 - RNA, 64 nt, Human
gagcaagcaguacaguggcauucccagggggaccagcagcuacccaaggagaaccaugcaugaa

SEQ ID NO: 303649 - RNA, 64 nt, Human
gggcagggacccggggucuccuggaccuugacagagcagcuaacuccgagagcagugggcaggu

SEQ ID NO: 303650 - RNA, 64 nt, Human
agugugugcucagagcaucuuuguucuucacggcagcagcuaccuucccucacugucucaggug

SEQ ID NO: 303651 - RNA, 64 nt, Human
cccuguaaguuacagucacaauuuucugugccaaagcagcuacaauaauagagaggaagccuuc

SEQ ID NO: 303652 - RNA, 64 nt, Human
agagccuccaguuaaaauggggcuccaguaccagagcagcuagcaacucugcccuaaugggaaa

SEQ ID NO: 303653 - RNA, 64 nt, Human
gcugugaggcuggagggaccagauggaggaggccagcagcuagccauugcacacuggggugaug

SEQ ID NO: 303654 - RNA, 64 nt, Human
cuuugaacgggagcagcugcucuuccgccaacccagcagcuacuuugugcaguucccgcaggcc

SEQ ID NO: 303655 - RNA, 64 nt, Human
uuuuauauuauaccuguucuuuagaagucauguuagcagcuaauuauuucagugaugaaauaau

SEQ ID NO: 303656 - RNA, 64 nt, Human
uuuucauuguguauuuuuguguaugugugcauauagcagcuacucuguagcagagguggguaga

SEQ ID NO: 303657 - RNA, 64 nt, Human
aucuuaccugucucuucuccaugagggagaaggaagcagcuagcuaugucccuagcugcaggaa

SEQ ID NO: 303658 - RNA, 64 nt, Human
uuucuacccagggacugugcucagccaccaguucagcagcuaagagaucggcuuuuucaugcuc

SEQ ID NO: 303659 - RNA, 64 nt, Human
aauuaugugaaauguauagcugcuuuugaugaaaagcagcuauuugccuuuuuuuuuuuuuccu

SEQ ID NO: 303660 - RNA, 64 nt, Human
aagauaaccccagagggcgcucagccaagcuuagagcagcuaucaaauuauaaguuaucaucau

SEQ ID NO: 303661 - RNA, 64 nt, Human
gcccucaaauccuaucuuccugccccacaaugugagcagcuaccccugauacuccuuuucuuua

SEQ ID NO: 303662 - RNA, 64 nt, Human
ucaaauauuucaagggcuccauagccacguggccagcagcuaccacacuggucagcgcagcacc

SEQ ID NO: 303663 - RNA, 64 nt, Human
guuccaagauuucaaaguggugaaaugaaaauggagcagcuaguauguuuuauuauuuuauggg

SEQ ID NO: 303664 - RNA, 64 nt, Human
cuguugcuacacuauuauaggcauguuugauacuagcagcuaacacuggucacuccaaagcacu

SEQ ID NO: 303665 - RNA, 64 nt, Human
acuacaucaguguggaaaaaaauucugauacauuagcagcuauguaaaugaccuaauugauagc

SEQ ID NO: 303666 - RNA, 64 nt, Human
auucuacgaagccuuggggaucagggucagugugagcagcuaacauccuaccucaaauggaaca

SEQ ID NO: 303667 - RNA, 64 nt, Human
aaauaaauuguuguuuuguauuuuguaacuuaaaagcagcuauugguaaauuucugagauauag

SEQ ID NO: 303668 - RNA, 64 nt, Human
cauucuggaauuuuuuuguaauuuuuuaaaucuuagcagcuaucauuaguguuuguguauuuua

SEQ ID NO: 303669 - RNA, 64 nt, Human
ugccuacuuuuaguugacucacaggcccuggagaagcagcuaacaaugucugguuaguuaaaag

SEQ ID NO: 303670 - RNA, 64 nt, Human
aaauguuaggccugaagugccuguggcauguugcagcagcuauuuugccaguuaguauaccucu

SEQ ID NO: 303671 - RNA, 64 nt, Human
cuucucccuacacucccagccaaccuagugcccaagcagcuaaacuuggcuuccuucuaauccu

SEQ ID NO: 303672 - RNA, 64 nt, Human
cucugucuguuuucacuugaauggguaaauaaccagcagcuagguuuugaauuccuaccuuguu

SEQ ID NO: 303673 - RNA, 64 nt, Human
aaaacgaccugacuuaguaaugcgaaccuauaguagcagcuacuccagaggcugaaaugggagg

SEQ ID NO: 303674 - RNA, 64 nt, Human
uugcugggauuaaggggauuagagugauuaugggagcagcuaaagaugagaggggcucaguuuu

SEQ ID NO: 303675 - RNA, 64 nt, Human
aguucgccccuuccccaccccuuaccagauguuaagcagcuaugaaacauucucuguacuaguu

SEQ ID NO: 303676 - RNA, 64 nt, Human
uauuccugguuaagcaggcauugcuuugcccuggagcagcuauuuuaagccaucucagauucug

SEQ ID NO: 303677 - RNA, 64 nt, Human
gacaaucaaucagucagucuuuacugacaggagcagcagcuaucugucuuuugcugaucuacaa

SEQ ID NO: 303678 - RNA, 64 nt, Human
cugagccuggcagguccccugcccugaggcugugagcagcuagugguggcuucuccagccuuuu

SEQ ID NO: 303679 - RNA, 64 nt, Human
cuaaaucaaaggcagcuaauccugucccugaaggagcagcuaggggaaccugaggcuuguucuu

SEQ ID NO: 303680 - RNA, 64 nt, Human
uuuguggaugaaucccacauuaggauggugaaccagcagcuacuagggagaagucugcaagaug

SEQ ID NO: 303681 - RNA, 64 nt, Human
ggacucagucaucuccacuuaaauugaugacacaagcagcuaauaaccauuucuggguuucugc

SEQ ID NO: 303682 - RNA, 64 nt, Human
aacuaggaucucacaggaaaagcuggguaacucaagcagcuauucuuucuguagggaccagaac

SEQ ID NO: 303683 - RNA, 64 nt, Human
cuggcagugggacgagcuagcccgaacugacuucagcagcuaccccaaaccaaucaaggguuug

SEQ ID NO: 303684 - RNA, 64 nt, Human
aggcuagcacauggaaaaacaacuuagaggauuuagcagcuaaaagaagaaugagucagcuggu

SEQ ID NO: 303685 - RNA, 64 nt, Human
ccccuuuuuuggugaucuaauugcauugguuaaaagcagcuaaccaggucuuuagaauaugcuc

SEQ ID NO: 303686 - RNA, 64 nt, Human
uugaagagacaggacuggcaguuggggaggccacagcagcuagaauuuccaggggaaaguacug

SEQ ID NO: 303687 - RNA, 64 nt, Human
ucuuguguauuaacuucugacuuauuuauacaagagcagcuauaggaguuuacaaaagaacuuu

SEQ ID NO: 303688 - RNA, 64 nt, Human
cucacccuggacuaagacaaagauauuuagguugagcagcuauuaauuggagaauugguacaga

SEQ ID NO: 303689 - RNA, 64 nt, Human
gacugaaauacuaugaucuuguuugucaauaaaaagcagcuaucugugaaccagguaacugugu

SEQ ID NO: 303690 - RNA, 64 nt, Human
gcccccagaccccgcagcucugugcccggcaagaagcagcuagacacacgccagggcgccaagc

SEQ ID NO: 303691 - RNA, 64 nt, Human
cuggggccagccuccuugccucugcucugaccucagcagcuacaccuaaccccaccgcacccua

SEQ ID NO: 303692 - RNA, 64 nt, Human
cucuauuuccaaagccauuuaccucaaaggacccagcagcuacaccccuacaggcuuccaggca

SEQ ID NO: 303693 - RNA, 64 nt, Human
gaguguucaucugcagccuucccucuccagacagagcagcuacaccaguaauggcacucuuccu

SEQ ID NO: 303694 - RNA, 64 nt, Human
ugagauaacugggggcaaagguugggauaggcgcagcagcuauaagacaagcuccuacgcucac

SEQ ID NO: 303695 - RNA, 64 nt, Human
acauuauucuuuaaugggauaauacaauucauugagcagcuaccacuuaaaaaacuugcaggac

SEQ ID NO: 303696 - RNA, 64 nt, Human
uugagccucugcuuagugaaacacaaaggaacaaagcagcuauaaacuaaauagaaugcaacua

SEQ ID NO: 303697 - RNA, 64 nt, Human
ccggagcccccagcagggcccuccgagguggagcagcagcuacaagcagaggcugaacaccugc

SEQ ID NO: 303698 - RNA, 64 nt, Human
ccggagcccccagcagggcccuccgagguggaacagcagcuacaagcagaggcugaacaccugc

SEQ ID NO: 303699 - RNA, 64 nt, Human
uacuuaauuuuaacuaaccaacaaccacaaaagcagcagcuacugcuaaauauuggauuacuga

SEQ ID NO: 303700 - RNA, 64 nt, Human
cguaccguccgcaucugggaccuggccacccugcagcagcuauacgacuucacaucaucagagg

SEQ ID NO: 303701 - RNA, 64 nt, Human
ccaaccagcagacagcuuuauggaaacuugguauagcagcuaaaagaguuuaguuuguuuauau

SEQ ID NO: 303702 - RNA, 64 nt, Human
acaugaccagaaaucaaagaugucagagccccgaagcagcuaauguaauaagcacucauguuau

SEQ ID NO: 303703 - RNA, 64 nt, Human
gauguuuuuucccuguuuaaugauugacguacuuagcagcuaucucucagugaacugugagggu

SEQ ID NO: 303704 - RNA, 64 nt, Human
caacggucucuuuugaugacccaccuucagcuaaagcagcuauugacugguuugaugguaugua

SEQ ID NO: 303705 - RNA, 60 nt, Human
aacagaagcacuuucaguaaagcaacggcaagcagcuagguugcaagaacauuccucuac

SEQ ID NO: 303706 - RNA, 64 nt, Human
ggaccuggguugcccugagacccaagccauuguuagcagcuagccagccacaccaaccacgcca

SEQ ID NO: 303707 - RNA, 64 nt, Human
gguccugcuguggucaucuuggugacucggucacagcagcuacuggccaagaucagacgucgcu

SEQ ID NO: 303708 - RNA, 64 nt, Human
uaagaaaaugacuguaaaucucaagaaaaaucucagcagcuaauagcaacucauuuauuucauu

SEQ ID NO: 303709 - RNA, 64 nt, Human
agggaacauuuucugcaccuucugauuuuacuuaagcagcuaccauuccauggacuugccuccc

SEQ ID NO: 303710 - RNA, 64 nt, Human
uuuuaauucuaguauuuuaucuggaacaacuuguagcagcuauauauuuccccuuggucccaag

SEQ ID NO: 303711 - RNA, 64 nt, Human
ugugugcagagugaacagaggacucagguuucauagcagcuagugcggggcauccucauccugu

SEQ ID NO: 303712 - RNA, 64 nt, Human
ccagaccuauuccuccugggccccucaucugcucagcagcuauuugaaugagaugauucagaag

SEQ ID NO: 303713 - RNA, 64 nt, Human
gacugacugccaauacuugucaccauucccuggaagcagcuaccuaggggaaacaagauguagu

SEQ ID NO: 303714 - RNA, 64 nt, Human
guucauaaauuuaugguucucaggccugacucucagcagcuaugguaggaacugcugggcuugg

SEQ ID NO: 303715 - RNA, 64 nt, Human
uccccaaaagggucguaguaggucacccuucuacagcagcuaacuagaguccuaacuaauggga

SEQ ID NO: 303716 - RNA, 64 nt, Human
aagccaagagacugcuuuugagugacauuuauuuagcagcuaguaacuucacuuauuucagggu

SEQ ID NO: 303717 - RNA, 64 nt, Human
gcaggggcuguugggcugugcuccagagaaaaggagcagcuacuccuuuuaaauccacgauuuc

SEQ ID NO: 303718 - RNA, 64 nt, Human
ugaauauucuguaacagggcaaguuuccacucuaagcagcuauuuaaaaauaaauaugaggauu

SEQ ID NO: 303719 - RNA, 64 nt, Human
cuccuuccauugcaucauuuuaaaggaagaaaaaagcagcuaaaaaagaguggaccaaaacacu

SEQ ID NO: 303720 - RNA, 64 nt, Human
ccuuccuagcagaguuuauccauucguccccaagagcagcuagaagagauuugaggucaugacc

SEQ ID NO: 303721 - RNA, 64 nt, Human
guugcccagauggggccuccuuuguucugcauucagcagcuauuuaucgaguaccuacucuguc

SEQ ID NO: 303722 - RNA, 64 nt, Human
uuugggguuuuuuguagugccuuuuguuuuggauagcagcuaucuuguuggaugugagguggaa

SEQ ID NO: 303723 - RNA, 64 nt, Human
ucauccauggaguggcugcuggugcccggggaggagcagcuauccuugcccccagaggagcagu

SEQ ID NO: 303724 - RNA, 64 nt, Human
acagcccucgcccugccaagcacugcggccacucagcagcuauguucccgccgcaguggggccc

SEQ ID NO: 303725 - RNA, 64 nt, Human
aaucccagcacugccgucuacucacuguaguaguagcagcuacagaaagguaguagugagacgu

SEQ ID NO: 303726 - RNA, 64 nt, Human
ucuucuucggaggcaacugagaacacauaaagcaagcagcuaccuagcaucccccuccuaaagc

SEQ ID NO: 303727 - RNA, 64 nt, Human
gcaccuuagccucaauagcuacgaacccuagagaagcagcuagcuggagcucaugugcaacucc

SEQ ID NO: 303728 - RNA, 64 nt, Human
ggguuuggagcuauucaagaggaaaugucacagaagcagcuaaaccaaggacugagcacccucu

SEQ ID NO: 303729 - RNA, 64 nt, Human
gaaauaccuuugccuggauaccucuggcuccuucagcagcuagagcucaguauacuaaugcccu

SEQ ID NO: 303730 - RNA, 64 nt, Human
auguucugagccgucugagggccuucaugccggcagcagcuagcaaagccagaaagcaagucua

SEQ ID NO: 303731 - RNA, 64 nt, Human
agaugugacugccaucaucuucgugguggccagcagcagcuacaacauggucauccgggaggac

SEQ ID NO: 303732 - RNA, 64 nt, Human
acgcacugggcauuggguaagggacuccagaagcagcagcuagaaagagaaaaagcccucuuca

SEQ ID NO: 303733 - RNA, 64 nt, Human
uugccagcccuaauaagaagcaugcuaaagccacagcagcuacugugguucuucaagcaauggg

SEQ ID NO: 303734 - RNA, 64 nt, Human
caacuccuuuucagagaucaggagggauuuauguagcagcuauuuuuacugcaaaaguaauuca

SEQ ID NO: 303735 - RNA, 64 nt, Human
ucugucaccacggggccugcuucuuaucugacacagcagcuaucagagucuagugguugugcuu

SEQ ID NO: 303736 - RNA, 64 nt, Human
ggcaccuuuuauauuauauuuguaaaagaaccacagcagcuauuuuggaaagaagcuguuguuc

SEQ ID NO: 303737 - RNA, 64 nt, Human
ugcaguggaauggagaggaaaauacuucuaggcaagcagcuagacuggugaauugggggaaaua

SEQ ID NO: 303738 - RNA, 64 nt, Human
aucaucucuggccaccacuccaccagaugggcagagcagcuaugaccgccacccagcccucccg

SEQ ID NO: 303739 - RNA, 64 nt, Human
aguauuuuuacauauuuuaagggugcaggaggacagcagcuaacaaggccaggaaauacucacu

SEQ ID NO: 303740 - RNA, 64 nt, Human
gcccuccaaacagagcaacaacaaguacgcggccagcagcuaccugagccugacgcccgagcag

SEQ ID NO: 303741 - RNA, 64 nt, Human
cuguguggggagccgagguauggaggagcuggggagcagcuaugcaaaucccuaccuacccagc

SEQ ID NO: 303742 - RNA, 64 nt, Human
acuuucucuuugugcucaguucuguucugucuccagcagcuauauugguaagacuaguaccugc

SEQ ID NO: 303743 - RNA, 64 nt, Human
auacuaauguuuggaaucuuaugucagaaauauaagcagcuauguacuuagaauagguuuugaa

SEQ ID NO: 303744 - RNA, 64 nt, Human
agaaggcacugaaucugccauccacaucacauauagcagcuauuaugaaaucagcuuucauagg

SEQ ID NO: 303745 - RNA, 64 nt, Human
uuuuuugagaccaucaggggugguuacauagaccagcagcuacagcucuggaaauugaaaucau

SEQ ID NO: 303746 - RNA, 64 nt, Human
uguauagaucccagcaggauuaaggagguggaaaagcagcuaacauuucuugaggcucuaccac

SEQ ID NO: 303747 - RNA, 64 nt, Human
uuaguuacucaucuuccaugcuagguauaccuacagcagcuacaaugauucuugucccagagag

SEQ ID NO: 303748 - RNA, 64 nt, Human
gaugacacugguggcucuaaggauauugcaauuaagcagcuaccuguagccagguauucugcug

SEQ ID NO: 303749 - RNA, 64 nt, Human
agaucacagaaguaauugugccauauguggaacaagcagcuaagcaauagauaacauccaucgu

SEQ ID NO: 303750 - RNA, 64 nt, Human
uaggcacagguguaaaaaggggagauuucagaagacgggcgaaacaacugaugggggaagauac

SEQ ID NO: 303751 - RNA, 64 nt, Human
aguuuugguuccuccacuggaauguaggcuccucacgggcgauggcugucuuuucuugacuuug

SEQ ID NO: 303752 - RNA, 64 nt, Human
caauggugcuaagcugauagauuuaaauacacagacgggcgaguggcgcccgugucgaugucuu

SEQ ID NO: 303753 - RNA, 64 nt, Human
ccuggcgccgccaccgagacugagccuccugcagacgggcgaagccgccugcugcagcccagga

SEQ ID NO: 303754 - RNA, 64 nt, Human
gcugagaucacaucauugcacuccagccugggcaacgggcgagacucugucucaaaaaaaagaa

SEQ ID NO: 303755 - RNA, 64 nt, Human
ccacccccuggugccugcaggccacccagggaccacgggcgaggacgugaagccucccgaacac

SEQ ID NO: 303756 - RNA, 64 nt, Human
agcagcagccgcuuccucggcagccuugggaagcacgggcgacuggacagcagccgccgggcac

SEQ ID NO: 303757 - RNA, 64 nt, Human
aggaggaagacugcucugagcgugcggccuuguuacgggcgaaaggccacuggccauuccuggg

SEQ ID NO: 303758 - RNA, 64 nt, Human
guuccuuggcagacugccuuuccuggaagagggcacgggcgaucccgacgggggcauuccugcg

SEQ ID NO: 303759 - RNA, 64 nt, Human
ucagaaacugggcucaucacaccaaggcaaagcaacgggcgagucuuccuccuuguccuaguua

SEQ ID NO: 303760 - RNA, 64 nt, Human
gcaguucuaccacuccugcaagcaguauggcaucacgggcgaaaauguccgaggagaacugcug

SEQ ID NO: 303761 - RNA, 64 nt, Human
ucuccugcccguccuggccggggugccucuggggacgggcgacgcugcuguguguggucucaga

SEQ ID NO: 303762 - RNA, 64 nt, Human
cugccuacacacacagccuauaucaaacaugcacacgggcgagcuuucucuccgacuuccccug

SEQ ID NO: 303763 - RNA, 64 nt, Human
uuccucuucacccccagguuccugcuaagaucccacgggcgagggcuugcucuggacucagucu

SEQ ID NO: 303764 - RNA, 61 nt, Human
ccagagucaaaagggaagucgagggauggggcgucgucagcuggcacugucucugcugcag

SEQ ID NO: 303765 - RNA, 61 nt, Human
uauagaacuagucucaccacuugacucauuacgucgucauucuuguuacaucacucauacu

SEQ ID NO: 303766 - RNA, 61 nt, Human
gccucuauuggcucucggccuuggcaacggccgucgucaugguuacuggccccuaggcgcc

SEQ ID NO: 303767 - RNA, 61 nt, Human
cccagcgucucagggaccugucccuccgucacgucgucaaagugugccuugugucuugugu

SEQ ID NO: 303768 - RNA, 61 nt, Human
cccaguagcuauuccgauuggauauuccguucgucgucacauagcuggcuuuucucuccuc

SEQ ID NO: 303769 - RNA, 61 nt, Human
gagggugugauugacacagcaguggaaaaagcgucgucagcaggaaaacuggaucaugacu

SEQ ID NO: 303770 - RNA, 61 nt, Human
ccauucaucugcucguagaaucuccuuucugcgucgucauauuugaacuugucgaaccaga

SEQ ID NO: 303771 - RNA, 61 nt, Human
cggcaccucacucccccaaaaugacacccaccgucgucaggguagcauguauaaugcccac

SEQ ID NO: 303772 - RNA, 61 nt, Human
aaccaacguuuugaauaagucugugacuuaacgucgucaaguauggcauauugucaucaag

SEQ ID NO: 303773 - RNA, 61 nt, Human
caacuguuuaaccuguuuucagucuuauuuacgucgucaaaaaugauuuaguacuuguucc

SEQ ID NO: 303774 - RNA, 61 nt, Human
auacaggaacaccccugugcagcuacguuuacgucgucauuuauuccacagagucaagacc

SEQ ID NO: 303775 - RNA, 61 nt, Human
ccagugguguguugcaugcucaaaacagcagcgucgucauugaagucugcuugauuaaacc

SEQ ID NO: 303776 - RNA, 61 nt, Human
cuguaugaaaggagagagcaaagggugucugcgucgucaccaaaucguagcguuuguuacc

SEQ ID NO: 303777 - RNA, 61 nt, Human
gcaccccagccggccuucucuggggccuccccgucgucaagccucuauccugucugucccc

SEQ ID NO: 303778 - RNA, 61 nt, Human
cucgcagagcuccugacaaaggcggcuucugcgucgucacugcuucccggcgccauuccga

SEQ ID NO: 303779 - RNA, 61 nt, Human
cugacuguccaggcgcucccuucagccgccucgucgucagcguucuuagucaugcauuauu

SEQ ID NO: 303780 - RNA, 61 nt, Human
agcccagccccaccgaaaagcaaaaauuacacgucgucagccacucagcccuucucuccuc

SEQ ID NO: 303781 - RNA, 61 nt, Human
caugggaccagacgugaugcuggaaggugggcgucgucacgguuaaagagaaaugggcucg

SEQ ID NO: 303782 - RNA, 61 nt, Human
cuugucccuccucccuccccuguugucuggccgucgucaaccccaccuugacugaguguug

SEQ ID NO: 303783 - RNA, 61 nt, Human
ggaaaauggagagaagcgcacuuugcacagacgucgucaauuaagucccaauuugccacuu

SEQ ID NO: 303784 - RNA, 61 nt, Human
gcugagucaucaucaucaucaucaucauugucgucgucaucaucuugcugagugucucuug

SEQ ID NO: 303785 - RNA, 61 nt, Human
cacacaucaucauuaucaucaucaucauugucgucgucaucaucuugcugagucaucauca

SEQ ID NO: 303786 - RNA, 61 nt, Human
uuuuuggacuaagccuucaggagguggagcucgucgucagcucuccugcugugauguggaa

SEQ ID NO: 303787 - RNA, 61 nt, Human
ucucugacguggugccugcuggagggaggcucgucgucaccagcugacugcugguccggcu

SEQ ID NO: 303788 - RNA, 61 nt, Human
uuuugguuacaauuaguucucaucucccugucgucgucauuguuaucgugguugcugaugg

SEQ ID NO: 303789 - RNA, 61 nt, Human
ccagggcaguuuaugcuggugggccacuugucgucgucaaagucaagggaaaguucuccug

SEQ ID NO: 303790 - RNA, 64 nt, Human
uccccugggguggggugagggguaaguuuaggcuuucgcggaggggaggagacauggagccugg

SEQ ID NO: 303791 - RNA, 64 nt, Human
uucuucgccuccuuuauuuaauucauguuauuuauucgcggagcucuguucguguuggggagau

SEQ ID NO: 303792 - RNA, 64 nt, Human
uggagccucuuuuugcaaauaaaguuggugcagcuucgcggagaggagaggcgcugcagucugu

SEQ ID NO: 303793 - RNA, 64 nt, Human
ucuguggggacuguggacuucaucgagguguguguucgcggaacggacaggugagauggagacc

SEQ ID NO: 303794 - RNA, 64 nt, Human
ggcgggccugcagggacgccccugccuagcagccuucgcggaacucccggcaguguuagacgcg

SEQ ID NO: 303795 - RNA, 64 nt, Human
uacagcuaagagaaaagcuuaagaggccacacuauucgcggaauggcuuuagaggcagaugaag

SEQ ID NO: 303796 - RNA, 64 nt, Human
ggcacacaugugccugcgugggcucugccuugucuucgcggaagcauuccugauggaacaccca

SEQ ID NO: 303797 - RNA, 64 nt, Human
uucacggcuggcuauguggacagcaagagucguuuucgcggaagccgacuggcagccaggccug

SEQ ID NO: 303798 - RNA, 64 nt, Human
acacucggauugcucugggucuacccgcucgggguucgcggaaggggagguccccagcgguacg

SEQ ID NO: 303799 - RNA, 64 nt, Human
cagccuagcucgggccaagcggccaucggucuccuucgcggaagguaccaaguuugcaccacag

SEQ ID NO: 303800 - RNA, 64 nt, Human
cgcgcguccaaauccagacguucuccgcgggugcuucgcggacaaggugcagccaaccacacga

SEQ ID NO: 303801 - RNA, 64 nt, Human
ccugaggagaggcccucuggccgccucaacgcacuucgcggaccucagcccugcagcuggaggg

SEQ ID NO: 303802 - RNA, 64 nt, Human
ggcggggccagggaaaggcggggucagggcgggguucgcggaagaggcggguauaagaaugggg

SEQ ID NO: 303803 - RNA, 64 nt, Human
gucacagcagaaaccaacuuuucuaacgacugaguucgcggagauagcaucaucccugaucaag

SEQ ID NO: 303804 - RNA, 64 nt, Human
gucuucagcuuccuuuucuguugguuugguuuucuucgcggauggauugaguuacauguuuuaa

SEQ ID NO: 303805 - RNA, 64 nt, Human
ugggaagcgcacccugucguucagugacgucauucuucuccaggcuggcccgcccccucugacu

SEQ ID NO: 303806 - RNA, 64 nt, Human
aucugcgcuuuccagauaagcccaaagacagcaacuucuccacucaugacaaaucaacugugac

SEQ ID NO: 303807 - RNA, 64 nt, Human
accaggcagccucuagaguugcuuuacccaaauccuucuccagccaugacuuggugacucuaag

SEQ ID NO: 303808 - RNA, 64 nt, Human
acuuugacauuuccuaccuuuugaggacuugauccuucuccaggaagaaggugcuuucugcuua

SEQ ID NO: 303809 - RNA, 64 nt, Human
acacuuacugcuacucuguacccccagcccuacugcccaccagguuuccucucuuguccccuag

SEQ ID NO: 303810 - RNA, 64 nt, Human
aaaugugaauguaugagcugggggagucaacccagcccaccaugccuuggcugaugauaccaga

SEQ ID NO: 303811 - RNA, 64 nt, Human
cucagucaagacggaaguaaaggcucaggaaacagcccaccacagaggcagaugccaaaccaaa

SEQ ID NO: 303812 - RNA, 64 nt, Human
uccacagaagcacaacccagccaaacaccacagccuucuccagagccggcacugucccggcaac

SEQ ID NO: 303813 - RNA, 64 nt, Human
aggcugagccccgcgaccggagcgccgcucuccgcuucuccacccagcuaacuucugcucgucu

SEQ ID NO: 303814 - RNA, 64 nt, Human
gagagaggaaucaacauggcugcuuugcugcuuccuucuccaaagugacauauggagggaacuu

SEQ ID NO: 303815 - RNA, 64 nt, Human
uaguuagccuacuuggcauuuacuacaucggucacuucuccaggcugcccuaaauuagguugau

SEQ ID NO: 303816 - RNA, 64 nt, Human
gggacacugggcagcaaggcugcugccggaaucacuucuccaaucaguguuugguguauuauca

SEQ ID NO: 303817 - RNA, 64 nt, Human
cguucucuguccacugggugugcauugauuuaaacuucuccacuguggggaagcucugugaaau

SEQ ID NO: 303818 - RNA, 64 nt, Human
aaguuuuaaggaguauuucucgacagaugauuuucuucuccauuaauacccaugcuuuguuuuu

SEQ ID NO: 303819 - RNA, 64 nt, Human
ccugggauccucagaagccugacuguccuaugggcuucuccaguguccacaggggcuugggaug

SEQ ID NO: 303820 - RNA, 64 nt, Human
ccucugccccuccuccuuccagcaccugccagagcuucuccaggaggccaagcagaggcucccc

SEQ ID NO: 303821 - RNA, 64 nt, Human
cagcuucuugcuguucccaguagaaucgcuagcucuucuccagaggaaaaguacuaggauucuu

SEQ ID NO: 303822 - RNA, 64 nt, Human
uuucguuuuuuuuuuuuccaaaaauagugacuuccuucuccagguguguuugacagcaacucaa

SEQ ID NO: 303823 - RNA, 64 nt, Human
ugucauguugccuuguaacggauguuuccaccuccuucuccaaccucuaccccaccauuagugu

SEQ ID NO: 303824 - RNA, 64 nt, Human
aucccuuccaauguggugcuagcaggcaggaucccuucuccaccuccaaaggcccuaaagggug

SEQ ID NO: 303825 - RNA, 64 nt, Human
augggaucaaagaggacagccuuuccucccucaccuucuccaaaucuaggugaaaucacagagu

SEQ ID NO: 303826 - RNA, 64 nt, Human
aagccuuguugaagcugugagcaggagaagcggugcccaccagcuuccaggucucccugaccug

SEQ ID NO: 303827 - RNA, 64 nt, Human
cugcaggaaucccggcuccagagcaggaaauucagcccaccagccaccucauccccaacccccu

SEQ ID NO: 303828 - RNA, 64 nt, Human
gcaggauuugucccacucuguuuucucccucucagcccaccacccacagcucccuucucaucuc

SEQ ID NO: 303829 - RNA, 64 nt, Human
gggggaucacagccucugaaaaccaauguucucucuucuccaccucccacaaaggagagcuagc

SEQ ID NO: 303830 - RNA, 64 nt, Human
cuuuggcauguuacccaagccauggagagagccccuucuccaucccuguccugugccccccagg

SEQ ID NO: 303831 - RNA, 64 nt, Human
ccuuucagccucuacaacagagcagcuucccagacuucuccaggaacccagaaacgggaugguu

SEQ ID NO: 303832 - RNA, 64 nt, Human
gcccucucuguggaucccuacugcugguuucugccuucuccaugcugagaacaaaaucaccuau

SEQ ID NO: 303833 - RNA, 64 nt, Human
ccuaacccucccccuaccuuuaugagaggaauuccuucuccaggcccuugcugagauuguagag

SEQ ID NO: 303834 - RNA, 64 nt, Human
ucucacucaguuacuugguaucaccgccucucaccuucuccaucgugcauguccccagccacau

SEQ ID NO: 303835 - RNA, 64 nt, Human
ugggcugguuucuuucaaguuuaaaaaaagcccccuucuccaugcacaaguucauucccuccau

SEQ ID NO: 303836 - RNA, 64 nt, Human
caacccugugcucucuggcccccagcuggccacacuucuccaggagggacccuuggacuucuuu

SEQ ID NO: 303837 - RNA, 64 nt, Human
ugaaaagcuuaaugggcuggccaggcugugucaccuucuccaagcaaagccauauggagcaucu

SEQ ID NO: 303838 - RNA, 64 nt, Human
gcucuugcacugguauugaucuugaaccucuauacuucuccacuuuuuagagcggcgucuuagu

SEQ ID NO: 303839 - RNA, 64 nt, Human
ugcuggaguaaauaucauuagugccaaagggauucuucuccaaaacuuuagaugauaaaaugga

SEQ ID NO: 303840 - RNA, 64 nt, Human
ucggugcccugcuuccuccuccacuccuggccgccuucuccagcgccgcacacacagaugcuca

SEQ ID NO: 303841 - RNA, 64 nt, Human
gccaacuuucugaaauuucaaaacugaauugauccuucuccaaauuaguauauacuauuggaaa

SEQ ID NO: 303842 - RNA, 64 nt, Human
cgccccccgcacuccuucauagcagcaguaguggcuucuccauccuguuuucugcaacauucua

SEQ ID NO: 303843 - RNA, 64 nt, Human
uccuugaacccaacagucccuuaugagcgucacugcccaccaaaggucaaugucaagagaggaa

SEQ ID NO: 303844 - RNA, 64 nt, Human
gaaacaaaggcuuagcaaacaauuuuuguucaaugcccaccaagacauauagaauugggaacug

SEQ ID NO: 303845 - RNA, 64 nt, Human
agagcaauaggaggaaaaggaaagcguuuuuguagcccaccaucuacagcuuuacuguaaaacc

SEQ ID NO: 303846 - RNA, 64 nt, Human
aauuggucccaccucagccgcaccuugcuggaugcuucuccaguagugcugccccugugacagg

SEQ ID NO: 303847 - RNA, 64 nt, Human
uggaaagaguucaagugucuguauauccuauggucuucuccauccucacaccuucugccuuugu

SEQ ID NO: 303848 - RNA, 64 nt, Human
ccuaaguguggaaaagugucuucagauuuagacucuucuccaugucagcugcagcgccacccgc

SEQ ID NO: 303849 - RNA, 64 nt, Human
gcauggacugugagacuacucccuccuguuccuccuucuccaucccccauggaggaggcaucgc

SEQ ID NO: 303850 - RNA, 64 nt, Human
cuuauaguaccaucacuauaaucaacgaacuucucuucuccacccagagauggcuuuuccaaca

SEQ ID NO: 303851 - RNA, 64 nt, Human
agagagugauucugucuucauagagggugggguacuucuccauaaggcaucucagucaaauccc

SEQ ID NO: 303852 - RNA, 64 nt, Human
agguuccuugccaacccuccuccccugcccacaacuucuccaaacaaagcaggcuguuugcuca

SEQ ID NO: 303853 - RNA, 64 nt, Human
aagaauauaagugggggaguggccacagaaaauucuucuccacuuucuagccagaggagagagg

SEQ ID NO: 303854 - RNA, 64 nt, Human
gaacucuacuaccacgaccuccccauauuccucacuucuccaucaccuccagccugacucccug

SEQ ID NO: 303855 - RNA, 64 nt, Human
cuagaagcuuccuggcaaauagucccuuuagcuacuucuccagugcaguauaaauuguaacaua

SEQ ID NO: 303856 - RNA, 64 nt, Human
gcuugcugaugccaccagcugaaaaaagcccuuccuucuccaacucggugucugagaaguuuug

SEQ ID NO: 303857 - RNA, 64 nt, Human
acuagaauucaugugagaaagcuaaaaugguggucuucuccaccagccccucacaggcuugggg

SEQ ID NO: 303858 - RNA, 64 nt, Human
gcaauaaacuguuacagucaagaccauuaauggucuucuccaaaauauuuugagauauaaaagu

SEQ ID NO: 303859 - RNA, 64 nt, Human
acaccugauggugaaaccaaacaaauacaaaauccuucuccagaccccagaacuagaaaccccg

SEQ ID NO: 303860 - RNA, 64 nt, Human
gcuuccugcuccuuggagcuggcucccggaccuugcccaccauccaugcaguggcucccagggc

SEQ ID NO: 303861 - RNA, 64 nt, Human
uggcugccaggcucgccaggagcccacuggaaacgcccaccacgggggcuccuuguuacacaug

SEQ ID NO: 303862 - RNA, 57 nt, Human
gugugcugguguccaagugaggccggcgcccaccaugcuccugggcgcccacgcggc

SEQ ID NO: 303863 - RNA, 64 nt, Human
aaacaaaccugaaaacugcuuggcauuugaguagcuucuccaugcuauguauuuuuuuaagcaa

SEQ ID NO: 303864 - RNA, 64 nt, Human
ucagacuugugauuuggggagagcaacuucagggcuucuccauagaccuugaccauuauaagca

SEQ ID NO: 303865 - RNA, 64 nt, Human
aauuaaccuaaacguauuucacuaacucuggcuccuucuccauaaagcacauuuuaaggaacaa

SEQ ID NO: 303866 - RNA, 64 nt, Human
guucuguccaagacaguucagguuaauuaauuuucuucuccauugcuucaccuuaaggguuaau

SEQ ID NO: 303867 - RNA, 64 nt, Human
ucccgucagcuggaaaaggccuguggcccagaggcuucuccaaagggagggugacaugcuggcu

SEQ ID NO: 303868 - RNA, 64 nt, Human
ggcaccuccugucauuuuuguccugaugauguuucuucuccaauaucuucuuuuaccuaucaau

SEQ ID NO: 303869 - RNA, 64 nt, Human
auugaucacaaccaguuuguagauuucuuuguuccuucuccauucccacugcuucacuugccua

SEQ ID NO: 303870 - RNA, 64 nt, Human
guuuuuuaaaaaaaccaugcuuccuuuggauagacuucuccagccuaccaauauauauccaugu

SEQ ID NO: 303871 - RNA, 64 nt, Human
aagcagauaaguagcaguucaacuggaugucucucuucuccaaaugcuacaguacaaagcccua

SEQ ID NO: 303872 - RNA, 64 nt, Human
gcugugcugcgcucugagcuccugcuucaugcuucuucuccaacccagcucacucaccucucug

SEQ ID NO: 303873 - RNA, 64 nt, Human
cuuuaacccaagacccugccucuuccacuccacccuucuccagggacccuuagaucacaucacu

SEQ ID NO: 303874 - RNA, 64 nt, Human
gagaggcaugcaggcaggguccuaggagccccugcuucuccaggccucuugccuuugagucuuu

SEQ ID NO: 303875 - RNA, 64 nt, Human
cuggggguaaagcccucagaucccaggguacacucuucuccauucccuccacccacuugccugu

SEQ ID NO: 303876 - RNA, 64 nt, Human
ugcaaccaaccuacuccccuggaaagauggcuuccuucuccaauuagccugaaugagcuuuagu

SEQ ID NO: 303877 - RNA, 64 nt, Human
caagucagccucccugcgacugcccaggcacacugcccaccaccccacccccgaaacaaugcca

SEQ ID NO: 303878 - RNA, 64 nt, Human
uuccugugaaccaaaguucucaggccaaggucucgcccaccaaagccagaaagugcaagcaccc

SEQ ID NO: 303879 - RNA, 64 nt, Human
agccucagccucccgaauagcugggauuacacgugcccaccaccaugcccagcuaauuuuugua

SEQ ID NO: 303880 - RNA, 64 nt, Human
uuccccagcagccaccuccucugagaucccucaccuucuccaaaccagauccaaucaaaccuca

SEQ ID NO: 303881 - RNA, 64 nt, Human
agacucccuucccuuguuuuuuaaagauaccgugcuucuccacauccucauccuucaaggagca

SEQ ID NO: 303882 - RNA, 64 nt, Human
cauauuuaugccacuaccuccaccagggagaguccuucuccacaggcuugauaaauucaaucac

SEQ ID NO: 303883 - RNA, 64 nt, Human
guuuguacaauuuaccucauaagagaaccacacccuucuccaaaagugcugguacugcaucagu

SEQ ID NO: 303884 - RNA, 64 nt, Human
gaauuuggauaauaaagaugcuuauugucucucccuucuccaguucugggaauuuacaggcaca

SEQ ID NO: 303885 - RNA, 64 nt, Human
caauuucucauacuuagaaacaaaaagagcuuuccuucuccaggaauacugaacaugggagcuc

SEQ ID NO: 303886 - RNA, 64 nt, Human
acaagccuuacugccuggagggcuuagauuccugcuucuccaauguaguguggguaucuuguag

SEQ ID NO: 303887 - RNA, 64 nt, Human
cucuccucuggggccucgucuucccgaagguccccuucuccagugcuucccugggagaggccag

SEQ ID NO: 303888 - RNA, 64 nt, Human
auuucauacgagauaaaacagagagaaguucucucuucuccagcuuguccauuuccccacuuga

SEQ ID NO: 303889 - RNA, 64 nt, Human
guugcugcugcugcaccgcccgccuuugccucgucuucuccaaaacugaauuuucaccccccaa

SEQ ID NO: 303890 - RNA, 64 nt, Human
ugcaauuuuugacccugaccacuaacuagugauucuucuccaaaauugagaaagacagcaccca

SEQ ID NO: 303891 - RNA, 64 nt, Human
ucugccaccccaccaggaugcccauucuccaggacuucuccaacuuacuauuagacuaaaccag

SEQ ID NO: 303892 - RNA, 64 nt, Human
uugagcucccaucuagcuucagcagggcagaacccuucuccagauguguguaacuuaugucuug

SEQ ID NO: 303893 - RNA, 64 nt, Human
gacaaggugagcucgcugaguccagccucguggucuucuccaagaugccgccagaugcccagcc

SEQ ID NO: 303894 - RNA, 64 nt, Human
aucugccucauaggccacucuuuccuuucccucugcccaccaaguccucauaucugcagagaac

SEQ ID NO: 303895 - RNA, 64 nt, Human
ccuguccccagaggcugaggagaggggguacugugcccaccacacaugauuaggccucagaccc

SEQ ID NO: 303896 - RNA, 64 nt, Human
ugcugcauacccaccgcccagcuucucccugagggcccaccagccugugcugcauacccaccgc

SEQ ID NO: 303897 - RNA, 64 nt, Human
ggucccacguuuguuaucucugccuaaauguuagcuucuccauccucaccacaugaugaccugc

SEQ ID NO: 303898 - RNA, 64 nt, Human
cuuugacccccagacuuugcuccaucuauuauugcuucuccauccuggauccuugacauuuguc

SEQ ID NO: 303899 - RNA, 64 nt, Human
acucacagccuggcugugaugcuuguucgcucagcuucuccauuuaugagauggggagaauagu

SEQ ID NO: 303900 - RNA, 64 nt, Human
aggaauuauuuuccccccuuuuacaggguaguaacuucuccacagaagugccaauauggcaaaa

SEQ ID NO: 303901 - RNA, 64 nt, Human
uaagacaaaaauccucagcaguuguucuccaccccuucuccaccuccaccagcaaggagaaguc

SEQ ID NO: 303902 - RNA, 64 nt, Human
uucagcagcauggacagucacucuugcacuauuccuucuccaagccagaaaccacauuuaauuu

SEQ ID NO: 303903 - RNA, 64 nt, Human
gacugacauauuucaaaccaaucucuucuguggucuucuccaucucaguuaaugcaacuucaac

SEQ ID NO: 303904 - RNA, 64 nt, Human
cccaguggagacccaggaguuccuuuccugcacucuucuccauccucccaccuuugcugggcuu

SEQ ID NO: 303905 - RNA, 64 nt, Human
cccugauuagacaggaucaauuguaaagugagggcuucuccaugacaccauaguucugcccaau

SEQ ID NO: 303906 - RNA, 64 nt, Human
guaggacaacuuugaaucaaaauaaauuauguuccuucuccaauuugaagcauugaggauaaau

SEQ ID NO: 303907 - RNA, 64 nt, Human
ucuuaaucucuccagaagggauacugcauugguucuucuccaucagcuggcuuagacaucaaac

SEQ ID NO: 303908 - RNA, 64 nt, Human
agcaggagucuguccuucaggccccacagugcagcuucuccagggccgacagcugagggcugcu

SEQ ID NO: 303909 - RNA, 64 nt, Human
ugagaucccacuggaggguaggggugguaauaaacuucuccaaacgaucguugucauuuuagac

SEQ ID NO: 303910 - RNA, 64 nt, Human
uaggcucagcugagggcugccuucgccaugaauccuucuccaucaaaaauaaggauuaauuuag

SEQ ID NO: 303911 - RNA, 64 nt, Human
aggcagcauaaaggacucaaggaccacagccucugcccaccagcauguuccuugaagcccaucg

SEQ ID NO: 303912 - RNA, 64 nt, Human
gccccacuucucccagccuggugcuguccucucggcccaccaucggccagguccagcgcuuccu

SEQ ID NO: 303913 - RNA, 64 nt, Human
ggugcccagcccccuuuccucaccugauacccaagcccaccacuuuuauuuucuggugaggugg

SEQ ID NO: 303914 - RNA, 64 nt, Human
ucugucauccgugcucuguuuccuuuuggaguuucuucuccacauuaucuuuguuccuggggaa

SEQ ID NO: 303915 - RNA, 64 nt, Human
uuucucaguaaucauuguaaaccuuuuuuuuuuucuucuccacucuaacaaaaguaaaagaaca

SEQ ID NO: 303916 - RNA, 64 nt, Human
acugguaaaggagcuucguugcgaacuugaucagcuucuccaggauaaaauuaaaaacccaagc

SEQ ID NO: 303917 - RNA, 64 nt, Human
ccaguguuuccggcaaaaccacauucaugggacacuucuccagguuuuucauuuguugcaagcc

SEQ ID NO: 303918 - RNA, 64 nt, Human
ugagacuuuuaaguuauuaauuuuuuaaaaugugcuucuccaucuaaauuuugcuuagucuaca

SEQ ID NO: 303919 - RNA, 64 nt, Human
cuuaucagagaguaccacccaacacuuuugcuuucuucuccaucucugaagaucugcucaagac

SEQ ID NO: 303920 - RNA, 64 nt, Human
cucccuggcuguuccuuucaggcuuccgugcaggcuucuccacuugcccaugcacaguaggguc

SEQ ID NO: 303921 - RNA, 64 nt, Human
uggggcuagacugggcuggcugccuucugcggagcuucuccagccaccaaggcugccugcccca

SEQ ID NO: 303922 - RNA, 64 nt, Human
aucuguccuauuuguuauucaucccgcugcucaacuucuccaguauguugcuucccuuaaguug

SEQ ID NO: 303923 - RNA, 64 nt, Human
agcuuccccuugccggcuuagcugugggggaccccuucuccacccucucccugagcacaggccg

SEQ ID NO: 303924 - RNA, 64 nt, Human
uuaccuggguggacagcagugaaucuccaccugucuucuccagggagcucccauguuggggcug

SEQ ID NO: 303925 - RNA, 64 nt, Human
cgauuuuuucuuguagaaauguugcccuauuugucuucuccaauguaugguauguuauuuuauu

SEQ ID NO: 303926 - RNA, 64 nt, Human
acaccuuagggucuuagacucugcugauacuggacuucuccauaaaguccugcugcaccguuag

SEQ ID NO: 303927 - RNA, 64 nt, Human
cuuggaaugcggggagaccgacggugcgaaggcccuucuccacccgcaggugggccaagcucug

SEQ ID NO: 303928 - RNA, 64 nt, Human
gcucagccuguuucucucugcccucuagagcaaggcccaccagguccauccaggaggcucuccu

SEQ ID NO: 303929 - RNA, 64 nt, Human
guuaaugaguuacauuaucagccagcccagccuugcccaccauuuaagaaauaucacagagcca

SEQ ID NO: 303930 - RNA, 64 nt, Human
ccaacuucccuacuggcugcuccccuugggucccgcccaccagcggacucggcccccaaggcuc

SEQ ID NO: 303931 - RNA, 64 nt, Human
uggggggggcgccuuagguacuuauuccagaugccuucuccagacaaaccagaagcaacagaaa

SEQ ID NO: 303932 - RNA, 64 nt, Human
ugccucagccucccaaguagcugggauuacaggugcccaccaccaugccuggcuuaauuuuuug

SEQ ID NO: 303933 - RNA, 64 nt, Human
auuuguguggaccaaucuacucggggaauuccaggcccaccaggacacgugccaauggccccau

SEQ ID NO: 303934 - RNA, 64 nt, Human
gcuuuaugagcccauuagcacuuugguucaaggggcccaccaagucuuggacgggaaggcgcua

SEQ ID NO: 303935 - RNA, 64 nt, Human
uccuggggccagcaaugugguuccugugcacugagcccaccagccacagugcccauguccccuc

SEQ ID NO: 303936 - RNA, 64 nt, Human
cugugucucuggcuacagcaagaccagcccaggagcccaccagcaccugccucucagcuacuug

SEQ ID NO: 303937 - RNA, 61 nt, Human
ucauccucuccacaaaguagacccucuccgagcccaccagccacagaauauuauguaaaga

SEQ ID NO: 303938 - RNA, 64 nt, Human
cacaaucauguagcagaauggcacccagaccacugcccaccagugacggacaugcacguggcag

SEQ ID NO: 303939 - RNA, 64 nt, Human
ccagugcaauucugaggcuaggggaauaggagaagcccaccagcugccccugccacccacgggg

SEQ ID NO: 303940 - RNA, 64 nt, Human
gagaggaccgccggccucagcuacuagcccaccagcccaccagggagaaaagaagccaugagag

SEQ ID NO: 303941 - RNA, 64 nt, Human
gagcucagaugugggcaggaauucccaaaccugagcccaccaaggacucacaagugguccagaa

SEQ ID NO: 303942 - RNA, 64 nt, Human
cagaacagaagccauguaucucccccacaccagggcccaccauggagcuuguguucucagaauc

SEQ ID NO: 303943 - RNA, 64 nt, Human
cccuggagugugucagagcccaggggagaaugcagcccaccaggagcaccuggacccccugccc

SEQ ID NO: 303944 - RNA, 64 nt, Human
cuggagcugaugacgggggaggcccguccgccuggcccaccaacccgcccaccuugacugcccc

SEQ ID NO: 303945 - RNA, 64 nt, Human
cccucaagaaguugugcccuuccccgccugcgaugcccaccauggccuauuuucuuggugucau

SEQ ID NO: 303946 - RNA, 64 nt, Human
gugccucuccuggcccugaaggugccacuccagugcccaccagccuuguccuaauaaaauuaag

SEQ ID NO: 303947 - RNA, 64 nt, Human
cuuuccuggaccccccagcuggccucugaagcuggcccaccagagcugccauuugucuccagcc

SEQ ID NO: 303948 - RNA, 64 nt, Human
cccugccccuggcaagugcucccaucgccccggugcccaccaugagcucccagcaccugacucc

SEQ ID NO: 303949 - RNA, 64 nt, Human
ucaggagccagcccucuuccauccgcccggcucugcccaccaccacugccaggcugaacagggg

SEQ ID NO: 303950 - RNA, 64 nt, Human
gaaaccccaugggcccguucugauugaaggugaagcccaccagauuauuuuucaaagucuuagg

SEQ ID NO: 303951 - RNA, 64 nt, Human
ucuguccccaggaccuaugcucccugcucacccccuucuccaaagcccaagcgucccgcugcuc

SEQ ID NO: 303952 - RNA, 64 nt, Human
aaugggcaaggagucucuagcaugcagcccaggccuucuccauaccccucuccccagcaucaug

SEQ ID NO: 303953 - RNA, 64 nt, Human
uuccccaaauacuaggcucagagcaaccuccagccuucuccagcaggaucugcucccugugucc

SEQ ID NO: 303954 - RNA, 64 nt, Human
gagucucccaaggcugcgucuggaggggccccugcuucuccagccuggacccccagcuuugccc

SEQ ID NO: 303955 - RNA, 64 nt, Human
ccacagccaggcccugggcccaagccccuugucccuucuccacugccccucuuuccagacagua

SEQ ID NO: 303956 - RNA, 64 nt, Human
cuggacaaggcagucaucacauaagaacagcuaccuucuccacuugguggcacaagagguaggg

SEQ ID NO: 303957 - RNA, 64 nt, Human
ccucaugaaggaugccacugcuuucugugcagaacuucuccaugucaagcagcaggugucagca

SEQ ID NO: 303958 - RNA, 64 nt, Human
cugcucagauaugacuccugggcaauucacuuaacuucuccauggcugcuuccugcugaauaaa

SEQ ID NO: 303959 - RNA, 64 nt, Human
uggggugggggugggcuuuggucuuagcacuuuccuucuccagauccccccuacccaccccagu

SEQ ID NO: 303960 - RNA, 64 nt, Human
ugucagaauuaagcugccucaguaacugcucccccuucuccauauaagcaaagccagaagcucu

SEQ ID NO: 303961 - RNA, 64 nt, Human
ucaccucugaugucugugacaugucugggaaggccuucuccagcuuccuggagcccacccuuua

SEQ ID NO: 303962 - RNA, 64 nt, Human
gaagcuggaaguuugggaaaggcccaagcugggacuucuccaggccuguguucccuccccagga

SEQ ID NO: 303963 - RNA, 64 nt, Human
guccacagcaccauucccaguguagacucccagucuucuccacauugcugucauggcgucaguu

SEQ ID NO: 303964 - RNA, 64 nt, Human
cggaccauucacugcuaagcacaggcuccucacucuucuccaucaggcauuaaaugaauggucu

SEQ ID NO: 303965 - RNA, 64 nt, Human
ccuaaccccuagccgucaucuccacacucaccaggcccaccaggggagggggcuggccuggggg

SEQ ID NO: 303966 - RNA, 64 nt, Human
accugagcuauucucacucggaccuggggaaacggcccaccaaggacagcuacacgcugacgga

SEQ ID NO: 303967 - RNA, 64 nt, Human
acgcacccuccaggaugcucgcugggauucccacgcccaccacugucccccaccccauggcugg

SEQ ID NO: 303968 - RNA, 64 nt, Human
uccucacgauggcugugucagcccagccccuucccuucuccaggcccagagaacucuuccacaa

SEQ ID NO: 303969 - RNA, 64 nt, Human
gaaggugggcugcgccccacagaacuggcagcagcuucuccacugucaucaaacuggccauguc

SEQ ID NO: 303970 - RNA, 64 nt, Human
ucagaauuuuguuggucugaauacaaacauuucacuucuccaacaaguaccugugaacaguaca

SEQ ID NO: 303971 - RNA, 64 nt, Human
gauacuugcuggagaccucagaaaacacaagugccuucuccacggugcaauucagacuucagug

SEQ ID NO: 303972 - RNA, 64 nt, Human
gaggugggggccucuccagggcacaucuggaguucuucuccagcuuacccuagggugaccaagu

SEQ ID NO: 303973 - RNA, 64 nt, Human
uaucuugguggcucccugccacugcccaccgccucuucuccaucugagaaucacggagaggugu

SEQ ID NO: 303974 - RNA, 64 nt, Human
ucauuauuucaccaagccaauaccagccgccauccuucuccagaauucuuguaaauaaaauaaa

SEQ ID NO: 303975 - RNA, 64 nt, Human
uuuccagaauaguaaucuuuuuccagcguucucucuucuccaaugcccugguuguuauuuuucc

SEQ ID NO: 303976 - RNA, 64 nt, Human
cuuugcuaaccucccuuaugcucuguauacaacacuucuccaucccccaacuggugucuuaccc

SEQ ID NO: 303977 - RNA, 64 nt, Human
uuugccacuguguggcaguuacccgugccuuagucuucuccacucugcacccuaccucgugggc

SEQ ID NO: 303978 - RNA, 64 nt, Human
uaugguuuuuuggccuuauuuucacuggcuuuuccuucuccaaacuuugaggcgugauuucauu

SEQ ID NO: 303979 - RNA, 64 nt, Human
cuuucucagcuucuuuggccuucuguaagaggggcuucuccaagagcaugucacuaguuuucua

SEQ ID NO: 303980 - RNA, 64 nt, Human
gaggaggcacagaccagugucuggaucccagcaucuucuccacuucagcgcugaguucaguaua

SEQ ID NO: 303981 - RNA, 64 nt, Human
caacuuccuguggcccccacaagcugagucuggccuucuccagcuggccccaaaaaaggccuuu

SEQ ID NO: 303982 - RNA, 64 nt, Human
aaaccagcacuccaugaagauaaacucugggcccgcccaccagcaggaccugucgaccugaggu

SEQ ID NO: 303983 - RNA, 64 nt, Human
ccagcccuuaaaucccccagcuuccaaacuugaggcccaccaucuccaccaucugguaauaaac

SEQ ID NO: 303984 - RNA, 64 nt, Human
ugccucagccuuccaaguagcugggauuacaagugcccaccaccaugcccagcuaauuuuuaua

SEQ ID NO: 303985 - RNA, 64 nt, Human
caguggacccaagcucaggaccuucguggagcugcuucuccaaccugagaaacucaagacccau

SEQ ID NO: 303986 - RNA, 64 nt, Human
ugggcagugcccgcgccauggggugcucugugggcuucuccaggagcagggaggguggagggga

SEQ ID NO: 303987 - RNA, 64 nt, Human
ggcuguuaagguuucuguuuuacuuugguuuuugcuucuccauuuuucauuugcuuuauuucua

SEQ ID NO: 303988 - RNA, 64 nt, Human
cguucggacugacuuuauucauauuuccaucaaacuucuccaauacaguaagagauaguguuga

SEQ ID NO: 303989 - RNA, 64 nt, Human
cucuguuuaucucuccccucccuccccuccccuucuucuccaucuccauucuuuugaauuuccu

SEQ ID NO: 303990 - RNA, 64 nt, Human
accugcccagugggccccgcugcagcuguguguccuucuccaucuacacggccuggggcgagca

SEQ ID NO: 303991 - RNA, 64 nt, Human
uugaugcuaaauaggagauaccagguugaaagaccuucuccaaaugagaucuaagccuuuccau

SEQ ID NO: 303992 - RNA, 64 nt, Human
agugguugagguguuguccugcaguugucauugucuucuccaccgggcuguucccauuuauuuc

SEQ ID NO: 303993 - RNA, 64 nt, Human
ucuguccacuguccuggcuuguuccaagcgcugccuucuccaacugggguccuggcugcagagc

SEQ ID NO: 303994 - RNA, 64 nt, Human
uaccacuccccauccccgucugaccaagggcugacuucuccaggaccuagucgggggguggcug

SEQ ID NO: 303995 - RNA, 59 nt, Human
aaaacgaguuagaccagugauguaccgcgcuucuccacgguagaggcguguucucaguu

SEQ ID NO: 303996 - RNA, 64 nt, Human
guuuuuuuuguuguuuuuagauacuaaaucgucccuucuccaguccugauuacuguacacagua

SEQ ID NO: 303997 - RNA, 64 nt, Human
agguauggacugggggccagaguccuuuccaaggcuucuccaauucugcccaaaaauaugguug

SEQ ID NO: 303998 - RNA, 64 nt, Human
cuaaaaccaaccaacugauaaaaaguagaugagacuucuccaagcugcuucacaagcaaacuaa

SEQ ID NO: 303999 - RNA, 64 nt, Human
ggguauucaccacccugggaccccccccccccccgcccaccagaccuguucugaccucaugagu

SEQ ID NO: 304000 - RNA, 64 nt, Human
cucaacccgcccugcagccucggccuccgccccggcccaccaccucgcuacugcuggaaccgcg

SEQ ID NO: 304001 - RNA, 64 nt, Human
cugcuccugaaguuguagagagcaagcugaagcugcccaccaucaagaugcccucccuuggcau

SEQ ID NO: 304002 - RNA, 64 nt, Human
uuacaacaguaaauuuuuuuauaagugcuucucccuucuccaugaugugacuuccggagauaaa

SEQ ID NO: 304003 - RNA, 64 nt, Human
agucacauuaagcuauaguagaaggaauuggacacuucuccagauauuuggcuucaaaggagua

SEQ ID NO: 304004 - RNA, 64 nt, Human
gugaguggucugugugaggcuguuccuucaguuucuucuccagacuguucuuugguugucacua

SEQ ID NO: 304005 - RNA, 64 nt, Human
uagggcugaggcaggauuuggaaucaggccaugucuucuccagagcccacauccauccuuucuc

SEQ ID NO: 304006 - RNA, 64 nt, Human
uggcaaggggugacacaaaguagcaaacugaauacuucuccaauagcaaccccaagcuaccucc

SEQ ID NO: 304007 - RNA, 64 nt, Human
cagcuuuauguacccuguccaccaucuugugccucuucuccauuugccucuuccuuccuauuuc

SEQ ID NO: 304008 - RNA, 64 nt, Human
aacaaguauuugugaagugacugagaaucuagcacuucuccacuuguagcugcacuuuaagucu

SEQ ID NO: 304009 - RNA, 64 nt, Human
ggcguccaggaaagcagcugcacucagacaaugccuucuccauuacuugaagcuucuuucuguu

SEQ ID NO: 304010 - RNA, 64 nt, Human
caggaaaagaagauuggaaaaagaccaaaacacacuucuccagcaacacuccaucagcuuuuua

SEQ ID NO: 304011 - RNA, 64 nt, Human
gugaccacuuaaagcugcucguuagcauggaagacuucuccauucuaucuuuguaaaacagaca

SEQ ID NO: 304012 - RNA, 64 nt, Human
auccuugucuuuuuaugacaggauguuugcucagcuucuccaacaauaagaagcacgugguaaa

SEQ ID NO: 304013 - RNA, 64 nt, Human
cuuuuuguuccccuuugcuucauucaagucagcucuucuccauccuaccacaaugcagugccuu

SEQ ID NO: 304014 - RNA, 64 nt, Human
ugguccuuuauaaauagccagccagcgucacccucuucuccaauuuguagguguauuuuaugcu

SEQ ID NO: 304015 - RNA, 64 nt, Human
uaaaucaaaccaggugcaauuauuucuuuauuuucuucuccaguggucauugggcaguguuaau

SEQ ID NO: 304016 - RNA, 64 nt, Human
ccuuugguaggaauggccugaguuggcguugugggcaggcuacugguuuguaugauguauuagu

SEQ ID NO: 304017 - RNA, 64 nt, Human
uuccugcggcuuagaagggaaagcgccagagagggcaggcuacagugcuucacacccuucgcca

SEQ ID NO: 304018 - RNA, 64 nt, Human
uggaguggauagcauuguuuucuuuuacagacuagcaggcuacugggaccuaaaaaggucuguu

SEQ ID NO: 304019 - RNA, 64 nt, Human
cuuaccccuggcaaaggacucacaagucacuucucuucuccauaguacauggacuuguuacaga

SEQ ID NO: 304020 - RNA, 64 nt, Human
guagaaaucuggaaaguucauuuccugggauucacuucuccagggauuuuuuaaaguuaauuug

SEQ ID NO: 304021 - RNA, 64 nt, Human
ccuucugauucguaaggguuacgaaacucauguucuucuccaguccccugugguuucuguugga

SEQ ID NO: 304022 - RNA, 64 nt, Human
ccacuugaagauccaaauucccaacuaguauucucuucuccacacuuaauccaguuccuaaaga

SEQ ID NO: 304023 - RNA, 64 nt, Human
aucugcacaacugggcacuggacagcuuuuccuucuucuccagugucuaccuuccuccucaacu

SEQ ID NO: 304024 - RNA, 64 nt, Human
cacuuguauuuccuaauuuauguaucuuggucagcuucuccacaagcuuaccuaauuguuuaua

SEQ ID NO: 304025 - RNA, 64 nt, Human
ccacuggaacccuuuccagaacugcuguuugguucuucuccauccucaauuuugccacuuucau

SEQ ID NO: 304026 - RNA, 64 nt, Human
uccugggucacuuccaccacugguaaagccagaacuucuccaaaaagaaccuugcaaaaagucc

SEQ ID NO: 304027 - RNA, 64 nt, Human
aguuuggagggugauggguagagcuuuccagaaccuucuccauuccagaaucucugccccugug

SEQ ID NO: 304028 - RNA, 64 nt, Human
cuucuggucccugcgcuuugguauaauauauauacuucuccauacacagaccucugcagaaugc

SEQ ID NO: 304029 - RNA, 64 nt, Human
aggcauacugcauucuguggaucaguuugaacagcuucuccaccuuauuuggacagugauaaau

SEQ ID NO: 304030 - RNA, 64 nt, Human
cuuuucucagacaugcgggagccaggagagcacccuucuccacucagcuccaaagcgaaucuuu

SEQ ID NO: 304031 - RNA, 64 nt, Human
acucuagcaacuauuacaguauaacacagaugaucuucuccacacaccccaucacccagauaau

SEQ ID NO: 304032 - RNA, 64 nt, Human
aagcuagcucuagcaugaagcuuuuuuggauuggcuucuccaucguguugggguaacauuuuuu

SEQ ID NO: 304033 - RNA, 64 nt, Human
ugccucagccuccugaguagcugggacuacaggcgcccaccaccacgcccggcuaauuuuuugu

SEQ ID NO: 304034 - RNA, 64 nt, Human
uuaccacugaaacacuucgagcuauuuagcuaaagcccaccaaaccaaaacaaaauacugauuu

SEQ ID NO: 304035 - RNA, 64 nt, Human
gaacuugcaaacaggcugauaccuuugugaaguugcccaccaaaacacagaaggaaaaaaacau

SEQ ID NO: 304036 - RNA, 64 nt, Human
accauuuaugagacauucuugcuauaacuaagugcuucuccaagaccccaacugaguccccagc

SEQ ID NO: 304037 - RNA, 64 nt, Human
agccaguguuuuucaacuauguuuauccagacuccuucuccacaaugaugaauccacaguuggu

SEQ ID NO: 304038 - RNA, 64 nt, Human
gaaacugaauguuuauuccuugauacuaaaaguucuucuccaauccuaucacugauagugucca

SEQ ID NO: 304039 - RNA, 64 nt, Human
aaaaaaaaaaaaaaaaaaaaaaaaaaaaaagauacuucuccaaaguguucucauguggccucac

SEQ ID NO: 304040 - RNA, 64 nt, Human
gagaauacuggcccugucgacuauugccacccugcuucuccaagagcagaccaggccaccucau

SEQ ID NO: 304041 - RNA, 64 nt, Human
agccaccugucuuccacuguaucuacuguacgaacuucuccagcucugcucuguuuucucuucc

SEQ ID NO: 304042 - RNA, 64 nt, Human
cauuuguaucuaagacuccaaggcaccaaggucucuucuccauuguugcucucuauacccgacc

SEQ ID NO: 304043 - RNA, 64 nt, Human
ugguaagcagaggcuuugggguccuagcccagugcuucuccaacacugaagugcuugcagauca

SEQ ID NO: 304044 - RNA, 64 nt, Human
aacccaaccccaugccucacagagcuuccuguggcuucuccagccuuucucccucacaucagga

SEQ ID NO: 304045 - RNA, 64 nt, Human
cccccagggcugcuccccacuugcagcacaaugccuucuccaccugcccucccacucuuccagu

SEQ ID NO: 304046 - RNA, 64 nt, Human
cuggcgauuccaggagacccagcuggaaaccuggcuucuccaugugaggggaugggaaaggaaa

SEQ ID NO: 304047 - RNA, 64 nt, Human
ucugagaaacauuucuguugcgcuacugacucuccuucuccacauuuguuguguuccuagggcu

SEQ ID NO: 304048 - RNA, 64 nt, Human
cauuuucuucucguguguggcccacaucccuccacuucuccaacuucuguuuaaucugaucacg

SEQ ID NO: 304049 - RNA, 64 nt, Human
ggaaucauuguuuacacauggggaucagagcagacuucuccacuacugugcaauagagauacag

SEQ ID NO: 304050 - RNA, 64 nt, Human
ccgacugcuggaacccagccagugggagggccuggcccaccagaguccugcucccucacuccuc

SEQ ID NO: 304051 - RNA, 64 nt, Human
cgaggggguggggacugagccgcccgccucugccgcccaccaccaucucaggaaaggcuguugu

SEQ ID NO: 304052 - RNA, 64 nt, Human
gccauaccucaaagauauuguggauuggguugcagcccaccacaauaaagcaaauauugcuaua

SEQ ID NO: 304053 - RNA, 64 nt, Human
gaaaaaggaaaacggggcacaggccauucgacgccuucuccaaggggucugauuugcugagaca

SEQ ID NO: 304054 - RNA, 64 nt, Human
caucacaugaccacauagcaugaggccacugcugcuucuccauggccaccuuuucagcgaugua

SEQ ID NO: 304055 - RNA, 64 nt, Human
uaauaagccaucuaaguguaaaaguggcucauaucuucuccagccaaaucagcuaggccauggc

SEQ ID NO: 304056 - RNA, 64 nt, Human
ugucugucuggcccuaaauguauccauguggcuacuucuccagcccccuccuucccucucuucu

SEQ ID NO: 304057 - RNA, 64 nt, Human
aaaacggauccaagaagaaaagagaauuuauuuccuucuccacucucuccaugcccuggagaaa

SEQ ID NO: 304058 - RNA, 64 nt, Human
acaggcuucaagugggaaggccccuacuuuugcacuucuccaagugcaggucacaccaggggca

SEQ ID NO: 304059 - RNA, 64 nt, Human
gagaaauacuugaacuugccucuuuuaccugcugcuucuccaaaaaucugccuggguuuuguuc

SEQ ID NO: 304060 - RNA, 64 nt, Human
agaaagaaacuuccuaccuggucagcuuuuucagcuucuccaacaaaugggaguugaggcagua

SEQ ID NO: 304061 - RNA, 64 nt, Human
ccucucccagcuuuucccagcuuuccccacugagcuucuccaguccaugcucuucuggacgugg

SEQ ID NO: 304062 - RNA, 64 nt, Human
ugaguuucaguccgugacuuggguggcacccuaucuucuccaucagggaugguagcuauuuuuc

SEQ ID NO: 304063 - RNA, 64 nt, Human
cacguuuccccucauucauguggcuguacuuaaccuucuccaacauacauccugcauuacauga

SEQ ID NO: 304064 - RNA, 64 nt, Human
uuuuaauagaaccuguaacuucauuuuggaaaugcuucuccaccaaauaagggcuuuuuccccu

SEQ ID NO: 304065 - RNA, 64 nt, Human
aaaugccaaaaagcacugucuaguugaaaguucccuucuccacccaggggcagugaaggaggag

SEQ ID NO: 304066 - RNA, 64 nt, Human
ggauguuacucauaaaacagauaaucaaauagaucuucuccaggauucccaaaaagcuuuuggc

SEQ ID NO: 304067 - RNA, 64 nt, Human
ugccucagccucccgaguagcugggauuacaggcgcccaccaccaugcccggcuaguuuuuuug

SEQ ID NO: 304068 - RNA, 64 nt, Human
ccuugccugguuccauauggcuccuuccagcccugcccaccaagugcagcucccacuuuccauc

SEQ ID NO: 304069 - RNA, 64 nt, Human
gcuccagccauugcggugguuucuagauagccaggcccaccaagagauauugccccuugaugag

SEQ ID NO: 304070 - RNA, 64 nt, Human
gggggaaaugggucuuuucaucaaggcaacuccccuucuccaagucacuuacaucauagauaaa

SEQ ID NO: 304071 - RNA, 64 nt, Human
cauuuuaaagugucggaauuuagccucugaauaccuucuccauugggggaaagauauucuugga

SEQ ID NO: 304072 - RNA, 64 nt, Human
cccugacacaggcugacacauucuuucuccuuuccuucuccaaaggcuuggaguuuucuucuga

SEQ ID NO: 304073 - RNA, 64 nt, Human
acuuccuaguauaaaacugcaagaauaaaaguaacuucuccagcuguaucgacuagugucuuga

SEQ ID NO: 304074 - RNA, 64 nt, Human
uuauuuucaguuacuaucccugacacucuggaaucuucuccauuucucccuaucacucaauuuc

SEQ ID NO: 304075 - RNA, 64 nt, Human
uguaaaguuguguauguuuuugcuucccauguaacuucuccaguguucuggcaugaauuagauu

SEQ ID NO: 304076 - RNA, 64 nt, Human
aguaguagaaaugaaugcauuuauucauuccuuccuucuccaauaguguuuaaguacaaucuuu

SEQ ID NO: 304077 - RNA, 64 nt, Human
ccauccagggcaaggacagacuaaaagagcauaucuucuccagaaguccuagaaacaucucauc

SEQ ID NO: 304078 - RNA, 64 nt, Human
guguuuggacugcaguuugccacccugagaacaccuucuccaggacuggcauuucagaaucaga

SEQ ID NO: 304079 - RNA, 64 nt, Human
ggccagucaguuuggcccagcaaacauguggguacuucuccaccuagggaagccacugaagaug

SEQ ID NO: 304080 - RNA, 64 nt, Human
uuuuucagccccggagaggguccugaccugggggcuucuccaagccucacugcgccagccuccc

SEQ ID NO: 304081 - RNA, 64 nt, Human
ccuccucuugguccacuugcuaaugcccaguuuucuucuccauuuccacuuuuucuuaggcucc

SEQ ID NO: 304082 - RNA, 64 nt, Human
uaacuaucaccagugcaucacaucugcacacucucuucuccauucccuagcaggaacuucuagc

SEQ ID NO: 304083 - RNA, 64 nt, Human
ugagauucccucaccugucgcuuccuagaauccccuucuccaaacgauuagucuaaauuuucag

SEQ ID NO: 304084 - RNA, 64 nt, Human
ugccucauccucccaaguaggugggauuacaggugcccaccaccaagcccugcaaauuuuuuug

SEQ ID NO: 304085 - RNA, 64 nt, Human
ugcggggaggcucuuuuucucccuggccuccagugcccaccaggaggaucugcgcacggugcac

SEQ ID NO: 304086 - RNA, 64 nt, Human
agugcccaccaggaggaucugcgcacggugcacagcccaccagagcacuacagccuuuuauuga

SEQ ID NO: 304087 - RNA, 64 nt, Human
ggauuacaggugugagccaccucgccugggcccccuucuccauaugccuccaaaaacauguccc

SEQ ID NO: 304088 - RNA, 64 nt, Human
aggggccggcaggugcucgaugggccccccagggcuucuccagggcagcacagggaccccggau

SEQ ID NO: 304089 - RNA, 64 nt, Human
uuacagccacaacacuuggauuccuguugauuaacuucuccauucucuuaagcaccuuuagaag

SEQ ID NO: 304090 - RNA, 64 nt, Human
ggaugaccuggauaacuuagguggcaagcugugacuucuccaggucucacgggcaugggcacuc

SEQ ID NO: 304091 - RNA, 64 nt, Human
uaguugggaaccaguguugaucucucucccuuaccuucuccacuuguucaacagacucugaaug

SEQ ID NO: 304092 - RNA, 64 nt, Human
uuuuauucuggauggauuugaagcaaagcaccagcuucuccaggcucuuuggggucagccaggg

SEQ ID NO: 304093 - RNA, 64 nt, Human
uccacuacuauacaagaaagaauucagcaagcugcuucuccaaucaaagcugccugccgugcuc

SEQ ID NO: 304094 - RNA, 64 nt, Human
ucaaauucuuaucuuuuccaagccaguaaguuggcuucuccauuccuggugucugauauucuug

SEQ ID NO: 304095 - RNA, 60 nt, Human
cgagauggggggcgcauugauggcauuccucuucuccacaucugcucguucuugccgagg

SEQ ID NO: 304096 - RNA, 64 nt, Human
gucauagguauuaauaauaaaagccucaaugcagcuucuccauguaguuccucuccuacaagcc

SEQ ID NO: 304097 - RNA, 64 nt, Human
cuccucgauaggccacuggcccugcacccuuuaccuucuccacucuuugaucagaaacagggua

SEQ ID NO: 304098 - RNA, 64 nt, Human
ggccuuccagcugcugucuucuggacaggcucugcuucuccaaggaaaccgccuaguuuacugu

SEQ ID NO: 304099 - RNA, 64 nt, Human
ugaugcccgagggcugggcccuugagucucuccucuucuccaucuucacuggcuuccccagcca

SEQ ID NO: 304100 - RNA, 64 nt, Human
guuaacuguaaacagucacacucccauuaccccccuucuccacuaaaaacaauaaucccaaagu

SEQ ID NO: 304101 - RNA, 64 nt, Human
ggagggaugggacuggggagucagcugcucaucugcaggcuaauggcaggaaauggucauauuu

SEQ ID NO: 304102 - RNA, 64 nt, Human
cggcagguccuguguccccugcaccuggaggagagcaggcuagaggcacagcggccacauggug

SEQ ID NO: 304103 - RNA, 64 nt, Human
cuaacuguacaguuuuauguggggaacaauucaugcaggcuacuggaaaauuaaaucuuauuac

SEQ ID NO: 304104 - RNA, 64 nt, Human
ggccuccaugccuucaccacgcgcucuacggaggcuucuccauugucccugcuggagauugggu

SEQ ID NO: 304105 - RNA, 64 nt, Human
ccuggaucaggguggggacaaggacuggacccuccuucuccagaaggccuucagcucuugccuu

SEQ ID NO: 304106 - RNA, 64 nt, Human
ugaagcaagccagguaugucuugcuuaaguauuucuucuccaugaauggccuuaacauuauuuu

SEQ ID NO: 304107 - RNA, 64 nt, Human
gacacuaaacacuuuuuaaaaagcuuaucuuugccuucuccaaacaagaagcaauagucuccaa

SEQ ID NO: 304108 - RNA, 64 nt, Human
guaguucugguuuauuaaucaacggggaaaacaucuucuccaaaaaacuuggaauaaauccaag

SEQ ID NO: 304109 - RNA, 64 nt, Human
uuuugacuaguaaucaaucaaaauuauauaaagucuucuccaguaauuaagaaauacauaugca

SEQ ID NO: 304110 - RNA, 64 nt, Human
cccuugccuccgagcucuggcuucaaggggagcucuucuccagguucacuaggugaauugauuu

SEQ ID NO: 304111 - RNA, 64 nt, Human
ugugaagucuuccucgcccucugcccucuugcugcuucuccacauugccaggaaaagcugcuga

SEQ ID NO: 304112 - RNA, 64 nt, Human
caaauguguuaaauuuguaacuccucuuuggggucuucuccaccaccugucugauuuuuuugug

SEQ ID NO: 304113 - RNA, 64 nt, Human
gaagacaguucccucgaauuuuuggaaaggugcucuucuccacuaacucgaucuucugggaguu

SEQ ID NO: 304114 - RNA, 64 nt, Human
cccucgaucagacgccucccgcccaccgcggccgcuucuccacgcuuuugcccagaucucugca

SEQ ID NO: 304115 - RNA, 64 nt, Human
aagucgcacucgaguccuucgcugaacccggauacuucuccaaucacugccaaagucaagcgua

SEQ ID NO: 304116 - RNA, 64 nt, Human
gucccgguaccuuccauacacagaggagugcagccuucuccauaucuccauggcccugucccag

SEQ ID NO: 304117 - RNA, 64 nt, Human
agaacccucuuccugcaugggagagcugucccuccuucuccaccugcccaccgggacacucccc

SEQ ID NO: 304118 - RNA, 64 nt, Human
agggacacguggggugugcugcugcugcuccccagcccaccagugccuggccagccugcccccu

SEQ ID NO: 304119 - RNA, 64 nt, Human
uggcgccugcugcgucagagcucaaggaaucugugcccaccaccagcuccugguccguaggagg

SEQ ID NO: 304120 - RNA, 64 nt, Human
guguucaugguggagacuugguucuuuacgcagagcaggcuaaaggcguguuuuuucugcucug

SEQ ID NO: 304121 - RNA, 64 nt, Human
cucaguaaccauuucagccucuuuccagcaaacccuucuccauaguauuucagucauggaagga

SEQ ID NO: 304122 - RNA, 64 nt, Human
cucaguaaucguuuuagcuucuuuccagcaaacucuucuccacaguagcccagucgugguagga

SEQ ID NO: 304123 - RNA, 64 nt, Human
accgagcucaccacagacacaguggagccgcgcucuucuccagugacacguggacaaaugcggg

SEQ ID NO: 304124 - RNA, 64 nt, Human
cuucaagugaaaagaacuuaugugugucuaccuucuucuccauacccugagccaccucucucac

SEQ ID NO: 304125 - RNA, 64 nt, Human
gaauccuuauagaaacaggaccagaaacaccucccuucuccaacaaaagguucauuuugguggc

SEQ ID NO: 304126 - RNA, 64 nt, Human
aagacacugcaaaggcgcagugcuucucuacagacuucuccagacccaccacaccgcagaagcg

SEQ ID NO: 304127 - RNA, 64 nt, Human
guuauuuuucuugaagaggcagcucaaaugucaccuucuccagaagcugcucuccacuugcuuu

SEQ ID NO: 304128 - RNA, 64 nt, Human
ucaguuguuagcauuuucaaugugauauaaacagcuucuccaauacagcaaaccuaauugcaca

SEQ ID NO: 304129 - RNA, 64 nt, Human
uugaucuaucuaguaauucuuuugcugccugucucuucuccauuuuccuucuucuuuuuuaagc

SEQ ID NO: 304130 - RNA, 64 nt, Human
cuuuacauaaccucaguuuuuaacacaugcauaucuucuccaaccaugaaaucaaagcacggug

SEQ ID NO: 304131 - RNA, 64 nt, Human
agggccuggccuuguccccagcuccaccuggccccuucuccagcaagcagugcccucuggacag

SEQ ID NO: 304132 - RNA, 64 nt, Human
gacuagccacuccugccaggccgccgggaugguucuucuccaguuagaaugcaccauggagacg

SEQ ID NO: 304133 - RNA, 64 nt, Human
uacccuccccagggcuccaucuccgccucaggggcuucuccaccccaagucuggcuccauuccu

SEQ ID NO: 304134 - RNA, 64 nt, Human
uguugcacuuuuuugggcugagcuguuagaggggcuucuccagaggcucgagagcaggccauuu

SEQ ID NO: 304135 - RNA, 64 nt, Human
agaccagcacaucccuuuugagacaccgccuucugcccaccacucacggacacauuucugccua

SEQ ID NO: 304136 - RNA, 64 nt, Human
ugccucuccuggucguggaaggugcuacuccagugcccaccagccuuguccuaauaaaauuaag

SEQ ID NO: 304137 - RNA, 64 nt, Human
aaagaacaagaacaaauuguggaucaugguauaugcaggcuaucagcagaaggaucagacaaua

SEQ ID NO: 304138 - RNA, 64 nt, Human
ucuuaaggagaagccacccaugagaugucuuuuccuucuccaucaucuuagagccaaguuauau

SEQ ID NO: 304139 - RNA, 64 nt, Human
acaaacugcauggacucaagcgagcuggagccaucuucuccauagcauuacggacuuagcauaa

SEQ ID NO: 304140 - RNA, 64 nt, Human
ucucuccaggacuugucagcuggugguucagccccuucuccaaccccuucauaagcuugggcca

SEQ ID NO: 304141 - RNA, 64 nt, Human
ccuggcucuuacaggcucgucccccaggccugcccuucuccacugcccccuccugugucugggu

SEQ ID NO: 304142 - RNA, 64 nt, Human
gccccuccucccccggcugggccuccuucuuccacuucuccaagaauggaagccugaacugagg

SEQ ID NO: 304143 - RNA, 64 nt, Human
ccgcagucuaggaaugaugcggggggguggacgccuucuccauagucuuuccccaccuggagca

SEQ ID NO: 304144 - RNA, 64 nt, Human
cgucggccuggcccccccggcuccuguccccuggcuucuccacagguuuuccagcggagggugg

SEQ ID NO: 304145 - RNA, 61 nt, Human
gccugaccccugagagcugaccccgugcugccuucuccaggcaggccuggccucugcccug

SEQ ID NO: 304146 - RNA, 64 nt, Human
gaacuguuuucucccugcuaagcaguuuauaguucuucuccauguuucuccagaauuaaucagu

SEQ ID NO: 304147 - RNA, 64 nt, Human
aaaaaccaaaguacuuuuggugucauuauuccaucuucuccauaaguggagaaaugaaaaguaa

SEQ ID NO: 304148 - RNA, 64 nt, Human
uuagaagcccgagguagguggagggacuagaggacuucuccagacaugauucuucauagagugg

SEQ ID NO: 304149 - RNA, 64 nt, Human
accaaacuguuguugucaauuaucuuuuauuuaacuucuccaccuucauugcuagauccuucga

SEQ ID NO: 304150 - RNA, 64 nt, Human
auguuagccaggucugcccuccccauucaagccccuucuccacuguagcaaaauaagcaccccc

SEQ ID NO: 304151 - RNA, 64 nt, Human
uggagagcgccucuucccaccaguccucagccaccuucuccacggcagcgaccuccgucucaag

SEQ ID NO: 304152 - RNA, 64 nt, Human
cacauguaauagggguucucuguguguuuauagagcaggcuacuacaguggaacuguuucuguu

SEQ ID NO: 304153 - RNA, 64 nt, Human
cccuguccucagacagugccaccauggccaugcagcaggcuaugauggcugcacacgaugacuc

SEQ ID NO: 304154 - RNA, 64 nt, Human
aaguguuccuaagcagccuguauacugagugcaagcaggcuaucaauuuuaauaauaguccaua

SEQ ID NO: 304155 - RNA, 64 nt, Human
gugaacacaugacgucagaucaaagaaaacagaucuucuccagauuggcagaaaguugauauag

SEQ ID NO: 304156 - RNA, 59 nt, Human
ggaucucuaauacauuuugaggucagccacuucuccaguggaacucugaaguacagaug

SEQ ID NO: 304157 - RNA, 64 nt, Human
auugguacucuuggaggaagaaaaacuguccuuccuucuccaaaaaaggaaaaauuauaauaau

SEQ ID NO: 304158 - RNA, 64 nt, Human
aggaaggaaggauguaaagugguaugaucuggggcuucuccacuccugccccagaguguggagg

SEQ ID NO: 304159 - RNA, 64 nt, Human
cacacaucacuggcugugaccccucaggcuagcccuucuccacucugggggaggaggugggaag

SEQ ID NO: 304160 - RNA, 64 nt, Human
gaaacucauagcaucucccacauuacucucaucacuucuccaaggugcuuuugcaagacuggaa

SEQ ID NO: 304161 - RNA, 64 nt, Human
uagagaacucaucagagugcggauugccaagacccuucuccagagauuaugggguugggggugg

SEQ ID NO: 304162 - RNA, 64 nt, Human
uuugcagaaagugaugaccuuacaccacaaccagcuucuccaggucauaugugccuuaccucca

SEQ ID NO: 304163 - RNA, 64 nt, Human
cuuagucuuuuuaggagugauuuugcuaguuugacuucuccaaagccucuguguaggugguagg

SEQ ID NO: 304164 - RNA, 64 nt, Human
uccuggguuggaacgaggcaguggcccugagccccuucuccagggccagguagaaaggacaaac

SEQ ID NO: 304165 - RNA, 64 nt, Human
cauuuccacagaagcccauccgcugccuccguggcuucuccagccauugaacuggucccacacg

SEQ ID NO: 304166 - RNA, 64 nt, Human
gucccagcucaggcucucugccuuccagaggccgcuucuccagugacuaaccuccuccucuggc

SEQ ID NO: 304167 - RNA, 64 nt, Human
cccucuaucccccaccgcuccaccccaccacugucuucuccauccuuccaccccacccucagcg

SEQ ID NO: 304168 - RNA, 64 nt, Human
aagagaggacaugagggggaaaguccuuuuugcccuucuccaaaaaauaaccuuccacagagac

SEQ ID NO: 304169 - RNA, 64 nt, Human
aacccugccuggaucucccugcuucaccccuguggcccaccaggugggccaugaaaggagagga

SEQ ID NO: 304170 - RNA, 64 nt, Human
ugccucagccucccgaguagcugggccuaaaggugcccaccacuauacccggcuaauuuuugua

SEQ ID NO: 304171 - RNA, 64 nt, Human
agcuggguccccccaaaacuugggcuggcccagggcccaccagcagcugauguugccuccucuc

SEQ ID NO: 304172 - RNA, 64 nt, Human
guagucuuggaaaccaucagguacugccugcagacuucuccagcacuaaauauauuuguucccu

SEQ ID NO: 304173 - RNA, 64 nt, Human
cuguuuccacacuugcaccugaucaagagcagugcuucuccauuuguuuugcagagaaauguuu

SEQ ID NO: 304174 - RNA, 64 nt, Human
uccauguacucuguuguuagagggcccagaguuccuucuccacccccgcucucucucucuuggc

SEQ ID NO: 304175 - RNA, 64 nt, Human
cacaucccacucugagcucccacgagaaacacugcuucuccaggcccgggguuguuggggagag

SEQ ID NO: 304176 - RNA, 64 nt, Human
ugagacuuccaggggauugccaucuuaccugucucuucuccaugagggagaaggaagcagcuag

SEQ ID NO: 304177 - RNA, 64 nt, Human
ugauuuauuaaauauguuuucucaauuguaacgacuucuccaucuccuguguaaucaaggccag

SEQ ID NO: 304178 - RNA, 64 nt, Human
accuacuuccuccuagcaaccaacuuuaccucuucuucuccaaaggaucuuuguuccucugagc

SEQ ID NO: 304179 - RNA, 64 nt, Human
gguuuggagagaacaaugaagcuccaggcucucucuucuccagggcaccaagaggcugggcuua

SEQ ID NO: 304180 - RNA, 64 nt, Human
ccauaaacagcuaucugucugaauuacuucaggccuucuccauaauaucuguuagaaagaaauu

SEQ ID NO: 304181 - RNA, 64 nt, Human
aguagcaaaacaauacagggaagagucaaaagggcuucuccaacuguagagguacagauugucu

SEQ ID NO: 304182 - RNA, 64 nt, Human
ucagggagugcauggucucagaugccauccuucucuucuccagcauuuccacucaccuccgugu

SEQ ID NO: 304183 - RNA, 64 nt, Human
ccugacauugcccucccugaaugcaucaaauacucuucuccaaggacugacaaaaacaaccccc

SEQ ID NO: 304184 - RNA, 64 nt, Human
gggaugguggagggccacaugggaggcucacccccuucuccauccacaugggagccgggucugc

SEQ ID NO: 304185 - RNA, 64 nt, Human
agcugcucccaucuugcuggaauuucuugggcggcuucuccaccuguaucucaagacagacacc

SEQ ID NO: 304186 - RNA, 64 nt, Human
ugccucagccucccaaguagcugggauaacaggcgcccaccaccgcacccugcuaauuuuuugu

SEQ ID NO: 304187 - RNA, 64 nt, Human
caacaacaaaaguguuuuccccccacccccacucgcccaccagggugaugccacuuuugccucc

SEQ ID NO: 304188 - RNA, 64 nt, Human
cauacauuaucucacuugugccaacacucaagaagcaggcuacacugacacugguauuccugcc

SEQ ID NO: 304189 - RNA, 64 nt, Human
agauggcccaaaguaaugaaucauguggcuguaccuucuccacauaaaugggauggauaauuau

SEQ ID NO: 304190 - RNA, 64 nt, Human
gugcugugcacagcggcuccagugggggaccccucuucuccaaccacucaggaaaccuccuugg

SEQ ID NO: 304191 - RNA, 64 nt, Human
ucaacucucucauugcccaguggugacaugugcucuucuccacacuguugggagguaaugcugc

SEQ ID NO: 304192 - RNA, 64 nt, Human
uuuccuuuccuggaucucugucuuuauuuccaggcuucuccacccauauuccuccacagaucuc

SEQ ID NO: 304193 - RNA, 64 nt, Human
cccuggcccugguucugucccagcugauggauggcuucuccaugcuggagaagaagcugaagga

SEQ ID NO: 304194 - RNA, 64 nt, Human
agagcaucaguccuugaagagcagcuuugaggcgcuucuccaacgcugcucccugucugcaacu

SEQ ID NO: 304195 - RNA, 64 nt, Human
ccccgggggccaacucacccuuggcccaucccgccuucuccaggcuuccccucccucguuuuca

SEQ ID NO: 304196 - RNA, 64 nt, Human
ggagcagugagcagccgacucugagauuagcuggcuucuccacggccguccuauagacaggauu

SEQ ID NO: 304197 - RNA, 64 nt, Human
accauguuuaaauccucguaugcacucuggccugcuucuccaguuacuugcuuguguaagaaca

SEQ ID NO: 304198 - RNA, 64 nt, Human
aagccacaucccacuggauccacacccgcccccacuucuccaucuuagaaaccccuucucuuga

SEQ ID NO: 304199 - RNA, 64 nt, Human
ccuguggugugcacgugugcucugggcuccgaggcuucuccagagcugggagcuggcuggcgug

SEQ ID NO: 304200 - RNA, 64 nt, Human
auucugcagaguggugaaguucacuuccccaacucuucuccaagucuagcuuuccuuuccuucu

SEQ ID NO: 304201 - RNA, 64 nt, Human
uuaacucaggaugccaaguggcccucagauuacacuucuccagauagcugaaugagucugcuuu

SEQ ID NO: 304202 - RNA, 64 nt, Human
augacaaggggacccucauaauggccuguauccacuucuccaguauagucaguuuaguucauau

SEQ ID NO: 304203 - RNA, 64 nt, Human
ucagacagcaggcucuccugcggccuaggccagggcaggcuaccagccacaucuucuaugagcc

SEQ ID NO: 304204 - RNA, 64 nt, Human
auauaaccaguuccuuuaagcagucuuuuuaccugcaggcuauaccaaccaggauccaaaugaa

SEQ ID NO: 304205 - RNA, 64 nt, Human
guuuuguguccuguuugaacuugcugaauguaaggcaggcuacuaugcguuauaaucuaaucac

SEQ ID NO: 304206 - RNA, 64 nt, Human
ggcuuggauaucuucuucaacauccuugccaagacuucuccacccucuugcauaccuccaggga

SEQ ID NO: 304207 - RNA, 64 nt, Human
cuaagguacagguuggcaggaccaccuccgccuacuucuccaccaucccuagcaugucagcccg

SEQ ID NO: 304208 - RNA, 64 nt, Human
gagggucugggcaagggaccugcuucuauuagcccuucuccauggcccugccaugcucuccaaa

SEQ ID NO: 304209 - RNA, 64 nt, Human
aaauugucuuucuaaauuucaacuucaaugucaucuucuccaugaagaccacugaaugaacacc

SEQ ID NO: 304210 - RNA, 64 nt, Human
uggcuguggucacuagcuuggccauagcaccucucuucuccacuucugaucugcugcuucuaac

SEQ ID NO: 304211 - RNA, 64 nt, Human
guccugagguccaagauucuggagcaaucugacccuucuccaaaggcucuguuaucagcugggc

SEQ ID NO: 304212 - RNA, 64 nt, Human
ucccagcugucucacguuguuuauucugcguccccuucuccaauaaaacaagccaguugggcgu

SEQ ID NO: 304213 - RNA, 64 nt, Human
ccuuuagucaaagacuccuggaaaggaguugccucuucuccaaucagagcguggaggcgaguug

SEQ ID NO: 304214 - RNA, 64 nt, Human
ggaggggcacauggagugggacaggagggggcaccuucuccagaugaugucccuggagggggca

SEQ ID NO: 304215 - RNA, 64 nt, Human
ggcacacguggccuccgugguauggaccugguggcuucuccaucccacuguggccucuguggua

SEQ ID NO: 304216 - RNA, 64 nt, Human
ucccacuguggccucugugguauggaccugguggcuucuccauccuacccaagguaacaguguc

SEQ ID NO: 304217 - RNA, 64 nt, Human
uucaucccacgcauccucccugaggcaccugccccuucuccagcucaucauccaugcacgcacc

SEQ ID NO: 304218 - RNA, 64 nt, Human
uaagaaguuucuaguuugugugccaaaacagaagcuucuccaagcaugauggccacaggucagu

SEQ ID NO: 304219 - RNA, 64 nt, Human
ucccgcaaguaaggaggucugcccggagcagcagcuucuccaggaagcccagggcaccauccag

SEQ ID NO: 304220 - RNA, 64 nt, Human
aagugaugcuuuugagcuuacacacaauucacaggcccaccagugacaauuuacugugaguuaa

SEQ ID NO: 304221 - RNA, 64 nt, Human
cuugugggaagaaguuugcaccucggcccuggcugcccaccaucagugccccgcagucagcagc

SEQ ID NO: 304222 - RNA, 64 nt, Human
aauuccuccuuccccccaucucugaguggaggaagcccaccaaucugcccuuugcagugugcag

SEQ ID NO: 304223 - RNA, 64 nt, Human
cucagauggccuggucuuacgccuguguagauuucuucuccauugggaaugaaggugucaggcg

SEQ ID NO: 304224 - RNA, 64 nt, Human
cgccacccugcugccggagccgggcuucggcagucuucuccacugagggacugggcugggaagu

SEQ ID NO: 304225 - RNA, 64 nt, Human
gcucuuggaauugcgcccccaagaugcucucucccuucuccaaugagggagccacagaauccug

SEQ ID NO: 304226 - RNA, 64 nt, Human
cuugagaccugggaggacucaguuucuccacagccuucuccagccugugugauacaaguuugau

SEQ ID NO: 304227 - RNA, 64 nt, Human
uacaguuaauucuauaaauucucuuucucccucucuucuccaaucaagcacuuggaguuagauc

SEQ ID NO: 304228 - RNA, 64 nt, Human
uugcuccuaaguguugcugcuguggcuuuuuugccuucuccaaagacgcacugccaggucccaa

SEQ ID NO: 304229 - RNA, 64 nt, Human
ggugggaagucuugagcggaggaggggaucugcccuucuccacuccucucuuggauccgccucg

SEQ ID NO: 304230 - RNA, 64 nt, Human
aucgugcguggucucugaucguccaucaccugaccuucuccaggacugucuucucacccuuccc

SEQ ID NO: 304231 - RNA, 64 nt, Human
ggugagcucagcucacugguccauuucucaguggcuucuccauccucauuugcaaaccucagag

SEQ ID NO: 304232 - RNA, 64 nt, Human
cuggacaguaucccacauccaacuccagcaacuucuucuccaucccucuaaugagacugaccau

SEQ ID NO: 304233 - RNA, 64 nt, Human
agcccuuaagaccucagggggcgggugcuggggucuucuccaauaaauggggugucaaccuuac

SEQ ID NO: 304234 - RNA, 64 nt, Human
gcagugcccuugccugccuucacccccaccaccacuucuccaauaaagccgccuggccuugucu

SEQ ID NO: 304235 - RNA, 64 nt, Human
cuugaauuguggaaaagcucuauuauccaauuaacuucuccauaauuauuguuguaauauuauu

SEQ ID NO: 304236 - RNA, 64 nt, Human
cccggggaacuucacccucaggggccucccacaccuucuccagcgaggaggucucagucccagc

SEQ ID NO: 304237 - RNA, 64 nt, Human
cagcccuacccagaguauuucugagccaugaggggcccaccagauugguucugaauuggauuca

SEQ ID NO: 304238 - RNA, 64 nt, Human
gaccucaagaccagccacaccaagucugugcacugcccaccacccccuucaaccccuccuacac

SEQ ID NO: 304239 - RNA, 64 nt, Human
ugccucagccucccgaguagcugggauuacaggugcccaccaccgcgcccagcuaauuuuuuaa

SEQ ID NO: 304240 - RNA, 64 nt, Human
cuaccuugccuccuuuuuucuuaaagcaaagucacuucuccaucacaaccagauuugaggcugg

SEQ ID NO: 304241 - RNA, 64 nt, Human
uugaucacuucagugacaauacccauuaaugaaucuucuccaugauuugggguuuuuuuucguu

SEQ ID NO: 304242 - RNA, 64 nt, Human
gugcugcucuaagcaccgucccugcccagccccacuucuccaucgcagccccaccuuggcugcu

SEQ ID NO: 304243 - RNA, 64 nt, Human
ugauguugcuggcgggauccccaugcaccuuguccuucuccacugauacuggcagcucggcucc

SEQ ID NO: 304244 - RNA, 64 nt, Human
uagaacucuuuuguacaaaugaaacuauuuucuucuucuccaugaagccagggcacaaagaauu

SEQ ID NO: 304245 - RNA, 64 nt, Human
cuccauggugaaugcagguugcugcaggcucugccuucuccaugggguaaccacccucgccugg

SEQ ID NO: 304246 - RNA, 64 nt, Human
ccaggccucuuccccuuuccaucugcuuuuucagcuucuccaucgccugccuucugaccuuuuc

SEQ ID NO: 304247 - RNA, 64 nt, Human
uuuuggcuuuaggguucagagucacuuuuguucccuucuccauucuggagagggacuuccccua

SEQ ID NO: 304248 - RNA, 64 nt, Human
agugucagugacacaguuuccucugaugcagcugcuucuccaauggcuuuggggaagaacuuca

SEQ ID NO: 304249 - RNA, 64 nt, Human
gauaagaaauccuagguccucugagcaacgccugcuucuccauaucacagacuuuaaucuacac

SEQ ID NO: 304250 - RNA, 64 nt, Human
cuugucacccugguuucccacuggggccaggucucuucuccagccuccaccugccugucugauc

SEQ ID NO: 304251 - RNA, 64 nt, Human
cuucacccuguaaugguugggaccaggccaaucccuucuccacuuacuauaaugguuggaacua

SEQ ID NO: 304252 - RNA, 64 nt, Human
cagaaccagaaugacuggacaaucuuuuucauagcuucuccaucacauucaagcugguuuaugu

SEQ ID NO: 304253 - RNA, 64 nt, Human
gcaauuucaggggagucaaaaaccuugcaacuuccuucuccacuaacccaggacuaaaaaugga

SEQ ID NO: 304254 - RNA, 64 nt, Human
cacccagagcuuccugccuagucccacugggcuggcccaccaggccucugacccaggcugcucu

SEQ ID NO: 304255 - RNA, 64 nt, Human
ccccucucccuuuccuuccuuccuuccuuucucugcccaccaccccgcucagucucucucucuc

SEQ ID NO: 304256 - RNA, 64 nt, Human
ccaggucccaugccaagaaccagugauucuaguggcccaccaccucccucuccugccacccuua

SEQ ID NO: 304257 - RNA, 64 nt, Human
uugacaagcauucauauuaacauauucauucucucuucuccaucacccauacccacacauacau

SEQ ID NO: 304258 - RNA, 64 nt, Human
gcagacgagagucaggccagcacccugcgaccagcuucuccacugaugcacauccaaggcuucc

SEQ ID NO: 304259 - RNA, 64 nt, Human
ccccugcccugaggcugugagcagcuagugguggcuucuccagccuuuuucagggaacugggaa

SEQ ID NO: 304260 - RNA, 64 nt, Human
gccugcugcucucaggaccagagaagggaaaugacuucuccaggcagaggcagaucugagucua

SEQ ID NO: 304261 - RNA, 64 nt, Human
ugcccacaacuuggggguccuuucuggaucucggcuucuccagcuguaaaauggacacacaauc

SEQ ID NO: 304262 - RNA, 64 nt, Human
ccuucagagacccaggaguugggagcuuucgcuccuucuccaagacucaggccugugggcacuc

SEQ ID NO: 304263 - RNA, 64 nt, Human
auuuaauugucaguuucuuugacauaaagcgcaucuucuccacaugggcuucacgugguuugga

SEQ ID NO: 304264 - RNA, 64 nt, Human
uacaaccuugaugggauuuuuccccccaaguuuccuucuccacugaaaugccacacuaaugcuu

SEQ ID NO: 304265 - RNA, 64 nt, Human
caguauuuugcuagugcauuucaaggaauggaaucuucuccaguaugaaauuaccagauauaaa

SEQ ID NO: 304266 - RNA, 64 nt, Human
caguagcuuuggggaaagggaggaagauauggcacuucuccaaccccggaaaacauugcuuuug

SEQ ID NO: 304267 - RNA, 64 nt, Human
gggauggcaaugagguggagccugaugaugaccacuucuccauugugaguggcucaugugggcc

SEQ ID NO: 304268 - RNA, 64 nt, Human
ucccaccaaaccccagacucugugaagugcaguucuucuccaccuaggaccgccagcagagcgg

SEQ ID NO: 304269 - RNA, 64 nt, Human
gugguggagaaguaacugagccugcgcuugagaccuucuccacgcagcaggaagaucccaccga

SEQ ID NO: 304270 - RNA, 64 nt, Human
ucuucgaaggugguuugcauucuuaaucuggcaucuucuccaggccuaaaucuuaagaaaaaga

SEQ ID NO: 304271 - RNA, 64 nt, Human
gagaaagugagccuggggaagaaggggguuugaagcccaccaagaccgaaacuggagaagggcu

SEQ ID NO: 304272 - RNA, 64 nt, Human
aggaggagcgcuacccaccuccagggagcacccugcccaccaagaagcacugggugaccagcug

SEQ ID NO: 304273 - RNA, 63 nt, Human
uggagaagcgugucagauagcggcgugacccgggcccaccaggccacggccgccugcuguaca

SEQ ID NO: 304274 - RNA, 64 nt, Human
ccaguaagauuugcuaauguucuacauuaagugccuucuccaaagacaucccucuuugccucau

SEQ ID NO: 304275 - RNA, 64 nt, Human
guccacaccaagugacacuacuggcccaggcuaccuucuccaucugguuuuuguuuuuguuuuu

SEQ ID NO: 304276 - RNA, 64 nt, Human
ccccaggcccaauggcaagcccucggcucagcugcuucuccauuggaauaaacucuuguuucuc

SEQ ID NO: 304277 - RNA, 64 nt, Human
gguguagggaagaggaaaucggagaucccagaagcuucuccacugcccuaugcauuuauguuag

SEQ ID NO: 304278 - RNA, 64 nt, Human
cuuccccacccaccguccuccauuccagcccaggcuucuccaucacccauuccuccuuuuucgu

SEQ ID NO: 304279 - RNA, 64 nt, Human
cgcuccucccucaggcuuucucccucagucuuggcuucuccagggcucuggggugucuggagcu

SEQ ID NO: 304280 - RNA, 64 nt, Human
uggcuucuuuaaacugugagcacgcagagcaccccuucuccagcggugggaagugaugcagaga

SEQ ID NO: 304281 - RNA, 64 nt, Human
ccuguggugagggcuaggugugaucaacacuuuucuucuccauucccuuccugcuuuuuucaug

SEQ ID NO: 304282 - RNA, 64 nt, Human
accaagaacuccacccccagaggaaguggaucugcuucuccaguuuuugaggagccagccaggg

SEQ ID NO: 304283 - RNA, 64 nt, Human
aaaauguaugggugagaggaaggaggaucuccuucuucuccaaccauugacagcuaacccuuag

SEQ ID NO: 304284 - RNA, 64 nt, Human
aaagaaaaaugaauuucucuuuacuucucuccaccuucuccaucucucuacuuuaaagauggaa

SEQ ID NO: 304285 - RNA, 64 nt, Human
guuggugcagugaaugggcugggggugggguggccuucuccaggccugaguguuuuugugucca

SEQ ID NO: 304286 - RNA, 64 nt, Human
aggggagagggucuggagaagcagugagccgcaucuucuccaucuggcagggugggauggagga

SEQ ID NO: 304287 - RNA, 64 nt, Human
gggugacauagcugaccuuaguaucaaccccccucuucuccaacucuuguuuucuaguccagga

SEQ ID NO: 304288 - RNA, 64 nt, Human
gacagacgugggcuucagaagcucgcuggccugggcccaccagcauuuucuuuuaugaacauga

SEQ ID NO: 304289 - RNA, 64 nt, Human
ccuggugaggccacuuggccucuugguuggccaggcccaccaggaagucaccaggacaguccac

SEQ ID NO: 304290 - RNA, 64 nt, Human
cccuccacgcagcggccggagccagacuagccccgcccaccaacgagucccggcuucgaguagu

SEQ ID NO: 304291 - RNA, 64 nt, Human
ccucaugcucugaggaagucuaaguccaguuuuccuucuccagcuucuugcuugggcagguaga

SEQ ID NO: 304292 - RNA, 64 nt, Human
gguugcaggaccgagacccacauccucucacucacuucuccacccgccaggcagcugccacagg

SEQ ID NO: 304293 - RNA, 64 nt, Human
uccuguauuauccaucuacaucagaaccaaacuacuucuccaacacccggcagcacuuggcccu

SEQ ID NO: 304294 - RNA, 64 nt, Human
ucccuguucuuguaacauucuugugcuuugacuccuucuccaucuuuucuaccugacccuggug

SEQ ID NO: 304295 - RNA, 64 nt, Human
uuuggguacuccaggcacacaccuuucugaaauccuucuccagccagcugcugcagacaaaaga

SEQ ID NO: 304296 - RNA, 64 nt, Human
cucuacuauuggauuuacaacauuguauuauaaucuucuccaugugugccuucucuaguagaau

SEQ ID NO: 304297 - RNA, 64 nt, Human
auccagagaucauaacuucuuugcaagaaaacagcuucuccacacauguauuuugaaacacuga

SEQ ID NO: 304298 - RNA, 64 nt, Human
uaaauuugcaaguuuuuggagaacccccaaacuccuucuccacuggaguuaggagggccugugg

SEQ ID NO: 304299 - RNA, 64 nt, Human
ccugagccgcaaugccugcccguguugagugagacuucuccauccuggauccuggcugcgugac

SEQ ID NO: 304300 - RNA, 64 nt, Human
gaaagaaucuagacuuucuuguauacauuuuucucuucuccaguaauaaacaauuaccuuucau

SEQ ID NO: 304301 - RNA, 64 nt, Human
cuguauguccccauuugcuuugguuuuguccugccuucuccaauaucacgugcucaguuuugcc

SEQ ID NO: 304302 - RNA, 64 nt, Human
agaaggugcugagggaucuguuuccuugcccuggcuucuccagugggaugugcugaguccaaua

SEQ ID NO: 304303 - RNA, 64 nt, Human
gucuggggacagugaugccaacucaaacacgugccuucuccacgguaucuccuggccaggcugc

SEQ ID NO: 304304 - RNA, 64 nt, Human
ucuaaauucuucaaaagagccacaacuuccccagcuucuccagcuccccuguccucuucaaucc

SEQ ID NO: 304305 - RNA, 64 nt, Human
acccucugcaagggggacaggcaggccccuccaggcccaccagccugguucccgcggcccauuu

SEQ ID NO: 304306 - RNA, 64 nt, Human
cacauggcuggcacugagcaguaccagugugcuugcccaccacagcgauccacggagcugaagc

SEQ ID NO: 304307 - RNA, 64 nt, Human
uccuagaacugagcugccucuaccacagccuccugcccaccagcuggccucaccuccugaaggc

SEQ ID NO: 304308 - RNA, 64 nt, Human
gggugaaagagaaaauguuuguugaaaaaauagucuucuccacuuacuuagauaucugcagggg

SEQ ID NO: 304309 - RNA, 64 nt, Human
guaaaauguagcugcgucauaaggagacuucugucuucuccagaaggcaauaccaaccugaaag

SEQ ID NO: 304310 - RNA, 64 nt, Human
ccaggggugaccgcaggauggugggggcagcgggcuucuccaccuaccccagccaccaaggccc

SEQ ID NO: 304311 - RNA, 64 nt, Human
aaguugaggagaguucuuuuuugcuuaaagcccccuucuccauggaguguuggcuucucaauag

SEQ ID NO: 304312 - RNA, 64 nt, Human
auguccuuguggucuuugcugcugcucucaggcgcuucuccaaugcucuggagugugcauuuca

SEQ ID NO: 304313 - RNA, 64 nt, Human
cauguacugaauuuuuacauccugauaccuuuuccuucuccaugucaguaucauguucucuaau

SEQ ID NO: 304314 - RNA, 64 nt, Human
caaauaucugacuucuguauuuuuaaaaaguugccuucuccaguggcaguccaaaagcagaaau

SEQ ID NO: 304315 - RNA, 64 nt, Human
cagagucccuuggagggaaaggugugggcuccagcuucuccaggcgucugcggagcccacaguu

SEQ ID NO: 304316 - RNA, 64 nt, Human
cugcaggcuagggguuaagggugacaaagcucagcuucuccacaaggcuagaaauggggcacag

SEQ ID NO: 304317 - RNA, 64 nt, Human
ggagacagagccauuuggauauuuuccccuugaacuucuccaugaccugaagcguuccuucccu

SEQ ID NO: 304318 - RNA, 64 nt, Human
gcucacugcaaccuccaccuccuggguucaagcgcuucuccagccucagccuccugaguagcug

SEQ ID NO: 304319 - RNA, 64 nt, Human
gcccacaagcugaacuguggcauagcucucucuucuucuccaagaagacucagcagccuacauu

SEQ ID NO: 304320 - RNA, 64 nt, Human
guuugcaucauuuuaauuaugagucugacaaaaccuucuccagagaaucaagcaagaccuggau

SEQ ID NO: 304321 - RNA, 64 nt, Human
guuuacgcccaagcauuucugaacaaaugaaacucuucuccauuuaaaagaggcacuuuacuuu

SEQ ID NO: 304322 - RNA, 64 nt, Human
gccaagagcgagcgagaggcgcugccccagccaggcccaccaccucucacagucagugcacgca

SEQ ID NO: 304323 - RNA, 64 nt, Human
aggggcggcugcugccuggugacggcacccggaggcccaccaggacgcgccaccggugaaugug

SEQ ID NO: 304324 - RNA, 64 nt, Human
gugccucuccuggcccugaaggugccacuccagugcccaccagccuugucuuaauaaaauuaag

SEQ ID NO: 304325 - RNA, 64 nt, Human
uugagaguuguguucacuaucaguggucguguaccuucuccaccugcccccaggaaaaagaguc

SEQ ID NO: 304326 - RNA, 64 nt, Human
uguugagcuuccucuaaagcuuucucguguaugucuucuccaugccacuacucugaggccuccu

SEQ ID NO: 304327 - RNA, 64 nt, Human
ggucccccagggaacagcaaggaaggaacugagccuucuccagcagggcuuccugucccgaugc

SEQ ID NO: 304328 - RNA, 64 nt, Human
uuucuaaggaacccugagugagggggguauuaagcuucuccaguguuuuuuguugucuccaauc

SEQ ID NO: 304329 - RNA, 64 nt, Human
uaaaccuccagcagucccuaggaugauguagauucuucuccaucucuccgugugugcaguagug

SEQ ID NO: 304330 - RNA, 64 nt, Human
uguuucuguucaccuucguuuacuaugccugugucuucuccaccacgcuggggucugggaggaa

SEQ ID NO: 304331 - RNA, 64 nt, Human
ggugucacagaacuggauccucugcauaccccagcuucuccacaugccacugcuagggguaccc

SEQ ID NO: 304332 - RNA, 64 nt, Human
ggagcaagugaggccggagaggaguucaggaacccuucuccauacccacaaucugagcacgcua

SEQ ID NO: 304333 - RNA, 64 nt, Human
uaacaaugcuugaggcggugcuacaaaugaaguccuucuccaaaugcauugagccccaagaaaa

SEQ ID NO: 304334 - RNA, 64 nt, Human
augaagagagcugucuggggagagcccuucuucccuucuccaccuagugaagggagaacagaag

SEQ ID NO: 304335 - RNA, 64 nt, Human
cuauaucuagaucaugucugauuuuuuauugugacuucuccagcccuggucugaauuucuuaag

SEQ ID NO: 304336 - RNA, 64 nt, Human
gcucacugcaaccucugccucccagguucaagugcuucuccagccucagccucccaaguagcug

SEQ ID NO: 304337 - RNA, 64 nt, Human
ucaucaguggagccauguuaauguaaucugauggcuucuccaggguccacaggaagugaagaau

SEQ ID NO: 304338 - RNA, 64 nt, Human
cuccaggggccuuggcuuucucuggcucauuguccuucuccaucugggccaauuguccuucccu

SEQ ID NO: 304339 - RNA, 64 nt, Human
acugucccuguuguaacugcccaaggcauguuuugcccaccagaucauggcccacguggaggcc

SEQ ID NO: 304340 - RNA, 64 nt, Human
uaccucugagucccagggaccugggcaggcccaagcccaccacgagcaucauccaguccucagc

SEQ ID NO: 304341 - RNA, 64 nt, Human
ugccucuccuggcccuggaaguugccacuccagugcccaccagccuuguccuaauaaaauuaag

SEQ ID NO: 304342 - RNA, 64 nt, Human
uuuauuguuguagaaguauuuuacauuuucaucccuucuccaaaagccgaaugcacuaaugaca

SEQ ID NO: 304343 - RNA, 64 nt, Human
gacuacucuauuuuuugcaaauuuguaaacuuugcuucuccaaauacaaguacuagguugucca

SEQ ID NO: 304344 - RNA, 64 nt, Human
ucuguaucuauagcaacaacccagaacuuacaaacuucuccaaagauuuuauugauuguuauau

SEQ ID NO: 304345 - RNA, 64 nt, Human
aggggcuccccuuacaauccacaaugagcaauugcuucuccaaggccuggagcuauucugguac

SEQ ID NO: 304346 - RNA, 64 nt, Human
gagcgugcuuucaaguguccuggaaauucugcugcuucuccaagcuuucagacaagaaugugca

SEQ ID NO: 304347 - RNA, 64 nt, Human
uuugguuucacuggauuuucuucuucaguaugugcuucuccaagaauacaaaucguccuuguuc

SEQ ID NO: 304348 - RNA, 64 nt, Human
ggaugccacaggccccucuggcucccaggugcugcuucuccacaggugcggccuggcccggccu

SEQ ID NO: 304349 - RNA, 64 nt, Human
caccagugccaccuaccaagcugugaaacuaaaccuucuccacuaaacgucguuagggccucag

SEQ ID NO: 304350 - RNA, 64 nt, Human
cuggaccuugaacuggguacuuguggacacagcucuucuccaggcuguaucccaugagccucag

SEQ ID NO: 304351 - RNA, 64 nt, Human
gcgugagccacugcaccgggccacagagaaaguacuucuccacccugcucuccgaccagacacc

SEQ ID NO: 304352 - RNA, 64 nt, Human
gacacacguaucuaacaaacaaacaaacagugaccuucuccaugggucaaggacuuccuuacaa

SEQ ID NO: 304353 - RNA, 64 nt, Human
uguucacucuacuuagcaugucccuaccgagucucuucuccacuggauggaggaaaaccaagcc

SEQ ID NO: 304354 - RNA, 64 nt, Human
gucaacagugaggcagucucccuuccugaccauucuucuccacccagucacagauaagggaaua

SEQ ID NO: 304355 - RNA, 64 nt, Human
gguuaucuuugagaccauccauucuccucaguggcuucuccagggaauucuuacagccaaguug

SEQ ID NO: 304356 - RNA, 64 nt, Human
gaaggagaaagaggccgcugcugccgccgccgccgcccaccagcaggcccugcgggaggagagc

SEQ ID NO: 304357 - RNA, 64 nt, Human
gcccugcugcuuccuaacuuauugccugggcagugcccaccaugcaccccugauguucgccguc

SEQ ID NO: 304358 - RNA, 64 nt, Human
cacacggccuuggcuauugcuuccuucaggcucugcccaccaaggugcccucuccccggggacc

SEQ ID NO: 304359 - RNA, 64 nt, Human
gcgagccccccauguaaaguggggacgggggcugcuucuccaccucccccaaacccugcuucug

SEQ ID NO: 304360 - RNA, 64 nt, Human
agaccacagagcugucacuuuugcuccgaagcuacuucuccacugucccguucagucugaaugc

SEQ ID NO: 304361 - RNA, 64 nt, Human
caguccaacaaaaacagguuccuuauguuucugccuucuccaccagggucgcuccaucacccaa

SEQ ID NO: 304362 - RNA, 64 nt, Human
acuugagcccaaaggcaagcguauaucaaacgaucuucuccacauaaccucucugugccaucau

SEQ ID NO: 304363 - RNA, 64 nt, Human
cacucuuaccucgguccccucccaguggucccaccuucuccacccugcccugccaaguccccug

SEQ ID NO: 304364 - RNA, 50 nt, Human
aagucaaggaagaacuuuagcuucuccaauaccaggaaaaaagaugcuua

SEQ ID NO: 304365 - RNA, 64 nt, Human
gucccuucauugcauggcacagcucacuuuggcccuucuccacccaucccaaccccauugcuaa

SEQ ID NO: 304366 - RNA, 64 nt, Human
cugcuugagggcuauccuccccaugcccaucucacuucuccaccaaguucacuguucaucauuu

SEQ ID NO: 304367 - RNA, 64 nt, Human
agcugaggggcuagggucccagcaccacuucccccuucuccacccucuacuucccgcccagugg

SEQ ID NO: 304368 - RNA, 64 nt, Human
gugagguggaagacuucgaggcucgugggagccgcuucuccaagucugcugaugagagacagcg

SEQ ID NO: 304369 - RNA, 64 nt, Human
aucucggcuugcaggaggccaacugcugagaccucuucuccaucccccuuauucaguggaagau

SEQ ID NO: 304370 - RNA, 64 nt, Human
cauagaggaccccuccuccucucccaguucucaacuucuccaugccuggaauccacgggugaag

SEQ ID NO: 304371 - RNA, 64 nt, Human
uacuuugcacucuuccucuucuccuuuuuccgcacuucuccaccccucccacauuuacagccag

SEQ ID NO: 304372 - RNA, 64 nt, Human
ucacagcccuucuccccaagggaggcugaggaggcuucuccaccaguggcagccccaccccguc

SEQ ID NO: 304373 - RNA, 64 nt, Human
cugagggcuuggcugccugccaccgccaucuggagcccaccacagcucuucucccuguucucug

SEQ ID NO: 304374 - RNA, 64 nt, Human
guggcugugcccucaguugcccccagggcugggugcccaccaugccccuuccucuuucuccucc

SEQ ID NO: 304375 - RNA, 64 nt, Human
ugccucagccucccgaguagcugggacuacaggugcccaccaccacgccuggcuaguuuuuugu

SEQ ID NO: 304376 - RNA, 64 nt, Human
ucuuguuggaguuuuugguuagcuuuuacguuuucuucuccacccacggcacaggugauaaaau

SEQ ID NO: 304377 - RNA, 64 nt, Human
agaccaugaaguaaauuauguaacuagguuuuugcuucuccaguggugaccacccccccccauc

SEQ ID NO: 304378 - RNA, 64 nt, Human
ugaagacuuacuguauuuugaaaaccaucauuaccuucuccauaccauuuggcucccaaauuua

SEQ ID NO: 304379 - RNA, 64 nt, Human
gaaugugggcauuaauuuuuugacugcagcucugcuucuccagccccgccguggguggcaagcu

SEQ ID NO: 304380 - RNA, 64 nt, Human
agagcucauccccccugcugcccagugcaaaccacuucuccaugcugcaaaggagaagcacagc

SEQ ID NO: 304381 - RNA, 64 nt, Human
ugccaagacccuacauaugacagaacccuuggcccuucuccaugccugugggaucuguuucuuu

SEQ ID NO: 304382 - RNA, 64 nt, Human
uccugaaaaggcaaaggguugucacuuagggcagcuucuccaacuuuaacaugcauccaaguca

SEQ ID NO: 304383 - RNA, 64 nt, Human
ccaccugcugcugcuaucuguccuuacuugugggcuucuccaugcugugccaauggcuggcuuu

SEQ ID NO: 304384 - RNA, 64 nt, Human
ggcgaggugccgccuuggccgggcccccacgugucuucuccagaaugugucugucuuugccugg

SEQ ID NO: 304385 - RNA, 64 nt, Human
gaagucuucagggaaggucaccugagcccggaugcuucuccaugagacacaucuccuccauacu

SEQ ID NO: 304386 - RNA, 64 nt, Human
gaagucuucagggaaggucaccugagccuggaugcuucuccaugagccgcaucuccuccauacu

SEQ ID NO: 304387 - RNA, 64 nt, Human
gacaaaggaaaccuuaaguuguauugucuacuuucuucuccauccugcuuuaaaacacuccugu

SEQ ID NO: 304388 - RNA, 64 nt, Human
uggguguuguauggggaggcaagugugggggguccuucuccacacccacuuuguccauuugcaa

SEQ ID NO: 304389 - RNA, 64 nt, Human
cagcaagcagucuacccuguccuuugcaauugcucuucuccacgucuuuccugcuacaaguguu

SEQ ID NO: 304390 - RNA, 64 nt, Human
cuuugggcugcccuggcccccacucucccgggccgcccaccacaggcucuuaauggggccgggu

SEQ ID NO: 304391 - RNA, 64 nt, Human
ucuuuaagucuauuguuuaacuguaccauccagagcccaccagaagcuauugaucauuaaaauu

SEQ ID NO: 304392 - RNA, 64 nt, Human
gucucccccuacauauuaauaccagucaccaggagcccaccaccucccucuaggaugcccccuc

SEQ ID NO: 304393 - RNA, 64 nt, Human
gcagagugggauugugggagggauuggcagccuucuucuccaccaccuguccagcuucuuccug

SEQ ID NO: 304394 - RNA, 64 nt, Human
ggggugcuuugccuguguuccccagcucaugacccuucuccaguugucuuguucccauauaaca

SEQ ID NO: 304395 - RNA, 64 nt, Human
cuccccaaacacacaagcucucagccacaggcagcuucuccacagccccagcuucgcacaggcu

SEQ ID NO: 304396 - RNA, 64 nt, Human
cauccuugauaaaaugaagaugaaacuuacacuacuucuccaagccuuuugcugucuuaagaau

SEQ ID NO: 304397 - RNA, 64 nt, Human
uugacaccacaccaucaggccgcauccugaacugcuucuccaaggacaucuaugucguugauga

SEQ ID NO: 304398 - RNA, 64 nt, Human
cagccgcccauccuaccuggauggagaagagacccuucuccaagcaccucagcgcacuugcccu

SEQ ID NO: 304399 - RNA, 64 nt, Human
gccugguuuuauuuauaucuuguuauuaauguuucuucuccaauucugaaauacuuuugaguau

SEQ ID NO: 304400 - RNA, 64 nt, Human
ggcagggggcccuuaagaagguucagagaccagccuucuccagaggcugucacugcaggagccg

SEQ ID NO: 304401 - RNA, 64 nt, Human
cacaccugccauauugaaccguuucugcacuaaucuucuccacgggcacggaguggagggaacg

SEQ ID NO: 304402 - RNA, 64 nt, Human
uggccuccaugaggggcagggccagcuuccaucccuucuccagcccuuggggcaacugagcaau

SEQ ID NO: 304403 - RNA, 64 nt, Human
gggguuucauaaaaccuccaaccugcaccccucccuucuccaucucgcuugcugcccaacacca

SEQ ID NO: 304404 - RNA, 64 nt, Human
ucugaguuggccccaaagcgagcuaugcugaacucuucuccaucuccaagcagacaaccuuugu

SEQ ID NO: 304405 - RNA, 64 nt, Human
ugugcugagcccuguuuucacguaugccucugcacuucuccauucuuccuguuuugucuagguu

SEQ ID NO: 304406 - RNA, 64 nt, Human
augaguuuccagcuaagccugaugauggaagggccuucuccacagggacacagucuggugccca

SEQ ID NO: 304407 - RNA, 64 nt, Human
gcugcacaggccagggcucgggcaugugguggccgcccaccaggggccuucacgucugcccuuu

SEQ ID NO: 304408 - RNA, 64 nt, Human
gcauguggacgcccuccguccugcagucuugccagcccaccacagccacuguagaccacaggca

SEQ ID NO: 304409 - RNA, 64 nt, Human
caccgguggggagggucguccgguaucccccagugcccaccaccaccaaccagaaucacuucuc

SEQ ID NO: 304410 - RNA, 64 nt, Human
augcuguguaacacacucaccgagaggaaaaaggcuucuccacaaccuccuccuccaguucuga

SEQ ID NO: 304411 - RNA, 64 nt, Human
aagaaaauagauucucaacgagauuucacuguggcuucuccagcagaauuuguuacucgcuuug

SEQ ID NO: 304412 - RNA, 64 nt, Human
caagggguucccuccuccucucucccaaggagugcuucuccagggaccucucuccgggggcucc

SEQ ID NO: 304413 - RNA, 64 nt, Human
cuugggggcaggagagagacacucuccaugaacacuucuccagccaccucauacccccuuccca

SEQ ID NO: 304414 - RNA, 64 nt, Human
cuggagacaguugaugugucaugcagagcucuuacuucuccagcaacacucuucaguacauaau

SEQ ID NO: 304415 - RNA, 64 nt, Human
accacagcagcccugaacaaccaguaugugucuucuucuccagauagugaaaaagguguccaga

SEQ ID NO: 304416 - RNA, 64 nt, Human
uuuggggggaaaugccuuaauuucacucuccucccuucuccagccucaggggaggaucuggagg

SEQ ID NO: 304417 - RNA, 64 nt, Human
agcaggaggguugggcgugcuaccugcaccgccccuucuccaacaaguugccuccaagcuuugg

SEQ ID NO: 304418 - RNA, 64 nt, Human
agcaucuucuuccccuucccuggcccugcagggccuucuccagcucccuuugguuagucccugg

SEQ ID NO: 304419 - RNA, 64 nt, Human
gggcaccggccccucugaacgugaugggaccugccuucuccacuaguagcugggcagcucacaa

SEQ ID NO: 304420 - RNA, 64 nt, Human
agccccagggcagaagcgagaaggugugggguuucuucuccaaggggaagcagcuccucaggag

SEQ ID NO: 304421 - RNA, 64 nt, Human
uagaccagaagccagccuacuccuucuuacauagcuucuccaacagggguagcaaugaccuguc

SEQ ID NO: 304422 - RNA, 64 nt, Human
uuggcaaccucuacugcccaucuccccugcucaacuucuccaccaagcauuugguuuauuuaga

SEQ ID NO: 304423 - RNA, 64 nt, Human
auaggaaggaaaaugaagagagccaguauuuccccuucuccagaagcagguacucagcuuucug

SEQ ID NO: 304424 - RNA, 64 nt, Human
aguggccuuagagggagccugcccugcccccaccgcccaccaccuccuccccuucauuccugcu

SEQ ID NO: 304425 - RNA, 64 nt, Human
cgggugggcaggggccugaggguggcucgggccagcccaccagccaauggaccccuccucaggc

SEQ ID NO: 304426 - RNA, 64 nt, Human
acaguaucuguucuaaccuaaaauuauagguagggcaggcuaagugaacagcauugaguauuuu

SEQ ID NO: 304427 - RNA, 64 nt, Human
ugcauaacuggcguguagcacaaagaaaaagccccuucuccaccagauauuugcuuccuaagaa

SEQ ID NO: 304428 - RNA, 64 nt, Human
agugagucgguggcuucuggacugaagcuauuuucuucuccaaacugcugucucuaauuuggcc

SEQ ID NO: 304429 - RNA, 64 nt, Human
ccugugacaacccaagugggugacacuagugaaccuucuccagucugcaggcuggcauagaagg

SEQ ID NO: 304430 - RNA, 64 nt, Human
ggcauucacaaacuuugcaagcgugguccagggccuucuccagaucuguuccaacuuggagugu

SEQ ID NO: 304431 - RNA, 64 nt, Human
uugacuuggaucuccaggaguccccugcacauaccuucuccaucgugucagcuguguuucucuu

SEQ ID NO: 304432 - RNA, 64 nt, Human
ccgagcacccuggcgaccucgugcagaccgaggccuucuccaaagaaagguggugagggcggag

SEQ ID NO: 304433 - RNA, 64 nt, Human
uaaauuuuccaugugauguuuauagucuguauuacuucuccaaauaaugaacuaccugauucau

SEQ ID NO: 304434 - RNA, 64 nt, Human
cagagauaaaugcuguuaauuuaacaaguagauucuucuccaaagaaugaugagugauucuugg

SEQ ID NO: 304435 - RNA, 64 nt, Human
cauccgguguaaaaaaaagagaucagccaguuaccuucuccauugucuuaguucugucacccau

SEQ ID NO: 304436 - RNA, 64 nt, Human
uuagcaggaucuacagaguguuucgugaucucuccuucuccaucaucucaucucuggaugcugu

SEQ ID NO: 304437 - RNA, 64 nt, Human
ugggucugagucauggccgggugggcggcacagccuucuccacuggccggagucagugccaggu

SEQ ID NO: 304438 - RNA, 64 nt, Human
cuaauuuggggaccccaggggccgcccccggccucuucuccauccugcuuggaccaggguccug

SEQ ID NO: 304439 - RNA, 64 nt, Human
caggcugaaggcacacgcucaaugccccacgugccuucuccaggaggaacgaagcaggguuuga

SEQ ID NO: 304440 - RNA, 64 nt, Human
ccacccccaccccgaguccugagcucacuuucgccuucuccauccccugccgugggggccacag

SEQ ID NO: 304441 - RNA, 64 nt, Human
cuucagaggaccuaagacccaccuaugacucagggcccaccacaccccacccccccccaacugg

SEQ ID NO: 304442 - RNA, 64 nt, Human
ccaccaggcccagagccugguuggccauucucaugcccaccagcuucuggcuuugggaugucuc

SEQ ID NO: 304443 - RNA, 64 nt, Human
agucguacacggagacuggcagcgccgacguccugcccaccacgcacucccggagagcacggaa

SEQ ID NO: 304444 - RNA, 64 nt, Human
uaucugggauagcaaaggucuucuucccucgccccuucuccaucgucccaggaaucccaggggg

SEQ ID NO: 304445 - RNA, 64 nt, Human
gaaaaaacggccuucagcccaggcugggaagcgccuucuccaggugccucucccucaccagcuc

SEQ ID NO: 304446 - RNA, 64 nt, Human
ggguuggggcugggcagagccuguccccuccccccuucuccaggagccagggggugacuggaga

SEQ ID NO: 304447 - RNA, 64 nt, Human
uuuauuccugccugcuccggccaggacugaaccccuucuccacaccugaacaguuggcucaagg

SEQ ID NO: 304448 - RNA, 64 nt, Human
aacccacagauagaucaaccuaagaauccuggcccuucuccacucuccaccaugcaggacaaac

SEQ ID NO: 304449 - RNA, 64 nt, Human
gccaagaaucccaagugacuggggcuggggaccacuucuccaggccucucuccccgaccaugag

SEQ ID NO: 304450 - RNA, 62 nt, Human
acuccuuugaccccaggaaguuuugccccuccuucuucuccagacagcccccuccccaggug

SEQ ID NO: 304451 - RNA, 60 nt, Human
gcgggccggaaauggcgugaccaccccauccuucuccaccaaagacaguugcgcgccugc

SEQ ID NO: 304452 - RNA, 64 nt, Human
cuccugggaucugcucgucaucauuuuuccuucccuucuccaucucucuggcccucuaccccug

SEQ ID NO: 304453 - RNA, 64 nt, Human
uucccccaguggggggugggaggguaaccucacucuucuccaggccaggccuccuuggacuccc

SEQ ID NO: 304454 - RNA, 64 nt, Human
ugaaucuuacugagucccucugggcagcagcucccuucuccaccccaccccagcacccguccca

SEQ ID NO: 304455 - RNA, 64 nt, Human
ggggguaaaacaaaaagaaaaaaaaaaguucauacuucuccaauaaauaaagucucaccugugu

SEQ ID NO: 304456 - RNA, 64 nt, Human
uuacagcugccucuguccccacaugugggggcaccuucuccaguaggauucggaaaagauugua

SEQ ID NO: 304457 - RNA, 64 nt, Human
uauaagcauauuauuauauacagguugaguaucccuucuccaaaaugccugggaucagaagcau

SEQ ID NO: 304458 - RNA, 64 nt, Human
guaaccugaacuucugugugguggcaguacuguggcccaccaguguaaucucccuggauuaagg

SEQ ID NO: 304459 - RNA, 64 nt, Human
ccuccuuggggcguuuaggacugggcgucuccaagcccaccauggcccagauggacgugcaaag

SEQ ID NO: 304460 - RNA, 63 nt, Human
gggacggagacacugacugaggcgaugggagcugcccaccagagugccucugagcagcucaca

SEQ ID NO: 304461 - RNA, 64 nt, Human
ccugcugcuguaaugggaaccccucccccauuuacuucuccaccucccguccuccccaucauug

SEQ ID NO: 304462 - RNA, 64 nt, Human
augguagaaauaaugcaaggaaaaagguagccaccuucuccauugaacagcaguaccugcuguu

SEQ ID NO: 304463 - RNA, 64 nt, Human
gagacuucucuaagcaaccaccgagcccuuugaccuucuccauuguacccccaagaucuuuuug

SEQ ID NO: 304464 - RNA, 64 nt, Human
ucauagaugucuucaaaucccuguuccuauccuucuucuccagcuccuccugcucccucugaaa

SEQ ID NO: 304465 - RNA, 64 nt, Human
ucagcccggcucugccuggugcucccugcagugccuucuccauggccccgcccuccccgcgugu

SEQ ID NO: 304466 - RNA, 64 nt, Human
cuguuuuacuguagaagggacaauuaacuccauccuucuccaugacucugaaauccaagggggg

SEQ ID NO: 304467 - RNA, 64 nt, Human
guauuaagugcaauuaaagccgugggugucgcaucuucuccagcgcugggcccucccuugcccc

SEQ ID NO: 304468 - RNA, 64 nt, Human
acccgugguuaccggcucuccaagugauucuguucuucuccauuuuuggcaguuaauuugcaga

SEQ ID NO: 304469 - RNA, 64 nt, Human
aaggugcauccugggguuggcuuuagaaacuaaacuucuccaaaaggacagggcagauuguaaa

SEQ ID NO: 304470 - RNA, 64 nt, Human
ccugcuggugcuccgcggccccgccuacacgcgucuucuccacggcaucgccgccgcccgcgua

SEQ ID NO: 304471 - RNA, 51 nt, Human
cugcugguguccuacugugagcuucuccaccuggaaauuucccucucaccu

SEQ ID NO: 304472 - RNA, 64 nt, Human
gccaacacccauugaccuccucguuuuugcccgccuucuccaaguaaauuuucccuuuuauuua

SEQ ID NO: 304473 - RNA, 64 nt, Human
acucucucuuccuuucucucugccugucccucuccuucuccaucucacccucccucucucacac

SEQ ID NO: 304474 - RNA, 64 nt, Human
ucuuugccuugaagaggaacagaugaauaugcaccuucuccagaguuaugugguuuuagaauuu

SEQ ID NO: 304475 - RNA, 64 nt, Human
ugacagucagaaaacacaccuggaauacgaugcagcccaccauuaacucauucauguaguuuau

SEQ ID NO: 304476 - RNA, 64 nt, Human
cuaugaaucucuaaggcucuggaaccaucugcccgcccaccaugcccuugggaccugguucucu

SEQ ID NO: 304477 - RNA, 64 nt, Human
aucggcccacagcucccaccccacccccuucagugcccaccaacaucccauugcccugguuaua

SEQ ID NO: 304478 - RNA, 64 nt, Human
ggacauuugacuguuuacuuucuccacacuaagucuucuccauguuuuguggccuucgguugua

SEQ ID NO: 304479 - RNA, 64 nt, Human
ccgaaaacgcaagggaaguuucauuccauuuauacuucuccagacccccugccauccucugcug

SEQ ID NO: 304480 - RNA, 64 nt, Human
cguuacaguuagcagacgagcaauuccauuuguucuucuccagcaucucuaaggcccacuugaa

SEQ ID NO: 304481 - RNA, 64 nt, Human
aucggagacaagcauggugcugcugcuucugcugcuucuccagaaaaucccugggacaccuuug

SEQ ID NO: 304482 - RNA, 64 nt, Human
gaccgacaugugaaagccuccagaggucccagcccuucuccagcaucacagaugaccuccagcc

SEQ ID NO: 304483 - RNA, 64 nt, Human
cucccucugcugucaccuugcucagccaucccgucuucuccaacaccaccucuccagaggccaa

SEQ ID NO: 304484 - RNA, 64 nt, Human
agaacaggagcucuuaacuacaguggcugaauagcuucuccaaaggcucccuguguucucaccg

SEQ ID NO: 304485 - RNA, 64 nt, Human
cccccaaggacucuggccucucgaguucuccuaucuucuccauucuagaugcuucccuuguauc

SEQ ID NO: 304486 - RNA, 64 nt, Human
gagcuucugccgccuccuguggaagauaaucuagcuucuccaccucuuguuucacacucauucc

SEQ ID NO: 304487 - RNA, 64 nt, Human
aggagaguagggaaggaacaggacugcaaaaauccuucuccaccgcacagacugggaaccccuc

SEQ ID NO: 304488 - RNA, 64 nt, Human
ucugcuuuuccagacugugguugugaaccggcuccuucuccaagaaagguugcaagcugagaac

SEQ ID NO: 304489 - RNA, 64 nt, Human
cgucccacacuuuaggggguugguaucucgugcucuucuccagagauuacaaaaauguagcuuc

SEQ ID NO: 304490 - RNA, 64 nt, Human
uugagccuagcugggguagaggcacugcccaucucuucuccaccuucucuccacagaauguuug

SEQ ID NO: 304491 - RNA, 64 nt, Human
gugcggcuccgggccugagcauucgcaaagcucgcuucuccagggagccuccucuuggcuuugg

SEQ ID NO: 304492 - RNA, 64 nt, Human
aaaaccauguuuagcuugcagcuguacaaaaacugcccaccagccagaugugacccucaggcca

SEQ ID NO: 304493 - RNA, 64 nt, Human
agagcaacuuccagcaaggcuggucugggucucugcccaccaggcggggagguguucaaagaca

SEQ ID NO: 304494 - RNA, 64 nt, Human
uggacucuccucggguggguccagcaggggcccugcccaccagaacacaguccgugcugugcug

SEQ ID NO: 304495 - RNA, 64 nt, Human
auaggaaagccuuuccuauuauuucucuucuuagcuucuccauugucuaaaucaggaaaacagg

SEQ ID NO: 304496 - RNA, 64 nt, Human
cugggcacuucucucaguaggugccucaugcugacuucuccaguaggguuucaggacaaacuac

SEQ ID NO: 304497 - RNA, 64 nt, Human
uuccaugggcuccuggcucuggacuguggccaaccuucuccacauuccgcccaaucuguaccgg

SEQ ID NO: 304498 - RNA, 64 nt, Human
uugcaagucaacauuauuuucucuucuuccucagcuucuccauguuuaggaacugagaaagaaa

SEQ ID NO: 304499 - RNA, 64 nt, Human
gugccacccuuuauaauacagcuaugaaaaguuacuucuccauuaauuucuccauucuguuuau

SEQ ID NO: 304500 - RNA, 64 nt, Human
caggauaccaugggaaggagccaucuccacucuccuucuccagaacccccuugaagggccuuug

SEQ ID NO: 304501 - RNA, 64 nt, Human
ugggauuugggaggacacagcaggcagcgcuggccuucuccagggauggcccaaggcuuccgca

SEQ ID NO: 304502 - RNA, 64 nt, Human
aauugccuuaaggccacacuggcaucucccugaccuucuccagggacagaagcaggaguaaguu

SEQ ID NO: 304503 - RNA, 64 nt, Human
uuggaggcugaaaucaccccaggcacugugagggcuucuccagggggcacccuuugagcugugg

SEQ ID NO: 304504 - RNA, 64 nt, Human
ggaggcugucuuuguaccacugcagcaucccccacuucuccacggaagccccaucccaaagcug

SEQ ID NO: 304505 - RNA, 64 nt, Human
uuugcauuugaaaagcagguugaauccuugcucucuucuccaaauuuggugugguauaaagaca

SEQ ID NO: 304506 - RNA, 64 nt, Human
gauuccuaggccuuuucaugcuucauuucuuccacuucuccagaaaauggaagcuaugaagcaa

SEQ ID NO: 304507 - RNA, 64 nt, Human
agccucgguuuuucagcaaaacgcggccaguccccuucuccacugcugccucccagcagagggc

SEQ ID NO: 304508 - RNA, 64 nt, Human
aucuuaacaauauuuuguaaaaugaugcuucccccuucuccauggucuagucaauuuuguacaa

SEQ ID NO: 304509 - RNA, 64 nt, Human
ugucucagccuccuagauaacugggauuacaggugcccaccaccaugcccggcuaauuuuugua

SEQ ID NO: 304510 - RNA, 64 nt, Human
caguguggggcaggcaccccacuggcugcagcuagcccaccauaggcacagcacaucccaccac

SEQ ID NO: 304511 - RNA, 64 nt, Human
acagcacacagggucagggucacuucuagaaauagcccaccaaggcuauucagauuggacugug

SEQ ID NO: 304512 - RNA, 64 nt, Human
aaacaaacaaacaaaaaacacaaaaaaaaccacucuucuccaaaugcccaagccuucuuucaaa

SEQ ID NO: 304513 - RNA, 64 nt, Human
cuccugggugcauccuuagccuuggcaaaauaaacuucuccauugaucgaggccugggucgggu

SEQ ID NO: 304514 - RNA, 64 nt, Human
ccugggcuccugccccgccccuggcuagcagcgccuucuccaccggggccccucugcucacaga

SEQ ID NO: 304515 - RNA, 64 nt, Human
auucauuuauucagcaaauauuuauugaucaucucuucuccauaagauagugugauaaacacag

SEQ ID NO: 304516 - RNA, 64 nt, Human
gcugcaaggagcggggucgugaccgcuuacaccccuucuccacagcccggcccgaccuggaggg

SEQ ID NO: 304517 - RNA, 64 nt, Human
aagaacaagaacugcgccauggcuggcuccuucucuucuccagcccaucccucugcagccuguc

SEQ ID NO: 304518 - RNA, 64 nt, Human
aucaccucccucaccucgggacaguagcccuccacuucuccagccucucagcccugugcuccug

SEQ ID NO: 304519 - RNA, 64 nt, Human
cucuuacuuuugccugaaguaacagcaucuucuacuucuccaucuagagauuuuugugugugug

SEQ ID NO: 304520 - RNA, 64 nt, Human
uugucaccacccacccuaccugcagaguuacuaacuucuccaaggagcaugucacuccagcagc

SEQ ID NO: 304521 - RNA, 64 nt, Human
gguuggccuucucuccucccugccuagaucaguccuucuccaaaaggaccugggagcuggcagc

SEQ ID NO: 304522 - RNA, 64 nt, Human
uaccuccuuccucucuuuuucauucucugucaugcuucuccacuguuuuccccaaugacgcacu

SEQ ID NO: 304523 - RNA, 64 nt, Human
agugcuuuucaaccuuucucucccgaacaucuuccuucuccaaagcugggagucauguugccug

SEQ ID NO: 304524 - RNA, 64 nt, Human
ucaccaaacuuuggcaaaagaugguguuaguccccuucuccagggcacaugagaaaaacaggcc

SEQ ID NO: 304525 - RNA, 64 nt, Human
cauuuuuaacugccccccaaccccacuccaacuccuucuccaccacccauucucccaauggucu

SEQ ID NO: 304526 - RNA, 60 nt, Human
gccgucgguuccuuaacugaggccguggcugcccaccacgaccccucacaccuccugcug

SEQ ID NO: 304527 - RNA, 64 nt, Human
acaacugaagacaacuaacccuuuccccaacagagcccaccagcagugguggagaugucggucc

SEQ ID NO: 304528 - RNA, 55 nt, Human
gggcccacggcucccacuaaggccugcccaccaccgcccgccugggcagccauga

SEQ ID NO: 304529 - RNA, 64 nt, Human
ucuccuuauccccccaaauggaaauuguauuugccuucuccacuuugggaggcucccacuucuu

SEQ ID NO: 304530 - RNA, 64 nt, Human
ugcugaggacacucaguguccaguugcagcuggacuucuccacccggauggcccccacccaguc

SEQ ID NO: 304531 - RNA, 64 nt, Human
gaguccugggcagggaaggggagggaaauugcugcuucuccaacucuugcuuggggccaagccc

SEQ ID NO: 304532 - RNA, 64 nt, Human
ucugucaucuccuuggucacccucugcuccaggccuucuccaccacaggaccucagcugucccu

SEQ ID NO: 304533 - RNA, 64 nt, Human
uugauccucacugagaaggccccagggcagcggucuucuccaucuccgcuguuuuggggucuua

SEQ ID NO: 304534 - RNA, 64 nt, Human
ccccgcagacccgggcacuucucagcauggccaucuucuccacgggcgucugggugacgggcau

SEQ ID NO: 304535 - RNA, 64 nt, Human
guauagaaauccaccuuaaagccccucgccccaacuucuccaccaacgccuucugggcuuucuu

SEQ ID NO: 304536 - RNA, 64 nt, Human
ugugaaccaagaauaaucuagucacgugaaaccucuucuccagucauaguauuucucauucauu

SEQ ID NO: 304537 - RNA, 64 nt, Human
cauaugccaauuaaacccggucuaaauccaaaugcuucuccagccauccaggaguggcuguccu

SEQ ID NO: 304538 - RNA, 64 nt, Human
aauaaaugcagacuaauuuccugcccaaaguggucuucuccagcuagcccuuaugaauauugaa

SEQ ID NO: 304539 - RNA, 64 nt, Human
uucaacgaggcccagugagcagcuucaagagcaacuucuccacauguuggguguccauccuggg

SEQ ID NO: 304540 - RNA, 64 nt, Human
uauuuaguuuuguggggccugucuccgcugccuccuucuccacuucuacaaucucauucucucu

SEQ ID NO: 304541 - RNA, 64 nt, Human
uguuccauugaaucuguauggcuagaauauccuacuucuccagccuagagguacuuuccacuug

SEQ ID NO: 304542 - RNA, 64 nt, Human
ugcggucuagggaaugagacaggaccuaggauaucuucuccaggaugucaacugaccuaaaauu

SEQ ID NO: 304543 - RNA, 64 nt, Human
uaaugaaaucguucacauucccucauaugcacaagcccaccaaccccuucacaccccccuucac

SEQ ID NO: 304544 - RNA, 64 nt, Human
ccaccucagcgggccagcagcccagggaaccccugcccaccaggauugcuggaagugugacgga

SEQ ID NO: 304545 - RNA, 64 nt, Human
uucgccagcacccuuuccccaucauggggcagaugcccaccagcccucacuaucuacugcuuga

SEQ ID NO: 304546 - RNA, 64 nt, Human
uacuagcaccugccagggaggccaucuggggcuccuucuccaccccagcccccaaagcagcccu

SEQ ID NO: 304547 - RNA, 64 nt, Human
augagucuuaacuuaauuacaucugcaaggcccccuucuccaaauaagauaaauucaugguuuu

SEQ ID NO: 304548 - RNA, 64 nt, Human
ggcccauugccuagaaaccuuugcauucauccuccuucuccaagaccuauggagaaggucccag

SEQ ID NO: 304549 - RNA, 64 nt, Human
auggguaacuaucaggaauaucugaagacauuggcuucuccacugcgagagauugauccagacc

SEQ ID NO: 304550 - RNA, 64 nt, Human
ccuuagcagcauuccaucuucccgaucuucuuugcuucuccaaccaaaacaucaauguuuauua

SEQ ID NO: 304551 - RNA, 64 nt, Human
cacagcaggaccacaagggcaaggagaccaccgccuucuccagugcuuccuugggcagccagua

SEQ ID NO: 304552 - RNA, 64 nt, Human
cauagcgggaccacaagggcaaggagaccaccaccuucuccagucucucuucggacagccagua

SEQ ID NO: 304553 - RNA, 64 nt, Human
caccggggcuuuggccaccucuccuuucccccuccuucuccaucccuguaaaauaaauguaauu

SEQ ID NO: 304554 - RNA, 64 nt, Human
gucuggcugcuugcccccaugcuggcgccaacaacuucuccauccuuucugccucucaacauca

SEQ ID NO: 304555 - RNA, 64 nt, Human
ccuccuucaaauucagucaccacuguuauauuaccuucuccaggaacccuccaguggggaaggc

SEQ ID NO: 304556 - RNA, 64 nt, Human
ucaaauugugaacccagagacacucccauccacccuucuccaugcucauccccaaacuggggcc

SEQ ID NO: 304557 - RNA, 64 nt, Human
cccuuccccacuuucacuagagcauccugccugccuucuccacugaggagcagguaaaugggag

SEQ ID NO: 304558 - RNA, 64 nt, Human
ugugucccaccccucaccccuuuacccccauugccuucuccauugucaacucuuggggcacucc

SEQ ID NO: 304559 - RNA, 64 nt, Human
uugaacuuuauaaacuggagagcuacaccauuuucuucuccaaccauuuuacccauuuccuguc

SEQ ID NO: 304560 - RNA, 64 nt, Human
uuguuuguugaauuugugaacaguauagaucucagcccaccaaugccaagacaaaauuauuuuu

SEQ ID NO: 304561 - RNA, 64 nt, Human
gggucaggaaauuacugcccacuugucaaguucagcccaccaucuguuugaagauuauaugaag

SEQ ID NO: 304562 - RNA, 64 nt, Human
ccacgugaggguccagccuccagggacaggcacugcccaccaacggcaaauccaaaguucuuuc

SEQ ID NO: 304563 - RNA, 64 nt, Human
ugagcucgccaauaagcuucuugguucuacuucucuucuccacaagccccaauuucacuuucuc

SEQ ID NO: 304564 - RNA, 64 nt, Human
ugagggaugccagcccccaagagacucagagugccuucuccaucccaguguccacacucuccuc

SEQ ID NO: 304565 - RNA, 64 nt, Human
uauaaauuguggacugcuaugaaaacagguuguacuucuccauaugugagacuacuggaaguga

SEQ ID NO: 304566 - RNA, 64 nt, Human
gacuuuggagaccuagccccagaaagccucccuucuucuccagguccccuccgcccuagucccu

SEQ ID NO: 304567 - RNA, 64 nt, Human
ggucagugagaggaagcugacuagccccuggauucuucuccagaccccccugcuucaggaacac

SEQ ID NO: 304568 - RNA, 64 nt, Human
auuucaggcugcaaacuuguuuuauaaucguuugcuucuccaagugaagcucagaaauaccuaa

SEQ ID NO: 304569 - RNA, 64 nt, Human
aagaaaaaggucaagauuucuaucacuuccccgucuucuccagaacuugugucuccagaggagu

SEQ ID NO: 304570 - RNA, 64 nt, Human
acagggguacacucacacagaccuccaagacuuucuucuccaccucuucuuuuucucaugcccu

SEQ ID NO: 304571 - RNA, 64 nt, Human
uaacaauuuugauagucugaacacaagcauuucacuucuccaagaaguaccugugaacaguaca

SEQ ID NO: 304572 - RNA, 64 nt, Human; identical to SEQ ID NO: 304571

SEQ ID NO: 304573 - RNA, 64 nt, Human
ccugcugacaucgucccuuaguugugguucuggccuucuccauucuccuccagggguucugguc

SEQ ID NO: 304574 - RNA, 64 nt, Human
cccccucccucaaggaauggccuugcccaggaaugcccaccacacauacccucuucuuuuuuuc

SEQ ID NO: 304575 - RNA, 64 nt, Human
guccaacaauucuaaccaacaaaggaccuagacagcccaccaagucacuugguucccacuccca

SEQ ID NO: 304576 - RNA, 64 nt, Human
gaagcaucugccucccaccccucggcccccucaagcccaccaucugcuucugagugucgcacua

SEQ ID NO: 304577 - RNA, 64 nt, Human
gcccugcccagccacccuggacgugaccguaucccucugccacaccccaggcccugcgaggggc

SEQ ID NO: 304578 - RNA, 64 nt, Human
acgcaugaaggcaaaagcaggucagaagcgaauacucugccauuaucucaaaaaucuuuuuuuu

SEQ ID NO: 304579 - RNA, 64 nt, Human
gggauuacaggcaugagccaccgcgcccggcccacucugccauugucuaagccaccucugaaag

SEQ ID NO: 304580 - RNA, 64 nt, Human
cagucuguccuguuguguggggcgaagugauggacucugccagguggacaugcuguggguggau

SEQ ID NO: 304581 - RNA, 64 nt, Human
ccacucaggccaacaagccaacgacaaagccaaacucugccagccacauccaaccccccaccug

SEQ ID NO: 304582 - RNA, 64 nt, Human
gagccgcuggcaagagacagcaugucaccugggacucugccagugcagaauaugaacaaugcca

SEQ ID NO: 304583 - RNA, 64 nt, Human
ggaugaggcuccagagagaguuggcugccacagccucugccaagcuuugucuuuggggcuugcu

SEQ ID NO: 304584 - RNA, 64 nt, Human
ugaugggcaccucuguugguuccaucagccagagcucugccaaaggccccgcagucccucuccc

SEQ ID NO: 304585 - RNA, 64 nt, Human
ugagggucaaagcuguguccuuucccuuaccucccucugccaggacuugcugcagagcugcuga

SEQ ID NO: 304586 - RNA, 64 nt, Human
ggcuuccagcuucaggcaccagcauccaccuuggcucugccaguggauccccugcggucaggcu

SEQ ID NO: 304587 - RNA, 64 nt, Human
cuucuauggacuucagacagccagugucuggggacucugccacucuacccccagcccuacccac

SEQ ID NO: 304588 - RNA, 64 nt, Human
ccuccacucccucgcucccucccucagccccugucucugccaggugccuccucucagucaggcu

SEQ ID NO: 304589 - RNA, 64 nt, Human
uaaaggagggggggcacgagccaacaccccaccccucugccaaccgggguauggcccccagugc

SEQ ID NO: 304590 - RNA, 64 nt, Human
aggugcccucaagcagcugugugaguguugagaucucugccaucucuggcugagauacugcugu

SEQ ID NO: 304591 - RNA, 64 nt, Human
ccagaagaguugaugagggcuacagcuguuggggcucugccagguccccugggaccaacuacag

SEQ ID NO: 304592 - RNA, 64 nt, Human
ucccuccaggccagaacugacuggagcaggcauggcccaccaggcuucaggaguaggggaagcc

SEQ ID NO: 304593 - RNA, 64 nt, Human
cccccuggcccacccuggggucugagccugcugggcccaccacauggaaucacuagcuuggguu

SEQ ID NO: 304594 - RNA, 64 nt, Human
auggcuccuccaccugguaugagaccacccaugggcccaccaauugggcuucccccugcucgag

SEQ ID NO: 304595 - RNA, 64 nt, Human
agaccuguggacucuaguagauuuugaauccugccucugccauuuccuggcuaugaggugucuu

SEQ ID NO: 304596 - RNA, 62 nt, Human
uguacugcaaucuacaauaaguccacuucugccucugccacuacugcugccacaugggaacu

SEQ ID NO: 304597 - RNA, 64 nt, Human
ugggggaagaccucagccacagcuguaagcagcucucugccagccacauggccggggaccgaaa

SEQ ID NO: 304598 - RNA, 64 nt, Human
uuggggcuggggaaggagaguggacuuuggcucacucugccaugagaacaggacaccauccugc

SEQ ID NO: 304599 - RNA, 64 nt, Human
gccaugguguuuaugaagagaagaguagugauugcucugccagaagcagcuccucuuuaaacuc

SEQ ID NO: 304600 - RNA, 64 nt, Human
ccccagugauugauugagagagcuguugggguuucucugccaaugaccccugggagagggacuu

SEQ ID NO: 304601 - RNA, 64 nt, Human
ggcucuuccaucucucaugacuucauggacccuccucugccaguuuuuuaaaucagaucacccu

SEQ ID NO: 304602 - RNA, 64 nt, Human
cuucccugaguuccuccagggagacuagguuauucucugccauagagcuaacuggggucuauau

SEQ ID NO: 304603 - RNA, 64 nt, Human
uuccccccaggcaagggcagcugccagcauggugcucugccaggacagguuucccugaaggaag

SEQ ID NO: 304604 - RNA, 64 nt, Human
cuaucucugcucgcuguucucccguuguuuuugccucugccauagagcucaccucauuuugccu

SEQ ID NO: 304605 - RNA, 64 nt, Human
aggagaauuuucaagaaccauacuucgacauuuccucugccacaaaaaaugaacgcauuuuaag

SEQ ID NO: 304606 - RNA, 64 nt, Human
gcaaaagggucuggcugucccuugcuguuuucaucucugccaagccuauugugccucuggcugc

SEQ ID NO: 304607 - RNA, 64 nt, Human
ccuccuccugcccuccccuucacucccucccuggcucugccagucgguucccacggagccauuu

SEQ ID NO: 304608 - RNA, 64 nt, Human
aucccugguugccucauggccagcgccccucagccucugccacugugaaccggcucccacccuc

SEQ ID NO: 304609 - RNA, 64 nt, Human
gaggaucauuuuaucacauuagacuggggcagaacucugccaggauuuaggaauauuuucagaa

SEQ ID NO: 304610 - RNA, 64 nt, Human
uaaaacauucaccagaaaccuuuugcacaucggucucugccacacgcaguagaauuuccgcagg

SEQ ID NO: 304611 - RNA, 64 nt, Human
ggcagaggccaggaggggaccuggugugucaccugcccaccaccuggcucaucccucaggccca

SEQ ID NO: 304612 - RNA, 64 nt, Human
gccaggaugcacagaccgaccgacagaccucagugcccaccacgggcuguggcggagcucccgc

SEQ ID NO: 304613 - RNA, 64 nt, Human
ugggggccucgggaggcuaggccccuccucaaaggcccaccagcccggcgcucaugcugagccc

SEQ ID NO: 304614 - RNA, 64 nt, Human
gaucugagaauguccuucuugguuugucagucaucucugccaaaaguggugauggugguguccg

SEQ ID NO: 304615 - RNA, 64 nt, Human
agguguuugcucucuccuuguggggagguggauccucugccagcaggugucuguccccggccca

SEQ ID NO: 304616 - RNA, 64 nt, Human
cuggcguuucacuugugucugcuccuagccugugcucugccagcagcacagacaucugcuccau

SEQ ID NO: 304617 - RNA, 64 nt, Human
aaggacuuugcagccggcacagggucugcucuuucucugccagugacagacaggcucuuagcag

SEQ ID NO: 304618 - RNA, 64 nt, Human
ccccacagcuaccugagacgggcaucgcaggagucucugccacccacucaggauugggaauugu

SEQ ID NO: 304619 - RNA, 64 nt, Human
caguuaucagggaguccugugucacaaggucugucucugccauuguaagcaagugccuugggcg

SEQ ID NO: 304620 - RNA, 64 nt, Human
aggcaugaccugacugcacuguugcugacuacuacucugccaaucggcuaccccucgacucagc

SEQ ID NO: 304621 - RNA, 64 nt, Human
ugccagaaagcugcugacugcagaacuaggcucccucugccacgguccgugccagccaauagau

SEQ ID NO: 304622 - RNA, 64 nt, Human
ccugcugccuccagacucuuucaugagcgccaaucucugccaggggcuccggcuaccagugcuu

SEQ ID NO: 304623 - RNA, 64 nt, Human
uuuaucuucccuugucuuccugcuuugcauuugccucugccaucuaggaaagacauguaagagc

SEQ ID NO: 304624 - RNA, 64 nt, Human
cuucaagccuccccacuccaccgugccgaaggagcucugccagugggccugggcaggcagccac

SEQ ID NO: 304625 - RNA, 64 nt, Human
gucuugucuuuuguuccacucuugacucucccggcucugccacuguuuucugagaaauguagca

SEQ ID NO: 304626 - RNA, 64 nt, Human
caccuuauacacacgaggcuuucucaggaaguggcucugccaggcaggacuaugugggaaaggg

SEQ ID NO: 304627 - RNA, 64 nt, Human
uuuuuuuuuuuuuuuuuuuugagacagaguagcucucugccagccaggcuggagugcaguggca

SEQ ID NO: 304628 - RNA, 64 nt, Human
ccaccugcuuguucacaugcacaggugcucucagcucugccaaagcgaaugaaugguguuuccg

SEQ ID NO: 304629 - RNA, 64 nt, Human
uucugcccuggguucuuccacagcacaaacacaccucugccaccccagguuuuucaucugaaaa

SEQ ID NO: 304630 - RNA, 64 nt, Human
aggugggugccccagaguagauuccaccccugcugcccaccaauggagaaucccaauguugaau

SEQ ID NO: 304631 - RNA, 64 nt, Human
acauggcccuuugcuugagggcuccccacucccugcccaccaauacccaggugaggaacagacc

SEQ ID NO: 304632 - RNA, 64 nt, Human
uacuugcccuagcaugaggcucugagagccaccugcccaccaaucuggugaggauaaugguggc

SEQ ID NO: 304633 - RNA, 64 nt, Human
aaauaauuaaaugaauuauuuauucauuucucuccucugccaaaucuacuuagccccacaaaaa

SEQ ID NO: 304634 - RNA, 64 nt, Human
gguaggaggagggugcacauaacccuuacccuaccucugccaaaaagugggggcuguacugggg

SEQ ID NO: 304635 - RNA, 64 nt, Human
cauuccauuuaaguuuuggggcaucuuuccugcccucugccaaccucccugcuggcccagguga

SEQ ID NO: 304636 - RNA, 64 nt, Human
uaaggagggugugggggagcccugagggcugccucucugccagucagccacagagacccuccuc

SEQ ID NO: 304637 - RNA, 64 nt, Human
acgaagaguccaaaaaaucuagguggccucucagcucugccaccucuagcugcaugaccuuggg

SEQ ID NO: 304638 - RNA, 64 nt, Human
aguuagcccucugugcuucucccugcagcccuaccucugccaaggucucucccuccagggaccu

SEQ ID NO: 304639 - RNA, 64 nt, Human
cuuccaggcaauuuccauagaucugcaguccugccucugccacagucucucuguuguccccaca

SEQ ID NO: 304640 - RNA, 64 nt, Human
gaauauuggccugaaauuuucuuuuccacugugucucugccagaauguuuguaucaggcugaug

SEQ ID NO: 304641 - RNA, 64 nt, Human
auaaaaugaagaaaucagugucaucucuacucuccucugccaugaggccauuuucagacaaguu

SEQ ID NO: 304642 - RNA, 64 nt, Human
uaggaauagcauuguaguaauggugaugaauaugcucugccaaauucauccagucugcaccauc

SEQ ID NO: 304643 - RNA, 64 nt, Human
aauaaacuuaaaacacuuuguaaccauguauuuacucugccaggugccuauauuccaauaaaau

SEQ ID NO: 304644 - RNA, 64 nt, Human
auaauuagguauuuucuccaaauguucacugguacucugccacuuuauuucucucaucuguuac

SEQ ID NO: 304645 - RNA, 54 nt, Human
gcuucgccuuggcccgcugaggcccucugccacccaggcaggcccugccuucag

SEQ ID NO: 304646 - RNA, 64 nt, Human
uaacugccuuuaggucccaacccugugccugucccucugccacaguggcuuccuuccauccuau

SEQ ID NO: 304647 - RNA, 64 nt, Human
auacauguaaaauaccaagaaauaaugucugcgccucugccaccucucucucaucucuuauuuc

SEQ ID NO: 304648 - RNA, 64 nt, Human
caguuccagugauagaaaacccacacaauacauccucugccagucuuaauagaauaucagaggu

SEQ ID NO: 304649 - RNA, 64 nt, Human
ucucgacacguaccacguacguggaaacacaagagcccaccacuugaauuucuaagaccauuuc

SEQ ID NO: 304650 - RNA, 64 nt, Human
agaaagaccaucaaucaggggccauaguacaggagcccaccagcaggauuuuugaauaauccua

SEQ ID NO: 304651 - RNA, 64 nt, Human
ggaagagggcucacaagacacauuugucccccgggcccaccacaucauccucacguguucggua

SEQ ID NO: 304652 - RNA, 64 nt, Human
ugucuuuacuuuuguugaccagaauaguugguaacucugccagagccuguacuuaccugccaaa

SEQ ID NO: 304653 - RNA, 64 nt, Human
cuuggaauugcaacccaugaguucagaaggcacacucugccaugcugagcuccaagggugcuac

SEQ ID NO: 304654 - RNA, 64 nt, Human
uccccuggacagacucugaaggcccucccggcaccucugccaaggcuggguaagacuccucuau

SEQ ID NO: 304655 - RNA, 64 nt, Human
gcuggagauggcugcugcucacccuccuagccugcucugccacugggacggcuccugcuuuugg

SEQ ID NO: 304656 - RNA, 64 nt, Human
aauugguaccauauuuucccuuugugucuugugacucugccacaucccaucucauccuggccuc

SEQ ID NO: 304657 - RNA, 64 nt, Human
cuuuauuuauuuccuugcauauguuuuagagcuacucugccaguuauuauacagaaacuauuug

SEQ ID NO: 304658 - RNA, 64 nt, Human
agccucugucuucuucggcaaaccuugcuuugaacucugccaguauuucauuuuaaagaauccc

SEQ ID NO: 304659 - RNA, 64 nt, Human
cgauauuucuuuuuuuuuccgagacggagucuugcucugccacugugcccggccaauacauuau

SEQ ID NO: 304660 - RNA, 64 nt, Human
ccgccugccccagcuuccccgacuccaucugcagcucugccauugugacauuuccuguuaccca

SEQ ID NO: 304661 - RNA, 64 nt, Human
gggauugggucgugguggagaaucugagggcacucucugccagcuccacagggugggaugagcc

SEQ ID NO: 304662 - RNA, 64 nt, Human
agccagauggcccccagccuaugggggaucuggccucugccagggaccucugaguagcucugag

SEQ ID NO: 304663 - RNA, 64 nt, Human
gauuuuuuccaaggacugggagcaaacuugcaggcucugccauguacuuauugugggguaccuu

SEQ ID NO: 304664 - RNA, 64 nt, Human
aaaagacacugcagcuucuacuugagcccucucucucugccacccaccgcccccaaucuaucuu

SEQ ID NO: 304665 - RNA, 64 nt, Human
cagugcaagguacucugaguccccucuguagugccucugccagacacacacugccugaguugaa

SEQ ID NO: 304666 - RNA, 64 nt, Human
auuugcaucugccaagcauaaugcaucuuuuuuccucugccauucuuguguugauuggagaauu

SEQ ID NO: 304667 - RNA, 64 nt, Human
agauguaacuuuuagcaguuuguuaaccugacaucucugccagucuaguuucugggcagguuuc

SEQ ID NO: 304668 - RNA, 64 nt, Human
cauugccccucccauccaugcugggacccuccuggcccaccaaggcccaggcaccacugugaau

SEQ ID NO: 304669 - RNA, 64 nt, Human
ugccucagccuccugaguagcuggcauuauaggugcccaccaccaugccuggcugauuuuugua

SEQ ID NO: 304670 - RNA, 64 nt, Human
uggucuuugcaaaaaggaacaaaacaacacaaaagcccaccaggcugcugcuuuguggaaagac

SEQ ID NO: 304671 - RNA, 64 nt, Human
ucuuugcuugguuagguuaaggaugauagaauuucucugccagugcaguaagaguugaaaccgg

SEQ ID NO: 304672 - RNA, 64 nt, Human
guggucucaugaagaaaagaccuuuuggcccaaucucugccauaucagugaaccuuuagaaacu

SEQ ID NO: 304673 - RNA, 64 nt, Human
uagugguuugggcugggccuuuugugcccugguacucugccaccuguguugcugauggugucaa

SEQ ID NO: 304674 - RNA, 61 nt, Human
agcagcaugaagugcucuaaagacagagacccucugccaccagagaccguccucaccccug

SEQ ID NO: 304675 - RNA, 64 nt, Human
acuugucugaagguggugauucuggccauggccccucugccaagccugugugcgaugcccuugg

SEQ ID NO: 304676 - RNA, 64 nt, Human
agcugggcccaaaggcccagggaggcagcgugggcucugccaaugugggcugccccucgcacac

SEQ ID NO: 304677 - RNA, 64 nt, Human
cggccaccugcagagccucuacacagagaggcugcucugccauacgcgggcgcugccuggggcc

SEQ ID NO: 304678 - RNA, 64 nt, Human
ccugcugccuugugaagaaggugcuuguuucucccucugccaugauuguaaguuucccgaggcc

SEQ ID NO: 304679 - RNA, 64 nt, Human
ucuagaaaucaaaugacugauaagcauuggaucccucugccauuuaauggcaaugguagucuuu

SEQ ID NO: 304680 - RNA, 64 nt, Human
ugaggugggccuuccaugggcauggccguugccucucugccagccgcuggugcccaccagcugg

SEQ ID NO: 304681 - RNA, 64 nt, Human
cugagagcaagaagccuguguggucugggccagucucugccauguccugagucugcuucagucu

SEQ ID NO: 304682 - RNA, 64 nt, Human
cuugacccggguucccccacucccauucccuggccucugccauaauuuguuguucaacugcucc

SEQ ID NO: 304683 - RNA, 64 nt, Human
aaauagacuuagauuuauuaauagaaacuauacucucugccaauuuuaccucaguguauuuaau

SEQ ID NO: 304684 - RNA, 64 nt, Human
uugcuuuguauugugagaguaucuuuguugcuugcucugccaaaugcagucuugguucuaaguu

SEQ ID NO: 304685 - RNA, 64 nt, Human
gcugagauccuugggaacacuguugucaugggggcucugccaagacccucaucucugggcuaca

SEQ ID NO: 304686 - RNA, 64 nt, Human
gcuagauaaauagaaacuaauaauagcucuauuucucugccaauauaaaaucuaccuuucauau

SEQ ID NO: 304687 - RNA, 64 nt, Human
ugccucagcuucccgaguagcugggacuacaggcgcccaccacgacgccuggcucauuuuuuug

SEQ ID NO: 304688 - RNA, 64 nt, Human
ugccucagccucccaaguagcugggauuacaggugcccaccaccaccccuggcuaaauuuguau

SEQ ID NO: 304689 - RNA, 64 nt, Human
auggcccugccacaucccguguaacauaaguggugcccaccauguuugcacuuuuaauaacucu

SEQ ID NO: 304690 - RNA, 64 nt, Human
uuuucuucagaauuauccauuacgugcauuuaaacucugccagaaaaaaauaacuauuuuguuu

SEQ ID NO: 304691 - RNA, 64 nt, Human
aucaucuuuccaauccagaggaacaagcaugucucucugccaagauccaucuaaacuggaguga

SEQ ID NO: 304692 - RNA, 64 nt, Human
ucucuuaguggauugagcccucuuggaaagacuucucugccaucccuuugcaccugagagggga

SEQ ID NO: 304693 - RNA, 64 nt, Human
ggguccccagauucugcucuaagggggccagacccucugccaggcuggauuguacgggccccac

SEQ ID NO: 304694 - RNA, 64 nt, Human
gagcccagcugccucugcccacccuuccccaggccucugccagccucuggcugcacggucaggc

SEQ ID NO: 304695 - RNA, 64 nt, Human
caugagcccgaccucucucggagcagcuucaggccucugccaguguccccagcacuuuuagguc

SEQ ID NO: 304696 - RNA, 64 nt, Human
cugagucaggacaccuggcuucuugaaaaguucgcucugccagaaaccaccuagggaccacguu

SEQ ID NO: 304697 - RNA, 64 nt, Human
ugcaauggcauggcuguuggucauucacaucucucucugccaagaauggggaugacgcuguuga

SEQ ID NO: 304698 - RNA, 64 nt, Human
agccuccuuggccccaguauaaguguugggaacucucugccagcuuccugaguucugccuaaag

SEQ ID NO: 304699 - RNA, 64 nt, Human
ggcauacauauuucacuguuuccaaagcuaucuacucugccaaacaacacccaguccuauucca

SEQ ID NO: 304700 - RNA, 64 nt, Human
gcuuuggcauggggauagagaggcuccaucuaggcucugccaacucaugucaaugacaugauuu

SEQ ID NO: 304701 - RNA, 64 nt, Human
caauuauggaauaggcuauguauuuaauauuaaucucugccauuaggauaucuacucacuguau

SEQ ID NO: 304702 - RNA, 64 nt, Human
ucaccccaguggccacucagcuuccuacccacaccucugccagaagauccccucaggacugcaa

SEQ ID NO: 304703 - RNA, 64 nt, Human
agaaaggggccugggcagcagguguggccagucccucugccaaggccugugccagagggguugg

SEQ ID NO: 304704 - RNA, 64 nt, Human
gcugugggcgggcuuggucugguaaccuugucugcucugccauuccacugcuccuccauccacu

SEQ ID NO: 304705 - RNA, 64 nt, Human
cacucaggccccagugccucuauuugcuaagggacucugccacagaaaagaaggggagagaugu

SEQ ID NO: 304706 - RNA, 64 nt, Human
aguaaggagaaacagagaggggcaaaguugcucugcccaccagaacugaagaggaggggcugcc

SEQ ID NO: 304707 - RNA, 64 nt, Human
ccgaguagucccaggaguagcugggacuacaggugcccaccaccacacccagcuaauuuuuuug

SEQ ID NO: 304708 - RNA, 64 nt, Human
ugagugagacaaauacagaaaugacccauucccugcccaccagaaacucagaggugauugggga

SEQ ID NO: 304709 - RNA, 64 nt, Human
caaugaaccgccaggaacugaccugcugacugcacucugccaggcuucccaaugcuuucacucu

SEQ ID NO: 304710 - RNA, 64 nt, Human
acaaauucucugaagaccaccuaaauaucacuugcucugccacugcccgcccagcccccauggu

SEQ ID NO: 304711 - RNA, 64 nt, Human
uuaaugagcagguuuccacugugggcgguuggcacucugccaucugaguccucugccuaaagca

SEQ ID NO: 304712 - RNA, 64 nt, Human
ugggacagcagucuccgagcuacuccguaccucccucugccaggucguggaguuaggccccagu

SEQ ID NO: 304713 - RNA, 64 nt, Human
gcuagcuccguguuuaguccacuugggucaucagcucugccaagcugagccuggccaagcuagg

SEQ ID NO: 304714 - RNA, 64 nt, Human
gucccugugggugaaacagaacaaucgcugcccucucugccagcaggacugggugguccaaaga

SEQ ID NO: 304715 - RNA, 64 nt, Human
uuuuuuuuuuuuuuuuugugggggugaagucuugcucugccacccaggcuggagugcaguggca

SEQ ID NO: 304716 - RNA, 64 nt, Human
ccugugaguggucaggggcugauguggcaacacccucugccaagagacagagcuguccugagaa

SEQ ID NO: 304717 - RNA, 64 nt, Human
agguuugcucgucacaguguggggaagcccauuccucugccaggcucuaaagccaaaggucuag

SEQ ID NO: 304718 - RNA, 64 nt, Human
agcuagccuucugaaccucgccugaagccagccucucugccaagucacucaggucaugggcauu

SEQ ID NO: 304719 - RNA, 64 nt, Human
agaaucuucacuccaggcacauagccccaaccaccucugccagcaaccuugagaggaaggacaa

SEQ ID NO: 304720 - RNA, 64 nt, Human
agcuaggcuucaggaggcccgcguccuacgcaggcucugccacagggguuagaccccagguccg

SEQ ID NO: 304721 - RNA, 64 nt, Human
gcauuucagagccagcaucccccaacucccaccccucugccaucacccaacccaaacacaucag

SEQ ID NO: 304722 - RNA, 64 nt, Human
cugccucccuucaccuggagugccacaccccucucucugccaguucagcucuucauucuucaag

SEQ ID NO: 304723 - RNA, 64 nt, Human
uagagacucagcuguugucacacccaaagggaugcucugccaaagguuuaaacacccaggagac

SEQ ID NO: 304724 - RNA, 64 nt, Human
ccucgagaugggugcugguccuguugaucccagucucugccagaccaaggcgaguuuccccacu

SEQ ID NO: 304725 - RNA, 64 nt, Human
gaaaaacauaaaggaaaaaacuccaauccccugagcccaccacuguucaggaccccugcuuuug

SEQ ID NO: 304726 - RNA, 64 nt, Human
cuucagauggcuuugauuucggcaagcuggaauggcccaccagcccaucccagaucuuccuuua

SEQ ID NO: 304727 - RNA, 64 nt, Human
cccagccuccucagaccccgccugccuguccugugcccaccacgcagcagucaggggagaaaau

SEQ ID NO: 304728 - RNA, 64 nt, Human
guaaugagaagcuuugguucugccaucucucccacucugccaggugcuggcuguggagcaaagg

SEQ ID NO: 304729 - RNA, 54 nt, Human
cuacaaaggcuucagaguagauaucucugccaacaugaggacagaaggacuggu

SEQ ID NO: 304730 - RNA, 64 nt, Human
cucaucauuuggacaugugacuggcuuuuccuaccucugccaugguguagaaauugauugcaca

SEQ ID NO: 304731 - RNA, 64 nt, Human
cucuggagcccaggccccaacacagccccauggccucugccagauggcuuugaaaaaggugauc

SEQ ID NO: 304732 - RNA, 64 nt, Human
aaaaucucuuuaccuccuuggccauuuucauguucucugccaauuacuauaggcagucuucauu

SEQ ID NO: 304733 - RNA, 64 nt, Human
aggaaguauaagucauugacaguuuccugaguggcucugccaauccauaccacccuugguacug

SEQ ID NO: 304734 - RNA, 64 nt, Human
ucuuguguuccugacuccuucccaaugaacaccucucugccaccccaagcucugcucuccuccu

SEQ ID NO: 304735 - RNA, 64 nt, Human
aaaucccuucuaggccucugccucagugucccaccucugccacaggagcugugaucuuuguguu

SEQ ID NO: 304736 - RNA, 64 nt, Human
ugacaagcuaagaugaaauucugacauaguacaucucugccaaaaaccacacacccucugugga

SEQ ID NO: 304737 - RNA, 64 nt, Human
uguuauaucugauuuucauguaacucauuggaaacucugccaugacucuuaaaguagucuuacu

SEQ ID NO: 304738 - RNA, 64 nt, Human
uguaccuuaccacagucuuauauuguuuuuuaaacucugccaugaaauuuggagacaugacugu

SEQ ID NO: 304739 - RNA, 64 nt, Human
auuuugaaacuggauugauuugcauuuccuggaacucugccaccucauuucacaagcauuuaug

SEQ ID NO: 304740 - RNA, 64 nt, Human
ggagugcaauggugcaauuucagcucacugcaaucucugccacccggauucaagcaauucuccu

SEQ ID NO: 304741 - RNA, 64 nt, Human
ccaagucucacagaggccuggguucaagucccaccucugccacuaacuggcaugugacccuauc

SEQ ID NO: 304742 - RNA, 64 nt, Human
ugcgcuaacacuguccuguccggagcgacccuggcucugccagcguccccggccacgucugugc

SEQ ID NO: 304743 - RNA, 64 nt, Human
gcacaugccgcgggcggccaggcaacgugcgugucucugccauguggcagaagugcucuuugug

SEQ ID NO: 304744 - RNA, 64 nt, Human
uccagccucugccgcugccaugcuuugaguccacgcccaccagccuugcucucuucaauaaacc

SEQ ID NO: 304745 - RNA, 64 nt, Human
ugccucagccucuugaguagcugggauuacaggcgcccaccaccacagccugcuaauuuuugua

SEQ ID NO: 304746 - RNA, 64 nt, Human
gcacaucuggcucacuccccacuccgucucuggagcccaccagggaaggcccucauccccugcc

SEQ ID NO: 304747 - RNA, 64 nt, Human
ggggagcugaaagggagccccuccucugagcagccucugccaggccuguaugaggcuuuuccca

SEQ ID NO: 304748 - RNA, 64 nt, Human
ucccaugcuggcaacagcccugcaaggggcuuggcucugccacagggcaggagaggaaguugua

SEQ ID NO: 304749 - RNA, 64 nt, Human
cccgcauucaccugcuuuugcaguaauaucguaucucugccauguguguucuuuaguuuuauuu

SEQ ID NO: 304750 - RNA, 64 nt, Human
aggagaaaacagaauuugguggauaccuaguagucucugccauacccuugaccagaaauuuuuc

SEQ ID NO: 304751 - RNA, 64 nt, Human
auuggcagcacaagauccugcagagccucuuucccucugccacaguuaucaagaaugggucagg

SEQ ID NO: 304752 - RNA, 64 nt, Human
gaagcugcaccuggcucccacuuucaacaagagccucugccauccacuugaggguauugagagc

SEQ ID NO: 304753 - RNA, 64 nt, Human
aguucuuauuguugggaaagaacacuaguccuaccucugccacuaaugagguguuuggaggagg

SEQ ID NO: 304754 - RNA, 64 nt, Human
gauauguuaacaauuuaguguuugacauugcuuccucugccacaaagacaauacucuggugaca

SEQ ID NO: 304755 - RNA, 64 nt, Human
gucaccagggaucuggguucuucccagcucucugcucugccaucuuuagcgcuggcuucauucu

SEQ ID NO: 304756 - RNA, 64 nt, Human
ggugucuaugugauaaugaguuucagaggcugaucucugccaaauaccuuaauuggugaugccu

SEQ ID NO: 304757 - RNA, 64 nt, Human
ugcaaaugcaaauggucaauucagaagaaagugucucugccauagguguguauguguauaugug

SEQ ID NO: 304758 - RNA, 64 nt, Human
cacuugcccaugcuauuuguucuucaagaacuuucucugccaucaacuacuauucaaaaccuca

SEQ ID NO: 304759 - RNA, 64 nt, Human
agagugcagugguaugaucucagcucacugcaaccucugccacccagauucaacagauucuccu

SEQ ID NO: 304760 - RNA, 64 nt, Human
uugcagugcggcuuucugggcacaggugucacugcucugccaccuaucacuauucuuuuucugu

SEQ ID NO: 304761 - RNA, 64 nt, Human
ggaagcaaagaggugagcuuaaagaacaaccaaacucugccaggggucccagaaagcccagggu

SEQ ID NO: 304762 - RNA, 64 nt, Human
cccagcaguuugagaccaauguagugagacucaucucugccaaaaaaaaaaaauuagccgggca

SEQ ID NO: 304763 - RNA, 64 nt, Human
gucccccaggcuggagugcaguggcgcgaucuuggcccaccacgcccgccuaauuuuuuguauu

SEQ ID NO: 304764 - RNA, 64 nt, Human
ggggccagcugggaaaugcuaaggagcugagggugcccaccaagcccaccuuccagaaacuugg

SEQ ID NO: 304765 - RNA, 64 nt, Human
cgggacugacagccucccagaggcccguggaggagcccaccagccccuucuucuugugaaggaa

SEQ ID NO: 304766 - RNA, 64 nt, Human
cacccugcguuucucccucccaggcuaggaaccucucugccaccaagggcugccauccaucgcc

SEQ ID NO: 304767 - RNA, 64 nt, Human
gcuugggagucagacuggaugggguagguucuaacucugccacugcuagccggaugaacuugag

SEQ ID NO: 304768 - RNA, 64 nt, Human
uaaccagaaaacccacugacuuugaaaaucucaccucugccacccaucuacuugcauucgucuu

SEQ ID NO: 304769 - RNA, 64 nt, Human
ccccacuuggacacaaguguucagagaggucccccucugccacuugacagggaccuucaaaccu

SEQ ID NO: 304770 - RNA, 64 nt, Human
aggacccccaguccugcagugucuguggggguuucucugccagcagggggcugagcagagccca

SEQ ID NO: 304771 - RNA, 64 nt, Human
ggccuacgcuccgggaaggggcccccagcuguggcucugccaugccgggcuguguuugcagcug

SEQ ID NO: 304772 - RNA, 64 nt, Human
guuggccaaaagcugcuuuccauggcacacugcccucugccacugacaggaaaguggaugccau

SEQ ID NO: 304773 - RNA, 64 nt, Human
cccacuucacagguccaugggucugacccuuggacucugccaggaucaacugcccagagugcca

SEQ ID NO: 304774 - RNA, 64 nt, Human
ucuuuuagacucacaagucagacguucgauuccccucugccaauagccaguuuuauuggaguga

SEQ ID NO: 304775 - RNA, 64 nt, Human
auauauaguuucauuuaaucauuucaaaguuaaucucugccaucucgcuaaaucaucagucucg

SEQ ID NO: 304776 - RNA, 64 nt, Human
augacuuauuucacuuagaauacauuucucccuucucugccaucuccacaaaugccauugggag

SEQ ID NO: 304777 - RNA, 64 nt, Human
uucuuuucuaugaauaauagaggaacuuacggcacucugccauuuguuaaugaaaggaagugca

SEQ ID NO: 304778 - RNA, 64 nt, Human
uugcaaaugcuccauaaacagccacaguguggggcucugccaugaggaagucacagcagacacg

SEQ ID NO: 304779 - RNA, 64 nt, Human
cuugucccacccccacccgaucauaccuuccccccucugccacagcuuagcaugaaucuucuuu

SEQ ID NO: 304780 - RNA, 64 nt, Human
gccaagguggacucagcuccggggagaagggccucucugccauuucggucccaaggugagcuga

SEQ ID NO: 304781 - RNA, 64 nt, Human
cugcccuuggggggaggaggaccugugugucaggcucugccaugggaacgaguguaaaccgugg

SEQ ID NO: 304782 - RNA, 64 nt, Human
ccagugucuucucuacauggcauaaagcggcaaagcccaccauuaggugaggcggucccgaguu

SEQ ID NO: 304783 - RNA, 64 nt, Human
cugccucagccucucaaguagcgggauuacaggcgcccaccaccaaaaauuagcccagcuaauu

SEQ ID NO: 304784 - RNA, 64 nt, Human
cucccuggacgaccggccucgaggcaacccuggggcccaccagccccugccaugcucucacccu

SEQ ID NO: 304785 - RNA, 64 nt, Human
auagaguccuggcuucccgcagacgacuuucacacucugccauguucaugccugugggccucuc

SEQ ID NO: 304786 - RNA, 64 nt, Human
uccgucagugucuuuuucucuccucucucucuugcucugccauggcuauuuccacugcucuauu

SEQ ID NO: 304787 - RNA, 64 nt, Human
aggacaccuguacuggagagcaacacaggauggucucugccaugaacuggaggccaggaaucuc

SEQ ID NO: 304788 - RNA, 64 nt, Human
cugcaaaguguuaguagguaugagguguuugcugcucugccacguagagagccagcaaagggau

SEQ ID NO: 304789 - RNA, 64 nt, Human
gguggcccagccagcuggccagccuccacucccacucugccagacacccugacacccacccagg

SEQ ID NO: 304790 - RNA, 64 nt, Human
uccccuugaggccagcugcuaugccagguggugucucugccaggcuccucaggcccagacagag

SEQ ID NO: 304791 - RNA, 64 nt, Human
cuuuggaacagacacauccgacauaaaauuccugcucugccacagcuccacucagggaucaugg

SEQ ID NO: 304792 - RNA, 64 nt, Human
cuccuccagguauuugaguuguuuuggugccugccucugccaugcccagagaaucagggcaggc

SEQ ID NO: 304793 - RNA, 64 nt, Human
uaccuccccugcgucacacugugugaggcugugucucugccauccaaaagggggccccuugaga

SEQ ID NO: 304794 - RNA, 64 nt, Human
cuggccuucaacuucuccccuugaccggguccaacucugccacucaucugccaacuuugccugg

SEQ ID NO: 304795 - RNA, 64 nt, Human
cuugcaugaaugcucucuucuguguuuagguauucucugccacucuugcugugaaauugaagug

SEQ ID NO: 304796 - RNA, 64 nt, Human
gaucccgcuaggcuggucccgacuggagaagcugcucugccaggugugcucucugucagcaaua

SEQ ID NO: 304797 - RNA, 64 nt, Human
agcaaaaagucugcaaaccccagggucaagccugcucugccacaggguuggauggugaccuugg

SEQ ID NO: 304798 - RNA, 64 nt, Human
caacucccugcccgcuccuucagcaggugacugucucugccacuucuuaccugcugaaggaucu

SEQ ID NO: 304799 - RNA, 64 nt, Human
caaaacaacugcuauuauaauucucaaaguccuacucugccaaaagaagauuaaaagucauaca

SEQ ID NO: 304800 - RNA, 64 nt, Human
uggccugcauguacaaacuucuacccuagaagcucucugccaucgauguauucuaauagauuug

SEQ ID NO: 304801 - RNA, 64 nt, Human
uccccuuucugccuggucagccccguggccucuggcccaccaagcucccugucacccagccaug

SEQ ID NO: 304802 - RNA, 63 nt, Human
aguaccguaacguggagugaggggcugcccugggcccaccacugcccaagaguucuugcuguu

SEQ ID NO: 304803 - RNA, 64 nt, Human
ucucgacuggaggaccacacucaagccgacuuaugcccaccaucccaccucuggauaauuuugc

SEQ ID NO: 304804 - RNA, 64 nt, Human
gaucucccagucuuguccuuacccauuccaagugcucugccagccccuguucauccaaguuuua

SEQ ID NO: 304805 - RNA, 64 nt, Human
ucuuugcuuuuggacugaccuggggguaucuccccucugccaccccaauugugaauaaagauug

SEQ ID NO: 304806 - RNA, 64 nt, Human
uccccagcauggauggccacagcucagccgccuccucugccaccagcugcucgcagcccaugcc

SEQ ID NO: 304807 - RNA, 64 nt, Human
gguccuucaccacccagccgcuggaggaagccuucucugccagcgaucucgcagcacuguguuu

SEQ ID NO: 304808 - RNA, 51 nt, Human
ucuaccucaaucaucccugaccucugccauucacacugacuuagaacgggg

SEQ ID NO: 304809 - RNA, 64 nt, Human
ggaauauguggucucccuggccucagggcucugacucugccaggguggggcucucuaacccaca

SEQ ID NO: 304810 - RNA, 64 nt, Human
gagugcuccacucccuagcagagcagagggaagucucugccagguacccacgccacaggccuca

SEQ ID NO: 304811 - RNA, 64 nt, Human
uugggcauccuaggugaauuuggccuugguugggcucugccaaagacuaauggacuaaaaugug

SEQ ID NO: 304812 - RNA, 64 nt, Human
auaucagccaguuccuguaauuuugugacacgcucucugccaagcccaccaaguauuuccuuua

SEQ ID NO: 304813 - RNA, 64 nt, Human
uuuauccuccugcuuaggccgugucuuccucucucucugccauuuucucuaucagaaaacauua

SEQ ID NO: 304814 - RNA, 64 nt, Human
cacauagugugcuuugauuguauuuuggcuuugacucugccauuucugaaaugugggggaggau

SEQ ID NO: 304815 - RNA, 64 nt, Human
cccacaaguucccuuaagucuugcccuagcugugcucugccaccuuccagacucacuccccucu

SEQ ID NO: 304816 - RNA, 64 nt, Human
cuccugccccaaagugccaagccauuugugaaggcucugccagacaccuccaagcuugagagcu

SEQ ID NO: 304817 - RNA, 64 nt, Human
caguacuaugauauucaaguaccuugcagcauuucucugccauugcuuucaaugaggccagagg

SEQ ID NO: 304818 - RNA, 64 nt, Human
caauauagggacauaggcuccaucuauuuuguggcucugccacccucuacagccuucaugcccc

SEQ ID NO: 304819 - RNA, 64 nt, Human
aacuguguuuuguucuuuagacauuuaugagauucucugccacuaacaguaaauaugauuuagg

SEQ ID NO: 304820 - RNA, 64 nt, Human
uuggggccgaacagccccugcccugccucugagggcccaccagccugugcugcauacccaccgc

SEQ ID NO: 304821 - RNA, 64 nt, Human
ucucucagccuccuggguagcugggauuacaggugcccaccaacaugccuggcuaauuuuugua

SEQ ID NO: 304822 - RNA, 64 nt, Human
ugccucagcauccuaauuaguugggauuacaggcgcccaccaccaugcccggcuaauuuuugug

SEQ ID NO: 304823 - RNA, 64 nt, Human
acuaaccaucugaagaaacuucccaaguguaagacucugccauuaaaacauuaccgagagggga

SEQ ID NO: 304824 - RNA, 64 nt, Human
ucuguuugcuuguguuuguuuguuugcagucucucucugccauggccuuggcaggcugcuggaa

SEQ ID NO: 304825 - RNA, 57 nt, Human
uguguagauacccuucaugagacccaacucugccacagcucauccucggaggcaauc

SEQ ID NO: 304826 - RNA, 64 nt, Human
aggggcucccaggccggcagcccuugccaccucccucugccaagccugcugcugcagaacgguu

SEQ ID NO: 304827 - RNA, 64 nt, Human
cugccaagccugaaucaauguuucaucuccaacccucugccaguuuggccccucagagcuuggu

SEQ ID NO: 304828 - RNA, 64 nt, Human
uuuggcuaagauuaaguauuaaaaaaaaaccaggcucugccaggcgcaguggcucaugccuaua

SEQ ID NO: 304829 - RNA, 64 nt, Human
guuaaaaauucgaaggcuuaugggucuccagaaacucugccagccagccucaguggagaagcuu

SEQ ID NO: 304830 - RNA, 64 nt, Human
guccucugggaugaugggcacugcuauccacagucucugccaguugguuuuauuuggagguuug

SEQ ID NO: 304831 - RNA, 64 nt, Human
uauuuuauaaagauacuaaaccagcauacccuuacucugccagaguagugaagcuaauuaaaca

SEQ ID NO: 304832 - RNA, 64 nt, Human
cugaucagaacaaauguuuauuaagcaucagaaacucugccaacacugaggauguaaagaucaa

SEQ ID NO: 304833 - RNA, 64 nt, Human
auaaaagggauaaacgagcuccuaguuuuaaaaucucugccauugcacuuuauagucugauuac

SEQ ID NO: 304834 - RNA, 64 nt, Human
ggcccaggcgggggagucagugcccagucagcagcucugccaccauccugcugggaacuggggg

SEQ ID NO: 304835 - RNA, 64 nt, Human
acugcccugaccuuccugcuucccacgcugccaucucugccagggugccacauggguuccugug

SEQ ID NO: 304836 - RNA, 64 nt, Human
auggaaauuguuccaauuggcacaacccaugugacucugccaguguaaguucuucuucuguggu

SEQ ID NO: 304837 - RNA, 64 nt, Human
aguuaauuuaauuugcaguuugugcggcagauugcucugccaagauacuugaacacuguguuuu

SEQ ID NO: 304838 - RNA, 64 nt, Human
acacucuuccaccuagagcauuccgucucucauccucugccauguguaagucuucugccuuagc

SEQ ID NO: 304839 - RNA, 64 nt, Human
augauuuccuauauuccaaauuccauuaaggucagcccaccauguaauuuucucaucagaaaug

SEQ ID NO: 304840 - RNA, 64 nt, Human
acucuccacuucccaguuugcaaauguggcuuucgcccaccaagugaaagcggacugagagcag

SEQ ID NO: 304841 - RNA, 64 nt, Human
uuuggcgagcacgaacuagaccaagcgaagggcagcccaccaccguauaucaaaccucacuucc

SEQ ID NO: 304842 - RNA, 64 nt, Human
cuggaggucaagaagagcagaguccccgucccugcucugccacugugcuccagcaccgugaccu

SEQ ID NO: 304843 - RNA, 64 nt, Human
agagcacccucccucccggcccccaugcucccuucucugccaugggcccuccguccccgccccg

SEQ ID NO: 304844 - RNA, 64 nt, Human
aaaaaacaaggugggggggugcucaucucgugaccucugccacccacauccuucacaaacucca

SEQ ID NO: 304845 - RNA, 64 nt, Human
ccacucacguucauguccuuaaauaucaccuauacucugccacaucccaaagggaucucaagcc

SEQ ID NO: 304846 - RNA, 60 nt, Human
uguccuuugucgaccccugacacucaaccacucugccaaaccugcccugccauugugccu

SEQ ID NO: 304847 - RNA, 64 nt, Human
cuguuguuucaugaaugugccgagugacuucugacucugccagcaucuuugaccucugacucug

SEQ ID NO: 304848 - RNA, 64 nt, Human
ccccagcauuuugccccgggcuccagcaucacuccucugccaccuugggguguggggcuggauu

SEQ ID NO: 304849 - RNA, 52 nt, Human
gacagauccagauuggguagggcucugccaagagccugugggacuggaaguc

SEQ ID NO: 304850 - RNA, 64 nt, Human
cuguuagcauacugccuauacacacagacacacccucugccacacugcucucuuccuuccagaa

SEQ ID NO: 304851 - RNA, 64 nt, Human
ggagagacaacaaaacaaaacaaagcacaaaagucucugccaacaacucuuuuguggaauucua

SEQ ID NO: 304852 - RNA, 64 nt, Human
uucauacuuaggaacauacaaaagguaauguaaacucugccacuuuuuuguguucaaaauuuug

SEQ ID NO: 304853 - RNA, 64 nt, Human
uugagccugggccacuccucccuggccuucuuaccucugccaagagccuccagaugugccugca

SEQ ID NO: 304854 - RNA, 64 nt, Human
cuccaggaucuccucucaccugcccccauuaaagcucugccacucaugcaggcauguguggacc

SEQ ID NO: 304855 - RNA, 64 nt, Human
cccucacuguucauuguguucaucuuugggugcucucugccagccaggccuuuccugcaagcug

SEQ ID NO: 304856 - RNA, 64 nt, Human
ggcaccccgcccagcugugcacuuugcucacucgcucugccauggugccaugacuguacugugc

SEQ ID NO: 304857 - RNA, 64 nt, Human
gcuccuuugaaguggaguaauagggaagguugcucucugccacagcuugcagcauggucuugac

SEQ ID NO: 304858 - RNA, 64 nt, Human
gucagcuguaacccucacccacagccccugcugggcccaccaccuguccgucccuguccccuuu

SEQ ID NO: 304859 - RNA, 64 nt, Human
uuccauggcuucugaguacaaggccagccccccggcccaccagcuuucggaaugccugcuuacc

SEQ ID NO: 304860 - RNA, 64 nt, Human
uugcugucccggugucaccugcuuccaucucccagcccaccagcccucugcccaccucacaugc

SEQ ID NO: 304861 - RNA, 64 nt, Human
uccucaggagaaaguacccucuuuuaccaacuuccucugccauguuuuuccccugcuccccuga

SEQ ID NO: 304862 - RNA, 64 nt, Human
cuugucucugcugacuucagccuggucaugcuugcucugccacuugcgauuucaucccuaauuu

SEQ ID NO: 304863 - RNA, 64 nt, Human
acgggggccgagggccugagcccccccaucccuccucugccaggguuucuuagcgguuucucug

SEQ ID NO: 304864 - RNA, 64 nt, Human
auggguaguauugaggaugaaagggaauuucucucucugccauuuuauuugauaauauuaaaga

SEQ ID NO: 304865 - RNA, 64 nt, Human
uauugcuuuucuuguuugaaggaaccaagaggggcucugccauuaguuggacccuggguccugg

SEQ ID NO: 304866 - RNA, 64 nt, Human
guggauaaauuggaauuuuuuauguugucucucucucugccaauuucaauacgaaucaucuucc

SEQ ID NO: 304867 - RNA, 64 nt, Human
cacaccucgacacccaaccccugaaccccacacacucugccaugcacacaggaggagagcugga

SEQ ID NO: 304868 - RNA, 64 nt, Human
uuaaauugauagcagauaucacgacagauuuaaccucugccauguguuuuuuauuuuguuuuuu

SEQ ID NO: 304869 - RNA, 64 nt, Human
ugaaucuggugaugggguggggccguggcacuuucucugccacagcuguucuucacaguguugg

SEQ ID NO: 304870 - RNA, 64 nt, Human
uuaaguauagcuuuauguaacuuuuagccaguugcucugccacagacauagacaaagagagaua

SEQ ID NO: 304871 - RNA, 64 nt, Human
ccguuggcagcaucuacucagcaaggucacuaagcucugccagcguggcagagcaugucuugga

SEQ ID NO: 304872 - RNA, 64 nt, Human
agcagggaaaccccgcccgcugccaggccauccucucugccagaggcuuucaugagccccaagg

SEQ ID NO: 304873 - RNA, 64 nt, Human
agucggagccgcccuccuacccucgccucgcauccucugccaaauccgaauucuuccagcccag

SEQ ID NO: 304874 - RNA, 64 nt, Human
uccucuccaacuccucuuuggccauugucucagccucugccacuucccagaccgaaagccugga

SEQ ID NO: 304875 - RNA, 64 nt, Human
uuaacgaagaucagcaaagaaaacaccaggcacccucugccacuuagacauaauccauuccacu

SEQ ID NO: 304876 - RNA, 64 nt, Human
ugggagacccuugacaccugcugagaaaacaugccucugccaaaggaugugauauauaagugua

SEQ ID NO: 304877 - RNA, 64 nt, Human
ugugaguuuaguuucucuccuaaaaugaauguaugcccaccagagcagacaucuuccacgugga

SEQ ID NO: 304878 - RNA, 64 nt, Human
aguuccuguaauuuugugacacgcucucugccaagcccaccaaguauuuccuuuauagcuaaaa

SEQ ID NO: 304879 - RNA, 64 nt, Human
gccuaagaggaacacagcagcuguuccuggcugugcccaccacccuucccagaacccucggacg

SEQ ID NO: 304880 - RNA, 64 nt, Human
agcugcacgcucauuacuacccuccgcuccugcgcucugccacuguccggaaauucaugguugg

SEQ ID NO: 304881 - RNA, 64 nt, Human
agaaggccacuccaaggggaaggaucccucuccucucugccauuucuuggcugggagcuguggu

SEQ ID NO: 304882 - RNA, 63 nt, Human
auuuggugaaaacauccuagaugucaucacaaacucugccaaauuuguggaacuaugaaaugu

SEQ ID NO: 304883 - RNA, 64 nt, Human
aaugaaagcuuaaaugucccugcgaacccacaaucucugccagcagaacugguuuuguucugaa

SEQ ID NO: 304884 - RNA, 64 nt, Human
auguauccagaggaauugauugucagccaccucccucugccagucgggagagccaggcuuggau

SEQ ID NO: 304885 - RNA, 64 nt, Human
ccucagaacagauagacagacugaagccacugaacucugccaggagucaacaugagauuccuuu

SEQ ID NO: 304886 - RNA, 64 nt, Human
ugggcaccugcaccccagaaggugugagcugucucucugccaggagcuaagguucauuagggga

SEQ ID NO: 304887 - RNA, 64 nt, Human
uuucugcagcagcagcugagaaggcagccggcagcucugccaggguggggagcugagcugaggc

SEQ ID NO: 304888 - RNA, 64 nt, Human
aggccccaggccucuuuguggacccaucuuccuccucugccaccccgaucuucacucggauacc

SEQ ID NO: 304889 - RNA, 64 nt, Human
gugacguuaauuugggucuuuguccuggcagugccucugccagucacugucaucguuguguccc

SEQ ID NO: 304890 - RNA, 64 nt, Human
gagccauccccacccgccggguguacauacgcgucucugccacuccccacccccagccucugcc

SEQ ID NO: 304891 - RNA, 64 nt, Human
aaucagugacgggaagauggaagggcaugaugaacucugccauagaaaacuuccuccagccuga

SEQ ID NO: 304892 - RNA, 64 nt, Human
gggguuagggacauccccaaaggguauacccuggcucugccacccaugaaccagcccagcaucc

SEQ ID NO: 304893 - RNA, 64 nt, Human
acaggugggcgugcuggugaccccgccugugaugcucugccaacuacaaaugcugcuccucugg

SEQ ID NO: 304894 - RNA, 64 nt, Human
uggccuagccuggcccacucaggaccugcccagccucugccagcuccucuggcauccgcccucu

SEQ ID NO: 304895 - RNA, 64 nt, Human
ccgucauucucuccccacuccacgcuccccacuccucugccacguuauguuacggcacaaaauu

SEQ ID NO: 304896 - RNA, 64 nt, Human
ucuuaaaacacaaaguuuuuaccaacuuuucaaagcccaccaauccacauuuucuccaggaaau

SEQ ID NO: 304897 - RNA, 64 nt, Human
caaggccaguucugcagugacaggcccaggggcugcccaccaggugugcugggcagacuucagc

SEQ ID NO: 304898 - RNA, 64 nt, Human
ccucuccuggggccacuguugggggugggagugagcccaccacagaggccacaggcaggccccc

SEQ ID NO: 304899 - RNA, 64 nt, Human
gaccugaaauuagccagggaccucugcugugugucucugccaaucugcugggcuggucccucuc

SEQ ID NO: 304900 - RNA, 64 nt, Human
cauccauagcccccauggcuuugaggagaauccucucugccauucuuccaaucuccccaguggg

SEQ ID NO: 304901 - RNA, 64 nt, Human
aagggacugcugugaagaaugacagauguggggccucugccaaguucugcauugcuaaauaagg

SEQ ID NO: 304902 - RNA, 64 nt, Human
uaguuacuaccauucucguuuuggaggaaacaaucucugccaccaccaagucauugacuuugcu

SEQ ID NO: 304903 - RNA, 64 nt, Human
acacccugucugcagcaggacauggacaaauaggcucugccaucaggaaaugggaagcaagaaa

SEQ ID NO: 304904 - RNA, 64 nt, Human
uuagugugaaaaagaguuuggcugauuccuaaaacucugccagcccugcaguaaucuccagggc

SEQ ID NO: 304905 - RNA, 64 nt, Human
aacuuuuaaaauugcugaagaucaaagagguuaucucugccagucacaaguguggcugguguca

SEQ ID NO: 304906 - RNA, 64 nt, Human
gccugcuccucaggaccacucaguccaccuguuccucugccaccugccuggcuucacccuccaa

SEQ ID NO: 304907 - RNA, 64 nt, Human
cucugcccugggaagagcccacucagcuuaauugcucugccaucguagagccugguuggacuug

SEQ ID NO: 304908 - RNA, 64 nt, Human
cccacccacuuguaccagcuaagaaugcuggagacucugccaccaugcucugcgugccccugaa

SEQ ID NO: 304909 - RNA, 64 nt, Human
ccagcaauguauaagcauuucuguuuaccaauagcucugccaguauuggguuuugccauuuuua

SEQ ID NO: 304910 - RNA, 64 nt, Human
auaggaggagagcaaauaucauuauaugaaaguccucugccaccgaguuccuaauuuucuuugu

SEQ ID NO: 304911 - RNA, 64 nt, Human
gucuuggaaauugucuucagaugaucuuagaggucucugccaagucugagaguauaauucugua

SEQ ID NO: 304912 - RNA, 64 nt, Human
uugagauggugcccagcaggccaaacccaccugccucugccaggaacagccaacuccaugggaa

SEQ ID NO: 304913 - RNA, 64 nt, Human
uugccaaacagccugcccucccugccggagccggcucugccagccccagauugggaagucuccc

SEQ ID NO: 304914 - RNA, 64 nt, Human
cugcaaauagccaaaucaaacuuaagaaccagaucucugccagauuaaacauuuuugaagcuuu

SEQ ID NO: 304915 - RNA, 64 nt, Human
ggaaagccagcagccccagacugcccaaaaacuugcccaccagaccaagggcagugccccaagg

SEQ ID NO: 304916 - RNA, 64 nt, Human
ucuguauauacacauaacugaaaaccaaguuuaagcccaccaaugcacugcugaugcaugccau

SEQ ID NO: 304917 - RNA, 64 nt, Human
cuccgcguguugguggcuguggccauggcucugugcccaccagcaucucccuccugagaugccg

SEQ ID NO: 304918 - RNA, 64 nt, Human
ccacugguagcuccccacuuccuuacuccugcugcucugccauugccgcuccccuuguugcugc

SEQ ID NO: 304919 - RNA, 64 nt, Human
gcaccaggcaucacacgacaucuuucccucccaucucugccaucugucugucuggcaauggaag

SEQ ID NO: 304920 - RNA, 64 nt, Human
uagccaucccaugaacacacuguguccuggugcucucugccacuggaagggcagaguagccagg

SEQ ID NO: 304921 - RNA, 64 nt, Human
ccgagcugagccacgcugggaggccagagccuuucucugccaucagcccuacguccagagggag

SEQ ID NO: 304922 - RNA, 64 nt, Human
gcucuuccagaaaguauuaggagccucacaucuacucugccaagcgccccagcaggcacugugc

SEQ ID NO: 304923 - RNA, 64 nt, Human
gaggcuucugaguggcacucauggaacaccgucccucugccagccauaggcccugccuccagug

SEQ ID NO: 304924 - RNA, 64 nt, Human
augagcugcucauuacaguucuuuccucuuucugcucugccaucuucaggauauugguucuucc

SEQ ID NO: 304925 - RNA, 64 nt, Human
gcaaacacauaggcuugcgucuuaaagccagcuccucugccagaccccguuguaaugugccaca

SEQ ID NO: 304926 - RNA, 64 nt, Human
cugugugcuggaugguccugaaaccagacaagaccucugccagccaccuaagcccugcguacau

SEQ ID NO: 304927 - RNA, 64 nt, Human
aucuagggcccucagcaaccagcucuguagggagcucugccagaggggcagcagcugcagaucc

SEQ ID NO: 304928 - RNA, 64 nt, Human
aaaggaugcaucuucccacagccuccucgcuuuacucugccauugguagcuuaaagacuuucuu

SEQ ID NO: 304929 - RNA, 64 nt, Human
uggaaacaugucccaaauuucuaaaauucugcuucucugccaaaagcaaugucuuucuugguug

SEQ ID NO: 304930 - RNA, 64 nt, Human
ucagauaccgcucuuucuccaacuuucccucuuucucugccaucacacuugggccuucacugca

SEQ ID NO: 304931 - RNA, 64 nt, Human
agcacagagaccccccacuguguccagggacccccucugccagguggagguguguccaggggcu

SEQ ID NO: 304932 - RNA, 64 nt, Human
ggacaggcuggggccaggaggcagaaacaccagccucugccaacaccggaacaagccgacgcuu

SEQ ID NO: 304933 - RNA, 64 nt, Human
gacaccaauccucaauggcaccuugguggcuucccucugccaugacagccccuaggccaggaac

SEQ ID NO: 304934 - RNA, 64 nt, Human
gcggagggcaggggaacgggauccuucucccgcugcccaccaacaccaacacacacacaccucu

SEQ ID NO: 304935 - RNA, 64 nt, Human
uggcucccgagcucagacacagcccccaggagccgcccaccacggcugugggaacuuccaggcc

SEQ ID NO: 304936 - RNA, 64 nt, Human
aauaccuuaacaaaugcacucugagcuggagggagcccaccauuugcacccaccuacccacccu

SEQ ID NO: 304937 - RNA, 64 nt, Human
ucagcacuuucccucugcagcacgcuggacagcacucugccauccugauacaugaccccugcug

SEQ ID NO: 304938 - RNA, 64 nt, Human
uugucuggugacucuguugauccaggcagucuuucucugccaauucaggaugagauguuuaggu

SEQ ID NO: 304939 - RNA, 64 nt, Human
gaaaagguagauggaguugcuucuguugaauuagcucugccaccaauauguaucuucauacacg

SEQ ID NO: 304940 - RNA, 64 nt, Human
gcugggggcaacagccaagcucaccugggcaggucucugccaccuccuugcucugugagcuguc

SEQ ID NO: 304941 - RNA, 64 nt, Human
cuuucacccaugauauaaaguaaaguuuauuuuccucugccauccuugcuaaguaguuuugaca

SEQ ID NO: 304942 - RNA, 64 nt, Human
ugugucacaaacucuacaucugcuucuccuguggcucugccaucagcuccaauaucaauaugaa

SEQ ID NO: 304943 - RNA, 64 nt, Human
gggcauugcaaagugcgcucauuuuaggccuccucucugccaccaccccauaaucucauucaaa

SEQ ID NO: 304944 - RNA, 64 nt, Human
gaccugagguggagagaggcccagcaccccaaaucucugccaucacacggucggggagcccaua

SEQ ID NO: 304945 - RNA, 64 nt, Human
gcuccauauggaaccugcucguuuauggaauuugcucugccaccaguaacagucaauaaacuuc

SEQ ID NO: 304946 - RNA, 64 nt, Human
gguccccaugcugacccucaucugggccugggcccucugccaagugccccugugggaugggagg

SEQ ID NO: 304947 - RNA, 64 nt, Human
gcgugcugguacacugugccauggggguaagccgcucugccacacuuguccuggccuuccucau

SEQ ID NO: 304948 - RNA, 64 nt, Human
cuuccagagcugguccuuacucccugccauggggcucugccacuuugccacccuggcacugauc

SEQ ID NO: 304949 - RNA, 64 nt, Human
cagagugcugggauuacaggugugagccaccaugcucugccaauuauuuuaaauuacuaggauu

SEQ ID NO: 304950 - RNA, 64 nt, Human
cucaauacuacugcaguuaccaaagggauuguuucucugccacccucauaccagaucugcuuca

SEQ ID NO: 304951 - RNA, 64 nt, Human
cugaauaaccaagaacauguucuaugaacccaaucucugccacaugucaauaccugcucuucaa

SEQ ID NO: 304952 - RNA, 64 nt, Human
ggcccacagcuuuggcuggaaucauuuucuuucucucugccagggacaugucaaccaagaaacc

SEQ ID NO: 304953 - RNA, 64 nt, Human
cuggugagacaaccucugauccugaggaccggccgcccaccaaggguugggcccccggggccag

SEQ ID NO: 304954 - RNA, 64 nt, Human
gcagggguguccuuguccacucgcaccccucgccgcccaccagggccaugcucugugacuuggg

SEQ ID NO: 304955 - RNA, 64 nt, Human
uggccuggcagcucuccagcagggcagaguguuugcccaccagcugcuagcccuaggaaggcca

SEQ ID NO: 304956 - RNA, 64 nt, Human
gcagagcuuggccuugugcccagcuggcagcccccucugccagccuuucugcugcuuuugcugc

SEQ ID NO: 304957 - RNA, 64 nt, Human
cugagguaacacggaccccagccccugucagggccucugccaaggaaauaauauggaccauuua

SEQ ID NO: 304958 - RNA, 64 nt, Human
cccggaccggaccgccgaggggagcugggaccuccucugccaacucccgccuccuccccugucc

SEQ ID NO: 304959 - RNA, 64 nt, Human
ccgcucuggacacaacccuuuuauagauuaauuucucugccaauuaacuugucauuuucaguac

SEQ ID NO: 304960 - RNA, 64 nt, Human
aacuguuucacucaugguauggaaaaccccaggacucugccacucuaggcacacaugaauuaua

SEQ ID NO: 304961 - RNA, 64 nt, Human
ccucuccuacagcauggagaggcugaccccauggcucugccaccguuggggcaggguuagcaga

SEQ ID NO: 304962 - RNA, 64 nt, Human
caccuacugcgcguaggccgcccaccgcccgcuucucugccaaaaggacgcccacggggagaug

SEQ ID NO: 304963 - RNA, 64 nt, Human
aguucgaagacucccgcgcagagccuguggcccucucugccaggccucagggugccugagacac

SEQ ID NO: 304964 - RNA, 64 nt, Human
cugggguauggaugauggggggaagggcggucgccucugccacugucagggaccagccggccaa

SEQ ID NO: 304965 - RNA, 64 nt, Human
agguccucagugucucuggcagacccaucggcagcucugccaggugcuccauguguugcccuug

SEQ ID NO: 304966 - RNA, 64 nt, Human
aguuccauuuuagacaaugaagcugcuuaguaaucucugccaagccaucucuuaauauuaaagc

SEQ ID NO: 304967 - RNA, 64 nt, Human
cuucaccaacaaaacuuggccucuuuugguuccacucugccacccugccauuggaacuuggauu

SEQ ID NO: 304968 - RNA, 64 nt, Human
cucauggucaagugugauuagacuuuccugaaaucucugccauuuuagauacugugaaacaaac

SEQ ID NO: 304969 - RNA, 64 nt, Human
uugucuaaagacaugggugcaaacucuaggcuagcucugccaaucacuuacugugcggguuuga

SEQ ID NO: 304970 - RNA, 64 nt, Human
gggagagacuugaugucuggccuuuuaauuccuccucugccaggguggguccugggaccucuaa

SEQ ID NO: 304971 - RNA, 64 nt, Human
cccuuugcuccacccacagcagggccccgucagacucugccagcgcguccugcccgcuucccuc

SEQ ID NO: 304972 - RNA, 64 nt, Human
gggacaaagagggcaaaugagaucaccuccugcagcccaccacuccagcaccugugccgagguc

SEQ ID NO: 304973 - RNA, 64 nt, Human
acacguuuacaggaaaguguucuccuggguuugugcccaccauggugcgaauccugacccaagg

SEQ ID NO: 304974 - RNA, 64 nt, Human
ggccagaggagggaggggcacagugaagaagggagcccaccaccucuccgaagaggaaagccac

SEQ ID NO: 304975 - RNA, 64 nt, Human
gagucagcaggcaugcugcgguggcggucacucccucugccacuauccccagggaaggaaaggc

SEQ ID NO: 304976 - RNA, 64 nt, Human
gcuggcuccagcccgcugcugcccugcugccccccucugccaggcgcuagacauguacagaggu

SEQ ID NO: 304977 - RNA, 64 nt, Human
cauucagccuccugcucuuaacugaauugggagccucugccaccugccccguguauccuggcuc

SEQ ID NO: 304978 - RNA, 64 nt, Human
ggcugggcagagcucuaaacaggggcaggggcuccucugccagccugugggcauggcagucauu

SEQ ID NO: 304979 - RNA, 64 nt, Human
uaguaggugcugcuggccccuggugauccagcuucucugccaaucaugaccuguuccuuccuga

SEQ ID NO: 304980 - RNA, 64 nt, Human
ccuucaguggaguggugacacgugccagcggucacucugccacaucacuuccuucuugaaagcc

SEQ ID NO: 304981 - RNA, 64 nt, Human
aacuaggaguuggaagacaaggaugugguccuggcucugccacuggcuugcuuuuggaccuugg

SEQ ID NO: 304982 - RNA, 64 nt, Human
cgcucgucuaguccugaaacugcaggaccaguuucucugccaaggggaggaguuggagagcaca

SEQ ID NO: 304983 - RNA, 64 nt, Human
uccaucucuucuaaccagccauggccuuccccuccucugccauacccuuaaugcggcccucaga

SEQ ID NO: 304984 - RNA, 64 nt, Human
agcagcauauucagcaggugccacuacaugccuacucugccagacacugagcuuggggcccuag

SEQ ID NO: 304985 - RNA, 64 nt, Human
ucuggcccagggaauccagccaugacccccaccccucugccaaaguacucuuaggugccagucu

SEQ ID NO: 304986 - RNA, 64 nt, Human
aacuuggggacuagaccaccuuauguugagggaacucugccaccugcgugcaacccacagcuaa

SEQ ID NO: 304987 - RNA, 64 nt, Human
cugaccacucacgauaaagcagauuuuucucugccucugccacaagguuucagaguaguguagu

SEQ ID NO: 304988 - RNA, 64 nt, Human
ggagugcaguggcaugaucuuggcucacugcaugcucugccacuuggguucaagcgauucuccu

SEQ ID NO: 304989 - RNA, 64 nt, Human
uucaccucccgccugccagggaaggcaggacccgcucugccaagggcccucugcguauucccuu

SEQ ID NO: 304990 - RNA, 64 nt, Human
ccagggcagggggcucguugcuguggcacccccucucugccagcaccaagagauuauuuaaugg

SEQ ID NO: 304991 - RNA, 64 nt, Human
guggucccccaccagcucccccucccauagggcugcccaccaagcccugcccccagcccaagag

SEQ ID NO: 304992 - RNA, 64 nt, Human
gcccuggccaccacaccggccugugccccuugaagcccaccaaagcggcccucacuugugguca

SEQ ID NO: 304993 - RNA, 64 nt, Human
cacugugccuuuaacaagguuguaaauauuuuaugcccaccagagauguggucauaagaucuga

SEQ ID NO: 304994 - RNA, 64 nt, Human
cuugggggcucagugugagagccaggguuaccuacucugccaagugaggacaaacugcuaggcu

SEQ ID NO: 304995 - RNA, 64 nt, Human
gagggccccucugcccagcuugggcccagcugggcucugccacccuaccuguucagugucccgg

SEQ ID NO: 304996 - RNA, 64 nt, Human
gauggucagugugucaugggaagcccacccccagcucugccagugcucucugggccuggcuccc

SEQ ID NO: 304997 - RNA, 64 nt, Human
cuggugcugccaaaagaugcuuccaugguccgugcucugccagugggguucacaacaagagacg

SEQ ID NO: 304998 - RNA, 64 nt, Human
uuuaugaauuuucuaacuuacauuuuguuguguccucugccaacaaucugguuuuauaauuguu

SEQ ID NO: 304999 - RNA, 64 nt, Human
uccugucuguucauggagagggucccugccucaccucugccauuuuggguuaggagaagucaag

SEQ ID NO: 305000 - RNA, 64 nt, Human
ugggcuuaaugugaauagaggaacaaguggguaucucugccaggcaccccacuuucuccuagua

SEQ ID NO: 305001 - RNA, 64 nt, Human
cugguugcuugaacugacaguaggccagccuguucucugccauucccuagucauccugugccuc

SEQ ID NO: 305002 - RNA, 64 nt, Human
cgcgcgagcgccacggccuccgggcgcgccuggacucugccaauaaagcggaaagcgggcacgc

SEQ ID NO: 305003 - RNA, 64 nt, Human
cuguuuggcuccgaagccuauaugugccuggauccucugccacggguuaaauuuucaggugaag

SEQ ID NO: 305004 - RNA, 64 nt, Human
uuaggcugccccgccacagagcaggcuucaucugcucugccauccagccccaucuggaugugag

SEQ ID NO: 305005 - RNA, 64 nt, Human
aaagauguuuguuuaaagcgugggguuuuuuaaucucugccacccuugucaagggagucuugua

SEQ ID NO: 305006 - RNA, 64 nt, Human
aaacggugcaggccaggcgggcccuaauaaaacccucugccaggucugggagucccaggccauc

SEQ ID NO: 305007 - RNA, 64 nt, Human
gggagggguggcugcuuggaaauaggcccaggggcucugccagccucggccucucccuccugag

SEQ ID NO: 305008 - RNA, 64 nt, Human
ccaacaggaccacagcgcacuggcuccaccccaucucugccaucuccacuccccuccuuuucau

SEQ ID NO: 305009 - RNA, 64 nt, Human
ucucccguucuuccucccauccaccuccucucuacucugccagucucagccuucaaagcacuug

SEQ ID NO: 305010 - RNA, 57 nt, Human
gcagugccggccaguucugagcccugcgcccaccaaucgaauuguagagcugcuugu

SEQ ID NO: 305011 - RNA, 64 nt, Human
acagaauauaaacaacaguagugccugugguuuagcccaccaaucuugaugacuaaaaguagcu

SEQ ID NO: 305012 - RNA, 64 nt, Human
cccagccugcccacuacauccagccuguggcuuugcccaccaggacuuuugagcuggggcugac

SEQ ID NO: 305013 - RNA, 64 nt, Human
uuaaacaucuuacauuuuuaaaaauuuauauugccucugccaaacaggccuaauaguuaaaagc

SEQ ID NO: 305014 - RNA, 64 nt, Human
gcuaggggacaucagagguucuuugagggacugccucugccacacucugacgcaaaaccacuuu

SEQ ID NO: 305015 - RNA, 64 nt, Human
uggcuccaugcuccucacugcccgcacacccucacucugccagggcagugcuagugagcugggc

SEQ ID NO: 305016 - RNA, 64 nt, Human
gccuuccccagccuuuuuucuggggcaccuauuccucugccaguccugcuccccucaccuuccu

SEQ ID NO: 305017 - RNA, 64 nt, Human
guauuucucccugaaauggggucugguccuuggucucugccacugcccugccucuccucuggcc

SEQ ID NO: 305018 - RNA, 64 nt, Human
agggagccugguccugcaccugcccucugcagcccucugccagccucuugggggcaguuccggc

SEQ ID NO: 305019 - RNA, 64 nt, Human
cccuaacuccaucagaccucuacgcaccauaagacucugccagaacugagaagccaacauuucu

SEQ ID NO: 305020 - RNA, 64 nt, Human
uuuguuuuuguccaucaaggcacaugagugugaccucugccauggggaaacacacacagagaua

SEQ ID NO: 305021 - RNA, 64 nt, Human
ugcuucucuccucaucaucauucccaacaacauccucugccacacacaacaaaacguaaguuuc

SEQ ID NO: 305022 - RNA, 64 nt, Human
uaaauuaaaguuguacauuggacaccugacaacccucugccaugaccgagacccccugauccuc

SEQ ID NO: 305023 - RNA, 64 nt, Human
ugaagauuggugaacuccccagggcucccgugggcucugccacuggacagaaggccuccagcuc

SEQ ID NO: 305024 - RNA, 64 nt, Human
uccgccucuccagacacugcgcccuccacccucacucugccauuguuccaccuccugaccugcu

SEQ ID NO: 305025 - RNA, 64 nt, Human
ugcugucaauuccgagaucuaaucucccccuacgcucugccaggaauucuuucagaccucacua

SEQ ID NO: 305026 - RNA, 64 nt, Human
gggcaugcacagcguggaggucagcggcucccagcucugccaggcccauucccagcugcugcag

SEQ ID NO: 305027 - RNA, 64 nt, Human
agcugaugcaggccccaaggaccccuuugcugaccucugccaggacccacacagcuucgaugga

SEQ ID NO: 305028 - RNA, 64 nt, Human
guauaaaugauauugaauguuggguauagugauacucugccauaguucuuacugcaugaagaga

SEQ ID NO: 305029 - RNA, 64 nt, Human
ggggcaguggucagaccccacacgcccucucugggcccaccaccugcaucugcgacuagagagc

SEQ ID NO: 305030 - RNA, 64 nt, Human
caucucacuccuuugccugcacugccaggguggggcccaccaagauuccugaucaugacgggaa

SEQ ID NO: 305031 - RNA, 64 nt, Human
ccagaggguuuccaugggguaggaggaugggcucgcccaccagugacuuuuucuaagagcuccc

SEQ ID NO: 305032 - RNA, 64 nt, Human
guguuugugggaucaccugcagauuuaaagccuacucugccacagacucgaguaagaaaauguu

SEQ ID NO: 305033 - RNA, 64 nt, Human
gccuuagagcaucucugccuccaacccagcaguucucugccaaagcuuguggaggagggagagc

SEQ ID NO: 305034 - RNA, 64 nt, Human
auggagcaggucuuugggaagcucccacacccaccucugccacucuuaacacuaagugagaguu

SEQ ID NO: 305035 - RNA, 64 nt, Human
cucuugcucuccagaggagcugagccugaguggacucugccagugccugguggaacuguccacc

SEQ ID NO: 305036 - RNA, 64 nt, Human
gaacuuaaucugguacuuuacaguuuugcaccaacucugccaagccacuggaucuuacauuaaa

SEQ ID NO: 305037 - RNA, 64 nt, Human
cuuaucucuggcgcacaucacuauauuuggcugccucugccagugcugaauucuuugcugacau

SEQ ID NO: 305038 - RNA, 64 nt, Human
auaaugaaaguuuauaucaacaggguuucguuggcucugccauauauuauaagcaaaagagauu

SEQ ID NO: 305039 - RNA, 64 nt, Human
ccuugucucagccuugcagggcaggcaugccagucucugccaguuccacugcccccuugaucuu

SEQ ID NO: 305040 - RNA, 64 nt, Human
cucagggccaguucuggugggcagcagagaccugcucugccaaguuguccagcagcagaguggc

SEQ ID NO: 305041 - RNA, 64 nt, Human
guguguuaaacagcuccugagaaccuuugggacacucugccauggcuggcgugaggcccagagg

SEQ ID NO: 305042 - RNA, 64 nt, Human
ggagcccaggccaggcagggagcagaugcagggacucugccacguugaauucuggugagggaca

SEQ ID NO: 305043 - RNA, 64 nt, Human
agcccuccucaccccgucugggguucagccccuccucugccaccuccccuauccacccagccca

SEQ ID NO: 305044 - RNA, 64 nt, Human
gcaggucgcggaucuccccaguugcuaaucccggcucugccacucaauccuaucccuaguuccc

SEQ ID NO: 305045 - RNA, 64 nt, Human
ccuuggugucacaagucuuggauuucaaucccaacucugccacugaguugcugguugacugagg

SEQ ID NO: 305046 - RNA, 64 nt, Human
gcaggcacugaugcuagagggugaugacccugcccucugccacccaggcugcguccaacagccu

SEQ ID NO: 305047 - RNA, 64 nt, Human
cucgcuccucugaggcuccuccuccagcaucaggcucugccaaggccccucugacucuugccca

SEQ ID NO: 305048 - RNA, 64 nt, Human
ccaccacucaggggcucuggaggggucagcuggagcccaccaagcugucacugcugcacucacu

SEQ ID NO: 305049 - RNA, 64 nt, Human
ucccucucuaccucccaaggugauaugggcagcugcccaccacuccagagguagcagcauccuu

SEQ ID NO: 305050 - RNA, 64 nt, Human
ugccucagccucccgaguagcugggacuauaggcgcccaccacgacgcccggcuaauuuuuugu

SEQ ID NO: 305051 - RNA, 64 nt, Human
cucacauuucucugugugaucccccacuucugggcucugccaccccacagugggaaaggccacc

SEQ ID NO: 305052 - RNA, 64 nt, Human
cuccacaaagccaagugaagguguauuggggauucucugccagccugugucacccacccaccuc

SEQ ID NO: 305053 - RNA, 63 nt, Human
uuuuuuuuuugguccaaaauaaaaccucagcuagcucugccaauguccuugcuugugugugca

SEQ ID NO: 305054 - RNA, 64 nt, Human
caagaggaagacccugccauuccacagccccuuccucugccaggugcuuggcucucugagagca

SEQ ID NO: 305055 - RNA, 64 nt, Human
cagagaaucuguagucacuuuggagcuuuagcuucucugccaagcccucaauaagccagcaaac

SEQ ID NO: 305056 - RNA, 64 nt, Human
uacagccauccaccuucagaugugucuacgugcgcucugccauucaacucggaaacuauaagua

SEQ ID NO: 305057 - RNA, 64 nt, Human
ugacaauuuuuuguacagucgguuuuaaggucuucucugccauuagagccaguagguuacagcu

SEQ ID NO: 305058 - RNA, 64 nt, Human
uagcugguaccugaagccccgcuuagcucugacacucugccaacauccucugauucuaggugug

SEQ ID NO: 305059 - RNA, 54 nt, Human
ugcacagcuuccucccuuagcucacucugccaucuguuuuggcaagaccccacc

SEQ ID NO: 305060 - RNA, 64 nt, Human
uucacguuuccccuugacuaagaaaagcaccuaccucugccaugugauguuucugaaaagccuc

SEQ ID NO: 305061 - RNA, 64 nt, Human
gcacguccgcuuccuuaacauggaaaccauggcccucugccacugacccaccgccaccuccgcg

SEQ ID NO: 305062 - RNA, 64 nt, Human
guuaaagugaaaaggcaaucuaugacucaccuugcucugccaucccuggcagcccccaccggug

SEQ ID NO: 305063 - RNA, 64 nt, Human
ggcaguucacugcaugugcugcccccuuggguugcucugccaauguauuaauaccaucccauag

SEQ ID NO: 305064 - RNA, 64 nt, Human
guggauaaauguaaauuauagucaaaguaagauacucugccaaguuuccucuguagagaauuca

SEQ ID NO: 305065 - RNA, 64 nt, Human
gcacgcgagaugcaggcgaaaagcagccacaccccucugccacaaaugaccaacagcuggucag

SEQ ID NO: 305066 - RNA, 64 nt, Human
aaugaugguguggauaacgucagugugcaugccucucugccagggugggaguaaguaacucauc

SEQ ID NO: 305067 - RNA, 64 nt, Human
ggcugccgaggccagggccuguggaggugccagggcccaccaugucgggguaugguuguaggcc

SEQ ID NO: 305068 - RNA, 64 nt, Human
ugcugcauacccaccgcccagcuucucccugagggcccaccagccugugcuguacaccccguua

SEQ ID NO: 305069 - RNA, 64 nt, Human
ccccgggggagaggaccgccggccucagcuacuagcccaccagcccaccagggagaaaagaagc

SEQ ID NO: 305070 - RNA, 64 nt, Human
augauacucugcaucuuuccuacaugagaagcuucucugccacaaaagugacuucaaagacgga

SEQ ID NO: 305071 - RNA, 64 nt, Human
caggaauuuaagaauuuguuuaaauuaggcauaucucugccaucacauaguauuaugucaccau

SEQ ID NO: 305072 - RNA, 64 nt, Human
acaccaaaaacuguauuauuugcaacuaaauuuucucugccauacacuaacucaaaaauuuuga

SEQ ID NO: 305073 - RNA, 64 nt, Human
gauuccucauauccaaggcuacuuuugaagaucccucugccaaaaauauagcucacuuaucuaa

SEQ ID NO: 305074 - RNA, 64 nt, Human
cugaagagacaggcauuguuuuccgugcuguguccucugccauuuaaagauguuuguagcuugu

SEQ ID NO: 305075 - RNA, 64 nt, Human
uucucacccccugacuuucccugagaagaaucaucucugccaggucaacuggagucccugguga

SEQ ID NO: 305076 - RNA, 64 nt, Human
aguuuggcaggacugccauuaucugggguguggccucugccagcaagagaaguguccugggugu

SEQ ID NO: 305077 - RNA, 64 nt, Human
caucuuuauuaagaugucuuucauguguauaugccucugccauagaauacucagucuugugguc

SEQ ID NO: 305078 - RNA, 64 nt, Human
acaucaauuuuuuccccugauuucaucaaguuaucucugccaagugcucuugauaauuucuuca

SEQ ID NO: 305079 - RNA, 64 nt, Human
cuggccaggagguuauaaacuggcauuuaggccucucugccauuuaguagcaguauagucauua

SEQ ID NO: 305080 - RNA, 64 nt, Human
uacauucucccuuuagcaaccugaguaagagacucucugccacugggcugcaaaaaaauaaauu

SEQ ID NO: 305081 - RNA, 64 nt, Human
ggagaugcucucugaggcaaggcccagaccuggccucugccauccucccuguuccccacagguc

SEQ ID NO: 305082 - RNA, 64 nt, Human
ccaccucaccuggcuucugucuaugucagucucccucugccaaccuccuagaaggacacuugug

SEQ ID NO: 305083 - RNA, 64 nt, Human
ggcagagaagguuugugucccuguugaggagccacucugccagucuuugcugguccauaggcgu

SEQ ID NO: 305084 - RNA, 64 nt, Human
ccuggacucuaggggaugccgccaccagaaaccccucugccaaucccuaccuugcacccuggga

SEQ ID NO: 305085 - RNA, 64 nt, Human
uggacucuaaagaccaaacuucacucugggcacacucugccagcaaagaggacucgcuuguaaa

SEQ ID NO: 305086 - RNA, 64 nt, Human
ccucucugaugucccagugcucaccagcccugcagcccaccagacgucaggcccugacuccucu

SEQ ID NO: 305087 - RNA, 64 nt, Human
agccggcuuugccauccgggcauguggccacacugcccaccaccgacgauguggguauggaacc

SEQ ID NO: 305088 - RNA, 64 nt, Human
cuaugcacccccaccauuccuacacaucuugccagcccaccagcagccccacucacagcugcug

SEQ ID NO: 305089 - RNA, 64 nt, Human
gacugacacaccaaacaagauguuucacuggguacucugccauagaaauggcagauuaagaaga

SEQ ID NO: 305090 - RNA, 64 nt, Human
auaacuuugaugcuugcuuuaacuuuagucccaucucugccacuuugaugcuauuuggguuaug

SEQ ID NO: 305091 - RNA, 64 nt, Human
agccuucaaguugcuuuucagccaugaaauuaagcucugccaagcaaucgugauuguaggucaa

SEQ ID NO: 305092 - RNA, 64 nt, Human
ugugcacugauucacacucccugcaaaauggucacucugccaucuuggugguugguggggcagg

SEQ ID NO: 305093 - RNA, 64 nt, Human
uaaaaucaccacguguaagaggcagccaagucagcucugccaacugcuaggggaguugggaaag

SEQ ID NO: 305094 - RNA, 64 nt, Human
cucccccagugagguugguccgaggcugugugcccucugccagcgaccccgaagcagauaucuc

SEQ ID NO: 305095 - RNA, 64 nt, Human
auauuucacugugccauaaacaacugaaagcuugcucugccaaaaggaaucagagaacaagaac

SEQ ID NO: 305096 - RNA, 64 nt, Human
uucucaacaauggaucccgcuacaaucugaugaacucugccauaauagagauguuugaauuuau

SEQ ID NO: 305097 - RNA, 64 nt, Human
gcuucuacugcucugauuuugugguaccaguacucucugccacugaacauuuugaaauauuuuu

SEQ ID NO: 305098 - RNA, 64 nt, Human
cguccccuccugagcagcacucggcgccagcagccucugccagaguggaagccagagcccugca

SEQ ID NO: 305099 - RNA, 64 nt, Human
cuguggggcccccacaauggucccaaacagcugccucugccacugacugcagggacacgggcag

SEQ ID NO: 305100 - RNA, 64 nt, Human
accagcaaacacugaauuucucuuguuguuuuaacucugccacaagaaugcaauuucguuaacg

SEQ ID NO: 305101 - RNA, 64 nt, Human
aacccagaagcugguagucaugugggcuugccuucucugccaaacgacugggaaaccaaaauga

SEQ ID NO: 305102 - RNA, 64 nt, Human
cccccuaccacauguccggcacauggccuaccagcucugccacgcccuuagauguaagugucca

SEQ ID NO: 305103 - RNA, 64 nt, Human
gucugcuguaaaggcugcagccuccccagcucuccucugccagccacccuaaauuccagccaac

SEQ ID NO: 305104 - RNA, 64 nt, Human
ugaugcugggauuuacacuugaggcuuagcuuugcucugccaacuucuucagagcugacacagg

SEQ ID NO: 305105 - RNA, 64 nt, Human
uauaaaaaauaauuuccauguaaguuaccagaaagcccaccagcaacauaauuuuaaagccuuu

SEQ ID NO: 305106 - RNA, 64 nt, Human
ugccucagccuccugaguagcugggacuacaggcgcccaccaccacacauggcuaauuuuugua

SEQ ID NO: 305107 - RNA, 64 nt, Human
gccuguggagcagugcccaucccagcccguuucugcccaccaguuguucucaggaaccuuaccc

SEQ ID NO: 305108 - RNA, 64 nt, Human
cagagcuggcuggcccggggcugcagccugaccccucugccaucggccucuaguucuccaagga

SEQ ID NO: 305109 - RNA, 64 nt, Human
gucccugggcucuggggcugaaggauuccagccucucugccagauauucaguacucgaucucaa

SEQ ID NO: 305110 - RNA, 64 nt, Human
gaauaaaaggcuucaauacucugcauuccaugcccucugccaccugcuuuuuuuuccccuuugu

SEQ ID NO: 305111 - RNA, 64 nt, Human
ggguggaccuccgcgacgauucugaaaaugagcucucugccaagguuuuaagauaauuuauuga

SEQ ID NO: 305112 - RNA, 64 nt, Human
aucucucuuguccauaccugauagacacauuccucucugccaccuuccuucagggaggacccgc

SEQ ID NO: 305113 - RNA, 64 nt, Human
agggcagccacauccaggcgucucccuacccuggcucugccaucagccuugaagggccucgaug

SEQ ID NO: 305114 - RNA, 64 nt, Human
gcaugugcagcaucucgucgugcugcugugccugcucugccaacuccuccaucaguguguucug

SEQ ID NO: 305115 - RNA, 64 nt, Human
caccuccaggacucagugaucccuggggggcaggcucugccagcccucggccacacguggcucc

SEQ ID NO: 305116 - RNA, 64 nt, Human
ugugucucccccucccuccaagagguccugcucccucugccagaaccgugugugggcggguggg

SEQ ID NO: 305117 - RNA, 64 nt, Human
uaccuuuaauuuauuuaauaucuguuguucagagcucugccauuucuugaguaccuguuaguua

SEQ ID NO: 305118 - RNA, 64 nt, Human
cuggcaccaccacacggccacagccagccaucugcucugccaggguggcaccagcucagcuggc

SEQ ID NO: 305119 - RNA, 64 nt, Human
ccuucacgccugccagggucagcugcagcccccacucugccaagguggggagugguuucuggga

SEQ ID NO: 305120 - RNA, 64 nt, Human
aggguaguggacaccaggauccuuuggauuaauccucugccaccucucucuuuuccucaaccga

SEQ ID NO: 305121 - RNA, 64 nt, Human
gaaggcuugcuccaaugccacugagcccugcucccucugccacuguggacacauccucuccacc

SEQ ID NO: 305122 - RNA, 64 nt, Human
ggcacauuuggcacuagcuugagcccaacucuggcucugccaccugcugcuccugugaccuguc

SEQ ID NO: 305123 - RNA, 64 nt, Human
cccuccaacccuucuggcccucgcaccacugugacucugccaucuuccucagacggaggcuggg

SEQ ID NO: 305124 - RNA, 64 nt, Human
gguccucuaggcaggcagggugcuccuggugucugcccaccacuguccccuugcugauggcaug

SEQ ID NO: 305125 - RNA, 64 nt, Human
guggcuggccaugggcacugggcucgccuugcacgcccaccaggagggccaggggcauacgcag

SEQ ID NO: 305126 - RNA, 64 nt, Human
augugcacaaccaccaugugucuucuaggugcuggcccaccaccacacaucacaggcugauuuc

SEQ ID NO: 305127 - RNA, 64 nt, Human
cuauucuaaucaggccccuucccaaucuccauuucucugccaagcccauuuacccccaccucau

SEQ ID NO: 305128 - RNA, 64 nt, Human
guacaggagggugccaucccccagcaugcggcuucucugccauuagcagcccugggcgggccga

SEQ ID NO: 305129 - RNA, 64 nt, Human
cucuggagccaggcugccugggcuccaaugccagcucugccacuugcuagcugugagacugugg

SEQ ID NO: 305130 - RNA, 64 nt, Human
caggaaccccacagacugucccuuccagcccacacucugccaccuccuggcccugucccaauuc

SEQ ID NO: 305131 - RNA, 64 nt, Human
auuucugucccacaggccuucagcccuuuaacgucucugccaaaaaccagcacaaggagacaaa

SEQ ID NO: 305132 - RNA, 64 nt, Human
agagcugcccucucggcauuaccucuucugcaggcucugccaugcacgcaccucacugccaggc

SEQ ID NO: 305133 - RNA, 64 nt, Human
uugugauguucugagguugggcucaggcugggugcucugccaugggcugaguggcccagauauu

SEQ ID NO: 305134 - RNA, 64 nt, Human
cugugguaccuacaucuucaggaagcugugcagccucugccauugccaucccagggggaucugg

SEQ ID NO: 305135 - RNA, 64 nt, Human
cccacauggcccaaggugggcaucuugacguuaccucugccacgugugagaagcucuuuuucgg

SEQ ID NO: 305136 - RNA, 64 nt, Human
aaccugcugcagucucuugggccccugcuggcagcucugccacgucaccgccugccuggcuccc

SEQ ID NO: 305137 - RNA, 64 nt, Human
cucuggcaggauuugcaggcagcaggcagcaccccucugccagccgggccccggcugcagaagu

SEQ ID NO: 305138 - RNA, 64 nt, Human
acaaaacccucgaauagcuugagagccccacaggcucugccacacccgugacuucauccacacu

SEQ ID NO: 305139 - RNA, 64 nt, Human
cuggaggaagcugacacggagaugccuggccucucucugccaaaaagcauuuuuuccuuuaaau

SEQ ID NO: 305140 - RNA, 51 nt, Human
gugauggcgagaguaacugagcucugccacccccaggagggacccuugaua

SEQ ID NO: 305141 - RNA, 64 nt, Human
aggaggaggcauagaccguccggagcagcggggccucugccagcccuugcagcugcagcccauc

SEQ ID NO: 305142 - RNA, 64 nt, Human
aaggggugagaagaaucaucucugcaccucgggucucugccagaggaagacuuaagcaucccug

SEQ ID NO: 305143 - RNA, 64 nt, Human
gagcauuuguaagcacauggugaaaucagccccugcccaccaaaauaaucuuuauguuaccaag

SEQ ID NO: 305144 - RNA, 64 nt, Human
ugccucagccucaugaauagcugggauuacaggugcccaccaccaugccuggcuaguuuuugua

SEQ ID NO: 305145 - RNA, 64 nt, Human
ugccucagccucaugaauagcugggauuacaggugcccaccaccaugccuggcugguuuuugua

SEQ ID NO: 305146 - RNA, 64 nt, Human
uccgagugcuuuuuugguaccacgagacccggcccucugccagcauaaaccacucacaccccag

SEQ ID NO: 305147 - RNA, 64 nt, Human
gcccgcgccugccucccuuccccgccaccgggcccucugccauuaaagccuccgugcuucgcuc

SEQ ID NO: 305148 - RNA, 64 nt, Human
cacugcggcgaguucccucgggccccagcuccgccucugccaggugucuggucuguuggcccug

SEQ ID NO: 305149 - RNA, 64 nt, Human
gaaagggagaacugacuccugucccaaauagcuccucugccaccuguccugcagugggccugug

SEQ ID NO: 305150 - RNA, 64 nt, Human
ugccccgcagucagcagccauuccuggcagugaacucugccaggacugaagcuguggcuuuauc

SEQ ID NO: 305151 - RNA, 64 nt, Human
ucauugcugggagaauuaagcauuauccugaagacucugccaggagaggauaauuggaaguucu

SEQ ID NO: 305152 - RNA, 64 nt, Human
guuacacagccugagucacaacgugggaaggaaucucugccacgggaaaggugggcggaagcag

SEQ ID NO: 305153 - RNA, 64 nt, Human
cacgaccagccuggccaacauugugaaaccccaucucugccaaaaauacaaaaguuagccgggc

SEQ ID NO: 305154 - RNA, 64 nt, Human
cuguuggaaggccucccugggccuggcccccacccucugccacccaguccucccagcugccaug

SEQ ID NO: 305155 - RNA, 64 nt, Human
ucacggauggugcaugggcucgccgugucucagccucugccagcgccaaaacaagccaaagagc

SEQ ID NO: 305156 - RNA, 64 nt, Human
gagacccuucuccaagcaccucagcgcacuugcccucugccacaccugucgguggaggcugugg

SEQ ID NO: 305157 - RNA, 64 nt, Human
gcccaggcugccguccccuagagucccagguuggcucugccaguccuguccuuuaccaaagaug

SEQ ID NO: 305158 - RNA, 64 nt, Human
ugcauggagaggccagggcuggggacaguccgcacucugccacccuccugccccuuccacccac

SEQ ID NO: 305159 - RNA, 64 nt, Human
gcaacaugugccccagaucuggaagggccucccucucugccaguguuugggugggugucauggg

SEQ ID NO: 305160 - RNA, 51 nt, Human
ucagcggggagucccuguaggcucugccaucaucagcaccaggagagccga

SEQ ID NO: 305161 - RNA, 64 nt, Human
gggucaggccgugggagccgcuauuaucugcguucucugccaaagacucgugggggccaucaca

SEQ ID NO: 305162 - RNA, 64 nt, Human
ugccucagccucccaaguagcugggguuacaggcgcccaccaccacacucggcuaauuuugugu

SEQ ID NO: 305163 - RNA, 64 nt, Human
ccuuugcauuuauuuauacagugccuugcucggcgcccaccacccccucaagccccagcagccc

SEQ ID NO: 305164 - RNA, 64 nt, Human
aagacagggaaaggaaggcagcaggaggccacaagcccaccaggucuucaugucaagagaggga

SEQ ID NO: 305165 - RNA, 64 nt, Human
gaggugcccacuccgccagccacaggaccaccuccucugccagcaggaauaaagacuugugcau

SEQ ID NO: 305166 - RNA, 64 nt, Human
ggagucuucauugcuucuguuauuaccccgucuccucugccauuuucuacagcuugcugaguug

SEQ ID NO: 305167 - RNA, 64 nt, Human
guuuuagccucauucacucaggccccacucagcacucugccagccaagaccauugauuuggaaa

SEQ ID NO: 305168 - RNA, 64 nt, Human
caacugcucaguuccuugugaaugcccagagggacucugccacccugucucuggguccugccag

SEQ ID NO: 305169 - RNA, 64 nt, Human
gcaaaucccgggcaugagcuacucgccgucggcucucugccacuucgucucgcucccuacucuc

SEQ ID NO: 305170 - RNA, 64 nt, Human
aguucuugguggcuaauaacagucagauuagggucucugccauucagaguugaugcuugaaaac

SEQ ID NO: 305171 - RNA, 64 nt, Human
ccuggagcaaugggugugccagcccucagcaugacucugccaagcauccagaccacaaaugcag

SEQ ID NO: 305172 - RNA, 64 nt, Human
ccgaaguucucucugacccccaccucgacucggccucugccagcugccuucccugccagagaac

SEQ ID NO: 305173 - RNA, 64 nt, Human
aaaucugucaacuaucuuaauugaaauauuugcucucugccauaauuucucauauggagcuauu

SEQ ID NO: 305174 - RNA, 64 nt, Human
gaaaccccccaacccacucccucuguagugaggccucugccauguccagagggcacaaaacugu

SEQ ID NO: 305175 - RNA, 64 nt, Human
ugggggcaacuguagaugugguuucuaguccuggcucugccacuaacuugcuguguaaccuuga

SEQ ID NO: 305176 - RNA, 64 nt, Human
gguuuuucgugcuggaacauccccaccagagccucucugccauaacugccagcugcucuccccg

SEQ ID NO: 305177 - RNA, 64 nt, Human
gaggggccaguugaguucugggagcugggcacuacucugccaguccagaguuguacagcagaag

SEQ ID NO: 305178 - RNA, 64 nt, Human
caguccauauccugaugagggaucaggccccuaccucugccaaggcaaguaaugguagugggcu

SEQ ID NO: 305179 - RNA, 64 nt, Human
gcuuccagaaaggguuuuaaagcccaugccccaacucugccagcccccaccugccaggacguuc

SEQ ID NO: 305180 - RNA, 64 nt, Human
ggugaauuauagaaagcaauccagaugugguuuacucugccacagucuaaugucauucacuuca

SEQ ID NO: 305181 - RNA, 64 nt, Human
gcuggcuaguguaacacugacuaugaguaggugggcccaccacuugaguugaggugauuucaug

SEQ ID NO: 305182 - RNA, 64 nt, Human
uccugccaagccaaaugugcuuccugcagcucacgcccaccagcuacugaagggacccaaggca

SEQ ID NO: 305183 - RNA, 64 nt, Human
gugcuaggcugggagcugcccugagagcugggaugcccaccaaggcccacagaacugucuccag

SEQ ID NO: 305184 - RNA, 64 nt, Human
ugggggaggagcacaaaacuccagcccacugaaccucugccaauuaagaugguguuggguuagg

SEQ ID NO: 305185 - RNA, 64 nt, Human
agaggcuggacugcugccaccccgggugcucccgcucugccauagcacugaucagugacaauuu

SEQ ID NO: 305186 - RNA, 64 nt, Human
ccuccauggaugcacugcugccgagcagagcguccucugccaggccccgcccuggauuccuaga

SEQ ID NO: 305187 - RNA, 64 nt, Human
gagacguggguccaagguccucaucccauccucccucugccaggcacuaugugucuggggcuuc

SEQ ID NO: 305188 - RNA, 64 nt, Human
guccuggcuguggguggccauccauuuugagcaccucugccaggcugcagaccuggaggcgaag

SEQ ID NO: 305189 - RNA, 64 nt, Human
cucucuuaaaugguaccucaaaaagcuggagccucucugccaugauuaugcuucuacaaauuuc

SEQ ID NO: 305190 - RNA, 64 nt, Human
cacugcgcguggagaagggcuuaucugcaguacacucugccauguggagggugggccucugugg

SEQ ID NO: 305191 - RNA, 64 nt, Human
uggaguccaagguguucugacaaggguggcuuuucucugccauucgcuaaggccuuugucacuu

SEQ ID NO: 305192 - RNA, 64 nt, Human
auaugagacaacauauuuuguauuucacucaaggcucugccaguaaaaaguaaugaaauuguac

SEQ ID NO: 305193 - RNA, 64 nt, Human
cgagaucagccuggguaacauagcgagaccccaccucugccaaaaaaaaaaaaaauaggguauc

SEQ ID NO: 305194 - RNA, 64 nt, Human
ggcuggagggaguuaggcugaauuucccgacuuccucugccaguuauugacacagcucucuuug

SEQ ID NO: 305195 - RNA, 64 nt, Human
cuccgcccuucccucccucccucccucccucccucucugccaaggcuccagcuucuucccccag

SEQ ID NO: 305196 - RNA, 64 nt, Human
agaacuuuuguagaaaucgggguucccucuuucucucugccaggaccccauagagucacagcuu

SEQ ID NO: 305197 - RNA, 64 nt, Human
augcugcguucuccugacuuuacguuggccccuccucugccaagcccccaggggagcccucccu

SEQ ID NO: 305198 - RNA, 60 nt, Human
acgcuuccauccccagguagcuggggcagccucugccaggcuugggugugccuggccugg

SEQ ID NO: 305199 - RNA, 64 nt, Human
aggcccccgcccuuuucucccuuugguccuuccccucugccauccccuuggggccggucccucu

SEQ ID NO: 305200 - RNA, 64 nt, Human
gacugucauguuauccagaagggcugguacauccgcccaccaugucccccugcugggucaggag

SEQ ID NO: 305201 - RNA, 64 nt, Human
gccuuuccuaugggcaaggcccagugcucuuccugcccaccagggaccauggagcaguggcacc

SEQ ID NO: 305202 - RNA, 64 nt, Human
agccuuaagcucccaaguagcugggauuacgggcgcccaccaccacgcccagcuaauuuuuuuu

SEQ ID NO: 305203 - RNA, 64 nt, Human
gcuggcggccuccuugggaacguguaggccacggcucugccaccacuagguaccugcugagggc

SEQ ID NO: 305204 - RNA, 64 nt, Human
ccucuccugccuggccuggccugggacaccuccucucugccaggaggcaauaaaagccagcgcc

SEQ ID NO: 305205 - RNA, 64 nt, Human
cucuggagccagucuaccuugaguuaaaucccaccucugccaucuacuaccuaagugaccuugg

SEQ ID NO: 305206 - RNA, 64 nt, Human
gccaggaaucaaacugccuggguuccagucccagcucugccaguuaugcccagcuguggggacu

SEQ ID NO: 305207 - RNA, 64 nt, Human
aaaaugaaaugcaagcacacaucuuuucaggcuucucugccaagccuauggcgcuuugucaugg

SEQ ID NO: 305208 - RNA, 64 nt, Human
guucccuuuguguguguucagggagcucuccuggcucugccaccucauuugucuuuauuuuuuu

SEQ ID NO: 305209 - RNA, 64 nt, Human
aaaugggcugucuuaccaugugcugauguaugugcucugccagugugaagggugaacagcucca

SEQ ID NO: 305210 - RNA, 64 nt, Human
uucuucuuauggucugggguggauugaaaacaggcucugccaaacugaagacagccuuugugcg

SEQ ID NO: 305211 - RNA, 64 nt, Human
acgucagcaagguggcucugacccucccaggugacucugccaagcagcuguggcccccagggcu

SEQ ID NO: 305212 - RNA, 64 nt, Human
cuuccagacaagacccacaaaucucagguggagacucugccaccaagucuggaagaaucgucca

SEQ ID NO: 305213 - RNA, 64 nt, Human
cagucagaaccguggacgggguggguugaggccucucugccacccgucuuccuggucagcagaa

SEQ ID NO: 305214 - RNA, 64 nt, Human
gcugguagggagcuuugccugccccggggauacccucugccagccgcuggaagugggaaugcug

SEQ ID NO: 305215 - RNA, 64 nt, Human
auauuucccucuccccuucccuccccgccaagagcucugccaggggcgggcaaaaaaaaaagua

SEQ ID NO: 305216 - RNA, 64 nt, Human
uugagccagccagagaagauagcgagaucuaaaucucugccaaaaaaaaaaaaaaacuuaaaaa

SEQ ID NO: 305217 - RNA, 64 nt, Human
ccucugggaacaagacugcgggcucugcccccagcucugccaggacggcugcaagaccagcugg

SEQ ID NO: 305218 - RNA, 64 nt, Human
gcuuccugaugaauucucccuuguucccccuuggcucugccauuauuucguuuucaguguaauu

SEQ ID NO: 305219 - RNA, 64 nt, Human
caacuaugauuauuaacgauguccaacccgucuggcccaccaggguccuuuugacacugcucua

SEQ ID NO: 305220 - RNA, 64 nt, Human
ccugccccuuucaggccuacagccacauccccaagcccaccaggugucaggauagucacaguga

SEQ ID NO: 305221 - RNA, 64 nt, Human
auacaaagccuuggucccgugaaaacacucgugugcccaccagcggccuugaagaggcaggucu

SEQ ID NO: 305222 - RNA, 64 nt, Human
cuccuacccgggccuccgugcagagaugggcuuucucugccaguccccugcugucugucugugg

SEQ ID NO: 305223 - RNA, 64 nt, Human
uaaucucaaaacugcuaguggagucacagacacacucugccaugucuuagcuguaggacacuca

SEQ ID NO: 305224 - RNA, 64 nt, Human
cuaaucuccccugggccccuccccggggaauccucucugccaauccugcgagggucuaggcccc

SEQ ID NO: 305225 - RNA, 64 nt, Human
guggcgguguuuguccaaaauaacggggcuccugcucugccagucaguacccucaagucacucc

SEQ ID NO: 305226 - RNA, 64 nt, Human
uggggccucacucugcgcuuugccaaagucgcuucucugccauagcugcacagaccuuaaaccc

SEQ ID NO: 305227 - RNA, 64 nt, Human
uccagagccaggagaguuggaccauugagggcagcucugccaacauuuaguaaaaguauucauu

SEQ ID NO: 305228 - RNA, 64 nt, Human
cuacuuuccccaguacugaggugguggacaucgucucugccacuccugacccagcccugaacaa

SEQ ID NO: 305229 - RNA, 64 nt, Human
cuccuugcgucucccauucccaagauugucccgccucugccaauccccgccguccuuccagccc

SEQ ID NO: 305230 - RNA, 64 nt, Human
gagagcaguuacuggggucacccaaccugacuuccucugccacucccugcugugugacuuuggg

SEQ ID NO: 305231 - RNA, 64 nt, Human
uaccuuuuuaugcuuacacuccauccaaaccuaacucugccaaccacuuuucuccuaucaguau

SEQ ID NO: 305232 - RNA, 64 nt, Human
aagcuccgggaggaguaagcugucacgacgcucccucugccagcuggucccgggaauucuguga

SEQ ID NO: 305233 - RNA, 64 nt, Human
gggguucucaggcccaggcuucgaccagaggacccucugccaccaccguuucuuccuguccuug

SEQ ID NO: 305234 - RNA, 64 nt, Human
ccaggcuccagacucccacacgcccacacagcaccucugccaggccuaggagaggacaggugca

SEQ ID NO: 305235 - RNA, 64 nt, Human
gggcggcuggcccagcccucggggcaggagcccccucugccacacgcuuugugccuccaaagcu

SEQ ID NO: 305236 - RNA, 64 nt, Human
aagcacauggaaaaaaauggaugaggagggaaaacucugccaaauggaaaaugaccaaauuuaa

SEQ ID NO: 305237 - RNA, 64 nt, Human
caggccacaaccgggcuggaagugcgguugagcucucugccacuuucuucaauguaaaaaguag

SEQ ID NO: 305238 - RNA, 64 nt, Human
ucuggcuaucgucccccuucucacugaccugaccgcccaccaccuccuucccccucaucacaug

SEQ ID NO: 305239 - RNA, 64 nt, Human
uaauauauucuuguuggcuaacuaaauuguguaugcccaccacaaagaagguacuauuuuuugu

SEQ ID NO: 305240 - RNA, 64 nt, Human
agggcagggggccuacggugcuauugcuuuaggggcccaccacgggcaggggccugcucccagc

SEQ ID NO: 305241 - RNA, 64 nt, Human
cucuggcauuugacuaccuuacuuugaguccagacucugccacuuaauagcucugugaucuugg

SEQ ID NO: 305242 - RNA, 64 nt, Human
uccagcucggacagcacccucagugccagccagccucugccagaccucucuuucccucuucucc

SEQ ID NO: 305243 - RNA, 64 nt, Human
gaagcaccuuuugacucuucccuuccaauguaaucucugccaacaccaugaggcuuaaggugcu

SEQ ID NO: 305244 - RNA, 64 nt, Human
ccucuuucucccuggccugugguugucccccagccucugccacccuccaccuccucggucagcc

SEQ ID NO: 305245 - RNA, 64 nt, Human
uucaagaagcucccaucacaagcuuggcauugcucucugccacacgugggcuuccucaggcuug

SEQ ID NO: 305246 - RNA, 64 nt, Human
cuucucucugugauggguuuuugcacggggugugcucugccacugugguggguggguggaugcu

SEQ ID NO: 305247 - RNA, 64 nt, Human
ggguuauuuauaggacugauggaaaugauuucaucucugccaucucuaaagcacuuuucauuga

SEQ ID NO: 305248 - RNA, 64 nt, Human
cccucccauccucacccaggccaaggcccaggggcucugccaggacaccacaugggagggggcu

SEQ ID NO: 305249 - RNA, 64 nt, Human
caggacacugagggccugccuguggugugcccggcucugccacucccgggaggggaagggcugc

SEQ ID NO: 305250 - RNA, 64 nt, Human
cccuggagguucccggccggagagugccucuccccucugccauccacgucaggucuuugguggg

SEQ ID NO: 305251 - RNA, 64 nt, Human
ucuucagagucacagacuugaguucauuucccagcucugccacucaugauuauauaacuuaauu

SEQ ID NO: 305252 - RNA, 64 nt, Human
aaaagugauguccccuuucccugccaccuccagccucugccagcaaugagcugucccccuccca

SEQ ID NO: 305253 - RNA, 64 nt, Human
guggggaaauaaacugacuuuggacugcuucagucucugccaucuuccaugacugcauuuguuc

SEQ ID NO: 305254 - RNA, 64 nt, Human
guugaguuggccauuaaaagaaacagagacuucucucugccauggcccuucuuuauuccaggga

SEQ ID NO: 305255 - RNA, 64 nt, Human
cuguuugcuuucugcugagauaaggaaugcaucacucugccagaguaugacuuuuuacagauua

SEQ ID NO: 305256 - RNA, 64 nt, Human
aguggccuuccucccuuccuuucacagccggucucucugccaggaaaugggggaaggaacuaga

SEQ ID NO: 305257 - RNA, 64 nt, Human
cgcugaccucuggccacaggaagccagguccaccgcccaccacccuuucaggccauguuucuac

SEQ ID NO: 305258 - RNA, 61 nt, Human
ccaucgaugaccgaaagugaccaagaccaaggcccaccaaggcagcagacuguuaaucaga

SEQ ID NO: 305259 - RNA, 64 nt, Human
aggcugggagcagccuagggagagcccccaucaugcccaccacccacucuggcacuggcuucau

SEQ ID NO: 305260 - RNA, 64 nt, Human
ucagccaccugaguugcucuaucugcaagccugacucugccagccuccccugguagagaggagg

SEQ ID NO: 305261 - RNA, 64 nt, Human
aggaccccaucugcugagcucugaccugcccccgcucugccaucagccccugcugcuccucggc

SEQ ID NO: 305262 - RNA, 64 nt, Human
uggccuuaugaccagugagaacucucucccuggucucugccagcccaagcaucacugcccgagg

SEQ ID NO: 305263 - RNA, 64 nt, Human
gggccugcccugagucugcuggggagugggcauucucugccagggacccaugagcaggcugcau

SEQ ID NO: 305264 - RNA, 64 nt, Human
caagccuuaacggaggucugcucugacgggugggcucugccagagcccgggugagcccagaaag

SEQ ID NO: 305265 - RNA, 64 nt, Human
cucucacauacagaggccgaggggccaauucguucucugccacagggacuugccucacuguguc

SEQ ID NO: 305266 - RNA, 64 nt, Human
ggcguuccgacagcacuuccuguccgcccuucuccucugccauccagaaccguccagaacuguu

SEQ ID NO: 305267 - RNA, 64 nt, Human
ucacagagggcacuguggucacacacagugccuccucugccaguuccuuuauugaaagaggugu

SEQ ID NO: 305268 - RNA, 64 nt, Human
uuccuaaagaaaaccacucuuugaucauggcucucucugccagaauugugugcacucuguaaca

SEQ ID NO: 305269 - RNA, 64 nt, Human
uuauuaaacagugaacuugucuggcuuuggcacucucugccauucugugcaggcugcaguggcu

SEQ ID NO: 305270 - RNA, 64 nt, Human
gagcccccggaaguccccacugggcuucaguguccucugccacauucccugggaggaacaaugu

SEQ ID NO: 305271 - RNA, 64 nt, Human
agggagggaaggcucugcccuggccuuccgucagcucugccagugcaggcugggcagccugggc

SEQ ID NO: 305272 - RNA, 64 nt, Human
cuucuugcaagguaacuugaaucaucacuuauuucucugccaccugguuuuaggacuggcacuc

SEQ ID NO: 305273 - RNA, 64 nt, Human
ucccccuccuagaagccaaagacccgcgggcgcccucugccaccuugcuccccgggaacccaug

SEQ ID NO: 305274 - RNA, 64 nt, Human
agcgcggaccggaaggggccgaggcugcacgggccucugccagaacgcucaggacaucccggcc

SEQ ID NO: 305275 - RNA, 64 nt, Human
acuucaggaugguuuuuaaauuugguaugagauucucugccaacaccaagcucugaguuaacug

SEQ ID NO: 305276 - RNA, 64 nt, Human
uaccucagccucccgaguagcugggacuacaggcgcccaccaccaugcccggcuaauuuuuguu

SEQ ID NO: 305277 - RNA, 64 nt, Human
uccccucccccuggggugugcugugucccaccuggcccaccagaggcucacgacgauggcaccu

SEQ ID NO: 305278 - RNA, 64 nt, Human
ucucuuuccucgccacauagggugcagggccugggcccaccacgacgccugaagucacagcucc

SEQ ID NO: 305279 - RNA, 64 nt, Human
ucucccuggcaaggcucuuccuuuucagggauaucucugccaaccccuccccuguccucggguu

SEQ ID NO: 305280 - RNA, 64 nt, Human
cagucccagcucugccucugacucgcugugugcccucugccaagucaugcccauucucuaguuc

SEQ ID NO: 305281 - RNA, 64 nt, Human
aacguuuauagucugaccccucacuuaggcuuuccucugccaccccgguccagggaagaggcuc

SEQ ID NO: 305282 - RNA, 64 nt, Human
cuguaaauacagacuacugcgaguguccagagcucucugccaugauacuuccuugggacugacu

SEQ ID NO: 305283 - RNA, 64 nt, Human
gccaaggcuccauagcuuugccaaaugcacggagcucugccauuccggugcagugcaggccuug

SEQ ID NO: 305284 - RNA, 64 nt, Human
gguaguguuggggccgggacgggcuuggcucccucucugccauacugagccugagguauuucau

SEQ ID NO: 305285 - RNA, 64 nt, Human
aucuggagagcaucaggcccgcaggacugcacaacucugccaggggugagguucuuggccucag

SEQ ID NO: 305286 - RNA, 64 nt, Human
caucacugaaucacagagccuuugcgugaaacagcucugccaggccgggagcuggguuucucuu

SEQ ID NO: 305287 - RNA, 64 nt, Human
ugcccccuccccuccuuuaccgaggacagccugccucugccacagcaaggcugucggggucaag

SEQ ID NO: 305288 - RNA, 64 nt, Human
cucacugggauccccuuccugccuccucccagggcucugccagggccuugcucagucccuucca

SEQ ID NO: 305289 - RNA, 64 nt, Human
guauuggaucauaggagagcacuugcucuccugccucugccaggagagggcuuguuccuccaac

SEQ ID NO: 305290 - RNA, 64 nt, Human
acaggguugcuaucccccuuccuuuccucccucccucugccauccuucauccuuuuauccuccc

SEQ ID NO: 305291 - RNA, 59 nt, Human
uugaaaggcucuuagucuaaaccuguggccucugccacgugcucccugccagcuucccc

SEQ ID NO: 305292 - RNA, 64 nt, Human
cuuaagaagggguuagugcaucuuucaggggucacucugccauggggauaaaauagcuguuuca

SEQ ID NO: 305293 - RNA, 64 nt, Human
ggccaaagaugagcauuguccaccacuaaaaugccucugccacuuugaauucugugcuaauuuu

SEQ ID NO: 305294 - RNA, 64 nt, Human
cguggaggcagcacagugcagacagaccuaauggcucugccacuuacuagcugguuugggcaaa

SEQ ID NO: 305295 - RNA, 64 nt, Human
gccccaacugcaggaaugcugacaaugcugccaugcccaccaucggguguaggugaaaggcauc

SEQ ID NO: 305296 - RNA, 64 nt, Human
uaagaaguaauuuuccaaccuuuggaagucaugagcccaccauuguucauuugugcaccaauua

SEQ ID NO: 305297 - RNA, 64 nt, Human
acauacuccagauugaccuuauaaauaaaagaaugcccaccagauugaaauccuagaaauacag

SEQ ID NO: 305298 - RNA, 64 nt, Human
gcaaagaggucgacagcaaugugugaucccagcucucugccagacugagagggcaagccgucuu

SEQ ID NO: 305299 - RNA, 64 nt, Human
acagagguuugaaggagaauggcauggcaggagucucugccaguuacuugggcuucaacagcca

SEQ ID NO: 305300 - RNA, 64 nt, Human
uggaugugugugguggcuccaguggguguuucuacucugccagugagaggcagcccccuagaaa

SEQ ID NO: 305301 - RNA, 64 nt, Human
uuucuuuacaagauggguccaggauuccucuuuucucugccauaaaugauuaauuaaauagcuu

SEQ ID NO: 305302 - RNA, 64 nt, Human
cagucagccgauccucugcucagguucagcuggacucugccaucugugggcccagcaucacucu

SEQ ID NO: 305303 - RNA, 64 nt, Human
ccaggaggcgguccauaagaauggggacagugggcucugccagggcugccgcaccuguccagac

SEQ ID NO: 305304 - RNA, 64 nt, Human
uaaggguccugcacguugccucccaccaccccagcucugccagaauaaaauuguuuccaauaga

SEQ ID NO: 305305 - RNA, 64 nt, Human
uuauuucugccuucaucucccacuucucacccaacucugccacuguucaggagcaguugacuaa

SEQ ID NO: 305306 - RNA, 64 nt, Human
caccagagguaggagaccuggauucaagugccagcucugccacugacccuggggccccgaccca

SEQ ID NO: 305307 - RNA, 64 nt, Human
caucuugccaccagaagacccgagggaggcucagcucugccagcucagaggaccagcuauaucc

SEQ ID NO: 305308 - RNA, 64 nt, Human
aacacugugaagagcuggacucccucaagccagacucugccaaaaccaagauauccacuuaccu

SEQ ID NO: 305309 - RNA, 64 nt, Human
cagacuccuguccccuugguuucuguguuugucucucugccaucuuagguugccaugagccaug

SEQ ID NO: 305310 - RNA, 64 nt, Human
caagaccagccagggcaacaugaugagacccugucucugccaaaaaauuuuuuaaacuauuagc

SEQ ID NO: 305311 - RNA, 64 nt, Human; identical to SEQ ID NO: 284740

SEQ ID NO: 305312 - RNA, 64 nt, Human; identical to SEQ ID NO: 284741

SEQ ID NO: 305313 - RNA, 64 nt, Human; identical to SEQ ID NO: 284742

SEQ ID NO: 305314 - RNA, 64 nt, Human
gguggcuucuuugaggagaagggcgccaucuucugcccaccaugcuaugacgugcgcuaugcac

SEQ ID NO: 305315 - RNA, 64 nt, Human
ggggucagcaaacuacugccugugggccaaauuugcccaccaccuguaucuguaaauaagguuu

SEQ ID NO: 305316 - RNA, 64 nt, Human; identical to SEQ ID NO: 284743

SEQ ID NO: 305317 - RNA, 64 nt, Human; identical to SEQ ID NO: 284744

SEQ ID NO: 305318 - RNA, 64 nt, Human; identical to SEQ ID NO: 284745

SEQ ID NO: 305319 - RNA, 64 nt, Human; identical to SEQ ID NO: 284746

SEQ ID NO: 305320 - RNA, 64 nt, Human; identical to SEQ ID NO: 284747

SEQ ID NO: 305321 - RNA, 64 nt, Human; identical to SEQ ID NO: 284751

SEQ ID NO: 305322 - RNA, 64 nt, Human; identical to SEQ ID NO: 284752

SEQ ID NO: 305323 - RNA, 64 nt, Human; identical to SEQ ID NO: 284753

SEQ ID NO: 305324 - RNA, 64 nt, Human; identical to SEQ ID NO: 284754

SEQ ID NO: 305325 - RNA, 64 nt, Human; identical to SEQ ID NO: 284755

SEQ ID NO: 305326 - RNA, 64 nt, Human; identical to SEQ ID NO: 284756

SEQ ID NO: 305327 - RNA, 64 nt, Human; identical to SEQ ID NO: 284757

SEQ ID NO: 305328 - RNA, 64 nt, Human; identical to SEQ ID NO: 284758

SEQ ID NO: 305329 - RNA, 64 nt, Human; identical to SEQ ID NO: 284759

SEQ ID NO: 305330 - RNA, 64 nt, Human
ccaguggggggcaggggugcgccuccucugcccugcccaccagccugugauuugauggggucuu

SEQ ID NO: 305331 - RNA, 64 nt, Human
cccaaccccgcagccugggcuucgaaggcgacccgcccaccauccugcccuucccagaaccuga

SEQ ID NO: 305332 - RNA, 64 nt, Human
cauaaguaguuuugagaggguggauggguuacuugcccaccagaaacagcccuagucccaacuc

SEQ ID NO: 305333 - RNA, 64 nt, Human; identical to SEQ ID NO: 284760

SEQ ID NO: 305334 - RNA, 64 nt, Human; identical to SEQ ID NO: 284761

SEQ ID NO: 305335 - RNA, 64 nt, Human; identical to SEQ ID NO: 284762

SEQ ID NO: 305336 - RNA, 64 nt, Human; identical to SEQ ID NO: 284763

SEQ ID NO: 305337 - RNA, 64 nt, Human; identical to SEQ ID NO: 284764

SEQ ID NO: 305338 - RNA, 64 nt, Human; identical to SEQ ID NO: 284765

SEQ ID NO: 305339 - RNA, 64 nt, Human; identical to SEQ ID NO: 284769

SEQ ID NO: 305340 - RNA, 64 nt, Human; identical to SEQ ID NO: 284770

SEQ ID NO: 305341 - RNA, 64 nt, Human; identical to SEQ ID NO: 284771

SEQ ID NO: 305342 - RNA, 64 nt, Human; identical to SEQ ID NO: 284772

SEQ ID NO: 305343 - RNA, 64 nt, Human; identical to SEQ ID NO: 284773

SEQ ID NO: 305344 - RNA, 64 nt, Human; identical to SEQ ID NO: 284774

SEQ ID NO: 305345 - RNA, 64 nt, Human; identical to SEQ ID NO: 284775

SEQ ID NO: 305346 - RNA, 64 nt, Human; identical to SEQ ID NO: 284776

SEQ ID NO: 305347 - RNA, 64 nt, Human
aaaucaaaacuucuuuaagcugguaaagugaggggcccaccagcagugaucuccugaugccuua

SEQ ID NO: 305348 - RNA, 64 nt, Human
auggcuucauuuagagaccacaguaacaacagcagcccaccaaucagagaagcugguuguuauu

SEQ ID NO: 305349 - RNA, 64 nt, Human
cggcugcuagcccacggugaagcccggcgggguugcccaccaguugcgaaagcccccuuuccuc

SEQ ID NO: 305350 - RNA, 64 nt, Human; identical to SEQ ID NO: 284777

SEQ ID NO: 305351 - RNA, 64 nt, Human; identical to SEQ ID NO: 284778

SEQ ID NO: 305352 - RNA, 64 nt, Human; identical to SEQ ID NO: 284779

SEQ ID NO: 305353 - RNA, 64 nt, Human; identical to SEQ ID NO: 284780

SEQ ID NO: 305354 - RNA, 64 nt, Human; identical to SEQ ID NO: 284781

SEQ ID NO: 305355 - RNA, 64 nt, Human; identical to SEQ ID NO: 284782

SEQ ID NO: 305356 - RNA, 64 nt, Human; identical to SEQ ID NO: 284783

SEQ ID NO: 305357 - RNA, 64 nt, Human; identical to SEQ ID NO: 284787

SEQ ID NO: 305358 - RNA, 64 nt, Human; identical to SEQ ID NO: 284788

SEQ ID NO: 305359 - RNA, 64 nt, Human; identical to SEQ ID NO: 284789

SEQ ID NO: 305360 - RNA, 64 nt, Human; identical to SEQ ID NO: 284790

SEQ ID NO: 305361 - RNA, 64 nt, Human; identical to SEQ ID NO: 284791

SEQ ID NO: 305362 - RNA, 64 nt, Human; identical to SEQ ID NO: 284792

SEQ ID NO: 305363 - RNA, 64 nt, Human; identical to SEQ ID NO: 284793

SEQ ID NO: 305364 - RNA, 64 nt, Human
uaaauaucuacucacucauacagccagcccaccagcccaccauuaacucacugaacaaugagac

SEQ ID NO: 305365 - RNA, 64 nt, Human
aggcagaguaaauaucuacucacucauacagccagcccaccagcccaccauuaacucacugaac

SEQ ID NO: 305366 - RNA, 64 nt, Human
ugcuccgcucccaccgcccccaccccuuccccaggcccaccaucaccaccgccucuggccgcca

SEQ ID NO: 305367 - RNA, 64 nt, Human; identical to SEQ ID NO: 284794

SEQ ID NO: 305368 - RNA, 64 nt, Human; identical to SEQ ID NO: 284795

SEQ ID NO: 305369 - RNA, 64 nt, Human; identical to SEQ ID NO: 284796

SEQ ID NO: 305370 - RNA, 64 nt, Human; identical to SEQ ID NO: 284797

SEQ ID NO: 305371 - RNA, 64 nt, Human; identical to SEQ ID NO: 284798

SEQ ID NO: 305372 - RNA, 64 nt, Human; identical to SEQ ID NO: 284799

SEQ ID NO: 305373 - RNA, 64 nt, Human; identical to SEQ ID NO: 284800

SEQ ID NO: 305374 - RNA, 64 nt, Human; identical to SEQ ID NO: 284801

SEQ ID NO: 305375 - RNA, 64 nt, Human; identical to SEQ ID NO: 284805

SEQ ID NO: 305376 - RNA, 64 nt, Human; identical to SEQ ID NO: 284806

SEQ ID NO: 305377 - RNA, 64 nt, Human; identical to SEQ ID NO: 284807

SEQ ID NO: 305378 - RNA, 64 nt, Human; identical to SEQ ID NO: 284808

SEQ ID NO: 305379 - RNA, 64 nt, Human; identical to SEQ ID NO: 284809

SEQ ID NO: 305380 - RNA, 64 nt, Human; identical to SEQ ID NO: 284810

SEQ ID NO: 305381 - RNA, 64 nt, Human
aggcagucuggccugugccagcacggucuccugugcccaccagccccacaggugcugugcuuug

SEQ ID NO: 305382 - RNA, 64 nt, Human
agagugaguggccacagguagaaccgcggccgaagcccaccacuggccaugcucaccgcccugc

SEQ ID NO: 305383 - RNA, 64 nt, Human
ugccucagccucccgaguagcugggacuacaggcgcccaccaccacgcccggcuaauuuuuugu

SEQ ID NO: 305384 - RNA, 64 nt, Human; identical to SEQ ID NO: 284811

SEQ ID NO: 305385 - RNA, 64 nt, Human; identical to SEQ ID NO: 284812

SEQ ID NO: 305386 - RNA, 64 nt, Human; identical to SEQ ID NO: 284813

SEQ ID NO: 305387 - RNA, 64 nt, Human; identical to SEQ ID NO: 284814

SEQ ID NO: 305388 - RNA, 64 nt, Human; identical to SEQ ID NO: 284815

SEQ ID NO: 305389 - RNA, 64 nt, Human; identical to SEQ ID NO: 284816

SEQ ID NO: 305390 - RNA, 64 nt, Human; identical to SEQ ID NO: 284817

SEQ ID NO: 305391 - RNA, 64 nt, Human; identical to SEQ ID NO: 284818

SEQ ID NO: 305392 - RNA, 64 nt, Human; identical to SEQ ID NO: 284819

SEQ ID NO: 305393 - RNA, 64 nt, Human; identical to SEQ ID NO: 284822

SEQ ID NO: 305394 - RNA, 64 nt, Human; identical to SEQ ID NO: 284823

SEQ ID NO: 305395 - RNA, 64 nt, Human; identical to SEQ ID NO: 284824

SEQ ID NO: 305396 - RNA, 64 nt, Human; identical to SEQ ID NO: 284825

SEQ ID NO: 305397 - RNA, 64 nt, Human; identical to SEQ ID NO: 284826

SEQ ID NO: 305398 - RNA, 64 nt, Human
cuccccuaccucaaaccccagcugggcccgcuuagcccaccaggcaugaggccaagggcuccac

SEQ ID NO: 305399 - RNA, 64 nt, Human
ggaagccccuccugccagucccuguccccuuucagcccaccagucccucucugcugccggugau

SEQ ID NO: 305400 - RNA, 64 nt, Human
gccucggccaggccugcucugcucagcgcccaccgcccaccaccccuccugcuuccccgagccu

SEQ ID NO: 305401 - RNA, 64 nt, Human; identical to SEQ ID NO: 284827

SEQ ID NO: 305402 - RNA, 64 nt, Human; identical to SEQ ID NO: 284828

SEQ ID NO: 305403 - RNA, 64 nt, Human; identical to SEQ ID NO: 284829

SEQ ID NO: 305404 - RNA, 64 nt, Human; identical to SEQ ID NO: 284830

SEQ ID NO: 305405 - RNA, 64 nt, Human; identical to SEQ ID NO: 284831

SEQ ID NO: 305406 - RNA, 64 nt, Human; identical to SEQ ID NO: 284832

SEQ ID NO: 305407 - RNA, 64 nt, Human; identical to SEQ ID NO: 284833

SEQ ID NO: 305408 - RNA, 64 nt, Human; identical to SEQ ID NO: 284834

SEQ ID NO: 305409 - RNA, 64 nt, Human; identical to SEQ ID NO: 284835

SEQ ID NO: 305410 - RNA, 64 nt, Human; identical to SEQ ID NO: 284836

SEQ ID NO: 305411 - RNA, 64 nt, Human; identical to SEQ ID NO: 284840

SEQ ID NO: 305412 - RNA, 64 nt, Human; identical to SEQ ID NO: 284841

SEQ ID NO: 305413 - RNA, 64 nt, Human; identical to SEQ ID NO: 284842

SEQ ID NO: 305414 - RNA, 64 nt, Human; identical to SEQ ID NO: 284843

SEQ ID NO: 305415 - RNA, 64 nt, Human
caggaaacuuauucuauuccuguuuucucuuucugcccaccacauccaaucucucaaaacgguc

SEQ ID NO: 305416 - RNA, 64 nt, Human
gggcauggccguugccucucugccagccgcuggugcccaccagcuggcucugcagcacauugcc

SEQ ID NO: 305417 - RNA, 64 nt, Human
cucccaggcccagcaccgagcagaacagaccagagcccaccacaccacaaagagcagcaccuga

SEQ ID NO: 305418 - RNA, 64 nt, Human; identical to SEQ ID NO: 284844

SEQ ID NO: 305419 - RNA, 64 nt, Human; identical to SEQ ID NO: 284845

SEQ ID NO: 305420 - RNA, 64 nt, Human; identical to SEQ ID NO: 284846

SEQ ID NO: 305421 - RNA, 64 nt, Human; identical to SEQ ID NO: 284847

SEQ ID NO: 305422 - RNA, 64 nt, Human; identical to SEQ ID NO: 284848

SEQ ID NO: 305423 - RNA, 64 nt, Human; identical to SEQ ID NO: 284849

SEQ ID NO: 305424 - RNA, 58 nt, Human; identical to SEQ ID NO: 284850

SEQ ID NO: 305425 - RNA, 64 nt, Human; identical to SEQ ID NO: 284851

SEQ ID NO: 305426 - RNA, 64 nt, Human; identical to SEQ ID NO: 284852

SEQ ID NO: 305427 - RNA, 64 nt, Human; identical to SEQ ID NO: 284853

SEQ ID NO: 305428 - RNA, 64 nt, Human; identical to SEQ ID NO: 284854

SEQ ID NO: 305429 - RNA, 64 nt, Human; identical to SEQ ID NO: 284858

SEQ ID NO: 305430 - RNA, 64 nt, Human; identical to SEQ ID NO: 284859

SEQ ID NO: 305431 - RNA, 64 nt, Human; identical to SEQ ID NO: 284860

SEQ ID NO: 305432 - RNA, 64 nt, Human
uucuugagcaccuucugugcccagcauaugcuaggcccaccagcuaaguguguguggggggucu

SEQ ID NO: 305433 - RNA, 64 nt, Human
ugggggagggcccgaaauaucuauguuuuaccaagcccaccacaugauucugauguacucuaaa

SEQ ID NO: 305434 - RNA, 64 nt, Human
ugccucagccucccgaguagccgggacuacaggcgcccaccaccgugcccggcuaauuuaguug

SEQ ID NO: 305435 - RNA, 64 nt, Human; identical to SEQ ID NO: 284861

SEQ ID NO: 305436 - RNA, 64 nt, Human; identical to SEQ ID NO: 284862

SEQ ID NO: 305437 - RNA, 56 nt, Human; identical to SEQ ID NO: 284863

SEQ ID NO: 305438 - RNA, 64 nt, Human; identical to SEQ ID NO: 284864

SEQ ID NO: 305439 - RNA, 64 nt, Human; identical to SEQ ID NO: 284865

SEQ ID NO: 305440 - RNA, 64 nt, Human; identical to SEQ ID NO: 284866

SEQ ID NO: 305441 - RNA, 64 nt, Human; identical to SEQ ID NO: 284867

SEQ ID NO: 305442 - RNA, 64 nt, Human; identical to SEQ ID NO: 284868

SEQ ID NO: 305443 - RNA, 60 nt, Human; identical to SEQ ID NO: 284869

SEQ ID NO: 305444 - RNA, 64 nt, Human; identical to SEQ ID NO: 284870

SEQ ID NO: 305445 - RNA, 64 nt, Human; identical to SEQ ID NO: 284871

SEQ ID NO: 305446 - RNA, 64 nt, Human; identical to SEQ ID NO: 284872

SEQ ID NO: 305447 - RNA, 64 nt, Human; identical to SEQ ID NO: 284876

SEQ ID NO: 305448 - RNA, 64 nt, Human; identical to SEQ ID NO: 284877

SEQ ID NO: 305449 - RNA, 64 nt, Human
cagccacaggcuucuuguccaccucuucuccccugcccaccagcugcucagcgcauaagaccuu

SEQ ID NO: 305450 - RNA, 64 nt, Human
accaaaacacagacaaaccaaagguaaccagcuagcccaccacugaaaggaaagaucugagaca

SEQ ID NO: 305451 - RNA, 64 nt, Human
ugccucagccugcugaguaguugggauuacaggcgcccaccaccaugcccagcuaauuuuugug

SEQ ID NO: 305452 - RNA, 64 nt, Human; identical to SEQ ID NO: 284878

SEQ ID NO: 305453 - RNA, 64 nt, Human; identical to SEQ ID NO: 284879

SEQ ID NO: 305454 - RNA, 64 nt, Human; identical to SEQ ID NO: 284880

SEQ ID NO: 305455 - RNA, 64 nt, Human; identical to SEQ ID NO: 284881

SEQ ID NO: 305456 - RNA, 64 nt, Human; identical to SEQ ID NO: 284882

SEQ ID NO: 305457 - RNA, 64 nt, Human; identical to SEQ ID NO: 284883

SEQ ID NO: 305458 - RNA, 64 nt, Human; identical to SEQ ID NO: 284884

SEQ ID NO: 305459 - RNA, 64 nt, Human; identical to SEQ ID NO: 284885

SEQ ID NO: 305460 - RNA, 64 nt, Human; identical to SEQ ID NO: 284886

SEQ ID NO: 305461 - RNA, 64 nt, Human; identical to SEQ ID NO: 284887

SEQ ID NO: 305462 - RNA, 64 nt, Human; identical to SEQ ID NO: 284888

SEQ ID NO: 305463 - RNA, 64 nt, Human; identical to SEQ ID NO: 284889

SEQ ID NO: 305464 - RNA, 64 nt, Human; identical to SEQ ID NO: 284890

SEQ ID NO: 305465 - RNA, 64 nt, Human; identical to SEQ ID NO: 284894

SEQ ID NO: 305466 - RNA, 64 nt, Human
uguugcaguaccccccauucacccacaaaaugcagcccaccacccagucccccaauuccagaga

SEQ ID NO: 305467 - RNA, 64 nt, Human
cuuaaggacuuagcuggccacagugagcugaugugcccaccaccgugucaugagagaauggguu

SEQ ID NO: 305468 - RNA, 64 nt, Human
gauguuuggaacccuuuagcuuuguuuuggaauggcccaccauucucacuggaaaacagugguc

SEQ ID NO: 305469 - RNA, 64 nt, Human; identical to SEQ ID NO: 284895

SEQ ID NO: 305470 - RNA, 57 nt, Human; identical to SEQ ID NO: 284896

SEQ ID NO: 305471 - RNA, 64 nt, Human; identical to SEQ ID NO: 284897

SEQ ID NO: 305472 - RNA, 64 nt, Human; identical to SEQ ID NO: 284898

SEQ ID NO: 305473 - RNA, 64 nt, Human; identical to SEQ ID NO: 284899

SEQ ID NO: 305474 - RNA, 64 nt, Human; identical to SEQ ID NO: 284900

SEQ ID NO: 305475 - RNA, 64 nt, Human; identical to SEQ ID NO: 284901

SEQ ID NO: 305476 - RNA, 64 nt, Human; identical to SEQ ID NO: 284902

SEQ ID NO: 305477 - RNA, 64 nt, Human; identical to SEQ ID NO: 284903

SEQ ID NO: 305478 - RNA, 64 nt, Human; identical to SEQ ID NO: 284904

SEQ ID NO: 305479 - RNA, 64 nt, Human; identical to SEQ ID NO: 284905

SEQ ID NO: 305480 - RNA, 64 nt, Human; identical to SEQ ID NO: 284906

SEQ ID NO: 305481 - RNA, 64 nt, Human; identical to SEQ ID NO: 284907

SEQ ID NO: 305482 - RNA, 64 nt, Human; identical to SEQ ID NO: 284908

SEQ ID NO: 305483 - RNA, 64 nt, Human
cccuccccaccucacuuggggcccccagcagguugcccaccaagcugaaaggcagugauuuaga

SEQ ID NO: 305484 - RNA, 64 nt, Human
aggcagucagagcuggaaguguauggagagcccagcccaccagguccugccuuuugcggugaua

SEQ ID NO: 305485 - RNA, 64 nt, Human
uagccaggcauuccaaacaauuucuuauacugcugcccaccaaagcagcuugccaacagucaaa

SEQ ID NO: 305486 - RNA, 64 nt, Human; identical to SEQ ID NO: 284912

SEQ ID NO: 305487 - RNA, 64 nt, Human; identical to SEQ ID NO: 284913

SEQ ID NO: 305488 - RNA, 64 nt, Human; identical to SEQ ID NO: 284914

SEQ ID NO: 305489 - RNA, 64 nt, Human; identical to SEQ ID NO: 284915

SEQ ID NO: 305490 - RNA, 64 nt, Human; identical to SEQ ID NO: 284916

SEQ ID NO: 305491 - RNA, 64 nt, Human; identical to SEQ ID NO: 284917

SEQ ID NO: 305492 - RNA, 64 nt, Human; identical to SEQ ID NO: 284918

SEQ ID NO: 305493 - RNA, 64 nt, Human; identical to SEQ ID NO: 284919

SEQ ID NO: 305494 - RNA, 64 nt, Human; identical to SEQ ID NO: 284920

SEQ ID NO: 305495 - RNA, 64 nt, Human; identical to SEQ ID NO: 284921

SEQ ID NO: 305496 - RNA, 64 nt, Human; identical to SEQ ID NO: 284922

SEQ ID NO: 305497 - RNA, 64 nt, Human; identical to SEQ ID NO: 284923

SEQ ID NO: 305498 - RNA, 64 nt, Human; identical to SEQ ID NO: 284924

SEQ ID NO: 305499 - RNA, 64 nt, Human; identical to SEQ ID NO: 284925

SEQ ID NO: 305500 - RNA, 64 nt, Human
ggauggagcaccucugggacaacuaagagccaaggcccaccaaggaguuuuccacccgucucuc

SEQ ID NO: 305501 - RNA, 64 nt, Human
acuggcccucccacuucccucuuugacuuacaaagcccaccaggaagauccaggauaaucucuc

SEQ ID NO: 305502 - RNA, 64 nt, Human
gcuccuuagccuggaagaugcagggaaccuccacgcccaccaccaugagcuggaguggggauga

SEQ ID NO: 305503 - RNA, 64 nt, Human; identical to SEQ ID NO: 284926

SEQ ID NO: 305504 - RNA, 64 nt, Human; identical to SEQ ID NO: 284930

SEQ ID NO: 305505 - RNA, 64 nt, Human; identical to SEQ ID NO: 284931

SEQ ID NO: 305506 - RNA, 64 nt, Human; identical to SEQ ID NO: 284932

SEQ ID NO: 305507 - RNA, 64 nt, Human; identical to SEQ ID NO: 284933

SEQ ID NO: 305508 - RNA, 64 nt, Human; identical to SEQ ID NO: 284934

SEQ ID NO: 305509 - RNA, 64 nt, Human; identical to SEQ ID NO: 284935

SEQ ID NO: 305510 - RNA, 64 nt, Human; identical to SEQ ID NO: 284936

SEQ ID NO: 305511 - RNA, 64 nt, Human; identical to SEQ ID NO: 284937

SEQ ID NO: 305512 - RNA, 64 nt, Human; identical to SEQ ID NO: 284938

SEQ ID NO: 305513 - RNA, 64 nt, Human; identical to SEQ ID NO: 284939

SEQ ID NO: 305514 - RNA, 64 nt, Human; identical to SEQ ID NO: 284940

SEQ ID NO: 305515 - RNA, 64 nt, Human; identical to SEQ ID NO: 284941

SEQ ID NO: 305516 - RNA, 64 nt, Human; identical to SEQ ID NO: 284942

SEQ ID NO: 305517 - RNA, 64 nt, Human
guagggugugacuugaaaguaucgugaccauguggcccaccagcagccuuuccaaaggggaacu

SEQ ID NO: 305518 - RNA, 50 nt, Human
cugucaccucccuggugugagcccaccagcgcgcaccgucgccacggauc

SEQ ID NO: 305519 - RNA, 64 nt, Human
acccaccuccgcauccacccccguccgccauccugcccaccaccaggucgguucccgaggccug

SEQ ID NO: 305520 - RNA, 64 nt, Human; identical to SEQ ID NO: 284943

SEQ ID NO: 305521 - RNA, 64 nt, Human; identical to SEQ ID NO: 284944

SEQ ID NO: 305522 - RNA, 64 nt, Human; identical to SEQ ID NO: 284948

SEQ ID NO: 305523 - RNA, 64 nt, Human; identical to SEQ ID NO: 284949

SEQ ID NO: 305524 - RNA, 64 nt, Human; identical to SEQ ID NO: 284950

SEQ ID NO: 305525 - RNA, 64 nt, Human; identical to SEQ ID NO: 284951

SEQ ID NO: 305526 - RNA, 64 nt, Human; identical to SEQ ID NO: 284952

SEQ ID NO: 305527 - RNA, 64 nt, Human; identical to SEQ ID NO: 284953

SEQ ID NO: 305528 - RNA, 64 nt, Human; identical to SEQ ID NO: 284954

SEQ ID NO: 305529 - RNA, 64 nt, Human; identical to SEQ ID NO: 284955

SEQ ID NO: 305530 - RNA, 64 nt, Human; identical to SEQ ID NO: 284956

SEQ ID NO: 305531 - RNA, 64 nt, Human; identical to SEQ ID NO: 284957

SEQ ID NO: 305532 - RNA, 64 nt, Human; identical to SEQ ID NO: 284958

SEQ ID NO: 305533 - RNA, 64 nt, Human; identical to SEQ ID NO: 284959

SEQ ID NO: 305534 - RNA, 64 nt, Human
agaccucucucagcaccacugccucaucugccacgcccaccagugagcugcugccccugggucc

SEQ ID NO: 305535 - RNA, 64 nt, Human
cuccagccccgggccggaccuccugcuggcucucgcccaccaaccaaguguuacaagccccaga

SEQ ID NO: 305536 - RNA, 64 nt, Human
ccgucugcucaccugccacagagcccacacccaugcccaccaguguuggucuuugccucaaagc

SEQ ID NO: 305537 - RNA, 64 nt, Human; identical to SEQ ID NO: 284960

SEQ ID NO: 305538 - RNA, 55 nt, Human; identical to SEQ ID NO: 284961

SEQ ID NO: 305539 - RNA, 64 nt, Human; identical to SEQ ID NO: 284962

SEQ ID NO: 305540 - RNA, 64 nt, Human; identical to SEQ ID NO: 284966

SEQ ID NO: 305541 - RNA, 64 nt, Human; identical to SEQ ID NO: 284967

SEQ ID NO: 305542 - RNA, 64 nt, Human; identical to SEQ ID NO: 284968

SEQ ID NO: 305543 - RNA, 64 nt, Human; identical to SEQ ID NO: 284969

SEQ ID NO: 305544 - RNA, 64 nt, Human; identical to SEQ ID NO: 284970

SEQ ID NO: 305545 - RNA, 64 nt, Human; identical to SEQ ID NO: 284971

SEQ ID NO: 305546 - RNA, 64 nt, Human; identical to SEQ ID NO: 284972

SEQ ID NO: 305547 - RNA, 64 nt, Human; identical to SEQ ID NO: 284973

SEQ ID NO: 305548 - RNA, 64 nt, Human; identical to SEQ ID NO: 284974

SEQ ID NO: 305549 - RNA, 64 nt, Human; identical to SEQ ID NO: 284975

SEQ ID NO: 305550 - RNA, 64 nt, Human; identical to SEQ ID NO: 284976

SEQ ID NO: 305551 - RNA, 64 nt, Human
cuccccgccuccucccacugggacucccagcagagcccaccagccagcccuggcccacccccca

SEQ ID NO: 305552 - RNA, 64 nt, Human
ggaaagugggagguggugcuggugcucucuccaggcccaccaugcugggagaggcggccagagc

SEQ ID NO: 305553 - RNA, 64 nt, Human
ggggaggaccugcccagguaugccuuccagugaugcccaccagagaauacauucucuauuaguu

SEQ ID NO: 305554 - RNA, 64 nt, Human; identical to SEQ ID NO: 284977

SEQ ID NO: 305555 - RNA, 64 nt, Human; identical to SEQ ID NO: 284978

SEQ ID NO: 305556 - RNA, 64 nt, Human; identical to SEQ ID NO: 284979

SEQ ID NO: 305557 - RNA, 64 nt, Human; identical to SEQ ID NO: 284980

SEQ ID NO: 305558 - RNA, 64 nt, Human; identical to SEQ ID NO: 284981

SEQ ID NO: 305559 - RNA, 64 nt, Human; identical to SEQ ID NO: 284982

SEQ ID NO: 305560 - RNA, 64 nt, Human; identical to SEQ ID NO: 284983

SEQ ID NO: 305561 - RNA, 64 nt, Human; identical to SEQ ID NO: 284984

SEQ ID NO: 305562 - RNA, 64 nt, Human; identical to SEQ ID NO: 284985

SEQ ID NO: 305563 - RNA, 64 nt, Human; identical to SEQ ID NO: 284986

SEQ ID NO: 305564 - RNA, 64 nt, Human; identical to SEQ ID NO: 284987

SEQ ID NO: 305565 - RNA, 64 nt, Human; identical to SEQ ID NO: 284988

SEQ ID NO: 305566 - RNA, 64 nt, Human
agagaagugagaguauuuauuuuuggcauguuuggcccaccacacagacucuguguguguaugu

SEQ ID NO: 305567 - RNA, 64 nt, Human
ucacguguaagaugagaauggcugauggcugagagcccaccaaccuuccccaccccguaucagu

SEQ ID NO: 305568 - RNA, 64 nt, Human
guuacugccuucucccuugaaauccuugcugcgugcccaccaggauuuccugugagggcccagg

SEQ ID NO: 305569 - RNA, 64 nt, Human
ugccucagccucuggaguagcugagacuacaggcgcccaccaccaugcccggcuaauuuuguuu

SEQ ID NO: 305570 - RNA, 64 nt, Human
cuugcccugugguuugacucuccuuagaaccaccgcccaccagaaacauaaaggauuaaaauca

SEQ ID NO: 305571 - RNA, 64 nt, Human
ccccuccccucucacacugaccuccccccuuacggcccaccaggguauguaaauaucucuuuuc

SEQ ID NO: 305572 - RNA, 64 nt, Human
acagagcugcugccuucccggccucacgcacccugcccaccagccccucggaagcaugugacaa

SEQ ID NO: 305573 - RNA, 64 nt, Human
caaguuguucuugaacaccugaggccuuccuggugcccaccaggcacuacggcuuccucuccag

SEQ ID NO: 305574 - RNA, 64 nt, Human
cugaccccacuggaccaaaaggggcagcacuggugcccaccauacacacaggugucucauguga

SEQ ID NO: 305575 - RNA, 64 nt, Human
ccggcugccucugagauagcccuggguacccugagcccaccagggacaccucgcccuucagccc

SEQ ID NO: 305576 - RNA, 64 nt, Human
uacccugagcccaccagggacaccucgcccuucagcccaccacccuggcaggcuuccauccccg

SEQ ID NO: 305577 - RNA, 64 nt, Human
uccccgugggaagccuccgcccugagguccgcuggcccaccaccccugggugcucaguuucuac

SEQ ID NO: 305578 - RNA, 64 nt, Human
ccuugaugagcaugccagcuaugugguagggccagcccaccaugggggccaagaccugcacagg

SEQ ID NO: 305579 - RNA, 64 nt, Human
aauuauggcuguaaauaacacuauaguuuaauaagcccaccauucugaguuuauuaaacauuuu

SEQ ID NO: 305580 - RNA, 64 nt, Human
guauauuacccuggggcagugaagcccuaggugugcccaccaguaugaguugccauuaagaccu

SEQ ID NO: 305581 - RNA, 64 nt, Human
agcccagggccucaaugagccugguccaugaagugcccaccacaucgcagcacuuuuaccacgu

SEQ ID NO: 305582 - RNA, 64 nt, Human
ccacccccacuggcuuuggugcuguccacacagugcccaccagaaggcagagggaacuccaggg

SEQ ID NO: 305583 - RNA, 64 nt, Human
cucuggaguuucuuaugugcccugguggacacuugcccaccauccugugaguaaaagugaaaua

SEQ ID NO: 305584 - RNA, 64 nt, Human
gaggccuucaaguccuuuccaccucucacccauugcccaccauuaauaagcuuagcuucucuug

SEQ ID NO: 305585 - RNA, 64 nt, Human
aagaccuggcacuccuccaagcuuggcacagugagcccaccagcucagaugguugaucuuacca

SEQ ID NO: 305586 - RNA, 64 nt, Human
uagcaaagagaccagcugacugucucucggcccagcccaccacgccgaguagcuuguguggaug

SEQ ID NO: 305587 - RNA, 64 nt, Human
aagccagcacaggguuaaaguaacuccuggcauugcccaccagggggcuggugcaccugcugac

SEQ ID NO: 305588 - RNA, 64 nt, Human
aggucuaggccgugugguacccagaagugucccagcccaccacaccguuuaccucccucgcccu

SEQ ID NO: 305589 - RNA, 64 nt, Human
guuucccuuacagggcccccucccccgggaaugcgcccaccaaggcccuagacucaucuuggcc

SEQ ID NO: 305590 - RNA, 64 nt, Human
agucccaggaaacagugcuuuccgaugagacucagcccaccauuucuccucaccugggccuucu

SEQ ID NO: 305591 - RNA, 64 nt, Human
cagacagcccagagccugccgcuacccucggccugcccaccaccaagcaagcagcaagcaagau

SEQ ID NO: 305592 - RNA, 64 nt, Human
ugccucagccucccaaguagcugggauuacaggugcccaccaucaugcccagcuaauuuuuugu

SEQ ID NO: 305593 - RNA, 64 nt, Human
gguccacgccugugccuguccuggccuccacugugcccaccacugcccucccccuugccagugu

SEQ ID NO: 305594 - RNA, 53 nt, Human
uggagcacugcuggaagugaguggcccaccagagccucccucagccacgccuc

SEQ ID NO: 305595 - RNA, 64 nt, Human
aacaggugccaucuuggccaccucggccagggcagcccaccaugcuaaaaggaccccaaauggu

SEQ ID NO: 305596 - RNA, 64 nt, Human
auuauuuuuaggauguguauuucauuuauuuauggcccaccagucucccccaaauuaguacaga

SEQ ID NO: 305597 - RNA, 64 nt, Human
ugccgcagccuccagaguagcugggauaacaggugcccaccaccacaccccacuaauuuuugua

SEQ ID NO: 305598 - RNA, 64 nt, Human
cuguaugugccacauggaaaaacaggacaccagagcccaccagacagugccggccagcagagaa

SEQ ID NO: 305599 - RNA, 64 nt, Human
ugaauuuagggguuacgauuauagcaauuuaagggcccaccagaagcaggccucgaggagucaa

SEQ ID NO: 305600 - RNA, 64 nt, Human
guccccuguugauuauaugugcggccuuccagcugcccaccaucacagcuacagcucgcucccc

SEQ ID NO: 305601 - RNA, 64 nt, Human
ucugaagggggcguggccacaccuccuagaccacgcccaccacuuagaccacgcccaccuccug

SEQ ID NO: 305602 - RNA, 64 nt, Human
gggcaggaguguuuauggcagagugaaguucugugcccaccacaagaggcugugagauguucug

SEQ ID NO: 305603 - RNA, 64 nt, Human
cucccagucucccugccccccaugccccagaccggcccaccagggacuagccgcugucgcacag

SEQ ID NO: 305604 - RNA, 64 nt, Human
ggcagccucugggggguggccaggccgggaaaaagcccaccauuuggcaucccugggccuuggg

SEQ ID NO: 305605 - RNA, 64 nt, Human
gccgggaugccugcaucccacccccggccccagggcccaccacauaaaaucugggagcccagag

SEQ ID NO: 305606 - RNA, 57 nt, Human
gacggcggcugccagagugagugcccggcccaccagggacugcagcugcaccagcag

SEQ ID NO: 305607 - RNA, 64 nt, Human
aguuuaucucuuaucuaccuaugaccugcgagcugcccaccacccccaguuguugcgccuuucc

SEQ ID NO: 305608 - RNA, 64 nt, Human
ugcccccacuccagggcagccaugaugugcuugggcccaccagggccuuccgggcugcucucuu

SEQ ID NO: 305609 - RNA, 64 nt, Human
cauccuggccccaccagggccuugggcaaguccugcccaccauaggccucugcuaccugccagu

SEQ ID NO: 305610 - RNA, 59 nt, Human
cagccgagaacaacagcuagcaccaagaagcccaccacuagggggagacaugcuguagg

SEQ ID NO: 305611 - RNA, 64 nt, Human
cagauuaguuagaauucacugccagguuucuucugcccaccaaaaugauccagucuggaauaac

SEQ ID NO: 305612 - RNA, 64 nt, Human
gucucgagcuggacagugaggcaaggccaggagugcccaccagcuugccccgcuccuccaccau

SEQ ID NO: 305613 - RNA, 64 nt, Human
ucccccaaagucccuucugucuggccuauccugugcccaccaccuguggcuucauccagcccuc

SEQ ID NO: 305614 - RNA, 64 nt, Human
acuauaaggcugagggcugccagcagccccgucugcccaccauucccggccguggaccauaguc

SEQ ID NO: 305615 - RNA, 64 nt, Human
gagccaaucucagcccuccacgccaaggagccuugcccaccagccaaucaauguucgucucugc

SEQ ID NO: 305616 - RNA, 64 nt, Human
ggauguggcuaugucuuuuaggaagccacucuuagcccaccagagucugcccuuuggcccaaaa

SEQ ID NO: 305617 - RNA, 64 nt, Human
caggugagcaaccaguuggcuaggggagcagggggcccaccagagcuguggagaggggacccua

SEQ ID NO: 305618 - RNA, 64 nt, Human
cagcacacauauuuucuugucaacuuuuccccaagcccaccaacuuggauucagauugcgacau

SEQ ID NO: 305619 - RNA, 64 nt, Human
ggcugaugcugauuuggccagagaugaccucaaggcccaccaaauagagcacaacuucccauug

SEQ ID NO: 305620 - RNA, 64 nt, Human
gggcgucaucugguccugguaagaggagugcguggcccaccaggccccccugucacccaugaca

SEQ ID NO: 305621 - RNA, 64 nt, Human; identical to SEQ ID NO: 64678

SEQ ID NO: 305622 - RNA, 53 nt, Human; identical to SEQ ID NO: 64684

SEQ ID NO: 305623 - RNA, 64 nt, Human; identical to SEQ ID NO: 64688

SEQ ID NO: 305624 - RNA, 64 nt, Human
gcuuccccuucauguggcaccuuugugccaggccaccaggcagacucuucccaccuucucccac

SEQ ID NO: 305625 - RNA, 64 nt, Human
caucaugaccaccucugaugucugugcugcugucaccaggcaccuuuguuuuucaagacaacau

SEQ ID NO: 305626 - RNA, 64 nt, Human
ccaucaggagaugaauauggaacaucuccuauguaccaggcacugugcuaagugcuggaauaca

SEQ ID NO: 305627 - RNA, 64 nt, Human
gucucaaaggcacuuuguuucucccaaguaggccaccaggcagccucuagaguugcuuuaccca

SEQ ID NO: 305628 - RNA, 64 nt, Human
ugagcgcaggaggacaggcaccaccggaugccacaccaggcaggaggagguguggacagugaug

SEQ ID NO: 305629 - RNA, 64 nt, Human
cccucugggucauauggugcagacugugaccagcaccaggcaggcaguccugucugcgugugga

SEQ ID NO: 305630 - RNA, 64 nt, Human
caaagguuggagucugcuggugcgguguuuacacaccaggcagggcugucugccaccuugugug

SEQ ID NO: 305631 - RNA, 64 nt, Human
aaauagccaaagcaucuuugacagaagguucugcaccaggcaaaaagaucugaaacauuaguuu

SEQ ID NO: 305632 - RNA, 64 nt, Human
cuagaccaucuaaguagccauuuucgaacaauucaccaggcauguaaacucaucugcagaaaau

SEQ ID NO: 305633 - RNA, 64 nt, Human
uuguucuugaacaccugaggccuuccuggugcccaccaggcacuacggcuuccucuccagaaug

SEQ ID NO: 305634 - RNA, 64 nt, Human
agagucucuuuagggauuuucccuaagguguaccaccaggcacaccucagucuucuugacccag

SEQ ID NO: 305635 - RNA, 64 nt, Human
aaggagacauacuacugaccccauuggaagaagaaccaggcauggaaagauggggagcucugga

SEQ ID NO: 305636 - RNA, 64 nt, Human
aauuauuacugaguuaaauugaaaaguccaguggaccaggcauuucuuauauaaauaaaauugg

SEQ ID NO: 305637 - RNA, 64 nt, Human
uuuuacagucgcacagcaagcagucucacagaaggcaggcuaguccauucacagccugacacgu

SEQ ID NO: 305638 - RNA, 64 nt, Human
cagccuugauucuucccuggagccuacagagcaggcaggcuaggccaagccaggcucaacuucu

SEQ ID NO: 305639 - RNA, 64 nt, Human; identical to SEQ ID NO: 64694

SEQ ID NO: 305640 - RNA, 64 nt, Human
gaagagccccaugggcccagccccugcccugggaaccaggcagccuuccagaccucaggggcug

SEQ ID NO: 305641 - RNA, 64 nt, Human
aacccacgcaaggauuuucuuuaaauugagaggcaccaggcaguaacuuccaugaugacacuga

SEQ ID NO: 305642 - RNA, 64 nt, Human
uccugcgcuugaucaacugaaccaguaugccaaaaccaggcauccaauuuguaaaccaauuaug

SEQ ID NO: 305643 - RNA, 64 nt, Human
ugucuuuggguuuagaagaccaaguauggggaaaaccaggcaccagccucugcagcaauggguc

SEQ ID NO: 305644 - RNA, 64 nt, Human
gggcagcauggaacaugcagcugggcuuccugugaccaggcacccucuggcacuguugcuugcc

SEQ ID NO: 305645 - RNA, 64 nt, Human
ugaggcugaggauggccugaaccuggagcagcggaccaggcagacgggcugaagugggguccca

SEQ ID NO: 305646 - RNA, 64 nt, Human
ugguuuuuggguccucauguuauuuauugccgaaaccaggcaggcaaccccaagggcaccaacc

SEQ ID NO: 305647 - RNA, 64 nt, Human
ccguccugccccacgaaggauccaaggccaguuaaccaggcaagacacaagccuuggcuggaaa

SEQ ID NO: 305648 - RNA, 64 nt, Human
ccuaccucaaaccccagcugggcccgcuuagcccaccaggcaugaggccaagggcuccacugac

SEQ ID NO: 305649 - RNA, 64 nt, Human
ugaugcuuaaaaaacacuuguuaguuuucccuguaccaggcaaugguuauaauuaaaaugauau

SEQ ID NO: 305650 - RNA, 64 nt, Human
uaggcccugcuuuaucaggggacaaaccagggguaccaggcacauggcugggggagggacugcu

SEQ ID NO: 305651 - RNA, 64 nt, Human
ugagggcaauacaggcauuuaaaaaauuaaaaugaccaggcacaguggcucacgccuguaaucu

SEQ ID NO: 305652 - RNA, 64 nt, Human
cuagccagccccucuuccccaaugcuccaucccaaccaggcaccucuuccuugauguuuggggu

SEQ ID NO: 305653 - RNA, 64 nt, Human
cagcaaauguucauggaucaccggcuaccaagguaccaggcaccaugcuagguauuggggaaga

SEQ ID NO: 305654 - RNA, 64 nt, Human
guuugcaaauuaaaaagggccagaaaaauuuggcaccaggcaaacgaauaaagauaggauuggg

SEQ ID NO: 305655 - RNA, 64 nt, Human
cccucacagggaggggagcaggggagggaaagaaaccaggcaucuggucaaaccagcagaucaa

SEQ ID NO: 305656 - RNA, 64 nt, Human; identical to SEQ ID NO: 64700

SEQ ID NO: 305657 - RNA, 64 nt, Human; identical to SEQ ID NO: 64706

SEQ ID NO: 305658 - RNA, 64 nt, Human; identical to SEQ ID NO: 64713

SEQ ID NO: 305659 - RNA, 64 nt, Human
gaagugccacuugcuccuuagagucuguuugucaaccaggcagagucccuuucuuuucugcucc

SEQ ID NO: 305660 - RNA, 64 nt, Human
aucacccauccuccuuucagcccccuuuauggggaccaggcagcucuggagccagccacagggg

SEQ ID NO: 305661 - RNA, 64 nt, Human
ccugggcucaagcaauguauugaauuuuaaaauaaccaggcacucacucuuaugaauuaauaaa

SEQ ID NO: 305662 - RNA, 64 nt, Human
ucauggcuaaauauuuauggagggccuacuguggaccaggcacugggcuaaauacuuacauuua

SEQ ID NO: 305663 - RNA, 64 nt, Human
uguguccuuugaggggcugauggcaauaucuaaaaccaggcaccagcaugaacaccaagcuggg

SEQ ID NO: 305664 - RNA, 64 nt, Human
agccaccagguacgacgaccagguaccagaaaccaccaggcacacggggcagaaagccagcguc

SEQ ID NO: 305665 - RNA, 64 nt, Human
uucugagauggggaugaagguaagaugccgcaucaccaggcacgccgccccugacagcugccuu

SEQ ID NO: 305666 - RNA, 64 nt, Human
uacucaacaaauauuuaucgagcaccuuuuauguaccaggcacuguuguaggugcuuaggauau

SEQ ID NO: 305667 - RNA, 64 nt, Human
gucugggcucagccagguggaaggaaccugccuaaccaggcaccuguguuaagagcaugauggu

SEQ ID NO: 305668 - RNA, 64 nt, Human
ccaaagcaguguaguggugauuggucagugacuaaccaggcagcuaagaagucuuaggcagcag

SEQ ID NO: 305669 - RNA, 64 nt, Human
ucugcagaugacagggaggugcugugagaagugcaccaggcagcuuucucucugugguagacua

SEQ ID NO: 305670 - RNA, 64 nt, Human
gcucacggggagcucagagguccaugccgaggagaccaggcaggaccucccgaggcugcgcccc

SEQ ID NO: 305671 - RNA, 64 nt, Human
acgugacaggaagaggagggagagggugacgaacaccaggcauuuccaggggcuauauuucacu

SEQ ID NO: 305672 - RNA, 64 nt, Human
cagguuugauugugaaguccgcaugaaacacugcaccaggcagggcuuugcaaagugcaaggua

SEQ ID NO: 305673 - RNA, 64 nt, Human
uauuaagggauuuaguaacaucauuuuguuuuccaccaggcagggaguagggcuuaguguuuua

SEQ ID NO: 305674 - RNA, 64 nt, Human
ccacagcaucaauucccuugauccagcccaagagaccaggcagccauggccacugccuuccucu

SEQ ID NO: 305675 - RNA, 64 nt, Human; identical to SEQ ID NO: 64718

SEQ ID NO: 305676 - RNA, 64 nt, Human; identical to SEQ ID NO: 64725

SEQ ID NO: 305677 - RNA, 64 nt, Human; identical to SEQ ID NO: 64730

SEQ ID NO: 305678 - RNA, 64 nt, Human
cugugguucuuugcaguuucuuguaaauuuauaaaccaggcacaagguucaaguuuagauuuua

SEQ ID NO: 305679 - RNA, 64 nt, Human
aggccauccagccaccaccuacagcccaguggguaccaggcaggcucccuuccuggggaaaaga

SEQ ID NO: 305680 - RNA, 64 nt, Human
acaggaaagccacugacccagcccgggaggcagaaccaggcagccucccuggccccaggcagcc

SEQ ID NO: 305681 - RNA, 64 nt, Human
cauaucugccauauuaaccccuuuguguauaaugaccaggcaguguuaaacugaguuuuuaauu

SEQ ID NO: 305682 - RNA, 64 nt, Human
caguuacuuuugagaguuuucuggucaagcuuuuaccaggcauucucuagccuugguacaaaaa

SEQ ID NO: 305683 - RNA, 64 nt, Human
agaaacuuuucugaaugccuaccuggcgguguauaccaggcagugugccaguuuaaaaagauga

SEQ ID NO: 305684 - RNA, 64 nt, Human
agccgggauacuuucagaugcucgccuguaccucaccaggcagaguaaauaucuacucacucau

SEQ ID NO: 305685 - RNA, 64 nt, Human
auauuuaugggaaccccuucauccucugagugugaccaggcauccuccacaauagcagacagug

SEQ ID NO: 305686 - RNA, 64 nt, Human
auguagacauugccccacuguaagcuguggccucaccaggcaagcugaggccaggagggacccu

SEQ ID NO: 305687 - RNA, 64 nt, Human
gacaagcaggugggcaggaaggacaugcaccgagaccaggcaggggcccaacuuucacguccag

SEQ ID NO: 305688 - RNA, 64 nt, Human
gcguccuccucuaccuuggaagcaguuagaaucuaccaggcacagaugaggccgcccuugccug

SEQ ID NO: 305689 - RNA, 64 nt, Human
aauguaaugugauggaauuuaaaaguuuuaugagaccaggcacaguggcucacgacuguaauuc

SEQ ID NO: 305690 - RNA, 64 nt, Human
aguccaauggcugcuuagagucagccuggguggcaccaggcaaugcaggugaaguggcugccuu

SEQ ID NO: 305691 - RNA, 64 nt, Human
agucugugaugaagaguagugaauacaacacacaaccaggcagccuucuugacuauacuuugca

SEQ ID NO: 305692 - RNA, 64 nt, Human
gaucagagcagcagugaaaacaagugcuggcaccaccaggcaccucacagaaaugagaucaggc

SEQ ID NO: 305693 - RNA, 64 nt, Human
ugugauucacagugugaaucuuggugucuacguuaccaggcaggaaggcugagaggagagagac

SEQ ID NO: 305694 - RNA, 64 nt, Human; identical to SEQ ID NO: 64737

SEQ ID NO: 305695 - RNA, 52 nt, Human; identical to SEQ ID NO: 64743

SEQ ID NO: 305696 - RNA, 64 nt, Human; identical to SEQ ID NO: 64747

SEQ ID NO: 305697 - RNA, 64 nt, Human
aucugaugcaagcaagaaacacugggcuucuagaaccaggcaacuugggaacuagacucccaag

SEQ ID NO: 305698 - RNA, 64 nt, Human
cuccuccccacuagcauuuucucuaccuucaagaaccaggcagcccugccaugucacaauaggc

SEQ ID NO: 305699 - RNA, 64 nt, Human
cucaacacacauccaucucaagaggaacauuuauaccaggcagucagagcuggaaguguaugga

SEQ ID NO: 305700 - RNA, 64 nt, Human
cuguguaaauuuugugaauauguauuauauuaaaaccaggcaacuuggaaucccuaaauucugu

SEQ ID NO: 305701 - RNA, 64 nt, Human
gaguucagaaaauagaugugguauugcucugaggaccaggcaggaggaacucuacaaccugagu

SEQ ID NO: 305702 - RNA, 64 nt, Human
aggaggcccaauccuaaaaguuugggcagagggaaccaggcacguuaaagaagacagaaagcgg

SEQ ID NO: 305703 - RNA, 64 nt, Human
ugucugagguagcaagugcagccucacgacagauaccaggcaauccagagccacaaaacgugau

SEQ ID NO: 305704 - RNA, 64 nt, Human
agggacagaaaggggauaguggaguuaugggcccaccaggcaagccugggccuucuggucaacc

SEQ ID NO: 305705 - RNA, 64 nt, Human
gggaguaagaaaugggccucagccccgcggaucaaccaggcagaguucuguggcgccgcgugga

SEQ ID NO: 305706 - RNA, 64 nt, Human
auccagguaacuuugaagagaugagcagugagugaccaggcaguuuuucugccuuuagcuuuga

SEQ ID NO: 305707 - RNA, 64 nt, Human
acugcagccaccauuuauucagcaccuguuaugcaccaggcacuuuauguaucuuauugcuaac

SEQ ID NO: 305708 - RNA, 64 nt, Human
gaaaugucauauuuuugaguuuuguaauggaagaaccaggcacagaaacagacagaaaugauac

SEQ ID NO: 305709 - RNA, 64 nt, Human
aauaaaugcaccuuagcagaaggucgaugugucuaccaggcagacgaagcucucuuacaaaccc

SEQ ID NO: 305710 - RNA, 64 nt, Human
ccaugucuccugcauagcuuuucccuguccugacaccaggcaagaaaagcgcagagaaaucggu

SEQ ID NO: 305711 - RNA, 64 nt, Human
cuccauagagaagaaaucaguaucugaguugcauaccaggcaguauuaaaaucuaacaggucug

SEQ ID NO: 305712 - RNA, 64 nt, Human
cguaacaaacaaagcuauuggguguccaugauauaccaggcacuaugcuagguguugagaaugu

SEQ ID NO: 305713 - RNA, 64 nt, Human; identical to SEQ ID NO: 64751

SEQ ID NO: 305714 - RNA, 64 nt, Human
gcaaaagguagauuauguaaccaaucagguacguaccaggcagugaugugcuaauacacugauc

SEQ ID NO: 305715 - RNA, 64 nt, Human
accacuguccccuugcugauggcauggggguccgaccaggcacugacaccgcaggcagagguug

SEQ ID NO: 305716 - RNA, 64 nt, Human
ugaguagcugagccacugugcccaggcugugggcaccaggcagagugggagccuaggucaggcc

SEQ ID NO: 305717 - RNA, 64 nt, Human
acgugggccuuagccgucacccaccagcuuccucaccaggcaaggaggccccggagccuuagca

SEQ ID NO: 305718 - RNA, 64 nt, Human
uuucauuucauccuggucagucuagagucugugcaccaggcaguccauccacugaaggcugugu

SEQ ID NO: 305719 - RNA, 64 nt, Human
auucauuccucaggcacuugagugacaguuguuuaccaggcacuguguguagccccaggguuug

SEQ ID NO: 305720 - RNA, 64 nt, Human
ggggagcugacacuucuguaaaacuagaagauaaaccaggcaauguaaguguucgagguguuga

SEQ ID NO: 305721 - RNA, 64 nt, Human
ugaaaccucgucucuacuaaaaauacaaaaaucaaccaggcaugacggugcacgccuguuauca

SEQ ID NO: 305722 - RNA, 64 nt, Human
agggaaaggaagggaagagugcuccaagacuuggaccaggcacacacacaccuccagaucaccu

SEQ ID NO: 305723 - RNA, 64 nt, Human
uagaaaacuuuaaagcguuugcacagaucaacuuaccaggcaccaaaagaaguaaaagcaaaaa

SEQ ID NO: 305724 - RNA, 64 nt, Human
aaagggucuagugauggaaguuuuguagauaaguaccaggcaucucaguaacuccuagacuuuu

SEQ ID NO: 305725 - RNA, 64 nt, Human
ugaaggaaugaauugaaucuugagacggguccucaccaggcaagagucuugcuuauugggcugc

SEQ ID NO: 305726 - RNA, 64 nt, Human
ugauucuauaagcccagcauuaccugauaccaaaaccaggcaaagaaaacagaagaagaggaag

SEQ ID NO: 305727 - RNA, 64 nt, Human
cccccgcccugggcugcagccucugcacgcaagcaccaggcauccuuuguguugucaacuccgu

SEQ ID NO: 305728 - RNA, 64 nt, Human
ugaauaccucaaauaguccaguagagggcaguccaccaggcagaaaagguuaggcguuuugguu

SEQ ID NO: 305729 - RNA, 64 nt, Human
cucauuugugacaacauuucauaucaccagacacaccaggcaacagaaguugaagcacaaccac

SEQ ID NO: 305730 - RNA, 64 nt, Human
accaagggacaguagccagagcuccucuuccuuuaccaggcaaggugcauccccucagcccucc

SEQ ID NO: 305731 - RNA, 64 nt, Human
augacuuuggagaaagcaaagcagugacccagugaccaggcacauuacucgugagcgagguauu

SEQ ID NO: 305732 - RNA, 64 nt, Human
cuccuguccucagccucccaaaaugcugggagccaccaggcaccaggugugaucuaccacaccu

SEQ ID NO: 305733 - RNA, 64 nt, Human
cuaccaacaaagauguacucuuaaacucaguaucaccaggcacuauauuucaucuuugaggcuu

SEQ ID NO: 305734 - RNA, 64 nt, Human
auguagaaugugaugucagaacucaaacaggcucaccaggcagugugcuuccuuccuugcauga

SEQ ID NO: 305735 - RNA, 64 nt, Human
uuuuuggagggaaaaaaaaaauaucacuacacaaaccaggcacucucccuuucugucuuucuag

SEQ ID NO: 305736 - RNA, 64 nt, Human
gucccugaaggcuccuuugggugagaacaugugaaccaggcacccugguuuguuuggagcauug

SEQ ID NO: 305737 - RNA, 64 nt, Human
uguaaugauguguuuugaccuuugcaggcgaguaaccaggcaauggaguggagugucuccugga

SEQ ID NO: 305738 - RNA, 64 nt, Human
ucucuucucugaaacuucaggaugcuccuuggucaccaggcaaugggagcuguagaccagccgc

SEQ ID NO: 305739 - RNA, 64 nt, Human
gaccccaucucuacaaagaaagauuuaaaaauuaaccaggcaugguggcucgcaccuguauucc

SEQ ID NO: 305740 - RNA, 64 nt, Human
cuccugcuggccgcugccuccuuagaaagcugugaccaggcagcuaagagccucugggcugcag

SEQ ID NO: 305741 - RNA, 64 nt, Human
ucuauauaguucagcaauggccugaauagaagcaaccaggcaccaucucagcaauguuuucucu

SEQ ID NO: 305742 - RNA, 64 nt, Human
gcaauuuuggguagguauucacaugcacuaaaaaaccaggcaaacaucugacucccaggauaaa

SEQ ID NO: 305743 - RNA, 64 nt, Human
caucuugaacauuaauccacauguuucagagcucaccaggcaguaccaaugcucuuuucacagc

SEQ ID NO: 305744 - RNA, 64 nt, Human
guuuuacuaagcagauggucgggcacugcagggcaccaggcaggauccuagggcgccucuuauu

SEQ ID NO: 305745 - RNA, 64 nt, Human
uauuccauggacauuuaguuagugcuuuuuauauaccaggcaugaugcugagugacacucuugu

SEQ ID NO: 305746 - RNA, 64 nt, Human
uggaugcccaggggaaggcauacaggccucauccaccaggcaauagacaggagagaggugagaa

SEQ ID NO: 305747 - RNA, 62 nt, Human
acccgcgccugugccacccccuggcccggccgcggcgcgacgccgaacccguguugggcggc

SEQ ID NO: 305748 - RNA, 64 nt, Human
gauaaauuuauaaauauauaaaauuauguaaaaacuacacuauauuuugauuuagauuuuccug

SEQ ID NO: 305749 - RNA, 64 nt, Human
ucuuagauuaauauggccaacccuguacacaucacuacacuaaacacugcucuagauaaacugc

SEQ ID NO: 305750 - RNA, 64 nt, Human
cacuacuaaaugcuaaauaagccuauuuuuuacacuacacuaucaaaauaauuuuugccuucga

SEQ ID NO: 305751 - RNA, 64 nt, Human
aaaagugucuuaaugucuaaggagggcauauuagcuacacuacaaaaacaaauuuugucuguac

SEQ ID NO: 305752 - RNA, 64 nt, Human
cauugccagugagauauauucaguauuguagauacuacacuaauuuccaacauaagaggcagga

SEQ ID NO: 305753 - RNA, 64 nt, Human
acuaauuauaaggaugaucagagacuuuugccagcuacacuaaaagaaaauggccuucuugacu

SEQ ID NO: 305754 - RNA, 64 nt, Human
cacucuaguguagcugaagagaaugcauauuuggcuacacuauuucuguuuacuguauuuugcu

SEQ ID NO: 305755 - RNA, 64 nt, Human
gcaguauccaauaggcauuugauuuugcccacuccuacacuaagcgaauguguacaaaguguaa

SEQ ID NO: 305756 - RNA, 64 nt, Human
agucaaguuucacuggcucuauaacagucuaccucuacacuaagagaacuauaacaugaacaac

SEQ ID NO: 305757 - RNA, 64 nt, Human
aaugguguguuaaaauuaggguuucuuugccucucuacacuacacuaaucugccuaaagguggu

SEQ ID NO: 305758 - RNA, 64 nt, Human
uguagcacuuuuuauuccauuugcuuucaaaugacuacacuaagccuaauaauacaagcuccag

SEQ ID NO: 305759 - RNA, 64 nt, Human
ccucuauugguacaacauauaaaugaaaguacaccuacacuaauagucugucucaacaaugagu

SEQ ID NO: 305760 - RNA, 64 nt, Human
uuaaaaugcugugucuacaccaucaagacugugucuacacuaucuuggcugaacgagaagagau

SEQ ID NO: 305761 - RNA, 64 nt, Human
aaggaaggaaggaaaaacuuguuacugaaagagacuacacuaucagguuucauuacauauucuc

SEQ ID NO: 305762 - RNA, 64 nt, Human
uccuagcuccccgcccuaaaaggaggcagugaggaccaggcacuauuuccuccgagguuacuuc

SEQ ID NO: 305763 - RNA, 64 nt, Human
augaaggcgaguaugugacacuggagaaaaguggaccaggcaugucuuuugcuuugaucuggag

SEQ ID NO: 305764 - RNA, 64 nt, Human
gcacaaguuuuuaccuagccaguuguuucugaggaccaggcaacuuuugaacuccugucucugu

SEQ ID NO: 305765 - RNA, 64 nt, Human
ugggugaaucauuagguauaaaaaauaaucaucaaccaggcaaauuacuuugcuuccuagcuga

SEQ ID NO: 305766 - RNA, 64 nt, Human
uguaauaagcuggcuacacagaaccccacuacuuaccaggcauggauugaagaagauugucuac

SEQ ID NO: 305767 - RNA, 64 nt, Human
ccuccuuuacucuagauucauucagcuuuuccagaccaggcaucaccgagcggagagaggggaa

SEQ ID NO: 305768 - RNA, 64 nt, Human
ccugcuggagauugggucccucggucucccuugcaccaggcacccuugggcuccaggggagggu

SEQ ID NO: 305769 - RNA, 64 nt, Human
auauucaucccuucaguucuggagaaagccugauaccaggcacagccuacugaccccaaggagc

SEQ ID NO: 305770 - RNA, 64 nt, Human
gauaggaaccuucuuggagaccccuuugaagaaaaccaggcagccaagggagccaaacacacua

SEQ ID NO: 305771 - RNA, 64 nt, Human
ccuuuguccucaauccagucaacaccuacuauguaccaggcaccaggaagccagaagcucaggg

SEQ ID NO: 305772 - RNA, 64 nt, Human
aggaagugggcgugaguggacgugucaggugguuaccaggcacugguuguugauggucgguggu

SEQ ID NO: 305773 - RNA, 64 nt, Human
gggugacauuucccaggacagcauggugaacauuaccaggcaugcuagcuggcccguguaaucc

SEQ ID NO: 305774 - RNA, 64 nt, Human
uucagaaacauaccugaccaaaaaauucccaguaaccaggcaugaucaauuuauaguggucguu

SEQ ID NO: 305775 - RNA, 64 nt, Human
ccagcuggagaagaaugaaaagaacucccaagaaaccaggcaggcagaagcuccugaaugcugg

SEQ ID NO: 305776 - RNA, 64 nt, Human
gaggacgugcaucaucacugcaaucagcaugaacaccaggcaccccugggacaccuaacgccca

SEQ ID NO: 305777 - RNA, 64 nt, Human
uugaaugggguagggggguuuaccugguuuuaugaccaggcauaguaucuauuauauuugcuuu

SEQ ID NO: 305778 - RNA, 64 nt, Human
ccucuacuacuuuuacuacagugacaaauuguaacuacacuaauaaaugccaacuggucacugu

SEQ ID NO: 305779 - RNA, 64 nt, Human
cuuccccagcugcaaagacaauguugcucuccgccuacacuagugaauuaaucugaaaggcacu

SEQ ID NO: 305780 - RNA, 64 nt, Human
uagugaaaaggauuggaagacaauuuaucugaugcuacacuauucuuccuguugugauuguuuu

SEQ ID NO: 305781 - RNA, 64 nt, Human
ccucccagauguuggaccaacaccccucccugccaccaggcacugccuggagggcagggagugg

SEQ ID NO: 305782 - RNA, 63 nt, Human
aggcggcugucugcgaccacagcagccucgaaacaccaggcagcagccuugcugggaguccac

SEQ ID NO: 305783 - RNA, 64 nt, Human
agggcaugucuuaacgaagaucagcaaagaaaacaccaggcacccucugccacuuagacauaau

SEQ ID NO: 305784 - RNA, 64 nt, Human
uaacuugaaauucaucaugggagucugcugcuauaccaggcacaagauaaaacuccaaaauuuc

SEQ ID NO: 305785 - RNA, 64 nt, Human
caccuauaauucugucuugcugguguggauagaaaccaggcaggacaguagaucccuaugguug

SEQ ID NO: 305786 - RNA, 64 nt, Human
cccagccacgaguaugccacagggggcuuucaaaaccaggcagggccaagccuuggccccacug

SEQ ID NO: 305787 - RNA, 64 nt, Human
acgugaaguaauguuugaacuggaagaugagcucaccaggcaaagcuaaggaaggauauacuag

SEQ ID NO: 305788 - RNA, 64 nt, Human
ggaauuuggucccuggauggcuagggauccaugaaccaggcagguaccuuuuuuguuuuuguuu

SEQ ID NO: 305789 - RNA, 64 nt, Human
uggggacggaugaggaaggagcucuuugcagugcaccaggcacguugagaguggaggcacaaug

SEQ ID NO: 305790 - RNA, 64 nt, Human
ucacagugggcggcuucccugcgacggaggcaggaccaggcauuuagcuaguuagagacucgcc

SEQ ID NO: 305791 - RNA, 64 nt, Human
uugucagcugccucacugcauacucuuuaauaguaccaggcaaagauuuucuucaacuauagua

SEQ ID NO: 305792 - RNA, 64 nt, Human
uggcucucguuuuuggggucauggggaggguagcaccaggcauagccacuuuugcccugaggga

SEQ ID NO: 305793 - RNA, 64 nt, Human
ccacugaaagauguaggcaggggcaggucucucaaccaggcauauuuuuaaaaguugcuucugu

SEQ ID NO: 305794 - RNA, 64 nt, Human
auggcacuuuugauaugagacaauguagcagaauaccaggcagacagaaccuugcaaacaccuu

SEQ ID NO: 305795 - RNA, 64 nt, Human
cucauuaguaucauaaacgucaaggauugauuggaccaggcaagagccauguuuuugagaaggu

SEQ ID NO: 305796 - RNA, 64 nt, Human
gugcuauuuaggggaacaaggggauucaggagaaaccaggcagcaggggaugaaauacaugaau

SEQ ID NO: 305797 - RNA, 64 nt, Human
aauaauuuaaguggcaucuucucucccaccgggucuacacuagaggaucgaggcuugugaugcc

SEQ ID NO: 305798 - RNA, 64 nt, Human
aacuggauccugaaaaauucaagaugcuaagcaccuacacuacuuuaagaauuuggaacugaaa

SEQ ID NO: 305799 - RNA, 64 nt, Human
cccucuucucaaggaaaugggugucaucaauuuucuacacuauuaaagauauaaaguucuuggc

SEQ ID NO: 305800 - RNA, 64 nt, Human
guaggugguagggagugagucaaagcacuaauagaccaggcaacuuaccacuuggaguggauuu

SEQ ID NO: 305801 - RNA, 64 nt, Human
cgggcaaauggggucggggggacuggggcaccagaccaggcaccaccuggacacuuucuuguug

SEQ ID NO: 305802 - RNA, 64 nt, Human
ucaugcccaagagaucugugccauagaacaagauaccaggcacuuaaagccuuuuccugaauug

SEQ ID NO: 305803 - RNA, 64 nt, Human
gaagacaccaaaguguuucucuuccaguuugaaaaccaggcagguuuacacguggguuucagug

SEQ ID NO: 305804 - RNA, 64 nt, Human
ggcacugcucaccgcccaaggcgacgccggcuggaccaggcacugcuggccuuucuccugcccg

SEQ ID NO: 305805 - RNA, 64 nt, Human
uguggguggaagggcugggugucgaaaucaaaccaccaggcauccggcccuuaccggcaagcag

SEQ ID NO: 305806 - RNA, 64 nt, Human
cauuuugugaggccaguauuacccuaauagcaaaaccaggcaaagauauuacaagaaaggaaaa

SEQ ID NO: 305807 - RNA, 64 nt, Human
uuuauguuauaaaagaggauuuucccaccuugacaccaggcaauguaguuagcauauuuuaugu

SEQ ID NO: 305808 - RNA, 64 nt, Human
gcagcugcugaccaaaccccacagaacagagggcaccaggcaucacacgacaucuuucccuccc

SEQ ID NO: 305809 - RNA, 64 nt, Human
accuugagcaagugagaagagaggccaggguccaaccaggcacccguccuugggaccagcagua

SEQ ID NO: 305810 - RNA, 64 nt, Human
aaaaaaugaugaugaugauaaaaaccacgacccaaccaggcacaggacuuuuuuguuuuuugca

SEQ ID NO: 305811 - RNA, 64 nt, Human
uagcugcagccuuggaaggaggcaccgacacgacaccaggcaggagugagccucaggccccguc

SEQ ID NO: 305812 - RNA, 64 nt, Human
cuacuugggaggcugaggcaggagaaucgcuugaaccaggcagucggaacuuguagugagccaa

SEQ ID NO: 305813 - RNA, 64 nt, Human
uaagccucuaacagcacagggaagcaaauaucuuaccaggcagccuaugaauuaacccaaagaa

SEQ ID NO: 305814 - RNA, 64 nt, Human
cugaugggauugcacgguuuggguauucuuaaugaccaggcaaaugccuuaaguaaacaaacaa

SEQ ID NO: 305815 - RNA, 64 nt, Human
auuguuggaaggguuaauuuauuccugaauuaguaccaggcagugaauaagcccuaggcagaau

SEQ ID NO: 305816 - RNA, 64 nt, Human
gaaccuauguuauaugauacaugcauaacuugagcuacacuaaaccacaugacaguguuuaguu

SEQ ID NO: 305817 - RNA, 64 nt, Human
uucucuccccaguucugguccuggccaggccaugcuacacuaaccccugcccccacucuccucc

SEQ ID NO: 305818 - RNA, 64 nt, Human
guuuguuauaacaaccucugcauauuccaggucuggcagacagguugccugacccugcaauccu

SEQ ID NO: 305819 - RNA, 64 nt, Human
gcucccuggcuccaggggugugggggaccccagaaccaggcagagugggaacuugaaacuguug

SEQ ID NO: 305820 - RNA, 64 nt, Human
agugaccacugggacuucaggcaagaagcucaccaccaggcacacagcaaagggacugaacuga

SEQ ID NO: 305821 - RNA, 64 nt, Human
gcuuggccucucugguccccauggacuuagggggaccaggcaagaacucugacagagcuuuggg

SEQ ID NO: 305822 - RNA, 64 nt, Human
uguccucaucaucgcucauaagcugcuggucuaaaccaggcagccucucuugcuaggaggccac

SEQ ID NO: 305823 - RNA, 64 nt, Human
aagggugaaaaagcccaaaugcugcugugguucaaccaggcaagaucauccggugaaagaacca

SEQ ID NO: 305824 - RNA, 64 nt, Human
uaaaaacacgugauguaaacuugcaagcauaucaaccaggcaagucuugcuguaaaaaugaaaa

SEQ ID NO: 305825 - RNA, 64 nt, Human
gggacucggggacuuggcuuccuuccuggcaaggaccaggcaguggggaaggaggagguccucc

SEQ ID NO: 305826 - RNA, 64 nt, Human
cccaacuauaaaacuaggugcugcagccccugggaccaggcacccccagaaugaccuggccgca

SEQ ID NO: 305827 - RNA, 64 nt, Human
gaaauggugggagagagucugcugcaagggugagaccaggcagccugcugggccacacuguccu

SEQ ID NO: 305828 - RNA, 64 nt, Human
ggcaacccugucucuacaaaaaauacaaaaauuaaccaggcaugguggcaugcaccuguagucc

SEQ ID NO: 305829 - RNA, 64 nt, Human
gcucuucauauaccucccuuuaguuaaguaauagaccaggcagcuucucaucucagcauuuacc

SEQ ID NO: 305830 - RNA, 64 nt, Human
cuucuuaacuagguuuacaacugguggaccacacaccaggcacuaaucaccuggugaggauuug

SEQ ID NO: 305831 - RNA, 64 nt, Human
gaugcaggcgaggccgcggccccagaguccccgcaccaggcagagccguaccugucacccuccc

SEQ ID NO: 305832 - RNA, 64 nt, Human
cacagugcuuagggccuacugagggaaagaaguaaccaggcaacuacaaaacagugauaaguau

SEQ ID NO: 305833 - RNA, 64 nt, Human
uaagggagcccucugcacucgugugcaggcucugaccaggcagaacaggcaagaggggagggaa

SEQ ID NO: 305834 - RNA, 64 nt, Human
aaccaaccccuccccugccuccaccauauccacuaccaggcacccuuuagaacaggggucuggg

SEQ ID NO: 305835 - RNA, 64 nt, Human
gcaugcuuauuagcagcuggguugguauggaguuggcagacaggauguucaacuuaaugaagaa

SEQ ID NO: 305836 - RNA, 64 nt, Human
acaguaguaaguuauacuugugagcccacagaguggcagacagcauggcucucacagcacaggg

SEQ ID NO: 305837 - RNA, 64 nt, Human
ccuuuggggcuaucugacuaaugagagggaagugggcagacaagaggcuggccccagucccaag

SEQ ID NO: 305838 - RNA, 64 nt, Human
gcagcugcuaggcugaggcugcauggacaggaacaccaggcacccuccgugugcuucugagcug

SEQ ID NO: 305839 - RNA, 64 nt, Human
aggccugcacagcuguggccguggagcugaccugaccaggcaaggcugcugucuccaucccuga

SEQ ID NO: 305840 - RNA, 64 nt, Human
uaggacuuccgcccuaaggcugugccucacugccaccaggcacagccgccuccggaaugcacag

SEQ ID NO: 305841 - RNA, 64 nt, Human
gcccaccguggucuuugaacucacccaagcacccaccaggcaggcuacaagugaggcuaccuuu

SEQ ID NO: 305842 - RNA, 64 nt, Human
aacaggccuaauaguuaaaagcaaguugagacaaaccaggcagauucaguguguggaacaggaa

SEQ ID NO: 305843 - RNA, 64 nt, Human
agggccggguaucaauuauugcuugcuguuugcaaccaggcauaaaaucacuuucucaaaucau

SEQ ID NO: 305844 - RNA, 64 nt, Human
ucuccucucccucugcaugugucuaaaaggugguaccaggcaucccuuuccuggcuuauggcca

SEQ ID NO: 305845 - RNA, 64 nt, Human
gcugggcaaggcgcucaggcaugcaaccaugggcaccaggcaauacccauccaucacccaucuc

SEQ ID NO: 305846 - RNA, 64 nt, Human
aucuaucucacacugcaccaagcacccacugugcaccaggcacuaagucucuagccucuuucuc

SEQ ID NO: 305847 - RNA, 64 nt, Human
cgucauggcacuuuuuaacgcuucagcaacaaacaccaggcagcuguugccacuggccuccuac

SEQ ID NO: 305848 - RNA, 64 nt, Human
guagaggugagaauggggaggcaagaucucaggcaccaggcaggaggugccuuguaagcuaacu

SEQ ID NO: 305849 - RNA, 64 nt, Human
augauguuauuuuguaaacagaugacauuuucugaccaggcacaugccauccaauuuucuguca

SEQ ID NO: 305850 - RNA, 64 nt, Human
gcaggugcagggggaccuuaggcacgccccaagcaccaggcaccagggcccaaggacgcgcagg

SEQ ID NO: 305851 - RNA, 64 nt, Human
gaguuaaugcuuugugccuggugcucuguaaugaaccaggcaaugagauaguuuucucaguuug

SEQ ID NO: 305852 - RNA, 64 nt, Human
caggaagauuccaaagacguuuaccaguaauaucaccaggcaccugcagaagaggaaaaucacu

SEQ ID NO: 305853 - RNA, 64 nt, Human
guggugagguggguuuucuucccaucacuggagcaccaggcacgaacccaccugcugagagacc

SEQ ID NO: 305854 - RNA, 64 nt, Human
cuguuuaagagaacaaaauguuccaagcacuuuaggcagacaccagcuguuugcaaacaaugug

SEQ ID NO: 305855 - RNA, 64 nt, Human
caaggcuggaauauuuaugccuuaauauaucuauggcagacauuuaagaaugcgcuuuaucuag

SEQ ID NO: 305856 - RNA, 64 nt, Human
ggagaggaagagcuauauauaugugccgacauguggcagacacacaguaaauaauggcugacca

SEQ ID NO: 305857 - RNA, 64 nt, Human
ugcagcuaaguauuaauccccagugcuaaaagauaccaggcaucuaguuuagcaauggagggaa

SEQ ID NO: 305858 - RNA, 64 nt, Human
uguuccucucccagcuccaucucuuucccuagggaccaggcacucauauggcgggguggggucc

SEQ ID NO: 305859 - RNA, 64 nt, Human
acgcagccucccgccuggaagggccugugccagcaccaggcagagggcaagacggagagggcag

SEQ ID NO: 305860 - RNA, 64 nt, Human
aagcagcaaacguuguuuaagcauuuuaguuugaaccaggcauuguguuaggaauccagggaua

SEQ ID NO: 305861 - RNA, 64 nt, Human
uauaauaagaugggugccuacugugaugcauuuuaccaggcauuuuaccuucauuauuacucau

SEQ ID NO: 305862 - RNA, 64 nt, Human
uggacucagacugugcauguugggaaggggucugaccaggcaagcugugaucugaaaggagcaa

SEQ ID NO: 305863 - RNA, 64 nt, Human
acgucucuguggccacccgggugucacugccagcaccaggcacugcuuucacguaaaaugucca

SEQ ID NO: 305864 - RNA, 64 nt, Human
aacaucuggcuuggagcaaguggguguucugcacaccaggcagcugcaccucacuggaucuagu

SEQ ID NO: 305865 - RNA, 64 nt, Human
guguuuuguguagcuucagaguuagauugaaauuaccaggcacagauuuagucuugucauuuug

SEQ ID NO: 305866 - RNA, 64 nt, Human
cgaugggggcaggagcucccauccugggcagccaaccaggcaacaccaaggacucuuuguaaac

SEQ ID NO: 305867 - RNA, 64 nt, Human
gugaccuuauccuggcagaggcuauaaaagauucaccaggcacuggcaugaagaaagagucuuu

SEQ ID NO: 305868 - RNA, 64 nt, Human
uuaauaaaagcuuuuaauugagaaccuacuauugaccaggcacuguucaagacacuagaacauu

SEQ ID NO: 305869 - RNA, 64 nt, Human
cucgucccccuaggagcagacccaagcuuguggcaccaggcaucugauggugccaggaaagcca

SEQ ID NO: 305870 - RNA, 64 nt, Human
agacggcugcggacacuggcuccuuccacgucucaccaggcagacagucugccuaggacccagu

SEQ ID NO: 305871 - RNA, 64 nt, Human
uaggcaugccgccuccgggaaugagacccccuccaccaggcauuagaggugagugggagcauag

SEQ ID NO: 305872 - RNA, 64 nt, Human
ugccccagcccaccccuaagcauggucccuugucaccaggcaaccaggaaacugcuacuugugg

SEQ ID NO: 305873 - RNA, 64 nt, Human
aucaaaaaagaugacaauguaaaggcucaguuguggcagacaguuuuuugaaaguaacuuguaa

SEQ ID NO: 305874 - RNA, 64 nt, Human
cagcauacggccaaugucacaacaaucagcccugggcagacacgagcaggagggagagacagag

SEQ ID NO: 305875 - RNA, 64 nt, Human
ucucuugaugaaaaaaauuauaagucaccugagaggcagacagaucaaaccaaacaggaaacag

SEQ ID NO: 305876 - RNA, 64 nt, Human
ucacuuagguuuuguccaucagauucugugagacaccaggcaucguuuugaggauguggguuau

SEQ ID NO: 305877 - RNA, 64 nt, Human
ggcuugcccagcaaacccugcgugccauucuucuaccaggcagccgagaacagggagauaaaca

SEQ ID NO: 305878 - RNA, 64 nt, Human
ggccaucucuggaugccugauugccaagcucaggaccaggcaaugugacuuugcaucagcaaca

SEQ ID NO: 305879 - RNA, 64 nt, Human
cgugggccugggguaccaagagacuccuugagagaccaggcaaagcaagugauugggacagagg

SEQ ID NO: 305880 - RNA, 64 nt, Human
gccgggcugguucucuccgggccaccuucuccccaccaggcacugcagcagacggagcuguacu

SEQ ID NO: 305881 - RNA, 64 nt, Human
ggcuccucuaagaaucagaguaggguaacaauguaccaggcaaauuguaaguugaaauucuaga

SEQ ID NO: 305882 - RNA, 64 nt, Human
ccaugacuuuuuaaggaaauguaauacaagucaaaccaggcaauacagaggagaagggaaaggc

SEQ ID NO: 305883 - RNA, 64 nt, Human
ucuuggcgggcaucgccgacccuauuauuccauuaccaggcacuccgccacccacaugccaacu

SEQ ID NO: 305884 - RNA, 64 nt, Human
cacagguuccucuaacaucugucacugucacuucaccaggcaggccuuggaguuccaugacaaa

SEQ ID NO: 305885 - RNA, 64 nt, Human
gccucacucugcaccccaccagggucccgcucacaccaggcagccuucauaguggucucccugg

SEQ ID NO: 305886 - RNA, 64 nt, Human
ggaugggcaggggucucuucucaucaagccuuguaccaggcaaaagacaggcccugcuuggccg

SEQ ID NO: 305887 - RNA, 64 nt, Human
agagauuuuccugagaugacugaguauggagauuaccaggcagaugauaccgaaaugcuuaaag

SEQ ID NO: 305888 - RNA, 64 nt, Human
cuucuguacauuucuagaugcaaauaacuccuucaccaggcagugaguggcguaggcucuggag

SEQ ID NO: 305889 - RNA, 64 nt, Human
aucaucuggacaacagccacaagggggcgcucggaccaggcagccacuuuccuggugcucucug

SEQ ID NO: 305890 - RNA, 64 nt, Human
agcccugcuacauaccccuguuccagcauuaacuaccaggcaccaaaacaguaggcauuagugc

SEQ ID NO: 305891 - RNA, 64 nt, Human
uccuggugccccuuuccccccacuuucagggcucaccaggcacuggcagggaggguaagggcug

SEQ ID NO: 305892 - RNA, 64 nt, Human
acaggcccuccccaugagagagcuacacggcaggggcagacacugugaguauaagcuacuuucc

SEQ ID NO: 305893 - RNA, 64 nt, Human
guauaugauaguucugcugauguuuuguuuauugggcagacauaucuucauuaagaguuuuugg

SEQ ID NO: 305894 - RNA, 56 nt, Human
uauucaagaaggugcagugaggcccaggcagacaaccuugucccaaggaaucagca

SEQ ID NO: 305895 - RNA, 64 nt, Human
uuguucacuggacucugauaguuggagcucccagaccaggcagugcugggagcaaccaccuuug

SEQ ID NO: 305896 - RNA, 64 nt, Human
gugacagccccagguggccaggccuccaggaggcaccaggcaggcccuguaucaggcuaggacg

SEQ ID NO: 305897 - RNA, 64 nt, Human
ccacugauaccugagcccuuugugucugcuacaaaccaggcaggugguguguguggacucacac

SEQ ID NO: 305898 - RNA, 64 nt, Human
ccaucugcccugggguggaggcaccaucaccaucaccaggcaugucugcagagccuggacacca

SEQ ID NO: 305899 - RNA, 64 nt, Human
cagccauccagggcuacccacugcuuacucagggaccaggcagcccccauggcaguaaaagcag

SEQ ID NO: 305900 - RNA, 64 nt, Human
agaagcccuggcuggccccacuugguaccaauccaccaggcagcucagggcuccugcccagccc

SEQ ID NO: 305901 - RNA, 64 nt, Human
ccaguggaccuagccuggauggccccuccuugcaaccaggcagcugagaccagggucuuaccuc

SEQ ID NO: 305902 - RNA, 64 nt, Human
gcagcggguggcauccaggcugcccguguguugcaccaggcacugcugcacaacaagauacgcu

SEQ ID NO: 305903 - RNA, 64 nt, Human
gauacacauugccuucaucuguacauucugugauaccaggcaaauuaccaauuacacacagcua

SEQ ID NO: 305904 - RNA, 64 nt, Human
cuaccuacgagugaaacucuguccucccgcgaggaccaggcaucgcugugugaggacggcacgg

SEQ ID NO: 305905 - RNA, 64 nt, Human
ggggggagccauccccgccgcccucacaggacccaccaggcagcggagacauguggaauuagag

SEQ ID NO: 305906 - RNA, 64 nt, Human
cagccggcaggcgccccuguacgucugcucaugcaccaggcagcacagccgcaguuccucaguu

SEQ ID NO: 305907 - RNA, 64 nt, Human
uagccaccagugauccccaagcauccaguacagaaccaggcaucgagcuagcucccugcacggc

SEQ ID NO: 305908 - RNA, 64 nt, Human
cgcccuugcacuggacuacgccaaaaccacacugaccaggcacuugccuucccucucuuccccc

SEQ ID NO: 305909 - RNA, 64 nt, Human
accuaaaaagaauaggcugaggaggaagucuucuaccaggcauauucaugcgcuugaacuagua

SEQ ID NO: 305910 - RNA, 64 nt, Human
gcuagggagcuggggcuggggcuccccucccaugaccaggcaguggucaccccaugggacaggc

SEQ ID NO: 305911 - RNA, 64 nt, Human
cgcagauaaaaaagggaaaacuauagcuuugaguggcagacagcacacaucacaugcaucaacu

SEQ ID NO: 305912 - RNA, 64 nt, Human
acuaaaacgacuuauuauuuauuaauuauguuguggcagacaauaugcugaacauuagacauaa

SEQ ID NO: 305913 - RNA, 64 nt, Human
agccugggccugggcuuggcccagggaaacagacggcagacacaccugucccccagugaugccg

SEQ ID NO: 305914 - RNA, 64 nt, Human
uuuggugccaaaccccaaaucuccaaagagacauaccaggcaagacaaacccccaaacaccucc

SEQ ID NO: 305915 - RNA, 64 nt, Human
caucuggccugcacccuugacaaaggaccccaggaccaggcagaaggcgccuccguccuagcca

SEQ ID NO: 305916 - RNA, 64 nt, Human
ccacacaggaguaaguagcagugcugguauuugaaccaggcauccuggcuccagagcccauucu

SEQ ID NO: 305917 - RNA, 64 nt, Human
uugccuuuggucaguaaugcguucaggaguccacaccaggcacagauggggccuugaaacgcuu

SEQ ID NO: 305918 - RNA, 64 nt, Human
gacuagaaaucaaacaacuuggaaaucgaucacaaccaggcauuaaguucacaguaagaucauu

SEQ ID NO: 305919 - RNA, 64 nt, Human
aaucauucuaacaacccagguuauuuucaaucagaccaggcauucgauaacacacuaagggggu

SEQ ID NO: 305920 - RNA, 64 nt, Human
uguauuuuuaacaccagaaagaaccuugccgaucaccaggcauaaccuaauuuuauccauggaa

SEQ ID NO: 305921 - RNA, 64 nt, Human
gcacaggagcccugcugccagaacaggccuccauaccaggcauguguuucucucuaaacgccau

SEQ ID NO: 305922 - RNA, 64 nt, Human
uauauggagguuccacgucuuucuuuaggcagggaccaggcaggacuucagaaaaacccucaug

SEQ ID NO: 305923 - RNA, 64 nt, Human
gaaccaagggaggcacaauuagaggcagagggaaaccaggcagacggcugcucuuuuugaguug

SEQ ID NO: 305924 - RNA, 64 nt, Human
guuguuguuuuaaaauauuaugauuuggcuacagaccaggcagggaaagagacccgguaauugg

SEQ ID NO: 305925 - RNA, 64 nt, Human
agaccuccccccucgucaccagccaucccucuggaccaggcagagggcggaccgggugggcagg

SEQ ID NO: 305926 - RNA, 64 nt, Human
agcagaaaggggaccccggagccgagcgaggaggaccaggcagccgccgcugccgcgcuaagcc

SEQ ID NO: 305927 - RNA, 64 nt, Human
accccccucgaaguucagguucagcuccuggaugaccaggcaccgcuguugagcagccuggugg

SEQ ID NO: 305928 - RNA, 64 nt, Human
aguuguauuuuuccuucuuuaaaauugcaucuugaccaggcacaguggcucaugccuauaaucc

SEQ ID NO: 305929 - RNA, 64 nt, Human
ucccaucucuacacacaaaaaaauuuuuuaaugaaccaggcauuguggcaugcgccuauagucc

SEQ ID NO: 305930 - RNA, 64 nt, Human
aguggggccgguggagauccuuggccccaggaugggcagacagagcaccauccugggucagaag

SEQ ID NO: 305931 - RNA, 64 nt, Human
ucacgccuguaauccuaacacuuugggaggccgaggcagacagaucaccugaggucaggaguuu

SEQ ID NO: 305932 - RNA, 64 nt, Human
cccaaaaggugacuuaauuaauaaagggcauuugggcagacacacuguguuggaccaacaaagu

SEQ ID NO: 305933 - RNA, 64 nt, Human
cuuuguagcuggccagagggacgccgcagcugggaccaggcacgcggcccauggggcugggccc

SEQ ID NO: 305934 - RNA, 64 nt, Human
ccacccagaguggcccaagacucccagaucagcuaccaggcaggauauuccaagggcuuagaga

SEQ ID NO: 305935 - RNA, 64 nt, Human
accauagcucacacucacugagcaccuacuggguaccaggcaccauucucaguguuucaccugg

SEQ ID NO: 305936 - RNA, 64 nt, Human
gccagcauccccuugguaaagacccccgcaggccaccaggcauucuggacacgcacacacacac

SEQ ID NO: 305937 - RNA, 64 nt, Human
gucaucauucaccauuuauccaggauggccgcucaccaggcaauuugcuaggcucgggggcggg

SEQ ID NO: 305938 - RNA, 64 nt, Human
uucuuuucguauugcuuagaauaugacaugcugaaccaggcaugguggcucaugcuuguaaacc

SEQ ID NO: 305939 - RNA, 64 nt, Human
cacaaacaggcaugccccuuagaagacaugccuaaccaggcacuguaacguaccaacguaccaa

SEQ ID NO: 305940 - RNA, 64 nt, Human
gaccugugagagccaccucacaggcagagcccccaccaggcagggcaaggagacuccgcucacu

SEQ ID NO: 305941 - RNA, 64 nt, Human
cccugcuucguuccaccccggguccugguggagcaccaggcaggugguccucgcugugacacug

SEQ ID NO: 305942 - RNA, 64 nt, Human
ugggguguggggcccgugggaugggccucaggccaccaggcaauaaccacagggccugcagcag

SEQ ID NO: 305943 - RNA, 64 nt, Human
acccgguuugcuuccaaaugaaggccauuuguccaccaggcauugaaaagacaugacuuaccca

SEQ ID NO: 305944 - RNA, 64 nt, Human
gaggcacaauggcagcccugccugggaggacuggaccaggcaguggcugcagagggagccuccu

SEQ ID NO: 305945 - RNA, 64 nt, Human
guggaaaccauugcccuccagaacaaccgugagaaccaggcauucagguaaggggggcccugcc

SEQ ID NO: 305946 - RNA, 64 nt, Human
aaccccaucucuacuaaaaauuaccaaaaaaugaaccaggcaugguagugcaugccucuaaucc

SEQ ID NO: 305947 - RNA, 64 nt, Human
aaaaaaaaagguagggggagcaaaaccaucaaccaccaggcagccaggccaucagcccaccucc

SEQ ID NO: 305948 - RNA, 64 nt, Human
acagaagcuucucuggauguguaaagcacaggaaaccaggcagaggaggcacagggugcucucc

SEQ ID NO: 305949 - RNA, 64 nt, Human
aaugaugcccugaauuaguucuaugagaaguacuggcagacagcuguuaugucugcagggcauc

SEQ ID NO: 305950 - RNA, 64 nt, Human
ugacuuuuguuaaagccaugacuuuuguuugcuuggcagacaaacccuuuuuuuaaaacuuuga

SEQ ID NO: 305951 - RNA, 64 nt, Human
uccaggaauauuucaaccagagacacaacuuucuggcagacagacaaauuguacaacaccaaca

SEQ ID NO: 305952 - RNA, 64 nt, Human
caugauuuugucgugagagauccacucaauaaaaaccaggcaaauguagugaaucuggaaaggu

SEQ ID NO: 305953 - RNA, 64 nt, Human
cuucaugaagaauagcaaacucaucccuguagggaccaggcagguaacauagacgagugacucu

SEQ ID NO: 305954 - RNA, 64 nt, Human
cagcugugugaccauccagggguggagggggaaaaccaggcaauuucguuccuggaaucaacca

SEQ ID NO: 305955 - RNA, 64 nt, Human
uccauggcagggguggauucgggagcugggaguaaccaggcaaagucaaccagaugccuagcuc

SEQ ID NO: 305956 - RNA, 64 nt, Human
agagggcaaguggaugggaauuugucagcguucuaccaggcaaauucacuguuucacugaaaug

SEQ ID NO: 305957 - RNA, 64 nt, Human
ccaaggcuggaaggcauagaacuggcaccuugggaccaggcauaauggcucacaccuauaaucc

SEQ ID NO: 305958 - RNA, 64 nt, Human
ucauucugggaacauguuguaagcacugacugggaccaggcaccaggcagggucuagaaggcug

SEQ ID NO: 305959 - RNA, 64 nt, Human
gggaacauguuguaagcacugacugggaccaggcaccaggcagggucuagaaggcuguggugag

SEQ ID NO: 305960 - RNA, 64 nt, Human
ccaucauaaagacacugccugucuucuaggaaugaccaggcacccagcucccacuggacuccaa

SEQ ID NO: 305961 - RNA, 64 nt, Human
guccaacaguuagacauugaggggcuucacuguuaccaggcauguaacagaaggaggaagacua

SEQ ID NO: 305962 - RNA, 64 nt, Human
acggaguucugcccaggggugcugcauaucggucaccaggcacccagggccaugccagggaaag

SEQ ID NO: 305963 - RNA, 64 nt, Human
uuucucuacgguuuuauaaaagccuuggguuccaaccaggcaguagaugugcuucugaaccgca

SEQ ID NO: 305964 - RNA, 64 nt, Human
cccuguuccuggucccggucccggucccagucccaccaggcaacuccuuccacccggaaauucu

SEQ ID NO: 305965 - RNA, 64 nt, Human
uagugaauuacacucaaggaaaagaugugcucccaccaggcagcuccagcuguuaccugagaua

SEQ ID NO: 305966 - RNA, 64 nt, Human
augagaggcuuccucaguccagucgcuccuuagcaccaggcaccguggguccuggauggggaac

SEQ ID NO: 305967 - RNA, 64 nt, Human
augaguaagugagggaugucuccaucuugagaucaccaggcaagagaguugccugcaccaggua

SEQ ID NO: 305968 - RNA, 64 nt, Human
caguuccucccaggaagcccaggagccucacuggggcagacaauaaacccucagagccucgcuc

SEQ ID NO: 305969 - RNA, 64 nt, Human
aaugaauuaagaacacauucuaacaagggucuguggcagacauugccgagugacuuucuaacau

SEQ ID NO: 305970 - RNA, 64 nt, Human
uaacuuaugauuagcucuaaagauuucaaauaguggcagacagugucuucugaauguaaguuuu

SEQ ID NO: 305971 - RNA, 64 nt, Human
aacuuccuaggaauguuuagcagcaaccgaauauaccaggcaaaacuccuuggugccugcgcug

SEQ ID NO: 305972 - RNA, 64 nt, Human
gcugcugacugugggguguggauggggcugcagcaccaggcagagccccucagggcgccgaugu

SEQ ID NO: 305973 - RNA, 64 nt, Human
cuagagacccauggccaucuuuguggcugugggcaccaggcaugggacugagcccaugucuccu

SEQ ID NO: 305974 - RNA, 64 nt, Human
aaaggcuggacucagcaggaacaccaaaucccggaccaggcagaaaccacccaagacugagggg

SEQ ID NO: 305975 - RNA, 64 nt, Human
ucagacuaacggcuaaagagacugaugcaucaacaccaggcagagaauaaagcagauuuuuuug

SEQ ID NO: 305976 - RNA, 64 nt, Human
gcccuugggcuccuugggccuagagccacuucuuaccaggcaacgggcacagccacccuggcac

SEQ ID NO: 305977 - RNA, 64 nt, Human
aggcaggauuggggaagagagccugcaggaucucaccaggcagccucugggggguggccaggcc

SEQ ID NO: 305978 - RNA, 64 nt, Human
uccucuuccucuccccugcucuaccuucuccggcaccaggcagccccuuaaaggaggacaaagu

SEQ ID NO: 305979 - RNA, 64 nt, Human
gacccgcucugcccacggcuguguacgacaucagaccaggcacucucagggccgcucuccagcu

SEQ ID NO: 305980 - RNA, 64 nt, Human
gaggcugggccagccugcugcugucugcuucaggaccaggcagagagugaggcuggggguucuc

SEQ ID NO: 305981 - RNA, 64 nt, Human
cacagccucccgagugcugacccacauggucaagaccaggcagaagcucccagagccccugucu

SEQ ID NO: 305982 - RNA, 64 nt, Human
gcuaguuccauccacgcucaagacccgcccuuagaccaggcaggcaaaggcccccaucacacuc

SEQ ID NO: 305983 - RNA, 64 nt, Human
agaggaggaggagucaagggagcagggcagcucuaccaggcaagguguuuccccagcauaggcg

SEQ ID NO: 305984 - RNA, 55 nt, Human
ggcucccccggccguccugagggggaccaggcagcccucagcagccacaggccuu

SEQ ID NO: 305985 - RNA, 64 nt, Human
uacuguagaaacuaacauuagcuauuauacacuaaccaggcauuuuucccaaauuaauuacaau

SEQ ID NO: 305986 - RNA, 58 nt, Human
accgcugcucggccugcugaugccacauaccaggcaaccucccaucccacccccgacc

SEQ ID NO: 305987 - RNA, 64 nt, Human
aaccuagcuucuuuuuacucuugccucugcuguaggcagacacuuuaauaaaaauaaaugacug

SEQ ID NO: 305988 - RNA, 64 nt, Human
cuacuaaaaaauacagaaauuagcugggugugguggcagacagcuguaaucucagcugcucggg

SEQ ID NO: 305989 - RNA, 64 nt, Human
cauguaaaaauuaauuccauuuucgaagccaccuggcagacagguuuagcuguuucaucagcag

SEQ ID NO: 305990 - RNA, 64 nt, Human
gagauguugccuugaccagccuuggcuggacuuuaccaggcaugcagaagccuguaccaacaca

SEQ ID NO: 305991 - RNA, 64 nt, Human
uagcauguuuacugcucuaugccuccugauccagaccaggcauugcccagccugggaaucuuuu

SEQ ID NO: 305992 - RNA, 64 nt, Human
cauauaagcaaaggggucagggcaagugugacccaccaggcaaaauugagcagcauuuucauag

SEQ ID NO: 305993 - RNA, 64 nt, Human
uucacacuuggguuuagggguguuuuuuuuuaaaaccaggcagguuagcuagcccacccugugc

SEQ ID NO: 305994 - RNA, 64 nt, Human
uugcugcagauacuacugaccagacaagcuguugaccaggcaccuccccucccgcccaaaccuu

SEQ ID NO: 305995 - RNA, 64 nt, Human
accuacugagcuauauucacugugcuguccuagggggagggagagcagagcucgccccugcacu

SEQ ID NO: 305996 - RNA, 64 nt, Human
gguguuccuccaaagaauaggguaaaggagagcugggagggagcccucuccguugggugacucu

SEQ ID NO: 305997 - RNA, 64 nt, Human
cagggugcccuggaacacugguaguucuggggcugggagggagaggggcuccggcuuucucuga

SEQ ID NO: 305998 - RNA, 64 nt, Human
ucugugguuccugguugguggcuaaugaagugaggggagggagggaugucaccccaaaaguagg

SEQ ID NO: 305999 - RNA, 64 nt, Human
ugguuccugguugguggcuaaugaagugaggggagggagggaugucaccccaaaaguaggcccu

SEQ ID NO: 306000 - RNA, 64 nt, Human
gagguucuuagccguuacucagauaccagugcuggggagggaggccugacuucagcaacagcug

SEQ ID NO: 306001 - RNA, 64 nt, Human
cagcaggauuccugcccacuguuuuuucucuguugggagggaagcucuuuucuaggagugucuc

SEQ ID NO: 306002 - RNA, 64 nt, Human
cgccugccaggcagggcagucuggcgcccaugaugggagggauugacauguuucaacaaaauaa

SEQ ID NO: 306003 - RNA, 64 nt, Human
ugggaagggcagggaauggggacgguguauggaggggagggaucuccugcgcccuucauugcca

SEQ ID NO: 306004 - RNA, 64 nt, Human
gcugcacuuuaacccuagaagguggggaccuggggggagggacagggcaggcgggcccaugaag

SEQ ID NO: 306005 - RNA, 64 nt, Human
ggaggaaguguccccaucccccaugccccuuauggggagggagggcgucugaugcucucucucu

SEQ ID NO: 306006 - RNA, 64 nt, Human
ggaccagaacugggagaggaagagagcaggacaaggcagacagaaggucaggucaggaacuggu

SEQ ID NO: 306007 - RNA, 64 nt, Human
cugggcacggugacugcgguuauuccuggaggucggcagacaugccaaccuugggcuauuugag

SEQ ID NO: 306008 - RNA, 64 nt, Human
aagauccugcuuuuuuguuucaaggguuaaauggggcagacaauugcaauacuuguacuaaaca

SEQ ID NO: 306009 - RNA, 64 nt, Human
aauugcccauggacagugacgcaaggacuaggcugggagggagcgugccaaccccuuuugccuc

SEQ ID NO: 306010 - RNA, 64 nt, Human
uuaacagcaauauugaaaggaggugggggauugagggagggacagaguguuggagggccagaga

SEQ ID NO: 306011 - RNA, 64 nt, Human
cuuuugguacccaugugagacaugaacaacaggagggagggaaagagcccaggugggacguggg

SEQ ID NO: 306012 - RNA, 64 nt, Human
agccccagacauacuguguugagagauacuuagagggagggaguagguuuugaagagguugaug

SEQ ID NO: 306013 - RNA, 64 nt, Human
gagggaguagguuuugaagagguugauggugguggggagggaaggccuccugaauugaguuuga

SEQ ID NO: 306014 - RNA, 64 nt, Human
ucucccaccaucccagacugugggcagggggauggggagggagugggccuggaucugggaccuc

SEQ ID NO: 306015 - RNA, 64 nt, Human
ggggguaguuuggucccuggguccugagccucaggggagggagguugauagcuacuggggauuu

SEQ ID NO: 306016 - RNA, 64 nt, Human
aaaaaacuggggccauuggaggcccacuguaggugggagggagcugauuuugggguggggggug

SEQ ID NO: 306017 - RNA, 64 nt, Human
acugaauguuuuauuuaucaaaauguagcuuuuggggagggaggggaaauguaauacuggaaua

SEQ ID NO: 306018 - RNA, 64 nt, Human
gaaaaaagauccaccagaggacaucuuggggagggggagggagcugggggggagggaaaugacu

SEQ ID NO: 306019 - RNA, 64 nt, Human
agaggacaucuuggggagggggagggagcugggggggagggaaaugacuaaugaagcuaauuaa

SEQ ID NO: 306020 - RNA, 64 nt, Human
gggaauaucucccccuuuucccucauagccucuagggagggagagugacuucauucuccauuug

SEQ ID NO: 306021 - RNA, 64 nt, Human
agccuuggacuuggcugugaucuuugacugcuaggggagggaaccuggguauggugagacggug

SEQ ID NO: 306022 - RNA, 64 nt, Human
gaacagcaaauagggcccagugaugccagaagaugggagggaggagccaaccuugcugccugcg

SEQ ID NO: 306023 - RNA, 64 nt, Human
gcugaacugccccuccaagggacaggaaggcugggggagggaguuuacaacccaagccauucca

SEQ ID NO: 306024 - RNA, 64 nt, Human
ugaccauccaaauaauuuuccugucucugccucugggagggaacaggaagcgaugaagaggucu

SEQ ID NO: 306025 - RNA, 64 nt, Human
gugcccgggccucggggcagccccugcagcacugggcagacaugcuggcccacgcccggcggcc

SEQ ID NO: 306026 - RNA, 64 nt, Human
ugugcccucuugcccccaggaagggcagcuggcuggcagacaaggugaagaggcugaugcggcc

SEQ ID NO: 306027 - RNA, 64 nt, Human
guccagauuauuggcugcuuugccucuaccaguuggcagacagccguuuguucuacauggcuuu

SEQ ID NO: 306028 - RNA, 64 nt, Human
caggcagcaguguucuuccccucagagugacuuggggagggagaaauaggaggagacguccagc

SEQ ID NO: 306029 - RNA, 64 nt, Human
ggaggcccaagaggaaaaggauguggcucaggcugggagggacuucaguuagcaugguggggga

SEQ ID NO: 306030 - RNA, 64 nt, Human
aguguuuuauuaaggacagaguucuguuaggggugggagggaauauuugagggagggcuggguc

SEQ ID NO: 306031 - RNA, 64 nt, Human
ugaccagugcucuguggggcagaggagcugaccagggagggagguacccaugagcagaggguag

SEQ ID NO: 306032 - RNA, 64 nt, Human
uauauauuauuuuuugguucucucucguuuuuuagggagggaagaaaguaccaaguugcauuga

SEQ ID NO: 306033 - RNA, 64 nt, Human
gcggaacucccgcacaugaccucccacccuaggagggagggaaggacaccguccuaggguauaa

SEQ ID NO: 306034 - RNA, 64 nt, Human
ucuccaucccuguccugugccccccaggcugauugggagggagggcaccuggaacacugggcau

SEQ ID NO: 306035 - RNA, 64 nt, Human
uucuucucuccucuaauccccgggggccaagcuggggagggauguggaggggaaaaagaugaca

SEQ ID NO: 306036 - RNA, 64 nt, Human
gcuuugggugcgguuuuguacucgguuuggaauggggagggaggagggcggggggaggggaggg

SEQ ID NO: 306037 - RNA, 64 nt, Human
cuugaagagaauggcuaagaagauuugaauuauagggagggaacagaaaucauacaugaaaagg

SEQ ID NO: 306038 - RNA, 64 nt, Human
uugaagaacagucuguaguauuugaaggguuugggggagggagaaaauauuaaugggaaaggca

SEQ ID NO: 306039 - RNA, 50 nt, Human
ugaaaaggauggaagcaugagggagggagggaggagggagaaaaacagaa

SEQ ID NO: 306040 - RNA, 54 nt, Human
ugaaaaggauggaagcaugagggagggagggaggagggagaaaaacagaaucca

SEQ ID NO: 306041 - RNA, 64 nt, Human
caucucaccagagcaacagcccaguccugaggaugggagggacgugacuuagccuugggauucc

SEQ ID NO: 306042 - RNA, 64 nt, Human
gaaggucagggugccgcugggggagcagggagcggggagggaggaagaggggaaugcacaucuu

SEQ ID NO: 306043 - RNA, 64 nt, Human
gguuugggccggggaguuccccauucguucuccggggagggagggacuuuacaccuaccccuca

SEQ ID NO: 306044 - RNA, 64 nt, Human
cauucgguccacauagcuuucuuugccucucugaggcagacaggaagugucuaauuacgauuuu

SEQ ID NO: 306045 - RNA, 64 nt, Human
uuuugauuuugcugacuuuaaaaggauuaaucugggcagacauuauguaaaagaaagguugcgu

SEQ ID NO: 306046 - RNA, 64 nt, Human
auucccauucacuuagccuaucagaaaagucauuggcagacauauauguccuugaaccuuuuuu

SEQ ID NO: 306047 - RNA, 64 nt, Human
ugggccggggaguuccccauucguucuccggggagggagggacuuuacaccuaccccucaccgg

SEQ ID NO: 306048 - RNA, 64 nt, Human
gcagcacaggcuaagucaggaacaucggaugccagggagggaggagaaagccgaagcgaaaggg

SEQ ID NO: 306049 - RNA, 51 nt, Human
acagcaaaaucacccucugaagggagggaccaguggccccuuguuugccaa

SEQ ID NO: 306050 - RNA, 64 nt, Human
cccaaccaaaaaaaauaauaaggcaugauugguggggagggaauguguauuuaggggcauaaua

SEQ ID NO: 306051 - RNA, 64 nt, Human
uugagaggcugagguaggagcaucaccuggggcugggagggaguuggagaccagccuggaugac

SEQ ID NO: 306052 - RNA, 64 nt, Human
gagggugggcacagcugggccugcugugaccacugggagggaagaggagaggaggucagaggac

SEQ ID NO: 306053 - RNA, 64 nt, Human
cugggcacaccuugcugaggccccaguagggguggggagggagggagaggccgccacccccgcc

SEQ ID NO: 306054 - RNA, 64 nt, Human
gcacaccuugcugaggccccaguagggguggggagggagggagaggccgccacccccgccggug

SEQ ID NO: 306055 - RNA, 64 nt, Human
acgccuccuaggaacugugggagaccagcggagugggagggagacgcaguagacagagacagac

SEQ ID NO: 306056 - RNA, 64 nt, Human
uuaggauucaggcagcagugucuguaccucgggugggagggauggggccaucuccuucaccgug

SEQ ID NO: 306057 - RNA, 64 nt, Human
ggcugggcucugccugucuggugccuggaggugugggagggaagaugaguuauuuaacugguaa

SEQ ID NO: 306058 - RNA, 64 nt, Human
ccacgaagcacaagccugaggagugacgggaugggggagggaggugggccaccauguuuggacc

SEQ ID NO: 306059 - RNA, 64 nt, Human
uuuauuuggauggauggauggagggauggaaggagggagggaaggaugucugggaugugaagag

SEQ ID NO: 306060 - RNA, 64 nt, Human
ucuuguuacaggaaauuucaaagguuugggaguggggagggaaaaaagcucagucagugaggau

SEQ ID NO: 306061 - RNA, 64 nt, Human
aacgacuuucacaaaauucagcugaccugagagugggagggaaacuaccgucauucugcucaug

SEQ ID NO: 306062 - RNA, 64 nt, Human
gggucaaggggccccgaugugcacagcugccacagggagggaggucuuggggagaugggcaguc

SEQ ID NO: 306063 - RNA, 64 nt, Human
ucauaaccaggauuaaaauucauauauacugcagggcagacauacauaugauagcuugugcuga

SEQ ID NO: 306064 - RNA, 64 nt, Human
uaaauggucacaagaaaugugaagagagagcuagggcagacaugcagugaaaugguucuuuguu

SEQ ID NO: 306065 - RNA, 64 nt, Human
gggaugaagaccccacugggguuggaagugcagaggcagacagguguauggagucaccuguaaa

SEQ ID NO: 306066 - RNA, 64 nt, Human
uggacauccugcccaccgugucccagccagggcagggagggaccauggcccgcagggucaaggg

SEQ ID NO: 306067 - RNA, 64 nt, Human
ggcuacauuuggcuucuguacuggcugaggacaggggagggagugaaguugguuugggguggcc

SEQ ID NO: 306068 - RNA, 64 nt, Human
gcuguuggauucugaggguggggagggagagagagggagggagagggagugaagagccugcccu

SEQ ID NO: 306069 - RNA, 64 nt, Human
uguugcaaacgacugcuguuggauucugaggguggggagggagagagagggagggagagggagu

SEQ ID NO: 306070 - RNA, 64 nt, Human
uacuuguucccaccuugggagaggacgaugacuugggagggacgcgugaagggagaaggggucc

SEQ ID NO: 306071 - RNA, 64 nt, Human
ucauacuuccagguuucauguugcgucuuguugagggagggagagcagguuacuuggcaaccau

SEQ ID NO: 306072 - RNA, 64 nt, Human
aaccuaaguccuuccaccugccacccccuucccugggagggaggugguccuccuaucucccugg

SEQ ID NO: 306073 - RNA, 64 nt, Human
ccagggaccuggaacccucuuggccaaggggagugggagggacagagggaaggucacaggcaag

SEQ ID NO: 306074 - RNA, 64 nt, Human
cucugauagaacaaagcgaaaugcagguccaccagggagggagacacacaagccuuuucugcag

SEQ ID NO: 306075 - RNA, 64 nt, Human
cagaagaccaagugaagggggauggcaucugguagggagggagguauaguugggggacaggggu

SEQ ID NO: 306076 - RNA, 64 nt, Human
ggggacaaaccagggguaccaggcacauggcugggggagggacugcugacccaccaaggucuca

SEQ ID NO: 306077 - RNA, 64 nt, Human
gagucucuggcucagcuguggucccacccaggaagggagggagcugaggccucccuugaguagg

SEQ ID NO: 306078 - RNA, 64 nt, Human
gcuauaggguugugggguggagggaggaagggcugggagggaguggggaggaauugcuagcugu

SEQ ID NO: 306079 - RNA, 64 nt, Human
caccaccacuuaccacucgugcaucccugagacagggagggaagaaugaacacuccccauuaac

SEQ ID NO: 306080 - RNA, 64 nt, Human
uguaaauacgugucgcucagauguccuuugaagugggagggaaucaauccggggauaauuucaa

SEQ ID NO: 306081 - RNA, 64 nt, Human
cucccuaccuguccccucacagggaggggagcaggggagggaaagaaaccaggcaucuggucaa

SEQ ID NO: 306082 - RNA, 64 nt, Human
uguggcccugcauccagauaccugccucguccgaggcagacacccccaccccugccuccuccag

SEQ ID NO: 306083 - RNA, 64 nt, Human
ggcaggcagauugccucacuuaacuuaaaucugcggcagacaacugccagugcccaucaaacag

SEQ ID NO: 306084 - RNA, 64 nt, Human
uggggccuccacucuggccggaggaaggaccgcaggcagacagccugggccucuaacagcuuuu

SEQ ID NO: 306085 - RNA, 64 nt, Human
cccuaaacugccuuuuuuucuuuuuugagguggggggagggaggagguauauuggaacucuucu

SEQ ID NO: 306086 - RNA, 64 nt, Human
gauucaccuuggaggaagcuggggaaagugguuagggagggagaggaggaagacugagaaaucu

SEQ ID NO: 306087 - RNA, 64 nt, Human
ggaagggcaaugccuacccccagcguuauuuuuggggagggagggcugugcauagggacauauu

SEQ ID NO: 306088 - RNA, 64 nt, Human
accuguguccuuaccccaggcucaggaacugccagggagggaagaugagguggggagucuguac

SEQ ID NO: 306089 - RNA, 64 nt, Human
caacagcgaagccaguccagaagagggguccgcugggagggaggguugugucaggcuuggggga

SEQ ID NO: 306090 - RNA, 64 nt, Human
aaucuggauucucuccucuuccccauucuccagagggagggagguggugaggaagaggaaggga

SEQ ID NO: 306091 - RNA, 64 nt, Human
aagcaguugguagaaggaaugguauuuguauggggggagggaggcuggaauggagaaucuggau

SEQ ID NO: 306092 - RNA, 64 nt, Human
auccuucuuccuuaaccccaacucuuugggagaagggagggaaaaugcaagggccuuccucucu

SEQ ID NO: 306093 - RNA, 59 nt, Human
ugcuucuauucuaucguugagaguuuugugggagggaacccagaccucuccucccaacc

SEQ ID NO: 306094 - RNA, 64 nt, Human
uuuaggacagggaggccagggaagagguggguuggggagggaguuuuguuggggaugcuguugu

SEQ ID NO: 306095 - RNA, 64 nt, Human
uggaagaacauuuuacuuaaaugauuugaggggugggagggagugaacuacugaguuugccaga

SEQ ID NO: 306096 - RNA, 64 nt, Human
cucucagcaugcaguccgaaagcaugugggaguggggagggaaagugagaugaauuaagacaaa

SEQ ID NO: 306097 - RNA, 64 nt, Human
caaauauucugaaucaccaauuaaaaaccuuuuugggagggauggggaaaacuacaaacguuug

SEQ ID NO: 306098 - RNA, 64 nt, Human
ucgcuccaaaggguugucuuccucgccaaaaggagggagggacuuugaauuugauaugaaucuu

SEQ ID NO: 306099 - RNA, 64 nt, Human
cccaacaguuuuuuccccaguggggaggguggaagggagggacugauauaaguaaggagaugag

SEQ ID NO: 306100 - RNA, 64 nt, Human
cauaggauuucucuuaauucagcuugaauugauggggagggagguaagaguagggucagaguua

SEQ ID NO: 306101 - RNA, 64 nt, Human
ggaccccuuccucacacuggccccuaugcagaagggcagacaguucuucugggguuggcagcug

SEQ ID NO: 306102 - RNA, 64 nt, Human
gagagguacugggguccacggauauguguuguggggcagacagucacugugggaugucuucaaa

SEQ ID NO: 306103 - RNA, 64 nt, Human
ucgucaggguguucgacucugggaugcugggccgggcagacauuuaugcucugagcagcaagga

SEQ ID NO: 306104 - RNA, 64 nt, Human
uuugccaccacgcaacucagggcucaagaugaaugggagggagagauuugaguccaagcauaca

SEQ ID NO: 306105 - RNA, 64 nt, Human
uguggguaguaaagaauuggagugggaguuaguggggagggaugacaaagcuucagcuuugguu

SEQ ID NO: 306106 - RNA, 64 nt, Human
gccgcaggggucacgcaugguccagcccucaggugggagggaaguccuuguuggcagagggaug

SEQ ID NO: 306107 - RNA, 64 nt, Human
acccggacacggccugguguguggcuugcugccugggagggaugcacagggccucuggagggac

SEQ ID NO: 306108 - RNA, 64 nt, Human
uaucauuuuauuaacauggaacccacacagauaggggagggauuaagcuaagaacuuacagaau

SEQ ID NO: 306109 - RNA, 64 nt, Human
gggguuugagguggccaugggcagacagccgaaagggagggagggugugggugugcgugugugc

SEQ ID NO: 306110 - RNA, 64 nt, Human
gggcgcggggcgcggcgggacccaggcuacgagcgggagggaggcgggagucgggggaagacgc

SEQ ID NO: 306111 - RNA, 64 nt, Human
gacaccagcgcuggcuucccgggcccgcgggccggggagggaagccucggggcugcggggugag

SEQ ID NO: 306112 - RNA, 64 nt, Human
acaggccaguuccugauuagaacacaggaccugugggagggacuaucagagaugcaaaaauuac

SEQ ID NO: 306113 - RNA, 64 nt, Human
agacuccucuauguugccugcuguccaggagcccgggagggaggggugugcaggagccgcaggg

SEQ ID NO: 306114 - RNA, 64 nt, Human
cucaaagaagcauuugcugaggauggagaggcaggggagggaggcgggaggccgucacuggagu

SEQ ID NO: 306115 - RNA, 64 nt, Human
ugugaugccccucucccgauuucccaggggcucugggagggacccuucuaagaagauugggcag

SEQ ID NO: 306116 - RNA, 64 nt, Human
acgagggagggcgcccuugaggcaugcccucugagggagggagaccagagaugcagggauuggc

SEQ ID NO: 306117 - RNA, 64 nt, Human
auccccagagagcucugacgacgcugcagccgcagggagggaggggcuggccagagggagaggc

SEQ ID NO: 306118 - RNA, 64 nt, Human
ggaauagugaucuucaaaaaacccuugcuuuuaggggagggaagcggggaaggaaaggaaugag

SEQ ID NO: 306119 - RNA, 64 nt, Human
cugggccgaugcuuaggaauauuuaugagggauggggagggagacaauuggaaugggggcguug

SEQ ID NO: 306120 - RNA, 64 nt, Human
agaucauuccucagaaugaggacccgaggacaguggcagacagacgcguuggcacaguucaugg

SEQ ID NO: 306121 - RNA, 64 nt, Human
ucuaucuccuuccccggcaaaaaccaaacaaacuggcagacaggccagggauguauguugcuug

SEQ ID NO: 306122 - RNA, 64 nt, Human
uuguauugaguccaucuguaauuugcucagugauggcagacaagauggcugucugguuuugaga

SEQ ID NO: 306123 - RNA, 64 nt, Human
uuuuuuuuauacacaacauuuauuucaaacuauugggagggaugagaguggcuuaaaaacuucc

SEQ ID NO: 306124 - RNA, 64 nt, Human
acagaguucgcauuggcgcaauauuuaugggagugggagggauggggaaaauaaacuuaacucu

SEQ ID NO: 306125 - RNA, 64 nt, Human
ggcaucacaaggacauaggaucauagauuggguagggagggaggaggauuucuggaacuuuucu

SEQ ID NO: 306126 - RNA, 64 nt, Human
uccccaaggcucuugcagagcuagggcucugaaggggagggaaggcaacggcucugcccagagc

SEQ ID NO: 306127 - RNA, 64 nt, Human
gacaugacuuauguguguguguguuuuugggguggggagggagggagagaagagggggcuaaau

SEQ ID NO: 306128 - RNA, 64 nt, Human
ugacuuauguguguguguguuuuugggguggggagggagggagagaagagggggcuaaauuuga

SEQ ID NO: 306129 - RNA, 64 nt, Human
ccagaagagggaccugggaguccugguggggacggggagggagucucaauacuccuuugcagug

SEQ ID NO: 306130 - RNA, 64 nt, Human
ggacuaguauagaauuaagcugagugcaagaugagggagggaagggcuuucuugguaauuuaga

SEQ ID NO: 306131 - RNA, 64 nt, Human
ugguggcuucagagacagugcugccuccuccugagggagggaagguaccagggagaaccuggga

SEQ ID NO: 306132 - RNA, 64 nt, Human
ugaggagcgucuccgcccggcagccacccaguccgggagggaggugggggggucagucccccgu

SEQ ID NO: 306133 - RNA, 64 nt, Human
gaggagccccucugccccgccagccaccccguccgggagggaggugggggggucagccccccgc

SEQ ID NO: 306134 - RNA, 64 nt, Human
gggucagccccccgcccggccagccgccccguccgggagggaggugggggaucagccccccgcc

SEQ ID NO: 306135 - RNA, 64 nt, Human
gggucagccccccgcccggccagccgcccgguccgggagggaggugggggggucagccccccgc

SEQ ID NO: 306136 - RNA, 64 nt, Human
gguuaguggguuaaacgggguaaguuagaguagggggagggauaggaagacauauuuaaaaacc

SEQ ID NO: 306137 - RNA, 64 nt, Human
agcgggcaucauccccccacacugcucaggggaggggagggaucaggcgaugagacugugaggc

SEQ ID NO: 306138 - RNA, 64 nt, Human
cucccuugccccuuuccugggcccagaaguuggggggagggagggaaaggauuuuuacauuuuu

SEQ ID NO: 306139 - RNA, 64 nt, Human
aucagcgggucaacaucgugccuauccuggcuaaggcagacacacugacaccucccgaagugga

SEQ ID NO: 306140 - RNA, 64 nt, Human
gaucgcgcccugcucccgugccaccguagucccuggcagacaggcagggcucugcccagggcag

SEQ ID NO: 306141 - RNA, 64 nt, Human
uacucugggucaagagaccagggaugcaggguuaggcagacagguccccagaguccucacccug

SEQ ID NO: 306142 - RNA, 64 nt, Human
cuugccccuuuccugggcccagaaguuggggggagggagggaaaggauuuuuacauuuuuuaaa

SEQ ID NO: 306143 - RNA, 64 nt, Human
uggggcuugagcugaggaugggacgaugugcccagggagggacccaccagagcacaagagaagg

SEQ ID NO: 306144 - RNA, 64 nt, Human
ucgugccccucagacuggggaagaguccaaggaagggagggagcagccacuccucaaugcucaa

SEQ ID NO: 306145 - RNA, 64 nt, Human
ucuccucagagcgccugucacuccauccccggcagggagggaccgucagcucacaaggcccucu

SEQ ID NO: 306146 - RNA, 64 nt, Human
uucaggcacgcugccuccugguaacagcuaugcagggagggaggacccacacugcuacacuucu

SEQ ID NO: 306147 - RNA, 64 nt, Human
aauugcaucucaaauuguaauccccaugugucaagggagggaccugaugggaggugaugggauc

SEQ ID NO: 306148 - RNA, 64 nt, Human
auauuacauucuauaguuaccaaaaaugguugaagggagggauuucucauugcagagggugggg

SEQ ID NO: 306149 - RNA, 64 nt, Human
uggcucgaaucucugugccuucgucuuucccauggggagggauucugguuccagggucccucug

SEQ ID NO: 306150 - RNA, 64 nt, Human
agcccaaugugucuuauuccccguggacaugaaggggagggaggguguggggaugccuugccaa

SEQ ID NO: 306151 - RNA, 64 nt, Human
gccccauugaacaaugacaacaucacaaggggaagggagggauuuugccaaaaguuagaaaggu

SEQ ID NO: 306152 - RNA, 64 nt, Human
agaaugugugugcagaauucuaggcagcaccuuagggagggacugggaugagagaaagugggac

SEQ ID NO: 306153 - RNA, 64 nt, Human
cgaaacaacccagccggaaggggugguggucaacgggagggaggaggagcagacggcagaggaa

SEQ ID NO: 306154 - RNA, 51 nt, Human
ccauggcugaagacuacugaagggagggagaggaggggagccaagacacuc

SEQ ID NO: 306155 - RNA, 64 nt, Human
acagcaggggacagugcagggaggugugggguaagggagggaagucacaucagaaaagggaaag

SEQ ID NO: 306156 - RNA, 64 nt, Human
cugcuccuagggcugugaauguuuucaggguggggggagggagauggagccuccuguguguuug

SEQ ID NO: 306157 - RNA, 64 nt, Human
agugcccaaggagggcggggcauguugggagagggggagggaggggagacagagccuuuaaccc

SEQ ID NO: 306158 - RNA, 64 nt, Human
gaaucuggcagugaaagaggaaaagaacauuccaggcagacagcacugcaagagggugagcucu

SEQ ID NO: 306159 - RNA, 64 nt, Human
agugggcacuggucacuccuaugugcuaagacaaggcagacaucuguguguucucuuaagucuu

SEQ ID NO: 306160 - RNA, 64 nt, Human
agcucugguguaguuucugcauuucaagaagacuggcagacaguuguuuuuauucuuccucaaa

SEQ ID NO: 306161 - RNA, 64 nt, Human
ccuuuauugccucauuucuugugacgccuuguuggggagggaaaucuguuuauuuuuuccuaca

SEQ ID NO: 306162 - RNA, 64 nt, Human
acaguaagaccuggggcuugagggguggggaauggggagggaagggcauagccugcuccuccau

SEQ ID NO: 306163 - RNA, 64 nt, Human
cccucgcugggggagaaagcaucugcuccaaggagggagggagcgcagggaaaagagcgagaga

SEQ ID NO: 306164 - RNA, 64 nt, Human
accuugucaaccucuuccugucuuaccaaacagugggagggaauuccuagcuguaaauauaaau

SEQ ID NO: 306165 - RNA, 64 nt, Human
uuuuggauugaggcuauguacuuggugggggcaggggagggaauauauuauaauacuauucagu

SEQ ID NO: 306166 - RNA, 64 nt, Human
aaccuccaaaaaaaaaaacaacuggguagagggugggagggauuuacuuuuaagaggcaaaaug

SEQ ID NO: 306167 - RNA, 64 nt, Human
gauggugggguggauggucagggagggaugcucagggagggauaugcuggugugagcagccaga

SEQ ID NO: 306168 - RNA, 64 nt, Human
caaauggcuguggggauggugggguggauggucagggagggaugcucagggagggauaugcugg

SEQ ID NO: 306169 - RNA, 64 nt, Human
ccaaagauuaggguuggugguggcagugcagcaggggagggacaaacaaccaagcuauggguga

SEQ ID NO: 306170 - RNA, 64 nt, Human
caggacuugguggggggaacagggaauuggggaugggagggaggcaauaaagauauuuggccuu

SEQ ID NO: 306171 - RNA, 64 nt, Human
ggguucuuguggcuguugucagagcaggagcugggggagggaagacuuguucucucuuucuuga

SEQ ID NO: 306172 - RNA, 64 nt, Human
gggcucuagacagcugagaggaccugaucauguagggagggacggggaggggagccaggaccca

SEQ ID NO: 306173 - RNA, 64 nt, Human
guaucauuucaugcuuugauuuacacucgaacucgggagggaacauccugcugcaugaccuauc

SEQ ID NO: 306174 - RNA, 64 nt, Human
cuuuuagggacccugcagcucuggaguggguggagggagggagcuacgggcaggaggaagaauu

SEQ ID NO: 306175 - RNA, 64 nt, Human
gcgcggcauggaggguggugugaguuccucuggugggagggagaacgcacaucucuucugggcg

SEQ ID NO: 306176 - RNA, 64 nt, Human
aaugggccccuuguacaagcugagcugccccggagggagggaggaguucccugggcuucuggca

SEQ ID NO: 306177 - RNA, 64 nt, Human
gccauuugaaucagggucuccaguuucuagaaaaggcagacacugguugggaccaaagucucca

SEQ ID NO: 306178 - RNA, 64 nt, Human
agaagcccauggaagcccagggagaugucccuggggcagacacuaaggcagguguugaagacaa

SEQ ID NO: 306179 - RNA, 64 nt, Human
cucugucucuguggaaaagccaucucagguuggcggcagacacauugucaucagaggggagcag

SEQ ID NO: 306180 - RNA, 64 nt, Human
gacuuauuuuuucucuccuaugccaccccagguggggagggagggagguuucagacuccaguuu

SEQ ID NO: 306181 - RNA, 64 nt, Human
uauuuuuucucuccuaugccaccccagguggggagggagggagguuucagacuccaguuucucc

SEQ ID NO: 306182 - RNA, 64 nt, Human
ggaaacacacaacaaaacaucugcuguccugggugggagggaaacuucauuucacuggaaugag

SEQ ID NO: 306183 - RNA, 64 nt, Human
gcggguguggcgcagcccagggcucacacugcgugggagggacugggucacuauugugguuuuu

SEQ ID NO: 306184 - RNA, 64 nt, Human
uuuuaauucacauuucuuaugaaguaugguaacagggagggagacaccuagauuagcagcucaa

SEQ ID NO: 306185 - RNA, 64 nt, Human
guagugauaauugcuguggagaaaaauaaagcaggggagggaguaagaaauccuggagaugagg

SEQ ID NO: 306186 - RNA, 64 nt, Human
caagacaaaaguaaaaugguuuaccugagcccaggggagggaaaauugauuaagauaucauuau

SEQ ID NO: 306187 - RNA, 64 nt, Human
caggcuggagcaagguaccuuuucuuaggaucuugggagggaauggaugccccucucugcauga

SEQ ID NO: 306188 - RNA, 64 nt, Human
uguguguggccugccuccaccauagcagggacuagggagggaggcagggaacguuuuuucuuuu

SEQ ID NO: 306189 - RNA, 64 nt, Human
ucuacauucugauaagcugugaggccacugccaagggagggagaaauggucacuuucugguggu

SEQ ID NO: 306190 - RNA, 64 nt, Human
uguuuuguaugucauaguaugucgucacauaaaagggagggagcgaaaaaccauuacauuaaga

SEQ ID NO: 306191 - RNA, 64 nt, Human
aguuuuugugugugcgagaucucuaagccagcgugggagggagcgccucaggauaaguuauuau

SEQ ID NO: 306192 - RNA, 64 nt, Human
uuucaggacuuuuauuucccccuggaugguuguugggagggagggaaaguguuuucugaauggc

SEQ ID NO: 306193 - RNA, 64 nt, Human
aggacuuuuauuucccccuggaugguuguugggagggagggaaaguguuuucugaauggcuauu

SEQ ID NO: 306194 - RNA, 64 nt, Human
ugcagggcaccaccuucaaggcacagcccuuguugggagggagaacccucuccagaaacccugc

SEQ ID NO: 306195 - RNA, 64 nt, Human
gcuggacagccuccgccaagaucuacaggacaaagggagggagcaagcccuacucggauggggc

SEQ ID NO: 306196 - RNA, 64 nt, Human
uaggaacugagcccaaggaaauagcgggguugcaggcagacauugagcugcgagacaaugggaa

SEQ ID NO: 306197 - RNA, 64 nt, Human
aagguuuuugaauaaauggaugaaaaucuuuuaacggagacaaaggaugguauuuaaaaaugua

SEQ ID NO: 306198 - RNA, 64 nt, Human
auuucucuguggcucaguuuuaccacccauaaagcggagacaguaauuuacgguuauccuuucu

SEQ ID NO: 306199 - RNA, 64 nt, Human
uaggguaugaagcugcgcuccuccaucggguuuggggagggagcacucugggacugugagacaa

SEQ ID NO: 306200 - RNA, 64 nt, Human
aucacauaguuaaauuuuucagucagugaagaccgggagggaaugucagugaauuggcuugaau

SEQ ID NO: 306201 - RNA, 64 nt, Human
auggaaaauggguaugcuuaaagauugcaggguagggagggauuuuccuucauccuugugacau

SEQ ID NO: 306202 - RNA, 64 nt, Human
uuucuuauuuuccucauaaucagcuacccuggaggggagggagaacucauuuuacagaacuugg

SEQ ID NO: 306203 - RNA, 64 nt, Human
uuauugggaugucaucuuccuggaagcagagcuggggagggagagccaucaccuugauaauggg

SEQ ID NO: 306204 - RNA, 64 nt, Human
acccaugaaaacugagaugaggaccuugguacuagggagggagggaaggacgugggaauguuuu

SEQ ID NO: 306205 - RNA, 64 nt, Human
augaaaacugagaugaggaccuugguacuagggagggagggaaggacgugggaauguuuucuua

SEQ ID NO: 306206 - RNA, 64 nt, Human
ccaagaaauuggaauugaaaacaggaggugacuagggagggauuaggaaauuagaggucuugac

SEQ ID NO: 306207 - RNA, 64 nt, Human
uguagcuggaggccucaggccaugggucaaaccugggagggaaagagacccuacacauggccua

SEQ ID NO: 306208 - RNA, 64 nt, Human
auuguggcguuguggucuuugcauugggggaggggggagggaccggaugggcggggggaggggg

SEQ ID NO: 306209 - RNA, 64 nt, Human
uauuuuuaauguaauagauuguaagacguggugagggagggaucugacagagaugaaugugcca

SEQ ID NO: 306210 - RNA, 64 nt, Human
gacagaaaaagauagcauuggggacaugggaugggggagggagggcaauaguggaacgaacuuu

SEQ ID NO: 306211 - RNA, 64 nt, Human
gcacuuucaguuccuccauuuggaauucaaaaaggggagggauccugaagaaaucauauguuaa

SEQ ID NO: 306212 - RNA, 64 nt, Human
uuagucuguguccacaagcagaggcccccucgaugggagggaguggcaggcaggagaagguggc

SEQ ID NO: 306213 - RNA, 64 nt, Human
auucuucucuugcuuuauacuacucacguccuuggggagggaaaugcacaauuuuuuuuuguua

SEQ ID NO: 306214 - RNA, 64 nt, Human
caucaaauaagaaauaaugcuacaauuuuaagaggggagggaagggaaaguuuuuuuuuauuau

SEQ ID NO: 306215 - RNA, 64 nt, Human
gaagcagcagcacgcacaguccugucgcugggugcggagacagccuggcaaagucccacucagc

SEQ ID NO: 306216 - RNA, 64 nt, Human
ccagaagccuuccccugcaaggugcccaccugcccggagacagagggagcagcugaggccucuc

SEQ ID NO: 306217 - RNA, 64 nt, Human
ccucgcucaccugagcgccgcaccgcuucagggacggagacaggaccgggcgagcccuggggcg

SEQ ID NO: 306218 - RNA, 64 nt, Human
ucuggucccccgcgaaaagguaaauacacccaaagggagggaccuaguuaagucacuggcaccu

SEQ ID NO: 306219 - RNA, 64 nt, Human
uuuguuuguuucuuuguguugggagggauuauuugggagggaaaagggaaguaguccuuggcau

SEQ ID NO: 306220 - RNA, 64 nt, Human
uugccuagcucuuuuuuguuuguuucuuuguguugggagggauuauuugggagggaaaagggaa

SEQ ID NO: 306221 - RNA, 64 nt, Human
auaacauggugugcuucuuaaaauagccauaaaggggagggacucaucauuuccauuuacccuu

SEQ ID NO: 306222 - RNA, 64 nt, Human
uuucucaguguguuguuauuuuggaaaaaaugaggggagggaguuuggcaagaauggagaaaau

SEQ ID NO: 306223 - RNA, 64 nt, Human
cugcaugcagucaggcuggcaguggcgcgguacagggagggaacuggugcauauuuuagccuca

SEQ ID NO: 306224 - RNA, 64 nt, Human
ugucuccugggggguuugaggcugggcugggagggggagggagauagagggagagaugcaguuu

SEQ ID NO: 306225 - RNA, 64 nt, Human
gccacuggugggcagguucccauucuuuggggcugggagggacagcuugccuguuucuggucac

SEQ ID NO: 306226 - RNA, 64 nt, Human
gcaccccguaagaagagccuaccugaccgacuuggggagggaacacagagguguugggaaggug

SEQ ID NO: 306227 - RNA, 64 nt, Human
cucaugccuguaaucccagcacuaugggaggccagggagggaggaucuccagaggucaggaguu

SEQ ID NO: 306228 - RNA, 64 nt, Human
cuuuaagaauauuggaugacauuuccugacaugugggagggagaaacucccuaacuuuuuuuuu

SEQ ID NO: 306229 - RNA, 64 nt, Human
uuuuguuuuguugccgguggggagggcugggagggggagggaacuuuuauuuauuguguucaca

SEQ ID NO: 306230 - RNA, 64 nt, Human
uauuuuaaagcagagacuauuuugguggauaggugggagggagcaaggggaguuugagggaauc

SEQ ID NO: 306231 - RNA, 64 nt, Human
agguggggcuguuaccuuccucagggcuuagggagggagggaggacauggacagggccuuccac

SEQ ID NO: 306232 - RNA, 64 nt, Human
ucacagguggggcuguuaccuuccucagggcuuagggagggagggaggacauggacagggccuu

SEQ ID NO: 306233 - RNA, 64 nt, Human
ucugugggcuucuccaggagcagggaggguggaggggagggauggggggcacaggagcugggag

SEQ ID NO: 306234 - RNA, 64 nt, Human
gcgcuggcccgaggauaucccagcggugguacuucggagacaccugucugcaucugacugagca

SEQ ID NO: 306235 - RNA, 64 nt, Human
uccaggccuccgcucagugaugagaccaagagaucggagacaagcauggugcugcugcuucugc

SEQ ID NO: 306236 - RNA, 64 nt, Human
cuuuucucucugucuuuaggaguagggugggauggggagggaggcugggcaucagggaucacau

SEQ ID NO: 306237 - RNA, 64 nt, Human
uuguguugcuuccuauuggcuagcuuccuaaggggggagggaaccgaguuaucaagaugggagg

SEQ ID NO: 306238 - RNA, 64 nt, Human
agcucccucugcccugccaguugucagucaggcagggagggaguggcuguguugguuuggggaa

SEQ ID NO: 306239 - RNA, 64 nt, Human
uuugaaguagggagguuggcagggguggucaagcgggagggagauagucacuuguucuugcccc

SEQ ID NO: 306240 - RNA, 64 nt, Human
ugcaguuugcugcaugccuggaaacugcaagauggggagggagggggcgggucuugcucgaaug

SEQ ID NO: 306241 - RNA, 64 nt, Human
ugugguauuuauuuucuuaguucugugaacaccugggagggagagcggagaaacugggauuuau

SEQ ID NO: 306242 - RNA, 64 nt, Human
uggccucugucagggaucccugguggaaggggaggggagggaggaacccauauagucaacucuu

SEQ ID NO: 306243 - RNA, 64 nt, Human
gggagggccugcuggcucaccgugaggcagccgcgggagggagcgcugacgucacagaagcgaa

SEQ ID NO: 306244 - RNA, 64 nt, Human
gccuggggaguguuggauccacaucccggugccggggagggaagcccaacauccccuuguacag

SEQ ID NO: 306245 - RNA, 58 nt, Human
cucucugcaaggcagccuaaugcucugugggagggacuuugcugauuuccccucuucc

SEQ ID NO: 306246 - RNA, 64 nt, Human
gaggacugugaaguacaggcacagcccgacugcagggagggaugcacccaucauuuacccaugg

SEQ ID NO: 306247 - RNA, 64 nt, Human
ucuuaccauuaacauuuuuuacccuuccauagaagggagggaauaaaucaugacuuaucccauu

SEQ ID NO: 306248 - RNA, 64 nt, Human
ucaagaggcugaggcacgagaaucacuugaacccgggagggagagguugcagugagccaagauc

SEQ ID NO: 306249 - RNA, 64 nt, Human
uuuaaaguaauguugccaagagaaaaaauuuccugggagggagguuucccacaagccaaaucuc

SEQ ID NO: 306250 - RNA, 64 nt, Human
gcaaauaaugcugguggaauggaggaguuguuuggggagggaaaggagagagaaggaaaggagu

SEQ ID NO: 306251 - RNA, 64 nt, Human
gaagaucaaauguguguuaagaaaaggugucgaggggagggacaaaaccagaaacgguggaagg

SEQ ID NO: 306252 - RNA, 64 nt, Human
cucccuuuuuauuuugccugcagaaucguugagagacuaauaaggcuuaauauuuaauugauuu

SEQ ID NO: 306253 - RNA, 64 nt, Human
uacgauucaguauguuccuguggaugucugcugugacuaauauaaauuucuugcagaaucagcu

SEQ ID NO: 306254 - RNA, 64 nt, Human
aaaaaaaaaguaaauauccagggaacccugcccagacuaauacuguugguggcauaagagaauc

SEQ ID NO: 306255 - RNA, 64 nt, Human
aaacugcugauuggccucaacugcccaggcggacgggagggaggcacccggccggcuggacuaa

SEQ ID NO: 306256 - RNA, 64 nt, Human
gcaagaguaggguuguggaaagaccaagcugauggggagggacuuguuuacgggaauuuuuuua

SEQ ID NO: 306257 - RNA, 64 nt, Human
uucuucaguuaacaacuuuguguucucugugggagggagggaguccuguguguuuguggggaga

SEQ ID NO: 306258 - RNA, 64 nt, Human
cuuguucuucaguuaacaacuuuguguucucugugggagggagggaguccuguguguuuguggg

SEQ ID NO: 306259 - RNA, 64 nt, Human
cacugcucuaacaugcugaagaaaucaucugagggggagggagauggaugcucaguugucacau

SEQ ID NO: 306260 - RNA, 64 nt, Human
gggcgccuucccgggggagugggaggagagggaggggagggauuuuuuauguucuucuguguug

SEQ ID NO: 306261 - RNA, 64 nt, Human
ugacacugugacaguuuugguaacuaggauccuagggagggaaauguuugccuguugaacuucu

SEQ ID NO: 306262 - RNA, 64 nt, Human
uuuuacuuuugcgggggggaggggggaggaguuggggagggagggaaugugggaggaauuaaga

SEQ ID NO: 306263 - RNA, 64 nt, Human
acuuuugcgggggggaggggggaggaguuggggagggagggaaugugggaggaauuaagacaaa

SEQ ID NO: 306264 - RNA, 64 nt, Human
gcccaaggaaaaauacaggauguugucccaucaagggagggagggggugggagaauccaaauag

SEQ ID NO: 306265 - RNA, 64 nt, Human
acaugcgaaaguuugccuuuguaccauauaaagggggagggaaauagcuaauaauguuaaccaa

SEQ ID NO: 306266 - RNA, 64 nt, Human
aauacaguacaaucccaacccuacugggaggggcgggagggagguguugccgucacuguauuaa

SEQ ID NO: 306267 - RNA, 64 nt, Human
caccgggaagugcagcgggccaggcaggcugggugggagggaggagggccgagacaggagcagc

SEQ ID NO: 306268 - RNA, 64 nt, Human
uuuuuagugauaagauucauacacucuguauuuggggagggaaaaccuuuuuaagcaugguggg

SEQ ID NO: 306269 - RNA, 64 nt, Human
cuucucuuagauucuuaauucaugaggagggugggggagggagguggagggagggaaggguuuc

SEQ ID NO: 306270 - RNA, 64 nt, Human
uuaauucaugaggagggugggggagggagguggagggagggaaggguuucucuauuaaaaugca

SEQ ID NO: 306271 - RNA, 64 nt, Human
cccagccugguccacuaaaugcagccuguggucgggcagacagcauugggguccauuaggaaga

SEQ ID NO: 306272 - RNA, 64 nt, Human
gccaucccaaauacuugggcagcagcucagcaugggcagacaugggggcuguggauucuuccag

SEQ ID NO: 306273 - RNA, 64 nt, Human
agucaccccauggugguauggcugaacaaggagcggcagacaacucagggagaaacucaggagu

SEQ ID NO: 306274 - RNA, 64 nt, Human
gacuggccgggacaagauaaacggagcugguggcgggagggacagccccagagcagacccuucc

SEQ ID NO: 306275 - RNA, 64 nt, Human
gcgugcagagcugccagcagggagcucacagaaggggagggagcaccaggccagcugagcugca

SEQ ID NO: 306276 - RNA, 64 nt, Human
uuggguaaugggaaaguucuuaagagugucaauggggagggauagagggugggggcucaugguu

SEQ ID NO: 306277 - RNA, 64 nt, Human
ccuacuuugcggauggacauauuaaggccaggaggggagggacuugccccaggucgcauggcag

SEQ ID NO: 306278 - RNA, 64 nt, Human
aggccaccugccucucugagggaucuaaacaacugggagggaggggaccgcucccccuuucucu

SEQ ID NO: 306279 - RNA, 64 nt, Human
gucacccugucuuagagcuagagaugagguggcagggagggaggcuguguccucaguggccugg

SEQ ID NO: 306280 - RNA, 64 nt, Human
cugaaggccgucucaucccauguccaccauguaggggagggacuuuguucaggaagaaauccgu

SEQ ID NO: 306281 - RNA, 64 nt, Human
gaugcuggcagaucucaaggccaucaauuauugggggagggagggacaaacacucccaaucauc

SEQ ID NO: 306282 - RNA, 64 nt, Human
cuggcagaucucaaggccaucaauuauugggggagggagggacaaacacucccaaucauccacc

SEQ ID NO: 306283 - RNA, 64 nt, Human
ccaugacucuugacauccuagcuucuucuaaggggggagggaaaggggggagauuuuuauauau

SEQ ID NO: 306284 - RNA, 64 nt, Human
cugcccauguugacgagacagcagcagggggagagggagggaaggaaggugcggcugcaagaag

SEQ ID NO: 306285 - RNA, 64 nt, Human
ccuggaauggggaaggccugggguggaaaggcaggggagggaggguguguguagguaugugcau

SEQ ID NO: 306286 - RNA, 64 nt, Human
uuaaaugcuucccuggacugcggggaggggcggggggagggagggauuucuuaucccguuuguu

SEQ ID NO: 306287 - RNA, 64 nt, Human
augcuucccuggacugcggggaggggcggggggagggagggauuucuuaucccguuuguuacau

SEQ ID NO: 306288 - RNA, 64 nt, Human
guccccugcccugauagggcuuaccugugggugggggagggagaccacacaugucagagguagu

SEQ ID NO: 306289 - RNA, 64 nt, Human
ccagcagcccugucacgccgggcucuacgucccagggagggaggggcggcccacacccaggccc

SEQ ID NO: 306290 - RNA, 54 nt, Human
aguucucacucacgcccugacccgggcagacaugauggggggugcagggggcug

SEQ ID NO: 306291 - RNA, 64 nt, Human
agacaaaaccuuuucuccuguguaucuuugaaguggcagacaaggcgaagcaucagacugguau

SEQ ID NO: 306292 - RNA, 64 nt, Human
gcuggugggugggggugguucguucucuagccggggcagacacccagcuggcuggguccuuccu

SEQ ID NO: 306293 - RNA, 64 nt, Human
ucagcacagagagcggcuuccccauugccuucuggggagggacacagaggacagcuuccccauc

SEQ ID NO: 306294 - RNA, 64 nt, Human
uuagcacagaggauggcuuccccauugccuucuggggagggacacagaggacggcuuccccauc

SEQ ID NO: 306295 - RNA, 64 nt, Human
gaggacuuuggaacugugaauauacuuccugaaggggagggagaagggaggaagcucccauguu

SEQ ID NO: 306296 - RNA, 64 nt, Human
ccuuuccgcauguggaagagugggaggaagcagagggagggacugggcagggacugccggcccc

SEQ ID NO: 306297 - RNA, 64 nt, Human
uuacugucugacuacaacaugcaucaugcucauggggagggagcaggggaagguuguauguguc

SEQ ID NO: 306298 - RNA, 64 nt, Human
gcaacauuuuuaaauccuuacucauacacuuguugggagggauguacaaugcauauucccaaac

SEQ ID NO: 306299 - RNA, 64 nt, Human
ucccugucuuagacuuugaauguugacccucacagggagggauaauuuagacucugguauggcc

SEQ ID NO: 306300 - RNA, 64 nt, Human
ugccacaggguuucuugucaguccuuugggaaaugggagggaguaguuuggggaggaggguggg

SEQ ID NO: 306301 - RNA, 64 nt, Human
cccccucaagccccagcagcccucaacaggcccagggagggaagugugagcgccuugguaugac

SEQ ID NO: 306302 - RNA, 64 nt, Human
aaugucuuguuuuaauuuguguuuuuuggggggagggagggagugaacuugcugauucuguagc

SEQ ID NO: 306303 - RNA, 64 nt, Human
gcaaaaugucuuguuuuaauuuguguuuuuuggggggagggagggagugaacuugcugauucug

SEQ ID NO: 306304 - RNA, 64 nt, Human
cgcuucucaaugugugucacccggaaccugggaggggagggaacacugggguuuaggaccacaa

SEQ ID NO: 306305 - RNA, 64 nt, Human
gaauuucucuccuuacacgcacugauuuucaagugggagggaauuaggggcuuauguauauugg

SEQ ID NO: 306306 - RNA, 64 nt, Human
aaaaaaaaaaauuaauaagacauggauacaaccagggagggagguuauaauaauagagcauccu

SEQ ID NO: 306307 - RNA, 64 nt, Human
augaauaggaggcauggaaguagaugugccaauggggagggaugaggagugaacaugaauauua

SEQ ID NO: 306308 - RNA, 64 nt, Human
ucguagggggugaguugaguguggcugggagagugggagggaagcccucagcccaggcuguugu

SEQ ID NO: 306309 - RNA, 64 nt, Human
gggcagacuagggaguagggcuggcaggggagggggcagacagccucgccucgcacccuucauc

SEQ ID NO: 306310 - RNA, 64 nt, Human
cuggguuucaagcacaaaacugggcggccauucgggcagacaccgagcuagcuguaggaguuuu

SEQ ID NO: 306311 - RNA, 64 nt, Human
gaggaaacuuaccaccuugguugagcggcuucauggcagacagcagcgagccagcggccggacu

SEQ ID NO: 306312 - RNA, 64 nt, Human
ucuggaaacuuguggguggggcccagggaggauggggagggaguggcccaggccugccccuucg

SEQ ID NO: 306313 - RNA, 64 nt, Human
uuaauuuauuagcgcugcucugcaccccucccuugggagggagacuucaugugguuuauugcga

SEQ ID NO: 306314 - RNA, 64 nt, Human
ugucggugugguccuagaugaagcauuggggugggggagggagagggagcuuuguguuaagugc

SEQ ID NO: 306315 - RNA, 64 nt, Human
agaucagagauagaggaaguggaaccagagagcugggagggaccaagguuguaaggauggcuaa

SEQ ID NO: 306316 - RNA, 64 nt, Human
agaucagagauagaggaaguggaaccagagagcugggagggaccaagguuguaaggguggcuaa

SEQ ID NO: 306317 - RNA, 64 nt, Human
ccagggaccugggucucugggagaggaaggaagagggagggagcaaagagauugggguaugucc

SEQ ID NO: 306318 - RNA, 64 nt, Human
ccagacugacuugugagugggguuuauggggaaagggagggacugagggcagagucucuggguu

SEQ ID NO: 306319 - RNA, 64 nt, Human
acagaggcaggaugggugcaaggcagggguggaggggagggaccagcccgggcugcaccagugg

SEQ ID NO: 306320 - RNA, 64 nt, Human
uuaggccugaccagugcgagugcgcccccggcuggggagggaagcacugucaugugggugaguc

SEQ ID NO: 306321 - RNA, 64 nt, Human
ccgccccccucuaggagagcuggcucugcagugggggagggaugcagggacauuuacugaagga

SEQ ID NO: 306322 - RNA, 64 nt, Human
ggaggguggggccgugguccccucagccuccauggggagggaagaagggggagcucuuuuuuua

SEQ ID NO: 306323 - RNA, 64 nt, Human
ggccugaccccaugguggggggaggggaggggaggggagggaaugaggcagcucuaggaucuau

SEQ ID NO: 306324 - RNA, 64 nt, Human
uuugagggggcgggcgguguguguguguucuggugggagggaucugagcaagugcaagccuggc

SEQ ID NO: 306325 - RNA, 64 nt, Human
guauggaaaagacuggaaggggaaaggaagggaagggagggagggucuguucuaucuguugcug

SEQ ID NO: 306326 - RNA, 64 nt, Human
agugguccggcaagaagggagacacagcugcccugggagggaagaaguccaagaagaagagcag

SEQ ID NO: 306327 - RNA, 64 nt, Human
ugaauauagggcccagauggaccaaguggggccggggagggaugaauaaacacccuaccccgug

SEQ ID NO: 306328 - RNA, 64 nt, Human
cucaggaagccggccugcagcaggagcagaggaaggcagacacccacaagaagaugacugaguu

SEQ ID NO: 306329 - RNA, 64 nt, Human
aggcugcauaacuuguucgugaagauauaacagaggcagacagaauccagagggcuacagagaa

SEQ ID NO: 306330 - RNA, 58 nt, Human
gggaaccugcuggcuacugauugcuccaggcagacaaggcugacaagcaauccaggga

SEQ ID NO: 306331 - RNA, 64 nt, Human
cugguggggucacccucccuguccucccgccugugggagggagggagggcuggcucaggcaucg

SEQ ID NO: 306332 - RNA, 64 nt, Human
uggggucacccucccuguccucccgccugugggagggagggagggcuggcucaggcaucgucuc

SEQ ID NO: 306333 - RNA, 64 nt, Human
ccucugagucacugaaugucaccaggagaggugggggagggaaagugggccaguggggaggggg

SEQ ID NO: 306334 - RNA, 51 nt, Human
agaaugagauucaccaguaaggggagggaggggcccuggaggccacauccu

SEQ ID NO: 306335 - RNA, 64 nt, Human
acuuggggguuucacugcucucccccaugauggagggagggagccccccaaccucagugaggag

SEQ ID NO: 306336 - RNA, 64 nt, Human
acggcgugugcugggcccggaucuccaggcccuggggagggagccucuggacggacagugggga

SEQ ID NO: 306337 - RNA, 64 nt, Human
auucaaagacuuauuuugaaaguuggaaggagaagggagggaagagagcagaagggaagaaggu

SEQ ID NO: 306338 - RNA, 64 nt, Human
aaaaaugaaauuugggggcaggggaaggggaggcgggagggaggggaagcucgcaagcccgggg

SEQ ID NO: 306339 - RNA, 64 nt, Human
aguuugucugggccacacuggggcagaggggggagggagggauacagagauggaugccacuuac

SEQ ID NO: 306340 - RNA, 64 nt, Human
uuucaguuugucugggccacacuggggcagaggggggagggagggauacagagauggaugccac

SEQ ID NO: 306341 - RNA, 64 nt, Human
ggccuguccggcccuacuucagucugaguuacucgggagggaaaagugcagcuccucugaucau

SEQ ID NO: 306342 - RNA, 64 nt, Human
gugaggguagggugagggaggacaggccaguagggggagggaaagggagaggggaagggcaggg

SEQ ID NO: 306343 - RNA, 64 nt, Human
aagcuuuguaccucuuuugcaggaucuggggguggggagggacaagcuaguuccccaaccuccu

SEQ ID NO: 306344 - RNA, 64 nt, Human
auuuccuucucuuagaagugcauguauauguggagggagggaaaaggguccuauagaaugaggg

SEQ ID NO: 306345 - RNA, 64 nt, Human
aagccccugcuccacagaguagauugcacauggagggagggagagggggcguguugaacauccu

SEQ ID NO: 306346 - RNA, 64 nt, Human
uaagaaggaaggaaggaagaaaggaaggaaagaagggagggaaacagggagaaagggaaaaaga

SEQ ID NO: 306347 - RNA, 64 nt, Human
cagucuugacgaggagcaaaccccgccuucagagggcagacaaagcagguggcaugaauugauc

SEQ ID NO: 306348 - RNA, 64 nt, Human
ccuccuuccagcccagaguggcccaguagagcaaggcagacagugaccuccacccccgcagccc

SEQ ID NO: 306349 - RNA, 64 nt, Human
agagggcaacccugggccccacaccguguggacaggcagacaccagauuguccaggagcaggag

SEQ ID NO: 306350 - RNA, 64 nt, Human
gggagagcggcgggaggggccgcggugccgggccgggagggaagagggaggcugcacgcucggc

SEQ ID NO: 306351 - RNA, 64 nt, Human
agcuccuccagcaagcagggcugcagugggagcugggagggagcagugcaccugccagcguggc

SEQ ID NO: 306352 - RNA, 64 nt, Human
acuccccucgggucagcggcugcggccuggcccugggagggauuucagaugccccugcccucuu

SEQ ID NO: 306353 - RNA, 64 nt, Human
gaugggguugcugcaguguuggaguaggggcagagggagggagccaaggucacuccaauaaaac

SEQ ID NO: 306354 - RNA, 64 nt, Human
ggcucuuuuucagcuaacccugggaaggcucugugggagggaggucggagccagcuguuucucg

SEQ ID NO: 306355 - RNA, 64 nt, Human
gaucucggucacagggaggaaggcagcuagaaaugggagggaagcuucuggguaggcaccauag

SEQ ID NO: 306356 - RNA, 51 nt, Human
uuaagaacuccaucaaguagagggagggagcuggggcacuggagccuggcc

SEQ ID NO: 306357 - RNA, 64 nt, Human
agcaagaacagaguccacccuccucuggauauuggggagggacggaagugacaggguguggugg

SEQ ID NO: 306358 - RNA, 60 nt, Human
uucaaaaggagcaagaaugagccugcgguugggagggaauggggcgugggggguuagagc

SEQ ID NO: 306359 - RNA, 64 nt, Human
cacuuuugagcccucaucaagcucucauugugaugggagggauaccuuuuuguuguuaaaagcc

SEQ ID NO: 306360 - RNA, 64 nt, Human
uuucugggacucccggcacaacuccccucauccagggagggaggcagcugcuggggaggggcuu

SEQ ID NO: 306361 - RNA, 64 nt, Human
ggcagggccugaccuggaggagugaugguugagggggagggauuuuuuucaaaugaucaguccc

SEQ ID NO: 306362 - RNA, 64 nt, Human
acacuaacucuggguggcuguccccaccgugcaggggagggaguccgcagccucccuucacugg

SEQ ID NO: 306363 - RNA, 64 nt, Human
guuaaaggggcuaggacuagggugagagggaguggggagggagagggcaggaaggaggcagagc

SEQ ID NO: 306364 - RNA, 64 nt, Human
guauuugagaauuacgguuugaagugauuucugugggagggaaucauugcaauguauauucuaa

SEQ ID NO: 306365 - RNA, 64 nt, Human
ucaaauaacuaucuugggggugagaggagaaggagggagggaaaaggggucaggcacacuggac

SEQ ID NO: 306366 - RNA, 64 nt, Human
aggaccagccugacgcacacgcuccuguugucauggcagacagccgccuugggugggcaccacc

SEQ ID NO: 306367 - RNA, 64 nt, Human
uaggcucugauuuccggggcagccuuucagaugcggcagacauacaacaccuguacuuuagagu

SEQ ID NO: 306368 - RNA, 64 nt, Human
ggcggggcucaagucgcgaggcggggaagcgggaggcagacacggacgagggcgacacagacac

SEQ ID NO: 306369 - RNA, 64 nt, Human
ccggggggcagcaggugggcucgggacgggcugggggagggacggccauggcacuugggggcuc

SEQ ID NO: 306370 - RNA, 64 nt, Human
gaggaaguauagaaacaaagcguguguuuuugaugggagggaaaaugagguaauggugugugug

SEQ ID NO: 306371 - RNA, 64 nt, Human
caaacaaacaaacaaacaaaaaaagggugggggagggagggaaagagaagagcucugcacuucc

SEQ ID NO: 306372 - RNA, 64 nt, Human
aaaacaaacaaacaaacaaacaaaaaaagggugggggagggagggaaagagaagagcucugcac

SEQ ID NO: 306373 - RNA, 64 nt, Human
gcucagagaugaagcagugaaagagacaggaauugggagggaaagggagaaugguguacccuuu

SEQ ID NO: 306374 - RNA, 64 nt, Human
ucccaugaguugggggucgggugggggagggaaagggagggaugaccuucccagggagaaaccc

SEQ ID NO: 306375 - RNA, 64 nt, Human
uuuauuuuuuucccaugaguugggggucgggugggggagggaaagggagggaugaccuucccag

SEQ ID NO: 306376 - RNA, 64 nt, Human
uuauggcaguacugaagagaaaugggaaagaagagggagggagagagaaagacgaagggagaga

SEQ ID NO: 306377 - RNA, 64 nt, Human
uuuugggaguggcagcccaggauggacagcaguggggagggaaccauuuggcauaaggccguug

SEQ ID NO: 306378 - RNA, 64 nt, Human
uguucccuugaggugccuccucuccucugcccaggggagggaguguggacaguaucuggaaguu

SEQ ID NO: 306379 - RNA, 64 nt, Human
gcuucaggacggggcgucagagggagcccccucugggagggaaccaacccccacccucccuccu

SEQ ID NO: 306380 - RNA, 64 nt, Human
gagcucccaguaggggcuggccacggccaggugugggagggacuucgaagauaagagugagcgg

SEQ ID NO: 306381 - RNA, 64 nt, Human
acccaggggucuggccuccagggaccuagagaaugggagggagaacggggccccaggagacccg

SEQ ID NO: 306382 - RNA, 64 nt, Human
ucuguauucacuugauuauucugacccuuccuaagggagggagguggauuagauaccacuggag

SEQ ID NO: 306383 - RNA, 64 nt, Human
ccaagugccguuuggauggggaagggaaagacuggggagggagagugaacuccgaggggugucc

SEQ ID NO: 306384 - RNA, 64 nt, Human
uacauauaaacacuggaggggagggagggagggagggagggagagaauggcccgagggaggagg

SEQ ID NO: 306385 - RNA, 64 nt, Human
gccaccaaguauagaugcuggaucuuggguuccaggcagacaucauccagguccaucuggaacu

SEQ ID NO: 306386 - RNA, 64 nt, Human
agcacgaaucaugauucugcuuucuguuagcuuaggcagacauugggccuucaccuacaaguuu

SEQ ID NO: 306387 - RNA, 64 nt, Human
gcaucauuaacaccuuccccacccccuccccgcaggcagacagugaagagaaucagaaaacaug

SEQ ID NO: 306388 - RNA, 64 nt, Human
cccuuacauauaaacacuggaggggagggagggagggagggagggagagaauggcccgagggag

SEQ ID NO: 306389 - RNA, 64 nt, Human
aguacccuuacauauaaacacuggaggggagggagggagggagggagggagagaauggcccgag

SEQ ID NO: 306390 - RNA, 63 nt, Human
accaguacccuuacauauaaacacuggaggggagggagggagggagggagggagagaauggcc

SEQ ID NO: 306391 - RNA, 59 nt, Human
accaguacccuuacauauaaacacuggaggggagggagggagggagggagggagagaau

SEQ ID NO: 306392 - RNA, 64 nt, Human
agggagguggggguagaaguaaaaggaugaucaugggagggagcugagggguuaauauauauac

SEQ ID NO: 306393 - RNA, 64 nt, Human
gaggagugagauagaacuugggagcccggggguugggagggacagggauaaauaaagacaaaga

SEQ ID NO: 306394 - RNA, 64 nt, Human
guuucuaaaguguuuaccagaugcugaaggcaaggggagggagcagaagcacuuauguuuacgg

SEQ ID NO: 306395 - RNA, 64 nt, Human
cagccaggaugggguggggagcgguggcacucgugggagggagaggacccccgcccacauccuc

SEQ ID NO: 306396 - RNA, 64 nt, Human
aaacacccccaggaggccaagccugaaaacagaggggagggaggaaggaaggagucccagcagg

SEQ ID NO: 306397 - RNA, 64 nt, Human
uccuagugucuguuagcaucuuccuuuucauggggggagggaagauaaagugaauugcccagag

SEQ ID NO: 306398 - RNA, 64 nt, Human
uuuggcugggggagugugaguuuugccuuucuaagggagggaccgcgcaggcuccuuuguucug

SEQ ID NO: 306399 - RNA, 64 nt, Human
cacuggagagcuuuuugcaauaugcuggggaaaggggagggagggaaugaaagugccaaagaaa

SEQ ID NO: 306400 - RNA, 64 nt, Human
ggagagcuuuuugcaauaugcuggggaaaggggagggagggaaugaaagugccaaagaaaacau

SEQ ID NO: 306401 - RNA, 64 nt, Human
cucagaccccugccuuggcuuucccagacauucagggagggaucauagguccaggcuugagcuc

SEQ ID NO: 306402 - RNA, 64 nt, Human
ccuugacauccccagaaucucggucuuugggguggggagggagggaggagggagguggaguugg

SEQ ID NO: 306403 - RNA, 64 nt, Human
gacauccccagaaucucggucuuugggguggggagggagggaggagggagguggaguugggaug

SEQ ID NO: 306404 - RNA, 64 nt, Human
aaguaauuuuuaaauauuuguaauauuguugacugacuaauaaacuauuaaguuauuggcauag

SEQ ID NO: 306405 - RNA, 64 nt, Human
uuuauguauugauggggacuuuuccaccucauuagacuaauacucauucaaaaagaguuugguu

SEQ ID NO: 306406 - RNA, 64 nt, Human
uuuuaaguuugauuuccugucuguaauuuucaaggacuaauauagcaaauuuuucuucugccau

SEQ ID NO: 306407 - RNA, 64 nt, Human
uacaacaaguuuguguaucagagcgggagugcgggggagggaaagaaaacaaacaguuucagaa

SEQ ID NO: 306408 - RNA, 64 nt, Human
cuccccucugccucugagggcuucaguauugauggggagggaggccuaaguaccacucauggag

SEQ ID NO: 306409 - RNA, 64 nt, Human
gagagcacguggcggcuucugggggccauguuuggggagggaggugugccagcagccuggagag

SEQ ID NO: 306410 - RNA, 64 nt, Human
ugauguggagguacagggcagaucuucccuaccggggagggauggaugguuggauacagguggc

SEQ ID NO: 306411 - RNA, 64 nt, Human
uccguguuuaagugauucucccgggggcaggguggggagggagccucggguggggugggagcgg

SEQ ID NO: 306412 - RNA, 64 nt, Human
ccaucccauuggagucucuucuuuuuuugauagcgggagggaggaaguacgacuaauguuggag

SEQ ID NO: 306413 - RNA, 64 nt, Human
ugugcuuugacauucuagcacuucagggaugagagggagggagaauccuggaugcuggauggag

SEQ ID NO: 306414 - RNA, 64 nt, Human
uuucuauccuuuuagagucuuauuugauuauggugggagggaauguuuucaaauuucccauuuc

SEQ ID NO: 306415 - RNA, 64 nt, Human
accuggggaucuggacccugcgggugaagggauggggagggacgucccuggagucucuucuguc

SEQ ID NO: 306416 - RNA, 64 nt, Human
aucaagggacaggccaggagccaggaguggggaagggagggaugaaaggggacacaagucccug

SEQ ID NO: 306417 - RNA, 64 nt, Human
gggggagcaugccugucucucagugauagaguaugggagggaccucccuagcuuggaaaaugag

SEQ ID NO: 306418 - RNA, 64 nt, Human
agagcaaguaguaauaaccaccguguagacaagugggagggaagaauagaauggcacuguccag

SEQ ID NO: 306419 - RNA, 64 nt, Human
gggugcugcacuuuauuuuuguucgguuuuugaugggagggaaagaguacugaaauguuuugua

SEQ ID NO: 306420 - RNA, 64 nt, Human
aaagaaauauauauaaccuuguuauuguauuugggggagggauacugggauaauuuuuauuuuc

SEQ ID NO: 306421 - RNA, 64 nt, Human
uugaauuguaguucccauaauccccacauguugugggagggacccagugggagguaauuaaauc

SEQ ID NO: 306422 - RNA, 64 nt, Human
gaccccuuuuagagcugggcugccuggggggagugggagggagguggggagagcuagcccaggc

SEQ ID NO: 306423 - RNA, 64 nt, Human
ugugccgugacagggcucccgagucaugcacucaggcagacagcaggcuggagcccagcauuca

SEQ ID NO: 306424 - RNA, 64 nt, Human
agucugagcaagagaccugcagccccuguuucguggcagacagcaggugccuggcggugaccca

SEQ ID NO: 306425 - RNA, 64 nt, Human
gugccagcacgggaucccugaagugacucagccaggcagacaugagacauggcggaguguccaa

SEQ ID NO: 306426 - RNA, 64 nt, Human
guuccccugaauagcaacuuuacaagguccaugugggagggaccaacccagaugcccugcugag

SEQ ID NO: 306427 - RNA, 64 nt, Human
gcauucagagaggagggagaggaggaagaggaaggggagggaagcuucccaagaguagccucaa

SEQ ID NO: 306428 - RNA, 64 nt, Human
ugcagucauuccacauggccuguuggaaggccuggggagggaacuuuggguuugggacagauuu

SEQ ID NO: 306429 - RNA, 64 nt, Human
augaaaaagugggagggcuggcuugggcugagaagggagggacagaaaagagaagacagaacaa

SEQ ID NO: 306430 - RNA, 64 nt, Human
auacuugguauaagguaguagauuguuggggguggggagggagggaucuaggauacagggcagg

SEQ ID NO: 306431 - RNA, 64 nt, Human
uugguauaagguaguagauuguuggggguggggagggagggaucuaggauacagggcagggaua

SEQ ID NO: 306432 - RNA, 64 nt, Human
cgaaagaaaagucaggaagguagagagagaaaaagggagggaaggagaaagaaugggaauaaaa

SEQ ID NO: 306433 - RNA, 64 nt, Human
ugccugugauuccggcuacuugggaggcugaggugggagggauugcuuaagccugggaggcaga

SEQ ID NO: 306434 - RNA, 64 nt, Human
ucugguugcaggagagaaccagagggugggaacggggagggaagaacugagggucugcagacug

SEQ ID NO: 306435 - RNA, 64 nt, Human
gcugguguuggucagaugcaccugugugcacugggggagggaugguuugggcaggugcagaucc

SEQ ID NO: 306436 - RNA, 64 nt, Human
gaguacuuuucuccacgagcccucuggccacugugggagggaaggacaaggguucccuuggaaa

SEQ ID NO: 306437 - RNA, 64 nt, Human
uugagggcgaagggcagagcguuuguguguucuggggagggaaggaaaagguguuggaggccuu

SEQ ID NO: 306438 - RNA, 64 nt, Human
aucccccagcccuggcuccuagguccucccaacugggagggaguccuccgugccucacuuagag

SEQ ID NO: 306439 - RNA, 64 nt, Human
aagcuuugagccuccugccccugcuuucugcccagggagggagaaggaagagggggagcugguu

SEQ ID NO: 306440 - RNA, 64 nt, Human
ugugaccuugguccaggaguucuauuuguuccuggggagggagguuuuuuuguuuguuuuuugg

SEQ ID NO: 306441 - RNA, 64 nt, Human
uguccuucccuggccuucucuuggcucaaaggcugggagggagggaaggagagaagaguuccag

SEQ ID NO: 306442 - RNA, 64 nt, Human
uauagaaaccaaauauuuuacuguuucuuuuaaggacuaauauugucaaaaacugcuguuauua

SEQ ID NO: 306443 - RNA, 64 nt, Human
uuucguguggauguacuccaaguaaagcuccagugacuaauauguauaaauguuaaaugauauu

SEQ ID NO: 306444 - RNA, 64 nt, Human
uggacucuaaagaccaauguuuggccacuaacuggacuaauauguaucuuucugugauuucauc

SEQ ID NO: 306445 - RNA, 64 nt, Human
cuucccuggccuucucuuggcucaaaggcugggagggagggaaggagagaagaguuccaggcaa

SEQ ID NO: 306446 - RNA, 64 nt, Human
cccauccuguucgugaauaggucucagggguugggggagggacugccagauuuggacacuauau

SEQ ID NO: 306447 - RNA, 64 nt, Human
ccauacugcucauaauaacauuuuagggggaaaggggagggaauguuuaaaaagaaaguccuug

SEQ ID NO: 306448 - RNA, 64 nt, Human
cagugcauuugaacugccuucugaaagagguccagggagggauuuaggaaauaaaguuucuacc

SEQ ID NO: 306449 - RNA, 64 nt, Human
uccacagacuggaguggaccuggaacuuagagacgggagggacccgagccuggcuuuugaccua

SEQ ID NO: 306450 - RNA, 64 nt, Human
caaaccugagcccagagugagccgucugaacugugggagggaagugcuaacagcccagccucca

SEQ ID NO: 306451 - RNA, 64 nt, Human
cucacccccaccaacaccguccagagaggccugagggagggauuccaugcugccuucuccggac

SEQ ID NO: 306452 - RNA, 64 nt, Human
ccaacgcuuugugaggugcugcccguggaagccagggagggauggaccccgaaaggagaaaagu

SEQ ID NO: 306453 - RNA, 64 nt, Human
caauugcugaagguggcgaugaacacccgaaggugggagggaggacugguacccacaaagcaac

SEQ ID NO: 306454 - RNA, 64 nt, Human
acccacccaaguauuaugggaaaccuccagagaggggagggacucagauuuauauggcuuuauu

SEQ ID NO: 306455 - RNA, 64 nt, Human
ggauaucaggguauaaauuauauccgugaguugggggagggaagaccagaauucccuugaauug

SEQ ID NO: 306456 - RNA, 64 nt, Human
aaccugggggacggggguggggggugguaguggugggagggaaaccaugucuugcuaaaccugu

SEQ ID NO: 306457 - RNA, 64 nt, Human
cuuggcugagggcagggucuguguggcaggaugggggagggagucagaagggucagaugaacug

SEQ ID NO: 306458 - RNA, 64 nt, Human
auucguaguccaaucagcugaaauuaaaucacuugggagggacgcauagaaggagcucuaggaa

SEQ ID NO: 306459 - RNA, 64 nt, Human
aaauuuaagacuagauacucguguguggggugaggggagggaguauuugguauguugggauaag

SEQ ID NO: 306460 - RNA, 64 nt, Human
cccccuccccgacucccacuuccagaagcuaggagggagggauaccuggaagacuccggucacc

SEQ ID NO: 306461 - RNA, 64 nt, Human
ugcaccgaugagaacucuccuuauugcugugaagggcagacaaugcauggcugaucuacucugu

SEQ ID NO: 306462 - RNA, 64 nt, Human
ggcguccccgucuccguuggggccauuagaaugaggcagacaccaggccacucuagaagccgag

SEQ ID NO: 306463 - RNA, 64 nt, Human
gaaauuauaguuacaaugaauugcauaugaagaaggcagacauuuauuuuuaauagccaaguag

SEQ ID NO: 306464 - RNA, 64 nt, Human
uucagaccuuucagccagugcugucagugccccugggagggaagggcaucccugaggcacccga

SEQ ID NO: 306465 - RNA, 64 nt, Human
ccccggggcggcauuuuacugcucagaauuuggagggagggagcaguaccuucccggaguccac

SEQ ID NO: 306466 - RNA, 64 nt, Human
accacggggagcaaaccagcuuguucugggcucagggagggagggcgguggacaauaaacaucu

SEQ ID NO: 306467 - RNA, 64 nt, Human
ggugggcacuggagcaugcagaggaggugagagugggagggagguaacgggugccugcugcggc

SEQ ID NO: 306468 - RNA, 64 nt, Human
gauggggccucaggaggggcggagagggguggaagggagggagcugccccaccuggacccccgc

SEQ ID NO: 306469 - RNA, 64 nt, Human
cuagauagggagagagguaacaugaaucuggacagggagggagauacuauagaaaggagaacac

SEQ ID NO: 306470 - RNA, 64 nt, Human
cugcuguagaugacuacuugggccaucggggggugggagggauggggagucgguuagucauuga

SEQ ID NO: 306471 - RNA, 64 nt, Human
uuauaaaaauaaaugcuugggguaggguggaguggggagggauuaaaacccauccaaaaaauaa

SEQ ID NO: 306472 - RNA, 64 nt, Human
gaaggugagagaaaagggugggagggugagagaggggagggaggggaauaaggugugggcagua

SEQ ID NO: 306473 - RNA, 64 nt, Human
acaaggcccuccuuucuccaggccugggcuacgggggagggagagccugaggcucugcucaggg

SEQ ID NO: 306474 - RNA, 64 nt, Human
ggucuagaugcggagucagagaugggacugaauggggagggauccuuuguguucucaugguugg

SEQ ID NO: 306475 - RNA, 64 nt, Human
ggaaguacaggaucugaguccaacauugccaugggggagggaagaguguguccuggcaggaagc

SEQ ID NO: 306476 - RNA, 64 nt, Human
uuggggcaggagggaggguuuuuuuaggguugcggggagggaacugcaagugccugaggaccag

SEQ ID NO: 306477 - RNA, 64 nt, Human
uccuuuuuuaacugauccaaauacuaguagaagggggagggagagguguuggguuuuuuuuuua

SEQ ID NO: 306478 - RNA, 64 nt, Human
gcucuccccugggcacagugccacucccuuggaagggagggaaccacccgugagccccagggcu

SEQ ID NO: 306479 - RNA, 64 nt, Human
ccuccacaucguccccgucugaccccaccccggagggagggaggaccgacgcgacgcgaugccu

SEQ ID NO: 306480 - RNA, 64 nt, Human
cggguuaucuugaaagaaacaaacugacauucuaggcagacaguugucuauguggucugagggu

SEQ ID NO: 306481 - RNA, 64 nt, Human
cagcagagcucucaggaggcugagaaaccuccagggcagacagaaaguuggggccagagcuagg

SEQ ID NO: 306482 - RNA, 64 nt, Human
uggccugacccgcuuggaucagugaccauuugcuggcagacaggggagagcagcuuccagccug

SEQ ID NO: 306483 - RNA, 64 nt, Human
gauggcaauugaggguagcaaccuauuagggugggggagggaccuccauaaggcuuuuccuccc

SEQ ID NO: 306484 - RNA, 64 nt, Human
cugccucucacaccuccagguucucuaaguucuggggagggagcgccccaccugcugaggucgg

SEQ ID NO: 306485 - RNA, 64 nt, Human
cccagucacugacccugggagaccccuucugugugggagggagcgggggcuggcuagcgggccc

SEQ ID NO: 306486 - RNA, 64 nt, Human
agcugagugagagacacagagagaaggagaaagagggagggagagagagaaagagagagaaaga

SEQ ID NO: 306487 - RNA, 64 nt, Human
ugaggcaggugaagacuucauaagcucaucacaggggagggaauuaggagcagggcagcaggua

SEQ ID NO: 306488 - RNA, 64 nt, Human
aacuucauccuuuuuuuacuguugaccuauuugugggagggaugaaaggcuacaaagagcacau

SEQ ID NO: 306489 - RNA, 64 nt, Human
cauuuuagaaaggaggaaaucuaaaauaagguaagggagggaagcauggaguugucaguuuucu

SEQ ID NO: 306490 - RNA, 64 nt, Human
uaggggucucaagugacuucacccuagaagaggagggagggauucugggugggggugacucuuc

SEQ ID NO: 306491 - RNA, 64 nt, Human
gucgcugggcugugggugcuaaggguaagggagagggagggagccgggagccguagaggguggc

SEQ ID NO: 306492 - RNA, 64 nt, Human
aaggggcagaggccacaggccuggaacccuggaagggagggaggcccaugggaggccaagccug

SEQ ID NO: 306493 - RNA, 64 nt, Human
uuccgggggaaggggugacugaacugggaguccagggagggagcugaggagcccuuacccuccc

SEQ ID NO: 306494 - RNA, 64 nt, Human
agcucuggccugcgagccuguccccauugcaaaggggagggaggggcagggagcugucuaccag

SEQ ID NO: 306495 - RNA, 64 nt, Human
uucuauaccuggcuaugggagagaccccuugcaugggagggaccccuugcuauggccccuuuag

SEQ ID NO: 306496 - RNA, 64 nt, Human
gucaccuaggaagccucagauuccuucccauggagggagggagugguuugcagguggccaaguu

SEQ ID NO: 306497 - RNA, 64 nt, Human
gagugcuuucucaaucauuaauagaguuguuucugggagggacuuucauaucuggucaauguca

SEQ ID NO: 306498 - RNA, 64 nt, Human
agagagacugugauaugugcuaagaagggugugagggagggagagaugaauuuucccuggaggg

SEQ ID NO: 306499 - RNA, 64 nt, Human
auguguggcucagugccuggacaaaugaugccauggcagacaguagacagaacaacacuucccu

SEQ ID NO: 306500 - RNA, 64 nt, Human
caaagggugaaauccgcauugauggccucaauguggcagacaucggccuccaugaccugcgcuc

SEQ ID NO: 306501 - RNA, 64 nt, Human
gacgcagccugaaagagacccagacagagagacaggcagacacagccuaaaacagaccuggaca

SEQ ID NO: 306502 - RNA, 64 nt, Human
gucuaagcaagauuaacaaauuucauagaaaagugggagggagucagaaacagaguuggugcug

SEQ ID NO: 306503 - RNA, 64 nt, Human
uccuugaagaggagagcuuggguggggguugggugggagggacuugggucuuuggugcuaggag

SEQ ID NO: 306504 - RNA, 64 nt, Human
gaacaaacgaggucccuguuaggguucuacucgggggagggagggggcuccaugaaagguacgu

SEQ ID NO: 306505 - RNA, 64 nt, Human
gaguuuggugggcuuaaggucagaggaguguguagggagggauguauguggaagguaagauuca

SEQ ID NO: 306506 - RNA, 64 nt, Human
cucaaacagaaggcaguaaugagagccuacaaaugggagggaccuaagugccuaccuacucgcu

SEQ ID NO: 306507 - RNA, 64 nt, Human
auaguaucucaugaguaauguguguuuugggagagggagggaugcugauugauauuucacauug

SEQ ID NO: 306508 - RNA, 64 nt, Human
cugcuggccccaggacuucugaucucaguccucugggagggagguucgccuaggaggugccccc

SEQ ID NO: 306509 - RNA, 64 nt, Human
aacaccacuucuacacaacccuccuugguacugggggagggagagaucugacaaauacugccca

SEQ ID NO: 306510 - RNA, 64 nt, Human
ccaugaucguaagggagaaugacauucugcuugagggagggaauagaaaggggcagggagggga

SEQ ID NO: 306511 - RNA, 64 nt, Human
acuauaugaugaggagaaacugggguggcagggagggagggaggguuuaucacugcuuaacuuc

SEQ ID NO: 306512 - RNA, 64 nt, Human
gaugacuauaugaugaggagaaacugggguggcagggagggagggaggguuuaucacugcuuaa

SEQ ID NO: 306513 - RNA, 64 nt, Human
accagccucggugcucugccccaugcugggaggagggagggagggacaggugccuggagccccc

SEQ ID NO: 306514 - RNA, 64 nt, Human
gccucggugcucugccccaugcugggaggagggagggagggacaggugccuggagcccccggaa

SEQ ID NO: 306515 - RNA, 64 nt, Human
uccccugccuagagcucccucuuucaaaguauaagggagggaagaaguggugagaaguuugccu

SEQ ID NO: 306516 - RNA, 64 nt, Human
gcuuugucacuugccacauggugucucccaacaugggagggaucagccccgccugucacaauaa

SEQ ID NO: 306517 - RNA, 64 nt, Human
agccaagucaugguugguaaccauguagguucuugggagggaaugggacagggugaauaaagca

SEQ ID NO: 306518 - RNA, 64 nt, Human
gaacauaauugcuggacacugacugauguacuguggcagacagaacuaguugcugucucaauau

SEQ ID NO: 306519 - RNA, 64 nt, Human
ucucccucucccccagcuagucccugagcaauacggcagacagaugcaagaccauuuuucucca

SEQ ID NO: 306520 - RNA, 64 nt, Human
gggcccggagggaaggccacugccggccacuuggggcagacacagacaccucaaggaucuguca

SEQ ID NO: 306521 - RNA, 64 nt, Human
uucugugaaucuccucaugaauacuuuaggguaggggagggaagggagugagugaugcucaggg

SEQ ID NO: 306522 - RNA, 64 nt, Human
gcgcaguggcucacgccuguaaucccagcacuuugggagggauaggugggcggaucaccugagg

SEQ ID NO: 306523 - RNA, 64 nt, Human
aucuauggagggcagagugggcugccuggggauugggagggacagggcuuggggagcaggucuc

SEQ ID NO: 306524 - RNA, 64 nt, Human
cacuccccagccccaccccuaagugcccaaaguggggagggacaagggauucugggaagcuuga

SEQ ID NO: 306525 - RNA, 64 nt, Human
gaaauuauauaucuauccugggaugggaaaaugagggagggauacauauacggagggggaucuu

SEQ ID NO: 306526 - RNA, 64 nt, Human
caguuuucccuggaacuccuggccuuuuguggaggggagggauggagagaauaggaaucuucac

SEQ ID NO: 306527 - RNA, 64 nt, Human
ccaugugucuccuugaauugaugaggaugcuccugggagggaugcgugacuaugugguguugca

SEQ ID NO: 306528 - RNA, 64 nt, Human
cccugacugucagggagggccagggaggcagagcgggagggagucucaggaggaggcugcccug

SEQ ID NO: 306529 - RNA, 64 nt, Human
ggugcugguagcugaggggacgggcaagugagaggggagggagggaaguccugggaggauccug

SEQ ID NO: 306530 - RNA, 64 nt, Human
cugguagcugaggggacgggcaagugagaggggagggagggaaguccugggaggauccugagcu

SEQ ID NO: 306531 - RNA, 64 nt, Human
aggccuagaggccuggagcuuggggugaggaagagggagggauggacaagucugaaaaccucac

SEQ ID NO: 306532 - RNA, 64 nt, Human
ugaagacauaauuuauaccaaguuaugccaguuggggagggaaggacuaaaaauaauauugcag

SEQ ID NO: 306533 - RNA, 64 nt, Human
cagccucugcacacacauuggcggguggggugcagggagggagaggcaggggagagagaauggc

SEQ ID NO: 306534 - RNA, 64 nt, Human
gcacgggaugcgugggaggcagaaaccuaucucagggagggaaggggauggaggccagagucuc

SEQ ID NO: 306535 - RNA, 64 nt, Human
agcgucuccugggccagagagaggagaugggggugggagggacugaguugauguuggguuuuuc

SEQ ID NO: 306536 - RNA, 64 nt, Human
gcccugccccuuggccgcagaggccucagcccuggggagggagggggcacuggugcccccagcc

SEQ ID NO: 306537 - RNA, 64 nt, Human
agugaccccagggccugucucccuucuuggguagggcagacaugccuuggugccggucacacuc

SEQ ID NO: 306538 - RNA, 64 nt, Human
gagguuucuucucaucaccagcucagcuaggccgggcagacaaggacagaagacucugggccac

SEQ ID NO: 306539 - RNA, 64 nt, Human
uucacugguggccuaucuuacauaugauuucgaaggcagacaugaggaaggccuuagucacauu

SEQ ID NO: 306540 - RNA, 64 nt, Human
cgcauguagggccauccugggauggggcaccacagggagggagggagaaaagagguggguaggg

SEQ ID NO: 306541 - RNA, 64 nt, Human
uguagggccauccugggauggggcaccacagggagggagggagaaaagagguggguaggguuac

SEQ ID NO: 306542 - RNA, 64 nt, Human
guguggcugaguguauucugcgcguguguguggagggagggagggaggggagcauggugucucc

SEQ ID NO: 306543 - RNA, 64 nt, Human
ggcugaguguauucugcgcguguguguggagggagggagggaggggagcauggugucucccgcu

SEQ ID NO: 306544 - RNA, 64 nt, Human
aggagcccaggaugggacggcgcaucagccgagagggagggaacuuuucagucaaauuccucaa

SEQ ID NO: 306545 - RNA, 64 nt, Human
ggccacucaggaccccucuggcugugucggacuggggagggauaugauggagagccagccagug

SEQ ID NO: 306546 - RNA, 64 nt, Human
cugggguuuauuuaaacuguucugugugggucuggggagggagagcaccuuaauauuauugggg

SEQ ID NO: 306547 - RNA, 64 nt, Human
ugcccugcucuggggaugcacggcggcagggugggggagggagguuccucgcaggucucagccc

SEQ ID NO: 306548 - RNA, 64 nt, Human
gggcccugggugggcaagucugggcccugggguagggagggagacucaggcccacacuugggua

SEQ ID NO: 306549 - RNA, 64 nt, Human
uuuuguuucuuccuuuuuuaguucuucaaagauagggagggaagggggaacaugagccuuuguu

SEQ ID NO: 306550 - RNA, 64 nt, Human
cggugccgaggacauggacgagggacugguggcugggagggagaggagggcccuguccggcaug

SEQ ID NO: 306551 - RNA, 64 nt, Human
auaacccugugaugauguguuaauauaaaauguugggagggaauauucccaauaaaggucuuaa

SEQ ID NO: 306552 - RNA, 64 nt, Human
acccagcagcagguuaccaagggcugucuggaaagggagggacaaaaggacccagaaguagaag

SEQ ID NO: 306553 - RNA, 64 nt, Human
uugguacuuuauaguaauaaaucugaccagcagagggagggaucaggcagcaguguuuagagca

SEQ ID NO: 306554 - RNA, 64 nt, Human
gccaguaugacccacuuggacucacccccucuuggggagggaguucugggccuggccaggucug

SEQ ID NO: 306555 - RNA, 64 nt, Human
auuuuuguaaacuugaagugugugguggccgugggggagggacaugcuggcagcaggcgccuuc

SEQ ID NO: 306556 - RNA, 64 nt, Human
aaacccaaaccaaaaacgcaaaccaaagcaggcaggcagacagcugcugggggaaauccugggg

SEQ ID NO: 306557 - RNA, 64 nt, Human
cuuugucucaaaaaaaaaaaaaaaaacaauggaaggcagacagcaagucccugaggacacauca

SEQ ID NO: 306558 - RNA, 64 nt, Human
cucauuccuuggcugagggagaggcugagaacugggcagacaccccuggagcucagccgacagu

SEQ ID NO: 306559 - RNA, 64 nt, Human
uccccaguagcuacgguucccugccuaggagcuggggagggagagaucuaaucccuucaaggaa

SEQ ID NO: 306560 - RNA, 64 nt, Human
ucuccugccacauuagaacuucuccguccucgaugggagggauggcccuuccuccuccaccacc

SEQ ID NO: 306561 - RNA, 64 nt, Human
ugugcaggcucugaccaggcagaacaggcaagaggggagggaaggagaccccugcaggcucccu

SEQ ID NO: 306562 - RNA, 64 nt, Human
caagaggcgccauagacccuagcggggagggcaggggagggacggaaggcuggcaccucuucca

SEQ ID NO: 306563 - RNA, 64 nt, Human
uugcuggaaaaggugugggaagguucaggauggugggagggacugaggucccugaggugaagag

SEQ ID NO: 306564 - RNA, 64 nt, Human
guguguguguguuguguuguguuuuguuuuuuaagggagggaauuuauuauuuaccguugcuug

SEQ ID NO: 306565 - RNA, 64 nt, Human
cagccgccccaagucugaggccccguggacugcugggagggagggggcagcaggccccuggccc

SEQ ID NO: 306566 - RNA, 64 nt, Human
ucuucuucuucuuuuuuuugggggggcggggcgggggagggaucucaaaguuuuagucuuccag

SEQ ID NO: 306567 - RNA, 64 nt, Human
ucaacuggagcaggacggaagguugucuguacuugggagggaguagggaguggugggaagggag

SEQ ID NO: 306568 - RNA, 64 nt, Human
accugcgauaacccaagggauguucuggguuagggggagggaaggggagcauuagugcugagag

SEQ ID NO: 306569 - RNA, 64 nt, Human
auggccuacugaccuccccuagagggaugucuuugggagggaagaagguacagaagaaagauug

SEQ ID NO: 306570 - RNA, 64 nt, Human
gucuggcccgaggccgccccgugacugugaccgagggagggagggcugccugaucccucuccuc

SEQ ID NO: 306571 - RNA, 64 nt, Human
cugccaacuuuccagacuucgcuauucccaggcagggagggaaacccggggaacugguuuuucu

SEQ ID NO: 306572 - RNA, 64 nt, Human
ugaggacugagaaggggccuuacagaacccuaaagggagggaagguccuacaggucuccggcca

SEQ ID NO: 306573 - RNA, 64 nt, Human
ucccuucuuuuagcaauaagucuggggugagguggggagggaggcugcagggggggaggugggc

SEQ ID NO: 306574 - RNA, 64 nt, Human
uggggaagcugcuggaggagcagggguggggggugggagggaggggaaaggcaaaugcagauau

SEQ ID NO: 306575 - RNA, 64 nt, Human
ggucuuagagcauguguguauucagucagauacuggcagacaauucagaacuuucaccacauga

SEQ ID NO: 306576 - RNA, 64 nt, Human
uacgcccaccuaguggccagucccagagccgcauggcagacagcuuaaaugacuucaggagagc

SEQ ID NO: 306577 - RNA, 64 nt, Human
uagcacuauuuaaaauaagcacaccaaguuauaugacuaauauaacuugaaaauuuuuuauacu

SEQ ID NO: 306578 - RNA, 64 nt, Human
gucagaaguaauccugagaaauguuucaggccuggggagggaggggagcccccgacgccucugc

SEQ ID NO: 306579 - RNA, 64 nt, Human
acuucccuuucauaugaggggacccagcgccggggggagggaggagggcgugggcaugggcgca

SEQ ID NO: 306580 - RNA, 64 nt, Human
ugucuugggcaguuucuaucacacaugggacaaggggagggaguuuuucuaacauggaaaaaga

SEQ ID NO: 306581 - RNA, 64 nt, Human
aaagcgggugcuguagaggagcacucagcucacggggagggagcucuuggcugagcuucuacag

SEQ ID NO: 306582 - RNA, 64 nt, Human
gggcaggaacacaugguaaagggguggggaauaugggagggagugugguguggaugggggugau

SEQ ID NO: 306583 - RNA, 64 nt, Human
ucuuuucacuaaaacucuagaagguguuacaagggggagggaaggggggcaaaguccuugaaca

SEQ ID NO: 306584 - RNA, 64 nt, Human
gucuuugacuugauuaaaguaucuccgcuuucuugggagggaauaggggauguuuuaucaguga

SEQ ID NO: 306585 - RNA, 64 nt, Human
gggcauuuaauauauaccacuggugugugugggagggagggaggaggaauacuagcccuuuuua

SEQ ID NO: 306586 - RNA, 64 nt, Human
acuugggcauuuaauauauaccacuggugugugugggagggagggaggaggaauacuagcccuu

SEQ ID NO: 306587 - RNA, 64 nt, Human
cucaugaguuacuccauucaagggugagggaguagggagggagaggcaccaugcauguggguga

SEQ ID NO: 306588 - RNA, 64 nt, Human
gccaggacugaggaggaguggagggaagcagggagggagggagcaagugugaagggcacagcug

SEQ ID NO: 306589 - RNA, 64 nt, Human
ucuggccaggacugaggaggaguggagggaagcagggagggagggagcaagugugaagggcaca

SEQ ID NO: 306590 - RNA, 64 nt, Human
uuggccuggcaguggcuucagagaggaccugguggggagggagggcuuuccugugcugacagcg

SEQ ID NO: 306591 - RNA, 64 nt, Human
caccccugugauuuggagguguggagaaggggaagggagggacagcucacugguuccuucugca

SEQ ID NO: 306592 - RNA, 64 nt, Human
ggcucuggaaggaugggccagcuugcagggguuggggagggagacauccagcuugggcuuuccc

SEQ ID NO: 306593 - RNA, 64 nt, Human
cucuugccuucuaagcuacugugcuugucugggugggagggagccugguccugcaccugcccuc

SEQ ID NO: 306594 - RNA, 64 nt, Human
caacugacaaguuaaaaaggucuaugaucuugagggcagacagcagaauuccucuuauaaagaa

SEQ ID NO: 306595 - RNA, 64 nt, Human
uagugacccucagagucuucuccccuuaggacaaggcagacaccccaccaugcgggccucaggu

SEQ ID NO: 306596 - RNA, 64 nt, Human
gguguggaguccagggcugcuaggaaaaggaaugggcagacacagguguaugccaauguuucug

SEQ ID NO: 306597 - RNA, 64 nt, Human
gagauggaucauaaguaaaugagcagugugagaggggagggauggguaggugcuuuccaaauac

SEQ ID NO: 306598 - RNA, 64 nt, Human
gugcuggggugacaaagccccgagcuguggugaugggagggaggaagcgccgguuuaugucugu

SEQ ID NO: 306599 - RNA, 64 nt, Human
agaggcugaacaaaggacgcauguggagcgcauggggagggaaggcuggggugcagggcuccgg

SEQ ID NO: 306600 - RNA, 64 nt, Human
cucggcugcuaggccccucgccuggacuggacuggggagggaaagcgccuuuuccugcagcucu

SEQ ID NO: 306601 - RNA, 64 nt, Human
gggcgcccacacuggcccugcagugaugcagggcgggagggagauaagaagaccccgcagucaa

SEQ ID NO: 306602 - RNA, 64 nt, Human
agacuuuauauaaauguuuaaaacauagggguaagggagggagggagaauuuuuguauagaaug

SEQ ID NO: 306603 - RNA, 64 nt, Human
uuuauauaaauguuuaaaacauagggguaagggagggagggagaauuuuuguauagaaugaaac

SEQ ID NO: 306604 - RNA, 64 nt, Human
ccuccuugcccaccugccugcccccgggcagcacgggagggagagcagggugagcacgcuuguu

SEQ ID NO: 306605 - RNA, 64 nt, Human
aguugcagggccuccgcagcuggacagagagugggggagggagggacagacagaaggccaaggc

SEQ ID NO: 306606 - RNA, 64 nt, Human
gcagggccuccgcagcuggacagagagugggggagggagggacagacagaaggccaaggcccga

SEQ ID NO: 306607 - RNA, 64 nt, Human
agguuugcuugugaaaugaggcugggugggagcggggagggacuagaucagaagagaucaaggg

SEQ ID NO: 306608 - RNA, 64 nt, Human
aauaaaggcugugacacaaggaagccaguggggugggagggaggcaccauaaucccucccuaaa

SEQ ID NO: 306609 - RNA, 64 nt, Human
ucugggggguggggaggaggaagccguugaaucugggagggaaguggagguugcuguacaggaa

SEQ ID NO: 306610 - RNA, 64 nt, Human
uuucagggaacugggaacuuaggggacugagcuggggagggaggcaggugggugguaagaggga

SEQ ID NO: 306611 - RNA, 64 nt, Human
agagaauguaccuuaagggggagggcuagugugggggagggaggcuuccccagccuuaagagac

SEQ ID NO: 306612 - RNA, 64 nt, Human
uugggguggggaagggaagggcgggcaaggaguggggagggagucuggggugggagggaggcau

SEQ ID NO: 306613 - RNA, 64 nt, Human
uguccuucagucuucuagaaacagagacaagaaaggcagacacaccgcggccaggcacccaugu

SEQ ID NO: 306614 - RNA, 64 nt, Human
cacaauuucugccaaagauugauggcaaaaagauggcagacacaagcaguacggaugaagacuc

SEQ ID NO: 306615 - RNA, 64 nt, Human
uucacuaucuggaaaaugggcucaaugcaaagguggcagacauuuauggacacccgccacgugg

SEQ ID NO: 306616 - RNA, 64 nt, Human
agggcgggcaaggaguggggagggagucuggggugggagggaggcaucugcaugggucuucuuu

SEQ ID NO: 306617 - RNA, 64 nt, Human
gugauauaaugccuggaaccugguugggcaguaggggagggagguagaaggaaaagugugagau

SEQ ID NO: 306618 - RNA, 64 nt, Human
cagugaaauagaaagccuuucuauuuuuuggugcgggagggaagaccucucacuuagggcaaga

SEQ ID NO: 306619 - RNA, 64 nt, Human
ugcccuaaguccugugagaagaugucagggacuagggagggagggagggaaggcagagaaaaau

SEQ ID NO: 306620 - RNA, 64 nt, Human
cuaaguccugugagaagaugucagggacuagggagggagggagggaaggcagagaaaaauuacu

SEQ ID NO: 306621 - RNA, 64 nt, Human
guccugugagaagaugucagggacuagggagggagggagggaaggcagagaaaaauuacuuagc

SEQ ID NO: 306622 - RNA, 64 nt, Human
uccuucuuggugugucuggagggugggcaaggcugggagggauaucaacuuggaggagaacacc

SEQ ID NO: 306623 - RNA, 64 nt, Human
ggucccugcccccaccacucuggguuccauuugugggagggagggcucauccacaucauggaga

SEQ ID NO: 306624 - RNA, 64 nt, Human
ucucgcacuuacucuccucaacaggaugggguaagggagggaggaacucaaccaucaaaaugug

SEQ ID NO: 306625 - RNA, 64 nt, Human
gugaggauuuaucucaaaaaccaacauccaaaaugggagggagauguggcuugaggucaagcgc

SEQ ID NO: 306626 - RNA, 64 nt, Human
aaaggaugcucgcaccaaguguucuguaggcuuggggagggaucguuucucuguuuuguuaaau

SEQ ID NO: 306627 - RNA, 64 nt, Human
ugggaacauuccaacuugcuaagcaggguccacugggagggaagcucuaucugggaacucaccc

SEQ ID NO: 306628 - RNA, 64 nt, Human
guuguaaaggaacagccccagugcacugggggaggggagggagugaggggcaguggugcccuuc

SEQ ID NO: 306629 - RNA, 64 nt, Human
auguaaauauaaauuugguugagaucuggagggggggagggagcuauuagagaaggaugaggca

SEQ ID NO: 306630 - RNA, 64 nt, Human
cacacaccgggccugucaugggguggggggaggggggagggauagcauuaggagauauacuaac

SEQ ID NO: 306631 - RNA, 64 nt, Human
auccaguguugucaugcauugguuagucaaaauggggagggacuagggcaguuuggauagcuca

SEQ ID NO: 306632 - RNA, 64 nt, Human
agccgugaugucauuucuguauuucaggaagacuggcagacaguugcuuucauucuuccucaaa

SEQ ID NO: 306633 - RNA, 64 nt, Human
agccgugaagucauuucuguauuucaggaagacuggcagacaguugcuuugauucuuccucaaa

SEQ ID NO: 306634 - RNA, 64 nt, Human
guacccauaaaaaccccaggcuccacuggcagacggcagacaaggggagaagagacgaagcagc

SEQ ID NO: 306635 - RNA, 64 nt, Human
ugucacugacccuggccugugguggucugagcuggggagggaaggacaccaaugaaucagcuug

SEQ ID NO: 306636 - RNA, 64 nt, Human
agacgaugccgacuggaagggagggagagggagggggagggagaaaauggggcuaugccuggcu

SEQ ID NO: 306637 - RNA, 64 nt, Human
uggggcugugggcagcagacgaugccgacuggaagggagggagagggagggggagggagaaaau

SEQ ID NO: 306638 - RNA, 64 nt, Human
cgucagcccuccaacccccagaggggcgccuguggggagggaaccaggaggccacacuggggga

SEQ ID NO: 306639 - RNA, 64 nt, Human
ugccaauacccugcucuuuacucaaugguacccagggagggagcaugggaagagggugagcuga

SEQ ID NO: 306640 - RNA, 64 nt, Human
guuguacacaguugauauuccaaauuguauggaugggagggagaggugucuuaagcuguaggcu

SEQ ID NO: 306641 - RNA, 64 nt, Human
ccuggcauuaauggaggcggaggagcagccuuacgggagggauggagggaggcaggcuggggag

SEQ ID NO: 306642 - RNA, 64 nt, Human
uacucagguuuucuccuugguccugcaguaggaugggagggaagguuaaaguugccagcuugag

SEQ ID NO: 306643 - RNA, 54 nt, Human
cagacagucccacucucugaaggagggagggacacuuacccaaggcucuucucc

SEQ ID NO: 306644 - RNA, 64 nt, Human
uaaguuaugaugacgggucagguagagugagcuggggagggaaguggauccauuucugcuaagg

SEQ ID NO: 306645 - RNA, 64 nt, Human
ucucccucccucccauuguagccuugcugcccaggggagggauaugucuuccuuuaugcaucug

SEQ ID NO: 306646 - RNA, 64 nt, Human
gggugguguauccuugggagagauauaaaguggagggagggagccguccggucaguagggcacc

SEQ ID NO: 306647 - RNA, 64 nt, Human
aaccaagagccugggucccucccacuacuaucuugggagggagaagggauggagcaggagcggg

SEQ ID NO: 306648 - RNA, 64 nt, Human
ugugaguccaaguaaaugaucacuuuauuugcuagggagggaaguccuagggugguuucaguuu

SEQ ID NO: 306649 - RNA, 64 nt, Human
ggaauguaaucuugaugccuugauacugagacuugggagggaaacuaagaaaugguugacagcg

SEQ ID NO: 306650 - RNA, 64 nt, Human
aacugagcauguguccuguuuuaagugguggacugggagggaagugucaacuucugaggucuuu

SEQ ID NO: 306651 - RNA, 64 nt, Human
gggccauguguguuugcaugaggaacucuuuaguggcagacaccuaagagacggcugcggucac

SEQ ID NO: 306652 - RNA, 64 nt, Human
acaaaagagagaaauuuuaaagcuggguguccggggcagacaucacaugucgguagguuccgug

SEQ ID NO: 306653 - RNA, 64 nt, Human
ugaaaccuguuucaacauggaaaugaucuguauugacuaauacaccaguccacacuucuaugac

SEQ ID NO: 306654 - RNA, 64 nt, Human
ucaaauuccuuaaaauauaacugagauugcuguggggagggaggagggcagaggcugcgguuug

SEQ ID NO: 306655 - RNA, 64 nt, Human
cgguucucaauaaauuacugagcagcuuuguuuggggagggaagucccuaccauccuuguuuag

SEQ ID NO: 306656 - RNA, 64 nt, Human
aaaaacagaauguuguacgugaagauucuaggaggggagggaccagcaaaucugagagaaccgu

SEQ ID NO: 306657 - RNA, 64 nt, Human
uaaaggguggaggugauauggcauucugaaaguagggagggacuaagucagucaucauacuaaa

SEQ ID NO: 306658 - RNA, 64 nt, Human
uuuaagucuagccucugcgugguagacagguauggggagggagaaugcuuuuccccucccagua

SEQ ID NO: 306659 - RNA, 64 nt, Human
gaaugaguagucaggaacuggucacuuugaaugugggagggaagauauucacgacaagguuuuc

SEQ ID NO: 306660 - RNA, 64 nt, Human
uguuugcaauguuauuucaccacacagugugguagggagggaacugauauguugcaaugcaaag

SEQ ID NO: 306661 - RNA, 64 nt, Human
auucuucugcaguuaaugggguagaggagggcaugggagggagggagagguggggagggagaca

SEQ ID NO: 306662 - RNA, 64 nt, Human
uucugcaguuaaugggguagaggagggcaugggagggagggagagguggggagggagacagaga

SEQ ID NO: 306663 - RNA, 64 nt, Human
ggguagaggagggcaugggagggagggagagguggggagggagacagagacagaaacagagaga

SEQ ID NO: 306664 - RNA, 64 nt, Human
aguaccauuuaauggggaggacaaaauggggcaggggagggagaaguuucugucguuaaaaaca

SEQ ID NO: 306665 - RNA, 64 nt, Human
guauauaaauccacagaaccggaugagcugcuuagggagggaauauauucaaaguguaccaagg

SEQ ID NO: 306666 - RNA, 64 nt, Human
ugguuaccagaggcugggaggcauugaagggauggggagggaagugagguugauuaauggguac

SEQ ID NO: 306667 - RNA, 64 nt, Human
guuuauuuugcaacuuacuaauacuuuauuaauggggagggacgaguagaugguaaaaagaagg

SEQ ID NO: 306668 - RNA, 64 nt, Human
uuuagcuguaagacuuggugggcggggugggguggggagggaggaaaggguaggaaggguggga

SEQ ID NO: 306669 - RNA, 64 nt, Human
aagugguaaauuggauuugcgguggaagagacaggggagggaaacgguugggguuagaucccuu

SEQ ID NO: 306670 - RNA, 64 nt, Human
acacagagauggaauagaaaagaugagaggcagaggcagacaggcgcuggacagaggggcaggg

SEQ ID NO: 306671 - RNA, 64 nt, Human
cagaggggcaggggagugccaagguuguccuggaggcagacagcccagcugagccuccuuaccu

SEQ ID NO: 306672 - RNA, 64 nt, Human
gaccuggccuucauguaagcagcugugggcugcgggcagacaggagcucagagaugcagcauga

SEQ ID NO: 306673 - RNA, 64 nt, Human
uuuugaaaaucaacuguauuggguagugggaggugggagggaagggcuuugggaaggggaugaa

SEQ ID NO: 306674 - RNA, 64 nt, Human
gccagcaagcugcccaugcaaagccgcagccuuugggagggagaagagaaggaagagcgcagag

SEQ ID NO: 306675 - RNA, 64 nt, Human
caggagauguagucguuccagggcugggggaggugggagggaucacgccuauaggugugggcac

SEQ ID NO: 306676 - RNA, 63 nt, Human
ccuugaacucugucgguugaugcugacuccugggggagggaggagucauguuggagguugggg

SEQ ID NO: 306677 - RNA, 64 nt, Human
uguguuaauaguucccauaaucccuacguguugugggagggacccagugggcaguaauuuaauc

SEQ ID NO: 306678 - RNA, 64 nt, Human
ugcucuggguuuccgugagguaaccaccuuaaaugggagggaaguuggggugucugcuuuggga

SEQ ID NO: 306679 - RNA, 64 nt, Human
cggagggccaggcaacaggcuagcaaggcccacagggagggagcagaauggagagggcaucuca

SEQ ID NO: 306680 - RNA, 64 nt, Human
cuguaagaaaucagagggagaaagggagagaagggggagggagacaacccaaacguuggagggu

SEQ ID NO: 306681 - RNA, 64 nt, Human
gggggaugauggagagcuguccaaccaagagagcgggagggagggaaggagggagggagagaga

SEQ ID NO: 306682 - RNA, 64 nt, Human
gaugauggagagcuguccaaccaagagagcgggagggagggaaggagggagggagagagauaga

SEQ ID NO: 306683 - RNA, 64 nt, Human
cuguccaaccaagagagcgggagggagggaaggagggagggagagagauagagagagagagaga

SEQ ID NO: 306684 - RNA, 64 nt, Human
auggaagaccuuucaguucaucgggaaagaaugagggagggagaauaagucagucaugcaucag

SEQ ID NO: 306685 - RNA, 64 nt, Human
uuugguagcucagugugcaucuagagugggacuggggagggagcuaagcuugggcugggcugcu

SEQ ID NO: 306686 - RNA, 64 nt, Human
aauaaucuauaauaguugaguaucucugggaauggggagggaaauuauauguaauagagcuuaa

SEQ ID NO: 306687 - RNA, 64 nt, Human
aaaugcagccacauaaaggcaguguacugggggugggagggaaggaaacaaucacauaaaauca

SEQ ID NO: 306688 - RNA, 64 nt, Human
aaauaaaaucaaacaaaacuaaguugugaaggaagggagggaaggucauagccuucuuaagcag

SEQ ID NO: 306689 - RNA, 53 nt, Human
ugguggacuugggguccuaaguggggagggacuggggccucgaagggauuccu

SEQ ID NO: 306690 - RNA, 64 nt, Human
guccccucaugggucccggguuagccuggugacaggcagacacaugcuguuggccucaagcaag

SEQ ID NO: 306691 - RNA, 64 nt, Human
agaccucaaccuguugggguuuagggcccaugauggcagacauucuaccccuuuuccuggaaaa

SEQ ID NO: 306692 - RNA, 59 nt, Human
uuuccaucucagaugacuaagccaggguagggagggaccuccugccuacuccagccccu

SEQ ID NO: 306693 - RNA, 64 nt, Human
cuugcugccuuuucuccuguccugaugggguucugggagggagaccugucgcugaugagaugaa

SEQ ID NO: 306694 - RNA, 64 nt, Human
ggccugcacuuuggagauuucuggauccuucccugggagggagaggucuccuaacucgauugga

SEQ ID NO: 306695 - RNA, 64 nt, Human
ccgugaccguguccugaguggccaccuccuccuugggagggaggccgcggcagguacucucccu

SEQ ID NO: 306696 - RNA, 64 nt, Human
ugcuuuccuggaccgggagagucccgguccccucgggagggacuccaccgccucucacacuccg

SEQ ID NO: 306697 - RNA, 64 nt, Human
gaggcccagaagcagggaugccaucuguugugcagggagggaugagguaggggacaggaugacc

SEQ ID NO: 306698 - RNA, 64 nt, Human
uuuucacccacaauucuggccauacuuaagcaaugggagggagagggaggaggggaagaucugg

SEQ ID NO: 306699 - RNA, 64 nt, Human
cccagggacaggcugugcuaccuacugggugguggggagggaagcuucuggccaugcuugggca

SEQ ID NO: 306700 - RNA, 64 nt, Human
aguacuguggcucaggauaugaugcgugaggagagggagggaacagagaugaccuuaacuuuua

SEQ ID NO: 306701 - RNA, 64 nt, Human
uugccacuuaccuuugcaaaguuaaaaaaaaggggggagggaaugggagagaaagcugagauuu

SEQ ID NO: 306702 - RNA, 64 nt, Human
gagcugguuuguuuuagagcagggcggggggugggggagggaagcggguguuggcuguuuccaa

SEQ ID NO: 306703 - RNA, 64 nt, Human
gagggcaggggccccuguggguucugggcuccaggggagggagcuggggaggccaggguauaag

SEQ ID NO: 306704 - RNA, 64 nt, Human
aaguuaacugaugauugugggguuugucauaucugggagggaagaugggugcugggagaggguu

SEQ ID NO: 306705 - RNA, 64 nt, Human
aaugaggaaagauucuccauucgagagaaugacugggagggaagaagucggggcccuccuauua

SEQ ID NO: 306706 - RNA, 64 nt, Human
ugccugcagccuugaggaaaaugucuagucacaagggagggacugcugguuucucgcagccauu

SEQ ID NO: 306707 - RNA, 64 nt, Human
cuuugggguugagggagaugggagcuagggggaggggagggagaugucuuguuguggggacuug

SEQ ID NO: 306708 - RNA, 64 nt, Human
cugucauagugaacaauuuauaagugucccauggggcagacacuccuuuuuucccaguccugca

SEQ ID NO: 306709 - RNA, 64 nt, Human
cacacgacaccccucuucccucaggaggcccgugggcagacaggggagccggggcuuugcccug

SEQ ID NO: 306710 - RNA, 64 nt, Human
gcugaggccauugcaccguuauccuggaaacugaggcagacacuccagccccuuucugggaucc

SEQ ID NO: 306711 - RNA, 64 nt, Human
accucuuuaucucaaucuauuuauuuggcauccugggagggauuuccaauaguaauuuauguga

SEQ ID NO: 306712 - RNA, 64 nt, Human
caggcuauuucuacugaugaacugcuucaggugggggagggaaacuuauuuuuauuugccugau

SEQ ID NO: 306713 - RNA, 64 nt, Human
ugauuuccaggagcugcaagggcagugagaggaagggagggaugaggagguggagugcagggga

SEQ ID NO: 306714 - RNA, 64 nt, Human
ccuugccccuugugagcuggauagacuugggauggggagggagggaguuuugucugucucccuc

SEQ ID NO: 306715 - RNA, 64 nt, Human
gccccuugugagcuggauagacuugggauggggagggagggaguuuugucugucucccuccccu

SEQ ID NO: 306716 - RNA, 64 nt, Human
agauccccuugcaugggaaacauaaagcagaauugggagggacuuuguggagacagggcuggac

SEQ ID NO: 306717 - RNA, 55 nt, Human
uuuccuuccucagauccugaucuccgggagggacagauggccaaucucuccccuu

SEQ ID NO: 306718 - RNA, 64 nt, Human
ccagcugugcccagaggacagccaggcaggcccugggagggaguuuagaaagacaguccuggug

SEQ ID NO: 306719 - RNA, 64 nt, Human
gguuuucuguuuguuugguugguuuucauuguaggggagggauuuuuuauauauauauaaaaac

SEQ ID NO: 306720 - RNA, 64 nt, Human
cuauagguugucugugaaaucgcaguccugccuggggagggagcuguuggccauuucuguguuu

SEQ ID NO: 306721 - RNA, 64 nt, Human
gcaggaccaugccaucucuguggagaaggugcuggggagggaaguccuuccagugccacaugga

SEQ ID NO: 306722 - RNA, 64 nt, Human
accgggacugugaaggguguacucccugcugugugggagggaccuagggccucuuuggaugcug

SEQ ID NO: 306723 - RNA, 64 nt, Human
uaaacugagaacuuucuuuugacaggggggaggcgggagggauaguaggugggggugaucugcu

SEQ ID NO: 306724 - RNA, 64 nt, Human
ugucucuagcgagggguggagaaucagauuuagagggagggagagucugaccuggauccugacc

SEQ ID NO: 306725 - RNA, 64 nt, Human
ugcaggggccuugggcucccaggacaggugaacagggagggaccuccccacaccuacuccaaag

SEQ ID NO: 306726 - RNA, 64 nt, Human
guguauguauuucugcugagugauaaagccagcggggagggacugauuuuuauaggaaaggagg

SEQ ID NO: 306727 - RNA, 64 nt, Human
ggcugcggacacuggcuccuuccacgucucaccaggcagacagucugccuaggacccagugccg

SEQ ID NO: 306728 - RNA, 64 nt, Human
ccugugucgucagaggcuugugauuaacuguggcggcagacacagcuuguccacagcuugggcc

SEQ ID NO: 306729 - RNA, 64 nt, Human
uucucagacuugggaccugggugccugggauccuggcagacagagguuguguccagacagccag

SEQ ID NO: 306730 - RNA, 64 nt, Human
ucuaucuagccuaggggaggacauugccuagagggggagggacugucuggguucaggggcaugg

SEQ ID NO: 306731 - RNA, 64 nt, Human
auuuccaacacuuggcgucucaaugaggauaaaagggagggacuguagguuguccagcauaagg

SEQ ID NO: 306732 - RNA, 64 nt, Human
uuuaacaaaccuuccuaggacaaaaaggagacuggggagggaagaggauuacuuuaaagcaccu

SEQ ID NO: 306733 - RNA, 64 nt, Human
aacgagaggggaagaguguacuggggguugcggggggagggauggcggguggggguggaauaaa

SEQ ID NO: 306734 - RNA, 64 nt, Human
uucagaauuagaggucccucuuuaccccagaccugggagggaaguagauguuuugccaaaauac

SEQ ID NO: 306735 - RNA, 64 nt, Human
acuauuuuaauacucagcacuagagggagggagggggagggaggagggagcaggcaggucccaa

SEQ ID NO: 306736 - RNA, 64 nt, Human
gcuuuuauagacuauuuuaauacucagcacuagagggagggagggggagggaggagggagcagg

SEQ ID NO: 306737 - RNA, 64 nt, Human
aggcucuaagcucugcggggauuggagagggauggggagggaagggaaggcagcuccaagaaga

SEQ ID NO: 306738 - RNA, 64 nt, Human
uccuccucccucagcgaccagcucucccuggaacgggagggacagggaauuuuuucccccucua

SEQ ID NO: 306739 - RNA, 64 nt, Human
gcugcuaagagggcaaggagaaggaaguacccuggggagggaagggacagaggaagcuauuccu

SEQ ID NO: 306740 - RNA, 64 nt, Human
cucuucuuccuccuuucucuucucuuccccaguggggagggaucacucaggaaaacaggaaagg

SEQ ID NO: 306741 - RNA, 63 nt, Human
ccacccugaccaggcccugagggcccagccgcggggagggacucgcaggcgucagggggcagc

SEQ ID NO: 306742 - RNA, 64 nt, Human
guggagaccccaaggagcugcagcugaacugcaggggagggaaggaggagcagccugggcugcc

SEQ ID NO: 306743 - RNA, 64 nt, Human
ugaucccaacugcagcucugcugugggggcccgugggagggaggcagaccccugggcuuuccug

SEQ ID NO: 306744 - RNA, 64 nt, Human
gccccucccgcugugguccuggaacucuucaccagggagggagcccugcgggggccgcagcuuu

SEQ ID NO: 306745 - RNA, 64 nt, Human
cuuccugguucauguguucugggggguuuggggugggagggaaugcagaugggaguugggggag

SEQ ID NO: 306746 - RNA, 64 nt, Human
accugcugcuccucauuggggggaucucuuggggggcagacaccaguuugccaaugaagcaaca

SEQ ID NO: 306747 - RNA, 64 nt, Human
auaauuacaguaaauuaaauaaagauuccuuuaaggcagacaagggcuaagauuuccuuagcag

SEQ ID NO: 306748 - RNA, 64 nt, Human
uagcacacagcacuugggccagcaaauccuggaaggcagacaaaaauaagagccugaagcaaug

SEQ ID NO: 306749 - RNA, 64 nt, Human
gggaggagauauuuauuuuggggagaguuuggaggggagggagaauuuauuaauaaaagaaucu

SEQ ID NO: 306750 - RNA, 64 nt, Human
aaauuauugauaucacugcugacuuuuauauuaugggagggaaaaaauaacauuaauaaaaagg

SEQ ID NO: 306751 - RNA, 64 nt, Human
ucagaggugaaugcacagugaagggugauuuguggggagggagcauuuuugguggucuuggggg

SEQ ID NO: 306752 - RNA, 64 nt, Human
agggagcauuuuugguggucuugggggaggggaggggagggaagggcugguguugauuuuccuc

SEQ ID NO: 306753 - RNA, 64 nt, Human
uucguaucacugcagaagcaacagugggggcacagggagggaacucuugacacugagccacuaa

SEQ ID NO: 306754 - RNA, 64 nt, Human
ggaaaucgccugaacccaggaggcggagguugcagggagggagacugcaccacugcacuucagc

SEQ ID NO: 306755 - RNA, 64 nt, Human
cgcuuagcagagaagaaagggccugggagguggugggagggagaaggaagggaagaaaggggag

SEQ ID NO: 306756 - RNA, 64 nt, Human
ggauagcgagaggcuugagaauggggccgcuugggggagggaagaggcagcccggcgaggggca

SEQ ID NO: 306757 - RNA, 64 nt, Human
ucugaacuucaagucuccaaagaucagaaucugggggagggagcgcgugcagggaggggcuuga

SEQ ID NO: 306758 - RNA, 64 nt, Human
aacauugcuggcuggaagggaggagcgcccucuagggagggacauggccccggugcggcugcag

SEQ ID NO: 306759 - RNA, 64 nt, Human
ccugagaccauccuucucauuuuggaaacugcuagggagggaaccaaccacuuaaacaagcgug

SEQ ID NO: 306760 - RNA, 64 nt, Human
ugcgcgugcuguggcaggaggacgcaucccaaucgggagggagagacagagacagagccgaugg

SEQ ID NO: 306761 - RNA, 64 nt, Human
cagcccgggcucugccucccaucacccgcuaagagggagggagggcuccagacacauguccaag

SEQ ID NO: 306762 - RNA, 64 nt, Human
cucccucaguuuccuucucuguacaauguggcuggggagggagaggaugggaccagguuggacc

SEQ ID NO: 306763 - RNA, 64 nt, Human
cccggcggcccaggcacagaagggcagggccauagggagggagauucgcuacggauccaggcca

SEQ ID NO: 306764 - RNA, 64 nt, Human
cccccaagcagagcggguaaagugcaauggguaagggagggaaggggaauggaagagaaaagac

SEQ ID NO: 306765 - RNA, 64 nt, Human
caggaggugguggggucugacguguccaagugcuggcagacacccuggucacccaggacagagc

SEQ ID NO: 306766 - RNA, 62 nt, Human
uacaaauacugcagaaaugacaccaauaauggggcagacacaacagcguggcuuagauugug

SEQ ID NO: 306767 - RNA, 64 nt, Human
ucauucuuuugagggguuggauuuucuuuuuucuggcagacauuucaguacauucacauuucuc

SEQ ID NO: 306768 - RNA, 64 nt, Human
ggagggaaggggaauggaagagaaaagacagggugggagggaggagggagugcuguguuuuagu

SEQ ID NO: 306769 - RNA, 64 nt, Human
cuuaauucuauaacaguaaaccccauacgcaggugggagggaggaacaccggugccucggucac

SEQ ID NO: 306770 - RNA, 64 nt, Human
cugugugagaucugugcugcacaccugagggagggggagggaucggccaccuccucccugugag

SEQ ID NO: 306771 - RNA, 64 nt, Human
ccaugccuggcccugccugagccagguggguggagggagggagaucaugagggacuuggaggga

SEQ ID NO: 306772 - RNA, 64 nt, Human
uguuucuucucaggauuccuugccagggaggaaggggagggaacaggguggguuuucucacuga

SEQ ID NO: 306773 - RNA, 64 nt, Human
cgguuugcauucuugugcuuuugggaggugccaggggagggaagggcugggaugcugggaccug

SEQ ID NO: 306774 - RNA, 64 nt, Human
uggucuucggugcuucccgggcccggggucugucgggagggaagagaacugggccugaccuacc

SEQ ID NO: 306775 - RNA, 64 nt, Human
cuguuuuaguauuuggauuugcauuccaucccuugggagggaguccucagggccacuagugaug

SEQ ID NO: 306776 - RNA, 64 nt, Human
augggcuggucuccaaagcucuuuccauugcccagggagggaagguucugagcaauaaaguuuc

SEQ ID NO: 306777 - RNA, 64 nt, Human
gaccuugcugacuaggcacaugggacgcaaaggagggagggaagcaaggccuugccuggcgagu

SEQ ID NO: 306778 - RNA, 64 nt, Human
ccuguagaggggaacugggguccaaaggucuuuggggagggaggcagagcuggcuggcucagcu

SEQ ID NO: 306779 - RNA, 64 nt, Human
augucaccaucagagacgaagggaaggguagccagggagggaguccagcccagcugccugcagg

SEQ ID NO: 306780 - RNA, 64 nt, Human
agugcccggugcuugggggaggagggcagggacagggagggagccacagucagugcccgggaac

SEQ ID NO: 306781 - RNA, 64 nt, Human
uggagaguuuauaucgugccuuuaggcagaaaaggggagggaaaccugaacuuuuccugcacuu

SEQ ID NO: 306782 - RNA, 64 nt, Human
cgguuucuccugauuauggcugcuguggggugaggggagggaggggcagccccgaggcagucuc

SEQ ID NO: 306783 - RNA, 64 nt, Human
cucuucccaaaacugugccuguccccagcuucuggggagggacacagcuuccccuucccaggaa

SEQ ID NO: 306784 - RNA, 64 nt, Human
ccuggagggcagcccucacucccuuugggggagaggcagacauugcugcccacagaccugccuc

SEQ ID NO: 306785 - RNA, 64 nt, Human
cgcucuguuuuuuccaagugccacgugggacugaggcagacacucccagucagcccgcucgauc

SEQ ID NO: 306786 - RNA, 64 nt, Human
uaaaucucuggucacuuuaagacccuaaauaaaaggcagacagcuccacucaaaaacuaaggcu

SEQ ID NO: 306787 - RNA, 64 nt, Human
ucuccucuucuagcccaugcccuuccccgguggagggagggagcagggagcccucacucuccac

SEQ ID NO: 306788 - RNA, 64 nt, Human
ccugccugugucucuccccaaaccccuuuagauggggagggaagaggaggagaggggaggggac

SEQ ID NO: 306789 - RNA, 64 nt, Human
cuuccagagaggacagacacagauuuccugcugggggagggaggaguccacgcauccugaugcu

SEQ ID NO: 306790 - RNA, 64 nt, Human
cagacuuggauaggguaggcugagggggcccuaagggagggacuaaggcuccaaggcaggucac

SEQ ID NO: 306791 - RNA, 64 nt, Human
cucaaucucugggggcugaggagcagcaggaggggggagggaagggagccaagggauggacauc

SEQ ID NO: 306792 - RNA, 64 nt, Human
aauaaauaaauaugagauaaugcagucgggagaagggagggagagaauuuuauuaaaugugacg

SEQ ID NO: 306793 - RNA, 64 nt, Human
agggggacuuuagagagggaugaaaaugagcccugggagggaggaagggacgaggagggguggc

SEQ ID NO: 306794 - RNA, 64 nt, Human
guauuuuggagaugaagaaaaaagucauucaccugggagggauuuuuaacaaacaugcacuaau

SEQ ID NO: 306795 - RNA, 64 nt, Human
cuuaucugaauuauuuuccaaaggaaugcugucagggagggacuguucugccagccuaacaaag

SEQ ID NO: 306796 - RNA, 64 nt, Human
cuaugucccaagagccauaagggggugggaauuggggagggagaaaggguaguucaaagagucu

SEQ ID NO: 306797 - RNA, 64 nt, Human
gaggagcgucuacgcccgggcagcugccccguccgggagggaggugggggggucagccccccgc

SEQ ID NO: 306798 - RNA, 64 nt, Human
gggucagccccccgcccggccagccgccccguccgggagggaggugggggggaucagccccccg

SEQ ID NO: 306799 - RNA, 64 nt, Human
ggaucagccccccgcccggccagccgccccguccgggagggagguggggggcgccucugcccgg

SEQ ID NO: 306800 - RNA, 64 nt, Human
uuuuucuacuuuguaauugugagacauuuucuuggggagggaaaauuggaaugguucccuuuuu

SEQ ID NO: 306801 - RNA, 64 nt, Human
ccccccugagggcuggaggcccaaggucggggaggggagggaaaagcagcacccacagggagcg

SEQ ID NO: 306802 - RNA, 64 nt, Human
aggaauggcaugagggauugaugggggacuuggagggagggacaaguggugcccuguccccugc

SEQ ID NO: 306803 - RNA, 64 nt, Human
agccgcggcugcucggccacugaccaggggcccuggcagacauuaggggaucaguuguauuuau

SEQ ID NO: 306804 - RNA, 64 nt, Human
aaacuccuuguaggucugcagaugugugucccauggcagacaaagcacccuguaggcacagaca

SEQ ID NO: 306805 - RNA, 64 nt, Human
aggggcugggggagguggaaggggcggggggcggggcagacagcagaccaccaaggguucaggg

SEQ ID NO: 306806 - RNA, 64 nt, Human
uuacacuggguguucaaauuuauuuuaagagauagggagggaggggacauaaagggaaugcaua

SEQ ID NO: 306807 - RNA, 64 nt, Human
gggcugcaaaacuggaagcacagccucggggauggggagggaaagacggugcuauauccaguuc

SEQ ID NO: 306808 - RNA, 64 nt, Human
aggggaaucuggaacgcucuaggcagaagaagcugggagggagggggaggugaaaagggcagag

SEQ ID NO: 306809 - RNA, 64 nt, Human
gacauuugccuugcuggacggggacuggggaugugggagggagcagacaggaggaaucauguca

SEQ ID NO: 306810 - RNA, 64 nt, Human
cugcucacccuucugucuugcagagugggauugugggagggauuggcagccuucuucuccacca

SEQ ID NO: 306811 - RNA, 64 nt, Human
cccgggcaguacuggggaccuucccugggggacggggagggaggaggcagcgacuccuuggaca

SEQ ID NO: 306812 - RNA, 64 nt, Human
gagcuggauccagagcuggaggggguggguccgggggagggaguggcucggaaggggcccccac

SEQ ID NO: 306813 - RNA, 64 nt, Human
gggcuaugaaaucuuggauuuggggcugaggggugggagggagggcagagcucugcacacucaa

SEQ ID NO: 306814 - RNA, 64 nt, Human
aauucaagauuucuauaugggguuguggcgcagggggagggagauuuaucuugaagcugaauuu

SEQ ID NO: 306815 - RNA, 64 nt, Human
cuaggagaaggaggggaaccagauguuagaucaggggagggagcaggagugucccucccgucag

SEQ ID NO: 306816 - RNA, 64 nt, Human
cggggccuggaagaaugauuggcugggaggccgcgggagggaggccaggaggcccggaccaguu

SEQ ID NO: 306817 - RNA, 64 nt, Human
ccgggucugucucucucacucucgcucucacugggggagggaaagaauggcuuugguggcuuug

SEQ ID NO: 306818 - RNA, 64 nt, Human
ccugccaucauguuuacagaggacaguauuuguggggagggauuuggggcucagagugggguag

SEQ ID NO: 306819 - RNA, 64 nt, Human
aauggcaguaugguagagggauaaauagggggcggggagggauagucauggauccaagaagucc

SEQ ID NO: 306820 - RNA, 64 nt, Human
ccagccuagggcucauggcaugggcccccacugggggagggaggcaucuuguuucuugugguuc

SEQ ID NO: 306821 - RNA, 64 nt, Human
ggggggugggguacacagacacaggguggggguggggagggacgguguuaacucuuucugcucc

SEQ ID NO: 306822 - RNA, 64 nt, Human
cugcuagacagauaacuuuuaauuuuucaaauuuggcagacacuuuuuuuuuuuuuuugaaaau

SEQ ID NO: 306823 - RNA, 64 nt, Human
acauuucuauaauaucuaccugcaaugguuuacaggcagacaaugaaauugaucuuuugacugu

SEQ ID NO: 306824 - RNA, 57 nt, Human
agagagaaauuacagagugacggagaaggcagacaucaugcaacaugcucaagggcu

SEQ ID NO: 306825 - RNA, 64 nt, Human
ucuguucugugugucugucuguggguggggggaggggagggaagucuugugaaaccgcugauug

SEQ ID NO: 306826 - RNA, 64 nt, Human
cuccacagacagcugagugcccuguccucagauggggagggacagggucggccuguaccccgga

SEQ ID NO: 306827 - RNA, 64 nt, Human
ccaguuacgacugaagucaguguagaccugagcugggagggaaccuguuagucuccccaccucu

SEQ ID NO: 306828 - RNA, 64 nt, Human
ggaauccaagaacaggaagccaagagagugagcagggagggauugggggugggggaggccucaa

SEQ ID NO: 306829 - RNA, 64 nt, Human
ccuucagccugugacuguugcugacuccaggggugggagggauggggagacuccccucuugcug

SEQ ID NO: 306830 - RNA, 64 nt, Human
aaugugcgcuaaugauuaucuguaagccuuuguggggagggaggccugcaaggucaugaaaggc

SEQ ID NO: 306831 - RNA, 64 nt, Human
acagaaaggauagaaccuuuuuggggggaggguggggagggagauauuuauuugugcccagaag

SEQ ID NO: 306832 - RNA, 64 nt, Human
ugaaaggggguggguauggggggggcaagaaagagggagggaaaucuuucaacuuauuucugaa

SEQ ID NO: 306833 - RNA, 64 nt, Human
aauggggcagauuaggggaccacuggacucagaggggagggaagggcucaucagcacccgcuca

SEQ ID NO: 306834 - RNA, 64 nt, Human
ccaugugugccccgugcagggaucaggagggcgggggagggaccgagcagcccucuugcccggu

SEQ ID NO: 306835 - RNA, 64 nt, Human
aggucuaagcaagugagucugguggaggagcugagggagggagccauggaaggugccagaagga

SEQ ID NO: 306836 - RNA, 64 nt, Human
uagccaaauggaucuuuuuaacagugugccuuuggggagggacccauguccauggcuucguuga

SEQ ID NO: 306837 - RNA, 64 nt, Human
cagcaccuucccggcucaccagugccaccugcgggggagggacggggcaggcaggagucuggga

SEQ ID NO: 306838 - RNA, 64 nt, Human
agucucugcuuucuuuccccagggcugggccauggggagggaaggacuuucucccaggggaagc

SEQ ID NO: 306839 - RNA, 64 nt, Human
cggggccggacaggccgcacagaccuacuguggcgggagggaggggcggcugcugccuggugac

SEQ ID NO: 306840 - RNA, 64 nt, Human
augaacaagcaacgcagaccacaagcgagugccugggagggaguggcccagggugguucuggag

SEQ ID NO: 306841 - RNA, 64 nt, Human
caaaugugaaauaaccgaucuauaacgugaaggaggcagacaugagcuguacuacucaguaugc

SEQ ID NO: 306842 - RNA, 64 nt, Human
acucaaggaaucuugugaggugugugcugagcauggcagacaccagauaggugaguccuuaacc

SEQ ID NO: 306843 - RNA, 64 nt, Human
aggauccagggaggcccagguacacacaggccauggcagacaccccaugucuuuguuaccccag

SEQ ID NO: 306844 - RNA, 64 nt, Human
uggcuccagccuucccuggcccccgccggaggccgggagggagcagggucucccucagggcugc

SEQ ID NO: 306845 - RNA, 64 nt, Human
uggguguuagcuugagaugguuaaaggugguuuggggagggacuucguuguaaugguuuugcug

SEQ ID NO: 306846 - RNA, 64 nt, Human
ucuccccagcuggaaggccgaugacuggguggucgggagggagacccagcucuccuuucugucc

SEQ ID NO: 306847 - RNA, 64 nt, Human
ccuaggggaagggggugcaaagacucugagccaagggagggaagggccacccugcugcacuagg

SEQ ID NO: 306848 - RNA, 64 nt, Human
agaggggacucacaggaaacaagucuuagugcuugggagggaggccccgcugcgugcucagacu

SEQ ID NO: 306849 - RNA, 64 nt, Human
uauccaaggccacuacauugaggaggggggaggggggagggaggagaaggguuacuugcugcuc

SEQ ID NO: 306850 - RNA, 64 nt, Human
aaagggagggaugggucuagggagugggaaaugcgggagggaggguggggggcaggggucgggg

SEQ ID NO: 306851 - RNA, 64 nt, Human
uuuuuuuuuuuccugggaauuuuuuuggggaaaagggagggaugggucuagggagugggaaaug

SEQ ID NO: 306852 - RNA, 60 nt, Human
aggggggcccaggugcauaaaugggggucagggagggaaaggaggagggagagagaugga

SEQ ID NO: 306853 - RNA, 64 nt, Human
ucuucucaaagaccuaagagugagcgcggggugggggagggaugugaaguuauccagccucugc

SEQ ID NO: 306854 - RNA, 64 nt, Human
aaagcuaccacucuggcugcuagauagcuugguggggagggagaugacuccuuguagcugauac

SEQ ID NO: 306855 - RNA, 64 nt, Human
gaacgccaggcugaugguugagggauggugggcagggagggagggcgaagaggcucccucuggc

SEQ ID NO: 306856 - RNA, 64 nt, Human
uccccaugaggggccaagacacugccuaaggugugggagggacuggcugagauugcagcccaug

SEQ ID NO: 306857 - RNA, 55 nt, Human
ugggggcgucuagagacugagcugcgggagggagagggacuugugggucugaucc

SEQ ID NO: 306858 - RNA, 64 nt, Human
ccgccuucuugggcugggcccgggggcgggacuggggagggaacuccgccccucgcgggagacc

SEQ ID NO: 306859 - RNA, 64 nt, Human
gccuacgccucaggcauguggugagaggaugagggggagggagccaacgccucagguggagugg

SEQ ID NO: 306860 - RNA, 64 nt, Human
ugaggacuuuccgcgcccauuggugacccuuccaggcagacagccucagcaacgccccuggugg

SEQ ID NO: 306861 - RNA, 64 nt, Human
cccgucaauuuugcacgggauccuagcucuuguaggcagacaccagugcacucuagauaccucc

SEQ ID NO: 306862 - RNA, 64 nt, Human
gccuaagaagggcauucagacuugaauuuuaauaggcagacagaaaguuugccuaauaguuaau

SEQ ID NO: 306863 - RNA, 64 nt, Human
guuccggcaaagacagagccagcagcugcgcugggggagggaagcgugccuccccaccccuccc

SEQ ID NO: 306864 - RNA, 64 nt, Human
gaggagugagauagaacuugggagcccggggguugggagggacagggauaaauaaaggcaaaga

SEQ ID NO: 306865 - RNA, 64 nt, Human
cucagaggcccuuuguggggucaggacacagagugggagggagacugaugcaggccuaccaguc

SEQ ID NO: 306866 - RNA, 64 nt, Human
ccugggucggccgcccaaaucuuuccuggcgaaggggagggaagggguguucugguggaguggg

SEQ ID NO: 306867 - RNA, 64 nt, Human
gcaccugagugguugggacacaggcagcuggcaugggagggacuuuuuuugagacagggucuca

SEQ ID NO: 306868 - RNA, 64 nt, Human
auaguggcucucagcccuuggggcauguuaucaugggagggaagucaaauaagaggagagaaaa

SEQ ID NO: 306869 - RNA, 64 nt, Human
cacggcgggaggaagggcucugagcccaggggaggggagggagcgaggggcucacaccugacau

SEQ ID NO: 306870 - RNA, 64 nt, Human
gauccucugggacuuggcggggaugggguggggugggagggaaugaggaagcuacagguagguc

SEQ ID NO: 306871 - RNA, 64 nt, Human
uaauguuuggugucuguuucuuaggagugacugggggagggaagauuauuuuagcuauuuauuu

SEQ ID NO: 306872 - RNA, 64 nt, Human
gggaggggggugggagggguguagggagagggaagggagggaaacaguuuugugggaaauauuc

SEQ ID NO: 306873 - RNA, 64 nt, Human
ggguuaauuuacccacagaaugugauaguaauaggggagggaggcugcuguggguuuaacuccu

SEQ ID NO: 306874 - RNA, 64 nt, Human
gaagcuagacccaaucuccuuugggaugugggcagggagggaagcaggcuuggaggguuaauuu

SEQ ID NO: 306875 - RNA, 64 nt, Human
aauggggccacauagcagcagaggacugguguaagggagggagggguagggacagaagcuagac

SEQ ID NO: 306876 - RNA, 64 nt, Human
agcaaagggaaccaaugccgaagaccgagggcaggggagggaggcggggguggacagggaggca

SEQ ID NO: 306877 - RNA, 64 nt, Human
uuuagaacugcaguucauuguuuuaagggauugggggagggagccuggggacacaaaccuuuua

SEQ ID NO: 306878 - RNA, 64 nt, Human
aacgaaaaccugugcuuguguguguguggcggcggggagggaggauccuguuucccaccuccuu

SEQ ID NO: 306879 - RNA, 64 nt, Human
guucucgacagccugaacuugaacauacaaagugggcagacagucgggauuguuggaagaacag

SEQ ID NO: 306880 - RNA, 64 nt, Human
augucgaugacuucaucaacacgagaauacaggaggcagacaaugaccccacggcuccuccuua

SEQ ID NO: 306881 - RNA, 64 nt, Human
cacgcagccagccagaugccuggcccugugcuggggcagacaacgcugcagagcccagggagcc

SEQ ID NO: 306882 - RNA, 64 nt, Human
auugggguagaaaaggagaggguccgaggguggugggagggauagaaaucacauccgccccaac

SEQ ID NO: 306883 - RNA, 64 nt, Human
cucagcccgccagcugaggggucccacggggcaggggagggaauugagagucacagacacugag

SEQ ID NO: 306884 - RNA, 64 nt, Human
gaucuguuguguacguggagagggaugaggugcugggagggauagaggggggcugccuggcccc

SEQ ID NO: 306885 - RNA, 64 nt, Human
guuuuuggcuauuacugguguauuauuugggggagggagggauggggaggggagaaagggagau

SEQ ID NO: 306886 - RNA, 64 nt, Human
uguaguuuuuggcuauuacugguguauuauuugggggagggagggauggggaggggagaaaggg

SEQ ID NO: 306887 - RNA, 64 nt, Human
ggaagaaaaacaggccgagugaaggugcuggaaagggagggaggacgcgaggggaaaggccugu

SEQ ID NO: 306888 - RNA, 64 nt, Human
ggaugacggggggugggaacaagauggauggaaagggagggaaagacaagaugcaacuaggaag

SEQ ID NO: 306889 - RNA, 64 nt, Human
aauguauucuguauccgugaauugcuuuaugggggggagggagggcuaauuauauauuuuguug

SEQ ID NO: 306890 - RNA, 64 nt, Human
uuaaaacagcacuaaauaacuugggggaaacggggggagggaaaaugaaaugaaaacccuguug

SEQ ID NO: 306891 - RNA, 64 nt, Human
ccaaaggugcuacaucuaugugaugggugggguggggagggaaucacuggugcuauagaaauug

SEQ ID NO: 306892 - RNA, 64 nt, Human
ucugcaauaauaaagccacgucaugucuucuuuugggagggagagagucgauggcaggaggggg

SEQ ID NO: 306893 - RNA, 64 nt, Human
uaucauuuuaucuucuuuggacuacagguggggugggagggauuuggguugguggauuaacaga

SEQ ID NO: 306894 - RNA, 64 nt, Human
auguugguggugaaagcaagguuccccaggagaggggagggacuggccccugggaagcucugag

SEQ ID NO: 306895 - RNA, 64 nt, Human
ugaaggggagggaggaaaauggaugaaugagagagggagggaacagugcccaagcgcuuggccu

SEQ ID NO: 306896 - RNA, 64 nt, Human
gugaauccuccaggcccuucucuacacccugaaggggagggaggaaaauggaugaaugagagag

SEQ ID NO: 306897 - RNA, 64 nt, Human
acacccuggggccuguuggggggaugggggcuaggggagggauagcauuaggagaaauaccuga

SEQ ID NO: 306898 - RNA, 64 nt, Human
gaacagauggagggggcaguggggacagggcuugggcagacaccagcaggaauaauuugaaaug

SEQ ID NO: 306899 - RNA, 64 nt, Human
ugauaccagaggaggcgagggacagagacagcaaggcagacaguggcuggcaggggggcccagg

SEQ ID NO: 306900 - RNA, 64 nt, Human
gauauuaggacuuugggguuugagagcaucauggggcagacagaugguggauggucuggacaag

SEQ ID NO: 306901 - RNA, 64 nt, Human
aguaucagcaagauaaaagugaguguguuuugucgggagggaacuccaggggaagugaggggag

SEQ ID NO: 306902 - RNA, 64 nt, Human
auguagugaguguagcuguagcugaggcuuaacugggagggaugccgagcuugcuggaacuacu

SEQ ID NO: 306903 - RNA, 64 nt, Human
gccaggccuccucggagaagcuugucccccgugugggagggacggagccggacuggacaugguc

SEQ ID NO: 306904 - RNA, 64 nt, Human
acugaucacagauuugccuggacuucccuucccagggagggaacagaaguuaggaggcaacuuu

SEQ ID NO: 306905 - RNA, 64 nt, Human
gaauugcaccauuuaagaugcugcuugaacaaaugggagggaaguugucaaugauugaugggca

SEQ ID NO: 306906 - RNA, 64 nt, Human
uuucugcugagacuggccugaaaggcuggcaagugggagggagucaguggggaggccaggauag

SEQ ID NO: 306907 - RNA, 64 nt, Human
uaauuuuuuuauuuuuuauuuucuuuuugguuuggggagggagaaaaguucuuagcacaaaugu

SEQ ID NO: 306908 - RNA, 64 nt, Human
uuugaugcuuguuuagagaucagcagucuuggaugggagggaacaaagcuaaauaaauguuagu

SEQ ID NO: 306909 - RNA, 64 nt, Human
cucugcuauuaggccagcaagcggggaugucccugggagggacaugcuuagcaguccccuuccc

SEQ ID NO: 306910 - RNA, 64 nt, Human
auuauaaauauauuuuuauuuuuuaguaauuuaggggagggaggagggagaaagggauaaugau

SEQ ID NO: 306911 - RNA, 64 nt, Human
aguguuccgugaugugaggggugggagggguggagggagggaaccagccauccuuggaaaagac

SEQ ID NO: 306912 - RNA, 64 nt, Human
aaagugguggcauaggacgguaggguagaaauuugggagggaaaaaagaaauugggaggguaca

SEQ ID NO: 306913 - RNA, 64 nt, Human
cuccaggggugcaguggggugggugaggacgggugggagggacagggagggaccaauaaaucau

SEQ ID NO: 306914 - RNA, 64 nt, Human
gcaguggggugggugaggacgggugggagggacagggagggaccaauaaaucauaaugaagaaa

SEQ ID NO: 306915 - RNA, 64 nt, Human
cucuacugggcuuggagcacguccgggcaguggagggagggacacagccugggacaggaagccu

SEQ ID NO: 306916 - RNA, 64 nt, Human
cacacaggggccaggauggcggaagauacggguggggagggaagauauccagaaaggagccaca

SEQ ID NO: 306917 - RNA, 56 nt, Human
caccgccugcacugccaugaccuggaggcagacagacgcccaccugcuccccgacc

SEQ ID NO: 306918 - RNA, 64 nt, Human
acuaguuagcuauuguuauuaacaagaucuccauggcagacaagcuaaagcaucugccuaaguc

SEQ ID NO: 306919 - RNA, 64 nt, Human
auuucaugcauagcuuggcucagaaggugccauuggcagacaggcacaugggaggcuggaguag

SEQ ID NO: 306920 - RNA, 64 nt, Human
agugccccugcccuaggggugucugucuccagaggggagggacaaauccccuacuggggccauu

SEQ ID NO: 306921 - RNA, 64 nt, Human
cucugucucaugcucccaggcugcacagcaggcagggagggaggcaaggcaggggaguggggcc

SEQ ID NO: 306922 - RNA, 64 nt, Human
guuccagggaggaggugcucgguugacaccaucagggagggagggugggcacugcugggcugag

SEQ ID NO: 306923 - RNA, 64 nt, Human
ggagccuuccccaccuuagcugucuccugccccagggagggauggaggagauaauuugcuuaua

SEQ ID NO: 306924 - RNA, 64 nt, Human
ggugggggugucuccuggcugggaaggagggaaagggagggagaguuuugcggggguuggcagu

SEQ ID NO: 306925 - RNA, 64 nt, Human
gcuagagcagcccuucucagcuccacccugcccggggagggaggaggagcucugguuucagagc

SEQ ID NO: 306926 - RNA, 64 nt, Human
gggaaucacacugggcugaccuggcauugggagagggagggaggaaggaagggagggaggggcu

SEQ ID NO: 306927 - RNA, 64 nt, Human
ugaccuggcauugggagagggagggaggaaggaagggagggaggggcuggaagauacugaagga

SEQ ID NO: 306928 - RNA, 64 nt, Human
ggggccuguccagagggucuucagaagccccccugggagggaggggaggaugagcacgcccagc

SEQ ID NO: 306929 - RNA, 64 nt, Human
cuaguuugugaggcuguggccccgagcuggcggagggagggaagaggagggagugacgggaggg

SEQ ID NO: 306930 - RNA, 64 nt, Human
cccaacuccagcagcuggacucugggcccacaaggggagggaccccagccaguauucccucaga

SEQ ID NO: 306931 - RNA, 64 nt, Human
uuggcgaccuuacuccuccaaaacugaacacaaggggagggaaagaucauuacauuugucagga

SEQ ID NO: 306932 - RNA, 64 nt, Human
uguggaagucaccugauauucuggccccaggggugggagggaggggagcuuggaaggcuagucc

SEQ ID NO: 306933 - RNA, 64 nt, Human
cugacgcuguggccccgggacccagcagagcugggggagggaucagcccccaaagaaauggggg

SEQ ID NO: 306934 - RNA, 64 nt, Human
cuggguugucauucacuuugagagcccgaggggugggagggagugaugcaggcagacgcugcgc

SEQ ID NO: 306935 - RNA, 64 nt, Human
auaaguccugagaagacacuggugucuggggacagggagggaugggggucccugaugaauaucu

SEQ ID NO: 306936 - RNA, 64 nt, Human
guugaaauccuggccuugggagagaugccuuccaggcagacacagcugucugguucaggccaag

SEQ ID NO: 306937 - RNA, 51 nt, Human
guacuuauucggaggcaugaaggcagacagagaugaaaagacagucaaagg

SEQ ID NO: 306938 - RNA, 64 nt, Human
ccuguagggaagggccccauaggcagagccccagggcagacagaaccucugggacacacaccaa

SEQ ID NO: 306939 - RNA, 64 nt, Human
gcaggggcagcaugcccagugggccuggggucccgggagggauuccggaauugaggggcacgca

SEQ ID NO: 306940 - RNA, 64 nt, Human
uagccccgcgaugccagaggaggggcacuggguggggagggagguggaggagccgugcaauccc

SEQ ID NO: 306941 - RNA, 64 nt, Human
caccugaggagacuuuggggacagggcaggggcagggagggaaacugaggaaaucuuccauucc

SEQ ID NO: 306942 - RNA, 64 nt, Human
agaugggcggguuugugcuaugugcaggguggaagggagggaaguugacaggucagaagaucag

SEQ ID NO: 306943 - RNA, 64 nt, Human
cgugcaggacaucaaacagccuccgggccuggaugggagggagaaaaaaaugaggaaccaguca

SEQ ID NO: 306944 - RNA, 64 nt, Human
ugggguggcugccagcccugucccgggaccugcugggagggacaagaggcccucccccaggcag

SEQ ID NO: 306945 - RNA, 64 nt, Human
gaccucaagauuccacucugugcccgccucugccgggagggagggaggcacacagguggagcug

SEQ ID NO: 306946 - RNA, 64 nt, Human
ucaagauuccacucugugcccgccucugccgggagggagggaggcacacagguggagcugaccc

SEQ ID NO: 306947 - RNA, 64 nt, Human
agacaccccgguggaagcauuuagaggggaccacgggagggacaaggcuucucuguccgcccuu

SEQ ID NO: 306948 - RNA, 64 nt, Human
gugcaaacaagucauagaaacuugaugggaguuggggagggacugaaggaugcaugcaagguuc

SEQ ID NO: 306949 - RNA, 64 nt, Human
aagcaggcuaggugaccuugggacacuacgcuaagggagggaggcuaaaggcggccagguuugc

SEQ ID NO: 306950 - RNA, 64 nt, Human
uguuuuauuugccuucuuuucacaccauuggugagggagggauuaccacccugggguuaugaag

SEQ ID NO: 306951 - RNA, 63 nt, Human
acgggaccccucugcccugaccccacggggccggggagggaggggaccccccuccaccccccu

SEQ ID NO: 306952 - RNA, 64 nt, Human
auuuauugaucaaucucucugcgggguggggugggggagggacgggagcugguugggguggcuu

SEQ ID NO: 306953 - RNA, 64 nt, Human
acccaggaccuccagaaggagcccuuggaccucugggagggagcugacccuugacuccagcaua

SEQ ID NO: 306954 - RNA, 64 nt, Human
uggguugggguggaggaaccaggagagggcuggagggagggagauggucucagccccacagagu

SEQ ID NO: 306955 - RNA, 64 nt, Human
agcauugcugucugcaagggagccccuagccccuggcagacauagcugcuucagugccccuuuu

SEQ ID NO: 306956 - RNA, 64 nt, Human
ggugccccccacauugguguccccaugggcagcaggcagacagcucacccccaccagcaugaug

SEQ ID NO: 306957 - RNA, 64 nt, Human
cugcuggcccggccuccaagaguucuggacaggaggcagacacugcccagaugcucgguggagg

SEQ ID NO: 306958 - RNA, 64 nt, Human
cuguuucuucagcgggaaaguggagcugguggaggggagggaggagacaucucccucuuuguca

SEQ ID NO: 306959 - RNA, 64 nt, Human
cccggagcagacgagggcagggcugggaaggauggggagggacauagaggauucgguuccuccc

SEQ ID NO: 306960 - RNA, 64 nt, Human
cacaaguggcugcagccuccgcggggaaccaggcgggagggacugaguggcccgcgggccccag

SEQ ID NO: 306961 - RNA, 64 nt, Human
gaaaguggagugcccuugucugguagcaccaugugggagggacccagcugggcgcagcgcccug

SEQ ID NO: 306962 - RNA, 64 nt, Human
aucccgccccggagcccccagcccgggggagagggggagggaguugggagaagcccagccccuc

SEQ ID NO: 306963 - RNA, 64 nt, Human
gccggccagagggggccccgggggggcgggaacugggagggaagggugagacggagccggaagu

SEQ ID NO: 306964 - RNA, 64 nt, Human
aaaccagcaaguuuuuauuagggauuuucaaaaggggagggagugugcaaauagguguggguca

SEQ ID NO: 306965 - RNA, 63 nt, Human
ccgucugcuucagcagcugagaguguccggggugggagggaccaugagggagccccagaaugg

SEQ ID NO: 306966 - RNA, 64 nt, Human
cuuugcugaguuccggggugcaaugggggagggagggagggaaagcuuccuccuaaaucaagca

SEQ ID NO: 306967 - RNA, 64 nt, Human
ucaccuuugcugaguuccggggugcaaugggggagggagggagggaaagcuuccuccuaaauca

SEQ ID NO: 306968 - RNA, 64 nt, Human
uggcucaccuuugcugaguuccggggugcaaugggggagggagggagggaaagcuuccuccuaa

SEQ ID NO: 306969 - RNA, 64 nt, Human
gucaucucuggcagcccacuugggccagcuacgugggagggaggaauuacacagcugaccgaau

SEQ ID NO: 306970 - RNA, 64 nt, Human
caugaucucugcucuucccucucccagauugguggggagggagggcgggagguagauauaggcc

SEQ ID NO: 306971 - RNA, 64 nt, Human
caccucauggaccaggggcugguggcccaggccagggagggaacccugggcagggcucuggugg

SEQ ID NO: 306972 - RNA, 64 nt, Human
uuccaggcccaucccuggcccagagcaggagggagggagggacgauggcgguggguuuuuguau

SEQ ID NO: 306973 - RNA, 64 nt, Human
cuccuuccaggcccaucccuggcccagagcaggagggagggagggacgauggcgguggguuuuu

SEQ ID NO: 306974 - RNA, 64 nt, Human
ccauggaguagaggccuaaguugacacugcccugggcagacaagacaggagcugucgccccagg

SEQ ID NO: 306975 - RNA, 64 nt, Human
agguuuagaaagauggacuuuucugauaaaucuuggcagacaucuaaaaaaaaaaccauauuuu

SEQ ID NO: 306976 - RNA, 64 nt, Human
ggacaaggugauacucugagcuguggacugaacuggcagacacaaccuguacagauugaaauuu

SEQ ID NO: 306977 - RNA, 64 nt, Human
ccccaccuaccucagcugggucaggcacagggaggggagggaucagccaaauugggcggccacc

SEQ ID NO: 306978 - RNA, 64 nt, Human
uauagggccauaauggaauucugaagaaaucuuggggagggaaggggaguuggaacaaaugucu

SEQ ID NO: 306979 - RNA, 64 nt, Human
gacugcuucuguguuuuuuuuguugugcuuauaugggagggagagugguguguuugcuuuuaua

SEQ ID NO: 306980 - RNA, 64 nt, Human
ggcugccgcugggcgggaaccccaacagggccccgggagggaacccugcccccaaccccccaca

SEQ ID NO: 306981 - RNA, 64 nt, Human
guucuuggaaauacuuguguauguacagaaggaagggagggauuauuuuucuacaaaguaauuu

SEQ ID NO: 306982 - RNA, 64 nt, Human
ccuuuugcgccucuugcgcgugcgccggggcacagggagggacagcgggaggugucgcggggag

SEQ ID NO: 306983 - RNA, 64 nt, Human
cuuaaccuuaauggaaacgcuggaaaucugcagggggagggagaggggaacuguuaucucccaa

SEQ ID NO: 306984 - RNA, 64 nt, Human
gggggcuagggccaaguugggggcccaggaggcggggagggaggaggaggagaagaugcgcagu

SEQ ID NO: 306985 - RNA, 64 nt, Human
gccccuggcucagccccuccuuccaggucuugaugggagggaggagggcccagaagcuggacaa

SEQ ID NO: 306986 - RNA, 64 nt, Human
cucugaguccugaggagacacaggccuggggacagggagggaugggagucccugcugaauaucu

SEQ ID NO: 306987 - RNA, 64 nt, Human
cucgggcccacagcgccgucccaucacaagcccggggagggaucccgccuuugaaaauaaagcu

SEQ ID NO: 306988 - RNA, 64 nt, Human
ggugggcuuuuuaagaggauuuuaacugguuguggggagggaagagaaggacaggguguugggg

SEQ ID NO: 306989 - RNA, 64 nt, Human
gguuucucauaccccacaaggucacagcaggggagggagggacaauuuuauaaugaaccaaaaa

SEQ ID NO: 306990 - RNA, 64 nt, Human
ccuagguuucucauaccccacaaggucacagcaggggagggagggacaauuuuauaaugaacca

SEQ ID NO: 306991 - RNA, 64 nt, Human
uggguuucuaagcucugggcaaaguggugguagggggagggagggggaaguuaagggggucacc

SEQ ID NO: 306992 - RNA, 64 nt, Human
ccagucucgccucuggccuucucuggccacuccugggagggacugccucaccaccccugucccg

SEQ ID NO: 306993 - RNA, 64 nt, Human
cucccugucccuuugccccagguuuccucccggaggcagacagucucccagagcugagggcuug

SEQ ID NO: 306994 - RNA, 64 nt, Human
uggacccagcgggcagguucugccugcuuuggcgggcagacacgcgggcgcgaucccacacagg

SEQ ID NO: 306995 - RNA, 64 nt, Human
cagcugggccagccucgugcugggcucugcccugggcagacaggcagagggccagagcagagga

SEQ ID NO: 306996 - RNA, 64 nt, Human
caguaauaauccucacuuccaucagaaucugccugggagggagcuuuuacaauguacaaguggu

SEQ ID NO: 306997 - RNA, 64 nt, Human
aguccugugauccgggcccgcccccuagcggccggggagggaggggccggguccgcggccggcg

SEQ ID NO: 306998 - RNA, 64 nt, Human
uuucauguuauuuauuauugcccuaugugggguggggagggaaccucucgggucugcacaucuc

SEQ ID NO: 306999 - RNA, 64 nt, Human
cuagagacagcccacgggcccucccuccaagugugggagggagagaugcucugccucugaacuu

SEQ ID NO: 307000 - RNA, 64 nt, Human
ggcccugagguaaacgauaggugaggucuugggugggagggaguuggggaagggagguggaucu

SEQ ID NO: 307001 - RNA, 55 nt, Human
agaaggaaucagucauguaaaccccgggagggaccuucccugcccugcugggggu

SEQ ID NO: 307002 - RNA, 64 nt, Human
gggaaaucucggaagagggaggagucugggaguggggagggauggcccagccuguaagauacug

SEQ ID NO: 307003 - RNA, 64 nt, Human
ccagauccccuuaaagcagagagggagggcaggcgggagggagggcauuggcaugcggcgcugu

SEQ ID NO: 307004 - RNA, 64 nt, Human
ugguccuccauuucaacuccagaaguggggcucugggagggauguucuagcccucccuggcaug

SEQ ID NO: 307005 - RNA, 64 nt, Human
ucucaacaaacaaacaaaaagagccagugggggagggagggacagagacccagagggcagcguc

SEQ ID NO: 307006 - RNA, 64 nt, Human
cccgucucaacaaacaaacaaaaagagccagugggggagggagggacagagacccagagggcag

SEQ ID NO: 307007 - RNA, 64 nt, Human
gaggucugcaggaccucacaccucccuagagggagggagggagggcaggguggagggcaaggcu

SEQ ID NO: 307008 - RNA, 64 nt, Human
aguugaggucugcaggaccucacaccucccuagagggagggagggagggcaggguggagggcaa

SEQ ID NO: 307009 - RNA, 56 nt, Human
agcugaagcggaaauauugaaguccagggagggagcgccccgggccgcguccgccc

SEQ ID NO: 307010 - RNA, 64 nt, Human
guccuaggcuggaaggaggaagaauagggcccaugggagggagcugagaagacucaaguccccg

SEQ ID NO: 307011 - RNA, 64 nt, Human
aauuguaaucagaauuauaauccccauguguugggggagggaccuggugggaggugauaggauc

SEQ ID NO: 307012 - RNA, 64 nt, Human
uguuuuuauugcugacuuuaaauauuuaucccacggcagacagagacauuuggugucuuuuuau

SEQ ID NO: 307013 - RNA, 64 nt, Human
aagaaccuaaagacuucgugugauugggagggguggcagacaggaagaaaacauguccaggccc

SEQ ID NO: 307014 - RNA, 64 nt, Human
aagacagagccuccacuuaguuuugggaggggauggcagacagucaaggagaugagcguccuaa

SEQ ID NO: 307015 - RNA, 64 nt, Human
uagcacauccuccaguuacauggcagaagagggagggagggagggccaaaaagaaaagggagag

SEQ ID NO: 307016 - RNA, 64 nt, Human
cucauagcacauccuccaguuacauggcagaagagggagggagggagggccaaaaagaaaaggg

SEQ ID NO: 307017 - RNA, 64 nt, Human
augaccgcugaaccccaggcacggucguauccaagggagggaucauggcaugggaggcgacuca

SEQ ID NO: 307018 - RNA, 64 nt, Human
caggugggccuguauauaggguccaugugcaauagggagggacgucuucuauuuuuugcugccc

SEQ ID NO: 307019 - RNA, 64 nt, Human
caggagguacaccagcuggacaaauugcagggaggggagggagcgagggccaacccggccccuc

SEQ ID NO: 307020 - RNA, 64 nt, Human
gaagaauucaggggaugugggaaguggggaggcggggagggaucuugacucuugucuccuuugu

SEQ ID NO: 307021 - RNA, 64 nt, Human
uuucacucucucucucauucccagagagccacgggggagggaucacccucacccccaacacccu

SEQ ID NO: 307022 - RNA, 64 nt, Human
ugccuugaacuguugucugggauuguuuuguggggggagggaagggaguguuccgaagaugcug

SEQ ID NO: 307023 - RNA, 64 nt, Human
agguaagaccucucugaagagcugucaugaaggagggagggagcacauuccuggcagagaaaac

SEQ ID NO: 307024 - RNA, 64 nt, Human
acacuuugguuccagucaucgaggggguugggaagggagggagagggggcgcagcucgcaggcg

SEQ ID NO: 307025 - RNA, 64 nt, Human
uuuaaaaauuccuuuagucuguaaaacuccuagagggagggagguaacugaauucacuucuuuu

SEQ ID NO: 307026 - RNA, 64 nt, Human
cugcaguuucauagucccagccuuccuggugcuggggagggaggacugugaauggcuguucucc

SEQ ID NO: 307027 - RNA, 64 nt, Human
uucuugaucuuaaagaucguguagauugggguuggggagggaugaagggcgagugaaucuaagg

SEQ ID NO: 307028 - RNA, 64 nt, Human
gccuccgcucaguguggcuccucagcccacagaggggagggagcauggggccaggugccaguca

SEQ ID NO: 307029 - RNA, 64 nt, Human
guuuuuucugggucaguaaauaacaacugucauagggagggaaauucucaguagugacagucaa

SEQ ID NO: 307030 - RNA, 64 nt, Human
caggcccagcgggaagggaggcugcagggauggugggagggagagggguagcagaagcaauuau

SEQ ID NO: 307031 - RNA, 64 nt, Human
ggcugggccggcgcugccccucaucuuagcauugggcagacaccagggcaaccugcccuccgcc

SEQ ID NO: 307032 - RNA, 64 nt, Human
cacccuaccugccuuuuauaguaugcccaccucaggcagacacagagcacaaugcugggguucu

SEQ ID NO: 307033 - RNA, 64 nt, Human
uuuuggguucaggccuggcguagcacccacaaguggcagacauaucacaagaguccccagacuc

SEQ ID NO: 307034 - RNA, 64 nt, Human
gaacagcuuuuuugggacaagcuuuacauggguggggagggaaaaugugaaacacauuagcaau

SEQ ID NO: 307035 - RNA, 64 nt, Human
aaguuccagagaugugucagcccuuaucaggcaugggagggacacguucaggagaggagccuua

SEQ ID NO: 307036 - RNA, 64 nt, Human
ggaccugucaagacgggaaggggaagaguagagagggagggacaaagugaggaaaaggugcuca

SEQ ID NO: 307037 - RNA, 64 nt, Human
cauuucuacccaggauaauagucacaguuuuccagggagggaaugauauaauuuucaugacaau

SEQ ID NO: 307038 - RNA, 64 nt, Human
gaggaggcauggcacaagugacccuggcuaaggagggagggagccucaaaucacguuguaguuc

SEQ ID NO: 307039 - RNA, 64 nt, Human
uggacauggucccgggcaucugaaugaucuguaggggagggaguucaaauaaagcuuuauuuug

SEQ ID NO: 307040 - RNA, 64 nt, Human
aggggaaggaggcccagugagccgggucccuuaggggagggagaguuuguccucuuugccccac

SEQ ID NO: 307041 - RNA, 64 nt, Human
gagggggcccacccuuaaaggcggcgggaggggagggagggagaguggaggguuugacgggccu

SEQ ID NO: 307042 - RNA, 64 nt, Human
gggggagggggcccacccuuaaaggcggcgggaggggagggagggagaguggaggguuugacgg

SEQ ID NO: 307043 - RNA, 64 nt, Human
ccugcuguucacauggacccugagcaaggaaggagggagggaggggcagaguggagugucauuc

SEQ ID NO: 307044 - RNA, 64 nt, Human
ugaggccugggugauuuauuuauugggaaagugagggagggagacagacugacugacagccaug

SEQ ID NO: 307045 - RNA, 64 nt, Human
cugccugccccaggucuuuggguacaggcuuggugggagggaaguccuagaagcccuugguccc

SEQ ID NO: 307046 - RNA, 64 nt, Human
uccugggcaccccagaggcaaggcugugcacucagggagggagggugggacacagaggugcauc

SEQ ID NO: 307047 - RNA, 64 nt, Human
agcuugcuugugggcacuggcuuggacuuuagcggggagggaagccaggggauuuugaagggug

SEQ ID NO: 307048 - RNA, 64 nt, Human
aucuugaauuguucccguaauccccacgugacaugggagggacccagugggagguaauuuaauc

SEQ ID NO: 307049 - RNA, 64 nt, Human
cuucccugcuuuucucccagaaggcuggguccaggggagggaaaagcuaagagggugaacaaag

SEQ ID NO: 307050 - RNA, 64 nt, Human
augaguuuuaggaccagcauuacuaaggcaggugggcagacagugaccucucuaggugugucca

SEQ ID NO: 307051 - RNA, 64 nt, Human
guuauugggccaccugacagcuggacagaaaaggggcagacacaccgaggaugcgauuuaaaau

SEQ ID NO: 307052 - RNA, 64 nt, Human
uucagcaaacuaaccagcauucccuacagccuagggcagacaauaguauagaagucuggaaaaa

SEQ ID NO: 307053 - RNA, 64 nt, Human
gggucagaagagucgaugaucaccaagcaggaaagggagggaauagaggaauguguucggguua

SEQ ID NO: 307054 - RNA, 64 nt, Human
uuaugucacuuuagaaucaagggugggggagggagggagggaguuggcaguuucaaaucgccca

SEQ ID NO: 307055 - RNA, 64 nt, Human
auucuuaugucacuuuagaaucaagggugggggagggagggagggaguuggcaguuucaaaucg

SEQ ID NO: 307056 - RNA, 64 nt, Human
caccauucuuaugucacuuuagaaucaagggugggggagggagggagggaguuggcaguuucaa

SEQ ID NO: 307057 - RNA, 64 nt, Human
uggccggcccugccccccacauucuggcuccaccgggagggacagucuggaggucccagacaug

SEQ ID NO: 307058 - RNA, 64 nt, Human
gaagagcccucuccaccugcaaggugccaggacugggagggaaaguccagggcccccccacccu

SEQ ID NO: 307059 - RNA, 64 nt, Human
gccugggccuggcuucaccucacccuaaucccccgggagggagcugacugaugcaaaaagcuga

SEQ ID NO: 307060 - RNA, 64 nt, Human
agggaucuuaaggacaaggaagagaagagagagagggagggaucuuugaucucuuucucuggua

SEQ ID NO: 307061 - RNA, 64 nt, Human
ucuggauggcuucuugccuagggugacugacagagggagggaugauaugcaaaggcaccuguuc

SEQ ID NO: 307062 - RNA, 64 nt, Human
aaguccugggcaguucugguaaacgguccaguuagggagggaguagaaacuauugacucaaaag

SEQ ID NO: 307063 - RNA, 64 nt, Human
gcagggagugauguggccgggccaaggacaggcagggagggaggccaggccucgcuugcaccgc

SEQ ID NO: 307064 - RNA, 64 nt, Human
ucaggaccguggcuccagaacuccugugccaggcgggagggaagggcggcacuggagagauggg

SEQ ID NO: 307065 - RNA, 64 nt, Human
cugucagauccuggucccuccacacugggugcuggggagggaggacccucggggcuaccgcgcg

SEQ ID NO: 307066 - RNA, 64 nt, Human
ucuagaauaacacccuucuaggggaggcgggugggggagggagggaucauaaccccuucugugc

SEQ ID NO: 307067 - RNA, 64 nt, Human
gaauaacacccuucuaggggaggcgggugggggagggagggaucauaaccccuucugugccuug

SEQ ID NO: 307068 - RNA, 64 nt, Human
cucacaucugaacugggggcaggugcauaccuuggggagggaguagggggacacgggggaccac

SEQ ID NO: 307069 - RNA, 64 nt, Human
gaaaaacguucucagcuuuaagacacccccauuaggcagacacuggguucugugacagcagagc

SEQ ID NO: 307070 - RNA, 64 nt, Human
aaggggccucucuugaaacaguaguugggaaggaggcagacaugcaccagugauguggugacag

SEQ ID NO: 307071 - RNA, 64 nt, Human
cacugaauuaugggcaaaaccaugacuuucauugggcagacagagucuucuaagcccacaggga

SEQ ID NO: 307072 - RNA, 64 nt, Human
cuccuccagggugugugcucgcccugcgguagaugggagggaggcucaggucccuggggcuagg

SEQ ID NO: 307073 - RNA, 64 nt, Human
ggaaggaagccggggaagagauccaaagacucuugggagggaguuacugaagucuuacuacaga

SEQ ID NO: 307074 - RNA, 64 nt, Human
uggcagccgggggccguggccacauuaccucagcgggagggagcagagcugggacaggcagcua

SEQ ID NO: 307075 - RNA, 64 nt, Human
gcaggucuccaccugcacauuggguggggcuccugggagggagacucagccuuccuccucaucc

SEQ ID NO: 307076 - RNA, 64 nt, Human
uggccuuuucugaaguuacagaaaacaccaacaugggagggaguuuaugaagcaaaggcaaagg

SEQ ID NO: 307077 - RNA, 64 nt, Human
ucauuccagaucuccagggcucaugucugugacagggagggaaggcucugcccuggccuuccgu

SEQ ID NO: 307078 - RNA, 64 nt, Human
gcucacgggcagagaaggguagcccuggggcugggggagggauuggaagccucccuggagucac

SEQ ID NO: 307079 - RNA, 64 nt, Human
acaggugcgggugguggggaugaaggccugaccagggagggagaagcagguuuggagaggaccc

SEQ ID NO: 307080 - RNA, 64 nt, Human
gaggcagaggggcugugccgugcuagaguccucagggagggagugaccucgacccuggcugugc

SEQ ID NO: 307081 - RNA, 64 nt, Human
uucugguuuuggcagucacuggaucaggauccaggggagggagauggaggcacccaaacuggaa

SEQ ID NO: 307082 - RNA, 64 nt, Human
gacugugucugucugugucugcauguaagagugagggagggaaggaaggaacuacaagagaguc

SEQ ID NO: 307083 - RNA, 64 nt, Human
aggguuggggugguuuuugagccaugcguggguggggagggagguguuuaacggcacuguggcc

SEQ ID NO: 307084 - RNA, 64 nt, Human
cggggaggagcagcugggacccagaacugagccugggagggauccgacagaaaagcucagggcg

SEQ ID NO: 307085 - RNA, 64 nt, Human
ccuaaaccccuccccaccucugcaggacagacaugggagggaggacagggaaggccaggcuugc

SEQ ID NO: 307086 - RNA, 64 nt, Human
uccccucagaucagucaggaggaagaugacuaaggggagggauccucugggugauggccucuuc

SEQ ID NO: 307087 - RNA, 64 nt, Human
acuuuccccuugugggguaggaaccgaugccagugggagggaugugccccugaccauuaacgac

SEQ ID NO: 307088 - RNA, 64 nt, Human
accuaagguggcccucuugcacaaaccagccuaaggcagacacucuccacuguccagguuauaa

SEQ ID NO: 307089 - RNA, 64 nt, Human
cagucucaguugcaaucagugugugcccagccugggcagacaggaaauuccucggauacauuau

SEQ ID NO: 307090 - RNA, 64 nt, Human
agaagcaaagaguggaaugugaggagcagaccuaggcagacaccuugagacuaaaagucagagc

SEQ ID NO: 307091 - RNA, 64 nt, Human
agauggcauggcaagcaugggggcgggguggguggggagggaugcugcauuucucagcugggca

SEQ ID NO: 307092 - RNA, 64 nt, Human
gugugucacugcuggugggccggagugauguggugggagggaagccgggaauguauccuuuuca

SEQ ID NO: 307093 - RNA, 64 nt, Human
ggucacccccugcagggaccugaugcccucgggugggagggaccgagguccacccucgggucaa

SEQ ID NO: 307094 - RNA, 64 nt, Human
ccauccccaguccagccugggcaaccccaccccugggagggaugaggcacccucuugcucagcc

SEQ ID NO: 307095 - RNA, 64 nt, Human
gcgaguggagaaacgcccuccagucugagagcaggggagggaaggaggcagcagaguuggggca

SEQ ID NO: 307096 - RNA, 64 nt, Human
ugugaugaagcugagcagaguggaaacuuccauagggagggagcuagaagaaggugccccuucc

SEQ ID NO: 307097 - RNA, 64 nt, Human
aucagaucaacucugucuugggcguuugaacucagggagggaggcccuugggagcaggugcuug

SEQ ID NO: 307098 - RNA, 64 nt, Human
agccccauguuuuguuuuucugaguugguggggagggagggagggggagggcugaauuguuuug

SEQ ID NO: 307099 - RNA, 64 nt, Human
ugggagccccauguuuuguuuuucugaguugguggggagggagggagggggagggcugaauugu

SEQ ID NO: 307100 - RNA, 64 nt, Human
aagcugagcaucucccgaguccugggcagggaaggggagggaaauugcugcuucuccaacucuu

SEQ ID NO: 307101 - RNA, 64 nt, Human
caacucagccaacccaggugugggcagucagggagggagggagugucccaccacguucucaggg

SEQ ID NO: 307102 - RNA, 64 nt, Human
ccuccaacucagccaacccaggugugggcagucagggagggagggagugucccaccacguucuc

SEQ ID NO: 307103 - RNA, 64 nt, Human
gaguguugacaacccaaagcuguucuccagucuggggagggagaggcaggguccccaauguccg

SEQ ID NO: 307104 - RNA, 64 nt, Human
ccucucccaucccuuggccuggaccagugagcuggggagggacucggaugaacugaggcgcagc

SEQ ID NO: 307105 - RNA, 64 nt, Human
ccagagcuggcagugugagcuguaggcagggacggggagggacugucgcugugaucagaguggg

SEQ ID NO: 307106 - RNA, 64 nt, Human
ugggaugauggggaaaggguggggggaauuaaaagggagggauaaauauauauauauaaaucua

SEQ ID NO: 307107 - RNA, 64 nt, Human
uuuuguuuucagcaacauaaauugauuuuuagcuggcagacaagaauauccauauaagauuugu

SEQ ID NO: 307108 - RNA, 64 nt, Human
guauaguaugauucucaccauuauuugucauggaggcagacauacaccagaaaugggggagaaa

SEQ ID NO: 307109 - RNA, 64 nt, Human
uguggaagagccuuguagagaacugcuccugugaggcagacaggacagugagguugucaccacu

SEQ ID NO: 307110 - RNA, 64 nt, Human
cugaccuaugaggccucaaugaccagaauguuccgggagggacggacugagacugugcguuccu

SEQ ID NO: 307111 - RNA, 64 nt, Human
auacacaccaucaccuuugaaagugcuuguuugggggagggaaggacauacggguaacuagaac

SEQ ID NO: 307112 - RNA, 64 nt, Human
acccagccugugccccacaaggaucucucuaaaugggagggauugaggcuacuuuucugccaag

SEQ ID NO: 307113 - RNA, 64 nt, Human
uaucacuuugacagaggagaagauugagggaggggggagggagggucauggggguggguuuccu

SEQ ID NO: 307114 - RNA, 64 nt, Human
ccccuccccaagcuccugaagacccgguuucugagggagggaaauugcuacuuggauugagagu

SEQ ID NO: 307115 - RNA, 64 nt, Human
uaugguuuagucauugcagaguucuuauuuuggggggagggaaagggggcuaguccccuucuuu

SEQ ID NO: 307116 - RNA, 55 nt, Human
gccugacacgggaagagugacaguagggagggaggacagaccuccaccacacuga

SEQ ID NO: 307117 - RNA, 64 nt, Human
uaaagauaaagcugccccaucuggggacgauauggggagggagaugggaggggaaaggggagag

SEQ ID NO: 307118 - RNA, 64 nt, Human
cgcagaguagcugucuguuugacugcuucauccagggagggagaaggcuuuucagcaccaucua

SEQ ID NO: 307119 - RNA, 64 nt, Human
uauguucacuucauuuguuugcuguucaucuuuugggagggaauaagcuagagccaucaauaca

SEQ ID NO: 307120 - RNA, 64 nt, Human
uaaaagcuguacauuugugggaguugaauagaaugggagggauguuuaguauauccaguaugau

SEQ ID NO: 307121 - RNA, 64 nt, Human
cucuucuuuuagcaguaaaauagcugagggaaaagggagggaaaaggaaguuaugggaauaccu

SEQ ID NO: 307122 - RNA, 64 nt, Human
auuuuacucaauugguuacucucauuugaaaugagggagggacauacagaauaggaacaggugu

SEQ ID NO: 307123 - RNA, 64 nt, Human
cugccugauacuaccauagcaccucaguaccaaggggagggauuuugacuaguugaauuauuaa

SEQ ID NO: 307124 - RNA, 64 nt, Human
ucucgugaugugaauuaauuuuuuugugugcuaggggagggagagugaggagggaguguuauuu

SEQ ID NO: 307125 - RNA, 64 nt, Human
cugucaaaugaaucucuucaguauaccaguuugugggagggauaugagacauguggauggcagu

SEQ ID NO: 307126 - RNA, 64 nt, Human
caagguucugcccuuauggagcucacacuccaguggcagacaaacagaccauaaauaaggaaac

SEQ ID NO: 307127 - RNA, 64 nt, Human
cucaagaccagagacccaacagcagugaucucagggcagacagcccuccacuccagcucugaga

SEQ ID NO: 307128 - RNA, 64 nt, Human
ucuaaaaucccagaacacaaucagaaauagcucaggcagacacuaauaauuaagaacgcucuuc

SEQ ID NO: 307129 - RNA, 64 nt, Human
uugggaaaugugaggaagggaaggagggagagacgggagggaggagagagaggagaagggaggc

SEQ ID NO: 307130 - RNA, 64 nt, Human
ggccacaccucagugccaaagaccccaugggagugggagggaugacaagcggcccccgccucca

SEQ ID NO: 307131 - RNA, 64 nt, Human
cugacaugcugcagucggaaguuuccuuuuccgugggagggaggcauucaucuacagacuccaa

SEQ ID NO: 307132 - RNA, 64 nt, Human
aauagggaaccaagauugcagagugucccaucuugggagggaaugcugaauaauuaauugauuu

SEQ ID NO: 307133 - RNA, 64 nt, Human
aucugggcuuccacccucaugaacacagggauuggggagggaccagagcgcccaauacacacag

SEQ ID NO: 307134 - RNA, 64 nt, Human
ggguacaaaggacccuuucaaugucccuggaguugggagggaggaaugggggacauaaagccug

SEQ ID NO: 307135 - RNA, 64 nt, Human
uccccugagguuaaggggaucuaaaaggaggacagggagggaacagaccucggcugugugggga

SEQ ID NO: 307136 - RNA, 64 nt, Human
uaaugggggacggaagggggaggagugcucaacggggagggaaaugaucuaugacuccaaccgu

SEQ ID NO: 307137 - RNA, 64 nt, Human
uccaaagcuaaggcuggguaagaauaguugugcagggagggagcacgagaugggcagagcuggu

SEQ ID NO: 307138 - RNA, 64 nt, Human
gggacacaaaggccgagugggguaaaaccacgaagggagggaagggaagucagcucugggagca

SEQ ID NO: 307139 - RNA, 64 nt, Human
cugggaggagcugagugugaugaagguguauguugggagggagcacagugucuguggggagccc

SEQ ID NO: 307140 - RNA, 64 nt, Human
cugugaggagggccugggcaggcugugggagccggggagggacugagcagugaguggggcugaa

SEQ ID NO: 307141 - RNA, 64 nt, Human
ugggagggagggcuggggauggaugggagggaaggggagggaaaggugggaggaaugggaagca

SEQ ID NO: 307142 - RNA, 64 nt, Human
ggaggaagagugggagggagggcuggggauggaugggagggaaggggagggaaaggugggagga

SEQ ID NO: 307143 - RNA, 64 nt, Human
cugauggcugggaagggaguuggggaggaagagugggagggagggcuggggauggaugggaggg

SEQ ID NO: 307144 - RNA, 64 nt, Human
ccgcugccgcccacccuggggagagacuuuugcggggagggaaggcggagcugaggacagccag

SEQ ID NO: 307145 - RNA, 64 nt, Human
aaaugaaguaacuuucaauaaaugcaauauuauuggcagacauuguugaaggaaaaaagccaga

SEQ ID NO: 307146 - RNA, 64 nt, Human
ugggcaucagaacagccugcccugggcaccagguggcagacacacucagagcaugucuggcuuu

SEQ ID NO: 307147 - RNA, 64 nt, Human
cuucgcacaggcuccuggagggcugccugggggaggcagacaugggagugccaagguggccaga

SEQ ID NO: 307148 - RNA, 64 nt, Human
cugggucucacuccugaguggggccagggugggagggagggacaagggggaggaaaggggcgag

SEQ ID NO: 307149 - RNA, 64 nt, Human
gccacugggucucacuccugaguggggccagggugggagggagggacaagggggaggaaagggg

SEQ ID NO: 307150 - RNA, 64 nt, Human
aaacccaggagcacugggaguuaagcuuuccuuggggagggaagagccuugauguccagcacac

SEQ ID NO: 307151 - RNA, 64 nt, Human
cugaggacgugaaccgcgggcuuuggaaagggaggggagggagacccgaaccucccacguuggg

SEQ ID NO: 307152 - RNA, 64 nt, Human
aucggcagccgauuccgugucuugaucacggggugggagggaaccguggcgucccugcgugggg

SEQ ID NO: 307153 - RNA, 64 nt, Human
acuuuacuucuguucuuggcaggacauggagagagggagggauuccaaaaagucucagccucca

SEQ ID NO: 307154 - RNA, 64 nt, Human; identical to SEQ ID NO: 290590

SEQ ID NO: 307155 - RNA, 64 nt, Human; identical to SEQ ID NO: 290591

SEQ ID NO: 307156 - RNA, 64 nt, Human; identical to SEQ ID NO: 290592

SEQ ID NO: 307157 - RNA, 64 nt, Human; identical to SEQ ID NO: 290593

SEQ ID NO: 307158 - RNA, 64 nt, Human; identical to SEQ ID NO: 290594

SEQ ID NO: 307159 - RNA, 64 nt, Human
ucacccauauuuccuuauugauauuauugguacaggcagacaacccugguaggagagauggauu

SEQ ID NO: 307160 - RNA, 64 nt, Human
accaggauuugcucgaucucagcccagcaggccaggcagacacaccccgcugugccuuaggaag

SEQ ID NO: 307161 - RNA, 64 nt, Human
guaaagaugagcaaacauuuggaauuuacaugugggcagacauugggauaacaacuuucaucac

SEQ ID NO: 307162 - RNA, 64 nt, Human; identical to SEQ ID NO: 290595

SEQ ID NO: 307163 - RNA, 64 nt, Human; identical to SEQ ID NO: 290596

SEQ ID NO: 307164 - RNA, 64 nt, Human; identical to SEQ ID NO: 290597

SEQ ID NO: 307165 - RNA, 64 nt, Human; identical to SEQ ID NO: 290598

SEQ ID NO: 307166 - RNA, 64 nt, Human; identical to SEQ ID NO: 290599

SEQ ID NO: 307167 - RNA, 64 nt, Human; identical to SEQ ID NO: 290600

SEQ ID NO: 307168 - RNA, 64 nt, Human; identical to SEQ ID NO: 290601

SEQ ID NO: 307169 - RNA, 64 nt, Human; identical to SEQ ID NO: 290602

SEQ ID NO: 307170 - RNA, 64 nt, Human; identical to SEQ ID NO: 290603

SEQ ID NO: 307171 - RNA, 64 nt, Human; identical to SEQ ID NO: 290604

SEQ ID NO: 307172 - RNA, 64 nt, Human; identical to SEQ ID NO: 290605

SEQ ID NO: 307173 - RNA, 64 nt, Human; identical to SEQ ID NO: 290609

SEQ ID NO: 307174 - RNA, 64 nt, Human; identical to SEQ ID NO: 290610

SEQ ID NO: 307175 - RNA, 64 nt, Human; identical to SEQ ID NO: 290611

SEQ ID NO: 307176 - RNA, 64 nt, Human; identical to SEQ ID NO: 290612

SEQ ID NO: 307177 - RNA, 64 nt, Human; identical to SEQ ID NO: 290613

SEQ ID NO: 307178 - RNA, 64 nt, Human
aaguucugaucauuauauaagaagggaaaugccuggcagacaccauguaaguuauaagugucug

SEQ ID NO: 307179 - RNA, 64 nt, Human
uaaaaauccugugaauacaauacuauccuuuacaggcagacauuauugguaaacaagaucuugc

SEQ ID NO: 307180 - RNA, 64 nt, Human
ggauuuucagcaggaacuuuauuccaaugcuaauggcagacaccaggaaggaggagaggaacca

SEQ ID NO: 307181 - RNA, 64 nt, Human; identical to SEQ ID NO: 290614

SEQ ID NO: 307182 - RNA, 64 nt, Human; identical to SEQ ID NO: 290615

SEQ ID NO: 307183 - RNA, 64 nt, Human; identical to SEQ ID NO: 290616

SEQ ID NO: 307184 - RNA, 64 nt, Human; identical to SEQ ID NO: 290617

SEQ ID NO: 307185 - RNA, 64 nt, Human; identical to SEQ ID NO: 290618

SEQ ID NO: 307186 - RNA, 64 nt, Human; identical to SEQ ID NO: 290619

SEQ ID NO: 307187 - RNA, 64 nt, Human; identical to SEQ ID NO: 290620

SEQ ID NO: 307188 - RNA, 64 nt, Human; identical to SEQ ID NO: 290621

SEQ ID NO: 307189 - RNA, 64 nt, Human; identical to SEQ ID NO: 290622

SEQ ID NO: 307190 - RNA, 64 nt, Human; identical to SEQ ID NO: 290623

SEQ ID NO: 307191 - RNA, 64 nt, Human; identical to SEQ ID NO: 290624

SEQ ID NO: 307192 - RNA, 64 nt, Human; identical to SEQ ID NO: 290628

SEQ ID NO: 307193 - RNA, 64 nt, Human; identical to SEQ ID NO: 290629

SEQ ID NO: 307194 - RNA, 64 nt, Human; identical to SEQ ID NO: 290630

SEQ ID NO: 307195 - RNA, 64 nt, Human; identical to SEQ ID NO: 290631

SEQ ID NO: 307196 - RNA, 64 nt, Human; identical to SEQ ID NO: 290632

SEQ ID NO: 307197 - RNA, 64 nt, Human
gauggccaagcucccacccuggguauucaaaaacggcagacacaacauguuccuccacgcggcu

SEQ ID NO: 307198 - RNA, 64 nt, Human
cccucugaaggaaacuaguuuccacuguguaacaggcagacauguaacuauuuaaagcacaguu

SEQ ID NO: 307199 - RNA, 64 nt, Human
auuauacaguaaguugacaccacuuagauuuaaaggcagacaguuuugcuuuaguacaauagua

SEQ ID NO: 307200 - RNA, 64 nt, Human; identical to SEQ ID NO: 290633

SEQ ID NO: 307201 - RNA, 64 nt, Human; identical to SEQ ID NO: 290634

SEQ ID NO: 307202 - RNA, 64 nt, Human; identical to SEQ ID NO: 290635

SEQ ID NO: 307203 - RNA, 64 nt, Human; identical to SEQ ID NO: 290636

SEQ ID NO: 307204 - RNA, 64 nt, Human; identical to SEQ ID NO: 290637

SEQ ID NO: 307205 - RNA, 64 nt, Human; identical to SEQ ID NO: 290638

SEQ ID NO: 307206 - RNA, 64 nt, Human; identical to SEQ ID NO: 290639

SEQ ID NO: 307207 - RNA, 64 nt, Human; identical to SEQ ID NO: 290640

SEQ ID NO: 307208 - RNA, 64 nt, Human; identical to SEQ ID NO: 290641

SEQ ID NO: 307209 - RNA, 64 nt, Human; identical to SEQ ID NO: 290642

SEQ ID NO: 307210 - RNA, 64 nt, Human; identical to SEQ ID NO: 290643

SEQ ID NO: 307211 - RNA, 64 nt, Human; identical to SEQ ID NO: 290647

SEQ ID NO: 307212 - RNA, 64 nt, Human; identical to SEQ ID NO: 290648

SEQ ID NO: 307213 - RNA, 64 nt, Human; identical to SEQ ID NO: 290649

SEQ ID NO: 307214 - RNA, 64 nt, Human; identical to SEQ ID NO: 290650

SEQ ID NO: 307215 - RNA, 64 nt, Human; identical to SEQ ID NO: 290651

SEQ ID NO: 307216 - RNA, 64 nt, Human
ucuauacauauggcucuugaggacuuagcuuucacuacacuacaggauaugaucuccauguagu

SEQ ID NO: 307217 - RNA, 64 nt, Human
auuacuuuaaauagccagcauguaauacaaguaacuacacuaccucauaucuacaugauuuuca

SEQ ID NO: 307218 - RNA, 64 nt, Human
caguggacagggcaucuguuacccugagaccuguggcagacacgucuuguuuucauuugauuuu

SEQ ID NO: 307219 - RNA, 64 nt, Human; identical to SEQ ID NO: 290652

SEQ ID NO: 307220 - RNA, 64 nt, Human; identical to SEQ ID NO: 290653

SEQ ID NO: 307221 - RNA, 64 nt, Human; identical to SEQ ID NO: 290654

SEQ ID NO: 307222 - RNA, 64 nt, Human; identical to SEQ ID NO: 290655

SEQ ID NO: 307223 - RNA, 64 nt, Human; identical to SEQ ID NO: 290656

SEQ ID NO: 307224 - RNA, 64 nt, Human; identical to SEQ ID NO: 290657

SEQ ID NO: 307225 - RNA, 64 nt, Human; identical to SEQ ID NO: 290658

SEQ ID NO: 307226 - RNA, 64 nt, Human; identical to SEQ ID NO: 290659

SEQ ID NO: 307227 - RNA, 64 nt, Human; identical to SEQ ID NO: 290660

SEQ ID NO: 307228 - RNA, 64 nt, Human; identical to SEQ ID NO: 290661

SEQ ID NO: 307229 - RNA, 64 nt, Human; identical to SEQ ID NO: 290662

SEQ ID NO: 307230 - RNA, 64 nt, Human; identical to SEQ ID NO: 290666

SEQ ID NO: 307231 - RNA, 64 nt, Human; identical to SEQ ID NO: 290667

SEQ ID NO: 307232 - RNA, 64 nt, Human; identical to SEQ ID NO: 290668

SEQ ID NO: 307233 - RNA, 64 nt, Human; identical to SEQ ID NO: 290669

SEQ ID NO: 307234 - RNA, 64 nt, Human; identical to SEQ ID NO: 290670

SEQ ID NO: 307235 - RNA, 64 nt, Human
ccaaagcuucuagucuagaggucuguugguugaaggcagacauuuccaaguuuguugaaauaau

SEQ ID NO: 307236 - RNA, 64 nt, Human
ggauacagacccugcaguccgcucagggugggauggcagacauggcaggugccggugcucaccc

SEQ ID NO: 307237 - RNA, 64 nt, Human
uugaagaugagggauggugaauggcugugaccauggcagacaucaccaaucaagugcagcacau

SEQ ID NO: 307238 - RNA, 64 nt, Human; identical to SEQ ID NO: 290671

SEQ ID NO: 307239 - RNA, 64 nt, Human; identical to SEQ ID NO: 290672

SEQ ID NO: 307240 - RNA, 64 nt, Human; identical to SEQ ID NO: 290673

SEQ ID NO: 307241 - RNA, 64 nt, Human; identical to SEQ ID NO: 290674

SEQ ID NO: 307242 - RNA, 64 nt, Human; identical to SEQ ID NO: 290675

SEQ ID NO: 307243 - RNA, 64 nt, Human; identical to SEQ ID NO: 290676

SEQ ID NO: 307244 - RNA, 64 nt, Human; identical to SEQ ID NO: 290677

SEQ ID NO: 307245 - RNA, 64 nt, Human; identical to SEQ ID NO: 290678

SEQ ID NO: 307246 - RNA, 64 nt, Human; identical to SEQ ID NO: 290679

SEQ ID NO: 307247 - RNA, 64 nt, Human; identical to SEQ ID NO: 290680

SEQ ID NO: 307248 - RNA, 64 nt, Human; identical to SEQ ID NO: 290681

SEQ ID NO: 307249 - RNA, 64 nt, Human; identical to SEQ ID NO: 290685

SEQ ID NO: 307250 - RNA, 64 nt, Human; identical to SEQ ID NO: 290686

SEQ ID NO: 307251 - RNA, 64 nt, Human; identical to SEQ ID NO: 290687

SEQ ID NO: 307252 - RNA, 64 nt, Human; identical to SEQ ID NO: 290688

SEQ ID NO: 307253 - RNA, 64 nt, Human; identical to SEQ ID NO: 290689

SEQ ID NO: 307254 - RNA, 64 nt, Human
aaauaauaauaaagaaaaauaaauaaaaaggagaggcagacaaugucuggauuccuguuuuuug

SEQ ID NO: 307255 - RNA, 64 nt, Human
gcaguagacggcuugggggagucggaggcuccccggcagacaccccacccccaucuuguucccu

SEQ ID NO: 307256 - RNA, 64 nt, Human
acagacugguuccucugcucugaggguggguccaggcagacauguggacucuggggagguacug

SEQ ID NO: 307257 - RNA, 64 nt, Human; identical to SEQ ID NO: 290690

SEQ ID NO: 307258 - RNA, 64 nt, Human; identical to SEQ ID NO: 290691

SEQ ID NO: 307259 - RNA, 64 nt, Human; identical to SEQ ID NO: 290692

SEQ ID NO: 307260 - RNA, 64 nt, Human; identical to SEQ ID NO: 290693

SEQ ID NO: 307261 - RNA, 64 nt, Human; identical to SEQ ID NO: 290694

SEQ ID NO: 307262 - RNA, 64 nt, Human; identical to SEQ ID NO: 290695

SEQ ID NO: 307263 - RNA, 64 nt, Human; identical to SEQ ID NO: 290696

SEQ ID NO: 307264 - RNA, 64 nt, Human; identical to SEQ ID NO: 290697

SEQ ID NO: 307265 - RNA, 64 nt, Human; identical to SEQ ID NO: 290698

SEQ ID NO: 307266 - RNA, 64 nt, Human; identical to SEQ ID NO: 290699

SEQ ID NO: 307267 - RNA, 64 nt, Human; identical to SEQ ID NO: 290700

SEQ ID NO: 307268 - RNA, 64 nt, Human; identical to SEQ ID NO: 290704

SEQ ID NO: 307269 - RNA, 64 nt, Human; identical to SEQ ID NO: 290705

SEQ ID NO: 307270 - RNA, 64 nt, Human; identical to SEQ ID NO: 290706

SEQ ID NO: 307271 - RNA, 64 nt, Human; identical to SEQ ID NO: 290707

SEQ ID NO: 307272 - RNA, 64 nt, Human; identical to SEQ ID NO: 290708

SEQ ID NO: 307273 - RNA, 64 nt, Human
uggccagcuggggugagaaggccgcgaagccaugggcagacaggaaguggaggugaaugucucu

SEQ ID NO: 307274 - RNA, 64 nt, Human
aggagaugcagccagcuaagacuguccacacuuuggcagacaaccgguuuucccuuuucugggu

SEQ ID NO: 307275 - RNA, 64 nt, Human
acuagguuauuuauaauguauuucugaaccacuuggcagacaaauucacaacacuuaauguuca

SEQ ID NO: 307276 - RNA, 64 nt, Human; identical to SEQ ID NO: 290709

SEQ ID NO: 307277 - RNA, 64 nt, Human; identical to SEQ ID NO: 290710

SEQ ID NO: 307278 - RNA, 64 nt, Human; identical to SEQ ID NO: 290711

SEQ ID NO: 307279 - RNA, 64 nt, Human; identical to SEQ ID NO: 290712

SEQ ID NO: 307280 - RNA, 64 nt, Human; identical to SEQ ID NO: 290713

SEQ ID NO: 307281 - RNA, 64 nt, Human; identical to SEQ ID NO: 290714

SEQ ID NO: 307282 - RNA, 64 nt, Human; identical to SEQ ID NO: 290715

SEQ ID NO: 307283 - RNA, 64 nt, Human; identical to SEQ ID NO: 290716

SEQ ID NO: 307284 - RNA, 64 nt, Human; identical to SEQ ID NO: 290717

SEQ ID NO: 307285 - RNA, 64 nt, Human; identical to SEQ ID NO: 290718

SEQ ID NO: 307286 - RNA, 64 nt, Human; identical to SEQ ID NO: 290719

SEQ ID NO: 307287 - RNA, 64 nt, Human; identical to SEQ ID NO: 290723

SEQ ID NO: 307288 - RNA, 64 nt, Human; identical to SEQ ID NO: 290724

SEQ ID NO: 307289 - RNA, 64 nt, Human; identical to SEQ ID NO: 290725

SEQ ID NO: 307290 - RNA, 64 nt, Human; identical to SEQ ID NO: 290726

SEQ ID NO: 307291 - RNA, 64 nt, Human; identical to SEQ ID NO: 290727

SEQ ID NO: 307292 - RNA, 64 nt, Human
caugguucuguguaacuguggcuauucugugucccuacacuaccuggcuacccccuuccauggc

SEQ ID NO: 307293 - RNA, 64 nt, Human
guaccaucuaugugcaauuauacucuaaauuccacuacacuacauuaaaguaaauggacauucc

SEQ ID NO: 307294 - RNA, 64 nt, Human
gcccuccaucucagccauuggggcagggacccuccuacacuacagaggggccaggggaucccuc

SEQ ID NO: 307295 - RNA, 64 nt, Human; identical to SEQ ID NO: 290728

SEQ ID NO: 307296 - RNA, 64 nt, Human; identical to SEQ ID NO: 290729

SEQ ID NO: 307297 - RNA, 64 nt, Human; identical to SEQ ID NO: 290730

SEQ ID NO: 307298 - RNA, 64 nt, Human; identical to SEQ ID NO: 290731

SEQ ID NO: 307299 - RNA, 64 nt, Human; identical to SEQ ID NO: 290732

SEQ ID NO: 307300 - RNA, 64 nt, Human; identical to SEQ ID NO: 290733

SEQ ID NO: 307301 - RNA, 64 nt, Human; identical to SEQ ID NO: 290734

SEQ ID NO: 307302 - RNA, 64 nt, Human; identical to SEQ ID NO: 290735

SEQ ID NO: 307303 - RNA, 64 nt, Human; identical to SEQ ID NO: 290736

SEQ ID NO: 307304 - RNA, 64 nt, Human; identical to SEQ ID NO: 290737

SEQ ID NO: 307305 - RNA, 64 nt, Human; identical to SEQ ID NO: 290738

SEQ ID NO: 307306 - RNA, 64 nt, Human; identical to SEQ ID NO: 290742

SEQ ID NO: 307307 - RNA, 64 nt, Human; identical to SEQ ID NO: 290743

SEQ ID NO: 307308 - RNA, 64 nt, Human; identical to SEQ ID NO: 290744

SEQ ID NO: 307309 - RNA, 64 nt, Human; identical to SEQ ID NO: 290745

SEQ ID NO: 307310 - RNA, 64 nt, Human; identical to SEQ ID NO: 290746

SEQ ID NO: 307311 - RNA, 64 nt, Human
cuuauugcccccucuucuuauacccuaaaaccuucuacacuagugccaugggaaccaggucuga

SEQ ID NO: 307312 - RNA, 64 nt, Human
aucuuacucugccuuucugcuuuggauguggucucuacacuaaccuucuugauguccaggguag

SEQ ID NO: 307313 - RNA, 64 nt, Human
ccuuuugaggcuucuccuucuccuucccauuucucuacacuaagggguauguucccucuugucc

SEQ ID NO: 307314 - RNA, 64 nt, Human; identical to SEQ ID NO: 290747

SEQ ID NO: 307315 - RNA, 64 nt, Human; identical to SEQ ID NO: 290748

SEQ ID NO: 307316 - RNA, 64 nt, Human; identical to SEQ ID NO: 290749

SEQ ID NO: 307317 - RNA, 64 nt, Human; identical to SEQ ID NO: 290750

SEQ ID NO: 307318 - RNA, 51 nt, Human; identical to SEQ ID NO: 290751

SEQ ID NO: 307319 - RNA, 64 nt, Human; identical to SEQ ID NO: 290752

SEQ ID NO: 307320 - RNA, 64 nt, Human; identical to SEQ ID NO: 290753

SEQ ID NO: 307321 - RNA, 64 nt, Human; identical to SEQ ID NO: 290754

SEQ ID NO: 307322 - RNA, 64 nt, Human; identical to SEQ ID NO: 290755

SEQ ID NO: 307323 - RNA, 64 nt, Human; identical to SEQ ID NO: 290756

SEQ ID NO: 307324 - RNA, 64 nt, Human; identical to SEQ ID NO: 290757

SEQ ID NO: 307325 - RNA, 64 nt, Human; identical to SEQ ID NO: 290761

SEQ ID NO: 307326 - RNA, 64 nt, Human; identical to SEQ ID NO: 290762

SEQ ID NO: 307327 - RNA, 64 nt, Human; identical to SEQ ID NO: 290763

SEQ ID NO: 307328 - RNA, 64 nt, Human; identical to SEQ ID NO: 290764

SEQ ID NO: 307329 - RNA, 64 nt, Human; identical to SEQ ID NO: 290765

SEQ ID NO: 307330 - RNA, 64 nt, Human
cauagcaagccuguaccacucuacaguaaaaucucuacacuaacaguuuaaagcccgaaagcug

SEQ ID NO: 307331 - RNA, 57 nt, Human
auaugcaaacgguuuuguaaguuaacacuacacuacucacaaugguaggggaacuua

SEQ ID NO: 307332 - RNA, 64 nt, Human
ggagaaaagucuguuugccucaggagugugaggacuacacuagugaaagcgccuggcgggcagc

SEQ ID NO: 307333 - RNA, 64 nt, Human; identical to SEQ ID NO: 290766

SEQ ID NO: 307334 - RNA, 64 nt, Human; identical to SEQ ID NO: 290767

SEQ ID NO: 307335 - RNA, 64 nt, Human; identical to SEQ ID NO: 290768

SEQ ID NO: 307336 - RNA, 64 nt, Human; identical to SEQ ID NO: 290769

SEQ ID NO: 307337 - RNA, 64 nt, Human; identical to SEQ ID NO: 290770

SEQ ID NO: 307338 - RNA, 64 nt, Human; identical to SEQ ID NO: 290771

SEQ ID NO: 307339 - RNA, 59 nt, Human; identical to SEQ ID NO: 290772

SEQ ID NO: 307340 - RNA, 64 nt, Human; identical to SEQ ID NO: 290773

SEQ ID NO: 307341 - RNA, 64 nt, Human; identical to SEQ ID NO: 290774

SEQ ID NO: 307342 - RNA, 64 nt, Human; identical to SEQ ID NO: 290775

SEQ ID NO: 307343 - RNA, 64 nt, Human; identical to SEQ ID NO: 290776

SEQ ID NO: 307344 - RNA, 64 nt, Human; identical to SEQ ID NO: 290780

SEQ ID NO: 307345 - RNA, 64 nt, Human; identical to SEQ ID NO: 290781

SEQ ID NO: 307346 - RNA, 64 nt, Human; identical to SEQ ID NO: 290782

SEQ ID NO: 307347 - RNA, 64 nt, Human; identical to SEQ ID NO: 290783

SEQ ID NO: 307348 - RNA, 64 nt, Human; identical to SEQ ID NO: 290784

SEQ ID NO: 307349 - RNA, 64 nt, Human
guuuuccuacaagugauuuaggggcagauccugacuacacuaagucaggguuugacaaaugaca

SEQ ID NO: 307350 - RNA, 64 nt, Human
gcuggagagagggagcuugcugccuccugccuugcuacacuaauguuuacagcaccuaagcuua

SEQ ID NO: 307351 - RNA, 64 nt, Human
ugucaauacuuaauugggggugggagagacugagcuacacuacugcuaaacuauuuuuagcaua

SEQ ID NO: 307352 - RNA, 64 nt, Human; identical to SEQ ID NO: 290785

SEQ ID NO: 307353 - RNA, 64 nt, Human; identical to SEQ ID NO: 290786

SEQ ID NO: 307354 - RNA, 64 nt, Human; identical to SEQ ID NO: 290787

SEQ ID NO: 307355 - RNA, 64 nt, Human; identical to SEQ ID NO: 290788

SEQ ID NO: 307356 - RNA, 64 nt, Human; identical to SEQ ID NO: 290789

SEQ ID NO: 307357 - RNA, 64 nt, Human; identical to SEQ ID NO: 290790

SEQ ID NO: 307358 - RNA, 64 nt, Human; identical to SEQ ID NO: 290791

SEQ ID NO: 307359 - RNA, 64 nt, Human; identical to SEQ ID NO: 290792

SEQ ID NO: 307360 - RNA, 64 nt, Human; identical to SEQ ID NO: 290793

SEQ ID NO: 307361 - RNA, 64 nt, Human; identical to SEQ ID NO: 290794

SEQ ID NO: 307362 - RNA, 64 nt, Human; identical to SEQ ID NO: 290795

SEQ ID NO: 307363 - RNA, 64 nt, Human; identical to SEQ ID NO: 290799

SEQ ID NO: 307364 - RNA, 64 nt, Human; identical to SEQ ID NO: 290800

SEQ ID NO: 307365 - RNA, 64 nt, Human; identical to SEQ ID NO: 290801

SEQ ID NO: 307366 - RNA, 64 nt, Human; identical to SEQ ID NO: 290802

SEQ ID NO: 307367 - RNA, 64 nt, Human; identical to SEQ ID NO: 290803

SEQ ID NO: 307368 - RNA, 64 nt, Human
ggggaccuuaccaccccucagagugcugcuucaccuacacuaccuacaagaucccgcgucagcg

SEQ ID NO: 307369 - RNA, 59 nt, Human
augaugaagagggggagugauggugcagccuacacuauucuagcaggaggguugggcgu

SEQ ID NO: 307370 - RNA, 64 nt, Human
aaugucuguaugcccuggaagaggggauaguccgcuacacuaaggaggucuacgugccucaucc

SEQ ID NO: 307371 - RNA, 64 nt, Human; identical to SEQ ID NO: 290804

SEQ ID NO: 307372 - RNA, 64 nt, Human; identical to SEQ ID NO: 290805

SEQ ID NO: 307373 - RNA, 64 nt, Human; identical to SEQ ID NO: 290806

SEQ ID NO: 307374 - RNA, 64 nt, Human; identical to SEQ ID NO: 290807

SEQ ID NO: 307375 - RNA, 64 nt, Human; identical to SEQ ID NO: 290808

SEQ ID NO: 307376 - RNA, 64 nt, Human; identical to SEQ ID NO: 290809

SEQ ID NO: 307377 - RNA, 64 nt, Human; identical to SEQ ID NO: 290810

SEQ ID NO: 307378 - RNA, 64 nt, Human; identical to SEQ ID NO: 290811

SEQ ID NO: 307379 - RNA, 64 nt, Human; identical to SEQ ID NO: 290812

SEQ ID NO: 307380 - RNA, 64 nt, Human; identical to SEQ ID NO: 290813

SEQ ID NO: 307381 - RNA, 64 nt, Human; identical to SEQ ID NO: 290814

SEQ ID NO: 307382 - RNA, 64 nt, Human; identical to SEQ ID NO: 290818

SEQ ID NO: 307383 - RNA, 64 nt, Human; identical to SEQ ID NO: 290819

SEQ ID NO: 307384 - RNA, 64 nt, Human; identical to SEQ ID NO: 290820

SEQ ID NO: 307385 - RNA, 64 nt, Human; identical to SEQ ID NO: 290821

SEQ ID NO: 307386 - RNA, 64 nt, Human; identical to SEQ ID NO: 290822

SEQ ID NO: 307387 - RNA, 64 nt, Human
gauuuggggggguuuuauauuaaagaaauuaagacuacacuauuuaaauaaacguuuccuguuu

SEQ ID NO: 307388 - RNA, 64 nt, Human
gaauguagguugagagggcacugaagaccugaaucuacacuaguaaucucaagaaagauuauuc

SEQ ID NO: 307389 - RNA, 64 nt, Human
cagcccaagcagagugauucaggggcuccccgggggcagacaccugugcaccccaugaguagug

SEQ ID NO: 307390 - RNA, 64 nt, Human; identical to SEQ ID NO: 290823

SEQ ID NO: 307391 - RNA, 64 nt, Human; identical to SEQ ID NO: 290824

SEQ ID NO: 307392 - RNA, 64 nt, Human; identical to SEQ ID NO: 290825

SEQ ID NO: 307393 - RNA, 64 nt, Human; identical to SEQ ID NO: 290826

SEQ ID NO: 307394 - RNA, 64 nt, Human; identical to SEQ ID NO: 290827

SEQ ID NO: 307395 - RNA, 52 nt, Human; identical to SEQ ID NO: 290828

SEQ ID NO: 307396 - RNA, 64 nt, Human; identical to SEQ ID NO: 290829

SEQ ID NO: 307397 - RNA, 64 nt, Human; identical to SEQ ID NO: 290830

SEQ ID NO: 307398 - RNA, 64 nt, Human; identical to SEQ ID NO: 290831

SEQ ID NO: 307399 - RNA, 64 nt, Human; identical to SEQ ID NO: 290832

SEQ ID NO: 307400 - RNA, 64 nt, Human; identical to SEQ ID NO: 290833

SEQ ID NO: 307401 - RNA, 64 nt, Human; identical to SEQ ID NO: 290837

SEQ ID NO: 307402 - RNA, 64 nt, Human; identical to SEQ ID NO: 290838

SEQ ID NO: 307403 - RNA, 64 nt, Human; identical to SEQ ID NO: 290839

SEQ ID NO: 307404 - RNA, 64 nt, Human; identical to SEQ ID NO: 290840

SEQ ID NO: 307405 - RNA, 64 nt, Human; identical to SEQ ID NO: 290841

SEQ ID NO: 307406 - RNA, 64 nt, Human
caauuccacgaggccaaucuaaagggaaaaaauccuacacuacuuuuacuacuuuugauuauuu

SEQ ID NO: 307407 - RNA, 64 nt, Human
uacuuauaagaugucucaaucugaauuuauuuggcuacacuaaagaaugcaguauauuuaguuu

SEQ ID NO: 307408 - RNA, 64 nt, Human
accaugauguucagguucauggaagcacuucacucuacacuaauuuauucauccauucaucaca

SEQ ID NO: 307409 - RNA, 64 nt, Human
cagggacgccaggacauagcugcuccuggucaguggaggucagccggguaucaaaagccaugaa

SEQ ID NO: 307410 - RNA, 64 nt, Human
ccccugcuacuggcuggacccucugcccugggcaggaggucaggggauucuguuuugguuuguc

SEQ ID NO: 307411 - RNA, 64 nt, Human
cugaguacaccggugaggcuggggucucugcaggggaggucacuggaacagcgagcaagggacu

SEQ ID NO: 307412 - RNA, 64 nt, Human
uacaauggugggcaaaacaggcuccugcucuuguggaggucacaaucuagcggagaaaggaugu

SEQ ID NO: 307413 - RNA, 64 nt, Human
gugugaccuuaaauuuaacuuuuuuuaaaaacugggaggucaauaaaauuuaaacugcuuaacu

SEQ ID NO: 307414 - RNA, 64 nt, Human
agguaacuagagcaguacuuggugaacuagaucaggaggucaguaaacuuucuguggaagggcc

SEQ ID NO: 307415 - RNA, 64 nt, Human
caggaggcugaggugggaggaucgcuugugccuuggaggucaaaacugcagugagccaugguug

SEQ ID NO: 307416 - RNA, 64 nt, Human
uacuuauucucaaagaaaaucuuugaaagaaucaggaggucaagucaagaacaugaaaauuuau

SEQ ID NO: 307417 - RNA, 64 nt, Human
uggggggcugaggugggaggaucucuugagccugggaggucaaggcugcagugagccgagauug

SEQ ID NO: 307418 - RNA, 64 nt, Human
uugaagccaaguggggugcugggaggagggagagggaggucacuggaaaggggagagccugcug

SEQ ID NO: 307419 - RNA, 64 nt, Human
cgaagauugaggacuacuuuccagaauuugcucgcuacacuacuccugaggaugguguguaugg

SEQ ID NO: 307420 - RNA, 64 nt, Human
ucuuauagauguuagcccugcccaacagccagggcuacacuacaaaaggcaagaaugcccaugu

SEQ ID NO: 307421 - RNA, 64 nt, Human
cucaguugagccugagcccccggcgcgggggcugcuacacuacaggacacccagcaucggcuuu

SEQ ID NO: 307422 - RNA, 64 nt, Human
gggccugcugugaccacugggagggaagaggagaggaggucagaggaccugggugaggacuagg

SEQ ID NO: 307423 - RNA, 64 nt, Human
agcggaagcucgagauggaggggcggcaggugcuggaggucaagaugcagguggaguacauguc

SEQ ID NO: 307424 - RNA, 64 nt, Human
gccacuuuccugccagcacauguuucugggucuuggaggucacccccaccccgcggaucacagc

SEQ ID NO: 307425 - RNA, 64 nt, Human
ggagcuucucccagugugagaccccaaagacucuggaggucaucuggcggaggucucugggagc

SEQ ID NO: 307426 - RNA, 64 nt, Human
cgggagacugaaguggaaggcuugcuugagcccaggaggucaaggcugcagugagccgugaugg

SEQ ID NO: 307427 - RNA, 64 nt, Human
gcagagggagaaaagaacccacaagggaagagguggaggucaggcacgguggcucacgcuugua

SEQ ID NO: 307428 - RNA, 64 nt, Human
ugggaggcugagguugcaggaucacuugagcccaggaggucaaggcugcagugagccaagauug

SEQ ID NO: 307429 - RNA, 64 nt, Human
agaaauuccgcaaggcugugacagacuucaccucggaggucaccuaugacccggcuggccgcgc

SEQ ID NO: 307430 - RNA, 64 nt, Human
gccuaaagcacuuguaacuuugaaccgucugucuggaggucagagccuguuggaaagcaggggu

SEQ ID NO: 307431 - RNA, 64 nt, Human
gacaggucuggccugacccccaacaaagaagccuggaggucagagaagcaaaugcggagccugc

SEQ ID NO: 307432 - RNA, 64 nt, Human
gauuaaagaaaaaaaucugcucacagucuguucuggaggucacaucaccaacaaagcucacgcc

SEQ ID NO: 307433 - RNA, 64 nt, Human
uaggaggggcagaagagccaaccagaggguuccuggaggucaucggguuccuccuucugcuucc

SEQ ID NO: 307434 - RNA, 64 nt, Human
caagggagagagagacucaucugacacuucuuuuggaggucaggauuuguauaucagaauugaa

SEQ ID NO: 307435 - RNA, 64 nt, Human
cucccuaaccucaccccuggaaagccaccagauuggaggucaccagcaugaugauaauauucau

SEQ ID NO: 307436 - RNA, 64 nt, Human
ggcaaugaugagugaucaagaauuagagugcccuggaggucacucacaaguccucauggagacu

SEQ ID NO: 307437 - RNA, 64 nt, Human
ggagggcagguuugagggacuuaguuuaccuauucuacacuaacaaguguuguuuuggguccau

SEQ ID NO: 307438 - RNA, 64 nt, Human
guauguaagaaauuuguaaaaugugaagagcuaucuacacuaaguucguaauguuauuauuauu

SEQ ID NO: 307439 - RNA, 64 nt, Human
ucaucccagaugugugccuccagauggcaguauacuacacuaucuguaaaauauauuugcaaag

SEQ ID NO: 307440 - RNA, 64 nt, Human
auacuucaugauuuuugucgaguuuacuucaugaggaggucagcccauuggcucccaucugaac

SEQ ID NO: 307441 - RNA, 64 nt, Human
ccauagcccagccagaugagcuugcagccucauaggaggucagcaccuugcaaagaugcaguca

SEQ ID NO: 307442 - RNA, 64 nt, Human
cgggaggcugaggugggaggaucacuugagccuuggaggucaaggcugcagugaaucaugauca

SEQ ID NO: 307443 - RNA, 64 nt, Human
aacaaagagggaggugugucagugugugaggaagggaggucaggcagcuaggaccaccugcagu

SEQ ID NO: 307444 - RNA, 64 nt, Human
gugacaugucaguagcaucaucuuuugacacacaggaggucauggucauuucauuccuacucuu

SEQ ID NO: 307445 - RNA, 64 nt, Human
cauaugacacucgagcacagaagaauaauuucaaggaggucaucuuguaaauuaaagguuuaga

SEQ ID NO: 307446 - RNA, 64 nt, Human
ucagguugguuuaaucaaucagaauuagagcaugggaggucaucacuuugaccuaaauuauuua

SEQ ID NO: 307447 - RNA, 64 nt, Human
ucccuuuuuucucuugccuuuuuuaugcauaaauggaggucaauuugauuguccugaccuacug

SEQ ID NO: 307448 - RNA, 64 nt, Human
uagcuugaccagucuaauuuaaaauguguuuguuggaggucauuaacguuacuuguacaaugcu

SEQ ID NO: 307449 - RNA, 64 nt, Human
uuucugaagccccuccuccuaacauggcgauuccggaggucaaggccuugggcucuccccaggg

SEQ ID NO: 307450 - RNA, 64 nt, Human
cugucuaugugcuguuggugugccuaugccugggggaggucaguaggggcccccuccccacaug

SEQ ID NO: 307451 - RNA, 64 nt, Human
cacaaaagauggcagcagcucauuuucuuuaauaggaggucaggauggucagcuccaguaucuc

SEQ ID NO: 307452 - RNA, 64 nt, Human
acauugaauacagguaacuaauuggaaggagaggggaggucacucuuuugaugguggcccugaa

SEQ ID NO: 307453 - RNA, 64 nt, Human
ccuuccugccgcaacaguuuuuuaugcuaaucagggaggucauuuugguaaaauacuucuugaa

SEQ ID NO: 307454 - RNA, 64 nt, Human
acugugaaugaggagaguaccugcugcaggaccuggaggucaggugugaaugcuguauuggcac

SEQ ID NO: 307455 - RNA, 64 nt, Human
agccauuacaauuccaggggcuaagaaggcucagggcagacaaagucaagaggaggaaguuuuu

SEQ ID NO: 307456 - RNA, 64 nt, Human
auauaccaagggccauucaguacaucaggaaaguggcagacagaagcuucucucugcaaccuug

SEQ ID NO: 307457 - RNA, 64 nt, Human
aaugaauuaagaacacauucuaacaagggucuguggcagacauugccgagugacuuucuuaguc

SEQ ID NO: 307458 - RNA, 64 nt, Human
uccagggugggccagcugcuugugggggcaccugggaggucaaaggucuccaccacaucaaccu

SEQ ID NO: 307459 - RNA, 64 nt, Human
ggacaagaaguagggaacaggcagggaaauguuaggaggucagccuccagcaggccuagucuca

SEQ ID NO: 307460 - RNA, 64 nt, Human
gugaacucucaggccuuggccagcacuaguuaggggaggucagguggucaauguccuggugauu

SEQ ID NO: 307461 - RNA, 64 nt, Human
acacugaggaucaaauuucaacaugagauuuggaggaggucaaacaaacuaaacuguagcagug

SEQ ID NO: 307462 - RNA, 64 nt, Human
ugggaguccgaggugggcagaucacuugagcucaggaggucaagaucagccugggcaacauggu

SEQ ID NO: 307463 - RNA, 64 nt, Human
ucucacucguuuuuguugcuccauuguaaagggcggaggucagucuuaguggccuugagaguug

SEQ ID NO: 307464 - RNA, 64 nt, Human
aauuagaugaagcaagcaugacagacacagcuguggaggucacagcugcuccuuuuuggucaau

SEQ ID NO: 307465 - RNA, 64 nt, Human
gcuucacaguaccuggaccagcaggaagauucugggaggucacugcucucagaggacagcaagg

SEQ ID NO: 307466 - RNA, 64 nt, Human
auccuccuuccugggcuccaggaaaguguuucugggaggucaggagggcuggcagcugaacgca

SEQ ID NO: 307467 - RNA, 64 nt, Human
ugagaagccuuccagccugcggugcugucugcugggaggucagcuggucaaggcagaggaggag

SEQ ID NO: 307468 - RNA, 64 nt, Human
cucccuuucaaagucaaucuuuggaaaauauugaggaggucacuaauuaguuggugcaguuaau

SEQ ID NO: 307469 - RNA, 64 nt, Human
aaaauggagauuuaauccuaaaacugugacuuggggaggucagucauuuacaguuaguccugug

SEQ ID NO: 307470 - RNA, 64 nt, Human
aggcaggaggaucauuugagcucaugagggcccaggaggucaaggcuucagugagccaugauca

SEQ ID NO: 307471 - RNA, 64 nt, Human
acgugauagauguugagagacagaagccaacgaaggaggucauucaucaacaaauauauuuauu

SEQ ID NO: 307472 - RNA, 64 nt, Human
guuccacuguauggcuuuggcccugaguggccagggaggucaacuugacccugccauguugguu

SEQ ID NO: 307473 - RNA, 64 nt, Human
uuuaaucuuuuuaaaaacugcugugguuuugcugcuacacuaagaauugugauuugcauuguac

SEQ ID NO: 307474 - RNA, 64 nt, Human
uugagagaaccuuauauuuuauauaguccucuagcuacacuauugcauuguucagaaacugucg

SEQ ID NO: 307475 - RNA, 64 nt, Human
aauacagagauuuuaaaaagugauuuuguaaaaucuacacuacggucucuguuucuccaaagua

SEQ ID NO: 307476 - RNA, 64 nt, Human
guuaaauaaaguagguacuguggaaaauucauggggaggucagugugcuggcuuacacugaacu

SEQ ID NO: 307477 - RNA, 64 nt, Human
caccccuggcugggaagaagaagaugggguaggaggaggucagguuccaaggaugcaggucugg

SEQ ID NO: 307478 - RNA, 64 nt, Human
cugauugaguuauugagauaguuuuuccagagcuggaggucacguuucuaaaacucaccuacga

SEQ ID NO: 307479 - RNA, 64 nt, Human
gagugggcugagaugggagaaucgcuugagcccaggaggucaaggguacagugagccgagguca

SEQ ID NO: 307480 - RNA, 64 nt, Human
aaagaguucuaaagugucuccagcugugaacccaggaggucaagugggcuauuaaaaucuaacg

SEQ ID NO: 307481 - RNA, 64 nt, Human
uuccaguucaucaggguaguagaccugucagauuggaggucaaagucaaaaguauaauaagugu

SEQ ID NO: 307482 - RNA, 64 nt, Human
agauuuaucuccucggcgauuccuugucauuuuuggaggucacaguuuuacucauucccaugug

SEQ ID NO: 307483 - RNA, 64 nt, Human
agacagacuugacuugcuguugcugggaggaaggggaggucaugagccaaggaauguggacagu

SEQ ID NO: 307484 - RNA, 64 nt, Human
ugauauuucugauauccccaggaaggaguggccuggaggucacugguucaggcucccuuugggc

SEQ ID NO: 307485 - RNA, 64 nt, Human
ugggaggcugaggcaggagaaucauuugagcccaggaggucaaggcugcagugagcuuugauca

SEQ ID NO: 307486 - RNA, 64 nt, Human
ccguucgugugucuuuccuccacggauaagcuugggaggucauuguuuuacugcccucacauuu

SEQ ID NO: 307487 - RNA, 64 nt, Human
aaagaaggaaaagcagagcugugaaugaguuaguggaggucaagucacaucagaguucaugacc

SEQ ID NO: 307488 - RNA, 64 nt, Human
auucauucacuuauggaguuguuacugauuuugcggaggucagguucauaccaauggacacuaa

SEQ ID NO: 307489 - RNA, 64 nt, Human
cagauggcugaggcaggagaacuacuugaaccugggaggucaaagcugcagucagccaagaucu

SEQ ID NO: 307490 - RNA, 64 nt, Human
cagcucugaaacuugggaaggugagggauucaggggaggucagaggaucccacuuccugagcau

SEQ ID NO: 307491 - RNA, 64 nt, Human
auauaaauccuggaacagaaauuguuuauagagacuacacuaauuauuuuaacuguauacaucu

SEQ ID NO: 307492 - RNA, 64 nt, Human
gauucucacuaccgcccgcuccucccauaggagccuacacuaaguccaagugugagccauucac

SEQ ID NO: 307493 - RNA, 64 nt, Human
uguuuucaggcuagauguauguacuucaugcugucuacacuaagagagaaugagagacacacug

SEQ ID NO: 307494 - RNA, 64 nt, Human
caggaggaugaggcaggaggaucucuugagcccaggaggucaaggcuauggugagccgugauug

SEQ ID NO: 307495 - RNA, 64 nt, Human
gucacagaaaggccagagggucucaggaaggucuggaggucacagcugggcucacagaagcucu

SEQ ID NO: 307496 - RNA, 64 nt, Human
gugauaaaugugauugaucuugccuuuuguacauggaggucaccucugaagugauuuuuuuuga

SEQ ID NO: 307497 - RNA, 64 nt, Human
auucaguuuaagcuaugaacugugugucccaguaggaggucaagaaaaccuccacagccuucug

SEQ ID NO: 307498 - RNA, 64 nt, Human
auauuuuuaugugccuuuuuauuuuuguugguggggaggucauuggacaaguuccaacuuucau

SEQ ID NO: 307499 - RNA, 64 nt, Human
uguuucuuguuuugaaagaugcgcauucuaaccuggaggucaauguuauguauuuauuuauuua

SEQ ID NO: 307500 - RNA, 64 nt, Human
uguauuauuucuucuuaccccaugccugaccaagggaggucaaaaggagaaaaguauaggcugu

SEQ ID NO: 307501 - RNA, 64 nt, Human
ugguuguguggacauuaugugauuuacuauauaaggaggucagagauggacuguggccaggcuu

SEQ ID NO: 307502 - RNA, 64 nt, Human
agggaagaguuuuugugaugggggagagggugaaggaggucaggccccacuccuuccugauugu

SEQ ID NO: 307503 - RNA, 60 nt, Human
aagcgaaagacgaacuuuaggaacacaguuggaggucaccucuccugcccagcucccgca

SEQ ID NO: 307504 - RNA, 64 nt, Human
ccuucuucccugccuuggaagcccuggccugggaggaggucauaccccaccguuggagcccagc

SEQ ID NO: 307505 - RNA, 64 nt, Human
uuuacaugggaacaggguuaacaucuguguuaggggaggucaccuuacccuuuuucauagggga

SEQ ID NO: 307506 - RNA, 55 nt, Human
acaacaaggagagcuucuagacuuuggaggucaaguccaggcauuguguaagugg

SEQ ID NO: 307507 - RNA, 64 nt, Human
ccacgccaugcugugccugggguccacagagccgggaggucacacauguacauccuggaagcug

SEQ ID NO: 307508 - RNA, 64 nt, Human
gauagucucuugacuaccauuaaaacgaauauugggaggucaugaaagucauugguaggccauu

SEQ ID NO: 307509 - RNA, 64 nt, Human
accuaccaaaauccaaauccuccaggaaaaacuacuacacuaaauggaccaggaaccucagagu

SEQ ID NO: 307510 - RNA, 64 nt, Human
uguguuaaaauuaggguuucuuugccucucuacacuacacuaaucugccuaaaggugguuguuu

SEQ ID NO: 307511 - RNA, 64 nt, Human
gaugcugaccagcagugaaggcugcacuaguuuucuacacuacaggaauuacuguugaugauuu

SEQ ID NO: 307512 - RNA, 64 nt, Human
cccaggccaggccaccaggauggcccuucccacuggaggucacauucaggaagaugaaagagga

SEQ ID NO: 307513 - RNA, 64 nt, Human
cccagcacuuugggaggccaaggugggcagaucaggaggucaggagaucgagaccaucuuggcu

SEQ ID NO: 307514 - RNA, 64 nt, Human
ccuucaccccuccccgccaaggccuggcucuuccggaggucaauugugccugcaggaucaguug

SEQ ID NO: 307515 - RNA, 64 nt, Human
gcucacuaaaguuguuccccugaucucuaaauauggaggucauuaccaagaaaugcuuugguau

SEQ ID NO: 307516 - RNA, 64 nt, Human
gagcaggguccagguuucacacuugccaccuccuggaggucaagaagagcagaguccccguccc

SEQ ID NO: 307517 - RNA, 64 nt, Human
aaaauuccacuugcuauuuacccaagaauccacuggaggucauuacugccauuaaauaauaacu

SEQ ID NO: 307518 - RNA, 64 nt, Human
gggaucuuuaaaaguugaagagggaggcaaaagaggaggucagagugauccuguauaagaaaga

SEQ ID NO: 307519 - RNA, 64 nt, Human
aaacaaacagugauuguacagcaggcugggcccaggaggucagguucauuuuguuacauaugca

SEQ ID NO: 307520 - RNA, 64 nt, Human
gaagccccuagggaugcaaguggacuugggcagaggaggucacaccaccccaccaagguagacu

SEQ ID NO: 307521 - RNA, 64 nt, Human
ugcgaggccgagguggguggauugcccgcgcucaggaggucaagaccagccugggcaacacggu

SEQ ID NO: 307522 - RNA, 64 nt, Human
ccgugggacccucagcagcucuggcucugccucaggaggucaccugccgcccugugggagccgc

SEQ ID NO: 307523 - RNA, 64 nt, Human
uagugggaacaggccccagcucagccuccggcagggaggucaccccuccacuucagcuugcccu

SEQ ID NO: 307524 - RNA, 64 nt, Human
ccaggcacagcucuggucaccucuggucacaacuggaggucaccacagcccuccccagcgcucu

SEQ ID NO: 307525 - RNA, 64 nt, Human
ugaaauaaugcauccaaaggguugauauucugggggaggucacugcagaaggauggaacugacc

SEQ ID NO: 307526 - RNA, 64 nt, Human
guauuacucacaugggugcaaucuuuagccccagggaggucaauaaugucuuuuaaagccagaa

SEQ ID NO: 307527 - RNA, 64 nt, Human
ggaacagcaauaaguacuauuaaacagaagauggcuacacuaaguuccaauuuuguugcugaau

SEQ ID NO: 307528 - RNA, 64 nt, Human
uucuuguaauaaccuuuuauuacuguucuagagacuacacuaccgacagugugggccagccacc

SEQ ID NO: 307529 - RNA, 64 nt, Human
uaaauuauguauuuucauauuuugcguaacugcucuacacuacuguuugacuugaucuucuucu

SEQ ID NO: 307530 - RNA, 64 nt, Human
ucccagcuacuugggaggcugaggugggagccugggaggucaaggcugcagugagccaugauca

SEQ ID NO: 307531 - RNA, 64 nt, Human
cuuuuacuaaguguucugcccuagauugguucaaggaggucauccaacugacuuuaucaagugg

SEQ ID NO: 307532 - RNA, 64 nt, Human
auagcauuccugcaccucccaaaguagauaaccuggaggucauucaguuaacaacugucccuga

SEQ ID NO: 307533 - RNA, 64 nt, Human
ggcaggugccuuguccucagggcuacagcaguagggaggucagugcuucgugccucgauugaag

SEQ ID NO: 307534 - RNA, 64 nt, Human
uacuugaagaggccagugggagaggagaggagggggaggucauuuaucugagucucuccagaag

SEQ ID NO: 307535 - RNA, 64 nt, Human
gugugguggcucaugccuuaaucccagcacuuugggaggucaagaugggaggauugcuugagcc

SEQ ID NO: 307536 - RNA, 64 nt, Human
caggcuggauggaaggggcccuccacacuuccugggaggucagagacaaacuguuucagagagu

SEQ ID NO: 307537 - RNA, 64 nt, Human
uuuuucuucagaucugcuccuggguuuuaauuugggaggucaauuguucuaccucacugagagg

SEQ ID NO: 307538 - RNA, 64 nt, Human
gggcuagaggcaggaaggaagugggaugaccucaggaggucaccuuuucuugauuccagaaaca

SEQ ID NO: 307539 - RNA, 64 nt, Human
ucuguagguggccccugaugccccaucuacagcaggaggucaggaccacgccccuggccucucc

SEQ ID NO: 307540 - RNA, 64 nt, Human
agacagaugaggagacuggcucagcaaggccccuggaggucaagcuuggccuuugccuccuguu

SEQ ID NO: 307541 - RNA, 64 nt, Human
ugcucacuagucucagggcuuguguaauauucugggaggucauuuaaaugccagaaauggucaa

SEQ ID NO: 307542 - RNA, 64 nt, Human
ccgauguagauuuguacaggagucuccguuggccggaggucaugaugaugggcagcgcccgcgu

SEQ ID NO: 307543 - RNA, 64 nt, Human
ccagggcuggccaagagagaagacuggacggcagggaggucaacauuaacgaguggggggauca

SEQ ID NO: 307544 - RNA, 64 nt, Human
aggcccaccucucuguacucugggcucuaaaguuggaggucagguuaccugagguuugcaauuu

SEQ ID NO: 307545 - RNA, 64 nt, Human
ccuaguuauauagacgaaauaaaaugcuaagucacuacacuacaucguuuauuuucuauuacau

SEQ ID NO: 307546 - RNA, 64 nt, Human
ccuaguuauauagacgaaauaaaaugcuaagucacuacacuacaucguuuauuuucuauuacgu

SEQ ID NO: 307547 - RNA, 64 nt, Human
accuuguggaaagacauguucauaugucacuccucuacacuaacugagauguguuaaauaaacu

SEQ ID NO: 307548 - RNA, 64 nt, Human
ccucaccuguucccugacugcgugaaauguucagggaggucaguugauuuccccagguacauuc

SEQ ID NO: 307549 - RNA, 64 nt, Human
cccuuaguaauugcuacagcuuccauaauuaacuggaggucagcaguaaaauaauuuugugauu

SEQ ID NO: 307550 - RNA, 64 nt, Human
acagccuuccucacccuuggcuggcagacccacuggaggucaggcacggaccaguggcccagcc

SEQ ID NO: 307551 - RNA, 64 nt, Human
uaaaauucaugucaaaaaggaaagaaggaauggaggaggucaguuaguucauugcaauaaauua

SEQ ID NO: 307552 - RNA, 64 nt, Human
ggcuuaaguuugggcuagaguuugacuuuaugaaggaggucauugaaaaagagaacagugacgu

SEQ ID NO: 307553 - RNA, 64 nt, Human
caugcaccagugauguggugacaggugcucugaaggaggucaccaggaccugaccucuuugaag

SEQ ID NO: 307554 - RNA, 64 nt, Human
ugggaggcuuagucaggaggaucucuugagccugggaggucaaggcugcagugaaccaugauug

SEQ ID NO: 307555 - RNA, 64 nt, Human
aaagcucacugcugccccagccgggcuucuuagaggaggucaguuguccuauguaucaucauuu

SEQ ID NO: 307556 - RNA, 64 nt, Human
uggaaauguugaucucuuagucuucuauagacaaggaggucagacuggagugaauguuguaaaa

SEQ ID NO: 307557 - RNA, 64 nt, Human
gugaauucaccaaaucagcuuccacuuagcauuaggaggucaugccauacaacucacguaugcg

SEQ ID NO: 307558 - RNA, 64 nt, Human
agcaggaaaaggaggcucagcacugucucaggcuggaggucagcgaaccucgugggcuguagga

SEQ ID NO: 307559 - RNA, 64 nt, Human
uccuacauguauuagguucuuucaaguuugacugggaggucaccuuuuucugauuuacaagucc

SEQ ID NO: 307560 - RNA, 64 nt, Human
uccacuguccgggacagcguucgcccuuuagcggggaggucauuacagccucauggccucuacc

SEQ ID NO: 307561 - RNA, 64 nt, Human
gaaagaaagaaggaagugaagagggagaagggauggaggucacacugguagaacguaaccacgg

SEQ ID NO: 307562 - RNA, 64 nt, Human
guuaauguggcaggggguggggcucauucuguugggaggucaaauuaccaaugccaaggacugu

SEQ ID NO: 307563 - RNA, 64 nt, Human
uuuugauucauacagggauuucuuaugucuuuggcuacacuagauauuuugugauuggcaagac

SEQ ID NO: 307564 - RNA, 58 nt, Human
aagacuacgccaagcucugaagggcacacuacacuauuaauaaaaauggaaucauuaa

SEQ ID NO: 307565 - RNA, 64 nt, Human
aaucuguaggguugacaaauaaauaguugcucuucuacacuagggguuucaccugcagguuuga

SEQ ID NO: 307566 - RNA, 64 nt, Human
uggucaaacucugggcaaaggguuuucaggaugaggaggucaagacaggaucuccagagcuacc

SEQ ID NO: 307567 - RNA, 64 nt, Human
ugugugcucuuccgucuaaggcaugaauaagaggggaggucaaaauaaagacccaaucugaggc

SEQ ID NO: 307568 - RNA, 64 nt, Human
cuccucggccuggggcucuggccaaggaugggcuggaggucauucaguuggucugucucuuccc

SEQ ID NO: 307569 - RNA, 64 nt, Human
cuccccuggagccagcugauccuguaacgcugcuggaggucagucugagcuaccaagacugucc

SEQ ID NO: 307570 - RNA, 64 nt, Human
ugagacgaauuuggagacugggauuagagccuuuggaggucaaagcaaauuaagauuuuuauuu

SEQ ID NO: 307571 - RNA, 64 nt, Human
cgggaggcugaagcgguagaaucacuugagcacaggaggucaaggcugcaggugagccaugauc

SEQ ID NO: 307572 - RNA, 64 nt, Human
cugggaaccacagaggaaggaugaggugggauguggaggucagagcaucucacgagagucccuc

SEQ ID NO: 307573 - RNA, 64 nt, Human
aggccgcgggugccccaggcucggcucaggucuuggaggucaagggcauggguugggguagugg

SEQ ID NO: 307574 - RNA, 64 nt, Human
uaaauuauguaucuauuguaaccuucagaguuuaggaggucaucugcugucauggauuuuucaa

SEQ ID NO: 307575 - RNA, 64 nt, Human
gaaaugcccguauuaggaggauuacuugagcccaggaggucaaagcugaggugagccaugauua

SEQ ID NO: 307576 - RNA, 64 nt, Human
ccaaggccaggcugucuacccuauggccacagcaggaggucagcccagggccaggagacacaug

SEQ ID NO: 307577 - RNA, 64 nt, Human
cccagcccuaguccuaggcgacuugaauaaagugggaggucaaacaugggccuucggcauuggg

SEQ ID NO: 307578 - RNA, 64 nt, Human
agggaagggacgagucuaggcugagggcaagaugggaggucagaggugacagaagcguucaggg

SEQ ID NO: 307579 - RNA, 64 nt, Human
ugggagguccaggcaggaggaucacuugggcccaggaggucaagccugcagcgagcugagauca

SEQ ID NO: 307580 - RNA, 64 nt, Human
uuaguaaggguggguggggugauggguugcagacggaggucaggucuuccucuuuccugagacu

SEQ ID NO: 307581 - RNA, 64 nt, Human
uaauaaauuguuuuacugacaauuuuuccuuuuucuacacuaaaacaauaugugauauauuucc

SEQ ID NO: 307582 - RNA, 64 nt, Human
gagugcagaaauagugaugccaucuuagauuuuccuacacuaguaucuucuagaucucuuuuua

SEQ ID NO: 307583 - RNA, 64 nt, Human
aacuuuaaauuucccagcuuuuugaagauuuaagcuacacuauuaguacuucccuuugucugug

SEQ ID NO: 307584 - RNA, 64 nt, Human
agguaguugcaaaagcugugcccaaggggaggaaggaggucacaccaauaugaugaugguuuuc

SEQ ID NO: 307585 - RNA, 64 nt, Human
ccccuccuugcccuaggcugguugguaaaagagaggaggucaacacccagccuagccaccucug

SEQ ID NO: 307586 - RNA, 64 nt, Human
cacagcacaugcuggccagccuggggccuggcagggaggucaggcccuggaacucuaucugggc

SEQ ID NO: 307587 - RNA, 64 nt, Human
uacugucacaggcgccccaccauucaaccuuccgggaggucagggaccuucuauaugaggcgag

SEQ ID NO: 307588 - RNA, 64 nt, Human
gagauaggggaggggggagggggaagcaaaggggggaggucaaaucccaaaccauuacugaggg

SEQ ID NO: 307589 - RNA, 64 nt, Human
accugaucgacaccaucacgggcaugcacagcguggaggucagcggcucccaggugugugggcc

SEQ ID NO: 307590 - RNA, 64 nt, Human
uggccaagcugccggccuggauccgagcccguguggaggucaaagcuaccuuuggccccgccau

SEQ ID NO: 307591 - RNA, 64 nt, Human
caggauagcacaggccaagguaggggaguaaaaaggaggucaggcaaaagggaggaguuuucug

SEQ ID NO: 307592 - RNA, 64 nt, Human
cacaggucucacuaguuagaaaccugugggccauggaggucagacauccaucuuguccaucuau

SEQ ID NO: 307593 - RNA, 64 nt, Human
guugugugcaggaucuguuugcccacucggcccaggaggucagcagucuguucuuggcuggguc

SEQ ID NO: 307594 - RNA, 64 nt, Human
uagacagcccuuccaacugugucaucucuucucuggaggucaaugguggagggagaugccuggg

SEQ ID NO: 307595 - RNA, 64 nt, Human
cugcccuugaucucuacuuccagcuguguucuguggaggucacuugugaaucaggcagugucau

SEQ ID NO: 307596 - RNA, 64 nt, Human
cucuguccccacugccggcccauguucucucuccggaggucaccaaggaaugcacagguuucga

SEQ ID NO: 307597 - RNA, 64 nt, Human
cacgccuggaaaacgcucuucugagaggaucuguggaggucaacccaggagagagaagacagga

SEQ ID NO: 307598 - RNA, 64 nt, Human
gcuaugaagagguuaacgcggccccuccacaccuggaggucagaaccuggccuguccucugucu

SEQ ID NO: 307599 - RNA, 64 nt, Human
aacuggucccagagcuggagcuucuugcacugcccuacacuaccuaccaucuccauccucuggg

SEQ ID NO: 307600 - RNA, 64 nt, Human
agacucccucucaaaaaaaaaaguuacauuuacacuacacuacacuguagucuaauaaagugua

SEQ ID NO: 307601 - RNA, 64 nt, Human
cauguguuaauuuacauuagauaguaaagaauggcuacacuaagacugaauuaucuuauuaguc

SEQ ID NO: 307602 - RNA, 64 nt, Human
ugacgacuuccccucccaccagcugagaauguauggaggucaucggggccucagcucggaggca

SEQ ID NO: 307603 - RNA, 64 nt, Human
gggccucccacccuuguccgaguugccucccacuggaggucaggagucuacacugcagccucgg

SEQ ID NO: 307604 - RNA, 64 nt, Human
cuggagacuucagggcuugucacuuucagaguguggaggucaggauggcugcgggcaaugaagc

SEQ ID NO: 307605 - RNA, 64 nt, Human
cucagccccgagcugccgcagccucaggcagaacggaggucaccuucucuccuuaucuugggaa

SEQ ID NO: 307606 - RNA, 64 nt, Human
auuuuuuuuaaauaccacugucuuuagcuguccaggaggucagaguguuuuuucugucuuuggg

SEQ ID NO: 307607 - RNA, 64 nt, Human
gggaaacaucacaccugcccuaaacccuguuccuggaggucagcauuugaucuguugcaagccc

SEQ ID NO: 307608 - RNA, 64 nt, Human
auucauuguuucaacucagaaugcacuugauucaggaggucaucugaccuucaccuuggauggu

SEQ ID NO: 307609 - RNA, 64 nt, Human
gagugcaaggcugcucaggucuccaagcgccguaggaggucaccuggcagugacuguagggagc

SEQ ID NO: 307610 - RNA, 64 nt, Human
auguuggaguggaaaugauggcuggcuaugaagaggaggucaacguguguggucuccucagucu

SEQ ID NO: 307611 - RNA, 64 nt, Human
caggaggcugaggugggaggaucaccuaaggccaggaggucaaggcugcggugagccgugauug

SEQ ID NO: 307612 - RNA, 64 nt, Human
ugagcuuaggcauucuaagucacaggaugagacaggaggucagcacaagauacacgucacaaag

SEQ ID NO: 307613 - RNA, 64 nt, Human
gaggaacuagauccuucucuccucagccuaggguggaggucacugcacuaccacccaccucugg

SEQ ID NO: 307614 - RNA, 64 nt, Human
aggagcagggcuugcccaggcaugguggaucaccggaggucaguaguucaagaccagccuggcc

SEQ ID NO: 307615 - RNA, 64 nt, Human
acucucugaaugcugcuccacugucuuuugucuuggaggucacucagcagguuccuugcauuug

SEQ ID NO: 307616 - RNA, 64 nt, Human
gcuccugccucagaaugucagugagcaccaugcuggaggucacccagcacuguggcagcgccca

SEQ ID NO: 307617 - RNA, 64 nt, Human
uuucuguuguuauuccuauuggagcuaaguuugucuacacuaaaauuuaaaucagacuagagaa

SEQ ID NO: 307618 - RNA, 64 nt, Human
aaaggacucggcuauuuaccugaagauugacuagcuacacuaaagaaaaugaacuccgccaucc

SEQ ID NO: 307619 - RNA, 64 nt, Human
uuaugugacuuuuuucccuucucagcaaagagcccuacacuagauuucuaccaucacuaauauu

SEQ ID NO: 307620 - RNA, 64 nt, Human
caggaggcaaagaugggaggauuacuugagcccaggaggucaaggcuacagugagccaugauug

SEQ ID NO: 307621 - RNA, 64 nt, Human
cagaucuugguagcacuuuauauguucaccaaugggaggucaauauuuaucuaauuuaaaaggu

SEQ ID NO: 307622 - RNA, 64 nt, Human
aauuucucaacuaaauuucauuauugggcaggaaggaggucauggguucauuucauuuuuguuu

SEQ ID NO: 307623 - RNA, 64 nt, Human
aacacggcaggcccugcuaucacaccuugggcuuggaggucauugggagugagcagaugugggg

SEQ ID NO: 307624 - RNA, 64 nt, Human
guuagccccugacaacucaguggggugaaguuuuggaggucagagucugcuuucguaggcucuu

SEQ ID NO: 307625 - RNA, 64 nt, Human
uccugucuuauuuguucauccuggagaauugaagggaggucaaguuguuugucaaugauuuguc

SEQ ID NO: 307626 - RNA, 64 nt, Human
acuguggcucaugccccuaaucccagcacuuuugggaggucaaggugagcagaacaccugagga

SEQ ID NO: 307627 - RNA, 64 nt, Human
uccucaguaaauguacaacugcaccugucaucauggaggucauacaugcauacaaagaggugua

SEQ ID NO: 307628 - RNA, 64 nt, Human
ggcugugcugcaggccuccccucgaaagacacugggaggucagcauguuccacagguguucaga

SEQ ID NO: 307629 - RNA, 64 nt, Human
aggcuugagagcuccaacgggaagauggcuucacggaggucagaagagaaggaggccggcgaga

SEQ ID NO: 307630 - RNA, 64 nt, Human
aggaggaaggaaggcugguuuggugggguaguggggaggucagggaggcggggccaaggguguc

SEQ ID NO: 307631 - RNA, 64 nt, Human
acacucccuuuugcuuauagugugcauuuuuuuuggaggucauucaaauuuucccucuucugug

SEQ ID NO: 307632 - RNA, 64 nt, Human
uccccugcucggaaggguuggccugccuggcuggggaggucaguaaacuuugaauaguaagcca

SEQ ID NO: 307633 - RNA, 64 nt, Human
gauuguggcgauccgguugcacacuggccucuguggaggucagggaggugggaagguggguggg

SEQ ID NO: 307634 - RNA, 64 nt, Human
aucccaguaccaaauggugcuucagcucuaacauggaggucagagaaagggacuuggaccaaua

SEQ ID NO: 307635 - RNA, 64 nt, Human
uuauacuaagacaccauuaagaacaguugaggcacuacacuaaaucaaaccauaaaugaggaaa

SEQ ID NO: 307636 - RNA, 64 nt, Human
aauugauaagagacacgaggugggacauacaauccuacacuacagauuucaguuuuuagaaaau

SEQ ID NO: 307637 - RNA, 64 nt, Human
ggguagacggcagaugccugacagagaguggguuggcagacaacacacuagcauuuucacgggu

SEQ ID NO: 307638 - RNA, 64 nt, Human
cagcacuuugggaggcugaggcagguggaucacuggaggucaggaguuugagaccagccuggcc

SEQ ID NO: 307639 - RNA, 64 nt, Human
agggauauaggccuccccuuggagcacugaguccggaggucaucccugagcucauccacggcuc

SEQ ID NO: 307640 - RNA, 64 nt, Human
acaguuaguuacuuguuaaugcuagucacagccaggaggucagaaggaauuuucuacuucugga

SEQ ID NO: 307641 - RNA, 64 nt, Human
ccggacacugaugugagaggaucacuugagccagggaggucauggcuacagugaccccucauug

SEQ ID NO: 307642 - RNA, 64 nt, Human
uauguaaguguucagaacaacugcaaagaaagugggaggucaggaaacuuuuaacugagaaauc

SEQ ID NO: 307643 - RNA, 64 nt, Human
uuccuccgcucagagaugcugcuucauuuacccaggaggucauauucuuuauauauauuuuuug

SEQ ID NO: 307644 - RNA, 64 nt, Human
ugguccaggcaccacucagcucuggcucuuccugggaggucagccgaggcuccccccaugcucc

SEQ ID NO: 307645 - RNA, 64 nt, Human
ccaucagcucccacccacccagcgauuuuuccuuggaggucagcccguuacccccauaacugau

SEQ ID NO: 307646 - RNA, 64 nt, Human
cccccuucccccauacccugcugucuccacggagggaggucacagcccaucacgcaggacacug

SEQ ID NO: 307647 - RNA, 64 nt, Human
cucuacagcucaugcugccugauggcaucaccguggaggucauuguggucaaccaggucaaugc

SEQ ID NO: 307648 - RNA, 64 nt, Human
cacucuccccguacacacacacucgggcacuucaggaggucaguucucaccccuuccucgaugg

SEQ ID NO: 307649 - RNA, 64 nt, Human
aggguggauuguuacagcuucgcuggaaaccucuggaggucaucucggcuguuccugagaaaua

SEQ ID NO: 307650 - RNA, 64 nt, Human
cugaggauuuccuggagugcccugcaggcacagaggaggucagcaaaggucuugaauagauuuu

SEQ ID NO: 307651 - RNA, 64 nt, Human
cucagguuggcccaguuugggccaguccauuuuuggaggucacucuuuccccccucauccccuc

SEQ ID NO: 307652 - RNA, 64 nt, Human
ccccccgagacacagugcgcuaguacggcuguccggaggucagccugauuucaacccaggugcc

SEQ ID NO: 307653 - RNA, 64 nt, Human
gggucugaacugccuccauccuagggcaaccuggggcagacaggccuggugggggguggggaaa

SEQ ID NO: 307654 - RNA, 64 nt, Human
gaggaaggggaggagagaaggagaaaggcaagcaggcagacagcuaugggucuagcaucugcag

SEQ ID NO: 307655 - RNA, 64 nt, Human
aacccuguaaccauacuuccacaucuucagcuuaggcagacaucgaaccucucugggauguuuc

SEQ ID NO: 307656 - RNA, 64 nt, Human
ggacucggucacugcggugguuuccccacuucugggaggucagcagagggaaggugagugaugu

SEQ ID NO: 307657 - RNA, 64 nt, Human
cccgaagucugcaggacuggggaggcaucccugaggaggucagcggcgcccugccgaggcccga

SEQ ID NO: 307658 - RNA, 64 nt, Human
ugcugggaaguuaauccaguacauuguagaagauggaggucauguguuugccggccagugcuau

SEQ ID NO: 307659 - RNA, 64 nt, Human
gccauugcaaccaaaauggggacuuccuggguagggaggucacucccucuacucacugagcuag

SEQ ID NO: 307660 - RNA, 64 nt, Human
gcucugucucccaacaccagcugguguugcagagggaggucaacgugaguuuggaucucuugua

SEQ ID NO: 307661 - RNA, 64 nt, Human
uuuaauuuggggaggaagcaaaggguuuuguuuuggaggucacucuuuggggccccuuucuggg

SEQ ID NO: 307662 - RNA, 64 nt, Human
aauguugaguuggugacuccagccucuuucuccuggaggucacaagaugaugauugcguagaug

SEQ ID NO: 307663 - RNA, 64 nt, Human
cucugggcccugucgccccuccuuuuggccugggggaggucagaacauucgaaucucugccccu

SEQ ID NO: 307664 - RNA, 64 nt, Human
cacagcccucccuccugccugggugggggaggcuggaggucauuggagaggcuggacugcugcc

SEQ ID NO: 307665 - RNA, 64 nt, Human
aaaauggcuggguaagcaagucaaggguguuggaggaggucaagagagagcucaguuucccucu

SEQ ID NO: 307666 - RNA, 64 nt, Human
cgggagggcuaggcccgugcccccgccugccaccggaggucacuccaccauccccaccccaccc

SEQ ID NO: 307667 - RNA, 64 nt, Human
ugcaccaauucugaaggcacuuuauguacuacauggaggucauaucugguuuuguuuuuauuuu

SEQ ID NO: 307668 - RNA, 64 nt, Human
augcuggaucauaaacuuggagcgcgcucuuaguggaggucagugauuggcugugucacagugc

SEQ ID NO: 307669 - RNA, 64 nt, Human
uuagccucuuccccuugucugagcauuccucaggggaggucaccugugagguucccagaacugu

SEQ ID NO: 307670 - RNA, 64 nt, Human
auuuggguuuuccuuuuucacucacaaacagcagggaggucauguacuuuuuguacaacaccug

SEQ ID NO: 307671 - RNA, 64 nt, Human
ugggcugccccaucagcucccugaggaccaccuccuacacuauugaccaggcccagaaggaacc

SEQ ID NO: 307672 - RNA, 64 nt, Human
uauuagucucccuguuuuuuauuuuuauuccuuucuacacuacaaccaaauugcuccaaaagac

SEQ ID NO: 307673 - RNA, 64 nt, Human
auugaguaacuacuaugguauuuguuaauauuuucuacacuaaauaccauuggugucuuuauag

SEQ ID NO: 307674 - RNA, 64 nt, Human
gagggagggaagaggagggagugacgggaggggaggaggucagcgaccuggggccguagcggca

SEQ ID NO: 307675 - RNA, 64 nt, Human
uauacugccauauauaggaacucuuugcuuaacuggaggucauggagauuuucuccuacauuuu

SEQ ID NO: 307676 - RNA, 64 nt, Human
cacgguagcucacaccuguaaucccagcacuuuaggaggucaaggugggcagaucaugagguca

SEQ ID NO: 307677 - RNA, 64 nt, Human
auuuggaaauaggguuguuacaacugucacuagcggaggucacuuuggagaagggugggccuua

SEQ ID NO: 307678 - RNA, 64 nt, Human
caauacccuacccuauggggaggcccugccuccgggaggucauuuuuuaaauccagccccuugc

SEQ ID NO: 307679 - RNA, 64 nt, Human
ugccaucuucucuuugaaaaaccuaugggcuugaggaggucacgaugccgacuccgccagagcu

SEQ ID NO: 307680 - RNA, 64 nt, Human
ugggaggccaaggcaggaggaucguuugaggccaggaggucaauaccagccugggcaacauagu

SEQ ID NO: 307681 - RNA, 64 nt, Human
cuuuaaauuaaaaaacauauauauauauauauuuggaggucaguaauuuccaaugggcgggagg

SEQ ID NO: 307682 - RNA, 64 nt, Human
agaugcagccucagaaggaacaaggcccccagagggaggucaccugggggcagcuggugccggg

SEQ ID NO: 307683 - RNA, 64 nt, Human
ggccagccccuccucuccccgccuucugggaggaggaggucacacgcugaugggcacuggagag

SEQ ID NO: 307684 - RNA, 64 nt, Human
aggaucuggggguggggaacugggccuagcugugggaggucaucgcggggcauugcagggagug

SEQ ID NO: 307685 - RNA, 64 nt, Human
ugugcuuuuguagagagaugauuauuguacugugggaggucaggaaguucgagauuccuucacu

SEQ ID NO: 307686 - RNA, 64 nt, Human
cagcacuuugagaggccaaggcgggcggaucacuggaggucaggaguuuaagaccagccuggcc

SEQ ID NO: 307687 - RNA, 64 nt, Human
gggugcaggcuggugcacugcauggagucgagguggaggucacgugcagagcuccaugaggucc

SEQ ID NO: 307688 - RNA, 64 nt, Human
guauagugcuguuagaauuacaugaguuagauguggaggucagaguggaagcaggugugagagg

SEQ ID NO: 307689 - RNA, 64 nt, Human
aauucaagaacagacucuggaguguccauuuagacuacacuaacuagacuuuuaaaagauuuug

SEQ ID NO: 307690 - RNA, 64 nt, Human
uacuggggugggaucuuggauggugacauugaaacuacacuaaauccccucacuaugaaugggu

SEQ ID NO: 307691 - RNA, 64 nt, Human
ggcauugcaggagcucccagagagacugccuucccuacacuagaaguccccacaaaggcuucug

SEQ ID NO: 307692 - RNA, 64 nt, Human
ucccauucuccccuacaguuuuaugcucagacauggaggucagagccacaagggaaaggggaga

SEQ ID NO: 307693 - RNA, 64 nt, Human
ucaggcgcugauaacaugcuucacaccugcccuuggaggucacaguacuaauuuacuucaaauu

SEQ ID NO: 307694 - RNA, 64 nt, Human
acaugagaguuugaggacaagaaagaugaagcuuggaggucacagcuggaucugcuuguugcau

SEQ ID NO: 307695 - RNA, 64 nt, Human
agcaguucugcagaggacgggaggcuggaagcugggaggucaggugggguggaugauauaaugc

SEQ ID NO: 307696 - RNA, 64 nt, Human
aggaggcugaagugggaggaucaccugagcccagggaggucaaggaugcagugagccauggucu

SEQ ID NO: 307697 - RNA, 64 nt, Human
gcuuuucuucauuugaaauguacucccuuggaaaggaggucaggguucugaagcuagacauuga

SEQ ID NO: 307698 - RNA, 64 nt, Human
gggccaggcuaaggguggcucaguuccaucaucuggaggucagacacacuguccagaggcagaa

SEQ ID NO: 307699 - RNA, 64 nt, Human
cacacuugugaugugucagccacagauucacccaggaggucacagaaugacagcaagggaaaug

SEQ ID NO: 307700 - RNA, 64 nt, Human
ccagaggcugucgugggaggaucaugugagccugggaggucaaggcugcagugagccgugauug

SEQ ID NO: 307701 - RNA, 64 nt, Human
uguguaugcgugugcguguguguguauauaugugggaggucaccugacccaagcauggcgggcu

SEQ ID NO: 307702 - RNA, 64 nt, Human
gucguucugagcugaggagagucccguggacaucggaggucagaggugggcccuccccuggacc

SEQ ID NO: 307703 - RNA, 64 nt, Human
acccagggaccgucuggcuuccccagcuggacugggaggucaggaagccaggcaaggagaggga

SEQ ID NO: 307704 - RNA, 64 nt, Human
gcgauacuaaggcagacucagcuuuuuaaagaugggaggucaggagguggaagugagaggagau

SEQ ID NO: 307705 - RNA, 64 nt, Human
uuuugagacagugucuugcucugucucccaggcuggaggucaguggcacaaaucucagcucacu

SEQ ID NO: 307706 - RNA, 64 nt, Human
uguucucugaaugcagcccuguucucaacaacagggaggucauggaaccccucuguggaaccca

SEQ ID NO: 307707 - RNA, 64 nt, Human
aucaucagcauugcuggagccaaggguaggagcccuacacuaggagcccaggaugggacggcgc

SEQ ID NO: 307708 - RNA, 64 nt, Human
uugcuuggauggaaaaagggcugcccauguugugcuacacuaugcuaaaacuguaauuuaguaa

SEQ ID NO: 307709 - RNA, 64 nt, Human
guuugguagauaagugggaggaaaaguacuguugcuacacuauuauaggcauguuugauacuag

SEQ ID NO: 307710 - RNA, 64 nt, Human
caggacuuugggaggccaaggcgggcagaucaccggaggucaggaguucgagaccagccugacc

SEQ ID NO: 307711 - RNA, 64 nt, Human
ucucugugcucugaaugggagccagaauucacuaggaggucaucaaccgaugguccucacaagc

SEQ ID NO: 307712 - RNA, 64 nt, Human
cuggcugugucaccccgagcagcucauccaccauggaggucauuggccugaggcaaguuccccg

SEQ ID NO: 307713 - RNA, 64 nt, Human
acgggacggccccacgacagagggagucagcccgggaggucaggagcgcggcgggcgagggccc

SEQ ID NO: 307714 - RNA, 58 nt, Human
ucuuaaaguguuuugacuagacagagcuggaggucaagucccugcgcuugccgcccuc

SEQ ID NO: 307715 - RNA, 64 nt, Human
caggaggcugaggugggaggaucauuugagccuaggaggucaaggcugcagugagccaugauuc

SEQ ID NO: 307716 - RNA, 64 nt, Human
augaugggagagcucuggcagaugucccaauccuggaggucauccauuaggaauuaaauucucc

SEQ ID NO: 307717 - RNA, 64 nt, Human
augccagcccaggaugaguaguuccuguucucagggaggucauccgcugagcaucccuucugca

SEQ ID NO: 307718 - RNA, 64 nt, Human
gacccaaaggcccaaagagggccguggggccugaggaggucauaaucucuucugagugggggca

SEQ ID NO: 307719 - RNA, 64 nt, Human
ugggagguccaggcagguggaucucuugagaccaggaggucaagaccagccuggccaacguggu

SEQ ID NO: 307720 - RNA, 64 nt, Human
uccgggggacuugacaaggggcccugaggccaagggaggucacuccucccuccaggccccugac

SEQ ID NO: 307721 - RNA, 64 nt, Human
cagaucauucauaucaucaacaaaagcucuagggggaggucacguugugaaugcuuaaaacaua

SEQ ID NO: 307722 - RNA, 64 nt, Human
accccauaaggguuuaggccacuuugcagaggauggaggucaaaaaccacucccagauaaguuu

SEQ ID NO: 307723 - RNA, 64 nt, Human
gggcauaggaacaaucuggcagaaguuuccagaaggaggucacuuggcauucaggcucuugggg

SEQ ID NO: 307724 - RNA, 64 nt, Human
cccccagacuuccuccuuuccguguuucugaaggggaggucacagccugagcuggccuccuaug

SEQ ID NO: 307725 - RNA, 64 nt, Human
agcccucccugagccguucuccugagucccugagggcagacacagcuccagggacccaggccag

SEQ ID NO: 307726 - RNA, 64 nt, Human
ccuccccucccuccuucuuuaguuuaaccaucagggcagacaggaacaaaguauuucaaagcuu

SEQ ID NO: 307727 - RNA, 55 nt, Human
ggcucugccugcugcucugacccagggcagacagaccucacgacagcacugacag

SEQ ID NO: 307728 - RNA, 64 nt, Human
cugaagagcagagaagcccuguucucugcauguaggaggucagcaggggugggcaggcccagcu

SEQ ID NO: 307729 - RNA, 64 nt, Human
uaccaaccacccucuaucagcaguggcccaggaaggaggucaagcaucuucggccgauauuuaa

SEQ ID NO: 307730 - RNA, 64 nt, Human
uucugguuuugguuccucuuucgcggggggugggggaggucaacagggacugaguggggcagag

SEQ ID NO: 307731 - RNA, 64 nt, Human
cagcacuuugggaggccgaggugggcagaucaccggaggucaggaguucgagaccagccuugcc

SEQ ID NO: 307732 - RNA, 64 nt, Human
aaaugcaauuugauaaucaguuuccacuacauucggaggucaagaaagcaguauauauucuuuc

SEQ ID NO: 307733 - RNA, 64 nt, Human
ccuaauaggguaggcccaaaucucuguuugcugaggaggucauugccauccauauuugggagcc

SEQ ID NO: 307734 - RNA, 64 nt, Human
cguguguccauuagacauuuggcuacaucuggcuggaggucaggagaaaauucugagguaaaua

SEQ ID NO: 307735 - RNA, 64 nt, Human
caggagauuaaggcaggaggaucacuugagcccaggaggucaaggcugcagugagcugcacugc

SEQ ID NO: 307736 - RNA, 64 nt, Human
ccacccuuuuucaucagugaccuuuucuucacguggaggucaacucaguaggugagaauaauua

SEQ ID NO: 307737 - RNA, 64 nt, Human
auuugagaagugggugauccccucuaggcuuccuggaggucacauuuaagcuagaccuugacaa

SEQ ID NO: 307738 - RNA, 64 nt, Human
aacaguuaaaagcugacaguucgcccuuacucuuggaggucauguucaggaggggcauuccuuu

SEQ ID NO: 307739 - RNA, 64 nt, Human
caggaggcugaggugggaggaucauuugagcccaggaggucaaggcugcagugagcugugauga

SEQ ID NO: 307740 - RNA, 64 nt, Human
aacuagaguccuacuuacauaguugaaauaucaaggaggucagaagaaaauuggacuggugaaa

SEQ ID NO: 307741 - RNA, 62 nt, Human
cagaaggcgggcaagugaagcgcgggcgcccgcggcgcgacccuccccggcggugccgcgcu

SEQ ID NO: 307742 - RNA, 62 nt, Human
aaagaacccuggggacccuaauguuggacucucggcgcgacacucaaccaccauggccgcuc

SEQ ID NO: 307743 - RNA, 64 nt, Human
gcucaggcagacaaaucgcucuagcucagaaguugcagagcagccugggcaacauggugaaacc

SEQ ID NO: 307744 - RNA, 64 nt, Human
cagaggggagggcuguuggauguauggggagcuggcagagcagguggcagucacugggacaagg

SEQ ID NO: 307745 - RNA, 64 nt, Human
cauggggauaaaggagaaggcaugaaauugucuagcagagcaggggcagggugauaaauuguug

SEQ ID NO: 307746 - RNA, 64 nt, Human
guggaugggccuggacucuccagaaacuacuugggcagagcaaaggaaaaccucuuguuuuaaa

SEQ ID NO: 307747 - RNA, 64 nt, Human
caguccggcuggccgccuucauggaggcaucauggcagagcacaugagauguccucagcugggc

SEQ ID NO: 307748 - RNA, 64 nt, Human
agacucccuccugugaaccaacacagacacccaagcagagcaaucaguuagugaauugaaugga

SEQ ID NO: 307749 - RNA, 64 nt, Human
gcacgugacucccucagccucagagccuugggaugcagagcagcuggcaggguuccucucaauc

SEQ ID NO: 307750 - RNA, 64 nt, Human
aacggccuggaaucgcaaagagacaccacucugggcagagcagagcaggguaugggguggggag

SEQ ID NO: 307751 - RNA, 64 nt, Human
ccuggaaucgcaaagagacaccacucugggcagagcagagcaggguaugggguggggagagagg

SEQ ID NO: 307752 - RNA, 64 nt, Human
uagguccagaagguggggggaacuguacagaucagcagagcaggacaguuggcagcagugaccu

SEQ ID NO: 307753 - RNA, 64 nt, Human
aucguccagcccuccuacgcagaugcugucacuggcagagcacagcccacggggaucacagcgu

SEQ ID NO: 307754 - RNA, 64 nt, Human
aggauucagaagugcaugaaggcacccugccucugcagagcagaaagaucauagacaacauuua

SEQ ID NO: 307755 - RNA, 64 nt, Human
aaaugaaugguuucaacaaagaucauuuaauacagcagagcauggcaugaccaagcaucuuugu

SEQ ID NO: 307756 - RNA, 62 nt, Human
gaccuauaccucaggaugggcgcgucugggcgcggcgcgagcggccgggcagggcccugcag

SEQ ID NO: 307757 - RNA, 57 nt, Human
agcagcagggccagagcuagucugagccggcgcgagggcacgggcuguggcccgagg

SEQ ID NO: 307758 - RNA, 64 nt, Human
guugauauuaucacugcaaaucacauugccagcugcagagcauauuguggauuggaaaggcugc

SEQ ID NO: 307759 - RNA, 64 nt, Human
ugagaaaaagugaaaaacuugaguuggcaaagaugcagagcagcagugcagauggcaaugaacu

SEQ ID NO: 307760 - RNA, 64 nt, Human
cgaauaggggugugguucauggcguguugacccagcagagcacucccucccacuaacuuguucu

SEQ ID NO: 307761 - RNA, 64 nt, Human
accagcuggggagcuagagggagcaggcccaagggcagagcagaggcugaggcacggggagcca

SEQ ID NO: 307762 - RNA, 64 nt, Human
cuuuuguuugauuucagcccauguucuugacaaugcagagcaauucugagcagucacaaagccu

SEQ ID NO: 307763 - RNA, 64 nt, Human
uauuaguucuauaggagugaucucaagugagauagcagagcaagaugccaaaagaccauaaaua

SEQ ID NO: 307764 - RNA, 64 nt, Human
aacuggaauuuugugugcuaacuguucccagacagcagagcaaguauucacugaguaggggugu

SEQ ID NO: 307765 - RNA, 64 nt, Human
cuguuggaaguucacuggagucuuguacacuuaagcagagcagaacuuuuuuuguggggcuggg

SEQ ID NO: 307766 - RNA, 64 nt, Human
ccuuaugccauuucaagaggagaaaugcaggcuggcagagcaauuuccagaaauggaauuugcc

SEQ ID NO: 307767 - RNA, 64 nt, Human
gagaugaggagcggugaugccagcaccgggaugcgcagagcacuggaagggcuggugcagaucu

SEQ ID NO: 307768 - RNA, 64 nt, Human
auaugccacuuaccagacuaaaucaaccacuccagcagagcagagaggcugaauagauuccaca

SEQ ID NO: 307769 - RNA, 64 nt, Human
ccaaaccuggugucuauccggcagagggaggaaggcagagcaaguggagcagggcuuagcagga

SEQ ID NO: 307770 - RNA, 64 nt, Human
gggaggcggcgcugcucuccccgagggcggcugggcagagcacaucccccaggacuugaugacc

SEQ ID NO: 307771 - RNA, 64 nt, Human
agaucugauggugagcugggaagcuguacucagagcagagcaaaugagggagggggcgcucagg

SEQ ID NO: 307772 - RNA, 64 nt, Human
uugaccuggcuccuggcuuaccagucuccuggaagcagagcaugcagauacucaugcggauacc

SEQ ID NO: 307773 - RNA, 64 nt, Human
guugcuuagcuaacaggagauccauaggcagccugcaggcuaggaaguggccuagugcaagaug

SEQ ID NO: 307774 - RNA, 64 nt, Human
gcagguuccuacacacccacgccugagggucauagcaggcuaaggguggauaccagcgacuccc

SEQ ID NO: 307775 - RNA, 64 nt, Human
cuggggucugggcccagguuugagggagaagguugcagagcacuucccaccucucugaauagug

SEQ ID NO: 307776 - RNA, 64 nt, Human
aggauccuugucaccccagccagguauccccaaggcagagcaccucucguuuggcccucugaac

SEQ ID NO: 307777 - RNA, 64 nt, Human
uucugcacucugagcuggccagccccucggggcugcagagcagugagccuacaucugccacuca

SEQ ID NO: 307778 - RNA, 64 nt, Human
aguuaaaagaaccugcucuccauuaucucaaguagcagagcagaugcuaaaccgucacagcugu

SEQ ID NO: 307779 - RNA, 64 nt, Human
cugagugcguaguacccauuagacagcuggagaugcagagcacuauggagcaauacuggcuaau

SEQ ID NO: 307780 - RNA, 64 nt, Human
gcagagaucacaccacugcacuccagccuggguggcagagcaacacuuugucucagaaaaaaaa

SEQ ID NO: 307781 - RNA, 64 nt, Human
aggaaacgaaauccuuugacuuguaucagcuucugcagagcaucuuuguuuuccuuuguccuuu

SEQ ID NO: 307782 - RNA, 64 nt, Human
acaggauaccucccuuccaaacugaacuguagaagcagagcagcagcaguuaugugaugcaaca

SEQ ID NO: 307783 - RNA, 64 nt, Human
guuggcuuuuagaguguuggucaugacuccaagagcagagcagggaagagcccaagcauagacu

SEQ ID NO: 307784 - RNA, 64 nt, Human
gaugagaaggauggcggggcuagggaagcagagagcagagcacacacuggcucaagcagcagag

SEQ ID NO: 307785 - RNA, 64 nt, Human
aaacuuuuaggugguggaaccagggaagcagagagcagagcaugcagugauggaagaagcagga

SEQ ID NO: 307786 - RNA, 57 nt, Human
agaaggucuauugguauugagccuggggcagagcagcuccuccccaacuucuguccc

SEQ ID NO: 307787 - RNA, 64 nt, Human
uauuucuuaguguagguagacaauucuuucaggagcagagcagcguccuauaauccuagaccuu

SEQ ID NO: 307788 - RNA, 64 nt, Human
aaagcacacuggaaaggccauuagaauugccccagcagagcagaucugcuuuuuuuccagagca

SEQ ID NO: 307789 - RNA, 64 nt, Human
cauuuuguuucagaaaugagugagaggccuuccugcagagcagucaggagaaaugguggagccu

SEQ ID NO: 307790 - RNA, 64 nt, Human
gauuuugcauaaaauuaugcauugaugucaaccggcaggcuacaggaacccuggcugguccugg

SEQ ID NO: 307791 - RNA, 64 nt, Human
agccucugccccacccaucaguggaguccagauggcaggcuacaguugggaagucucagccugg

SEQ ID NO: 307792 - RNA, 64 nt, Human
ccuguagagcuagaacauggagagcuagaacccggcaggcuagaaccuggcaagcuagaaccug

SEQ ID NO: 307793 - RNA, 64 nt, Human
uggaucccgaagugggcuucccgggaaaccucgagcagagcaggcuacacaaucccccauccuc

SEQ ID NO: 307794 - RNA, 64 nt, Human
gaaaggaaacugcuauugaacuuaagcaucucuagcagagcaauuugaucaguauauaaaaccc

SEQ ID NO: 307795 - RNA, 64 nt, Human
ucucuauggaagucaaacuggagguccuguugucgcagagcauucgguggugaggcuguugugu

SEQ ID NO: 307796 - RNA, 61 nt, Human
acucacagccucggaacugaauucagagcaggcagagcaccagcaagugcugcuuuacuaa

SEQ ID NO: 307797 - RNA, 64 nt, Human
gcagcgcccguguccugggcacucagcgugcugggcagagcaggugcgauggccccaguccuag

SEQ ID NO: 307798 - RNA, 64 nt, Human
aucaaguaaagaaaacauuuuaaaauuacaauuagcagagcaguucauguuuaagggcaucacu

SEQ ID NO: 307799 - RNA, 64 nt, Human
cucugccugucucccccaccgggcugggagcucugcagagcaggaaacaugacucguauauguc

SEQ ID NO: 307800 - RNA, 64 nt, Human
uaaaacaggcuuuaaguuucuugguugcccaagggcagagcaaggaauaucugguguuucuugu

SEQ ID NO: 307801 - RNA, 64 nt, Human
uauuucaagaguugauaaagauuaccugugcagugcagagcacuuuaaugcaaccagcuuucaa

SEQ ID NO: 307802 - RNA, 64 nt, Human
cauuaaaucauggccuugcauuaaaauauggaaagcagagcaguacauauucaaauguauucag

SEQ ID NO: 307803 - RNA, 64 nt, Human
cacuguguuauauucuuugaauccuagcccaucugcagagcaaugacugugcucaccaguaaaa

SEQ ID NO: 307804 - RNA, 64 nt, Human
gccccuguuccaaugaaaaacagaacacaaaagagcagagcaccuaagccugucucugccuccc

SEQ ID NO: 307805 - RNA, 64 nt, Human
gaugugugaacugcuaagggccaaaugaacguuugcagagcagugggcacaauguuuacaaugu

SEQ ID NO: 307806 - RNA, 64 nt, Human
gcauuuuuggaagccucccucacucuccaugcuggcagagcaggagggagacugaaguaagaga

SEQ ID NO: 307807 - RNA, 64 nt, Human
cacauacgugcaggcuggcucgggaguccagugagcagagcauuggacuuggcuggccagaggg

SEQ ID NO: 307808 - RNA, 64 nt, Human
ccuccccacaucccugcagccaccucccagcagagcaggcuacguccucacugagguguucuuc

SEQ ID NO: 307809 - RNA, 64 nt, Human
cagaguccucuaugaacuauggacggugcuccaggcaggcuaaggcguggagcugccugauauu

SEQ ID NO: 307810 - RNA, 64 nt, Human
ccccaggucgcaggugucugaggccagccaaccugcagagcacucgcggcgugggugggcugag

SEQ ID NO: 307811 - RNA, 64 nt, Human
acucaugcagcccuauggccgcucagaccaaggcgcagagcaacuaucagggcagcucugccuc

SEQ ID NO: 307812 - RNA, 64 nt, Human
auaaagaagaccuaaaacugauggcuacuaaaaagcagagcauuucugguaagacuaaauuuuc

SEQ ID NO: 307813 - RNA, 64 nt, Human
gagcccucucgcccagccagcccuggcucugugugcagagcauagcucugcgaguaccugugua

SEQ ID NO: 307814 - RNA, 64 nt, Human
auauaccgaaauauuuccauuguuucccuuuuuugcagagcauguggaaguuaaaccugcuuga

SEQ ID NO: 307815 - RNA, 64 nt, Human
gcgaccuugugccgcccagcuguccauggcccgugcagagcagaggacagugagugucugcacu

SEQ ID NO: 307816 - RNA, 64 nt, Human
uguggcuuuguucaaugcuuccacucuagggcaggcagagcagucuauacucucccaagccugc

SEQ ID NO: 307817 - RNA, 64 nt, Human
cuucacagugacagcccuccccuacaauccuugggcagagcauguggucugagggcccacagug

SEQ ID NO: 307818 - RNA, 64 nt, Human
ccagucuguuggugucuuuauaggaaacuauaaagcagagcaguggugucuuuagaggaaacuc

SEQ ID NO: 307819 - RNA, 64 nt, Human
guucagaggaggccuacaagggcaaggucagauggcagagcaagguugguccucagggccucuc

SEQ ID NO: 307820 - RNA, 64 nt, Human
ucuuaguucucagguugggacuucaauuacugcugcagagcaguagugguuaaaaauaagauau

SEQ ID NO: 307821 - RNA, 64 nt, Human
uuaauuuguauugaagaaguucagaaauuuaaaagcagagcauuuuuuaugauaucauuguugg

SEQ ID NO: 307822 - RNA, 64 nt, Human
gaagggagggugggcaguggucuggaagcuugaugcagagcagugugggucccacuggcagccc

SEQ ID NO: 307823 - RNA, 64 nt, Human
agucacuugcaggaccucuuuauagucuaggauggcagagcagaagauuuuaauaugcuuuuau

SEQ ID NO: 307824 - RNA, 64 nt, Human
ugugaccaccacugcgaccccugagcccacaagggcagagcagcauucugagagacgcacagga

SEQ ID NO: 307825 - RNA, 64 nt, Human
gaugggagucgggguggcacaaacaauagaacaagcaggcuagugguuuucuuuguuaaagugu

SEQ ID NO: 307826 - RNA, 64 nt, Human
ccaccugcccaccccgccccaggcaccaucaggagcaggcuagggggcaggccugggcccagcu

SEQ ID NO: 307827 - RNA, 64 nt, Human
ucugaugaacauccucugaugaucuaggcucccagcaggcuacuuugaagggaacaaucagaug

SEQ ID NO: 307828 - RNA, 64 nt, Human
acuggugauauaaagaaugaaaguagcuguaugagcagagcaguucaagggccaaacccuggaa

SEQ ID NO: 307829 - RNA, 64 nt, Human
uauguuaugcagagacacucugccucugguggcugcagagcaauacccaagccucauuuggaag

SEQ ID NO: 307830 - RNA, 64 nt, Human
uccaaacauuuuauucucaacagguguaaaacaggcagagcauucuaaaaccacaugguagugc

SEQ ID NO: 307831 - RNA, 51 nt, Human
uucagaauaauuuaaccuaaagcagagcaagaagagaggaagcggggguag

SEQ ID NO: 307832 - RNA, 64 nt, Human
ggggugagcaggcugcugggaucccauggccugagcagagcaugugggaacuguucaguggccu

SEQ ID NO: 307833 - RNA, 64 nt, Human
ccuccagcuuaucucccacaacaacccuuucccugcagagcaugguuuguauaccacaagcccu

SEQ ID NO: 307834 - RNA, 64 nt, Human
ggcaaccuuguguucucugugcccucagggacuggcagagcaagaggccaucagaaggacgagg

SEQ ID NO: 307835 - RNA, 64 nt, Human
aguguugaaccagcaucaagucuccagaaacauggcagagcagacaggccguuaaguuucacag

SEQ ID NO: 307836 - RNA, 64 nt, Human
gccgagauugcaccacugcacuccagccuggagagcagagcaagacucugucucaaaaaaaaga

SEQ ID NO: 307837 - RNA, 64 nt, Human
uacauuuccugggccucuuggaaaaagugauggagcagagcaagucugcaggugcaccacuucc

SEQ ID NO: 307838 - RNA, 64 nt, Human
aagugugagccaaaggauccuuccuuauuccuaagcagagcaucugcucugggcccuggccucc

SEQ ID NO: 307839 - RNA, 64 nt, Human
ucacaaaacacaaacccaggacuuucugccuaaggcagagcacaagacucacagcagcaccgaa

SEQ ID NO: 307840 - RNA, 64 nt, Human
gccccuacaucucagcugaaucuccagggaggcugcagagcaucguggagaccacuuucugccu

SEQ ID NO: 307841 - RNA, 64 nt, Human
gccuagaucaugccacugcacuccaaccugggcagcagagcaagacucugucucaaaaggggaa

SEQ ID NO: 307842 - RNA, 64 nt, Human
gcugugccuauuuccuagaccuuuuaaaagaugugcagagcagcuuagcauucguugcagcuga

SEQ ID NO: 307843 - RNA, 64 nt, Human
augcugaugaugugggucucguucuuucuucauugcaggcuaguauauaccgagggggauacaa

SEQ ID NO: 307844 - RNA, 64 nt, Human
ggccauccccacuuccuccucuaccccaacacaugcaggcuaggccuugcccuggaacauggag

SEQ ID NO: 307845 - RNA, 64 nt, Human
auuuaauucaccagcaguaauccuuuaauaacuggcagagcacuuuauucuucuggugagcucc

SEQ ID NO: 307846 - RNA, 64 nt, Human
ugcagaaagccaacagguacucuucuguuugugggcagagcaaaagacaucaaauaagcaucca

SEQ ID NO: 307847 - RNA, 64 nt, Human
uaauucacaggggaauucccaguacugucauggagcagagcaggcagugggugcugaugugugu

SEQ ID NO: 307848 - RNA, 64 nt, Human
cauucaggcaagugcaagugguucaggggccagcgcagagcagagugcugaguaaagaugucag

SEQ ID NO: 307849 - RNA, 64 nt, Human
acagaguuugugauaacucauaauuauuuuaauggcagagcacugcuguaucuguuuuaugguc

SEQ ID NO: 307850 - RNA, 64 nt, Human
cagcacaccacagcccgcgaccucagggcagggagcagagcagcugccggcugugugcccaugg

SEQ ID NO: 307851 - RNA, 64 nt, Human
auaugcucgcagguuagaguuggguguaaguaaagcagagcacauaugggguccauuuuugcac

SEQ ID NO: 307852 - RNA, 64 nt, Human
uauucacaaucauauuguauuucggaaccccaaugcagagcaguuugcuuugaaaaauaguugu

SEQ ID NO: 307853 - RNA, 64 nt, Human
ccccagggcccccacaggccccccgcagcacccugcagagcacacagguacagcaacaggaauc

SEQ ID NO: 307854 - RNA, 64 nt, Human
cgacucagcuugagccccuccacccccgcaggcugcagagcaaggaugaagccucaggaggggc

SEQ ID NO: 307855 - RNA, 64 nt, Human
gaaaagggauggagcugaaaaagauggaaugcuugcagagcaugaccugaggagggaggaacgu

SEQ ID NO: 307856 - RNA, 64 nt, Human
ggaaaucuacccucuaggccuggaggccucucucgcagagcauggaaggcaggagaggugggcu

SEQ ID NO: 307857 - RNA, 64 nt, Human
gauggccuuaaagguggugagggagauacugggggcagagcagacuuugccagugccccucagg

SEQ ID NO: 307858 - RNA, 64 nt, Human
acucaccaacuuugcaauagaaauacuggugccugcagagcagcacuaacaguggcaggugcug

SEQ ID NO: 307859 - RNA, 64 nt, Human
gacaacagaggggccuccaugguggcaugggucagcagagcauggagcaggcagaggaagccua

SEQ ID NO: 307860 - RNA, 64 nt, Human
aauuugguuuagaaugcugcgcuuaccuucccaugcaggcuaaagugauuccuucuugcucagu

SEQ ID NO: 307861 - RNA, 64 nt, Human
accugaagagccuccgugccucggagcaggagaggcaggcuauggcugccacccucccuccugc

SEQ ID NO: 307862 - RNA, 64 nt, Human
augccaggcaguagagucucucugccucugaggagcaggcuacccgcaucccacucagccccuc

SEQ ID NO: 307863 - RNA, 64 nt, Human
gccacagcuccguggaaggacucccccuaccugagcagagcagaagccccagggcggagcuccc

SEQ ID NO: 307864 - RNA, 64 nt, Human
ucuucuaccauuugaauuuguguagaggguguuugcagagcaaugcccguaaugcuuagagaau

SEQ ID NO: 307865 - RNA, 64 nt, Human
gcuccugccucgccuaguccacugggaucauucagcagagcagaggagaauuguacauuugggg

SEQ ID NO: 307866 - RNA, 64 nt, Human
caaggucuacaaaaucaugauacuuuuuuaaaaggcagagcauucuuuuuucggcaauuuugau

SEQ ID NO: 307867 - RNA, 64 nt, Human
ccuccucaccgcccgccgugcaagagucgagccggcagagcaaggggcgcggccccagggcccu

SEQ ID NO: 307868 - RNA, 64 nt, Human
cagguuucuaagcaugaauugaggaacagaagaagcagagcagaugaucggagcagcauuuguu

SEQ ID NO: 307869 - RNA, 64 nt, Human
auaugcuccugacggacucaggaaaaugccaacagcagagcacccuggugccaaggccuucuca

SEQ ID NO: 307870 - RNA, 64 nt, Human
cuagcagacacauacacaccccugaaauggggcugcagagcaggcugucucagccuugccacug

SEQ ID NO: 307871 - RNA, 64 nt, Human
cagccucagucccccucagcacagacaaaagccagcagagcaaagcgucuauacuucauggggu

SEQ ID NO: 307872 - RNA, 64 nt, Human
ccagagccagccuuccuucaaucaagguuuccaggcagagcaaauacccuagagauucucugug

SEQ ID NO: 307873 - RNA, 64 nt, Human; identical to SEQ ID NO: 307872

SEQ ID NO: 307874 - RNA, 64 nt, Human
gccccuccucucaggcguucagauggugcgaacagcagagcaggcaagggaaacuggggagaug

SEQ ID NO: 307875 - RNA, 64 nt, Human
aaagcugaaagaucgcucugcucggggagccugggcagagcagcagcaacgugagggucgcugu

SEQ ID NO: 307876 - RNA, 64 nt, Human
ccacgugcugaagggaaaagacaccaguugccuggcagagcagugguccggcaagaagggagac

SEQ ID NO: 307877 - RNA, 64 nt, Human
agaaaacuaaguucaugucauccugcuguaaugggcagagcauauuuuuuuuguauuuaaaaga

SEQ ID NO: 307878 - RNA, 64 nt, Human
cucuccccagaccuggcccggccgcccugucuccgcaggcuagauccgagguggcagcuccagc

SEQ ID NO: 307879 - RNA, 64 nt, Human
gcuguaaagaaaauagaaaugcgauagagugcuggcaggcuaguguagauaaguggucugaaaa

SEQ ID NO: 307880 - RNA, 64 nt, Human
ggcucagaguacagucccuucagcagagggcacagcaggcuacaggguucaggugccccaggug

SEQ ID NO: 307881 - RNA, 64 nt, Human
caauugagugcgauuauuggcuucugagcgcugagcagagcagguggaagaggaacuuugagca

SEQ ID NO: 307882 - RNA, 64 nt, Human
aacagaccaucacagauuggaaacuugguagauagcagagcaugguauuagugaaaaagguuca

SEQ ID NO: 307883 - RNA, 64 nt, Human
guucacucacaggguacgcucauggagagagggcgcagagcaaaccaugucacgccauccaaug

SEQ ID NO: 307884 - RNA, 64 nt, Human
ugaauaacugccacuucuaaggacgccauucagagcagagcauuagcagaauuucaccaugcuu

SEQ ID NO: 307885 - RNA, 64 nt, Human
uaccagucacaaagucagagaugguggugaggcugcagagcaaaagaaacagacacuguuggug

SEQ ID NO: 307886 - RNA, 64 nt, Human
auuuucugugcacaugggagugcuccacucccuagcagagcagagggaagucucugccagguac

SEQ ID NO: 307887 - RNA, 64 nt, Human
ccgagucucccaugaaggcagacuccuccucccagcagagcagcaggauccccagccagacucu

SEQ ID NO: 307888 - RNA, 64 nt, Human
uucugugggcccccaagugguaggagggagaguagcagagcauggguuacuggaagccgggacu

SEQ ID NO: 307889 - RNA, 64 nt, Human
acuuggagauuuggcuuuuccaagaaaagcuagagcagagcagcccuucucccacaagcccucc

SEQ ID NO: 307890 - RNA, 64 nt, Human
uaguggaagaaauaguaggcuccgcuauucagaugcagagcacugcagcauccagccuuucaaa

SEQ ID NO: 307891 - RNA, 64 nt, Human
cugcguugugccaguugcuggagagguagugugagcagagcagcugaaaucuugccaucaagca

SEQ ID NO: 307892 - RNA, 64 nt, Human
ggggggacacgucuucccacugcuuagagcgagagcagagcaaacugcgcagcaggcaccucca

SEQ ID NO: 307893 - RNA, 64 nt, Human
cauugaaaaugcacuauauuuuucuauuuuacuugcagagcaucacaaaagaacagguauuuuc

SEQ ID NO: 307894 - RNA, 64 nt, Human
cagaaauguauugggggguggaggagaauaagaggcagagcaagagcuagagaauugguuuccu

SEQ ID NO: 307895 - RNA, 64 nt, Human
cauuucugccuugugauggacccaggaggucucugcagagcaagugccguuggaccagcugauu

SEQ ID NO: 307896 - RNA, 64 nt, Human
cauugaaaauguguuuagacaacgucauccccuggcaggcuaaagugcuguauccuuuaguaaa

SEQ ID NO: 307897 - RNA, 64 nt, Human
guagaggauccacaucagguggccacgaggacuugcaggcuauaguuaugguggugacaugcau

SEQ ID NO: 307898 - RNA, 64 nt, Human
gagccucgcuuuuucauccuucuuuccuuguucagcaggcuagacagaaacaugucuugacugu

SEQ ID NO: 307899 - RNA, 64 nt, Human
ggauuuggcaaaaccucauuuaaguaaaagguuagcagagcaaagugcggugcuuuagcugcug

SEQ ID NO: 307900 - RNA, 64 nt, Human
uccccacaucaucuucagcugcugcccaggcuccgcagagcagguguccaccgcccauccagcc

SEQ ID NO: 307901 - RNA, 64 nt, Human
ccagcccuccuggggagacgugacucugguggacgcagagcacuuaguuacccuggacgcuccc

SEQ ID NO: 307902 - RNA, 64 nt, Human
cauccauguguucaugaaucaaucaucacggccugcagagcaccuguccuaaggagggaaaauc

SEQ ID NO: 307903 - RNA, 64 nt, Human
augacugucgccacacgccucuguguacaugugugcagagcagacaggcuacaaagcagagauc

SEQ ID NO: 307904 - RNA, 64 nt, Human
cuuuuagaacucagugccauccugggugcccagggcagagcaggcuuuguucgcaccucaucug

SEQ ID NO: 307905 - RNA, 64 nt, Human
gccacgguggcuccagccaggaccagccagaccagcagagcagggagccacuugccagggugga

SEQ ID NO: 307906 - RNA, 64 nt, Human
caggguuacagcaagagccacugagguguggcuggcagagcaacugaggagcucugcgagagug

SEQ ID NO: 307907 - RNA, 64 nt, Human
cagacgaggaggcagcgggugcagccaggugucugcagagcagccacaaagguggccuaggaug

SEQ ID NO: 307908 - RNA, 64 nt, Human
uuccaguaucuuccuaaggauggagcccaaaauugcagagcaguaacuuuggaauaaaaccagg

SEQ ID NO: 307909 - RNA, 54 nt, Human
augcagacucggacuucugagccugcagagcaggaccugggacaggaaagagag

SEQ ID NO: 307910 - RNA, 64 nt, Human
cacuggagaaagccgacguggugauggugacucagcagagcagugacgguaagcgggagcaugc

SEQ ID NO: 307911 - RNA, 64 nt, Human
cuacuguuuuuuauuuggacacuuacauaacagugcagagcacaaugcuguguaacauaggaau

SEQ ID NO: 307912 - RNA, 64 nt, Human
guuuauaugcuuacaaagauuucucaggaagacagcagagcagaggaaucuauauagauguaug

SEQ ID NO: 307913 - RNA, 64 nt, Human
uagccuugauuuguucuuacaguuaagaagcccugcagagcacaaacuucagaaacccggcuuc

SEQ ID NO: 307914 - RNA, 64 nt, Human
accaagcugaaucacgcuuucuccaagacagcccgcaggcuaagugcauuccuuccccuuccca

SEQ ID NO: 307915 - RNA, 64 nt, Human
uuugagaaggggacccauauccuacaggcaaaaagcaggcuaggugaccuugggacacuacgcu

SEQ ID NO: 307916 - RNA, 64 nt, Human
uuuauguaauuucccuaaaaagaaugaacuaccacuacacuaugguguuaaaccaaaauauagg

SEQ ID NO: 307917 - RNA, 64 nt, Human
ugggucugcguggaauucaggccgaggcgagccggcagagcaggccggacgcagcagcccucug

SEQ ID NO: 307918 - RNA, 64 nt, Human
cguaaugaaacuuggauuugcucagugucuggcugcagagcagugggccuggccagcagguccc

SEQ ID NO: 307919 - RNA, 64 nt, Human
ccaagacucaggggaucggcugggaacugggccagcagagcauguuggacaccccccaccaugg

SEQ ID NO: 307920 - RNA, 64 nt, Human
gcuugguguucaugguggagacuugguucuuuacgcagagcaggcuaaaggcguguuuuuucug

SEQ ID NO: 307921 - RNA, 64 nt, Human
cuggugucaggaucuaguaaggaaaugggcuugagcagagcaggggguaccugugggguucuuc

SEQ ID NO: 307922 - RNA, 64 nt, Human
uuuaaaauguagucagcaaaauggggguggggaagcagagcauguccuaguucaauguugacuu

SEQ ID NO: 307923 - RNA, 64 nt, Human
gcagaaccacucaauuuuaagugcuguuuaaauugcagagcaaauaauccugugugggaacugu

SEQ ID NO: 307924 - RNA, 64 nt, Human
ucucuugcuaacagauucagaaaagugucucaaagcagagcacagaguuauuugguguuugcug

SEQ ID NO: 307925 - RNA, 64 nt, Human
aaaguggccagguuuauuauuagaagacacaguggcagagcacacaugugcacagguucugauu

SEQ ID NO: 307926 - RNA, 64 nt, Human
ugggugaugaucacugugcugcuuguggcucauggcagagcauucagugccacgguuuagguga

SEQ ID NO: 307927 - RNA, 64 nt, Human
gcagagccacugucacacagaaugccggaggggcgcagagcagauccaggccccagaaagccuc

SEQ ID NO: 307928 - RNA, 64 nt, Human
ucaggauuucuuaaauacucaacagagaggcugagcagagcaaauggggggcuucacccucauc

SEQ ID NO: 307929 - RNA, 64 nt, Human
uuuauuuugguccucucguaguugugaaacacuugcagagcaaacaaagcagaggcaagaacug

SEQ ID NO: 307930 - RNA, 64 nt, Human
ccugccaggagcagaagccuggagggguggcagggcagagcagcccaggcucagcauggagccc

SEQ ID NO: 307931 - RNA, 64 nt, Human
gugcaguguugcuaccagcaagaaugaagguugugcagagcaguacugugagguaggcaccgug

SEQ ID NO: 307932 - RNA, 64 nt, Human
ucuaucaggaaaacaaaucacuguauuuaucuccgcaggcuauuuguucagagaggccuuuugu

SEQ ID NO: 307933 - RNA, 64 nt, Human
uagaauacuggggucccccagcucuuagcaggaugcaggcuauugcuuccacaccccuggccgu

SEQ ID NO: 307934 - RNA, 64 nt, Human
gauguaagacgaacuuggaucacggcuugguucagcagagcaugggggcgggggcucuggagug

SEQ ID NO: 307935 - RNA, 64 nt, Human
aagcucacccuagacuaugaaaauuauauucacugcagagcaauuacuucugucauuaccugaa

SEQ ID NO: 307936 - RNA, 64 nt, Human
cguuagugaaucuugagccucauuugggcucagggcagagcagguguuuaucugccccggcauc

SEQ ID NO: 307937 - RNA, 64 nt, Human
ucaccagcauuuuacccccuuguuauaaaacugugcagagcaagaagaugauacuuauuuuuga

SEQ ID NO: 307938 - RNA, 64 nt, Human
ugacaaaauugcccuuguuugaugagaggaaugagcagagcauugauguggugaacaaggaucu

SEQ ID NO: 307939 - RNA, 64 nt, Human
gcauuuccagaguggccaugccuagagggcagaugcagagcaggugguagugggacaggacaau

SEQ ID NO: 307940 - RNA, 64 nt, Human
gccgagaucgcaccacugcacuccagccugggcagcagagcaaguaguaauaaccaccguguag

SEQ ID NO: 307941 - RNA, 64 nt, Human
cuacucagcaaggucacuaagcucugccagcguggcagagcaugucuuggaaccugucuugagu

SEQ ID NO: 307942 - RNA, 64 nt, Human
cuccucccaggggagaguagaagucgcacacgcagcagagcagaccugaugucccggugcuucc

SEQ ID NO: 307943 - RNA, 64 nt, Human
ugcuauuuaucucugagccguccccguccuccgugcagagcaaguugaggucauuccuucuuuu

SEQ ID NO: 307944 - RNA, 64 nt, Human
gucaugcugggcagcacaccggcuaagcaggggagcagagcaccaggccgggcgccugcccagc

SEQ ID NO: 307945 - RNA, 64 nt, Human
cuugaagggagcacgaguccaggauggacucagugcagagcaggacaugaugccaucgaaauug

SEQ ID NO: 307946 - RNA, 64 nt, Human
uagaucuucuugucagagaagcugcaugguuucugcagagcacaguuagcuagaaaggugauag

SEQ ID NO: 307947 - RNA, 64 nt, Human
gaacuguccuucccucaaagaggccuuagagcgagcagagcagcucugcuaugagugugugugu

SEQ ID NO: 307948 - RNA, 64 nt, Human
ggaaagagcacccucgagaaggguggaugacagggcagagcaggaaggacaggaagcuggcaga

SEQ ID NO: 307949 - RNA, 64 nt, Human
uuuugaaauauuuguggacauaaauaaaaccaagcuacacuacaacccuugggugucucccgug

SEQ ID NO: 307950 - RNA, 64 nt, Human
uacaguaaacaaaacuaacguaaucuaccauuuccuacacuauuugagcauggaaaucauaguc

SEQ ID NO: 307951 - RNA, 64 nt, Human
cuguuucugcugcuuccaucaaagccaaaaggaccuacacuaaagaaaugcagggugggggugg

SEQ ID NO: 307952 - RNA, 64 nt, Human
aaaaggcugcccagccuuacagcagaugcugaaggcagagcagcugagggaggggcgcuggcca

SEQ ID NO: 307953 - RNA, 64 nt, Human
cucagcacccaguggguaauacuugcuuccacuugcagagcaccgugccaagcacuucccacac

SEQ ID NO: 307954 - RNA, 64 nt, Human
gcccugccggucaccaggccacugugcagugggcgcagagcauggucaggaguggccugcccgu

SEQ ID NO: 307955 - RNA, 64 nt, Human
guuguuuccaggugugcucaagugccuuccucuagcagagcacagaaagcuagaauacccccag

SEQ ID NO: 307956 - RNA, 64 nt, Human
gcaaagcucugugaccacugcuguaccacauuaugcagagcacacaggacaggcuggugcaccu

SEQ ID NO: 307957 - RNA, 64 nt, Human
acgacagaugcuaaaaucccuggaucacgacgcugcagagcaccuuugcacaggaugcuggccu

SEQ ID NO: 307958 - RNA, 64 nt, Human
ugcugguagagccugggcuugcugugccaagggggcagagcaauaaauaaacucuucaacccca

SEQ ID NO: 307959 - RNA, 64 nt, Human
ugucucuacagagcccggcaccccaugaggacaugcagagcaccugcagaggagcaggaggccg

SEQ ID NO: 307960 - RNA, 64 nt, Human
cucuuggugcaucaccggacaucuuagaccuauggcagagcauccucucugcccugggugaccc

SEQ ID NO: 307961 - RNA, 64 nt, Human
cugauggccucuaccuuuguauccaggagaaacugcagagcagcccugugacuuuacaaaauau

SEQ ID NO: 307962 - RNA, 64 nt, Human
caaaacaaacaggccaaaagggggcugaccuggagcagagcauggugagaggcaaggcaugaga

SEQ ID NO: 307963 - RNA, 64 nt, Human
uaccccacaaggacaguguguauacaaaguauuugcagagcaugacuuuuauaugugugggaua

SEQ ID NO: 307964 - RNA, 64 nt, Human
aacucugagaaacacaucuaguauaacugaauaagcagagcaucaaauuaaacagacagaaacc

SEQ ID NO: 307965 - RNA, 64 nt, Human
auaaucaaaugccuucaauuucugagaaaaugaggcagagcauggaaaaggaauaggaaggaga

SEQ ID NO: 307966 - RNA, 64 nt, Human
uuauuccuacauucugaauggggagcagguaagagcagagcaccucccacugggggugggguau

SEQ ID NO: 307967 - RNA, 64 nt, Human
gggaauaccugucucugcucuagcagaggcuaaagcaggcuagagcaguggagggguggaguug

SEQ ID NO: 307968 - RNA, 64 nt, Human
uuuuuuuuuuuuuuuuuuuaacaggauaacuugagcaggcuaggccucuuaaaaaaaaauuuga

SEQ ID NO: 307969 - RNA, 64 nt, Human
cccugcaggcuucugccauauccaugagaagauucuacacuagcguccuguugggaauuaugcc

SEQ ID NO: 307970 - RNA, 64 nt, Human
cacccccauuaggcagacacuggguucugugacagcagagcaugaccuuaaggguuacaggcag

SEQ ID NO: 307971 - RNA, 64 nt, Human
accgaggccuccccagcgcacugaauguccccgcgcagagcagagggaaggcagcggaagacgc

SEQ ID NO: 307972 - RNA, 64 nt, Human
uggccaccaccccccccccccgccacgccuuagagcagagcagccccuccucucauuuggugca

SEQ ID NO: 307973 - RNA, 64 nt, Human
acuacaguuuuagcggggagggggauaggaagacgcagagcaaaugagcuccggagucccugca

SEQ ID NO: 307974 - RNA, 64 nt, Human
agcugaugucaucacacucuccauguuaguaauggcagagcagucuaaacagaguccgggagaa

SEQ ID NO: 307975 - RNA, 64 nt, Human
gcagggagagagggaaccugcucacggcccugcagcagagcagggcgcaaacccaggacaucug

SEQ ID NO: 307976 - RNA, 64 nt, Human
gucuucugaggacaaggcgcacguucuccgcagugcagagcagcuugccgaggaccccgcguga

SEQ ID NO: 307977 - RNA, 64 nt, Human
ugaugggagaguguuguuuuugucacuugccccagcagagcagggguuuuggaaggagaggucu

SEQ ID NO: 307978 - RNA, 64 nt, Human
aggaaaggccuaaaguuucacuuggggacagagagcagagcacacucgggccucaucccuccca

SEQ ID NO: 307979 - RNA, 64 nt, Human
gacaaaagauaagcugcagaaggaccucagaagggcagagcaaagggugagccuacaguaagac

SEQ ID NO: 307980 - RNA, 64 nt, Human
gugaaaugguuuaaauuuuacaugcugaaaagcugcagagcagaggaaccaaaccagguuuauu

SEQ ID NO: 307981 - RNA, 64 nt, Human
ggacuauggcugcauguccucugcuugcccggcugcagagcagagaugugcagcccucugguca

SEQ ID NO: 307982 - RNA, 64 nt, Human
cccaacucccuuucccaaacaaaaagccacagaggcagagcaagcauuccccuuuaagagcuuc

SEQ ID NO: 307983 - RNA, 64 nt, Human
uuuugccuuagauggcaacacccuccagucuguagcagagcaguccaacccagauuagugcagc

SEQ ID NO: 307984 - RNA, 64 nt, Human
ucuuaauuaacuuucauauuagcagauuaaacuagcagagcagguucaagggaaauuaaaugau

SEQ ID NO: 307985 - RNA, 64 nt, Human
uuuuacuugcuugcuguucuuuugggucaaaggagcaggcuaaugcaaagcuuuuggagacugc

SEQ ID NO: 307986 - RNA, 64 nt, Human
ggcugggaacccaaguccaagcauaccaacacgagcaggcuacugucagcuccccucggagaag

SEQ ID NO: 307987 - RNA, 64 nt, Human
guaacaguuuacugguuguuccauuccugaauaugcaggcuaauuuguacagauagggauuaag

SEQ ID NO: 307988 - RNA, 64 nt, Human
ggcagugggaucccugagugcugaaugcucgccugcagagcagcccagaaagagcccugacugg

SEQ ID NO: 307989 - RNA, 64 nt, Human
gaaagauuugacucgugugucuacuagccaacaggcagagcaggguugaaaaaaauaucagcuc

SEQ ID NO: 307990 - RNA, 64 nt, Human
cuguagcucagugacagguggugguuguuuaagugcagagcaauauuaaaauguacuggugacu

SEQ ID NO: 307991 - RNA, 64 nt, Human
gccgccuccagcuugcagugguccccagccuggagcagagcauuggggagugucuagccaugac

SEQ ID NO: 307992 - RNA, 64 nt, Human
gcuuaucuguagaaacaaauggccauggagaaacgcagagcaguccagaaccaguggcagcuac

SEQ ID NO: 307993 - RNA, 64 nt, Human
agaaggagacccagacaucccgaggaaguucccagcagagcaaacugcuuuccagccugaagcc

SEQ ID NO: 307994 - RNA, 64 nt, Human
gggggaaauauucccucaccccaggguucuuucugcagagcaaggguugccuuuguccuauccc

SEQ ID NO: 307995 - RNA, 64 nt, Human
cacucaucucuacagagauaagaaaacaaguuuggcagagcaagagacagaagaccguggagaa

SEQ ID NO: 307996 - RNA, 64 nt, Human
agucacuagugcgccagccaggccaggagggagugcagagcaugucugccaagcacagagcauc

SEQ ID NO: 307997 - RNA, 64 nt, Human
caccagcugggcugggccagccuggcccugcagggcagagcacgcuuguuugggcaauuguaau

SEQ ID NO: 307998 - RNA, 64 nt, Human
gccagcagggacgcgccccaggugggcagcuguggcagagcagcgacccgcggcggggcggcau

SEQ ID NO: 307999 - RNA, 64 nt, Human
gccagcagggacgcgccccaggugggcagcuguggcagagcagucccgacaccuaaauaaaagu

SEQ ID NO: 308000 - RNA, 64 nt, Human
aguuucugacaaggcucauacccuguacccuuaugcagagcaagcauuccauccuaaguuauaa

SEQ ID NO: 308001 - RNA, 64 nt, Human
uuuaaauuauuuaaggucucugggaagggcuggggcagagcaucugugggguggggucuucccc

SEQ ID NO: 308002 - RNA, 64 nt, Human
cauaugguauuuguuaaauacguuuguuuuuauugcagagcaaaaauaaaucaaauuagaagca

SEQ ID NO: 308003 - RNA, 64 nt, Human
cgugauggcaggugccuguaauccuagcuacuuggcaggcuaacgcaggagaaucacuugaccg

SEQ ID NO: 308004 - RNA, 64 nt, Human
ugggcccgccuccccaggagguagaaaaugaguggcaggcuagagauuucacccauuuuguggg

SEQ ID NO: 308005 - RNA, 64 nt, Human
agacaaaacaaagccggcuuguuuccuccccuuggcaggcuaagcucucccggcagcccgggcu

SEQ ID NO: 308006 - RNA, 64 nt, Human
uauugcgaagcacaugccccaucgagccuacugggcagagcagcagagcaggguuggaggggcu

SEQ ID NO: 308007 - RNA, 64 nt, Human
agcacaugccccaucgagccuacugggcagagcagcagagcaggguuggaggggcuggggagac

SEQ ID NO: 308008 - RNA, 64 nt, Human
cucaggggguaggagagcacugccucuaugcccugcagagcaauaacacuauauuuauuuuugg

SEQ ID NO: 308009 - RNA, 64 nt, Human
ccuuuaagaagugucccuuuggcgcccccuggaggcagagcacugagcuggacccuggguagac

SEQ ID NO: 308010 - RNA, 64 nt, Human
ucuggugguuuuuuuuucucacgcugauggcuuggcagagcaccuucgguuaacuugcaucucc

SEQ ID NO: 308011 - RNA, 64 nt, Human
uggccgucccugcaaagaguguacugugcuugaagcagagcacucacacauaaauggcugugug

SEQ ID NO: 308012 - RNA, 64 nt, Human
cucaguucaugaacuaacugccgugggccuccuggcagagcacaacuggggcuuuuguauaaga

SEQ ID NO: 308013 - RNA, 64 nt, Human
auugcuuuccaagcugccuuguugcgggguugcugcagagcagcaacuggaccuuuccagcugu

SEQ ID NO: 308014 - RNA, 64 nt, Human
ggggccacagcgugucuggagaagccaggucugagcagagcagcuggugaaucccagacguggc

SEQ ID NO: 308015 - RNA, 64 nt, Human
accguucauguagcagcaaccggcggcggcugccgcagagcagcguucgguuuuguuuuuaaau

SEQ ID NO: 308016 - RNA, 64 nt, Human
uucaaaaacauaaagcuaguucaaaaaacgaguugcagagcauauaauaaauuuggaugucaac

SEQ ID NO: 308017 - RNA, 64 nt, Human
agcggaugccccgagacucugcuugguaaacguggcagagcagaaugggaggcuggacccugag

SEQ ID NO: 308018 - RNA, 64 nt, Human
uccccagaucugcuggaaugauuguccgggcccugcagagcaggggccccaacagaguuuuuaa

SEQ ID NO: 308019 - RNA, 64 nt, Human
ccucggccucagcgucuggaccuauccggccacugcagagcacccgcuucucccuggccuucau

SEQ ID NO: 308020 - RNA, 64 nt, Human
uaguccugggagagugucugcagggcggcggagggcagagcaggcccugcggagagcucacucu

SEQ ID NO: 308021 - RNA, 64 nt, Human
agguuuuaggguccugcaaaaggcuagcucggcacuacacuagggaauuugcuccuguucuguc

SEQ ID NO: 308022 - RNA, 64 nt, Human
ccaggagccaaaagcugggguaggagaggagaaagcagagcagccuccuggaagaaggccuugu

SEQ ID NO: 308023 - RNA, 64 nt, Human
caaggagaaaauugcacuaggcacuccaugaucugcagagcauguugcuuuuguuuuuuuaaaa

SEQ ID NO: 308024 - RNA, 64 nt, Human
aaaaauuuuggcagucuuguaugcaaaugacacugcagagcauuguuuucucccccccacguag

SEQ ID NO: 308025 - RNA, 64 nt, Human
ggccucagggccacucccucccuagccuucaucagcagagcacccuccaucccccugcauugcu

SEQ ID NO: 308026 - RNA, 64 nt, Human
gagcugcuucacuagggaauccugcggcaggacugcagagcagauggcagaugcacauguugga

SEQ ID NO: 308027 - RNA, 64 nt, Human
uucuucuuccuucucaauggugacauuugaagaggcagagcaccuuggggcuccuccuucuguc

SEQ ID NO: 308028 - RNA, 64 nt, Human
gagaagugguugugaaaacauguacaggcuuuaugcagagcacugcgcauggcuguucugcugc

SEQ ID NO: 308029 - RNA, 64 nt, Human
gggaagaagcuggaggccgugggagaauggcugggcagagcagaggggcagcgauagacucugg

SEQ ID NO: 308030 - RNA, 64 nt, Human
uuaaccaaguauuuauuuuucaucuuguuauaaugcagagcaaauguagagaacagcaaaugau

SEQ ID NO: 308031 - RNA, 64 nt, Human
ggaaaaaaauuaaccagagagggucuguaaucucgcagagcacaggcagaaucguuccuuccuu

SEQ ID NO: 308032 - RNA, 64 nt, Human
agauccuggaaacgaauuuaaauggugucaaacugcagagcaacagggcuucaguauauucaca

SEQ ID NO: 308033 - RNA, 64 nt, Human
uaccugcccugguccugcuugaagguuuguccaggcagagcagcuccugcagcgccucggucug

SEQ ID NO: 308034 - RNA, 64 nt, Human
acagccugcgcagggggcugggcuucagcaaggggcagagcauggagggaagaggauuuuuaua

SEQ ID NO: 308035 - RNA, 64 nt, Human
ugagcugaggccggaggagaaguagcagucgcuggcagagcacacaggcugcucugggggauga

SEQ ID NO: 308036 - RNA, 64 nt, Human
aagcccagaucucuucagcaaucguuucuuccgugcagagcaaaaucacucaggucagugggca

SEQ ID NO: 308037 - RNA, 64 nt, Human
aaauuuguucauuuggucucauauagcaauuaaugcaggcuauuaucagacacagcagcaggau

SEQ ID NO: 308038 - RNA, 64 nt, Human
guugcaggcucaggccccugggcuccuucagcaagcaggcuagucaaugaggcaugaggauccg

SEQ ID NO: 308039 - RNA, 64 nt, Human
gcagggcucccuaugugccucccaaacgucaaaugcaggcuacccauucuccccaucagcugcc

SEQ ID NO: 308040 - RNA, 64 nt, Human
gcugcuggaaauggcuucuuuaaacugugagcacgcagagcaccccuucuccagcggugggaag

SEQ ID NO: 308041 - RNA, 64 nt, Human
ucagguuauucuuagagacuacacauuuggaauagcagagcaaaauauggauaaugaaaguguu

SEQ ID NO: 308042 - RNA, 62 nt, Human
aaaauuguauuauuucuuaaccaaguagugaugcagagcauuuguuuaaaacuuagccauua

SEQ ID NO: 308043 - RNA, 64 nt, Human
agaaggacuggaauguaccccaucucccuugacugcagagcagguuccuccacugccccacccc

SEQ ID NO: 308044 - RNA, 64 nt, Human
gugccagcaccaggcagagggcaagacggagagggcagagcaagaacugcacugcaucucacug

SEQ ID NO: 308045 - RNA, 64 nt, Human
ugcaacuaaguaggccuccagagccucucuaguggcagagcagcucacacucccuccgcuggga

SEQ ID NO: 308046 - RNA, 64 nt, Human
agaugcaucugucaccuucaucaggguccucagugcagagcaacuuacgcauccucaagaaucc

SEQ ID NO: 308047 - RNA, 64 nt, Human
uagugguuggaagugcuaagaaugguggaugauggcagagcauagauucuacucuuccucuuuu

SEQ ID NO: 308048 - RNA, 64 nt, Human
ucauacauuuaguaugaaaacuugaacagcgaaagcagagcauguuauuuauauaacugcauuu

SEQ ID NO: 308049 - RNA, 64 nt, Human
guuccgugaugagcguuuagugagccugcuggcugcagagcacuaugaaaucaugguacguagu

SEQ ID NO: 308050 - RNA, 64 nt, Human
accgucacccagugacccaccggguucugcagcggcagagcaauuccaggcugagccaugagga

SEQ ID NO: 308051 - RNA, 64 nt, Human
aaagauaacuaagcgugaaugaggaacagaagaagcagagcagaugauucgagcagcauuuguu

SEQ ID NO: 308052 - RNA, 64 nt, Human
acuaagguagagccauagcgccgccugugggaccgcagagcaugcugcguagcucgcgcgucag

SEQ ID NO: 308053 - RNA, 64 nt, Human
guuagugagacaauuuauuuuuauugccuaaacugcagagcauucucuacacagcguaaaggag

SEQ ID NO: 308054 - RNA, 64 nt, Human
ugccucagguggagaccugaagcuguaacuagaugcagagcaagauaugacuauagcccacaac

SEQ ID NO: 308055 - RNA, 64 nt, Human
ccucagcuuccucuacccaucuucuuuucuuaaagcaggcuaugugcccuacauggcaaggcac

SEQ ID NO: 308056 - RNA, 64 nt, Human
caccagguacgauucucuuuccacaguggacacagcaggcuauuuucuaguuugugcuggucac

SEQ ID NO: 308057 - RNA, 64 nt, Human
agaacauugaguccagugagauuaagugauuuuugcaggcuaugagguuuuaugcuauuccugu

SEQ ID NO: 308058 - RNA, 64 nt, Human
uggaggcucugccuugccucaagaaccauccccugcagagcauccagggagguuucucgcccca

SEQ ID NO: 308059 - RNA, 64 nt, Human
aggcagacacaugcuguuggccucaagcaaggaagcagagcacuguguaaccagcagucacagg

SEQ ID NO: 308060 - RNA, 64 nt, Human
agucagagagugaaggcuuuuuccccuaauccuggcagagcagggcguagaaaagagaggaugu

SEQ ID NO: 308061 - RNA, 64 nt, Human
aaguguuggcacgcacagccauggacccagcugagcagagcagacgcuuugcaggcugccccug

SEQ ID NO: 308062 - RNA, 64 nt, Human
ggacauuccacacccuggugcugugcagccucuggcagagcauccgaccucuuggagcaaguuu

SEQ ID NO: 308063 - RNA, 64 nt, Human
caucauagggggguguccccccagagacaaagcugcagagcacauuccaugccagacgcucugg

SEQ ID NO: 308064 - RNA, 64 nt, Human
cccagggcgaguauuggaggaggggcagccacgggcagagcaccaugcccauccccgagucucu

SEQ ID NO: 308065 - RNA, 64 nt, Human
agcgcgugggucuguuugggaggccugggccggagcagagcagaggugauccggccccugccug

SEQ ID NO: 308066 - RNA, 64 nt, Human
guguaauguaucuaacuuuuagcaaaggaggguugcagagcagcuuaaauuuuuuuuauaaugu

SEQ ID NO: 308067 - RNA, 64 nt, Human
uccauccuccccacaucccugcagccaccucccagcagagcaggcuacguccucacugaggugu

SEQ ID NO: 308068 - RNA, 64 nt, Human
guugauagaggcugugguguucucacuagacuuugcagagcaguaggcaucucaagguaacaga

SEQ ID NO: 308069 - RNA, 64 nt, Human
ggugaagagccgcagugcgcauaugaagagccacgcagagcaggagaagaaggcugcagcgcug

SEQ ID NO: 308070 - RNA, 64 nt, Human
agaauacugaccucaccuugggaugucaccaaaggcagagcagaugggacugucaaaguugugc

SEQ ID NO: 308071 - RNA, 64 nt, Human
uuuuaaauccagaaagcauauuuuauaaacuuaugcagagcacuuuuauugcucaaaaguucug

SEQ ID NO: 308072 - RNA, 64 nt, Human
cacggagccgggacccagaggggcagcgcagggcgcagagcacacccgcugggccagcagcucc

SEQ ID NO: 308073 - RNA, 54 nt, Human
gagguggaggagcaaacugaaggggcaggcuacuggggugggguagcuuucggg

SEQ ID NO: 308074 - RNA, 64 nt, Human
auuuaauacucccagcugucaugugagaaagaaagcaggcuaggcaugugaaaucacuuucaug

SEQ ID NO: 308075 - RNA, 64 nt, Human
aaccuuugauaagcaaagaaaaucguguauuagggcaggcuaggccacaggauacguagacucc

SEQ ID NO: 308076 - RNA, 64 nt, Human
gcaccagcguugcugaguaucccaugagugcuucgcagagcaacaaaggaguagacgugaacaa

SEQ ID NO: 308077 - RNA, 64 nt, Human
ccaccaggacggggcacuccgcccccacccgucggcagagcaaccccaccuccagguaagggau

SEQ ID NO: 308078 - RNA, 64 nt, Human
ugaaguaucuuguacauauaaauuuauuucuuuugcagagcauuauauuacuggauguuuaauu

SEQ ID NO: 308079 - RNA, 64 nt, Human
cuccccccaguuaucuuccacccacauggacugggcagagcagcccucuucugugugcacugca

SEQ ID NO: 308080 - RNA, 64 nt, Human
gaugugcuggauuaggaaaggugacaugacacaggcagagcagaguggcacccaccacagaaua

SEQ ID NO: 308081 - RNA, 64 nt, Human
caggagccaagagcaugccuucaugcccuucucugcagagcaugggauggggcccuuccagccc

SEQ ID NO: 308082 - RNA, 64 nt, Human
ucauuguuuuuguuuuuguuuuuguuuugacacugcagagcacaaggcuaaagguuacagcuga

SEQ ID NO: 308083 - RNA, 64 nt, Human
cuaaagguuacagcugagaucuuuggaaccaaaggcagagcaagcagagcccguugucugggcc

SEQ ID NO: 308084 - RNA, 64 nt, Human
uaugguuccuugguaagcacgguauucuaaaccagcagagcacuuguuaacguuuggaggcaca

SEQ ID NO: 308085 - RNA, 64 nt, Human
aauaaauguagccaucuccuuguuguuugcaauggcagagcauccuagaguuccucagcuaacc

SEQ ID NO: 308086 - RNA, 64 nt, Human
aacaugggggaacaaugagcagagauggcagagggcagagcacauggcccccagaggcuuccag

SEQ ID NO: 308087 - RNA, 64 nt, Human
cauguaaagcaaucgcaaagcaagggggaaguuugcagagcaugccaggggacuacguuucuca

SEQ ID NO: 308088 - RNA, 64 nt, Human
cauuccugucugggugaagaggagacguguuacggcagagcaggugggcaaggccagggcuacc

SEQ ID NO: 308089 - RNA, 64 nt, Human
cacuguggaucugccauccauucugcagucuccagcagagcaggcagucaggccccagcgugcc

SEQ ID NO: 308090 - RNA, 64 nt, Human
guuguucugugccugcagcauagagcgcaggcuggcagagcaaauagggcuggugaggagugac

SEQ ID NO: 308091 - RNA, 64 nt, Human
caaaaaagaaagaaugauguccugacaugaaacagcaggcuacaaaaccacugcaugcugugau

SEQ ID NO: 308092 - RNA, 64 nt, Human
ccguaggagaggcucucaugcuguaaauaauguugcaggcuaauaaccuuucaucacuuccuuu

SEQ ID NO: 308093 - RNA, 64 nt, Human; identical to SEQ ID NO: 64677

SEQ ID NO: 308094 - RNA, 64 nt, Human
aguagaggggcucugggucgggguuucauaugcagcagagcagcucccuugcugccguccauca

SEQ ID NO: 308095 - RNA, 64 nt, Human
uguugcaggagggagagggcagggaagacucacagcagagcaggagggggccugugcuucucgg

SEQ ID NO: 308096 - RNA, 64 nt, Human
gagaacuuaggagagaagcacggaggagcccccggcagagcacccgcccccgggccccagccuu

SEQ ID NO: 308097 - RNA, 64 nt, Human
ucuguaacaucugaggugaccaagaggcagaagagcagagcagucgggggccguguccuggcug

SEQ ID NO: 308098 - RNA, 64 nt, Human
cucagaagguauauuaggacauuuggaaucaguagcagagcaaagccucuuugaaaaaaaccac

SEQ ID NO: 308099 - RNA, 64 nt, Human
gccgggccagcuggaacccagcccauccucucaggcagagcagggugguccgggcacacugggc

SEQ ID NO: 308100 - RNA, 64 nt, Human
guggugggaggcacaguguuuacaggcucugguggcagagcaguuggcacaccugugggugaau

SEQ ID NO: 308101 - RNA, 64 nt, Human
cagaccuacaggcgaggccgcagcagaggguggggcagagcagccucggggucugggggcugca

SEQ ID NO: 308102 - RNA, 64 nt, Human
ggcacgcguccuggaggcugccagcguccuuguagcagagcaguuucuugccgcuugggucuuc

SEQ ID NO: 308103 - RNA, 64 nt, Human
aaauguaaagagaauagcuauucagugucuacuagcagagcaacaugugucaauuuaaccaaau

SEQ ID NO: 308104 - RNA, 64 nt, Human
cuguggauggcuggaucccgccugaaacggaccugcagagcagcagcacccuuccgguguggag

SEQ ID NO: 308105 - RNA, 64 nt, Human
acccucacagugaggcccucagaccugccacagggcagagcaggucuggggccugaggcaggga

SEQ ID NO: 308106 - RNA, 64 nt, Human
ccagccccuggaugcagccucacaguccuuaccagcagagcaccuuagacagucccugccaaug

SEQ ID NO: 308107 - RNA, 64 nt, Human
agacccugcccugugggcccccaaauggaaaugggcagagcagagaccaucccugaaggccccg

SEQ ID NO: 308108 - RNA, 64 nt, Human
ccugguaccugggcccagcucgccagggaugugggcagagcaccagccugggcaucaggaagcc

SEQ ID NO: 308109 - RNA, 64 nt, Human
ugacacaaguggccaacauccacacuguaggcuugcaggcuacccgcccugagauuugguaaag

SEQ ID NO: 308110 - RNA, 64 nt, Human
uguaaagggccgguuuauaaauauuuuagacuuugcaggcuauaauauaugguucacacaugag

SEQ ID NO: 308111 - RNA, 64 nt, Human
ucaaguugaaauuagguacagcuguugcuccuuagcaggcuaugaaguugcaaugcuucacauc

SEQ ID NO: 308112 - RNA, 64 nt, Human
cagcucccgcuccugugcuggcacuucugugcucgcagagcaggggaacaggacucagccccca

SEQ ID NO: 308113 - RNA, 64 nt, Human
cgcccccaccccuacagccugcacacaccugccugcagagcaggaaaugagagauagaggaugg

SEQ ID NO: 308114 - RNA, 57 nt, Human
uucguguucauuccccuugaggaggaagcagagcagagugcgagauccugacccaag

SEQ ID NO: 308115 - RNA, 64 nt, Human
gcaaccgcgacaaaauaacucuugacuaacagccgcagagcagccgguccuggggucccacccu

SEQ ID NO: 308116 - RNA, 64 nt, Human
cugaugccgugauccugagccaaggaggugaggagcagagcaggcaauuucaccaccaaaugcc

SEQ ID NO: 308117 - RNA, 64 nt, Human
gugaaggaggccgccccugcccccaccugagaaggcagagcagugucugugcugccagguccug

SEQ ID NO: 308118 - RNA, 64 nt, Human
aguaguuugacccucacaguucacauucagcucagcagagcaagaccccagagaugcuuagaga

SEQ ID NO: 308119 - RNA, 64 nt, Human
caggaugccggagagacagccccuugugcugugagcagagcaggcaguggcucuggaggcugcc

SEQ ID NO: 308120 - RNA, 64 nt, Human
ccaccaagguuuccucucuucccccaggaccugggcagagcaggcaugagcugggcuguggugc

SEQ ID NO: 308121 - RNA, 64 nt, Human
accugggcagagcaggcaugagcugggcuguggugcagagcaagcagacccagccacacugcuc

SEQ ID NO: 308122 - RNA, 64 nt, Human
ugaggggcuucagccugucccgggguugccugaggcagagcaagacggguucucaccccugacu

SEQ ID NO: 308123 - RNA, 64 nt, Human
cucucccucuaaaccccauuaaggacugggagaggcagagcaagccucagagcccaggccucag

SEQ ID NO: 308124 - RNA, 64 nt, Human
ggagggcugggcagcaagccaggcacagugaguggcagagcaagagggggaaagcaggaucagu

SEQ ID NO: 308125 - RNA, 64 nt, Human
gcugagaucaugccacugcacccuagcuuggguggcagagcaagacucuaucaaaaaaauaagu

SEQ ID NO: 308126 - RNA, 64 nt, Human
agcucaggcagcgcaggugugaugggcacaguacgcagagcaagcucgggaaguugguaggauc

SEQ ID NO: 308127 - RNA, 64 nt, Human
ggucugagaugagggggagccccacgggccccaggcaggcuagaggaggcacaggcccugccac

SEQ ID NO: 308128 - RNA, 64 nt, Human
uuauuuuuuggugccugcauguuugaagacugaagcaggcuaaaagcucuugaugaaauuugag

SEQ ID NO: 308129 - RNA, 64 nt, Human
cauaugucuauaacaaaagcaauauauacccagacuacacuaguccauaagcuuuacccacuaa

SEQ ID NO: 308130 - RNA, 64 nt, Human
agcauccucagaagccucgacugagcuuuagacagcagagcagaugccgcaggcgcggcggcuc

SEQ ID NO: 308131 - RNA, 64 nt, Human
aggcccccgagguguguguaggaggcggaggcccgcagagcacagagcaggagaagggcuuggg

SEQ ID NO: 308132 - RNA, 64 nt, Human
uugaauguguggccaauggagacagaggcuuagugcagagcagccaauggguacugagcuggcu

SEQ ID NO: 308133 - RNA, 64 nt, Human
ccucgagaucaaacacuaaggcacggggcuggcugcagagcagccuuaggacccugggaccaag

SEQ ID NO: 308134 - RNA, 64 nt, Human
acuugccugcacccaccaugaggcauggagcagggcagagcaagggccccgggacagaguuuuc

SEQ ID NO: 308135 - RNA, 64 nt, Human
ucagcagcgggcacggguggggcggggccgggccgcagagcaugugcuggaucuguucugugug

SEQ ID NO: 308136 - RNA, 64 nt, Human
ggguccugaccaggucagagauguccccugccaugcagagcaggaagccucagcugggccugga

SEQ ID NO: 308137 - RNA, 64 nt, Human
gggacgcuuuugagugggcccugcccggggagcugcagagcagcagcaccuuucucugagaaga

SEQ ID NO: 308138 - RNA, 64 nt, Human
uccaggagccccaggcccggaggaggcgaagcccgcagagcaaagguggaaacacgugccuacg

SEQ ID NO: 308139 - RNA, 57 nt, Human
acaagcuccugaaggagugaggccugggcagagcacacucagcaggauagaggcagu

SEQ ID NO: 308140 - RNA, 64 nt, Human
uugcuuguagucauggccagggccaaauagcuaugcagagcagagaugccuucaccuggcacca

SEQ ID NO: 308141 - RNA, 64 nt, Human
cuccucaugcccuggaccagccuggaacacacuagcagagcaggaguaccuuucuccacaugac

SEQ ID NO: 308142 - RNA, 64 nt, Human
gcaucagugcccuggcuguccugugaguccucaugcagagcagggccaucauggucagcccuug

SEQ ID NO: 308143 - RNA, 64 nt, Human
guuuaaugucaguuuaauaaguggucucuuuuuagcagagcaaaaaaauauagcguaaauacuu

SEQ ID NO: 308144 - RNA, 64 nt, Human
ggaugaugacaucgcuuuccuuuggucaagguuggcagagcaaggguauaaagggggaaauugu

SEQ ID NO: 308145 - RNA, 64 nt, Human
cucuuuucuuaaacuucuggcauuucagagcucagcaggcuaccccugguuucuggagaguugg

SEQ ID NO: 308146 - RNA, 64 nt, Human
auucacaaaauauuuuugcaaccagaacacaaaagcaggcuagucagcuaagguaaauuucauu

SEQ ID NO: 308147 - RNA, 64 nt, Human
aucaguugacaucuccuagggaaugaugaaaacagcaggcuauuagaaaauuauuucauauagu

SEQ ID NO: 308148 - RNA, 64 nt, Human
cuuuuguuguuguuccugcuacuuucaccuuuaagcagagcagucaggagacaagcauaaacca

SEQ ID NO: 308149 - RNA, 64 nt, Human
cccaggcuguggugccacccucucuggcauucaugcagagcaaagcacuuuaaccauuucuuuu

SEQ ID NO: 308150 - RNA, 64 nt, Human
aaaacuacaagugcuguacauaugcugagaaacugcagagcauaauacugccacccaaaaaucu

SEQ ID NO: 308151 - RNA, 64 nt, Human
ggaggagucagagugagagcuaguggccacagcugcagagcacugcagcucccagcuccuuugg

SEQ ID NO: 308152 - RNA, 64 nt, Human
acugaggagcggacucacuugauguuuccuggaagcagagcaaaaugcucuugucccugucgcg

SEQ ID NO: 308153 - RNA, 64 nt, Human
cuuuggguaggacuucggguguucgguccuggucgcagagcacagaucuuuaaagaagcgagag

SEQ ID NO: 308154 - RNA, 64 nt, Human
gugagccuuuucauuucggugacagaagagaugggcagagcaacuuauuuuccacauuaaauug

SEQ ID NO: 308155 - RNA, 64 nt, Human
aauuaagccauuuacauguuuguguuuuucuauagcagagcauuauauuuugcauuauauguuu

SEQ ID NO: 308156 - RNA, 64 nt, Human
cuggugggauauuuugggaugucaagggguggaggcagagcacaagucacaccagaaacugcuu

SEQ ID NO: 308157 - RNA, 64 nt, Human
uagcuccuccugguuuggugugguguuugccauugcagagcaagcugccacgaagaccccuggg

SEQ ID NO: 308158 - RNA, 64 nt, Human
cugccacuccgccagggccagcaugccaguccaggcagagcagguggcuggcugucuggccguc

SEQ ID NO: 308159 - RNA, 64 nt, Human
accaugagccauccucugcccugacuagcgaggggcagagcacaccccagugcuuacgccucca

SEQ ID NO: 308160 - RNA, 64 nt, Human
cacacugacugcccacccagcuguggcgggaggugcagagcagagggcuuuagggagcagugac

SEQ ID NO: 308161 - RNA, 64 nt, Human
auccagcggcucuucuuuuuaggaaggcucuggugcagagcacuucaaauauguccucaggcca

SEQ ID NO: 308162 - RNA, 64 nt, Human
agauguagauguagugaaaaacuucaagaaugaagcagagcaauugaguauucuuuuuuaaauu

SEQ ID NO: 308163 - RNA, 64 nt, Human
gaaaacuagcuuguaaaauuuauccaaguagagugcaggcuaggcugucuuggggaaauaaaca

SEQ ID NO: 308164 - RNA, 64 nt, Human
aaggguuucuugcuuucuuaaacauuuccguaaggcaggcuagaaauguaauacuucaaauguu

SEQ ID NO: 308165 - RNA, 64 nt, Human
aauagucugcuuccacggugaucagagcccacuagcaggcuaagauuucuaaaguaugcccuuc

SEQ ID NO: 308166 - RNA, 64 nt, Human
acucaguauugauaaaaccuuuuuaauaagugaugcagagcagccaaggauauguugacccaga

SEQ ID NO: 308167 - RNA, 64 nt, Human
ucaaccaggcuauuuuuauacuuaaaacaugucagcagagcauaggcagaauaaaaugguuuaa

SEQ ID NO: 308168 - RNA, 64 nt, Human
uccagucauuucucuaugagacugaagcaggaaggcagagcaucaucuuguucagccucagcug

SEQ ID NO: 308169 - RNA, 64 nt, Human
cuucugucuuccugacugaaugaaacuugaauuggcagagcauuuuccuuauggaagggaugag

SEQ ID NO: 308170 - RNA, 64 nt, Human
cagaugaaaaaugccuuagugauaagcuuucauggcagagcacgucaagauaaauggguauacu

SEQ ID NO: 308171 - RNA, 52 nt, Human
acgcaaauaaaauucuguaagcgcagagcagcagggaaaugguucuguauga

SEQ ID NO: 308172 - RNA, 64 nt, Human
acagacaauaauuugguuguucuaaauauuccuggcagagcauuuagcuaacaccuugcagcgg

SEQ ID NO: 308173 - RNA, 64 nt, Human
aggcugccccucuccuuccccggcucgcaggagagcagagcagagaacuguggggaacgcugug

SEQ ID NO: 308174 - RNA, 64 nt, Human
auggccuucagggaagguggucuuggggcauggugcagagcaggugaccggagggaaucgguga

SEQ ID NO: 308175 - RNA, 64 nt, Human
gcguggcgguggaccagccagcugcuguccaugugcagagcaaggcugcaccugcugcccuucg

SEQ ID NO: 308176 - RNA, 64 nt, Human
caacuaauauuaagacuccugugguauugauugagcagagcagaagagauuucaaaaaaagacc

SEQ ID NO: 308177 - RNA, 64 nt, Human
uccaaucccaccggacccaggcccugggcuaggggcagagcaggccccgccccagggcaauguu

SEQ ID NO: 308178 - RNA, 64 nt, Human
uccuccaagguucucuucuguucccauggauccugcagagcaugucaggagugaaaccauccau

SEQ ID NO: 308179 - RNA, 64 nt, Human
cucaggcugcuggggccucagacgagacccaagggcagagcauuuaagagugaagucaugaccu

SEQ ID NO: 308180 - RNA, 64 nt, Human
cccuucccaggggcgaggucggcaaagcaacauggcagagcagucauaggacccaaguggugcc

SEQ ID NO: 308181 - RNA, 64 nt, Human
ucuuugacugcugaaggaaccccauggaugaggugcaggcuacuucacucuuuuuuuuucuuuu

SEQ ID NO: 308182 - RNA, 64 nt, Human
uauuggccccaugacauccagugacagugugggagcaggcuacucuccagggacauguuuuugg

SEQ ID NO: 308183 - RNA, 64 nt, Human
uaccaggacugagggagccagaggaguccuauaggcaggcuacugugcuggagcaucccccagc

SEQ ID NO: 308184 - RNA, 64 nt, Human
ccugcggcccgggccagcccgggcuuucuccggagcagagcagcgcugcuggccuggcagccag

SEQ ID NO: 308185 - RNA, 64 nt, Human
ccuggggaccgguaagauccaugucacuaguuaugcagagcaguugccuugggucccacuguca

SEQ ID NO: 308186 - RNA, 64 nt, Human
accucagaccucuguccuaugacuaauguuacuggcagagcaaauaaucuaaagguuuugguuu

SEQ ID NO: 308187 - RNA, 64 nt, Human
ucagaucuuugcaaaucaguacgacagccucagagcagagcaaggguuguuugggagaaucaua

SEQ ID NO: 308188 - RNA, 64 nt, Human
gccgagauugcgccacugcacuccagccugggcagcagagcaacacucugucucaaaaaaaaaa

SEQ ID NO: 308189 - RNA, 64 nt, Human
guguccugggauagguuuccuaggcaggggcguggcagagcagguaggcgcccugcagccuccc

SEQ ID NO: 308190 - RNA, 64 nt, Human
guuuuaacauugaaagugagcggaggacuugggggcagagcagcacaaagaaacagccuuacac

SEQ ID NO: 308191 - RNA, 62 nt, Human
aggagcaagaagaguauuaacagccuggaccagcagagcaacaucggaauucuucacuccaa

SEQ ID NO: 308192 - RNA, 64 nt, Human
ccaauaaguuugaguuaggagcuuuuaccuuguagcagagcaguauuaacaccuaguugguuca

SEQ ID NO: 308193 - RNA, 64 nt, Human
aggcagggaaagggcacacacccuaggucagcgugcagagcagugaugcuggaggacacaccau

SEQ ID NO: 308194 - RNA, 64 nt, Human
gaaacaccgcauccuugcacugcugcuggggcuggcagagcaguuggcugacagcaacaaccga

SEQ ID NO: 308195 - RNA, 64 nt, Human
gcaccuuucuaagccugugguugcuucacccgcugcagagcacacgcaacccagccucagcauc

SEQ ID NO: 308196 - RNA, 64 nt, Human
ucuuacugacagcaaccaggaauuuuuuuauccugcagagcaaguuuucaaaauguaaauacuu

SEQ ID NO: 308197 - RNA, 64 nt, Human
uuagacuugaaaagagacaggcaggugaucugcugcagagcaguaagggaacaaguugagcuau

SEQ ID NO: 308198 - RNA, 64 nt, Human
gaggacuuugggggacaggcuucuccugugagcagcagagcagcacaauaaaugaggccacugu

SEQ ID NO: 308199 - RNA, 64 nt, Human
ccguggucuuugaacucacccaagcacccaccaggcaggcuacaagugaggcuaccuuucaaac

SEQ ID NO: 308200 - RNA, 64 nt, Human
agcaaggagcuggugagcccagcguugacgucaggcaggcuaugcccuuccgugguuaauuucu

SEQ ID NO: 308201 - RNA, 64 nt, Human
gagccccucaugccacagugguacucugugucuggcaggcuacucugcccaccccagcaucagc

SEQ ID NO: 308202 - RNA, 64 nt, Human
ugugcuuucuaaggacugcucuuagccagugacugcagagcagggauaccaaggcaggccuguu

SEQ ID NO: 308203 - RNA, 64 nt, Human
uggcugcaguccagagaaaggaaagauugagguggcagagcagaccacucucccuucccaaacu

SEQ ID NO: 308204 - RNA, 64 nt, Human
caauaccaagaugucuucacagggcacagccccugcagagcaucuuggucauuuggaagaggac

SEQ ID NO: 308205 - RNA, 64 nt, Human
ccagaccugccgccuggcuucuggagugcuucaagcagagcauggugggucauugaggagaccc

SEQ ID NO: 308206 - RNA, 64 nt, Human
aucaccuacugccuucugaguagaagaacucacugcagagcaguuuaccucauuuuaccuuagu

SEQ ID NO: 308207 - RNA, 64 nt, Human
ggcccagagcaggggaacuggaguuugugagugagcagagcagguuaugugcagacagggaaac

SEQ ID NO: 308208 - RNA, 64 nt, Human
gcucccuaccuccuggacgucucugagaguccaggcagagcagagggcagcgcucggccgguca

SEQ ID NO: 308209 - RNA, 64 nt, Human
auguauuauuaaauauuuacuaguucuguuaaaagcagagcagaaguuagacacuaaggaucuc

SEQ ID NO: 308210 - RNA, 64 nt, Human
cagccugcacagggcaaggcccccgcggaauccugcagagcaaacucagguuaacuugggucca

SEQ ID NO: 308211 - RNA, 64 nt, Human
gcaaaaaggcugcuuaaaagcaugaacccgggaugcagagcagcuuuugugcacgguuccacuu

SEQ ID NO: 308212 - RNA, 64 nt, Human
ggggacucugggggacuggcuuccccugugagcagcagagcagcacaauaaaugaggccacugu

SEQ ID NO: 308213 - RNA, 64 nt, Human
cauguuccugucuccaacaccgccuccugcacaugcagagcagacagaaauaccccacacauuc

SEQ ID NO: 308214 - RNA, 64 nt, Human
cagcaggaggagccgcuagagcagcugcucaugggcagagcagcccuugggcaacuccugccac

SEQ ID NO: 308215 - RNA, 64 nt, Human
ggggacucugggggaccggcuuccccugugagcagcagagcagcacaauaaaugaggccacugu

SEQ ID NO: 308216 - RNA, 64 nt, Human
ggaaaugugggaggagagaauuacugcuugguacgcagagcaccgaggccgagccaggugaggc

SEQ ID NO: 308217 - RNA, 64 nt, Human
ggcugaugggaaggaggcccaguguugcagggaggcaggcuagcaggccacccucacucaugua

SEQ ID NO: 308218 - RNA, 64 nt, Human
uuaugggugggauuacauugcacccucugagggugcaggcuagaccgucuccugagaggaaguu

SEQ ID NO: 308219 - RNA, 64 nt, Human
agagcccaaaacagaagggggcugccccagcccagcagagcacagaguuucuggagcucccauc

SEQ ID NO: 308220 - RNA, 64 nt, Human
ggucaucaucucuggccaccacuccaccagaugggcagagcagcuaugaccgccacccagcccu

SEQ ID NO: 308221 - RNA, 64 nt, Human
uccacccaguguccacuggccuguccuucagggagcagagcagagcaggugguggacgggccca

SEQ ID NO: 308222 - RNA, 64 nt, Human
ccaguguccacuggccuguccuucagggagcagagcagagcaggugguggacgggcccagugcu

SEQ ID NO: 308223 - RNA, 64 nt, Human
acagcucuguggccugggaauccauuuuccugcggcagagcagggccugguguggaaccaggga

SEQ ID NO: 308224 - RNA, 64 nt, Human
gagucaugugcccugugaccacugaagggugucagcagagcacacggcaugaggacagagggag

SEQ ID NO: 308225 - RNA, 64 nt, Human
gaggacuuugggggacgggcuuccccugugagcagcagagcagcauaauaaaugaggccacugu

SEQ ID NO: 308226 - RNA, 64 nt, Human
guugggcauugguggggacaaccaaaacaggucugcagagcaaaggcaggucuggagggugggu

SEQ ID NO: 308227 - RNA, 64 nt, Human
agcuggaggcagcugggugaggguccugguuccagcagagcacuggggcccauccaaguuuguu

SEQ ID NO: 308228 - RNA, 64 nt, Human
agcucagaggguggggagaagcaugaagcagugagcagagcacugggugagagggagaagaccu

SEQ ID NO: 308229 - RNA, 64 nt, Human
cccugguggcucuccccuuuggagagagcuaguggcagagcaaccuagcuagguccuccuuggg

SEQ ID NO: 308230 - RNA, 64 nt, Human
ccaggccugggggcccccugggggcccgcggggugcagagcaccccaacuuugcacucaugcag

SEQ ID NO: 308231 - RNA, 64 nt, Human
cauuuccuucaagaauggccaguugggucucaaugcagagcaugcgugggcagaugcucccauc

SEQ ID NO: 308232 - RNA, 64 nt, Human
cagaacacuguaggagcaucugucacuucauuaugcagagcauaaguugauccuuuuccuagaa

SEQ ID NO: 308233 - RNA, 64 nt, Human
acagcguuaaguuuuaauuuacaacuuuuaaaaggcagagcauuuuuaacaaggggugacaggu

SEQ ID NO: 308234 - RNA, 64 nt, Human
ugcuuaauaaauuauaaaaugauggcuuggaaaagcaggcuagucuaaccauggugcuauuauu

SEQ ID NO: 308235 - RNA, 64 nt, Human
agcccucaugauaaucugggcaucucgugccagggcaggcuaccccuucauggugacuaacagu

SEQ ID NO: 308236 - RNA, 64 nt, Human
cccgaagugggcuucccgggaaaccucgagcagagcaggcuacacaaucccccauccucaaguc

SEQ ID NO: 308237 - RNA, 64 nt, Human
cagucuuucuucacucuggcuucaaaaagccacagcagagcauugucaccgcaggugcucaugc

SEQ ID NO: 308238 - RNA, 64 nt, Human
cauucaagaggaauuccagcaucugaagacucaggcagagcagcuccacaaccaccuccagccu

SEQ ID NO: 308239 - RNA, 64 nt, Human
auuccuguuggguuuucuuguugaucucaugcuagcagagcaaaaauuguaaaauauuuugauu

SEQ ID NO: 308240 - RNA, 64 nt, Human
guuuugaucauaugcauguauguagaauauuuuugcagagcagaaagauuauguuagaagugug

SEQ ID NO: 308241 - RNA, 64 nt, Human
aacaacugcccaguuuccagucgggggaacugaggcagagcaagguagugaucacaccaguaca

SEQ ID NO: 308242 - RNA, 64 nt, Human
agacccuaaagcauuuaguccugcaauuccugcagcagagcaacuugugcaaguacuucaagga

SEQ ID NO: 308243 - RNA, 64 nt, Human
aacuuuguuggcuguggaagaggccaauccuauggcagagcauucagaaugucaaugaguaauu

SEQ ID NO: 308244 - RNA, 64 nt, Human
aauacagcagaaccucacuguagcauucuuuacugcagagcaaaauucaauuuaagaugggcuu

SEQ ID NO: 308245 - RNA, 64 nt, Human
aaggugcaggcaggcuggccuggggucaggccgggcagagcacagcggggugagagggauuccu

SEQ ID NO: 308246 - RNA, 64 nt, Human
cuaggcccuuguggggugaagaauggagggaggagcaggcuaggaagacggggccaccacccuc

SEQ ID NO: 308247 - RNA, 64 nt, Human
cccuauccaugucaagcuuguggaaaaagauuuagcaggcuagaccaucuaaguagccauuuuc

SEQ ID NO: 308248 - RNA, 64 nt, Human
ugaagagcugcccacccagagucuugacucuagggcaggcuagugcuauuguggugucaguuga

SEQ ID NO: 308249 - RNA, 64 nt, Human
uccccagaggacccggccgaccucagcgccuccugcaggcuaggacacuggugcacuacacccc

SEQ ID NO: 308250 - RNA, 64 nt, Human
ggcaacauuuggggagagauaaugaggcaacucagcaggcuaaguugcgggguauauaaauugg

SEQ ID NO: 308251 - RNA, 64 nt, Human
aaaugcugccccaaugcuaacuccuuggauugucaacccccaucccccaaauggaaauuccgaa

SEQ ID NO: 308252 - RNA, 64 nt, Human
gaccccagaaaggucagccuuccugaggaugggcaacccccaggucugcagcuccagguacaua

SEQ ID NO: 308253 - RNA, 64 nt, Human
uccagaauguuaggcucuccagggcuucuuuccaaacccccagcuccacaccccccagacccag

SEQ ID NO: 308254 - RNA, 64 nt, Human
gguguguuucccaucccacugcucccccaacacaaacccccacuccagcuccuucgcuuaagcc

SEQ ID NO: 308255 - RNA, 64 nt, Human
gcccccucaguggcgcugcuaugcaaggcuugugaacccccagcauguguuucugacuuuucuc

SEQ ID NO: 308256 - RNA, 64 nt, Human
ugaucaucugguucuccucucauuaagcaucccuaacccccagucacaccuuccucuuacauac

SEQ ID NO: 308257 - RNA, 59 nt, Human
gaugcugcuccggcugcugagaggcccgcaacccccagcgcugcgcuagagaaacccgc

SEQ ID NO: 308258 - RNA, 64 nt, Human
gucacaaagccuacucucuguucuugucccugccaacccccaccccccauaaucugacucacaa

SEQ ID NO: 308259 - RNA, 64 nt, Human
aaagcaguggggacggaaggcaaagagaccacucaacccccaccuggaaggggcaaagaaaagc

SEQ ID NO: 308260 - RNA, 64 nt, Human
cauucccaacuccagcuaaaauaugggaagggagaacccccaauaaaacugccauggacuggac

SEQ ID NO: 308261 - RNA, 64 nt, Human
auaaauuccaggacaugguaaaauguguuuuaauaacccccagacccaaaugaaaauuucaaag

SEQ ID NO: 308262 - RNA, 64 nt, Human
gggacacagcugucaggaaaugaaucuuccccccaacccccaccaugcagauggauagacagaa

SEQ ID NO: 308263 - RNA, 64 nt, Human
uauaagcucacaugccuuuucccugccacagccaaacccccacugcacccuacccacccacccc

SEQ ID NO: 308264 - RNA, 64 nt, Human
caaagcuccugccucuuugugugcgucacugugaaacccccacccuucugccucgugcuaaacg

SEQ ID NO: 308265 - RNA, 64 nt, Human
cgcucacccccucaccccuccaagcucacuccccaacccccaacuccgugugguaagcaacaug

SEQ ID NO: 308266 - RNA, 64 nt, Human
ccaaucacagugcagcaaggccaauucucgcagaaacccccacgugugcacgagugggagaggg

SEQ ID NO: 308267 - RNA, 64 nt, Human; identical to SEQ ID NO: 64752

SEQ ID NO: 308268 - RNA, 64 nt, Human; identical to SEQ ID NO: 64753

SEQ ID NO: 308269 - RNA, 64 nt, Human; identical to SEQ ID NO: 64754

SEQ ID NO: 308270 - RNA, 64 nt, Human; identical to SEQ ID NO: 64755

SEQ ID NO: 308271 - RNA, 64 nt, Human
gccucgccccaacacuguccuucccugccacuucaacccccagcuaauaaaccagauuccagag

SEQ ID NO: 308272 - RNA, 64 nt, Human
caaaugguggaccagaaugauggugggagggggcaacccccaguagcuuugccugcuuuuauaa

SEQ ID NO: 308273 - RNA, 64 nt, Human
cuuuuucaucuacgaaggcccugagguucccaucaacccccauuucccuaggguccuggaggaa

SEQ ID NO: 308274 - RNA, 64 nt, Human
gcuggagugcaguggcaugaucucagcucgcugcaacccccaccucccagguucaagcgauucu

SEQ ID NO: 308275 - RNA, 64 nt, Human
gccacacauaagugaaaauacggaaggcuuuggaaacccccagaugaacuucuauacaugugaa

SEQ ID NO: 308276 - RNA, 64 nt, Human
aacuuuuuuuuuauuucagguucugccaucuugaaacccccauucuguuuccagcccagaagaa

SEQ ID NO: 308277 - RNA, 64 nt, Human
cuuuaacugggaacacaggcucucacaagaucagaacccccacucacccccaagaucuuaucua

SEQ ID NO: 308278 - RNA, 64 nt, Human
cuucagcuuccauuucgccccucauuuaucccucaacccccagcccacagguguuuauacagcu

SEQ ID NO: 308279 - RNA, 64 nt, Human
uaccaauauauauccaugugccuggauuaucuuuaacccccacaccucuuaccuuggacaggua

SEQ ID NO: 308280 - RNA, 64 nt, Human
ccaggccuacccuccuuccccacaagcccccuccaacccccacccccaugcucuggaccucaug

SEQ ID NO: 308281 - RNA, 64 nt, Human
ugaugaagugauccuuaacccccaaguaaucauuaacccccagaccagccucagaacugaagga

SEQ ID NO: 308282 - RNA, 64 nt, Human
cuagauccccugaggacuugaugaagugauccuuaacccccaaguaaucauuaacccccagacc

SEQ ID NO: 308283 - RNA, 64 nt, Human
ucucuuauagaauauuuauuaccucugauaccucaacccccauuucuauuuauuuacugagcuu

SEQ ID NO: 308284 - RNA, 64 nt, Human
uuccccuacccccuccucucugccgcaauacaggaacccccaggggaaagaugagcuuuucuag

SEQ ID NO: 308285 - RNA, 64 nt, Human
ggaauguaaaauuugccugacuucuuaagaacaaaacccccagcucugugccccaugcuccuug

SEQ ID NO: 308286 - RNA, 64 nt, Human
caagaaaauaacaaauuaaccgcaaacuaucaacaacccccaaccaccaucuaccacuacggcc

SEQ ID NO: 308287 - RNA, 64 nt, Human; identical to SEQ ID NO: 64756

SEQ ID NO: 308288 - RNA, 64 nt, Human; identical to SEQ ID NO: 64757

SEQ ID NO: 308289 - RNA, 64 nt, Human
gacaaugguccugacauaauaaggaucuuugauuaacccccauaaggcauguguguguauacaa

SEQ ID NO: 308290 - RNA, 64 nt, Human
uagaggguaggagagagccuggaucucuggccccaacccccaccagaccucaugcccuggacac

SEQ ID NO: 308291 - RNA, 64 nt, Human
aguagcucagaaauuaagaaagaaugguauaaugaacccccauauacccuuccuucuggauuca

SEQ ID NO: 308292 - RNA, 64 nt, Human
gggcugagagggcuguggcuggguggucagcagaaacccccaggaggagagagaugcugcuccc

SEQ ID NO: 308293 - RNA, 64 nt, Human
caagaguucgagaccagccugaccaacauggagaaacccccaucucuacugaaaauacagaauu

SEQ ID NO: 308294 - RNA, 64 nt, Human
aucucuccugcuguaaccccacgcacaagccugcaacccccagagcucuuugacaggcucccag

SEQ ID NO: 308295 - RNA, 64 nt, Human
cacuuugcccuccugcaguuucuucucugcucccaacccccaucucacagcaucccccucuauu

SEQ ID NO: 308296 - RNA, 64 nt, Human
aacgccaggaaucaugaagagacuucugcuuuucaacccccacccuccucaagaaguaauaauu

SEQ ID NO: 308297 - RNA, 64 nt, Human
ugcaccccagacaauaaagggaccaaaaccacccaacccccacccugccucuauccuaaggaag

SEQ ID NO: 308298 - RNA, 64 nt, Human
aguccucaccaguacuacaccacuuuuccucaccaacccccauccuauucuugguaagugcgcc

SEQ ID NO: 308299 - RNA, 64 nt, Human
uuguaacuggcacacgccccacgccuuccucuauaacccccagagacaggcuggggcagcgcca

SEQ ID NO: 308300 - RNA, 54 nt, Human
ccgaggagucaucaguaugaggggaacccccaccgcgucggcgggaagcguggg

SEQ ID NO: 308301 - RNA, 64 nt, Human
ugaaacuuuguuugggucaagcuuccuucuuucuaacccccagacuuuggccucugagugaaau

SEQ ID NO: 308302 - RNA, 64 nt, Human
uauaaaaauacucaucuuuucagacuuuuuuguaaacccccaguugugaaaacugcaguuuagc

SEQ ID NO: 308303 - RNA, 64 nt, Human
gauaacauuuucuuuucuuaguccuccugcucucaacccccauauuuugccuuugaauacgugg

SEQ ID NO: 308304 - RNA, 64 nt, Human
uugccaaggucugauuuuucacacaaaaaauugcaacccccagcauaaauggguuagcuacugu

SEQ ID NO: 308305 - RNA, 64 nt, Human
gucaccuguguagcauuguaauuauguacuaucaaacccccaagaugcugaugauaggccuucu

SEQ ID NO: 308306 - RNA, 64 nt, Human
aaugccuccacauagcccuguaauauucagauggaacccccaaccaccuccacccuguuuguuc

SEQ ID NO: 308307 - RNA, 64 nt, Human
aacaaacuccccaaacccaaguugaaacaaaaaaaacccccagacuguaauaguauuauuauua

SEQ ID NO: 308308 - RNA, 64 nt, Human
auacaguuuuguuuguuauacucuuugcaccuuaaacccccaccacuccccgacacuauugccu

SEQ ID NO: 308309 - RNA, 64 nt, Human
agugggcuguaggcaggguccuccauggguuuccaacccccaucacuggcaccaggaucuccca

SEQ ID NO: 308310 - RNA, 64 nt, Human
ucaagggaguaaguagagguggcuucagaaauggaacccccagcccagcagacaucaagcucaa

SEQ ID NO: 308311 - RNA, 64 nt, Human
augcaauugagaaacuggauagauacacucauaaaacccccaccccuccccaccccaccccugc

SEQ ID NO: 308312 - RNA, 64 nt, Human
cuccaauucaugguuaucagggcauguguucaacaacccccaaaguccacgcagguggcuugua

SEQ ID NO: 308313 - RNA, 64 nt, Human
aguucauacugguuuaauuaagcucucuccugacaacccccagaauuaaaugaaccaugauugu

SEQ ID NO: 308314 - RNA, 64 nt, Human
aggggcuccugcaucaccuucagaauccaguuccaacccccacucuccuuaggccuugugcucu

SEQ ID NO: 308315 - RNA, 64 nt, Human
ugccuccucccuguuuauaugcguacagccugguaacccccaggcaugcaaauauacaaucugu

SEQ ID NO: 308316 - RNA, 64 nt, Human
uauuaaaaaggauagacauuucugauguaaguaaaacccccaagcaacuuaauauccaucuguc

SEQ ID NO: 308317 - RNA, 64 nt, Human
acaacauuacugaaagaacccugcgaaucaaaacaacccccacacagaccccgcaauccuuuuu

SEQ ID NO: 308318 - RNA, 64 nt, Human
agacuuguuggugcuaccccuuacuccccucugcaacccccauuuugggaguugaccccagcaa

SEQ ID NO: 308319 - RNA, 64 nt, Human
cugauaugcuggugauucccaaauacauagcuccaacccccaacuucccccagacuuuagaucu

SEQ ID NO: 308320 - RNA, 64 nt, Human
agaacauaucaaaauaggauuucuuaaauuuuucaacccccagaccauacugacucaacaugga

SEQ ID NO: 308321 - RNA, 64 nt, Human
gggugaaagccuuucuuuguuggaucaaauacuacuacacuauuacacuuccacacuauuuauu

SEQ ID NO: 308322 - RNA, 64 nt, Human
aaguuugugcaggguuuaaguugcuacuauucaacuacacuauauauaaauaaaauauauacaa

SEQ ID NO: 308323 - RNA, 64 nt, Human
ccuaguuauauagacgaaauaaaaugcuaagucacuacacuacaucguuauuuucuauuacguc

SEQ ID NO: 308324 - RNA, 64 nt, Human
cccucccacuugaccugagaugcugggagggcugaacccccacucacacaagcacacacacaca

SEQ ID NO: 308325 - RNA, 64 nt, Human
auaaaccucaaaguggauucacuuucugauaguuaacccccauaaaugugcacguaccuguguc

SEQ ID NO: 308326 - RNA, 64 nt, Human
uucugagcagagacucccugcccaucaagucugaaacccccauggaugaggucagcuccuuguc

SEQ ID NO: 308327 - RNA, 64 nt, Human
uuucuauccuuuuacugauuaugcagcuucuuauaacccccaagguacagauuauuucagcuua

SEQ ID NO: 308328 - RNA, 64 nt, Human
ggucccgugggucuagccuuccccccuguggacaaacccccauuguggcuccugccacccuggc

SEQ ID NO: 308329 - RNA, 64 nt, Human
aggacccugaccuggccaucuugagggguuuucuaacccccaggucucccaggccgaaggucag

SEQ ID NO: 308330 - RNA, 64 nt, Human
guuaugaguagccuaccacccccucccuuacaguaacccccaccccuucaggaucagucaaggg

SEQ ID NO: 308331 - RNA, 64 nt, Human
cccuacugcaacuaacuguugccccccaaccccgaacccccaguugaggaguugagagagugca

SEQ ID NO: 308332 - RNA, 64 nt, Human
aacagacaaaacaauccccaucagguagcugucuaacccccagcugggucuaauccuucucauu

SEQ ID NO: 308333 - RNA, 64 nt, Human
accacaugccacugccugcaccuuucggcagaggaacccccaccagacaucacccuuugccuua

SEQ ID NO: 308334 - RNA, 64 nt, Human
aaugaggaaggccaauuccuuacaaugauggcagaacccccaagcgaaugcccuauugaggaga

SEQ ID NO: 308335 - RNA, 64 nt, Human
cugcauuuuguuuuuaaauuaugcaccuucugauaacccccaaauacagaaauguucuacaucu

SEQ ID NO: 308336 - RNA, 64 nt, Human
augggaagaaugggaaaaacaaacugacacuccaaacccccacuucccucauuuuuauuuauuu

SEQ ID NO: 308337 - RNA, 64 nt, Human
uaucuauccucuaaaccagggaucagcaaacuauaacccccaggccaaaucuagcccacucccu

SEQ ID NO: 308338 - RNA, 64 nt, Human
acacacacaaagggauagagagauuaccucucuuaacccccauuuuaauuacuaugucuagguu

SEQ ID NO: 308339 - RNA, 64 nt, Human
aaccagcuaaaacugagagcacacagccuucggaaacccccaaggugucgaggaggaucagauc

SEQ ID NO: 308340 - RNA, 64 nt, Human
uggcauaacauuacaagacgaggcaaaaauauuuaacccccaaauauauuucuuugcccuaccu

SEQ ID NO: 308341 - RNA, 64 nt, Human
ugggggucucaccauguugcccaggcuggucucaaacccccagccucaacugauccucgcaucu

SEQ ID NO: 308342 - RNA, 64 nt, Human
gccacagagaguguuaccaccagcacccagaccgaacccccaccggccaaauguggugaugccg

SEQ ID NO: 308343 - RNA, 64 nt, Human
agcucuuucgggauaaccaccugauaccugcagaaacccccaguccuguuauuuucagugauuu

SEQ ID NO: 308344 - RNA, 64 nt, Human
uagaaaaauuuuaaaaauuugcuuaugaaaauauaacccccagaaaguaacaaugacaaaguau

SEQ ID NO: 308345 - RNA, 64 nt, Human
acccaucucugcccugggucagcuccucagaaccaacccccagcaucucuaaagcaaaagccuc

SEQ ID NO: 308346 - RNA, 64 nt, Human
gugccaggggcagccccaacccacccgggccaggaacccccaggaagguggggccacgcugcag

SEQ ID NO: 308347 - RNA, 64 nt, Human
cugccauugcgcaaucugagccugagcaacuggaaacccccauuucucauuagugcaaugucau

SEQ ID NO: 308348 - RNA, 64 nt, Human
cccucauuucaaccccacuccuacccccuuccucaacccccaaacaaaacaaacaaacuucccu

SEQ ID NO: 308349 - RNA, 64 nt, Human
uucaaagcagcauuuaaacaaauggaaaacuuugaacccccacuauuagcacucagcagagaug

SEQ ID NO: 308350 - RNA, 64 nt, Human
guagcauugaaguguuugcugcagaguugagggaaacccccagccacccucccggaauccgaga

SEQ ID NO: 308351 - RNA, 64 nt, Human
cucauguguucagcucaagacuccacaggaauucaacccccagaaagacauaaacuuggagucc

SEQ ID NO: 308352 - RNA, 64 nt, Human
aguugucucaacuccuugguacaggguucauucaaacccccaagcugugagaguguguuuauuu

SEQ ID NO: 308353 - RNA, 64 nt, Human
gcuacucgggaggcugaggcaggagaaucaccugaacccccaggcuggaguacaguggcaggau

SEQ ID NO: 308354 - RNA, 63 nt, Human
aagaaggggaagaagauugaucaaacugaaugaaacccccacacacacacacaugcauacaca

SEQ ID NO: 308355 - RNA, 64 nt, Human
cuuaccugcacccaggccucagaguuucagggcuaacccccagaauacugguaggggccaaggc

SEQ ID NO: 308356 - RNA, 64 nt, Human
aggggguugaauaugcaaaagcaguuccgcugggaacccccauccaaucaacugcuguacccau

SEQ ID NO: 308357 - RNA, 64 nt, Human
cuguuugggggccaucccugcgguccacccucugaacccccagcauguuuguccuguuucucac

SEQ ID NO: 308358 - RNA, 64 nt, Human
ccauaaaagaccaaaaaaaaaaaaaaaaucagaaaacccccaccuaauccacagaaaguaaugu

SEQ ID NO: 308359 - RNA, 64 nt, Human
agaauucagcacgcacacaacacacaagggagagaacccccagaugagaaaauaggaaggagca

SEQ ID NO: 308360 - RNA, 64 nt, Human
aaagaguuucagaaaaugacugagaaggagcgauaacccccagaaugcaaaaucaggggcauca

SEQ ID NO: 308361 - RNA, 64 nt, Human
ugaagcuauccaagcuuuugaaauaaaauuuaaaaacccccaagccugggugagugugggauau

SEQ ID NO: 308362 - RNA, 64 nt, Human
ucaggagaucgagaccauccuuacuaagacggugaacccccaucucuauuaaaaauacaaaaaa

SEQ ID NO: 308363 - RNA, 64 nt, Human
caaaacuuaucacgccuacuuaagagugcuguguaacccccaguucaagacuuagcuccuguug

SEQ ID NO: 308364 - RNA, 64 nt, Human
uaaaacauuaaauaaaaagcccuccucagauuggaacccccaaaucgauggagccacauuaaua

SEQ ID NO: 308365 - RNA, 64 nt, Human
uuucccccuauuccagggugugcacccucuccccaacccccaagaaccccacuacugcuuuccc

SEQ ID NO: 308366 - RNA, 64 nt, Human
acccaaaaauguucccuugaccauuggcugcgcuaacccccagcccacagagccugaauuugua

SEQ ID NO: 308367 - RNA, 64 nt, Human
uugauucugcacaagauuuccuugcucugggaacaacccccaaaugcccuugggaggaacaaca

SEQ ID NO: 308368 - RNA, 64 nt, Human
gucucaaaaaaacaaaacaaaaaaacaccaaaaaaacccccaaaccugaagaaauucagauaca

SEQ ID NO: 308369 - RNA, 64 nt, Human
ugccugguuugcgggagauuuccuccccucagucaacccccauaaccuggggauugggcagugu

SEQ ID NO: 308370 - RNA, 64 nt, Human
ccuccuugcuguguaguuuuggguaagcuuauuaaacccccaugccucaguuuggucaccugua

SEQ ID NO: 308371 - RNA, 64 nt, Human
gaaaauuacccucccagcaccagccccccucucaaacccccaacccaaaaccaagcauuuugga

SEQ ID NO: 308372 - RNA, 64 nt, Human
uuaauaccugggugauuacauaaucuguacaaugaacccccaugauguaaguuuaccuauguaa

SEQ ID NO: 308373 - RNA, 64 nt, Human
aguccuccucgccccuuucuucaccccgccccccaacccccagacuuuccuggagcaucugccc

SEQ ID NO: 308374 - RNA, 64 nt, Human
ccgaggcacccugcagggcaaugcaugucaucccaacccccacacuccccauccuccaacccac

SEQ ID NO: 308375 - RNA, 64 nt, Human
agaggagccuguuuuguugagaagauaaauguguaacccccauugauguuuaaccagaaaagua

SEQ ID NO: 308376 - RNA, 64 nt, Human
cuugccuuagucagaggcccuuuucucuguccugaacccccagguaugggugaaauuggaaauu

SEQ ID NO: 308377 - RNA, 64 nt, Human
cgaugaggucucguguugagauauugugugccacaacccccacagucuucaccuccguguguga

SEQ ID NO: 308378 - RNA, 64 nt, Human
uuuggaguacuugcuauaaagccaccugucaacaaacccccauuauguacagaauaggaccuau

SEQ ID NO: 308379 - RNA, 64 nt, Human
ggauacuuagggugaugaaauaaucuguguaacaaacccccaugacacaccuuuauguauguaa

SEQ ID NO: 308380 - RNA, 64 nt, Human
auuucaaacauacauaaaagagaagagcacagugaacccccauguacuccauguagccaccauc

SEQ ID NO: 308381 - RNA, 64 nt, Human
auggcuuccaucuuuugcaucaccaccacuccugaacccccauuucugauuugucagaauuuuu

SEQ ID NO: 308382 - RNA, 64 nt, Human
gacccauaaccccaagucccagcccagaaccccuaacccccaauacuugaagggguuuuguuuu

SEQ ID NO: 308383 - RNA, 64 nt, Human
cuuuucagaauauagggcuccucucauuccugugaacccccaguccuggcuucuuuguuugagg

SEQ ID NO: 308384 - RNA, 64 nt, Human
cgggaguucgagaccagccugaccagcaugguggaacccccaucucuacuaaaaacacaaaaaa

SEQ ID NO: 308385 - RNA, 64 nt, Human
guugacucgaucgaaaccccggcgaaagaaaucaaacccccaacuucuucggcgugaauuaaaa

SEQ ID NO: 308386 - RNA, 64 nt, Human
ugcauucauaauuuuucauuuucuuccccaccccaacccccaugagcucuuaaauuuagauuuc

SEQ ID NO: 308387 - RNA, 64 nt, Human
ugucuagguagcaacagguaucgaggacucuccaaacccccaaagcagagagagggcugauccc

SEQ ID NO: 308388 - RNA, 64 nt, Human
uucuauuacaauuggaaguggagaauaugugcaucuacacuaaaaaaauguuuaagauaucaaa

SEQ ID NO: 308389 - RNA, 64 nt, Human
uuuggcugguaguagaacaccaagaaggagguugcuacacuaaaacagaguuagcagagugcug

SEQ ID NO: 308390 - RNA, 64 nt, Human
aacuuggguuugauucaguauuaacagaucuugacuacacuaauucuuuauauuauagaaccaa

SEQ ID NO: 308391 - RNA, 64 nt, Human
cuguuaauuacaaccucuucaaagaaauaggagcaacccccaagaggcuuaauuuaccaauuua

SEQ ID NO: 308392 - RNA, 64 nt, Human
auuguuucauguaugaaguuuuuaaucacccccuaacccccaaaaaagauucgguugucaaggg

SEQ ID NO: 308393 - RNA, 61 nt, Human
ugguguuccuccggaccugagcuccgugcucaacccccagcccaccccacccucccugggc

SEQ ID NO: 308394 - RNA, 64 nt, Human
gaaaagcaugauagcaauguggcauguggaagcgaacccccagggcauaacauaguaagaaagu

SEQ ID NO: 308395 - RNA, 64 nt, Human
ccccaucagcccagcccguuaaaugucaaacgucaacccccaaaauacgcaauuucagauaagu

SEQ ID NO: 308396 - RNA, 64 nt, Human
aagaucuuugcuugcagcccuccguccugcugaaaacccccauaagccagugaacacagagcag

SEQ ID NO: 308397 - RNA, 64 nt, Human
caggaguucaagaccagccuguccaacauggugaaacccccaucucuacuaaaaauaccaaaaa

SEQ ID NO: 308398 - RNA, 64 nt, Human
ggguugugagacuucuguuugaucacugugaaccaacccccaucucccuagcccaccccccucc

SEQ ID NO: 308399 - RNA, 64 nt, Human
caacucugagccaucuucuuccuccaucucuuucaacccccacaggggcugccugcucuucaca

SEQ ID NO: 308400 - RNA, 64 nt, Human
gggcgucagagggagcccccucugggagggaaccaacccccacccucccuccugggacccccca

SEQ ID NO: 308401 - RNA, 64 nt, Human
cacaccugcucccaagcucagauggaagucccuuaacccccaugccacauugccccccuccucc

SEQ ID NO: 308402 - RNA, 64 nt, Human
uugagaauuugccuacucacuaaaauauguuuguaacccccaaaucaauacuguggcacuuucu

SEQ ID NO: 308403 - RNA, 64 nt, Human
augaccucaaaugugggcccagccuaggucagccaacccccauccaacccuuagacucacgaac

SEQ ID NO: 308404 - RNA, 64 nt, Human
uaaaugaugauucguggagcccuacucacacauuaacccccaaauucaaaaguaagaaugcaaa

SEQ ID NO: 308405 - RNA, 64 nt, Human
uaaaaauugaaagcucgaucucauuauugucaggaacccccagugugaccucacacauaggaug

SEQ ID NO: 308406 - RNA, 64 nt, Human
ugacuccuguagcagcagagacgccuuggaguuuaacccccaccaaccagagcgugggcuggua

SEQ ID NO: 308407 - RNA, 64 nt, Human
uauuugugucuugugacaauuauguuuuauagaccuacacuagugccaggucacuauuguaaga

SEQ ID NO: 308408 - RNA, 64 nt, Human
aauuguguucccccaaaauauauggugaagucuuaacccccauccccgugaaugggaccuuguu

SEQ ID NO: 308409 - RNA, 64 nt, Human
cuucaucaccuaugaguuccugcaggagcaggucaacccccaccggaccuacaacccgcagucc

SEQ ID NO: 308410 - RNA, 64 nt, Human
ucccucuuuucuuacuccuccucuuucucuccccaacccccauucucaucugcacccuucuuuu

SEQ ID NO: 308411 - RNA, 64 nt, Human
ucacuguuggcugucauugugacaaagucaaauaaacccccaaggacgacacacaguauggauc

SEQ ID NO: 308412 - RNA, 64 nt, Human
gauauguguucucuuguguuguuuuuccuuuuuaaacccccaugaacacgaauacucugaaaaa

SEQ ID NO: 308413 - RNA, 64 nt, Human
augguguuucccaaccccccucacuucccaagacaacccccagcuucagguccucauggggagg

SEQ ID NO: 308414 - RNA, 64 nt, Human
cccugugcuuccugcccaagauacugacccauugaacccccaaagcaucuuucucuccacaaag

SEQ ID NO: 308415 - RNA, 64 nt, Human
uuucuugcacacaugccucucucccacuuuucccaacccccacauuugcaacuagaagagguug

SEQ ID NO: 308416 - RNA, 64 nt, Human
uacaaacaaagacuuugcuaccucccuccuccacaacccccaaguaauuagccuucuggagcug

SEQ ID NO: 308417 - RNA, 64 nt, Human
caagccaaaaaaaaaaaaaagaugcguaaguccuaacccccaacagagguguucacaguguaga

SEQ ID NO: 308418 - RNA, 64 nt, Human
caggucaggaaagccaggacucaggggagaagcaaacccccaggauugaaggcuaggguucuag

SEQ ID NO: 308419 - RNA, 64 nt, Human
acagugcugauuuaccucccccaaaaugcccccaaacccccaugcaaguuuacagccaguagcu

SEQ ID NO: 308420 - RNA, 64 nt, Human
cuuugaaaacaaaggugccaugaugggcuguucuaacccccacccccacugccagguaagggug

SEQ ID NO: 308421 - RNA, 64 nt, Human
cccugugcaugcugguggccucagggacccucauaacccccagacucagagcccgagagcccuu

SEQ ID NO: 308422 - RNA, 64 nt, Human
uaggagagcggaaaggaccuccuggacuccuguaaacccccauucuuuccaagucagauagucu

SEQ ID NO: 308423 - RNA, 64 nt, Human
gagauggggaccaggcucagaguucuaccuaucuaacccccaaccacagcccccuugguggccc

SEQ ID NO: 308424 - RNA, 64 nt, Human; identical to SEQ ID NO: 64728

SEQ ID NO: 308425 - RNA, 64 nt, Human; identical to SEQ ID NO: 64729

SEQ ID NO: 308426 - RNA, 64 nt, Human; identical to SEQ ID NO: 64741

SEQ ID NO: 308427 - RNA, 64 nt, Human; identical to SEQ ID NO: 64742

SEQ ID NO: 308428 - RNA, 64 nt, Human
acagguaacagguuauacaaguggauucagacugaacccccaguacaaggacauuguuuugaac

SEQ ID NO: 308429 - RNA, 64 nt, Human
aauuacuaccuuccccuuggcggcucuccuccccaacccccaccccacaauuuuaugacuucca

SEQ ID NO: 308430 - RNA, 64 nt, Human
cccuccguccccagggugcaggcgcgcaccgcccaacccccaccucccgguguaugcaguggug

SEQ ID NO: 308431 - RNA, 64 nt, Human
augaugcuguguccaugaugcuuuuaauaaaaacaacccccacugcagucucacccuccaagug

SEQ ID NO: 308432 - RNA, 64 nt, Human
uuuuggcaugaauugucaucuuugguguuuuuuuaacccccagccccucaaaaaaauaaggccu

SEQ ID NO: 308433 - RNA, 64 nt, Human
uaucacaacccagaaguaaccaccuuuaaaaagcaacccccauguaugccuauauguguauugu

SEQ ID NO: 308434 - RNA, 64 nt, Human
cugaucuuguacuccauaugaccccaccccuaggaacccccagggaaaaccaggcugggacagc

SEQ ID NO: 308435 - RNA, 64 nt, Human
uuccuguccucccagcuccucacucaccuucaguaacccccacuggacugaccugguccacagg

SEQ ID NO: 308436 - RNA, 64 nt, Human
ccuuggaaccaucucugaauucugaauagcugacaacccccaauguuauccacucuguugcuuu

SEQ ID NO: 308437 - RNA, 64 nt, Human
caccagcaacuuugauuuauagaaggaaaauggaaacccccaucugaguauuuugggaggagcc

SEQ ID NO: 308438 - RNA, 64 nt, Human
uggggccuaggcagggcugggaugaggcuuguacaacccccaccaccaauuucccagggacucc

SEQ ID NO: 308439 - RNA, 64 nt, Human
ucugaggccaguauccuccagcccucccaaugccaacccccaccccguuucccuggugcccaga

SEQ ID NO: 308440 - RNA, 64 nt, Human
gcgcuaggucaagguccccgccuggagggggccaaacccccaguggcugggccucuguguuggc

SEQ ID NO: 308441 - RNA, 64 nt, Human
cucccuguccuuagccuaggccuaguccugcgaaaacccccaaaccagauacggacagagacca

SEQ ID NO: 308442 - RNA, 64 nt, Human
aggaauucuguggcugugcugcguuucagaaaauaacccccagaggccuugggcuguggaccug

SEQ ID NO: 308443 - RNA, 64 nt, Human
cccugcuggccaggcaaggggccagaccccccccaacccccagcugccaucgcucucccaccca

SEQ ID NO: 308444 - RNA, 64 nt, Human
acagccagaguugccucuccuccuccucuuccccaacccccagaccaugaccagccuuagaaaa

SEQ ID NO: 308445 - RNA, 64 nt, Human
ccuguuccacugacauuucuuagacauucagcaaaacccccaccuuaaccucuuuucuuucuug

SEQ ID NO: 308446 - RNA, 64 nt, Human
cggauguugccagaugccccuaggggacagagucaacccccaacugaggaccacuguccuacag

SEQ ID NO: 308447 - RNA, 64 nt, Human
acaauuuacuggcuuccaagacuuccugcuucaaaacccccagccagacuauucauggcccauu

SEQ ID NO: 308448 - RNA, 54 nt, Human
gggcacaguaugcaauuuaaggaaaacccccaaaggcuacaggcgaccugcuga

SEQ ID NO: 308449 - RNA, 64 nt, Human
uggagcuucuugcacaaauucuggguccauaaacaacccccaaagucccugcugauccaguagc

SEQ ID NO: 308450 - RNA, 64 nt, Human
uuccccaggagcucucugcugagcagcccagcacaacccccaggaaacacaaaugggguccagg

SEQ ID NO: 308451 - RNA, 64 nt, Human
augcaaccaacuauccaaguguuauaccaacuaaaacccccaauaaaccuugaacagugacuac

SEQ ID NO: 308452 - RNA, 64 nt, Human
ugccaccugcaagugcccgcccugccccugccccaacccccaccgaagagcccugagcucaggc

SEQ ID NO: 308453 - RNA, 64 nt, Human
aaacaaacaaacaaacuguugcagauuaugagugaacccccaaauaggguguuuucugccuuca

SEQ ID NO: 308454 - RNA, 64 nt, Human
cccuucccacccucaucccugaccgacuccacuuaacccccaaacccagccccccuuccagggg

SEQ ID NO: 308455 - RNA, 64 nt, Human
ggagggagggggcacuggugcccccagccucuccaacccccaaacugcugcugcggggaacccc

SEQ ID NO: 308456 - RNA, 64 nt, Human
ugcugcuacccucccugcuguccccucuugccccaacccccagcacccgggcucagggaccaca

SEQ ID NO: 308457 - RNA, 64 nt, Human
cacagcggucgggccugggccguuaucuccccacaacccccagccaaucaggacuuuccagacu

SEQ ID NO: 308458 - RNA, 64 nt, Human
gugaaaaccagccauaggaaaacaugugagcaacaacccccaugaacauuuguccuaacucaga

SEQ ID NO: 308459 - RNA, 64 nt, Human
gaaggcagcuauucccagcagcuuccuaguuaacaacccccaugcugccuccagucuuugucug

SEQ ID NO: 308460 - RNA, 64 nt, Human
aggaguauccucauuugggguagcuagaggaaccaacccccauuucuagaacaucccugccagc

SEQ ID NO: 308461 - RNA, 64 nt, Human
cccuccgagcgguccccagaauuagcugguucacaacccccacccucccccgcccccgccugug

SEQ ID NO: 308462 - RNA, 64 nt, Human
ggcacuuagaaaacaaaaagaacaaaaaaagagaaacccccaagccuggaacgcagagaggucu

SEQ ID NO: 308463 - RNA, 64 nt, Human
cugacagacaaaaaccaaccaacgacaaaacaaaaacccccaaucaugaacgccuguacauaga

SEQ ID NO: 308464 - RNA, 64 nt, Human
ggagccggacacuucucaggaaauggcuuuucccaacccccagcccccacccggugguucuucc

SEQ ID NO: 308465 - RNA, 64 nt, Human
cuuccugguaaggaguuucagccgccuccgcaggaacccccaaagugcagauuccggagcagac

SEQ ID NO: 308466 - RNA, 64 nt, Human
cuucucaguuguccccugcauggggagauacacuaacccccagaaaugacugcuaagccucuug

SEQ ID NO: 308467 - RNA, 64 nt, Human
auacagguugagcaucccuaaucugaacaguuaaaacccccaaaugccccaaaauccaaaccuu

SEQ ID NO: 308468 - RNA, 64 nt, Human
cugggccauaugugcuauggagaggacucucccaaacccccaauagcuagugacagccacuugg

SEQ ID NO: 308469 - RNA, 64 nt, Human
uauuguucuuauauaagaucacugaagaaagaggaacccccacaacccccuccacaaagagacc

SEQ ID NO: 308470 - RNA, 64 nt, Human
gaggcccaaggagggcgcgccuuggccccacaccaacccccagggccuccccgcagucccugcc

SEQ ID NO: 308471 - RNA, 64 nt, Human
uuccaacgcaugaccuguuggggagcagagacuuaacccccaacucagaggaacccuuccucca

SEQ ID NO: 308472 - RNA, 64 nt, Human
gcugcucuugggugccagcagagccauucaguacaacccccaggcucacagcaguggcuucuag

SEQ ID NO: 308473 - RNA, 64 nt, Human
ucacaucacuguugcaccaagccacugcaagagaaacccccacccggcaagcccgccccauccc

SEQ ID NO: 308474 - RNA, 64 nt, Human
gaauugaagauauaucccuagagcaggggaccccaacccccaggccaugggccacacagcagga

SEQ ID NO: 308475 - RNA, 64 nt, Human
cugggaucucaggcagggugugcgucagcccuccaacccccagaggggcgccuguggggaggga

SEQ ID NO: 308476 - RNA, 64 nt, Human; identical to SEQ ID NO: 64701

SEQ ID NO: 308477 - RNA, 64 nt, Human; identical to SEQ ID NO: 64702

SEQ ID NO: 308478 - RNA, 64 nt, Human; identical to SEQ ID NO: 64703

SEQ ID NO: 308479 - RNA, 64 nt, Human; identical to SEQ ID NO: 64704

SEQ ID NO: 308480 - RNA, 64 nt, Human
gagcaugcauugcucuuaaccgcagaauggcaauaacccccaaaaggucaaaugggcacaccac

SEQ ID NO: 308481 - RNA, 64 nt, Human
uggcucucaaacucucuaacuuauaaguguugugaacccccacccaggcaguauccaugaaagc

SEQ ID NO: 308482 - RNA, 64 nt, Human
aagccacuaccuucugaccuccccaccccccaccaacccccaucuuuuaauaugcuguggggca

SEQ ID NO: 308483 - RNA, 64 nt, Human
agcagcaagugugcuggccucucugacauaugcuaacccccaaauacucugaauuuggagucug

SEQ ID NO: 308484 - RNA, 64 nt, Human
uaguuuuaauauguaaauuugcaaguuuuuggagaacccccaaacuccuucuccacuggaguua

SEQ ID NO: 308485 - RNA, 64 nt, Human
cagaccccaggggaaagcaaagggcgucucagggaacccccacauucucucacugaaguuuccc

SEQ ID NO: 308486 - RNA, 64 nt, Human
ugaguagucugcauaucgaauaucuagagcucuaaacccccaauacuuaaaagucuaauugcug

SEQ ID NO: 308487 - RNA, 64 nt, Human
aaaacauuucagcccuuagaugaggucuuacaccaacccccacuuggcuguuggcugucaucuu

SEQ ID NO: 308488 - RNA, 64 nt, Human
uaagauagaaagcuggacugaccaaagacugcagaacccccagguggccugcgucuuuuuucuc

SEQ ID NO: 308489 - RNA, 64 nt, Human
gaaaaagaaggcacacuucuuuuggucugaagguaacccccaucaugacuagacgagaaccguc

SEQ ID NO: 308490 - RNA, 64 nt, Human
ucuuuggaccuccugaaccgagagaacccagaggaacccccaccccacccccaccuaccacucc

SEQ ID NO: 308491 - RNA, 64 nt, Human
uuucucauucuucuuccucgccccucagccccccaacccccaacccccucccgguccguguugc

SEQ ID NO: 308492 - RNA, 64 nt, Human
cagggcccauggucaguauugcaccuguguuaugaacccccagaugcugugcagggcaggggcg

SEQ ID NO: 308493 - RNA, 64 nt, Human
aauacucauucucauuuauguauauuguauguuuaacccccagugggauuucuggcugcugaaa

SEQ ID NO: 308494 - RNA, 64 nt, Human
ggcccuucacaaaagcagaaggaacacuggcccaaacccccagcaccccggaagcagaggugag

SEQ ID NO: 308495 - RNA, 64 nt, Human
gguugguuuggugaugcuguuuagcuuuaauagaaacccccagccccuggaggggcuggauucc

SEQ ID NO: 308496 - RNA, 64 nt, Human; identical to SEQ ID NO: 64707

SEQ ID NO: 308497 - RNA, 64 nt, Human; identical to SEQ ID NO: 64708

SEQ ID NO: 308498 - RNA, 64 nt, Human; identical to SEQ ID NO: 64709

SEQ ID NO: 308499 - RNA, 64 nt, Human; identical to SEQ ID NO: 64710

SEQ ID NO: 308500 - RNA, 64 nt, Human
gggggcccccgggugggcuaggccgguucugagcaacccccacccggcugcaggguguuuuaca

SEQ ID NO: 308501 - RNA, 64 nt, Human
auccuuaccuuuaaaaaaagcuucuagucuccauaacccccaaaguacugcuuauuuguuugaa

SEQ ID NO: 308502 - RNA, 64 nt, Human
ggacuguuucuggccgaggacuucuuccaauuaaaacccccaccgugggcugucuccccucauu

SEQ ID NO: 308503 - RNA, 64 nt, Human
gauucuuacuuggcuuaaaccuagaggccagaagaacccccagcugccuccuggcaggagccug

SEQ ID NO: 308504 - RNA, 64 nt, Human
gguauugcaccuucuggaacuaugggcuugagaaaacccccaggaucacuucuccuuggcuucc

SEQ ID NO: 308505 - RNA, 64 nt, Human
caguaaaaguuugauaaucaguauaucccuucccaacccccauugugacaguuucuuuuuguca

SEQ ID NO: 308506 - RNA, 64 nt, Human
acagcagaucaugcggcugcuucaugagaugcagaacccccaggagcgcccaggcuugggcagc

SEQ ID NO: 308507 - RNA, 64 nt, Human
cuggaggagccccaugaacucccugcuuccccugaacccccagcaaguugcagaggcuacugcc

SEQ ID NO: 308508 - RNA, 64 nt, Human
uugcaguugccauacagugccuuuccauuuauuuaacccccaccugaacggcauaaacugagug

SEQ ID NO: 308509 - RNA, 64 nt, Human
cgggcccugccccagccccuaagccccguccccuaacccccaguccucacuguccuguuuucuu

SEQ ID NO: 308510 - RNA, 64 nt, Human
gcggugucaccccgcaggaccgcgggccugccccaacccccagcauucccgggugggcccagac

SEQ ID NO: 308511 - RNA, 64 nt, Human
gugagaggucacaggucagcaaaaacagucaaaaaacccccacagauuuugaauaaaggaucua

SEQ ID NO: 308512 - RNA, 64 nt, Human
caguugaagguuccccaccauucagugagagcagaacccccauuccccagccucugcugguagc

SEQ ID NO: 308513 - RNA, 64 nt, Human
gggcacaccgggcacucagaagacacugaugggcaacccccagccugcuaauuccccagauugc

SEQ ID NO: 308514 - RNA, 64 nt, Human
ugaggguugggggugagcaagggcugucugcagaaacccccaucaagagcugcugaaugaagug

SEQ ID NO: 308515 - RNA, 64 nt, Human
cagcuguauggcugggggcuccucguaugcauggaacccccagaauaaauaugcucagccaccc

SEQ ID NO: 308516 - RNA, 64 nt, Human; identical to SEQ ID NO: 64698

SEQ ID NO: 308517 - RNA, 64 nt, Human; identical to SEQ ID NO: 64699

SEQ ID NO: 308518 - RNA, 64 nt, Human; identical to SEQ ID NO: 64705

SEQ ID NO: 308519 - RNA, 64 nt, Human
cucugaggucauggaaccugggaacagaagccucaacccccacaagaccaagcaucacauggag

SEQ ID NO: 308520 - RNA, 64 nt, Human
uccagcaccaguuccgucauucucguuccuggggaacccccacucugaccuguuauuaaaguuc

SEQ ID NO: 308521 - RNA, 64 nt, Human
cuggccaucugagccugccuggaggagaaggaggaacccccaugccaauguccaggucacaggc

SEQ ID NO: 308522 - RNA, 64 nt, Human
aggaggcuccgugagcccuugguuccuccccgaaaacccccagcauuacgaucccccaaguguc

SEQ ID NO: 308523 - RNA, 64 nt, Human
cugagccccaugcccagcccugccuuggucccccaacccccagagcuuggagucugggccccac

SEQ ID NO: 308524 - RNA, 64 nt, Human
gguagauucagaccuuguccacaccuuccugggcaacccccaccaugaaccugucagccucuuu

SEQ ID NO: 308525 - RNA, 64 nt, Human
uccagagcaaaaacuggcacucauagcaagccagaacccccauccccauccucaugggucugug

SEQ ID NO: 308526 - RNA, 64 nt, Human
aagaggaaaagcuuuaaaaacaagauugcaucauaacccccaggagcaaagcaaccuggaggcu

SEQ ID NO: 308527 - RNA, 64 nt, Human
ccacuagagcgagcuuuaaaacuaaucugagcauaacccccaacguggcucuaugcuuguguac

SEQ ID NO: 308528 - RNA, 64 nt, Human
uggggagauuuguaagcuucugcugucugggcugaacccccagagguucggauugaauuggugu

SEQ ID NO: 308529 - RNA, 64 nt, Human
ugggauggagaguggggagaggcacuuaaucuguaacccccaaggaggaaauaacuaagagauu

SEQ ID NO: 308530 - RNA, 64 nt, Human
uguuucugacuuauuuuuccugucucugucuuccaacccccaauaauauuuccaccggggaugc

SEQ ID NO: 308531 - RNA, 64 nt, Human
agauucccacccccucaauguuccucucacacgaaacccccaucagucccuuugguuaauucuu

SEQ ID NO: 308532 - RNA, 64 nt, Human
uucugguuuuuuuccucccuuuaguuccacccccaacccccauucccugguguccuucuuagag

SEQ ID NO: 308533 - RNA, 64 nt, Human
caacccaaaccaaguguauguauugauuucuaggaacccccaaaaggagaauaguaaaaaaaga

SEQ ID NO: 308534 - RNA, 64 nt, Human
gcacacugccugagggacaacagacaucagaacaaacccccagagagaaacagucaaaaucagg

SEQ ID NO: 308535 - RNA, 64 nt, Human; identical to SEQ ID NO: 64711

SEQ ID NO: 308536 - RNA, 64 nt, Human; identical to SEQ ID NO: 64712

SEQ ID NO: 308537 - RNA, 64 nt, Human; identical to SEQ ID NO: 64714

SEQ ID NO: 308538 - RNA, 64 nt, Human; identical to SEQ ID NO: 64715

SEQ ID NO: 308539 - RNA, 64 nt, Human
gcugcuucuccccccaucccagggucccacccccaacccccagagguggcccuuguuuacagug

SEQ ID NO: 308540 - RNA, 64 nt, Human
gcuggagugcaguggcaugaucucggcucacugcaacccccaucucccagguucaagcgauucu

SEQ ID NO: 308541 - RNA, 64 nt, Human
ugcuuucugaauagggcuggaaacuuucaaagaaaacccccaaacuuuuaagucacaaagucug

SEQ ID NO: 308542 - RNA, 64 nt, Human
guugcacuuuaaacauuuaaauuauacaaucaucaacccccaacccucugggucucuuggauuu

SEQ ID NO: 308543 - RNA, 64 nt, Human
ccccagggccuccagggcccagguucgagacccaaacccccaaaauccaaaacuucucuugaaa

SEQ ID NO: 308544 - RNA, 64 nt, Human
cccaaaucuccaaagagacauaccaggcaagacaaacccccaaacaccuccuuuccgguggccu

SEQ ID NO: 308545 - RNA, 64 nt, Human
guuuccuuugcuguggugggagauaguuugacugaacccccaccuugaccuuggucuccagggg

SEQ ID NO: 308546 - RNA, 58 nt, Human
ugggcagugcccuggccugaaggcccacaacccccacccccaggacugcugcuggagc

SEQ ID NO: 308547 - RNA, 64 nt, Human
cugucagugccggcccacccaccagcaggcccccaacccccaggcagcccggcagaggacggga

SEQ ID NO: 308548 - RNA, 59 nt, Human
agggcagugcaugugcuugagacugagccaacccccaguguguggccccacccauguua

SEQ ID NO: 308549 - RNA, 64 nt, Human
gcagucagaauuagggacuagaauguauaugagaaacccccacucuacuaaaaauauaagaaau

SEQ ID NO: 308550 - RNA, 64 nt, Human
guauuaucuuaaacccacauaaacacuucuccuuaacccccauuuuuguaauauaagacaaguc

SEQ ID NO: 308551 - RNA, 64 nt, Human
gcagugcccccaccguggccccccacgccccauuaacccccacacccccauuccgcgcaauaaa

SEQ ID NO: 308552 - RNA, 64 nt, Human
ggagggucccacccaccacccugcugugcuugggaacccccacuccccacuccccacaucccaa

SEQ ID NO: 308553 - RNA, 64 nt, Human
auaaagccuuugaaaaaaaaaucuguaaaacaucaacccccaaucagaagauggcaaaugggga

SEQ ID NO: 308554 - RNA, 64 nt, Human
cugcaccuuggaugaggcagggccaggcgcccagaacccccauccuggccgcaccccccuuucc

SEQ ID NO: 308555 - RNA, 64 nt, Human; identical to SEQ ID NO: 64692

SEQ ID NO: 308556 - RNA, 64 nt, Human; identical to SEQ ID NO: 64693

SEQ ID NO: 308557 - RNA, 64 nt, Human; identical to SEQ ID NO: 64749

SEQ ID NO: 308558 - RNA, 64 nt, Human; identical to SEQ ID NO: 64750

SEQ ID NO: 308559 - RNA, 64 nt, Human
cuuuuuuacacgauguugccgccguccccacccuaacccccaccucccggcccugagcgugugu

SEQ ID NO: 308560 - RNA, 64 nt, Human
gaccagcccgcccugaccaccagcucuacuucccaacccccacugccugagaggucucuaucag

SEQ ID NO: 308561 - RNA, 64 nt, Human
gcccucguccucccugccucucaucugccuccccaacccccaccuacccacugcucccaggggu

SEQ ID NO: 308562 - RNA, 63 nt, Human
acaacugcuacaacauucuaauaaaggcucauuuaacccccaggcuccugucgugugaauauc

SEQ ID NO: 308563 - RNA, 64 nt, Human
gcccuuagcagggaaggcuggucucccccagccuaacccccagccccuccaugucuaugcuccc

SEQ ID NO: 308564 - RNA, 64 nt, Human
ugaccgguugcucauuuucuggucugaccggcggaacccccacgaggugaagccagccuaugcc

SEQ ID NO: 308565 - RNA, 64 nt, Human
gcagauuccuuccccucccguccccucacgcucaaacccccacuuccugccccaggcuggcgcg

SEQ ID NO: 308566 - RNA, 64 nt, Human
agaagauuucagagcugaggcuuugguacccccaaacccccaauauuuuuggacuggcagacuc

SEQ ID NO: 308567 - RNA, 64 nt, Human
ccugcagaaggaaagccacgcaaguuggggagaaaacccccaaggaugaaucugccaauguaag

SEQ ID NO: 308568 - RNA, 64 nt, Human
uccagcccaggacuaggggcaggacucuugccugaacccccagccugggcuuagcccugugguc

SEQ ID NO: 308569 - RNA, 64 nt, Human
aggagcaaacacuggccucugguguccacccuccaacccccacaagucccucuuuggggagaca

SEQ ID NO: 308570 - RNA, 64 nt, Human
ggcccccacccauucccccucccuccaaacucccaacccccagucaguguuugagccuccucgu

SEQ ID NO: 308571 - RNA, 64 nt, Human
agcagggacaggggcauugucaucucaaaggcccaacccccagaggccacaccaguccucccag

SEQ ID NO: 308572 - RNA, 64 nt, Human
ccuccccacccaagccucaccuccccaccccuugaacccccaugcaaugagcuucuaacucaga

SEQ ID NO: 308573 - RNA, 64 nt, Human
cccccaagucuuccuacccucugcacccucaagaaacccccagugccuuguaugaagcccaccc

SEQ ID NO: 308574 - RNA, 64 nt, Human
uugaggccccauuauuaacagauacucccauaauaacccccaaauacagaccccaugucaccca

SEQ ID NO: 308575 - RNA, 64 nt, Human; identical to SEQ ID NO: 64719

SEQ ID NO: 308576 - RNA, 64 nt, Human; identical to SEQ ID NO: 64720

SEQ ID NO: 308577 - RNA, 64 nt, Human; identical to SEQ ID NO: 64721

SEQ ID NO: 308578 - RNA, 64 nt, Human; identical to SEQ ID NO: 64722

SEQ ID NO: 308579 - RNA, 64 nt, Human
uggaguacauguguucacaaggguuacuccucaaaacccccaguucucacucauguccccaacu

SEQ ID NO: 308580 - RNA, 64 nt, Human
cccaugauccagaacugaggucacuggguucuagaacccccacauuuaccucgaggcucuucca

SEQ ID NO: 308581 - RNA, 64 nt, Human
agccugaccauaggaucuugacuccaacagcggcaacccccacccccauugugguccguccuua

SEQ ID NO: 308582 - RNA, 64 nt, Human
gccccucccccgcagacacaccccaaggcagcccaacccccaccccuuccccgacacccaagcc

SEQ ID NO: 308583 - RNA, 64 nt, Human
agguuggccagagggugugacccaguuacccuuuaacccccacccuuccagucgggugugaggg

SEQ ID NO: 308584 - RNA, 64 nt, Human
gguaaccccauacucuccuuuugacuccuuuuggaacccccacuuuuacguugugucccuccgc

SEQ ID NO: 308585 - RNA, 64 nt, Human
accaucaggagaaggaguuugagacuguguaugcaacccccaauagacccccuuuuacucugau

SEQ ID NO: 308586 - RNA, 64 nt, Human
gcaccuucgucaguacgagcugcucuaagaagggaacccccaaauuuaauuaaagccuuaagca

SEQ ID NO: 308587 - RNA, 64 nt, Human
gccucaucccugacugcagcuugacucugggcccaacccccauuucccuucaggagaccagcga

SEQ ID NO: 308588 - RNA, 64 nt, Human
cgcuccuccuccguccuaucccaacucacccccaaacccccaucccuuccccaccuccagcagu

SEQ ID NO: 308589 - RNA, 64 nt, Human
gggacccccggcccggcccggaacuuuucuccccaacccccaaacccacgacucacuuccacac

SEQ ID NO: 308590 - RNA, 64 nt, Human
cagcggguggcccccaguccugcuggaccagcugaacccccagggagacccggagcacagccuc

SEQ ID NO: 308591 - RNA, 64 nt, Human
uugugguaaugauggguuguuucaugcuuaucagaacccccagcguuuucugagaaguacuuca

SEQ ID NO: 308592 - RNA, 64 nt, Human
guccuggcuccugaggggcaucugccccucccccaacccccaccccacacuuguuccagcucuu

SEQ ID NO: 308593 - RNA, 64 nt, Human
ggggcuccaagccuugcuuuuaacaccccugcaaaacccccacccucccaagauguucacaaaa

SEQ ID NO: 308594 - RNA, 64 nt, Human
gcacuuuccauaggacauuucacacaguccuuagaacccccaggagagagcuacugacuuguua

SEQ ID NO: 308595 - RNA, 64 nt, Human; identical to SEQ ID NO: 64716

SEQ ID NO: 308596 - RNA, 64 nt, Human; identical to SEQ ID NO: 64717

SEQ ID NO: 308597 - RNA, 64 nt, Human; identical to SEQ ID NO: 64726

SEQ ID NO: 308598 - RNA, 64 nt, Human; identical to SEQ ID NO: 64727

SEQ ID NO: 308599 - RNA, 64 nt, Human
uuuucccacauucauagccuguagugcccccucuaacccccagugccacagagaagacgggauu

SEQ ID NO: 308600 - RNA, 64 nt, Human
ugcauauagcaauaaagaccccccuccacccugcaacccccaucccccaccgggccuuuguccc

SEQ ID NO: 308601 - RNA, 64 nt, Human
ccaguguccucugauccuguccggugccucccccaacccccacacccaugcagaacucccaggu

SEQ ID NO: 308602 - RNA, 64 nt, Human
augcccugaagcgaaaagaugcagguuuauauggaacccccacccccucccccacucucccacu

SEQ ID NO: 308603 - RNA, 64 nt, Human
cagcuacucccccagacccaaguucugcagaacuaacccccagcaggccugguuccacccuggg

SEQ ID NO: 308604 - RNA, 64 nt, Human
ccuuugagucagguucaaauuuuuucuccucuuuaacccccagucacuccaguuauaagugauu

SEQ ID NO: 308605 - RNA, 64 nt, Human
ggcuccugggaaauuaaggagggauuugcacaggaacccccaggacccagucgcugcugugguc

SEQ ID NO: 308606 - RNA, 64 nt, Human
cccauccacagaugcaggaggggguacugaugguaacccccauguggauuugagggcagcaguc

SEQ ID NO: 308607 - RNA, 64 nt, Human
ucugggauuuggugucugcugcugccagagcaggaacccccagucuaggacuugggcauuuuaa

SEQ ID NO: 308608 - RNA, 64 nt, Human
ccaaacaaacaaacaaaaacuaaacacacacacaaacccccagaaacccacaauauguacacgc

SEQ ID NO: 308609 - RNA, 64 nt, Human
ccuuggccgaaagaugaaaaaaagccugaaccccaacccccagcugguugagagcacccugcau

SEQ ID NO: 308610 - RNA, 64 nt, Human
caaugacacgcugauggcagguggucccugcugaaacccccacgccuccgcuucagcaucucca

SEQ ID NO: 308611 - RNA, 64 nt, Human
uuuuaauguucugaucaccugacagggcaccccaaacccccaacucccaauaaaagccgugacg

SEQ ID NO: 308612 - RNA, 64 nt, Human
ccugaucguccacuagcccagaguguguguguucaacccccacaccagguggugguaggcggug

SEQ ID NO: 308613 - RNA, 64 nt, Human
aggcucuuuaggcucaggagaagcauuuuaaagaaacccccacccugccgcccgcauuauaaac

SEQ ID NO: 308614 - RNA, 64 nt, Human
gagaccggccuguuccugaguuugagugccgaccaacccccaggauggcggaagcucaccaggc

SEQ ID NO: 308615 - RNA, 64 nt, Human; identical to SEQ ID NO: 64731

SEQ ID NO: 308616 - RNA, 64 nt, Human; identical to SEQ ID NO: 64732

SEQ ID NO: 308617 - RNA, 64 nt, Human; identical to SEQ ID NO: 64733

SEQ ID NO: 308618 - RNA, 64 nt, Human; identical to SEQ ID NO: 64734

SEQ ID NO: 308619 - RNA, 64 nt, Human
ccugucccagccccaucuguggguugcacuuacaaacccccacccaccuucagaaauaguuuuu

SEQ ID NO: 308620 - RNA, 64 nt, Human
ccccugggcuucggaggggggugcuugugccccuaacccccaugcucuugugccuucccccucu

SEQ ID NO: 308621 - RNA, 64 nt, Human
ccugcuccuuuucugggcccuagcacagguggguaacccccacccaacccagcuccugcugcug

SEQ ID NO: 308622 - RNA, 64 nt, Human
aauuacauaacaggagccacauuccccauugaucaacccccaaagccaugagggauccaaguag

SEQ ID NO: 308623 - RNA, 64 nt, Human
aggaagaaagccccagacgcuugguuuuucucagaacccccaaaagaugugcaauagcuguugu

SEQ ID NO: 308624 - RNA, 64 nt, Human
aagacaguaagacaguaaacuauuuuaggaagucaacccccauugcacucuguggcaguuauuc

SEQ ID NO: 308625 - RNA, 64 nt, Human
aaaauaaacacuaaacucucaacacuuuaaaagcaacccccaaauucaaccuauguaaugugau

SEQ ID NO: 308626 - RNA, 64 nt, Human
acuuagugauguaagcaagaagcauaggagauaaaacccccacugagaugccucucaugccuca

SEQ ID NO: 308627 - RNA, 64 nt, Human
auaacagucaauuucugacucacagcagugaacaaacccccacuccauuguauuuggagacugg

SEQ ID NO: 308628 - RNA, 64 nt, Human
caggaguucgagaccagccuggccaacauggcaaaacccccaucucuacuaaaauacaaaaauu

SEQ ID NO: 308629 - RNA, 64 nt, Human
ccuccuccaugaagccuucccuaauuccaccccaaacccccaccuucaacaauauuucaacgcu

SEQ ID NO: 308630 - RNA, 64 nt, Human
auggugggaggccugauuuuaaacuucaggccagaacccccaaugacuccacccauagucucac

SEQ ID NO: 308631 - RNA, 64 nt, Human
cucugucucugaaaaaacaaaacuugaaguuugaaacccccagcuugcugaggagcccuuuuua

SEQ ID NO: 308632 - RNA, 64 nt, Human; identical to SEQ ID NO: 64686

SEQ ID NO: 308633 - RNA, 64 nt, Human; identical to SEQ ID NO: 64687

SEQ ID NO: 308634 - RNA, 64 nt, Human
aaugaagaguguguguacacaugccuccuagaaacuacacuauggguaauuaauuaauuuauuu

SEQ ID NO: 308635 - RNA, 64 nt, Human; identical to SEQ ID NO: 40787

SEQ ID NO: 308636 - RNA, 64 nt, Human; identical to SEQ ID NO: 40788

SEQ ID NO: 308637 - RNA, 58 nt, Human; identical to SEQ ID NO: 40789

SEQ ID NO: 308638 - RNA, 64 nt, Human; identical to SEQ ID NO: 40790

SEQ ID NO: 308639 - RNA, 64 nt, Human; identical to SEQ ID NO: 40791

SEQ ID NO: 308640 - RNA, 64 nt, Human; identical to SEQ ID NO: 40792

SEQ ID NO: 308641 - RNA, 64 nt, Human; identical to SEQ ID NO: 40793

SEQ ID NO: 308642 - RNA, 64 nt, Human; identical to SEQ ID NO: 40794

SEQ ID NO: 308643 - RNA, 64 nt, Human; identical to SEQ ID NO: 40795

SEQ ID NO: 308644 - RNA, 64 nt, Human; identical to SEQ ID NO: 40796

SEQ ID NO: 308645 - RNA, 64 nt, Human; identical to SEQ ID NO: 40797

SEQ ID NO: 308646 - RNA, 64 nt, Human; identical to SEQ ID NO: 40798

SEQ ID NO: 308647 - RNA, 64 nt, Human; identical to SEQ ID NO: 40799

SEQ ID NO: 308648 - RNA, 64 nt, Human; identical to SEQ ID NO: 40800

SEQ ID NO: 308649 - RNA, 64 nt, Human; identical to SEQ ID NO: 40801

SEQ ID NO: 308650 - RNA, 64 nt, Human; identical to SEQ ID NO: 40802

SEQ ID NO: 308651 - RNA, 64 nt, Human; identical to SEQ ID NO: 64738

SEQ ID NO: 308652 - RNA, 64 nt, Human; identical to SEQ ID NO: 64739

SEQ ID NO: 308653 - RNA, 64 nt, Human; identical to SEQ ID NO: 64740

SEQ ID NO: 308654 - RNA, 64 nt, Human; identical to SEQ ID NO: 40803

SEQ ID NO: 308655 - RNA, 64 nt, Human; identical to SEQ ID NO: 40804

SEQ ID NO: 308656 - RNA, 64 nt, Human; identical to SEQ ID NO: 40805

SEQ ID NO: 308657 - RNA, 64 nt, Human; identical to SEQ ID NO: 40806

SEQ ID NO: 308658 - RNA, 64 nt, Human; identical to SEQ ID NO: 40807

SEQ ID NO: 308659 - RNA, 64 nt, Human; identical to SEQ ID NO: 40808

SEQ ID NO: 308660 - RNA, 64 nt, Human; identical to SEQ ID NO: 40809

SEQ ID NO: 308661 - RNA, 64 nt, Human; identical to SEQ ID NO: 40810

SEQ ID NO: 308662 - RNA, 64 nt, Human; identical to SEQ ID NO: 40811

SEQ ID NO: 308663 - RNA, 64 nt, Human; identical to SEQ ID NO: 40812

SEQ ID NO: 308664 - RNA, 64 nt, Human; identical to SEQ ID NO: 40813

SEQ ID NO: 308665 - RNA, 64 nt, Human; identical to SEQ ID NO: 40814

SEQ ID NO: 308666 - RNA, 64 nt, Human; identical to SEQ ID NO: 40815

SEQ ID NO: 308667 - RNA, 64 nt, Human; identical to SEQ ID NO: 40816

SEQ ID NO: 308668 - RNA, 64 nt, Human; identical to SEQ ID NO: 40817

SEQ ID NO: 308669 - RNA, 64 nt, Human; identical to SEQ ID NO: 40818

SEQ ID NO: 308670 - RNA, 64 nt, Human; identical to SEQ ID NO: 64735

SEQ ID NO: 308671 - RNA, 64 nt, Human; identical to SEQ ID NO: 64736

SEQ ID NO: 308672 - RNA, 64 nt, Human; identical to SEQ ID NO: 40819

SEQ ID NO: 308673 - RNA, 64 nt, Human; identical to SEQ ID NO: 40820

SEQ ID NO: 308674 - RNA, 64 nt, Human; identical to SEQ ID NO: 40821

SEQ ID NO: 308675 - RNA, 64 nt, Human; identical to SEQ ID NO: 40822

SEQ ID NO: 308676 - RNA, 62 nt, Human; identical to SEQ ID NO: 40823

SEQ ID NO: 308677 - RNA, 62 nt, Human; identical to SEQ ID NO: 40824

SEQ ID NO: 308678 - RNA, 64 nt, Human; identical to SEQ ID NO: 40825

SEQ ID NO: 308679 - RNA, 62 nt, Human; identical to SEQ ID NO: 40826

SEQ ID NO: 308680 - RNA, 62 nt, Human; identical to SEQ ID NO: 40827

SEQ ID NO: 308681 - RNA, 64 nt, Human; identical to SEQ ID NO: 40828

SEQ ID NO: 308682 - RNA, 64 nt, Human; identical to SEQ ID NO: 40829

SEQ ID NO: 308683 - RNA, 64 nt, Human; identical to SEQ ID NO: 40830

SEQ ID NO: 308684 - RNA, 64 nt, Human; identical to SEQ ID NO: 40831

SEQ ID NO: 308685 - RNA, 64 nt, Human; identical to SEQ ID NO: 40832

SEQ ID NO: 308686 - RNA, 64 nt, Human; identical to SEQ ID NO: 40833

SEQ ID NO: 308687 - RNA, 64 nt, Human; identical to SEQ ID NO: 40834

SEQ ID NO: 308688 - RNA, 64 nt, Human; identical to SEQ ID NO: 64723

SEQ ID NO: 308689 - RNA, 64 nt, Human; identical to SEQ ID NO: 64724

SEQ ID NO: 308690 - RNA, 64 nt, Human; identical to SEQ ID NO: 64744

SEQ ID NO: 308691 - RNA, 64 nt, Human; identical to SEQ ID NO: 40835

SEQ ID NO: 308692 - RNA, 64 nt, Human; identical to SEQ ID NO: 40836

SEQ ID NO: 308693 - RNA, 64 nt, Human; identical to SEQ ID NO: 40837

SEQ ID NO: 308694 - RNA, 56 nt, Human; identical to SEQ ID NO: 40838

SEQ ID NO: 308695 - RNA, 64 nt, Human; identical to SEQ ID NO: 40839

SEQ ID NO: 308696 - RNA, 64 nt, Human; identical to SEQ ID NO: 40840

SEQ ID NO: 308697 - RNA, 64 nt, Human; identical to SEQ ID NO: 40841

SEQ ID NO: 308698 - RNA, 64 nt, Human; identical to SEQ ID NO: 40842

SEQ ID NO: 308699 - RNA, 64 nt, Human; identical to SEQ ID NO: 40843

SEQ ID NO: 308700 - RNA, 64 nt, Human; identical to SEQ ID NO: 40844

SEQ ID NO: 308701 - RNA, 64 nt, Human; identical to SEQ ID NO: 40845

SEQ ID NO: 308702 - RNA, 64 nt, Human; identical to SEQ ID NO: 40846

SEQ ID NO: 308703 - RNA, 64 nt, Human; identical to SEQ ID NO: 40847

SEQ ID NO: 308704 - RNA, 64 nt, Human; identical to SEQ ID NO: 40848

SEQ ID NO: 308705 - RNA, 64 nt, Human; identical to SEQ ID NO: 40849

SEQ ID NO: 308706 - RNA, 64 nt, Human; identical to SEQ ID NO: 40850

SEQ ID NO: 308707 - RNA, 58 nt, Human; identical to SEQ ID NO: 64745

SEQ ID NO: 308708 - RNA, 64 nt, Human; identical to SEQ ID NO: 64746

SEQ ID NO: 308709 - RNA, 64 nt, Human; identical to SEQ ID NO: 64748

SEQ ID NO: 308710 - RNA, 64 nt, Human; identical to SEQ ID NO: 40851

SEQ ID NO: 308711 - RNA, 64 nt, Human; identical to SEQ ID NO: 40852

SEQ ID NO: 308712 - RNA, 64 nt, Human; identical to SEQ ID NO: 40853

SEQ ID NO: 308713 - RNA, 64 nt, Human; identical to SEQ ID NO: 40854

SEQ ID NO: 308714 - RNA, 64 nt, Human; identical to SEQ ID NO: 40855

SEQ ID NO: 308715 - RNA, 64 nt, Human; identical to SEQ ID NO: 40856

SEQ ID NO: 308716 - RNA, 52 nt, Human; identical to SEQ ID NO: 40857

SEQ ID NO: 308717 - RNA, 50 nt, Human; identical to SEQ ID NO: 40858

SEQ ID NO: 308718 - RNA, 60 nt, Human; identical to SEQ ID NO: 40859

SEQ ID NO: 308719 - RNA, 53 nt, Human; identical to SEQ ID NO: 40860

SEQ ID NO: 308720 - RNA, 64 nt, Human; identical to SEQ ID NO: 40861

SEQ ID NO: 308721 - RNA, 64 nt, Human; identical to SEQ ID NO: 40862

SEQ ID NO: 308722 - RNA, 64 nt, Human; identical to SEQ ID NO: 40863

SEQ ID NO: 308723 - RNA, 64 nt, Human; identical to SEQ ID NO: 40864

SEQ ID NO: 308724 - RNA, 64 nt, Human; identical to SEQ ID NO: 40865

SEQ ID NO: 308725 - RNA, 64 nt, Human; identical to SEQ ID NO: 40866

SEQ ID NO: 308726 - RNA, 64 nt, Human; identical to SEQ ID NO: 64679

SEQ ID NO: 308727 - RNA, 64 nt, Human; identical to SEQ ID NO: 64680

SEQ ID NO: 308728 - RNA, 64 nt, Human; identical to SEQ ID NO: 64681

SEQ ID NO: 308729 - RNA, 64 nt, Human; identical to SEQ ID NO: 40867

SEQ ID NO: 308730 - RNA, 64 nt, Human; identical to SEQ ID NO: 40868

SEQ ID NO: 308731 - RNA, 64 nt, Human; identical to SEQ ID NO: 40869

SEQ ID NO: 308732 - RNA, 64 nt, Human; identical to SEQ ID NO: 40870

SEQ ID NO: 308733 - RNA, 64 nt, Human; identical to SEQ ID NO: 40871

SEQ ID NO: 308734 - RNA, 64 nt, Human; identical to SEQ ID NO: 40872

SEQ ID NO: 308735 - RNA, 64 nt, Human; identical to SEQ ID NO: 40873

SEQ ID NO: 308736 - RNA, 64 nt, Human; identical to SEQ ID NO: 40874

SEQ ID NO: 308737 - RNA, 64 nt, Human; identical to SEQ ID NO: 40875

SEQ ID NO: 308738 - RNA, 64 nt, Human; identical to SEQ ID NO: 40876

SEQ ID NO: 308739 - RNA, 64 nt, Human; identical to SEQ ID NO: 40877

SEQ ID NO: 308740 - RNA, 64 nt, Human; identical to SEQ ID NO: 40878

SEQ ID NO: 308741 - RNA, 64 nt, Human; identical to SEQ ID NO: 40879

SEQ ID NO: 308742 - RNA, 64 nt, Human; identical to SEQ ID NO: 40880

SEQ ID NO: 308743 - RNA, 63 nt, Human; identical to SEQ ID NO: 40881

SEQ ID NO: 308744 - RNA, 64 nt, Human; identical to SEQ ID NO: 40882

SEQ ID NO: 308745 - RNA, 64 nt, Human; identical to SEQ ID NO: 64682

SEQ ID NO: 308746 - RNA, 63 nt, Human; identical to SEQ ID NO: 64683

SEQ ID NO: 308747 - RNA, 64 nt, Human; identical to SEQ ID NO: 64685

SEQ ID NO: 308748 - RNA, 64 nt, Human; identical to SEQ ID NO: 40883

SEQ ID NO: 308749 - RNA, 64 nt, Human; identical to SEQ ID NO: 40884

SEQ ID NO: 308750 - RNA, 64 nt, Human; identical to SEQ ID NO: 40885

SEQ ID NO: 308751 - RNA, 64 nt, Human; identical to SEQ ID NO: 40886

SEQ ID NO: 308752 - RNA, 64 nt, Human; identical to SEQ ID NO: 40887

SEQ ID NO: 308753 - RNA, 64 nt, Human; identical to SEQ ID NO: 40888

SEQ ID NO: 308754 - RNA, 64 nt, Human; identical to SEQ ID NO: 40889

SEQ ID NO: 308755 - RNA, 64 nt, Human; identical to SEQ ID NO: 40890

SEQ ID NO: 308756 - RNA, 64 nt, Human; identical to SEQ ID NO: 40891

SEQ ID NO: 308757 - RNA, 64 nt, Human; identical to SEQ ID NO: 40892

SEQ ID NO: 308758 - RNA, 64 nt, Human; identical to SEQ ID NO: 40893

SEQ ID NO: 308759 - RNA, 64 nt, Human; identical to SEQ ID NO: 40894

SEQ ID NO: 308760 - RNA, 64 nt, Human; identical to SEQ ID NO: 40895

SEQ ID NO: 308761 - RNA, 64 nt, Human; identical to SEQ ID NO: 40896

SEQ ID NO: 308762 - RNA, 64 nt, Human; identical to SEQ ID NO: 40897

SEQ ID NO: 308763 - RNA, 64 nt, Human; identical to SEQ ID NO: 40898

SEQ ID NO: 308764 - RNA, 64 nt, Human; identical to SEQ ID NO: 64689

SEQ ID NO: 308765 - RNA, 64 nt, Human; identical to SEQ ID NO: 64690

SEQ ID NO: 308766 - RNA, 64 nt, Human; identical to SEQ ID NO: 64691

SEQ ID NO: 308767 - RNA, 64 nt, Human; identical to SEQ ID NO: 40899

SEQ ID NO: 308768 - RNA, 64 nt, Human; identical to SEQ ID NO: 40900

SEQ ID NO: 308769 - RNA, 64 nt, Human; identical to SEQ ID NO: 40901

SEQ ID NO: 308770 - RNA, 64 nt, Human; identical to SEQ ID NO: 40902

SEQ ID NO: 308771 - RNA, 64 nt, Human; identical to SEQ ID NO: 40903

SEQ ID NO: 308772 - RNA, 64 nt, Human; identical to SEQ ID NO: 40904

SEQ ID NO: 308773 - RNA, 64 nt, Human; identical to SEQ ID NO: 40905

SEQ ID NO: 308774 - RNA, 64 nt, Human; identical to SEQ ID NO: 40906

SEQ ID NO: 308775 - RNA, 64 nt, Human; identical to SEQ ID NO: 40907

SEQ ID NO: 308776 - RNA, 64 nt, Human; identical to SEQ ID NO: 40908

SEQ ID NO: 308777 - RNA, 64 nt, Human; identical to SEQ ID NO: 40909

SEQ ID NO: 308778 - RNA, 64 nt, Human; identical to SEQ ID NO: 40910

SEQ ID NO: 308779 - RNA, 64 nt, Human; identical to SEQ ID NO: 40911

SEQ ID NO: 308780 - RNA, 64 nt, Human; identical to SEQ ID NO: 40912

SEQ ID NO: 308781 - RNA, 64 nt, Human; identical to SEQ ID NO: 40913

SEQ ID NO: 308782 - RNA, 64 nt, Human; identical to SEQ ID NO: 40914

SEQ ID NO: 308783 - RNA, 64 nt, Human
cucaagguaccaaauaccccacauaaggaaaguacuacacuaaauucacucaacuauuguaugc

SEQ ID NO: 308784 - RNA, 64 nt, Human; identical to SEQ ID NO: 40915

SEQ ID NO: 308785 - RNA, 64 nt, Human; identical to SEQ ID NO: 40916

SEQ ID NO: 308786 - RNA, 64 nt, Human; identical to SEQ ID NO: 40917

SEQ ID NO: 308787 - RNA, 64 nt, Human; identical to SEQ ID NO: 40918

SEQ ID NO: 308788 - RNA, 64 nt, Human; identical to SEQ ID NO: 40919

SEQ ID NO: 308789 - RNA, 64 nt, Human; identical to SEQ ID NO: 40920

SEQ ID NO: 308790 - RNA, 64 nt, Human; identical to SEQ ID NO: 40921

SEQ ID NO: 308791 - RNA, 64 nt, Human; identical to SEQ ID NO: 40922

SEQ ID NO: 308792 - RNA, 64 nt, Human; identical to SEQ ID NO: 40923

SEQ ID NO: 308793 - RNA, 64 nt, Human; identical to SEQ ID NO: 40924

SEQ ID NO: 308794 - RNA, 64 nt, Human; identical to SEQ ID NO: 40925

SEQ ID NO: 308795 - RNA, 64 nt, Human; identical to SEQ ID NO: 40926

SEQ ID NO: 308796 - RNA, 64 nt, Human; identical to SEQ ID NO: 40927

SEQ ID NO: 308797 - RNA, 64 nt, Human; identical to SEQ ID NO: 40928

SEQ ID NO: 308798 - RNA, 64 nt, Human; identical to SEQ ID NO: 40929

SEQ ID NO: 308799 - RNA, 64 nt, Human; identical to SEQ ID NO: 40930

SEQ ID NO: 308800 - RNA, 64 nt, Human; identical to SEQ ID NO: 64695

SEQ ID NO: 308801 - RNA, 64 nt, Human; identical to SEQ ID NO: 64696

SEQ ID NO: 308802 - RNA, 64 nt, Human; identical to SEQ ID NO: 64697

SEQ ID NO: 308803 - RNA, 64 nt, Human; identical to SEQ ID NO: 40931

SEQ ID NO: 308804 - RNA, 64 nt, Human; identical to SEQ ID NO: 40932

SEQ ID NO: 308805 - RNA, 64 nt, Human; identical to SEQ ID NO: 40933

SEQ ID NO: 308806 - RNA, 64 nt, Human; identical to SEQ ID NO: 40934

SEQ ID NO: 308807 - RNA, 64 nt, Human; identical to SEQ ID NO: 40935

SEQ ID NO: 308808 - RNA, 64 nt, Human; identical to SEQ ID NO: 40936

SEQ ID NO: 308809 - RNA, 64 nt, Human; identical to SEQ ID NO: 40937

SEQ ID NO: 308810 - RNA, 64 nt, Human; identical to SEQ ID NO: 40938

SEQ ID NO: 308811 - RNA, 64 nt, Human; identical to SEQ ID NO: 40939

SEQ ID NO: 308812 - RNA, 64 nt, Human; identical to SEQ ID NO: 40940

SEQ ID NO: 308813 - RNA, 64 nt, Human; identical to SEQ ID NO: 40941

SEQ ID NO: 308814 - RNA, 64 nt, Human; identical to SEQ ID NO: 40942

SEQ ID NO: 308815 - RNA, 64 nt, Human; identical to SEQ ID NO: 40943

SEQ ID NO: 308816 - RNA, 62 nt, Human
aaggauguuacuagaaguacacaaauugggcccggcgcgauggcucacgccuguaaucccag

SEQ ID NO: 308817 - RNA, 62 nt, Human
uaauacgaaggugaggucugggaugcugcgugcggcgcgacgacaggagguaugaccugggu

SEQ ID NO: 308818 - RNA, 62 nt, Human
acacccgucacaagacgcggacaugcaggucucggcgcgagcucugccccguccaagagccu

SEQ ID NO: 308819 - RNA, 64 nt, Human; identical to SEQ ID NO: 64674

SEQ ID NO: 308820 - RNA, 64 nt, Human; identical to SEQ ID NO: 64675

SEQ ID NO: 308821 - RNA, 64 nt, Human; identical to SEQ ID NO: 64676

SEQ ID NO: 308822 - RNA, 64 nt, Human; identical to SEQ ID NO: 85098

SEQ ID NO: 308823 - RNA, 64 nt, Human; identical to SEQ ID NO: 85099

SEQ ID NO: 308824 - RNA, 64 nt, Human; identical to SEQ ID NO: 85100

SEQ ID NO: 308825 - RNA, 64 nt, Human; identical to SEQ ID NO: 85101

SEQ ID NO: 308826 - RNA, 64 nt, Human; identical to SEQ ID NO: 85102

SEQ ID NO: 308827 - RNA, 64 nt, Human; identical to SEQ ID NO: 85103

SEQ ID NO: 308828 - RNA, 64 nt, Human; identical to SEQ ID NO: 85104

SEQ ID NO: 308829 - RNA, 64 nt, Human; identical to SEQ ID NO: 85105

SEQ ID NO: 308830 - RNA, 64 nt, Human; identical to SEQ ID NO: 85106

SEQ ID NO: 308831 - RNA, 64 nt, Human; identical to SEQ ID NO: 85107

SEQ ID NO: 308832 - RNA, 64 nt, Human; identical to SEQ ID NO: 85108

SEQ ID NO: 308833 - RNA, 64 nt, Human; identical to SEQ ID NO: 85109

SEQ ID NO: 308834 - RNA, 64 nt, Human; identical to SEQ ID NO: 85110

SEQ ID NO: 308835 - RNA, 64 nt, Human; identical to SEQ ID NO: 85111

SEQ ID NO: 308836 - RNA, 64 nt, Human; identical to SEQ ID NO: 85112

SEQ ID NO: 308837 - RNA, 64 nt, Human
cugccuuacagagcagcccagguacccaggcccgggcagacaaggccccugggguaaaaaguag

SEQ ID NO: 308838 - RNA, 64 nt, Human
aggagagaagguacuauaccuuucaaauccccagggcagacacacccccacccagccccuauuu

SEQ ID NO: 308839 - RNA, 64 nt, Human
caaguagcucuaugccugcaaucauggagacacaggcagacagauaagcuucauggggaaggca

SEQ ID NO: 308840 - RNA, 64 nt, Human; identical to SEQ ID NO: 85113

SEQ ID NO: 308841 - RNA, 64 nt, Human; identical to SEQ ID NO: 85114

SEQ ID NO: 308842 - RNA, 64 nt, Human; identical to SEQ ID NO: 85115

SEQ ID NO: 308843 - RNA, 64 nt, Human; identical to SEQ ID NO: 85116

SEQ ID NO: 308844 - RNA, 64 nt, Human; identical to SEQ ID NO: 85117

SEQ ID NO: 308845 - RNA, 64 nt, Human; identical to SEQ ID NO: 85118

SEQ ID NO: 308846 - RNA, 56 nt, Human; identical to SEQ ID NO: 85119

SEQ ID NO: 308847 - RNA, 64 nt, Human; identical to SEQ ID NO: 85120

SEQ ID NO: 308848 - RNA, 52 nt, Human; identical to SEQ ID NO: 85121

SEQ ID NO: 308849 - RNA, 64 nt, Human; identical to SEQ ID NO: 85122

SEQ ID NO: 308850 - RNA, 63 nt, Human; identical to SEQ ID NO: 85123

SEQ ID NO: 308851 - RNA, 64 nt, Human; identical to SEQ ID NO: 85124

SEQ ID NO: 308852 - RNA, 64 nt, Human; identical to SEQ ID NO: 85125

SEQ ID NO: 308853 - RNA, 64 nt, Human; identical to SEQ ID NO: 85126

SEQ ID NO: 308854 - RNA, 64 nt, Human; identical to SEQ ID NO: 85127

SEQ ID NO: 308855 - RNA, 64 nt, Human
gugccucacagcgcugugagccagacccuccuugggcagacaggcugacuggcagcaccagcuu

SEQ ID NO: 308856 - RNA, 64 nt, Human
cacauuguggcauuuuuccuugccuuccucggagggcagacacagggaggaaggacccagugcc

SEQ ID NO: 308857 - RNA, 64 nt, Human
aaggaccggagcgaaugaggccuguauccucccuggcagacacaacccaauaggagucuuaauu

SEQ ID NO: 308858 - RNA, 64 nt, Human; identical to SEQ ID NO: 85128

SEQ ID NO: 308859 - RNA, 64 nt, Human; identical to SEQ ID NO: 85129

SEQ ID NO: 308860 - RNA, 64 nt, Human; identical to SEQ ID NO: 85130

SEQ ID NO: 308861 - RNA, 64 nt, Human; identical to SEQ ID NO: 85131

SEQ ID NO: 308862 - RNA, 64 nt, Human; identical to SEQ ID NO: 85132

SEQ ID NO: 308863 - RNA, 64 nt, Human; identical to SEQ ID NO: 85133

SEQ ID NO: 308864 - RNA, 64 nt, Human; identical to SEQ ID NO: 85134

SEQ ID NO: 308865 - RNA, 64 nt, Human; identical to SEQ ID NO: 85135

SEQ ID NO: 308866 - RNA, 64 nt, Human; identical to SEQ ID NO: 85136

SEQ ID NO: 308867 - RNA, 64 nt, Human; identical to SEQ ID NO: 85137

SEQ ID NO: 308868 - RNA, 64 nt, Human; identical to SEQ ID NO: 85138

SEQ ID NO: 308869 - RNA, 64 nt, Human; identical to SEQ ID NO: 85139

SEQ ID NO: 308870 - RNA, 57 nt, Human; identical to SEQ ID NO: 85140

SEQ ID NO: 308871 - RNA, 64 nt, Human; identical to SEQ ID NO: 85141

SEQ ID NO: 308872 - RNA, 64 nt, Human; identical to SEQ ID NO: 85142

SEQ ID NO: 308873 - RNA, 64 nt, Human
uaagaaguuaaguuguugcuaucgcaacaauccuggcagacaauugaguaauauuuugaugauu

SEQ ID NO: 308874 - RNA, 64 nt, Human
gucuauccucaaguugcuacgguucagugagagaggcagacaucugaacaggcagguaggauuc

SEQ ID NO: 308875 - RNA, 64 nt, Human
gagccccacuuucgggaccagccugagguguaagggcagacaaacaggugagggugaguguggc

SEQ ID NO: 308876 - RNA, 64 nt, Human; identical to SEQ ID NO: 85143

SEQ ID NO: 308877 - RNA, 64 nt, Human; identical to SEQ ID NO: 85144

SEQ ID NO: 308878 - RNA, 64 nt, Human; identical to SEQ ID NO: 85145

SEQ ID NO: 308879 - RNA, 64 nt, Human; identical to SEQ ID NO: 85146

SEQ ID NO: 308880 - RNA, 64 nt, Human; identical to SEQ ID NO: 85147

SEQ ID NO: 308881 - RNA, 64 nt, Human; identical to SEQ ID NO: 85148

SEQ ID NO: 308882 - RNA, 64 nt, Human; identical to SEQ ID NO: 85149

SEQ ID NO: 308883 - RNA, 64 nt, Human; identical to SEQ ID NO: 85150

SEQ ID NO: 308884 - RNA, 64 nt, Human; identical to SEQ ID NO: 85151

SEQ ID NO: 308885 - RNA, 64 nt, Human; identical to SEQ ID NO: 85152

SEQ ID NO: 308886 - RNA, 64 nt, Human; identical to SEQ ID NO: 85153

SEQ ID NO: 308887 - RNA, 64 nt, Human; identical to SEQ ID NO: 85154

SEQ ID NO: 308888 - RNA, 64 nt, Human; identical to SEQ ID NO: 85155

SEQ ID NO: 308889 - RNA, 64 nt, Human; identical to SEQ ID NO: 85156

SEQ ID NO: 308890 - RNA, 64 nt, Human; identical to SEQ ID NO: 85157

SEQ ID NO: 308891 - RNA, 61 nt, Human
ugauccucuaugaggugugacccugggagguggcagacagaagcacccccugccccggcaa

SEQ ID NO: 308892 - RNA, 64 nt, Human
ccccuugggugaccucuuguacccccagguggaaggcagacagcaggcagcgccaagugcgugc

SEQ ID NO: 308893 - RNA, 64 nt, Human
uuccuggauuguauuaucugcuuuccuuuaccaaggcagacagaacugcugccuuagccugaca

SEQ ID NO: 308894 - RNA, 64 nt, Human; identical to SEQ ID NO: 85158

SEQ ID NO: 308895 - RNA, 64 nt, Human; identical to SEQ ID NO: 85159

SEQ ID NO: 308896 - RNA, 64 nt, Human; identical to SEQ ID NO: 85160

SEQ ID NO: 308897 - RNA, 64 nt, Human; identical to SEQ ID NO: 85161

SEQ ID NO: 308898 - RNA, 64 nt, Human; identical to SEQ ID NO: 85162

SEQ ID NO: 308899 - RNA, 64 nt, Human; identical to SEQ ID NO: 85163

SEQ ID NO: 308900 - RNA, 64 nt, Human; identical to SEQ ID NO: 85164

SEQ ID NO: 308901 - RNA, 64 nt, Human; identical to SEQ ID NO: 85165

SEQ ID NO: 308902 - RNA, 64 nt, Human; identical to SEQ ID NO: 85166

SEQ ID NO: 308903 - RNA, 64 nt, Human; identical to SEQ ID NO: 85167

SEQ ID NO: 308904 - RNA, 64 nt, Human; identical to SEQ ID NO: 85168

SEQ ID NO: 308905 - RNA, 64 nt, Human; identical to SEQ ID NO: 85169

SEQ ID NO: 308906 - RNA, 64 nt, Human; identical to SEQ ID NO: 85170

SEQ ID NO: 308907 - RNA, 64 nt, Human; identical to SEQ ID NO: 85171

SEQ ID NO: 308908 - RNA, 64 nt, Human; identical to SEQ ID NO: 85172

SEQ ID NO: 308909 - RNA, 64 nt, Human
aaugauagucuucauuuuuaaaaacaaaaaggcaggcagacagaaauaaugauguuuucuugca

SEQ ID NO: 308910 - RNA, 64 nt, Human
gacaggagggagccuggggauugugguuugggaaggcagacaccugguucuagaacuagcucug

SEQ ID NO: 308911 - RNA, 64 nt, Human
ugggcgagcgugcaccaucccuuuuugaaguguaggcagacacagggacuugaaguuguuacua

SEQ ID NO: 308912 - RNA, 64 nt, Human; identical to SEQ ID NO: 85173

SEQ ID NO: 308913 - RNA, 64 nt, Human; identical to SEQ ID NO: 85174

SEQ ID NO: 308914 - RNA, 64 nt, Human; identical to SEQ ID NO: 85175

SEQ ID NO: 308915 - RNA, 64 nt, Human; identical to SEQ ID NO: 85176

SEQ ID NO: 308916 - RNA, 64 nt, Human; identical to SEQ ID NO: 85177

SEQ ID NO: 308917 - RNA, 64 nt, Human; identical to SEQ ID NO: 85178

SEQ ID NO: 308918 - RNA, 64 nt, Human; identical to SEQ ID NO: 85179

SEQ ID NO: 308919 - RNA, 64 nt, Human; identical to SEQ ID NO: 85180

SEQ ID NO: 308920 - RNA, 64 nt, Human; identical to SEQ ID NO: 85181

SEQ ID NO: 308921 - RNA, 64 nt, Human; identical to SEQ ID NO: 85182

SEQ ID NO: 308922 - RNA, 64 nt, Human; identical to SEQ ID NO: 85183

SEQ ID NO: 308923 - RNA, 64 nt, Human; identical to SEQ ID NO: 85184

SEQ ID NO: 308924 - RNA, 64 nt, Human; identical to SEQ ID NO: 85185

SEQ ID NO: 308925 - RNA, 64 nt, Human
ccuucagaugugggggcagaauaggacccauuugggcagacacaggccacggaaaccacagggc

SEQ ID NO: 308926 - RNA, 64 nt, Human
ccuuccgaccacucagcugucagggcacugcgggggcagacaccucuggccugaagucacagca

SEQ ID NO: 308927 - RNA, 64 nt, Human
guguguuuacagcauuuccagguccagagagguuggcagacaagugccauuuuaauaaaaaaug

SEQ ID NO: 308928 - RNA, 64 nt, Human; identical to SEQ ID NO: 85098

SEQ ID NO: 308929 - RNA, 64 nt, Human; identical to SEQ ID NO: 85099

SEQ ID NO: 308930 - RNA, 64 nt, Human; identical to SEQ ID NO: 85100

SEQ ID NO: 308931 - RNA, 64 nt, Human; identical to SEQ ID NO: 85101

SEQ ID NO: 308932 - RNA, 64 nt, Human; identical to SEQ ID NO: 85102

SEQ ID NO: 308933 - RNA, 64 nt, Human; identical to SEQ ID NO: 85103

SEQ ID NO: 308934 - RNA, 64 nt, Human; identical to SEQ ID NO: 85104

SEQ ID NO: 308935 - RNA, 64 nt, Human; identical to SEQ ID NO: 85105

SEQ ID NO: 308936 - RNA, 64 nt, Human; identical to SEQ ID NO: 85106

SEQ ID NO: 308937 - RNA, 64 nt, Human; identical to SEQ ID NO: 85107

SEQ ID NO: 308938 - RNA, 64 nt, Human; identical to SEQ ID NO: 85108

SEQ ID NO: 308939 - RNA, 64 nt, Human; identical to SEQ ID NO: 85109

SEQ ID NO: 308940 - RNA, 64 nt, Human; identical to SEQ ID NO: 85110

SEQ ID NO: 308941 - RNA, 64 nt, Human; identical to SEQ ID NO: 85111

SEQ ID NO: 308942 - RNA, 64 nt, Human; identical to SEQ ID NO: 85112

SEQ ID NO: 308943 - RNA, 64 nt, Human
gcuggcagugcaugugcuugaguuaaaugugcagggcagacagagccagaagggccuguaccca

SEQ ID NO: 308944 - RNA, 64 nt, Human
cgccuccacugcagugccugggcuccccuugcagggcagacagugccuggcacugaggggugcc

SEQ ID NO: 308945 - RNA, 64 nt, Human
gcaaaugaaaucaaugcaagauuucuuaauaaugggcagacagaaaaauguaaaaccacacaaa

SEQ ID NO: 308946 - RNA, 64 nt, Human; identical to SEQ ID NO: 85113

SEQ ID NO: 308947 - RNA, 64 nt, Human; identical to SEQ ID NO: 85114

SEQ ID NO: 308948 - RNA, 64 nt, Human; identical to SEQ ID NO: 85115

SEQ ID NO: 308949 - RNA, 64 nt, Human; identical to SEQ ID NO: 85116

SEQ ID NO: 308950 - RNA, 64 nt, Human; identical to SEQ ID NO: 85117

SEQ ID NO: 308951 - RNA, 64 nt, Human; identical to SEQ ID NO: 85118

SEQ ID NO: 308952 - RNA, 56 nt, Human; identical to SEQ ID NO: 85119

SEQ ID NO: 308953 - RNA, 64 nt, Human; identical to SEQ ID NO: 85120

SEQ ID NO: 308954 - RNA, 52 nt, Human; identical to SEQ ID NO: 85121

SEQ ID NO: 308955 - RNA, 64 nt, Human; identical to SEQ ID NO: 85122

SEQ ID NO: 308956 - RNA, 63 nt, Human; identical to SEQ ID NO: 85123

SEQ ID NO: 308957 - RNA, 64 nt, Human; identical to SEQ ID NO: 85124

SEQ ID NO: 308958 - RNA, 64 nt, Human; identical to SEQ ID NO: 85125

SEQ ID NO: 308959 - RNA, 64 nt, Human; identical to SEQ ID NO: 85126

SEQ ID NO: 308960 - RNA, 64 nt, Human; identical to SEQ ID NO: 85127

SEQ ID NO: 308961 - RNA, 64 nt, Human
gggacagggacccacuucacacacaggcaacugaggcagacagcagcucaggcacacuucuucu

SEQ ID NO: 308962 - RNA, 64 nt, Human
acacgguccccacacccucccagccucaggcccaggcagacaugggcgagcuggugagacugcc

SEQ ID NO: 308963 - RNA, 64 nt, Human
auuuaggccaaaaggaggaagugacuuguccaggggcagacaccaaaugggaaucugauuccag

SEQ ID NO: 308964 - RNA, 64 nt, Human; identical to SEQ ID NO: 85128

SEQ ID NO: 308965 - RNA, 64 nt, Human; identical to SEQ ID NO: 85129

SEQ ID NO: 308966 - RNA, 64 nt, Human; identical to SEQ ID NO: 85130

SEQ ID NO: 308967 - RNA, 64 nt, Human; identical to SEQ ID NO: 85131

SEQ ID NO: 308968 - RNA, 64 nt, Human; identical to SEQ ID NO: 85132

SEQ ID NO: 308969 - RNA, 64 nt, Human; identical to SEQ ID NO: 85133

SEQ ID NO: 308970 - RNA, 64 nt, Human; identical to SEQ ID NO: 85134

SEQ ID NO: 308971 - RNA, 64 nt, Human; identical to SEQ ID NO: 85135

SEQ ID NO: 308972 - RNA, 64 nt, Human; identical to SEQ ID NO: 85136

SEQ ID NO: 308973 - RNA, 64 nt, Human; identical to SEQ ID NO: 85137

SEQ ID NO: 308974 - RNA, 64 nt, Human; identical to SEQ ID NO: 85138

SEQ ID NO: 308975 - RNA, 64 nt, Human; identical to SEQ ID NO: 85139

SEQ ID NO: 308976 - RNA, 57 nt, Human; identical to SEQ ID NO: 85140

SEQ ID NO: 308977 - RNA, 64 nt, Human; identical to SEQ ID NO: 85141

SEQ ID NO: 308978 - RNA, 64 nt, Human; identical to SEQ ID NO: 85142

SEQ ID NO: 308979 - RNA, 64 nt, Human
gccagguaaccugagggcaggggagaggugggguggcagacacgcagaagugcuacuagugaca

SEQ ID NO: 308980 - RNA, 64 nt, Human
cauggcaacaggaggcugugcugaccuccugagcggcagacaccuuccaggagcccugagggug

SEQ ID NO: 308981 - RNA, 64 nt, Human
guccacuggcuagagagcaggcggugcgcgguugggcagacaccugggaggagucuccaagcca

SEQ ID NO: 308982 - RNA, 64 nt, Human; identical to SEQ ID NO: 85143

SEQ ID NO: 308983 - RNA, 64 nt, Human; identical to SEQ ID NO: 85144

SEQ ID NO: 308984 - RNA, 64 nt, Human; identical to SEQ ID NO: 85145

SEQ ID NO: 308985 - RNA, 64 nt, Human; identical to SEQ ID NO: 85146

SEQ ID NO: 308986 - RNA, 64 nt, Human; identical to SEQ ID NO: 85147

SEQ ID NO: 308987 - RNA, 64 nt, Human; identical to SEQ ID NO: 85148

SEQ ID NO: 308988 - RNA, 64 nt, Human; identical to SEQ ID NO: 85149

SEQ ID NO: 308989 - RNA, 64 nt, Human; identical to SEQ ID NO: 85150

SEQ ID NO: 308990 - RNA, 64 nt, Human; identical to SEQ ID NO: 85151

SEQ ID NO: 308991 - RNA, 64 nt, Human; identical to SEQ ID NO: 85152

SEQ ID NO: 308992 - RNA, 64 nt, Human; identical to SEQ ID NO: 85153

SEQ ID NO: 308993 - RNA, 64 nt, Human; identical to SEQ ID NO: 85154

SEQ ID NO: 308994 - RNA, 64 nt, Human; identical to SEQ ID NO: 85155

SEQ ID NO: 308995 - RNA, 64 nt, Human; identical to SEQ ID NO: 85156

SEQ ID NO: 308996 - RNA, 64 nt, Human; identical to SEQ ID NO: 85157

SEQ ID NO: 308997 - RNA, 64 nt, Human
caucucaagcgagcauaugaacugugugacaacaggcagacaguaccucugugucuaugagaaa

SEQ ID NO: 308998 - RNA, 64 nt, Human
cacuuuugauaugagacaauguagcagaauaccaggcagacagaaccuugcaaacaccuuaacu

SEQ ID NO: 308999 - RNA, 64 nt, Human
aaaguggggugagguucccugguugaguagguuuggcagacacuaaagcgagcuacacgaucau

SEQ ID NO: 309000 - RNA, 64 nt, Human; identical to SEQ ID NO: 85158

SEQ ID NO: 309001 - RNA, 64 nt, Human; identical to SEQ ID NO: 85159

SEQ ID NO: 309002 - RNA, 64 nt, Human; identical to SEQ ID NO: 85160

SEQ ID NO: 309003 - RNA, 64 nt, Human; identical to SEQ ID NO: 85161

SEQ ID NO: 309004 - RNA, 64 nt, Human; identical to SEQ ID NO: 85162

SEQ ID NO: 309005 - RNA, 64 nt, Human; identical to SEQ ID NO: 85163

SEQ ID NO: 309006 - RNA, 64 nt, Human; identical to SEQ ID NO: 85164

SEQ ID NO: 309007 - RNA, 64 nt, Human; identical to SEQ ID NO: 85165

SEQ ID NO: 309008 - RNA, 64 nt, Human; identical to SEQ ID NO: 85166

SEQ ID NO: 309009 - RNA, 64 nt, Human; identical to SEQ ID NO: 85167

SEQ ID NO: 309010 - RNA, 64 nt, Human; identical to SEQ ID NO: 85168

SEQ ID NO: 309011 - RNA, 64 nt, Human; identical to SEQ ID NO: 85169

SEQ ID NO: 309012 - RNA, 64 nt, Human; identical to SEQ ID NO: 85170

SEQ ID NO: 309013 - RNA, 64 nt, Human; identical to SEQ ID NO: 85171

SEQ ID NO: 309014 - RNA, 64 nt, Human; identical to SEQ ID NO: 85172

SEQ ID NO: 309015 - RNA, 64 nt, Human
aaaacugcguuaaaggcucgauuuuguaucugcaggcagacacggaucugagaaucuuuauuga

SEQ ID NO: 309016 - RNA, 64 nt, Human
auguugucaguuaggaaacugaagccauaggucaggcagacaucagcucagccuguggcccauu

SEQ ID NO: 309017 - RNA, 64 nt, Human
uaaaaaaaaaaaaaaaacugguaaaauuacuuuuggcagacaguguuuuaugaauuauguauca

SEQ ID NO: 309018 - RNA, 64 nt, Human; identical to SEQ ID NO: 85173

SEQ ID NO: 309019 - RNA, 64 nt, Human; identical to SEQ ID NO: 85174

SEQ ID NO: 309020 - RNA, 64 nt, Human; identical to SEQ ID NO: 85175

SEQ ID NO: 309021 - RNA, 64 nt, Human; identical to SEQ ID NO: 85176

SEQ ID NO: 309022 - RNA, 64 nt, Human; identical to SEQ ID NO: 85177

SEQ ID NO: 309023 - RNA, 64 nt, Human; identical to SEQ ID NO: 85178

SEQ ID NO: 309024 - RNA, 64 nt, Human; identical to SEQ ID NO: 85179

SEQ ID NO: 309025 - RNA, 64 nt, Human; identical to SEQ ID NO: 85180

SEQ ID NO: 309026 - RNA, 64 nt, Human; identical to SEQ ID NO: 85181

SEQ ID NO: 309027 - RNA, 64 nt, Human; identical to SEQ ID NO: 85182

SEQ ID NO: 309028 - RNA, 64 nt, Human; identical to SEQ ID NO: 85183

SEQ ID NO: 309029 - RNA, 64 nt, Human; identical to SEQ ID NO: 85184

SEQ ID NO: 309030 - RNA, 64 nt, Human; identical to SEQ ID NO: 85185

SEQ ID NO: 309031 - RNA, 64 nt, Human
gaaauucuguuccguguuuguguagguaaauaaaggcagacaugguuugcaaaccacaagaauc

SEQ ID NO: 309032 - RNA, 64 nt, Human
cacaaugagaaccucgggguuugagguggccaugggcagacagccgaaagggagggagggugug

SEQ ID NO: 309033 - RNA, 64 nt, Human
ugugaauuccuaccccgaacuggaagccgggaguggcagacagaaucacuauuucaaguuaaag

SEQ ID NO: 309034 - RNA, 64 nt, Human
gacaaaagccaaaagacucucgcugucccugugcugcugguauuucauucucuguaacuucagu

SEQ ID NO: 309035 - RNA, 64 nt, Human
guauuaggaauuuccaugggaaaagagguuugcaugcugguaaugcaaccuuugaaacuuugua

SEQ ID NO: 309036 - RNA, 64 nt, Human
uucauaacuaucaccugcaccgacuaggcugaggugcugguacuugccccaaccccuacuuuug

SEQ ID NO: 309037 - RNA, 64 nt, Human
uuauaaaguaguguuuaaaaggcagcucaccauuugcugguaacuuaaugugagagaauccaua

SEQ ID NO: 309038 - RNA, 64 nt, Human
auauuuaaaagauguucaauacacuguuugaaugugcugguaacugcuuugcuucuugaguaga

SEQ ID NO: 309039 - RNA, 64 nt, Human
agaagguccccauggucagacagcuggucugcauugcugguacugguugcaucauccucauccu

SEQ ID NO: 309040 - RNA, 64 nt, Human
ucuuuguuaaaaggguccuuuugaagcaauuaagugcugguaagaauauuucucuguuguugcc

SEQ ID NO: 309041 - RNA, 64 nt, Human
caguagaaacuuuuuacacaguaacaccauucguugcugguauuuaguuuucugaagggucgca

SEQ ID NO: 309042 - RNA, 64 nt, Human
caguugaaggucaagcccauagacacacacucucugcugguaagaaaccauagcccagaacuga

SEQ ID NO: 309043 - RNA, 64 nt, Human
cgaguacccguucccucccagaggugggaguaacugcugguagugccuucuuugguuguguugc

SEQ ID NO: 309044 - RNA, 64 nt, Human
uaggugaggacuucucuaugcucuuuaugacuguugcugguagcauuuuuuaaauugugcauga

SEQ ID NO: 309045 - RNA, 64 nt, Human
ucacaaugggucugaucugcauuucacuuccagcugcugguaggucuuuagcaggccucuggca

SEQ ID NO: 309046 - RNA, 64 nt, Human
aaacauaaucuauuauuugcuaugcaauauuuuaugcugguauuauaucuguuuuuuaaauugu

SEQ ID NO: 309047 - RNA, 64 nt, Human
uguuuggcgucuuugggcuggguuugguuuuugcugcugguagaaucaggguccucgggcauga

SEQ ID NO: 309048 - RNA, 64 nt, Human
gucuaccucauacuagaaugaucgugacuacccgggcagacauuuuacuguguuucucagacca

SEQ ID NO: 309049 - RNA, 64 nt, Human
cuccaccuugcucuucuuucugagaguuggcucaggcagacaagagcugcuguccuuuuaggaa

SEQ ID NO: 309050 - RNA, 64 nt, Human
cauugcagaaagauucuggaagguccauguagagggcagacauugaagaaagaaacuuaaaauc

SEQ ID NO: 309051 - RNA, 64 nt, Human
agccuugugguuuaugcuuaaauguacauuuuccugcugguaaaaggagaaacugagagguguc

SEQ ID NO: 309052 - RNA, 64 nt, Human
caguccucaggaagggggccgccacccuccccuaugcugguagaugcugaggccccuaggugcc

SEQ ID NO: 309053 - RNA, 64 nt, Human
gcguuacucugauuuucugucuaguaucagagaaugcugguagcuuaaaauuuuuauuuuagga

SEQ ID NO: 309054 - RNA, 64 nt, Human
caggggagguucuagcuggaggaggggucugaugugcugguaacuugggcugaccuaccuacag

SEQ ID NO: 309055 - RNA, 64 nt, Human
uagcccuucccuccauccuguaggauuuuguagaugcugguaggggcuggggcuaccuuguuuu

SEQ ID NO: 309056 - RNA, 64 nt, Human
cccuccuaagucuuaaugcugagauuucuaaagaugcugguacugacagauuaauggcuugccu

SEQ ID NO: 309057 - RNA, 63 nt, Human
ugauguuuuugugguuuuucacuuuuuaugggucugcugguaagaaaagggaaaaaaaaaaag

SEQ ID NO: 309058 - RNA, 64 nt, Human
cagacauuaccuaaaacacauacguuagccaugcugcugguauggagaaauuccacaccaugau

SEQ ID NO: 309059 - RNA, 64 nt, Human
caggaaguggauuaucugccucgggagugggaauugcugguacaaagaccaaaacaaccaaaug

SEQ ID NO: 309060 - RNA, 64 nt, Human
aagccaagcuagcuuuuuaggggaguguuccagcugcugguaguggaucagcuuagagggaaca

SEQ ID NO: 309061 - RNA, 64 nt, Human
uaccucauaagagaaccacacccuucuccaaaagugcugguacugcaucagugagaugaguagg

SEQ ID NO: 309062 - RNA, 64 nt, Human
aggagaaaggcuuaggaaguuuuuuugcagagagugcugguaaagaauugagcaaguuugcuau

SEQ ID NO: 309063 - RNA, 64 nt, Human
uagcuaccucacaaccaguccugucuguuuauagugcugguaguaucaccuuuugccagaaggc

SEQ ID NO: 309064 - RNA, 64 nt, Human
gaaaaucuaagaagcucccaguccucagagacccugcugguacccagacccccaccuucggagg

SEQ ID NO: 309065 - RNA, 64 nt, Human
ccucucuuaaagcggcaccaacgugagagagacaggcagacagacagaaagccagaggcuuagg

SEQ ID NO: 309066 - RNA, 64 nt, Human
gaucucucuugucuaguacgcacauaugcacacaggcagacauaccucccaucaugacaugguc

SEQ ID NO: 309067 - RNA, 64 nt, Human
cgccagcccuucauccuuccucccucagcagccaggcagacauaacaacaaaacuacuaaaagg

SEQ ID NO: 309068 - RNA, 64 nt, Human
gguggcagaacuugaaggguuacugacguguaaaugcugguauuugauuuccuguguguguugc

SEQ ID NO: 309069 - RNA, 64 nt, Human
uugaauguagaauuuguuuuugauuucauaauucugcugguaaaugugacaguuaaaauggugc

SEQ ID NO: 309070 - RNA, 64 nt, Human
aaguuagaggcaaauacauagguguagcuuggagugcugguaucuaauauaccauuguauucac

SEQ ID NO: 309071 - RNA, 64 nt, Human
ggauguggaaugucuucuugacaucauuguguauugcugguaaucaaguugguaacgacuacuu

SEQ ID NO: 309072 - RNA, 64 nt, Human
agguaaacuguauuuaaaaccuuugacuugagucugcugguaaagcuucugaauauugaguuug

SEQ ID NO: 309073 - RNA, 64 nt, Human
cucauauuuugaacugcagguguaggacaguguuugcugguaacaacuccaauguguauuaaua

SEQ ID NO: 309074 - RNA, 64 nt, Human
aaccccucuuucagcuucuaugugguguuggaggugcugguaucguguucacacaagauccugg

SEQ ID NO: 309075 - RNA, 64 nt, Human
aguuaagccaagccccccaacauguauuccaucgugcugguagaagagucuuugcuguugcucc

SEQ ID NO: 309076 - RNA, 64 nt, Human
ggaucugaggccuuucccuugccauagaaaugguugcugguagcaguagagagcacugugcacc

SEQ ID NO: 309077 - RNA, 64 nt, Human
uuugucuuggcuuaaucccuaaagaacccaguucugcugguaucgaauaguucagcuugguugu

SEQ ID NO: 309078 - RNA, 64 nt, Human
caauuguauuuggcuuuuuuuugcacuguuucaaugcugguaauugaaaccauuuuaauauauu

SEQ ID NO: 309079 - RNA, 64 nt, Human
ucaggccuuguugcaucucagauaaaccugugacugcugguaaaauaaugucccaagccuuucc

SEQ ID NO: 309080 - RNA, 64 nt, Human
accucuucugcaccgccuggcuaccucacuccucugcugguagcagugccuauagcuggaccua

SEQ ID NO: 309081 - RNA, 64 nt, Human
ccagggaagagggagaauuaauuuauugugcaaaugcugguauuucuuacaugauuuuuuguuu

SEQ ID NO: 309082 - RNA, 64 nt, Human
gaaaucuguacuguaugaaagcuacacaaaaaugggcagacauuugguuaauugugccagauac

SEQ ID NO: 309083 - RNA, 64 nt, Human
ucagccaccacugugccauggugacacaggccaaggcagacauuggcccucccuucucccagcc

SEQ ID NO: 309084 - RNA, 64 nt, Human
cgagccaguguggcugagugaccggggugugcccggcagacacagcaggacagggcucuaugug

SEQ ID NO: 309085 - RNA, 64 nt, Human
aaauacuuuuucaguuguuuagaucuuaggcaugugcugguauccacaguuaauucccugcuaa

SEQ ID NO: 309086 - RNA, 64 nt, Human
ugagaaacaaauuuugugagaauagguaguggguugcugguaguuaauuggauuuaauauuugu

SEQ ID NO: 309087 - RNA, 64 nt, Human
augcaguccagaauaagugcuguuugagaugugaugcugguaccacuggaaucgaucuguacug

SEQ ID NO: 309088 - RNA, 64 nt, Human
gcacuaccuugugccucucagauugcugaagugcugcugguaagcaugugcaugcucugccuuu

SEQ ID NO: 309089 - RNA, 64 nt, Human
auccaggggcuugugccuugguuucuccuuugauugcugguaaauucugaggccacagagaaau

SEQ ID NO: 309090 - RNA, 64 nt, Human
cagagauuuuagauucuuuucugguuagaaacauugcugguaguuggauuauauuuuuauugua

SEQ ID NO: 309091 - RNA, 64 nt, Human
uuagaaauggcaguaagcccaaaaggaagaauuaugcugguaguaaaugggacucugagucaaa

SEQ ID NO: 309092 - RNA, 64 nt, Human
uugggggcagaguccuaggaugaggcuugggcagugcugguaggguuucaaggugcuauuagug

SEQ ID NO: 309093 - RNA, 64 nt, Human
ggccucccuguuugaagccugcccuugucugagaugcugguaauggccaugguacccccuucug

SEQ ID NO: 309094 - RNA, 64 nt, Human
gccacucuuuggucagccugcugacaaauuuaagugcugguaccugugguggcaguggcuugcu

SEQ ID NO: 309095 - RNA, 64 nt, Human
uauuuuugucaguuacaguccuagauauacuuacugcugguacaguuguacucuaagauuggua

SEQ ID NO: 309096 - RNA, 64 nt, Human
gguaguaaacacuuaaccaguggaauagucugacugcugguacugauggcaucagaagaaaaca

SEQ ID NO: 309097 - RNA, 64 nt, Human
ucaaagaaguaaggagguaagauugccacgugccugcugguacugugaugcauuucaaguggca

SEQ ID NO: 309098 - RNA, 64 nt, Human
ucauuuuguacuacaugaagaacuguuuuuugccugcugguacauuacauuuccggaggcuugg

SEQ ID NO: 309099 - RNA, 64 nt, Human
aacgaaaggugguuaacacgugaccaauccccauggcagacagcgggcuggugaacaggaagag

SEQ ID NO: 309100 - RNA, 64 nt, Human
gcaccacuccuuccccaggguuuaagagauugggggcagacagggacuuuccucugccggcugc

SEQ ID NO: 309101 - RNA, 64 nt, Human
aauugucgaaggucucccaggagcucuguacugaggcagacacagaaagacacaaaacggucgu

SEQ ID NO: 309102 - RNA, 64 nt, Human
auuuuaggagauuauauugguucugccucuggcaugcugguagacuagggccauccuaacuuau

SEQ ID NO: 309103 - RNA, 64 nt, Human
ucagguuguuuuuagcacaaguuucucuuuuuuaugcugguauucucacugccacauuuuugga

SEQ ID NO: 309104 - RNA, 64 nt, Human
ugacucuuaaaguagucuuacuuguuuuuuaaaaugcugguauuaaacuaaauggacuccuuuc

SEQ ID NO: 309105 - RNA, 64 nt, Human
ggaaaaguuacuggugguaccuugcugccugcucugcugguagaauucugugcuccccgugaca

SEQ ID NO: 309106 - RNA, 64 nt, Human
accuaccccugcccuugcuaaacuuaauaauaaaugcugguauauccagugcauuguuggcacc

SEQ ID NO: 309107 - RNA, 64 nt, Human
aagaagaagugaccaaguucucuuuuguguuuucugcugguauucuggaggugggaaggacuug

SEQ ID NO: 309108 - RNA, 64 nt, Human
ggaguuacugugaagaaguuuucacaacuauuuaugcugguaaaacaaaugcuguuaaaucacc

SEQ ID NO: 309109 - RNA, 64 nt, Human
ggggugggcuguggggagauugcuuuuguuuuccugcugguaauaucgggaaagauuuuaauga

SEQ ID NO: 309110 - RNA, 64 nt, Human
cauuagacugcacuaaauuaacaagcauguuaguugcugguagagguuuuggagguuaauuuac

SEQ ID NO: 309111 - RNA, 64 nt, Human
ggggcuggguaccaaugcugcaggucaacagcuaugcugguaggcuccugccaguguggaacca

SEQ ID NO: 309112 - RNA, 64 nt, Human
acucccuaugcccaggccugcccggugcccacccugcugguaggagccagcggcucuggccaag

SEQ ID NO: 309113 - RNA, 64 nt, Human
aaggcaaggaagggagggguagugucuggggcagugcugguagccugcauguguuguaaaucau

SEQ ID NO: 309114 - RNA, 64 nt, Human
gauggugccuucuauuaauacaucauuccagucuugcugguaauuuuguacaguauaguguaug

SEQ ID NO: 309115 - RNA, 64 nt, Human
uaaacccuuguauaguaauuuuguuguuguugggugcugguagcuccagaauuuugugaccacu

SEQ ID NO: 309116 - RNA, 64 nt, Human
cacagaugccaucauuucccuuuccccucugaauggcagacaucaguaaucaaucuggaauguu

SEQ ID NO: 309117 - RNA, 64 nt, Human
cuguaguauucaguaaugugucugcuccuuguugggcagacaccagcggugugcagggagagac

SEQ ID NO: 309118 - RNA, 64 nt, Human
ugccaccaacaacccuccccucaccccugccaggggcagacaggcuucucagcagaacugugac

SEQ ID NO: 309119 - RNA, 64 nt, Human
uagaaagaaauguaucuuagcaucugaaugauuuugcugguaauaauauuauccacagauuugc

SEQ ID NO: 309120 - RNA, 64 nt, Human
uaaaaauacaaaauuagcugggcaugguggcacaugcugguaaucucagcuauugaggaggcug

SEQ ID NO: 309121 - RNA, 64 nt, Human
ccucugauggacaggucagagugaaggaagguugugcugguaagacaucucugacgaagagcca

SEQ ID NO: 309122 - RNA, 64 nt, Human
aacuuucccuuucccaauuuauaaauaaucugucugcugguacgacagacauaaaucucuacuc

SEQ ID NO: 309123 - RNA, 64 nt, Human
agaugcauauguguauauauaaugaaauuuauguugcugguauuuugcauuuuaaagugaucaa

SEQ ID NO: 309124 - RNA, 64 nt, Human
ccucacuauucaaguauuagggguaauauauugcugcugguaauuuguaucugaaggagauuuu

SEQ ID NO: 309125 - RNA, 64 nt, Human
acugagucguucccuggccagaggacauaaauggugcugguaggagguuaucagaguaaggaag

SEQ ID NO: 309126 - RNA, 64 nt, Human
acgaggaccaauaauucucucacacuggcauuugugcugguaguacaaguccuuuaauaugucc

SEQ ID NO: 309127 - RNA, 64 nt, Human
guggcuuuuucuuuuuuguacguguacaggauucugcugguacgagaggccuuccucuuucugu

SEQ ID NO: 309128 - RNA, 64 nt, Human
ugcauccuauuaccacaauggggugugcuauaacugcugguauuagagagggaacuuuggcccu

SEQ ID NO: 309129 - RNA, 64 nt, Human
auuuguagccauuuuuaaaaguuuuugucuucagugcugguaagucagguaaaccauaaauagu

SEQ ID NO: 309130 - RNA, 64 nt, Human
ugucuucaaaacauaaauuuauaagaaccauaagugcugguauuuauucacuuccccauuacga

SEQ ID NO: 309131 - RNA, 64 nt, Human
uuugccuuuugcucuuacuauguuucugugaucuugcugguagaauuguaucugugcauugaug

SEQ ID NO: 309132 - RNA, 64 nt, Human
ugaccccuuugcagguuugggcggcggcgucugcugcugguagccuacgugaguacccuggugc

SEQ ID NO: 309133 - RNA, 64 nt, Human
ccauuuacgauucucacugacuccccgucuuccuggcagacacaaauaaacccagugucagguc

SEQ ID NO: 309134 - RNA, 64 nt, Human
cacugaacuuggccacaggccccaaguuuccucuggcagacaugcugcacgucuguacccuucu

SEQ ID NO: 309135 - RNA, 64 nt, Human
accuagaagccugcccacgauuccuaggaaggcuggcagacacccuggaacccuggggagcuac

SEQ ID NO: 309136 - RNA, 64 nt, Human
cacuuuaauggguuuuuuaaaaaucuguggagguugcugguacacaccaaaugaguccaaacug

SEQ ID NO: 309137 - RNA, 64 nt, Human
uuuaaaaaauaaauacaauuccuaaggcaauaucugcugguaagucaagcugauaaacacucag

SEQ ID NO: 309138 - RNA, 64 nt, Human
gccguaggaucgcgcaacccuuuguguguguggcugcugguacgugugaucuuugaaaaccuug

SEQ ID NO: 309139 - RNA, 64 nt, Human
aggauggagucugcugcagacccauuggauuugcugcugguaacaguuccaccauuuagguucc

SEQ ID NO: 309140 - RNA, 64 nt, Human
uugucugagggccucauuaggcccagacugcugcugcugguaccagucuccugagacacugccu

SEQ ID NO: 309141 - RNA, 64 nt, Human
cuugaggcgcacuuuuuauaaucaagccucaucuugcugguaucaugggaacuccagccugcua

SEQ ID NO: 309142 - RNA, 64 nt, Human
ccacucugaacuaagcagaugccaucugcagaagugcugguagcauaaggaggaucgggucaua

SEQ ID NO: 309143 - RNA, 64 nt, Human
uacuucaaugggcucuuccaacaaggaagaagcuugcugguagcacuugcuacccugaguucau

SEQ ID NO: 309144 - RNA, 64 nt, Human
ucaucuuggaaaagguuagucuuucaguacacguugcugguaaguaguuuccaaguuacguguu

SEQ ID NO: 309145 - RNA, 64 nt, Human
cucagcaaagccuugcucucuggagcuuacuaugugcugguacuuaaagaguacauucugccuu

SEQ ID NO: 309146 - RNA, 64 nt, Human
uacauuccaauacauuaucaagcaagcacaaguaugcugguaguagccucuuuaaauaauaugu

SEQ ID NO: 309147 - RNA, 64 nt, Human
aaaaauauaaaaauuagccaggcaugauggcacaugcugguaauagcagcuacugagguggcug

SEQ ID NO: 309148 - RNA, 64 nt, Human
uaucucugaaacauuuuuauaucaaaaaucagauugcugguagguguguuguuuugaaguguuu

SEQ ID NO: 309149 - RNA, 64 nt, Human
ccaaaauaccacuaguggaaagucaggcuagcugugcugguauuggaauagcagccucacacug

SEQ ID NO: 309150 - RNA, 64 nt, Human
gggccugaaaagaggggcugcccuccugcgccaaggcagacacaagcugcgggcugugcggucc

SEQ ID NO: 309151 - RNA, 64 nt, Human
gcaggaccaccugcgucuggcacccaggaggugaggcagacaccaugguuaggugauagggucu

SEQ ID NO: 309152 - RNA, 64 nt, Human
ccugguggcuuugccagaagggagccagaaguggggcagacauggagccccucccuuggucaga

SEQ ID NO: 309153 - RNA, 64 nt, Human
agcuucugaaaagcccacugaaaauugccuguccugcugguaacugcuacgggguaagauuugc

SEQ ID NO: 309154 - RNA, 64 nt, Human
acauuuauauagcauugaaacacuuucaaacuccugcugguaguaaaaggggauuuaaaaauag

SEQ ID NO: 309155 - RNA, 64 nt, Human
cuucacgucccuggaccuguaccgcagccgccugugcugguacgacuauguggagguccgagau

SEQ ID NO: 309156 - RNA, 64 nt, Human
uauuuuauuuuccaggcuaaagcaaaugaaaguuugcugguaucaacacagccugccauauuuu

SEQ ID NO: 309157 - RNA, 64 nt, Human
ggaucaugaaaccugagaaaugcuaauggagauuugcugguacauaggaaucuagcaaauucag

SEQ ID NO: 309158 - RNA, 64 nt, Human
aaacuguugguggcccugaauccaucugaccagcugcugguaucugccaggacuggcaguucug

SEQ ID NO: 309159 - RNA, 64 nt, Human
ggagacuguggcccugcaacccuggagaaggacuugcugguacuuaaaaaaugggacauuugcc

SEQ ID NO: 309160 - RNA, 64 nt, Human
aguucacauacacuggaagcggugguaaaaaucuugcugguaacaaaagaauuggugcaccuuc

SEQ ID NO: 309161 - RNA, 64 nt, Human
gcggucauuagcaaaguaacuaaauaaaauacagugcugguagucaaaauuaagcacacucuac

SEQ ID NO: 309162 - RNA, 64 nt, Human
aagaugaagccacccucagguccagggaagguugugcugguauuuggcucaugacagccaagag

SEQ ID NO: 309163 - RNA, 64 nt, Human
acccccauucuuuccaagucagauagucuucugcugcugguaccugggugggcaauggccacca

SEQ ID NO: 309164 - RNA, 64 nt, Human
uauaucauaacuuauugaacuuuugagcaggacgugcugguaauuucauggcuguuacugccca

SEQ ID NO: 309165 - RNA, 64 nt, Human
caugcuuccagccugcagaacacagaaugaaacaugcugguagacuccacgagggcagggccuc

SEQ ID NO: 309166 - RNA, 64 nt, Human
ugaguuugugucugagaccuaucccgacuaucguugcugguagagccugggcuugcugugccaa

SEQ ID NO: 309167 - RNA, 64 nt, Human
auaagcuucggcaguaucacaagaagauuaaaguggcagacaccccuuccagcggaaguuacua

SEQ ID NO: 309168 - RNA, 64 nt, Human
gccccugagcugagcacagggccaaagcagccauggcagacaccugacggagggcacggggcug

SEQ ID NO: 309169 - RNA, 64 nt, Human
caugaaggacaguaugcuucaaauugucuuuugaggcagacauguucucaguacuaaaagacau

SEQ ID NO: 309170 - RNA, 64 nt, Human
gugacuccuaaaaucugagacaggacaucgugacugcugguaguaauaugguggugcauuguuu

SEQ ID NO: 309171 - RNA, 64 nt, Human
gacucucccugauaguuuaguuuuugauaaagcaugcugguaaaaccacuacccucagagagag

SEQ ID NO: 309172 - RNA, 64 nt, Human
cuuucuucugagaaaugcugcagucagaagggugugcugguaaaguauuuugguggcagcugcc

SEQ ID NO: 309173 - RNA, 64 nt, Human
augagagaaaauaaagcagcugaggauacaaaugugcugguagggagcgauauucaagauauau

SEQ ID NO: 309174 - RNA, 64 nt, Human
ccccccccaccccccgcccugcccacagagcaccugcugguaacccugggccuauugaaagcag

SEQ ID NO: 309175 - RNA, 64 nt, Human
gccuuuuuaaugaauguacuugucuuggauagguugcugguaaaccauuuuaaacuauuuuuua

SEQ ID NO: 309176 - RNA, 64 nt, Human
ccacuaccucuuauuuauuugguguuugcuugaaugcugguacuauugugaccacaggcuggug

SEQ ID NO: 309177 - RNA, 64 nt, Human
guauauggucaaguccaagaaaucgauguuaccuugcugguagauagagacuuagucagauuuu

SEQ ID NO: 309178 - RNA, 64 nt, Human
gaugccugggaaggaacaucucccuuccagcaucugcugguagcaggcugggacagucccuucc

SEQ ID NO: 309179 - RNA, 64 nt, Human
cuguugaccugugcaccuaccccuuggaaaugucugcugguauuucuaauuccacaggucauca

SEQ ID NO: 309180 - RNA, 64 nt, Human
guuaagauaggauuuuauguuagagauaccagaaugcugguauucuacuacuugugcaauauau

SEQ ID NO: 309181 - RNA, 64 nt, Human
aagaauguguauuuacaauauuugccauguuaagugcugguaauuauaugguuauaugugccau

SEQ ID NO: 309182 - RNA, 64 nt, Human
cucagcacaggagggguggaggggaaaugagaguugcugguagcaggcucccuccuucugcagc

SEQ ID NO: 309183 - RNA, 64 nt, Human
cagcugugaaccuuauucuuguacuuuucuuucuugcugguaauuuuauggagcagguuaagaa

SEQ ID NO: 309184 - RNA, 64 nt, Human
auguguauauaagagguuauugauaaacuucugaggcagacauuugucucgcuuuuuuucauuu

SEQ ID NO: 309185 - RNA, 64 nt, Human
uuaauacugggugaugugugaauauuuguuuguuggcagacagggucucacuuugucacccagg

SEQ ID NO: 309186 - RNA, 64 nt, Human
cauuuauuuuaucaauaccaauuuuuguggccauggcagacauugcuaaucaaucacagcacua

SEQ ID NO: 309187 - RNA, 64 nt, Human
caucccaucuaugcugucaagggcugcugguuggugcugguacaaggagcccacucagcaguuu

SEQ ID NO: 309188 - RNA, 64 nt, Human
auccgagcugcccucaguguuccccaaggccgcgugcugguacacugugccauggggguaagcc

SEQ ID NO: 309189 - RNA, 64 nt, Human
auuuuucuacugucaaauauguaccuuuucuucaugcugguauuuuuucaauaguaauguagcc

SEQ ID NO: 309190 - RNA, 64 nt, Human
auccaaauuguuaucuaaagaugauucuagguguugcugguaguaugugaaucuuccaaucuag

SEQ ID NO: 309191 - RNA, 64 nt, Human
caaugaauaagugguuccuuaggacucacucaggugcugguacugacccacuaaucugccauag

SEQ ID NO: 309192 - RNA, 64 nt, Human
guuaaaugcugcuauacaacugcuuugcaacaguugcugguauauuuaaaucauuaaauuucag

SEQ ID NO: 309193 - RNA, 64 nt, Human
ggagcugagaagaggaggaggugggggcuggaggugcugguagcugaggggacgggcaagugag

SEQ ID NO: 309194 - RNA, 64 nt, Human
ugagauuucccaguuuaggugauggccagucaugugcugguaaauguuaagccauuuaacugga

SEQ ID NO: 309195 - RNA, 64 nt, Human
acucaaaguaauguccagguucccagagaauaucugcugguauuuuucuguaaagaccauuugc

SEQ ID NO: 309196 - RNA, 64 nt, Human
gccugaucccccgcucccuccucccugccuucucugcugguacccaguccuaaaauauugcugc

SEQ ID NO: 309197 - RNA, 64 nt, Human
uccugugagggcuaucaguuguugccuucuagcuugcugguaacuuuggcgccuccgccaagcc

SEQ ID NO: 309198 - RNA, 64 nt, Human
gaggaccuuuuaaaaaaaucaaguuucuauuuuuugcugguaguccgcauacccauacccucug

SEQ ID NO: 309199 - RNA, 64 nt, Human
caucacugggaguguccuuaguguauaaaaaccaugcugguauauggcuucaaguuguaaaaau

SEQ ID NO: 309200 - RNA, 64 nt, Human
gacaaaacucagugaagggugaguagaccuccauugcugguaggcugaugccgcguccacuacu

SEQ ID NO: 309201 - RNA, 64 nt, Human
gcaucauuaacaccuuccccacccccuccccccaggcagacagugaagagaaucagaaaacaug

SEQ ID NO: 309202 - RNA, 64 nt, Human
gguggcggggagcagauagugcugccucccugcgggcagacaggagaggaaccucaacucaguc

SEQ ID NO: 309203 - RNA, 64 nt, Human
accccaggcagaccgauaaaaagaccuccagauaggcagacagacagauggaccaccaaccugg

SEQ ID NO: 309204 - RNA, 64 nt, Human
uggguggcgguggcggggccucacgacagcuuggugcugguaagaggaagcccgugguucuggc

SEQ ID NO: 309205 - RNA, 64 nt, Human
cuucacuguucaccugcuacaaguaagaguuuggugcugguagaaacauuugacucugaugucu

SEQ ID NO: 309206 - RNA, 64 nt, Human
gugggugagagccaagaccgcgugggccgcggggugcugguaggagugguuggagagacuugcg

SEQ ID NO: 309207 - RNA, 64 nt, Human
ugccuuaaaaucugaaacaaaaaaagggacaaauugcugguagaucuacugacuguagccauca

SEQ ID NO: 309208 - RNA, 64 nt, Human
aaaauauuuuuuaaagucuauuguuuguugugcuugcugguacuaagaggcuauuuaaaaguau

SEQ ID NO: 309209 - RNA, 64 nt, Human
aggagcagaaacauggaaugccagacgcuggggaugcugguacaaguugugggacugcaugcua

SEQ ID NO: 309210 - RNA, 64 nt, Human
gccaaaacuuguuagcugagcucacguccccugaugcugguaaccugaaagauacgacauugcu

SEQ ID NO: 309211 - RNA, 64 nt, Human
gaccucgugauuggcccaccucagccucccaaagugcugguauuacagaugugagccaccgcac

SEQ ID NO: 309212 - RNA, 64 nt, Human
uccccuacaucgucucacuuugcuuccuauugacugcugguagaaggagauuugggguaggggc

SEQ ID NO: 309213 - RNA, 64 nt, Human
auuccgaguucagggugacacauuuugggacaucugcugguagcccagugcugaaggacuugcu

SEQ ID NO: 309214 - RNA, 64 nt, Human
gguuuuucuuaaugguuauccucuuaaauacaccugcugguacuuggugugguuaaauaggaaa

SEQ ID NO: 309215 - RNA, 64 nt, Human
guuuaguucugucuuuuuucuccuuuuuucuaaaugcugguaaauauuuacauucagccaggga

SEQ ID NO: 309216 - RNA, 64 nt, Human
gguaacagccccaugaaguaccgcuuuaauuccuugcugguaaucuaauagaaucagauuaaga

SEQ ID NO: 309217 - RNA, 64 nt, Human
cuuaaguuggaaaaccagccucuaaaaaauuaggugcugguaaugagagcuuaauaccaugguu

SEQ ID NO: 309218 - RNA, 64 nt, Human
cagacuccuaaccaaccagauggacugccagacaggcagacaucagccacauggaauccugaca

SEQ ID NO: 309219 - RNA, 64 nt, Human
ggggaaaaccacuugagucuugugguguguggugggcagacaccacaggguggcaucaccuggu

SEQ ID NO: 309220 - RNA, 64 nt, Human
uguucggacaggcucugcgugccaggcaacagugggcagacaaagggcucccuggcuacuggga

SEQ ID NO: 309221 - RNA, 64 nt, Human
aauaagcaacucuuagguuugccugacugccuuaugcugguaaagaaaagggauucaacugucu

SEQ ID NO: 309222 - RNA, 64 nt, Human
auacuuuaauuuugcuccaacaagggcuuuauguugcugguaagagaauuuauuuacuaaaugc

SEQ ID NO: 309223 - RNA, 64 nt, Human
uucauuguguuugugguuuaggagcugcugacacugcugguauacacagggccaaaacccacua

SEQ ID NO: 309224 - RNA, 64 nt, Human
ggcgagaguuugcuagucucccuccccggcuuugugcugguauuccacguauuccugcauuaau

SEQ ID NO: 309225 - RNA, 64 nt, Human
gugcuuaggcugcgauccuaugguagcaauucugugcugguauaaaucuuacuuauaaaguagg

SEQ ID NO: 309226 - RNA, 64 nt, Human
cagggcugaagcugccugguauccaggaggggaaugcugguauccccauaugucuguguuuguu

SEQ ID NO: 309227 - RNA, 64 nt, Human
agcucucugcaaagaugauuuugcuuuucccuagugcugguauacuauagagaaaccccugggg

SEQ ID NO: 309228 - RNA, 64 nt, Human
cuucagauuuuguuuacauauuuuacuacauuuuugcugguauaauuccuuagccaccuaugua

SEQ ID NO: 309229 - RNA, 64 nt, Human
gagaugaagggggcuaagcuauggcccaucuguaugcugguagcuagugauuuacacagguuua

SEQ ID NO: 309230 - RNA, 64 nt, Human
agagaguuaaggaauguugcuagaacauagggcuugcugguaccuaugugacuaagaaagggac

SEQ ID NO: 309231 - RNA, 64 nt, Human
gguauuuuggaaauugaaaaacuuaauuuacaagugcugguacaucuuuuuucuuuuguggacc

SEQ ID NO: 309232 - RNA, 64 nt, Human
cucccgggacugggggguuugucuggcauagccaugcugguagcaagagagaaaaaaucaacag

SEQ ID NO: 309233 - RNA, 64 nt, Human
uguauuuauuaccgucacacucuucagugacuccugcugguaccugcccucuauuuauuagcca

SEQ ID NO: 309234 - RNA, 64 nt, Human
gcccccauguugggagaggggaguggauucuugcugcugguaugagacucccugggaccuagag

SEQ ID NO: 309235 - RNA, 64 nt, Human
agagggccugugggcuugcuuuuggaaggccucaggcagacacgugcccucugggugaugucug

SEQ ID NO: 309236 - RNA, 64 nt, Human
uaguuuuggguuuuuuuuuuuuuuuuacguaaguggcagacacuuuauugcacaugaaauuugu

SEQ ID NO: 309237 - RNA, 64 nt, Human
agagcccccaaccuuuucucucugccuucaagaaggcagacauuugguaugauuuagcaucaac

SEQ ID NO: 309238 - RNA, 64 nt, Human
gccuugucuccacccaugacucacuacaaccuugugcugguaagguccuagcaucuuccccuca

SEQ ID NO: 309239 - RNA, 64 nt, Human
aaaacuuuuuuugauguaauauaaccuaacguugugcugguaccuguuuuaccauguguaauuu

SEQ ID NO: 309240 - RNA, 64 nt, Human
caaauuguugauugaaagacugaucauaaaccaaugcugguauugcaccuucuggaacuauggg

SEQ ID NO: 309241 - RNA, 64 nt, Human
ugaugccugagaacccucuccuagcacugucaaaugcugguauugaauggggacugaggauggg

SEQ ID NO: 309242 - RNA, 64 nt, Human
ugaggaccaaucuuuuuuaaaucaaaagggauguugcugguaucagaauuguuauugcuucauu

SEQ ID NO: 309243 - RNA, 64 nt, Human
uaugugguagagcacuugauuucaguugaaugccugcugguagcuuuuccauucuguggagcug

SEQ ID NO: 309244 - RNA, 64 nt, Human
uggcauuuuauugcucaggcaauaauugguuuaaugcugguagugucaaauuuugaaguguuaa

SEQ ID NO: 309245 - RNA, 64 nt, Human
uuauuugcuuaacacagguuuuauuuugucuuuuugcugguagauuauacaagggacaacuuua

SEQ ID NO: 309246 - RNA, 64 nt, Human
uugugcaacuccauggucuuucugggccuuacugugcugguauaauuaaaauaaaauauauuuu

SEQ ID NO: 309247 - RNA, 64 nt, Human
uucagugagagcagaacccccauuccccagccucugcugguagcaugucgcaguuuccaugugu

SEQ ID NO: 309248 - RNA, 64 nt, Human
uccguuacuggccaagggcucuguagaaucacggugcugguacaggaugcaggaauaaauugua

SEQ ID NO: 309249 - RNA, 64 nt, Human
gaacuugcuguauaaaggaauuucauggcaacaaugcugguaagggcaauuagccucgcuuaag

SEQ ID NO: 309250 - RNA, 64 nt, Human
uuguacauagaagucauagaugcagaagugguucugcugguacgauuugauuccuguuggaaug

SEQ ID NO: 309251 - RNA, 64 nt, Human
caaguuacaaaucacuguguccauagaaaaacugugcugguauuugcuggacaaaggguugggc

SEQ ID NO: 309252 - RNA, 64 nt, Human
ugagaagacggugaaaugauguaaugacagagaaggcagacaacauguuuccgugacucaucua

SEQ ID NO: 309253 - RNA, 64 nt, Human
gcugaaucauuuacauuuugacuccauagcuuagggcagacagaagccuguauggcuucugccc

SEQ ID NO: 309254 - RNA, 64 nt, Human
cagaccuccuaggccugauuguccugccagggugggcagacagacagauggaccggcccacacu

SEQ ID NO: 309255 - RNA, 64 nt, Human
aacucuguuuuggaguggcaaaaccaguuccaccugcugguagggguagguuggcucccaacac

SEQ ID NO: 309256 - RNA, 64 nt, Human
gccuacauuagcauauuucucauguaauguauuuugcugguaagcucauccauuagcugcgucc

SEQ ID NO: 309257 - RNA, 64 nt, Human
ugcugcaaugcaauuaaagcaauugauuuucuagugcugguauuuguugacuaccaugcagaag

SEQ ID NO: 309258 - RNA, 64 nt, Human
agacuacugaaaaguauuauuuuguaacuaagauugcugguacuauuaggaaaaaucugugugu

SEQ ID NO: 309259 - RNA, 64 nt, Human
accaaaacugcaugauacugguacaaaagcauggugcugguacaaaagcagacacauagaucaa

SEQ ID NO: 309260 - RNA, 64 nt, Human
ugacgauugcucucuugcacucaaggacauuugaugcugguaguauggauuaugagauggacua

SEQ ID NO: 309261 - RNA, 64 nt, Human
auauuuuaaaacucuucguaauucuaauguguacugcugguauagcugaacuacugaccuggau

SEQ ID NO: 309262 - RNA, 64 nt, Human
ucucaaaaaaaaaacaaaacaaaaaaaaccucuuugcugguauauuugaagagcuugggaugga

SEQ ID NO: 309263 - RNA, 64 nt, Human
guaacuaaaagaaccauaguaccucacaucacagugcugguagaaauggaacuaaaccacaguc

SEQ ID NO: 309264 - RNA, 64 nt, Human
gagcauuuucucaacucgacucucauuucuucccugcugguaaaauagaaacagggauuuaaac

SEQ ID NO: 309265 - RNA, 64 nt, Human
caguccgucaggaauuuuguagaagggcuucaugugcugguaccaauaggacaggaagauuuua

SEQ ID NO: 309266 - RNA, 64 nt, Human
ucaguuggacccucaagagucacugcuuugucugugcugguaguuugugagaagugacccgcac

SEQ ID NO: 309267 - RNA, 64 nt, Human
cuuauugcagcagccuacugagaacuuugacuguugcugguaaauuagaagcuacaauaauaau

SEQ ID NO: 309268 - RNA, 64 nt, Human
gcaccagaggugcuucugccugugcagcgggugcugcugguaacaguggcugcuucucucucuc

SEQ ID NO: 309269 - RNA, 64 nt, Human
uacauacgcagccauugucucuguuuuuacccauggcagacauugcuaaucaauggcagcucua

SEQ ID NO: 309270 - RNA, 64 nt, Human
gccuuuugaagaagagcccgcauaaugaguggacggcagacagcuauauuuaguggugccucga

SEQ ID NO: 309271 - RNA, 64 nt, Human
caaauacccggcauuauggggacagagagcagggggcagacagcaccccuggaguccuccuagc

SEQ ID NO: 309272 - RNA, 64 nt, Human
cccggcagcgccaaccccugcuuggcuguuauggugcugguaauaagccucgcagcccaggucc

SEQ ID NO: 309273 - RNA, 64 nt, Human
uccaacuccgcugaaauguugcugaaaagcauggugcugguaacaguucaacaauccguggcug

SEQ ID NO: 309274 - RNA, 64 nt, Human
ggucuuuaguaaugcaucuggguagcaucucaacugcugguagcauuuaucugacuuggaaagu

SEQ ID NO: 309275 - RNA, 64 nt, Human
acuucauuagggccccaaagcaccagaguagugaugcugguagugaugcuggcuguucggauau

SEQ ID NO: 309276 - RNA, 64 nt, Human
guaagaaaaauauuguauuuuuaaucauucauagugcugguaaaaaaaaaaaaaaaaaaaaaaa

SEQ ID NO: 309277 - RNA, 64 nt, Human
ucugccccacgcacgcacccguaucugcccuccuugcugguagaagcugaagagcacggucccc

SEQ ID NO: 309278 - RNA, 64 nt, Human
cuugcgugggucaguucuuucugaguagaggacuugcugguaaaggggcagaugcuuuuuauua

SEQ ID NO: 309279 - RNA, 64 nt, Human
acugaacuuggcccgugucugcuacucuguaccuugcugguacagacagggguggugggcagcc

SEQ ID NO: 309280 - RNA, 64 nt, Human
aacuugccuaagaccacacaggaguaaguagcagugcugguauuugaaccaggcauccuggcuc

SEQ ID NO: 309281 - RNA, 64 nt, Human
uaauuucagauaguguccuaggauccuuugagggugcugguagcaggugagcaggacaaaguug

SEQ ID NO: 309282 - RNA, 64 nt, Human
ccagggcacugcgacuuugugaagcugaggacaaugcugguacguacccacaugcaggaccuga

SEQ ID NO: 309283 - RNA, 64 nt, Human
gauauuguggcggaaagucuagacugaguguguaugcugguaaacuguagacuuuuuuuuuuuu

SEQ ID NO: 309284 - RNA, 64 nt, Human
uucugaaauccaggcagcaggcuggaauaaacgcugcugguaugucuguauuggcuacuguucu

SEQ ID NO: 309285 - RNA, 64 nt, Human
ucuuucugugcuuggauuugcauauuuauugcauugcugguagagacccccaggccuguccacc

SEQ ID NO: 309286 - RNA, 64 nt, Human
agaggaggaagauaaaugcccggagauuccaaguggcagacauuucccuuucaauuuauggccc

SEQ ID NO: 309287 - RNA, 64 nt, Human
uugugacauaauuauuuaacccagaauacuuucuggcagacauacagaaagcucugugugauca

SEQ ID NO: 309288 - RNA, 64 nt, Human
ucacuucucuuuaauauuuuuccuccaacuggagggcagacaauuuucugacuugcuuuucucu

SEQ ID NO: 309289 - RNA, 64 nt, Human
auuauugcuacuaucaagagggcugggcauucucugcugguaauuccugaagaggcaugacugc

SEQ ID NO: 309290 - RNA, 64 nt, Human
ggaggugugauuuguuuacaugcaccuuuguuccugcugguagugaccuuguucuugauucagc

SEQ ID NO: 309291 - RNA, 64 nt, Human
uguugccacucauauuguaagucaguuuuuucauugcugguacaaugacucaguauuucuuuau

SEQ ID NO: 309292 - RNA, 64 nt, Human
guggcucaaacauuguugaacaucggggaauuuaugcugguaggaaacuuucaaaugugaagaa

SEQ ID NO: 309293 - RNA, 58 nt, Human
agcugaaagugccuuccugagauggcagugcugguacccacugcccacccuggcugcc

SEQ ID NO: 309294 - RNA, 64 nt, Human
ucacuuuugacuggcgcagucagaaccgcgcuccugcugguauccgccccugagccccaggagc

SEQ ID NO: 309295 - RNA, 64 nt, Human
uacauauaacaggaaaaaauauuaaaauaaacagugcugguaaguaugaagcugacauucuaaa

SEQ ID NO: 309296 - RNA, 64 nt, Human
augaccuaucaugaggaaaugaaaguggcugauuugcugguaggauuuuguacaguuuagagaa

SEQ ID NO: 309297 - RNA, 64 nt, Human
uuguugggggaggggagacuuugaugucagcaguugcugguaaaaugaagaauuuaaagaaaaa

SEQ ID NO: 309298 - RNA, 64 nt, Human
cacccacaaggaauuuuccuaucacugugaacuuugcugguacagaggaauaauaucugccuuc

SEQ ID NO: 309299 - RNA, 64 nt, Human
aaccggaaaugugaagacccucgacaucuugaauugcugguagaguaugugaggaaacagguga

SEQ ID NO: 309300 - RNA, 64 nt, Human
uugaaucugccaaguacauuuacaaaaacacggaugcugguauuuuaacagauggagagacaag

SEQ ID NO: 309301 - RNA, 64 nt, Human
gucuacaauggaaaaaaagcagugaagcauuagaugcugguaaaagcuagaggagacacaauga

SEQ ID NO: 309302 - RNA, 64 nt, Human
gucacuuuuauguuauaaacuugaauuuauaaagugcugguaaauuauuuuuaaugauuugagu

SEQ ID NO: 309303 - RNA, 64 nt, Human
gucgaggcugguaagggaccuucagggagagcugggcagacaggugggagauggagguagggcu

SEQ ID NO: 309304 - RNA, 64 nt, Human
ugagaaagacaucugaggaaaauggaagaccuaaggcagacaggaaggaagcacaaaagacaag

SEQ ID NO: 309305 - RNA, 64 nt, Human
gaauaugaaauacaugugcauauuucauuccccaggcagacauuuuuuagaaaucaauacaugc

SEQ ID NO: 309306 - RNA, 64 nt, Human
cucccccggcacacuuagugacagugaugcucugugcugguaccaaacaaggcagacuugcaag

SEQ ID NO: 309307 - RNA, 64 nt, Human
uugcacacguaaaccuaggcuggucuacacgcagugcugguacgucaaggagccuaaacacccu

SEQ ID NO: 309308 - RNA, 64 nt, Human
aacuuuggguugggaaugagaucuagguuguggcugcugguaugcuucagcuugcuggcaauga

SEQ ID NO: 309309 - RNA, 64 nt, Human
cucuuggugcuuaugugugugggcuugggacgagugcugguaugcacuuaggaccuucuugaua

SEQ ID NO: 309310 - RNA, 64 nt, Human
ucccaagaggagcagagaaaacuggaagaagauuugcugguagaagucagucggugaggaagga

SEQ ID NO: 309311 - RNA, 64 nt, Human
cuaaauguauucugccuucagaccaucuaguaccugcugguacucugaacaaguauauaaggua

SEQ ID NO: 309312 - RNA, 64 nt, Human
uuucccuccacuuaaaacuaaagccuguucuugcugcugguaaucucccuguagcguaaacaua

SEQ ID NO: 309313 - RNA, 64 nt, Human
aacacuauccaugcauuacuuacugguaauuaccugcugguauauaauuccauguagccuuuaa

SEQ ID NO: 309314 - RNA, 64 nt, Human
gccauggcaaaucugaguggcuucucuaagcaucugcugguacaagucaauguggcaccaugag

SEQ ID NO: 309315 - RNA, 64 nt, Human
ucaugccuguaaucccagcauuuugggaggcucaggcagacaaaucgcucuagcucagaaguug

SEQ ID NO: 309316 - RNA, 64 nt, Human
agaaccuggacauuggccagaagaagcuuaagugggcagacacuguuugcccaguguuugugca

SEQ ID NO: 309317 - RNA, 64 nt, Human
cuccugggucguccgccacggguugcacugccguggcagacagcuggacuugagcagagggaac

SEQ ID NO: 309318 - RNA, 64 nt, Human
cagcguagcaugucugauuugccaccuggaugaaggcagacaucaacaugggucagcacguuca

SEQ ID NO: 309319 - RNA, 64 nt, Human
cggggcucacucagccuggcagaggaagaaggaaggcagacaucuccgcagccacuccugggcc

SEQ ID NO: 309320 - RNA, 64 nt, Human
aggugugccgcaaauauuugacgaauagauggauggcagacauuaacugcgugccuggcccuau

SEQ ID NO: 309321 - RNA, 64 nt, Human
agcccacuggaggcgccgccccacccggcccacuggcagacacagacccaggcagcaccaggcc

SEQ ID NO: 309322 - RNA, 64 nt, Human
auuggcccuuuggcucuugcccuuggcucccuugggcagacagcaggcuuaggccauugauauc

SEQ ID NO: 309323 - RNA, 64 nt, Human
caaagacgugucauuucugccuuuguuugggacaggcagacaggcugaggaagucaccagugau

SEQ ID NO: 309324 - RNA, 64 nt, Human
ugggucuuccccagcauuaaguaaaucagucucaggcagacagcccuuuauagguguuugggcc

SEQ ID NO: 309325 - RNA, 64 nt, Human
ugccccaaagguauggggaagcaaccccagagcaggcagacaucagaggccagagugccuagcc

SEQ ID NO: 309326 - RNA, 62 nt, Human
aacccuacugugucaugugaagcaggcugguaggcagacaggcagagagaaggucauggcca

SEQ ID NO: 309327 - RNA, 64 nt, Human
uuaauucccuccugcccauaucccuacaggcgacggcagacagugcaauggcccuccugccacu

SEQ ID NO: 309328 - RNA, 64 nt, Human
gccucgcugaagggagcucgaggccuggaucuagggcagacacacaaccuccuccuccucuucc

SEQ ID NO: 309329 - RNA, 64 nt, Human
uaaauguccauucuuuaucaagggccuacuuuauggcagacauugugcuagugcuuuuauucua

SEQ ID NO: 309330 - RNA, 64 nt, Human
ccuuugagcaaguuaggaaaagaugcccccacugggcagacacagcccuaugggcucaugguuu

SEQ ID NO: 309331 - RNA, 64 nt, Human
ggugccccuuaggcuuggagagccccagauuggaggcagacagacugcaccaccccuucccccc

SEQ ID NO: 309332 - RNA, 64 nt, Human
uccgaaaugcugucuuucuugcucccugacugggggcagacaugguggggucuccucaggacca

SEQ ID NO: 309333 - RNA, 64 nt, Human
agaagccccuggaaggcagaaaaguugggagcauggcagacagggaagggaaacauuuucaggg

SEQ ID NO: 309334 - RNA, 64 nt, Human
ccccagccggggcucuggacccaggguaacagccccaguucaucccaaccccucucagagccuc

SEQ ID NO: 309335 - RNA, 64 nt, Human
ggagaaacgggugagcugagcuuggcguuuggacccaguucagugagguucuuggguuuugugc

SEQ ID NO: 309336 - RNA, 64 nt, Human
ccagguugcugggggcaccacagacaucaagauuccaguucauccagguggcuggagccagcag

SEQ ID NO: 309337 - RNA, 64 nt, Human
uuuuucucacacaggcauacuccaaaugcuucuuccaguucauuuuucagccaucaguucaaga

SEQ ID NO: 309338 - RNA, 64 nt, Human
uccaagcccuguuuccugcguaaaggugguauguccaguucagagauguguauaaugagcaugg

SEQ ID NO: 309339 - RNA, 64 nt, Human
uauaccuugccugugccuuaguguccucuuuuuuccaguucaccugugcgaauccgacccaccu

SEQ ID NO: 309340 - RNA, 64 nt, Human
ugaaaacugguucaucauggaaaugauucucauugacuaauacaucaucucacacuuucaugag

SEQ ID NO: 309341 - RNA, 64 nt, Human
auuuuaaacacuuuuccaaagugauucuuauccagacuaauauuugagaaguacuguauuaaau

SEQ ID NO: 309342 - RNA, 64 nt, Human
gcugaacuaguagccacaucuuguucaucacauagacuaauagaaaggaggcuguggcuaaagc

SEQ ID NO: 309343 - RNA, 64 nt, Human
uguaucccugcugguguugacuucuguguaggggccaguucaugucccugacucucaccuccca

SEQ ID NO: 309344 - RNA, 64 nt, Human
cagagaggcugaauagauuccacaaccugguuugccaguucaucuuuugacucuauuaaaaucu

SEQ ID NO: 309345 - RNA, 64 nt, Human
uuaaauuauucaucuucucuauaauaaugacaucccaguucauggaggcaaaaaacaaguuucu

SEQ ID NO: 309346 - RNA, 64 nt, Human
guaauaaaggacgcccucccuccaguguccacauccaguucaccccagagggucgggcagguug

SEQ ID NO: 309347 - RNA, 64 nt, Human
uucuuuuccuugauuucucaguaggugcuagaauccaguucacacccuucacugugcgugcaga

SEQ ID NO: 309348 - RNA, 64 nt, Human
cauguccaguggccuuuggaaaggugguggggauccaguucaggagggagggguauguuugucu

SEQ ID NO: 309349 - RNA, 64 nt, Human
aaaaaaagucuuuucccauuuaaaauaggcucagccaguucaaugucuccuuguuaucagagaa

SEQ ID NO: 309350 - RNA, 64 nt, Human
auacuagaaacaaacaaaacuuuggaccaaaaucccaguucaaagaaacaaaaaaaagagugga

SEQ ID NO: 309351 - RNA, 64 nt, Human
ugugugaucuugauugcggcuuuaucauuccuuuccaguucauaaacaacaggcacccacaacc

SEQ ID NO: 309352 - RNA, 64 nt, Human
cacaguguuaaaaaucagauaccuccuuuagugaccaguucaaauuuuaauagcgauagguagc

SEQ ID NO: 309353 - RNA, 64 nt, Human
guugugugcgaacugagcugcacucuccuuaggcccaguucaggccucagccccucuuucccag

SEQ ID NO: 309354 - RNA, 64 nt, Human
uuaggguuucuuauuuauuucuuuacaaaucauuccaguucaaaauauauaucagauuaauaca

SEQ ID NO: 309355 - RNA, 64 nt, Human
cuauaaauacauagaguuuauguugugaaguuucccaguucacugaaauguuagguuuccuaaa

SEQ ID NO: 309356 - RNA, 64 nt, Human
cagcuaucaggaugucccugaaacuucaccaggaccaguucacuugcccugacgaguaugaaga

SEQ ID NO: 309357 - RNA, 64 nt, Human
uaaaucuuaaacaauguauaaagauuguacuuagccaguucaaaguguauauuuauucauaaug

SEQ ID NO: 309358 - RNA, 64 nt, Human
cccauucugcgucaugcuuguguuauaacuacuccggagacaggguuuggcugugucuaaacug

SEQ ID NO: 309359 - RNA, 64 nt, Human
acaagguaguuuuuaccuaccacagugucuguaucggagacagugaucuccauauguuacacua

SEQ ID NO: 309360 - RNA, 64 nt, Human
uaacuguuagucuuaaauaguugggacaucagcugacuaauagaccucagccucaaaaggcuug

SEQ ID NO: 309361 - RNA, 64 nt, Human
gagagagacucaaagagacuccaagauucaaagagacuaauagagacacagagauggaauagaa

SEQ ID NO: 309362 - RNA, 62 nt, Human
acccauucagcuuacucugaaagaggcagaucccaguucaaaagcagccaugagaaggaagg

SEQ ID NO: 309363 - RNA, 64 nt, Human
aggcauuaugccuuggaagaccuaaaucucccauccaguucaggaggugacaacauccuuauuu

SEQ ID NO: 309364 - RNA, 64 nt, Human
aauggcuaguuuuuauucucgucaaggcacaaaaccaguucaugcuuaaccuuuuuuuccuuuc

SEQ ID NO: 309365 - RNA, 64 nt, Human
agaucacaacuaacaacugacaaaucagaguuugccaguucaaauucagcauggcugcagcuga

SEQ ID NO: 309366 - RNA, 64 nt, Human
uuucccucuccugccucaucccuuguuggcagcuccaguucaggccguggagggacgugaugcu

SEQ ID NO: 309367 - RNA, 64 nt, Human
ugcauuagagagggaacuguuaaauguuuucaacccaguucaucugguggauguuuuugcaggu

SEQ ID NO: 309368 - RNA, 64 nt, Human
uguugauuuccuguuuccuccucccccgccucuuccaguucaaaggagucugcaauuggaacug

SEQ ID NO: 309369 - RNA, 64 nt, Human
aauacccagaacuaggcuauucaugggcuguugcccaguucaagcucuauuggguccugaggaa

SEQ ID NO: 309370 - RNA, 64 nt, Human
cuugaggaacauggcacucuagaucccucacauaccaguucaccauaugguucgcacuucuaug

SEQ ID NO: 309371 - RNA, 64 nt, Human
cuuuccuguguggggagaggugugugacguuuuuccaguucacauuuauuugguagcccaccug

SEQ ID NO: 309372 - RNA, 64 nt, Human
agguuaacaacccuguugaguauuugcuguuuguccaguucaggaauuuuuguuuuguuuuguc

SEQ ID NO: 309373 - RNA, 64 nt, Human
accuugugcuucuuaucuguccacugccacucccccaguucaaauccuuacccugcagaaauau

SEQ ID NO: 309374 - RNA, 64 nt, Human
caguguucggcguugcucgggauucaagauaccaccaguucagagcuaaauaauaaccuuggcc

SEQ ID NO: 309375 - RNA, 64 nt, Human
uuugagucuguauccuccacugggggaagugcucccaguucagaacaagggcagcccguggugc

SEQ ID NO: 309376 - RNA, 64 nt, Human
acuagcagaagagaauucuguaucaguguaacugccaguucaguuaaucaaaugucauuuguuc

SEQ ID NO: 309377 - RNA, 64 nt, Human
guuuucaugaccaauccuaugucauuucuacuuugacuaauacccaaacccuaaaccucuucac

SEQ ID NO: 309378 - RNA, 64 nt, Human
cugggaacuugugggacucaccugacucaaagaugacuaauaucgucccauuuuggaaauaaag

SEQ ID NO: 309379 - RNA, 64 nt, Human
agacaauuagaaacuauuuuucuuauuaacuggugacuaauauuaacaaaacuugagccaagag

SEQ ID NO: 309380 - RNA, 64 nt, Human
aauaaaauaagagugauacugaaagugcucagaugacuaauauuaugcuauaguuaaauggcuu

SEQ ID NO: 309381 - RNA, 64 nt, Human
gaggguggcugccuccucugguccccaggccccuccaguucaucggaauucagccaugaaacug

SEQ ID NO: 309382 - RNA, 64 nt, Human
aacagccaucuucaagacagccccugaaaagagaccaguucagguccugcccugcuguucuuug

SEQ ID NO: 309383 - RNA, 64 nt, Human
ccccuaccccugaggaugaggacaagccccucggccaguucagcguucccgugcuucucccuug

SEQ ID NO: 309384 - RNA, 64 nt, Human
cauuccucaggaaggacaugggugccccccacccccaguucagucuguagggagugaagccaca

SEQ ID NO: 309385 - RNA, 64 nt, Human
aaaguaaccuaauguggacaccauccagaaaacuccaguucaugcuggaucuuaaccaaaaaug

SEQ ID NO: 309386 - RNA, 64 nt, Human
caaugugguacgugaauugcuugguacaaaauggccaguucacagaggaauagaagguacuuua

SEQ ID NO: 309387 - RNA, 64 nt, Human
ggaaugaggaaaauucuuaaaaggcccauagcagccaguucaaaaacacccgacgucauguauu

SEQ ID NO: 309388 - RNA, 64 nt, Human
gccgucuugcaugaaacgcaugagccgugagcgcccaguucagacuggggccagggaggggcag

SEQ ID NO: 309389 - RNA, 64 nt, Human
aagucugguauguacuguacuuuugcaguucuucccaguucagacuagccacauuccaagugcu

SEQ ID NO: 309390 - RNA, 64 nt, Human
ucccuucaccuggagugccacaccccucucucugccaguucagcucuucauucuucaaggccug

SEQ ID NO: 309391 - RNA, 64 nt, Human
auuauuuggaagaguguguaggaaagacguuuuuccaguucaaaaugccuuauacaaucaagag

SEQ ID NO: 309392 - RNA, 64 nt, Human
agaaaagcaaagaaguauucagaaaagagaugucccaguucaucguccagugccugaacccuua

SEQ ID NO: 309393 - RNA, 64 nt, Human
cagcguugcugucuugccagugccggcccccggcccaguucagggacagaauuauaguguuugg

SEQ ID NO: 309394 - RNA, 64 nt, Human
aagcccaccaggugucaggauagucacagugauaccaguucagacacuaccccauauacaccug

SEQ ID NO: 309395 - RNA, 64 nt, Human
agggcugguuucaggcugacauauggccgcagguccaguucagcccaggucucucaugguuauc

SEQ ID NO: 309396 - RNA, 64 nt, Human
cuuucauuuguagggauauuuguuuuucauaucagacuaauaaaaagaaauuagaaaccaagua

SEQ ID NO: 309397 - RNA, 64 nt, Human
gaugcggaaggauugcaaugcccgccagcacaguggcggcaacauugaagacguggacggagga

SEQ ID NO: 309398 - RNA, 64 nt, Human
gaugggguggagggggccaccggggcagggagggggcggcaaggggggaaugggaguugucucc

SEQ ID NO: 309399 - RNA, 64 nt, Human
cccuccccgggagccucagaguuugcuucuggcuggcggcaagggaaagggacgauggagaagg

SEQ ID NO: 309400 - RNA, 64 nt, Human
uuuuagaaaaagguuguuacauaaaacacccuggccaguucauuucagcaugcucuuucaacca

SEQ ID NO: 309401 - RNA, 64 nt, Human
cagcaaguggagguugcuaugagcugagauugugccaguucauuccacccugggcaacagggug

SEQ ID NO: 309402 - RNA, 64 nt, Human
cauuuuauauugugcccagcaaagaaacuuucacccaguucagguuuccccaaaacuccugugg

SEQ ID NO: 309403 - RNA, 64 nt, Human
uugguuuuucaucauuucauguaucuaucaaagcccaguucaccuccucccccaaacacacaca

SEQ ID NO: 309404 - RNA, 64 nt, Human
agcucuuuuuuuuuuuuaaucacaaaaaaaaaccccaguucaaaauguguaguucuucauuguu

SEQ ID NO: 309405 - RNA, 64 nt, Human
cuagaaauauuuccucuuuuggauaggucuuuaaccaguucauauauauacuuugucaaauaua

SEQ ID NO: 309406 - RNA, 64 nt, Human
ucaaauaaaaauuuguuuuucagagauuuaccacccaguucaugguuagaaauauuuuguggca

SEQ ID NO: 309407 - RNA, 64 nt, Human
uggcacagucucagcucacugcaaccucugccucccaguucaagcaauucuucugccucagccu

SEQ ID NO: 309408 - RNA, 64 nt, Human
ggaaaagacauuaucagggccuggaaagucucuuccaguucaucaggguaguagaccugucaga

SEQ ID NO: 309409 - RNA, 64 nt, Human
uggauauuuuuauguacagaaguaugucucuuaaccaguucacuuauuguacucuggcaauuua

SEQ ID NO: 309410 - RNA, 64 nt, Human
gaccacaaaugaugagcuaagauuguacuguuuuccaguucaucgauuuucuauuauggaaaac

SEQ ID NO: 309411 - RNA, 64 nt, Human
aauugccaacuacuaacugugugaccuuaggugaccaguucauuaagggcuaauagauuuccau

SEQ ID NO: 309412 - RNA, 64 nt, Human
uuccaggagugggauuauucaucaaacucuuugcccaguucaucccaaugggggaaguauuccc

SEQ ID NO: 309413 - RNA, 64 nt, Human
caauaggguucaaauuccugcaaaauuaccuaccccaguucaucucugcugaacauuuggaaac

SEQ ID NO: 309414 - RNA, 64 nt, Human
auuugaagggcaugcuguaauuucacacaauuuuccaguucaaaaauggagaauacuucgccua

SEQ ID NO: 309415 - RNA, 64 nt, Human
aacagagccccucuaggagaagccacgggaucccggcggcaaggagaacagaacacugaagacu

SEQ ID NO: 309416 - RNA, 64 nt, Human
ggcgauucuaguuaauaaaaaggggggagaugugggcggcaagccacccaggcaccgaggcaag

SEQ ID NO: 309417 - RNA, 64 nt, Human
uccaaacuugugaacucgugacaaucacaaacuuggcggcaaaguggcgacucaaccuuggggg

SEQ ID NO: 309418 - RNA, 64 nt, Human
uggcuggacauggccaagacacaaggcauuccacggcggcaagcugaccgcacagcagucuggc

SEQ ID NO: 309419 - RNA, 64 nt, Human
aacgugaucuuggcucacugcgaccuccaccuccccaguucaagcgauucuccugccucagccu

SEQ ID NO: 309420 - RNA, 64 nt, Human
ccccauucacagagccuuuuucacaauuccauuuccaguucaucuauggcaguccagccagcuc

SEQ ID NO: 309421 - RNA, 64 nt, Human
aguguuguaaaagaugcagaguaaguauuaugccccaguucagaaauuuggcauugaucuuaaa

SEQ ID NO: 309422 - RNA, 64 nt, Human
cucacuugguccuaccuauuauccuucuacuuguccaguucaaauaagaaauaaggacaagccu

SEQ ID NO: 309423 - RNA, 64 nt, Human
aaagugauuuuugagugugccaggguaaaggcuuccaguucagccucaguuauuuuagacaauc

SEQ ID NO: 309424 - RNA, 64 nt, Human
uauucaauaccaaugcuguaugagugggcugaauccaguucauuguuuuuuuuuugguaagaag

SEQ ID NO: 309425 - RNA, 64 nt, Human
agcugccaaccaccagccuuucuggugcuguucuccaguucacgucugccagcuggugagggca

SEQ ID NO: 309426 - RNA, 64 nt, Human
auacgaaugauacagauuuuuaaaaaaguaauaaccaguucacccucuuugccuaacaaucucg

SEQ ID NO: 309427 - RNA, 64 nt, Human
uggugaauuaccagaucuccgucaagugcaguaaccaguucaaguuggaagugugucuuuugaa

SEQ ID NO: 309428 - RNA, 64 nt, Human
gagaggugaaaagcuauguaaauagaaggaauggccaguucaaaagaauaguagaugugauagu

SEQ ID NO: 309429 - RNA, 64 nt, Human
cuuaucacgccuacuuaagagugcuguguaacccccaguucaagacuuagcuccuguugucaug

SEQ ID NO: 309430 - RNA, 64 nt, Human
augaguauggaaaaggucuguucucuaguuuuguccaguucaguuuacugaaggaauauauuua

SEQ ID NO: 309431 - RNA, 64 nt, Human
uggugcgaucucagcucacugcaaccuccgccucccaguucaagugauucuccugccucagccc

SEQ ID NO: 309432 - RNA, 64 nt, Human
uuuuuuagacagaucuucaugaccuguucccaccccaguucaucaucaucucuuuuacaccaaa

SEQ ID NO: 309433 - RNA, 64 nt, Human
uugucaucaacagccgugaccacuuuagaaugaaccaguucauugcaugcugaagcgacauugu

SEQ ID NO: 309434 - RNA, 64 nt, Human
caauuuccccuuuuccccuggcuaccaggaaacucggagacaaucuuuucagccucagcauuuc

SEQ ID NO: 309435 - RNA, 64 nt, Human
ggaugugaggaacacaaguucauuucuguuguugcggagacacugcagacuccacugugccgag

SEQ ID NO: 309436 - RNA, 64 nt, Human
gcugaccaaugaugggcggugacccgguaaccgaggcggcaaggaggccagguagucccggcac

SEQ ID NO: 309437 - RNA, 64 nt, Human
ggccuggaggggcagggcuggggcaacccggcuuggcggcaaagcccagccccuucucagacca

SEQ ID NO: 309438 - RNA, 64 nt, Human
uguaacugagaugggcuucacaggaauguaguugccaguucauaucacaauagcccuuucuaua

SEQ ID NO: 309439 - RNA, 64 nt, Human
uaaggugggcagauuaguuugucaaagucucagcccaguucaauucaguugaucucgaguggug

SEQ ID NO: 309440 - RNA, 64 nt, Human
agccugaauuuguaagcaacuugcuucuaaaugcccaguucacuucuuugcagagccuuuuacc

SEQ ID NO: 309441 - RNA, 64 nt, Human
uguguuaugaaaauauagacauucucacauaagcccaguucaucaccauuuccuccuuuaccuu

SEQ ID NO: 309442 - RNA, 64 nt, Human
ucauuaugauuccuccuuuuagucuaauaucuuuccaguucauacuuguuuuuaaucauuaaau

SEQ ID NO: 309443 - RNA, 64 nt, Human
agaaccaaugaucccuuggccuacuuaguuaaaaccaguucauacaucccuuaggguuuuuauu

SEQ ID NO: 309444 - RNA, 64 nt, Human
augugaaagaaacugaacuuggugguuuuuccugccaguucaggagagauucuuggcauguaau

SEQ ID NO: 309445 - RNA, 64 nt, Human
guuaacccauuuuuuuuuuuuuuaggcauagaagccaguucaggguccauaauauuuagugacc

SEQ ID NO: 309446 - RNA, 64 nt, Human
guccagcgaccuuccucauccaccccaucccuccccaguucauugcacuuugauuagcagcgga

SEQ ID NO: 309447 - RNA, 64 nt, Human
gcacaagugcuguuucuaucacuauuguaauuugccaguucauuuuucaugcugaaaguaauau

SEQ ID NO: 309448 - RNA, 64 nt, Human
guguuuuauuuccuauaauaggaugcugccuaacccaguucaucucuauguccuguucacugaa

SEQ ID NO: 309449 - RNA, 64 nt, Human
cccgcacucuuuaagcagcuguuuaccgaaggcaccaguucagccaggagugaaauccggagag

SEQ ID NO: 309450 - RNA, 64 nt, Human
cacuuuaucuugguaacgagccaagaucaugcaaccaguucauccaugucugacccaagagcuc

SEQ ID NO: 309451 - RNA, 64 nt, Human
cccagaugcccagggucgugcacucucugggauaccaguucagucuccacauuucugguuuucu

SEQ ID NO: 309452 - RNA, 64 nt, Human
ccagccauugcuccccucucccugccacccuuccccaguucaccaaaccuuacauguugcaaaa

SEQ ID NO: 309453 - RNA, 62 nt, Human
cagagagcuggcaugaguauagggaaggaggaaggacacauuuucaauccucugccuguagc

SEQ ID NO: 309454 - RNA, 62 nt, Human
ccgguccagacagcagccuguacauccaucccaggacacagcccagccccuccccacaccau

SEQ ID NO: 309455 - RNA, 62 nt, Human
gucucgggcacucuaaauauugaguguuauggaggacacagagguagcagaaucccaguuga

SEQ ID NO: 309456 - RNA, 62 nt, Human
auggccguggggcccuugcucucugacuucucaggacacaggucauggagguucuucccaag

SEQ ID NO: 309457 - RNA, 64 nt, Human
aguuagaucugauugggcuacucauguccuguagccaguucauccucauaauaagaaugggcag

SEQ ID NO: 309458 - RNA, 64 nt, Human
caacacuggaaaggguauccacagcaggaaguccccaguucaccuccaugacuacagggcagcu

SEQ ID NO: 309459 - RNA, 64 nt, Human
cucugacacagaacgcccaacguggacacaggugccaguucagcagugaccgucaagaccgggg

SEQ ID NO: 309460 - RNA, 64 nt, Human
acccgggagcucuuucccucagggucucagggagccaguucaaggucuggcugucaagugucca

SEQ ID NO: 309461 - RNA, 64 nt, Human
cuaaggucagcagauuuagcaaauacagacugccccaguucauugaauuuuagauaaaugaaau

SEQ ID NO: 309462 - RNA, 64 nt, Human
cuguuagggcuuacaaaguaaauuacaaagugauccaguucaaaguuugcuuaguuacaacaaa

SEQ ID NO: 309463 - RNA, 64 nt, Human
gguccucagaaggugucaggagguuccacacucgccaguucacuggagcagagucccuucgcca

SEQ ID NO: 309464 - RNA, 64 nt, Human
ucuucggcacuuaugacaacauuaacacagaaugccaguucaucagcagccgacucacggagug

SEQ ID NO: 309465 - RNA, 64 nt, Human
accccugaguaaaaaagcugugugcucuccaagcccaguucagcuuggggacaggggcaggagg

SEQ ID NO: 309466 - RNA, 64 nt, Human
auagauggauauagaagcauuucucugcaggauaccaguucaggccccaccauuccugccaagg

SEQ ID NO: 309467 - RNA, 64 nt, Human
uucaguggugguucuguugcucagcugcagugagccaguucaauuuugcaaaggugcaguaccu

SEQ ID NO: 309468 - RNA, 64 nt, Human
agagcugagguacgaagaaguuuuguuaauuuuuccaguucacguaacaaguaaaugggaaacc

SEQ ID NO: 309469 - RNA, 64 nt, Human
ugcaggagugaagaacccugggggccuguagccaccaguucauaggugccaagucaauaaagca

SEQ ID NO: 309470 - RNA, 64 nt, Human
gugucuuuagaacuccaguacucacccagggacuccaguucacaggccagaaaacauaugcauu

SEQ ID NO: 309471 - RNA, 64 nt, Human
uguuucaccgccacccuuucaggagagaacuacaccaguucaucaugagggucagggaagcaaa

SEQ ID NO: 309472 - RNA, 64 nt, Human
gagggcgggcaaggggccccagccgcugcagcagcggagacagucgccagcagcugggcugggg

SEQ ID NO: 309473 - RNA, 64 nt, Human
guuuucuaauuuugacuuuaaauuuuucauccgccggagacacugcucccauuuguggggggac

SEQ ID NO: 309474 - RNA, 62 nt, Human
ggcugaguucggcugucauuuaagagaacuccaggacacaauucagcccggguuccgcaaac

SEQ ID NO: 309475 - RNA, 62 nt, Human
auuuccauggcagcaggaugcagggauuaauaaggacacauacacauuauuccaccaauuga

SEQ ID NO: 309476 - RNA, 64 nt, Human
uuuuuaagagccugugauaguuacuguggagcagccaguucauggggucccccuuggggcccca

SEQ ID NO: 309477 - RNA, 64 nt, Human
augcuuucaaaagcuaaucugccuguugaugguaacuagguacagcgacuuuaaauacaguugc

SEQ ID NO: 309478 - RNA, 64 nt, Human
ucucaaaaauuaauuaauuaauuaauuaaaauaaacuagguaaacuuggauaggcaguagauau

SEQ ID NO: 309479 - RNA, 64 nt, Human
uuucccauaggaggcccuucuugagaaacaauaaacuagguagaacuaccccuaugcccaucca

SEQ ID NO: 309480 - RNA, 64 nt, Human
ucccaguaagggcguggcucugggugggcggggcacuagguaggcuucuaccugcaggcggggc

SEQ ID NO: 309481 - RNA, 64 nt, Human
agucaguuuaauugccagagagaaggaugcaaucacuagguaaaaugagguuuuuaggauuauu

SEQ ID NO: 309482 - RNA, 64 nt, Human
aaauguucccuuuccuggaggggagaggcuucuuacuagguaagagacagguuuccucuuuccu

SEQ ID NO: 309483 - RNA, 64 nt, Human
gcagaucugcuuuuuuuccagagcaaaaugaagcacuagguauaaauauguuguuacugccaag

SEQ ID NO: 309484 - RNA, 64 nt, Human
ucugcaagccgcuguggggacuuagcuuccugauacuagguagugaugguggaucuagagacau

SEQ ID NO: 309485 - RNA, 64 nt, Human
ugaaagaauacauuaaaauaaaaaacuugccccuacuagguaagaacuuuauaaugaagacaua

SEQ ID NO: 309486 - RNA, 64 nt, Human
cccaccagcuucacucucuccgucuguuuuugcaacuagguauuucuaacgccagcacacuauu

SEQ ID NO: 309487 - RNA, 64 nt, Human
cuugcaagugaauggaaaaaaaaauaagcuucaaacuagguauucugggaaugauguaaugcuc

SEQ ID NO: 309488 - RNA, 64 nt, Human
guggcgacauggagagagggaagcucaauaaaucacuagguacaauccugguaucauugccaau

SEQ ID NO: 309489 - RNA, 64 nt, Human
ucagcuuugcaaacacauuuucuacauagauaguacuagguauuaauagauauguaaagaaaga

SEQ ID NO: 309490 - RNA, 64 nt, Human
uccaggguugagagacuccccugagccagaggccacuagguauucuugcucccagaggcugaag

SEQ ID NO: 309491 - RNA, 62 nt, Human
cucagucuccacaugaagggagcucauauccaaggacacaaaaccacuuuaaaaacauaaau

SEQ ID NO: 309492 - RNA, 62 nt, Human
ucccuuuaggacaauguuguguaaaucuuugaaggacacaccgaagaccuuuauacugugau

SEQ ID NO: 309493 - RNA, 62 nt, Human
cuguggcaaauuuagaacacuuaucguuuggcaggacacagagagguaggugaacauuccag

SEQ ID NO: 309494 - RNA, 62 nt, Human
aucagggcucgggaagccacgccugggaaggcaggacacaggacacagcagcuuucuuugga

SEQ ID NO: 309495 - RNA, 64 nt, Human
agccucauuaacccaagugaaccaaccaaagucaccaguucagaagugcuaagcuaauaggagu

SEQ ID NO: 309496 - RNA, 62 nt, Human
acaaugaaaaugaugaauaaccaguaccaguuccaguucaaguguuuaaaacuuuugacaag

SEQ ID NO: 309497 - RNA, 64 nt, Human
aaguaacaaaaggaaauuauuuguuuuugaaauaccaguucaacuuuguggauuauuuuuccuc

SEQ ID NO: 309498 - RNA, 64 nt, Human
cucuaaaacugaaagaaaccuuaucacauuuuccccaguucaaugcuaugccauuaccaacucc

SEQ ID NO: 309499 - RNA, 64 nt, Human
uguaacaagugauucugcuuaauauuuuguuauuccaguucauaaaaaguagauuacguuuucc

SEQ ID NO: 309500 - RNA, 64 nt, Human
acagagugagacuuaaagaaccccuagauccccaccaguucaacacuccauuaacugggaagcc

SEQ ID NO: 309501 - RNA, 64 nt, Human
caccuuccugcaaguuuacuggggccaguuuguaccaguucagauucugccuguuuucaagaug

SEQ ID NO: 309502 - RNA, 64 nt, Human
ggcacagggaagagggagggugucucacaaccaaccaguucagaaugauacggaacagcauuuc

SEQ ID NO: 309503 - RNA, 64 nt, Human
aaagcccuuauguuuaaucagcgauguauauaagccaguucacuuagacaacuuuacccuucuu

SEQ ID NO: 309504 - RNA, 64 nt, Human
cacacugucuucccaguacguaaguuaaaaaauaccaguucacccaaguugcuucuagccuacu

SEQ ID NO: 309505 - RNA, 64 nt, Human
uucagacaugcacuucuaaggggaaggugauuuuccaguucaaaaaaaugggcaggagugggga

SEQ ID NO: 309506 - RNA, 64 nt, Human
ggcuugaaauccagcaggauggaggacuuggccaccaguucaggcuucuuggccuucuucuccg

SEQ ID NO: 309507 - RNA, 64 nt, Human
gugacggacccucagggccagcugcuccuccuguccaguucacgcuguuuuguaaccacuuucu

SEQ ID NO: 309508 - RNA, 64 nt, Human
gggcuucuguuuuauuuuguaggcuggaugcuacccaguucaugaaucgcuaauaaaagccaau

SEQ ID NO: 309509 - RNA, 64 nt, Human
uggugcgaucuuggcucacugcaaccuccaccucccaguucaagugauuccccugccucagccu

SEQ ID NO: 309510 - RNA, 64 nt, Human
ggcuccuaagaaucugggcucugcuacccaccuccggagacacaagcccacguaucuacuuuca

SEQ ID NO: 309511 - RNA, 64 nt, Human
ccuucucugaaaacaaugcugagaaugagagcggcggagacaagccccccaucgaucccaguaa

SEQ ID NO: 309512 - RNA, 64 nt, Human
uccugggucacacuucaccagccagggcuuuugacggagacagcaaauaggccucugcaaauca

SEQ ID NO: 309513 - RNA, 64 nt, Human
ugaucuggcccuccccagaacaaucuggauuucacggagacagcaaccagaaguuaaaccaugu

SEQ ID NO: 309514 - RNA, 64 nt, Human
cuucuucccugccagcaggacugagugugcguacccaguucaccuggacaugagugcacacucu

SEQ ID NO: 309515 - RNA, 64 nt, Human
aaauggccagguuggguuaacccacugguuucaaccaguucaggaaugagguuauuuggccaug

SEQ ID NO: 309516 - RNA, 64 nt, Human
ucuauuuaaccagaccuguaguaguauuaccaauccaguucaauuaaggugauuuuuuguaauu

SEQ ID NO: 309517 - RNA, 64 nt, Human
agagacugguuacuagcguaaagcugacaaguuaccaguucaccugaucagaauguauuuuuua

SEQ ID NO: 309518 - RNA, 64 nt, Human
uccuauugcaucuccuuucuuauuauaagcuguuccaguucacaggcagcaaaccuccuggguu

SEQ ID NO: 309519 - RNA, 64 nt, Human
ggagcgaauaccaaccuuuauuugcacuuggguuccaguucaaagccaccuuagacaguguggc

SEQ ID NO: 309520 - RNA, 64 nt, Human
ucacgcuggccacagcacaaagaacaacuccucaccaguucauccugaggcugggaggaccggg

SEQ ID NO: 309521 - RNA, 64 nt, Human
agugaacagcagggucuaacugugcuuacuuagcccaguucaaacagaacaaaggaaaaauaua

SEQ ID NO: 309522 - RNA, 64 nt, Human
ucccuugcugcucagaaaaaguuuacggaaaacaccaguucacuaaaagcaccgaaaucugcaa

SEQ ID NO: 309523 - RNA, 64 nt, Human
ccuccugauggggauguuuggccucugcuuccucccaguucacagccagaguugccucuccucc

SEQ ID NO: 309524 - RNA, 64 nt, Human
gagccuggucaucaacuugcaauaccucacagagccaguucacaucccacucugagcucccacg

SEQ ID NO: 309525 - RNA, 64 nt, Human
cacuuaaugaggacauuccccaucacugucuguaccaguucaccuuuauuuuacguuuuauuca

SEQ ID NO: 309526 - RNA, 64 nt, Human
aaaaguagguuuacauucaucucauuccaacuucccaguucaggagucccaaggaaagccccag

SEQ ID NO: 309527 - RNA, 64 nt, Human
gaucccuaccacgggaucccaaacuuggauagagccaguucaaccucccccaauccauacacau

SEQ ID NO: 309528 - RNA, 64 nt, Human
aguuaagccaugguuaaccuaaaugccucaugccccaguucagcaaaaggaggaaaaugugccu

SEQ ID NO: 309529 - RNA, 64 nt, Human
cccagggcuggcuggccugccauuugccucuccccggagacagccguucuucugcaaccacacc

SEQ ID NO: 309530 - RNA, 64 nt, Human
uaaugucaagauguguuuucccacauaaauucaccggagacauccgggccccgcuucgauguaa

SEQ ID NO: 309531 - RNA, 64 nt, Human
uccuuugguuaaaggucccccauacuucucuguucggagacaugagaaguaugauuacuucagu

SEQ ID NO: 309532 - RNA, 64 nt, Human
cucaaaucaaaaaauagaaacagcaucaagugugcggagacaggcggcugaaagccagcagcac

SEQ ID NO: 309533 - RNA, 64 nt, Human
uuuauauccaagaaaaugauaacuuugaagaugcccaguucacucuaguuucaauuagaaacau

SEQ ID NO: 309534 - RNA, 64 nt, Human
caugagcuuucuacccagggacugugcucagccaccaguucagcagcuaagagaucggcuuuuu

SEQ ID NO: 309535 - RNA, 64 nt, Human
ccugcagccucgcuccucagaugucugcacugagccaguucagucacuagugcgccagccaggc

SEQ ID NO: 309536 - RNA, 64 nt, Human
acagugagaauguauuucugcuguuuuaagguacccaguucaugguaauuuguuacagcaaucc

SEQ ID NO: 309537 - RNA, 64 nt, Human
ucucuaguacugcuccccuacccagcagucacuuccaguucauucagcuauuuuuaaaaugugc

SEQ ID NO: 309538 - RNA, 64 nt, Human
acccccgcccccucccugcaccuccuguccucucccaguucauuccuggaaccagccaggccag

SEQ ID NO: 309539 - RNA, 64 nt, Human
agucggaggaucauaagcaagcucagaccugcccccaguucaguacuugaccacaucccaggau

SEQ ID NO: 309540 - RNA, 64 nt, Human
gguugcuacaaacccuugugcuuucacuguauagccaguucauucagaaaaggaggaaagggua

SEQ ID NO: 309541 - RNA, 64 nt, Human
agcgacacuaccuggggcucaggccuggacccccccaguucacgguugcuccugggagcugccc

SEQ ID NO: 309542 - RNA, 64 nt, Human
caacccagugcccccucccauuuuccgcuacugaccaguucauccagcuuuccacacaguuguu

SEQ ID NO: 309543 - RNA, 64 nt, Human
gcaggggagggacggaaggcuggcaccucuuccaccaguucagggggacuuuccccucuccugu

SEQ ID NO: 309544 - RNA, 64 nt, Human
aucaccaccaccagagccuccugcccagcccuggccaguucaaagguucagccaucccugcccu

SEQ ID NO: 309545 - RNA, 64 nt, Human
aagaaaccagaaccuugcggcccaguggcccgggccaguucaggccgccucccccuccucugcc

SEQ ID NO: 309546 - RNA, 64 nt, Human
cuagaauuaguacaacucuuaacugugccaguccccaguucaccagcuuuguauccagucguca

SEQ ID NO: 309547 - RNA, 64 nt, Human
auuacaccccuccacguauuaugugacucuuacaccaguucacccuucccagaauguauccaaa

SEQ ID NO: 309548 - RNA, 64 nt, Human
ucugaccaacuggcagugucuucuggcugcuggccggagacagcucuugcccuuuccaaaguca

SEQ ID NO: 309549 - RNA, 64 nt, Human
ccaucccgcagaggccccuguccaccuggagacccggagacagaggccuggacaaggagugaac

SEQ ID NO: 309550 - RNA, 64 nt, Human
guguugacaacuaacucguuuuccuagauggaaacggagacauugaccccucccuccauguggu

SEQ ID NO: 309551 - RNA, 64 nt, Human
cggagcuugucaggaaguggccguagcaacuuggcggagacaggcuaugagucugacguuagag

SEQ ID NO: 309552 - RNA, 64 nt, Human
cucuucugaaaacugaggaguguccucuguucuuccaguucacgagggcaggggguuuaaaaca

SEQ ID NO: 309553 - RNA, 64 nt, Human
aaguggugaacccaggaacugaggaaggagguuuccaguucauuuacauuaagggcccuggggg

SEQ ID NO: 309554 - RNA, 64 nt, Human
uguucuaagagcaggcuccaccugggagccagccccaguucacaccaaaccaggcucccugaac

SEQ ID NO: 309555 - RNA, 64 nt, Human
cugucuucuagucaaacuuguaaagaaaaagauuccaguucaguauuugcagcaagaagcuuga

SEQ ID NO: 309556 - RNA, 64 nt, Human
ucuuuucaaaaagcagccccuucagucugcguucccaguucauuuugcaggcgcauucgcccuu

SEQ ID NO: 309557 - RNA, 64 nt, Human
ccugaacuguccuggaggccccaagccauguuccccaguucaguguugcauguauaauagauuu

SEQ ID NO: 309558 - RNA, 64 nt, Human
aaggcggacugcaucuguauguagugaaauugccccaguucagaguugaauguuuauuauuaaa

SEQ ID NO: 309559 - RNA, 64 nt, Human
cugccucuuuucuaaauguucaggaaaagcauugccaguucagucuuuucaaaaugagggagaa

SEQ ID NO: 309560 - RNA, 64 nt, Human
uuucaacauagcggguuagaguucuuauacuguuccaguucaauuccaagaauugcaaauguuu

SEQ ID NO: 309561 - RNA, 64 nt, Human
auuccucugccuccaaguagaaugcccuuaugccccaguucaagccacugcagcuaaguauuaa

SEQ ID NO: 309562 - RNA, 64 nt, Human
uauuugggccugcuccagaccugauccuggaggcccaguucacccugauuuaggagaagccagg

SEQ ID NO: 309563 - RNA, 64 nt, Human
acugucagguugguugguaaugugccugccucagccaguucacuuucuuagguaauucacugca

SEQ ID NO: 309564 - RNA, 64 nt, Human
uagacccgucccagacacgucuuuucauuccaguccaguucaggcugccgugcacuuugucgga

SEQ ID NO: 309565 - RNA, 64 nt, Human
uccuccuccuguuccuccccaccucccuccuuuuccaguucaguauuuggaguucaacacuguc

SEQ ID NO: 309566 - RNA, 64 nt, Human
acauguggggaauagggcauuuuaaaggcuggaaccaguucagaggaaacaaggguuuggguag

SEQ ID NO: 309567 - RNA, 62 nt, Human
ugaagauagccuguguguaguuuaaccugggcaggacacaucucccugcauuuuuuuuuuuu

SEQ ID NO: 309568 - RNA, 62 nt, Human
guccugugccacauggcuggacuccagccaggaggacacacggugagggcuccagguggagc

SEQ ID NO: 309569 - RNA, 62 nt, Human
caggcagggaccauuguucugaacuugccgugaggacacacagacuugcuuuuaaaggguua

SEQ ID NO: 309570 - RNA, 62 nt, Human
acccacuggaaggcucacaggcaaggugagagaggacacagaaggugccaacacugucgcua

SEQ ID NO: 309571 - RNA, 64 nt, Human
auacucaggaaaaugucaccaagcacccuccuccccaguucacaaaaggaagaagaugaagauu

SEQ ID NO: 309572 - RNA, 64 nt, Human
ugaucacugaucuugucauuauagaugaguuuugccaguucaagaauuuaauggaaucagauau

SEQ ID NO: 309573 - RNA, 64 nt, Human
uuauuugguucaagaagacaucgcucuggcauccccaguucagugaacugguacaauguggucc

SEQ ID NO: 309574 - RNA, 64 nt, Human
aaaacuggaccagagguggaaagauguauuugccccaguucacuucaaagcagcaaacguuguu

SEQ ID NO: 309575 - RNA, 64 nt, Human
ggcuuggcuuaguacucucaucucugguuccauuccaguucagcuaagucuugcuuuaaaauuu

SEQ ID NO: 309576 - RNA, 64 nt, Human
cgcacuuuccuccuggcagaaugcuagcucugagccaguucaguaccuggaggaggagcagggg

SEQ ID NO: 309577 - RNA, 64 nt, Human
uucauuuguauuauuucaagaaauguacuaauuuccaguucacucaggccuuacuaauccauac

SEQ ID NO: 309578 - RNA, 64 nt, Human
ccucugccuuucuucgaccaacuuucucuuguugccaguucauuacacaaaauguagcgggauu

SEQ ID NO: 309579 - RNA, 64 nt, Human
aauacugaaugacugcuaagaauuaaccuuaagaccaguucauaguuaauacagguuuacaguu

SEQ ID NO: 309580 - RNA, 64 nt, Human
acuaggagagacuugauuuuggugcuaaaguuccccaguucauaugugacaucuuuuuaaaaaa

SEQ ID NO: 309581 - RNA, 64 nt, Human
uggccuugguuguggggacccauuccuggagggaccaguucauggaggccaucaccgucagugc

SEQ ID NO: 309582 - RNA, 64 nt, Human
ugugcccaaaguccucacucagaccagugccccuccaguucaguugucuauguauuaccuuccu

SEQ ID NO: 309583 - RNA, 64 nt, Human
ucccauuuuaugauguaacccaacaacuuacagaccaguucaucaaugccagcugauaacucgg

SEQ ID NO: 309584 - RNA, 64 nt, Human
cugcucggccgccuuggggguuccgcuuccuguuccaguucaccuaaaggcugauugugcaggc

SEQ ID NO: 309585 - RNA, 64 nt, Human
ccacuauauauauagauagauguagguuaugaacccaguucauaggccaccuugaguuagaauu

SEQ ID NO: 309586 - RNA, 64 nt, Human
uccugccucucugcuccgacacccggcaagcagccggagacaaaacgccuuaaagcccccggcc

SEQ ID NO: 309587 - RNA, 64 nt, Human
caaaagcaugaacugagcaucguggaugggugcacggagacacgcaccuuggagaaaugagggg

SEQ ID NO: 309588 - RNA, 64 nt, Human
ugccuccagccgcccgcgccagauuuugaaaucucggagacaaaacuaguacuguaagauaaau

SEQ ID NO: 309589 - RNA, 64 nt, Human
guugggaccagaauccacuauaaguuucauucuucggagacacggaagcucugcacuggaggcc

SEQ ID NO: 309590 - RNA, 64 nt, Human
aaacguaaguuauuguuauuuauugugagaacagccaguucauagugggacuuguauuuugauc

SEQ ID NO: 309591 - RNA, 64 nt, Human
gcagccacauuuucaaggacuguccaagagccagccaguucagggcucaggccucacccauugc

SEQ ID NO: 309592 - RNA, 64 nt, Human
agagauagcauggcaugcagcacacacggcugcuccaguucauggccucccaggggugcugggg

SEQ ID NO: 309593 - RNA, 64 nt, Human
ggaacuaacugcacccugguccucuccccaguccccaguucacccuccaucccucaccuuccuc

SEQ ID NO: 309594 - RNA, 64 nt, Human
cugccuccuccuugcuucccuaacaggaagguguccaguucaagagaacccacccagagacugg

SEQ ID NO: 309595 - RNA, 64 nt, Human
ccccugggggugugggauggaggagggucugcagccaguucauucccagggccccaucuugaug

SEQ ID NO: 309596 - RNA, 64 nt, Human
gagagccauuucccugugacauuuaguggacuggccaguucauagcagcacugugaggaccccc

SEQ ID NO: 309597 - RNA, 64 nt, Human
uauaauaagagcuguuaaacuucuguuuaaauuuccaguucaacuuguaaauguuuuuauugug

SEQ ID NO: 309598 - RNA, 64 nt, Human
auuuucuguccgaagcugacauuccucuggcaguccaguucaccuuggauuacagccaccuuca

SEQ ID NO: 309599 - RNA, 64 nt, Human
gucucggucagcucauuccugccuccuuccugagccaguucagggccugggggagagccagcuu

SEQ ID NO: 309600 - RNA, 64 nt, Human
caaucauuuaucaaugguucuaaguuacucauugccaguucaagccaaaggucauguuguuaag

SEQ ID NO: 309601 - RNA, 64 nt, Human
cacagcagaggucaaaggcaguggagagccuuggccaguucagugacagcuucuggcugaagac

SEQ ID NO: 309602 - RNA, 64 nt, Human
aaccagaugggaaggaccuugguugggacucuuuccaguucacuuggggcagagggaauuuaau

SEQ ID NO: 309603 - RNA, 64 nt, Human
gaaugggugcugggcaggacaaagcaucagcuguccaguucaggccucuccucuuucccuggug

SEQ ID NO: 309604 - RNA, 64 nt, Human
cuaaugcuccugcucucuucucuuuccccuccaaccaguucaaucucaucccucccagcagcuc

SEQ ID NO: 309605 - RNA, 64 nt, Human
caccaccaugcccagcuaacuuuuguauuuuuggcggagacaggguuucaccauguuggccagg

SEQ ID NO: 309606 - RNA, 64 nt, Human
ggcauucaucuacagacuccaacaaggccuccagcggagacaucuccccuuaugacaacaacuc

SEQ ID NO: 309607 - RNA, 64 nt, Human
cagcaucgcuaauccaauuacugugccuucuaaacggagacacucagacacuugaacucaucuu

SEQ ID NO: 309608 - RNA, 64 nt, Human
cccuccccacggggccucgggaccucagguggccccaguucaaucucccgcugcugcugcugcg

SEQ ID NO: 309609 - RNA, 64 nt, Human
uuuuaauuaaagacuaaugcuuugauuggauuugccaguucaccggacagugauuaaaacuaug

SEQ ID NO: 309610 - RNA, 64 nt, Human
aaacuuacuaaaaccuagguaacucuagauuaggccaguucagguguauuuuguaucuuaguaa

SEQ ID NO: 309611 - RNA, 64 nt, Human
gacuuuuccucagggauacauuggccugcaggucccaguucacauguaguccccugcucaccau

SEQ ID NO: 309612 - RNA, 64 nt, Human
cccugcugccaguguaccgugagcggggcuccagccaguucaagcucagagccagagcuggacg

SEQ ID NO: 309613 - RNA, 64 nt, Human
agagagaagccagagauagccugauccugcccuuccaguucaguucugaaaaguaagguuggga

SEQ ID NO: 309614 - RNA, 64 nt, Human
gcaccuuguguugagagagaggcaacccugggggccaguucaggugguccccaaccauaagcua

SEQ ID NO: 309615 - RNA, 64 nt, Human
uguccccucacccccucuccuguauuucucagguccaguucaaaucuaaaauucuacuuuuaga

SEQ ID NO: 309616 - RNA, 64 nt, Human
uguguauguguaugugugugagugugugaagccgccaguucaucuuuuuauaugggguuguugu

SEQ ID NO: 309617 - RNA, 64 nt, Human
gucauucauggccugggggauguaccagcaucucccaguucauaaucacaacccuucagauuug

SEQ ID NO: 309618 - RNA, 64 nt, Human
uaauaaggauaguaaucccuugccuuuucucaaaccaguucaacucagcaaacacuuccugagc

SEQ ID NO: 309619 - RNA, 64 nt, Human
ggggucaucccaggaggagggguuuacauuggaaccaguucagguucggugcaucuuuccucuu

SEQ ID NO: 309620 - RNA, 56 nt, Human
acccaggcccaccuguuuaaagucacccaguucaaggacccggaugugaauggcau

SEQ ID NO: 309621 - RNA, 64 nt, Human
uaacguugagaaauguaacugugaaaucagcucaccaguucaagucacuagguuugccacuugg

SEQ ID NO: 309622 - RNA, 64 nt, Human
agcccuaaaaggcugccuucauggccaucuagccccaguucagggcagcauccauagcccacaa

SEQ ID NO: 309623 - RNA, 64 nt, Human
gcagaguggcgccugccugugcuggcccauggaacggagacagcauugggcugacugugggcau

SEQ ID NO: 309624 - RNA, 64 nt, Human
guucugagaacauuucacagaagugccugagacgcggagacauggcugguguuaaauggagcua

SEQ ID NO: 309625 - RNA, 62 nt, Human
ucucagcuucgaaaaguccugguuccacugacaggacacauucuuuagugggaauuaagacc

SEQ ID NO: 309626 - RNA, 62 nt, Human
aucuuucacuacaaguauuucuaacaguugcaaggacacauacacaaacaaauguuugacug

SEQ ID NO: 309627 - RNA, 64 nt, Human
gcagcucuccguacaugcgccccacccccaugagccaguucagcccuacugggggcugagcggg

SEQ ID NO: 309628 - RNA, 64 nt, Human
gccagcuuaaggacaacaccugugugguggaauuccaguucaugcugcccacaucucauccaaa

SEQ ID NO: 309629 - RNA, 64 nt, Human
caccgcccaggccaggccuguggucaucaaugccccaguucacauccaccugcuucucuuccag

SEQ ID NO: 309630 - RNA, 64 nt, Human
ccuccucugcuucuccuuucuccgcugcuauagaccaguucauuguguguggcucccgugucuc

SEQ ID NO: 309631 - RNA, 64 nt, Human
gccaguuucacugaaugcugcaccacaugcuacaccaguucagcgugagaauuuucuaauaaau

SEQ ID NO: 309632 - RNA, 64 nt, Human
ucuuugcuuucauucgucucccgucuuugguucuccaguucaaauuauugcaaaguaaaggauc

SEQ ID NO: 309633 - RNA, 64 nt, Human
gugagggggccccugccggagccucagacacacuccaguucagggcuguggggggccuuggcca

SEQ ID NO: 309634 - RNA, 64 nt, Human
gugcagagagaguauccuugacugcuuaagucagccaguucagcauggauaccaacauuagcuu

SEQ ID NO: 309635 - RNA, 64 nt, Human
caaggggccagaauuauuccuuguuagaauugcuccaguucaagucugcugcuuuccuacaauu

SEQ ID NO: 309636 - RNA, 64 nt, Human
uuuaaauucacggugaacagcacuuuuauuauuuccaguucagaagagccaaaaaaaaguaucu

SEQ ID NO: 309637 - RNA, 64 nt, Human
ugaagcuuaaacuccuguggauucacaucaaauaccaguucaguuuugucauuguucuaguaaa

SEQ ID NO: 309638 - RNA, 64 nt, Human
gccaucaggauggucccugguccuuagagaggguccaguucaggcuucuagacauuuuacucau

SEQ ID NO: 309639 - RNA, 64 nt, Human
uggcugcguccugugggggcgguguggacuccucccaguucagcgaguaugugcuuugccggga

SEQ ID NO: 309640 - RNA, 64 nt, Human
aaguagcugagacuacagacgugcgccaccacacccaguucauuuuuguauuuuuaguagagac

SEQ ID NO: 309641 - RNA, 64 nt, Human
cugugauuucauuugcacguggggacaggauuugccaguucacccacagaucacaccuccaucc

SEQ ID NO: 309642 - RNA, 64 nt, Human
ucagucagccgcucaccuaucuacucccacuuuucggagacagugacuggugccagugucaucc

SEQ ID NO: 309643 - RNA, 64 nt, Human
cauccccgccgcccucacaggacccaccaggcagcggagacauguggaauuagaguauuuugag

SEQ ID NO: 309644 - RNA, 64 nt, Human
agauguuugcuaacuucaaaacugugcuugaauagacuaauaauauaugcucauaucagauguc

SEQ ID NO: 309645 - RNA, 64 nt, Human
acagcuacaccaaaacucuucuuguaagaauacugacuaauaugccauguuaaucuggcuagau

SEQ ID NO: 309646 - RNA, 64 nt, Human
gcgccugcagucccagcuacuugggaggcuaagcccaguucaaggcugcagugaacuaugaugg

SEQ ID NO: 309647 - RNA, 64 nt, Human
uccccccagagccccucuucagcauccgccccuuccaguucacauagugagacccccccuccag

SEQ ID NO: 309648 - RNA, 64 nt, Human
ccauguaauaaaugugggaaagcucucauuuguuccaguucacuuuaaagacaugaaugaacuc

SEQ ID NO: 309649 - RNA, 64 nt, Human
ucucgaccauaagagauggcuacacccaggggggccaguucagagacccacucccaggugugca

SEQ ID NO: 309650 - RNA, 64 nt, Human
ugggauuauaggcgugagccaccgcgcccggccuccaguucauuuuaaaaccaugaaaccaccc

SEQ ID NO: 309651 - RNA, 64 nt, Human
ggcucaggaaccaguuuggacuugauuuugaaucccaguucauccccuuccuagcuguaugacc

SEQ ID NO: 309652 - RNA, 64 nt, Human
guuuuauugcugucaugaauauaaugguuuugcuccaguucauuucaugguuuaacauaucaaa

SEQ ID NO: 309653 - RNA, 64 nt, Human
cggggcacggcacagaagccgcgcccaccgccugccaguucacaaccgcuccgagcgugggucu

SEQ ID NO: 309654 - RNA, 64 nt, Human
uguugaauuguacaaccauaugagccuuguaaggccaguucaguugggucaugccacuguuuga

SEQ ID NO: 309655 - RNA, 64 nt, Human
uggaaacauaaugguugggggccacaugagucuuccaguucacucucacuccuguguuuaggag

SEQ ID NO: 309656 - RNA, 64 nt, Human
uggggagaacgcugcuguuaggaggaaguuguguccaguucagggugcccucgggagcccuguc

SEQ ID NO: 309657 - RNA, 64 nt, Human
agaaagaagcaacacagaugucguccccaaaaugccaguucaagacaccuucucccugcccccc

SEQ ID NO: 309658 - RNA, 64 nt, Human
uggugccccccguggagcuggccaaccccgagaaccaguucagaguggacuacauccugagugu

SEQ ID NO: 309659 - RNA, 64 nt, Human
ugcagcacagaggccugugacugcguuccagcggccaguucacuacgcaguaucucuggggccu

SEQ ID NO: 309660 - RNA, 64 nt, Human
uuccucuguuuaacaguccuuggaccauucugauccaguucaccaguagguuggacagcauaua

SEQ ID NO: 309661 - RNA, 64 nt, Human
ccauccacuauuaaugcacuaggugggaggagagggcggcaaugacacugcaccucuccuuucc

SEQ ID NO: 309662 - RNA, 64 nt, Human
agagagcgcacccuacucuuuccgugacgaugagggcggcaaaaacagacauuucuuccuucau

SEQ ID NO: 309663 - RNA, 64 nt, Human
ccccaccccacuggcucuucuuaauuagaagugaccaguucaccucuguguccuuuugaaacau

SEQ ID NO: 309664 - RNA, 64 nt, Human
gguuagaaaugcagaauccuaggcuccaccccauccaguucaugagaaucuauauuuaacaaga

SEQ ID NO: 309665 - RNA, 64 nt, Human
caaaucaugacucccaagggugcccuuuggggucccaguucagaccccugccuggacuuaagcg

SEQ ID NO: 309666 - RNA, 64 nt, Human
uggucagaugguggggugggcccucuccagggggccaguucagggccccagcugccccccagga

SEQ ID NO: 309667 - RNA, 64 nt, Human
uagucuaggaggcacagaauucucauucuguuauccaguucauuccagcaaucauaguuaauac

SEQ ID NO: 309668 - RNA, 64 nt, Human
agaggacuggacucuggaccuggagccccgugguccaguucacauucaccccacaagaguuuca

SEQ ID NO: 309669 - RNA, 64 nt, Human
aaugaaaggaaaaaaauaccacgcauugaaaugcccaguucagacugaauaauuccugcugcag

SEQ ID NO: 309670 - RNA, 64 nt, Human
ggugggaggcaaacacgccuuguuccugcucuucccaguucagcuuggugggagaaagucauuc

SEQ ID NO: 309671 - RNA, 64 nt, Human
uugaugccugggcucagcugaacucuauuccuggccaguucacaggaaguacaggaguacaggu

SEQ ID NO: 309672 - RNA, 64 nt, Human
cuccuauauucugcaaauuuuccccaaauagaagccaguucaguccacaccaucucuucuuuga

SEQ ID NO: 309673 - RNA, 64 nt, Human
ggagguggcagccgagaucgggguggcagaaaucccaguucauguugcucagaagagaaucaag

SEQ ID NO: 309674 - RNA, 63 nt, Human
ucaaugguugcaccuuaugaccuugagggaaagccaguucauuuaagaggaaauggacuggca

SEQ ID NO: 309675 - RNA, 64 nt, Human
gucugcuagaaaguguuguaguugauugaccaaaccaguucauaaggggaauuuuuuuuaaaaa

SEQ ID NO: 309676 - RNA, 64 nt, Human
gggggcaaaaagcccagauaccauuuuaacuggcccaguucauuuucuccuuucauuuuacaaa

SEQ ID NO: 309677 - RNA, 64 nt, Human
gguuuuuuauguggccaccugagggcgccccaagccaguucaucucggaguccaggccuggccc

SEQ ID NO: 309678 - RNA, 62 nt, Human
gagaaggccguaauaucugggccuuggaaggaaggacacagggcucuggaaggaggaggcug

SEQ ID NO: 309679 - RNA, 62 nt, Human
cugcacaguuuccaaagcuuuacuacucuuagaggacacaugccuuaaaaaaggaggggagg

SEQ ID NO: 309680 - RNA, 53 nt, Human
agaaauaccuccagaaguaggaaccaguucagccuccuugaagcugcccuuga

SEQ ID NO: 309681 - RNA, 64 nt, Human
agccuagugacucccuccuuggccaggcccucacccaguucagauccacggccuccacccggga

SEQ ID NO: 309682 - RNA, 64 nt, Human
aaacuaaaagagugggugggaagacuagugaaacccaguucacggauggggaaacaggccugag

SEQ ID NO: 309683 - RNA, 64 nt, Human
ugagagaacaugugggcacuuaacucuucauguuccaguucaucccagaaguagacaucccagg

SEQ ID NO: 309684 - RNA, 64 nt, Human
gggcaucaauacucaaauauaggcugauuaugccccaguucaaaugggaacuauuaacagagug

SEQ ID NO: 309685 - RNA, 64 nt, Human
ggcaacuuggccaauucuggcagauaucaggcccccaguucagccccagucacccucuuuuaca

SEQ ID NO: 309686 - RNA, 64 nt, Human
uuuaaacaguaccauugcuugugucccaccuggaccaguucagucagccccagugguggcaugu

SEQ ID NO: 309687 - RNA, 64 nt, Human
agugacgugagaccccugcaaaugggacagccccccaguucaugaggccuggcuauugcaauau

SEQ ID NO: 309688 - RNA, 64 nt, Human
ucaggagcaugacuccagugcugcgcucuugggcccaguucagucugucuugucucaaaucuag

SEQ ID NO: 309689 - RNA, 64 nt, Human
guguguguggcguugaucuuuagccugucucacaccaguucagaaaacacuagacccaggauug

SEQ ID NO: 309690 - RNA, 64 nt, Human
ucgugaguccaggggucuacaagucccgggccccccaguucacgauucuggcgcggacuucgcu

SEQ ID NO: 309691 - RNA, 64 nt, Human
ccaggauggcggaagcucaccaggccguggccuuccaguucacggugaccccagacggggucga

SEQ ID NO: 309692 - RNA, 64 nt, Human
caauggaaauucagaccuugacuauuugguguuuccaguucacaaaggugaugaagacugucuu

SEQ ID NO: 309693 - RNA, 64 nt, Human
agaagguuacaguguaacuauuuugguacuagaaccaguucaugcuggccgaaacgacaauggu

SEQ ID NO: 309694 - RNA, 64 nt, Human
ggguuuuuuagaaaaccccacagaaaucucucacccaguucagguguauagggaauuuucauuu

SEQ ID NO: 309695 - RNA, 64 nt, Human
uguuugaguuuuuccucccagugagacugccccacggagacagaggaaagggcuggcucccccu

SEQ ID NO: 309696 - RNA, 64 nt, Human
uuucuucccccucuucucccuaauccugagugcacggagacagcucucagcaguuuguagccug

SEQ ID NO: 309697 - RNA, 64 nt, Human
cugagauguguuaggaggcguuuaaaacaaagauccaguucauuuacuccacaguuauucccag

SEQ ID NO: 309698 - RNA, 64 nt, Human
ucuauuuuuuguauuaccuuuuuaaaaauauauaccaguucaaguccuuuuaggaagaagaaaa

SEQ ID NO: 309699 - RNA, 64 nt, Human
uauuaaaaaucuuacguaguuguguuaaacugaaccaguucauuauaccuuaugcauuaaauua

SEQ ID NO: 309700 - RNA, 64 nt, Human
cuuucacacuucucaaaagugacacaagagaaauccaguucaccuacagagguagagcacucac

SEQ ID NO: 309701 - RNA, 64 nt, Human
ugucuggagaguuucuaaaaauucagcuauaaccccaguucauguauuuacuggugauuguucu

SEQ ID NO: 309702 - RNA, 64 nt, Human
auacuagaaacaaacaaaacuuuggaccaaaaucccaguucaaagaaacaaaaaguggaaacua

SEQ ID NO: 309703 - RNA, 64 nt, Human
cuccuccccuagggaauggucccagcacgaguggccaguucauugugggggccugauuguuugu

SEQ ID NO: 309704 - RNA, 64 nt, Human; identical to SEQ ID NO: 309703

SEQ ID NO: 309705 - RNA, 64 nt, Human
gaggugaugcuuuaaauuacuuuuuggauuguagccaguucagcuaggcaaaagccauacuuuu

SEQ ID NO: 309706 - RNA, 64 nt, Human
ccgugggaucaugggcagggaaggcucugggggucggagacaccgcugcuuagcacccccagcc

SEQ ID NO: 309707 - RNA, 64 nt, Human
aaagggcuugggagauucaugcgauguguccaaucggagacaaaagcaguuucucuccaacucc

SEQ ID NO: 309708 - RNA, 64 nt, Human
aagccccuccacguuugaaaaugcgccuccuccucggagacagacgcaucggugccaccuagug

SEQ ID NO: 309709 - RNA, 64 nt, Human
aaaguuguggacaagcugugccccucuuaacauucggagacaccagucugcagucugugagcuu

SEQ ID NO: 309710 - RNA, 64 nt, Human
cugggcgcgccccgccgcgggcccuugaggcgcgcggagacaccagcgcuggcuucccgggccc

SEQ ID NO: 309711 - RNA, 64 nt, Human
gucacagcaugccuccugccuuaccguggcaguacggagacaguccagaacauggucuucuugc

SEQ ID NO: 309712 - RNA, 64 nt, Human
guuuuuuccuguuaaugcaauuauagaaauacaucggagacacaacaaauguggccauuacagg

SEQ ID NO: 309713 - RNA, 64 nt, Human
uaaaguagaaaaagauuucugcccacuuuaccuacggagacaugauaaacacgcaaaaaaaacc

SEQ ID NO: 309714 - RNA, 64 nt, Human
gaguguuggaagucauuugauagaaagaugagaucggagacaauguuguguuauagggcacaca

SEQ ID NO: 309715 - RNA, 64 nt, Human
gcugccuuuggcuuugaucucaagucaggcugaaggcagcgaagccucggggcccaagccccuc

SEQ ID NO: 309716 - RNA, 64 nt, Human
gcagccucccucugaccugcaggccaagagcagaggcagcgaguuguggaaagccucugcugcc

SEQ ID NO: 309717 - RNA, 64 nt, Human
gaaaaugcagcugugauuuguugcugggagcggcggcagcgagucccugcaacagcaauaaacu

SEQ ID NO: 309718 - RNA, 64 nt, Human
uuccaggacuggccucccugaucucucuccucauggcagcgacccaccuccaguccccuggaca

SEQ ID NO: 309719 - RNA, 64 nt, Human
ccugcacaccugcuggccuggggagcuccagccaggcagcgaguccugccccgcccgcagcucc

SEQ ID NO: 309720 - RNA, 64 nt, Human
auucuucauuuuuagaaaugccugugaagaccuuggcagcgacguggcucgagaagcauucauc

SEQ ID NO: 309721 - RNA, 64 nt, Human
acggcaggacuggagaggcugcgugcccggcacuggcagcgaggcucgugugucccccaggcag

SEQ ID NO: 309722 - RNA, 64 nt, Human
guccccgcugagccucgcggugacagccgccuuuggcagcgagcgcucggggcacuucuauccc

SEQ ID NO: 309723 - RNA, 64 nt, Human
gcaccaagcuugagcugugucguuucguggagggggcagcgaggaugggcuugagcuguugaga

SEQ ID NO: 309724 - RNA, 64 nt, Human
gggaagaguaagugggaucacagggaaggauguuggcagcgacaccaucccauacaggcucuua

SEQ ID NO: 309725 - RNA, 64 nt, Human
uuugucucuccuacccccacugccccgagugucgggcagcgauguacauauggagguggggugg

SEQ ID NO: 309726 - RNA, 64 nt, Human
uuuuccucagcugacuccauauuuuccuacuuguggcagcgacugcauccgacauaaaggaaca

SEQ ID NO: 309727 - RNA, 64 nt, Human
cucagcugucgaggagggggccgccgcggacccuggcagcgaugggucuccaggcaaguccccg

SEQ ID NO: 309728 - RNA, 64 nt, Human
ugugaauuccaccuucccuccugcagugcugagaggcagcgaggacggagaggacagcggcauc

SEQ ID NO: 309729 - RNA, 64 nt, Human
ugccgcaggcacccagugaacccgcuugggcugaggcagcgagugauucccgcgcuccggcucc

SEQ ID NO: 309730 - RNA, 64 nt, Human
gaaaacgaagcucauucccaacgugcaaagccaaggcagcgaccccaggaccucuucuggagau

SEQ ID NO: 309731 - RNA, 64 nt, Human
aggguguugggauacugcagggccaggacugagccccgcagaccuccccagccccuagcccagg

SEQ ID NO: 309732 - RNA, 64 nt, Human
ugagucccuggcaguagccuuggggcagagggcacccgcagagucccagagaugaugugggcag

SEQ ID NO: 309733 - RNA, 64 nt, Human
gccucggagcccggcccgcccuccggcuacaauccccgcagagucuccggugcagacgcgcugc

SEQ ID NO: 309734 - RNA, 64 nt, Human
uucuguauaggaacagaggugccuccgggaaggaggcagcgagguagguagcuaugauaggcac

SEQ ID NO: 309735 - RNA, 64 nt, Human
uauaugauuuauaguuuguacaugcauucauacaggcagcgauggucucagaaaccaaacaguu

SEQ ID NO: 309736 - RNA, 64 nt, Human
cucccagucaaaaagaaagugagagaagcuguugggcagcgaaccuacuguuuaaaaucaggau

SEQ ID NO: 309737 - RNA, 64 nt, Human
agcaucucucagagaugugaagccagauccucauggcagcgaggcccucugcaagaagcucaag

SEQ ID NO: 309738 - RNA, 64 nt, Human
ccucucacugaucacaaauggaaucaccucccugggcagcgagacgcaguugcucugggaagau

SEQ ID NO: 309739 - RNA, 64 nt, Human
cucagcuccccagccaaucuguacaucccucagaggcagcgaucugaugaauugguuuuugaau

SEQ ID NO: 309740 - RNA, 64 nt, Human
acuccucaugccuuccuggagguagaaggccaguggcagcgacugagcuggcaugaaugaauaa

SEQ ID NO: 309741 - RNA, 64 nt, Human
ccucuucccaccaguccucagccaccuucuccacggcagcgaccuccgucucaaguuccgcauc

SEQ ID NO: 309742 - RNA, 64 nt, Human
uauuucaaaacguugggaauaagggccugcaaaaggcagcgaggaggcaccucgggucuugagg

SEQ ID NO: 309743 - RNA, 64 nt, Human
cccggccacgucccccugccgcaucuuugaccugggcagcgacaacgaggaggugguggcuggc

SEQ ID NO: 309744 - RNA, 64 nt, Human
gcugggcgccggggaggacgauggccccgacccuggcagcgagaggagaccaggaggcuaggac

SEQ ID NO: 309745 - RNA, 64 nt, Human
acaaacacuccguggcugagaggcagcggauccaggcagcgaugcugagccaccuccuccgagc

SEQ ID NO: 309746 - RNA, 64 nt, Human
aggcuguggggcaggcugggcagggggcugagcuggcagcgauucagagcccuggggcuggggg

SEQ ID NO: 309747 - RNA, 64 nt, Human
uaccccugcagcuggggaagacuuaugccaucccggcagcgaggcugggcuggccagccaccac

SEQ ID NO: 309748 - RNA, 64 nt, Human
acgugcacauaccucugcuagaaacuccugucaaggcagcgagagcugaugcacucggacagag

SEQ ID NO: 309749 - RNA, 64 nt, Human
cgggcuggggagcggcccccagccgggacgggagggcagcgaccccgaggccucguggacgugg

SEQ ID NO: 309750 - RNA, 64 nt, Human
aagcauugcucaggguggggggcugggaccauggcccgcagaggcacugccacagcugugaggg

SEQ ID NO: 309751 - RNA, 64 nt, Human
uucagcagaaugacucuggaaccauccucuguuacccgcagauccugucccaugggcucuggcc

SEQ ID NO: 309752 - RNA, 64 nt, Human
ccuucuggccccucugaggauucccuagggcugccccgcagaggggcuuccccaagcucuguuu

SEQ ID NO: 309753 - RNA, 64 nt, Human
gaggccgugggagaauggcugggcagagcagaggggcagcgauagacucuggggauggagcagg

SEQ ID NO: 309754 - RNA, 64 nt, Human
aucuaacugcucccucucuccacacggagcuccuggcagcgagaacuacgcacagcugccgcgu

SEQ ID NO: 309755 - RNA, 64 nt, Human
agagacagaaccuggaccucaccagggacugcugggcagcgauuccuggcaguggccugguguu

SEQ ID NO: 309756 - RNA, 64 nt, Human
aggacucacacaaauuaaaauacagcugcacugaggcagcgaccucaaguguccugaaagcuua

SEQ ID NO: 309757 - RNA, 64 nt, Human
aauguguggcagauuuagugaaagcuagagauauggcagcgaaaggauguaaacagugccugcu

SEQ ID NO: 309758 - RNA, 64 nt, Human
caugcucaucucacugcccagugaagggggcaagggcagcgaggggcaggaccccugcugcuca

SEQ ID NO: 309759 - RNA, 64 nt, Human
aaagaggguguuuauguaaaacuaaaugagugcaggcagcgagcuacacuuuuuuuuuuccuaa

SEQ ID NO: 309760 - RNA, 64 nt, Human
agcugcccagcuuugcccaacuguugcuucuuggggcagcgaacugagcccuggggcugcugcu

SEQ ID NO: 309761 - RNA, 64 nt, Human
aggaagagagaguuuauuuagucaacuggcccaaggcagcgaggcuucuacagucccacacccc

SEQ ID NO: 309762 - RNA, 64 nt, Human
cugcagcggaaacgccgugcaucucuugucuguuggcagcgagcacaucgugcuggagacacga

SEQ ID NO: 309763 - RNA, 64 nt, Human
ccuggacuuuguggaggaggcaccaagugucucaggcagcgaggaaauuggaggccauuuuuca

SEQ ID NO: 309764 - RNA, 64 nt, Human
agcgggcuccuaaugaggugggaaagccacggcaggcagcgagcagcccaggccagcuuucugc

SEQ ID NO: 309765 - RNA, 64 nt, Human
cuggggaccuucccugggggacggggagggaggaggcagcgacuccuuggacagaggccugggc

SEQ ID NO: 309766 - RNA, 64 nt, Human
gcuagguggccauggugaaggugucaguggcggcggcagcgauggcaagcaggcggcguugcug

SEQ ID NO: 309767 - RNA, 64 nt, Human
aauauuuucuuuuccugcuuuggagcuguguaauggcagcgaaacauguagcugucuuuguucu

SEQ ID NO: 309768 - RNA, 64 nt, Human
ggagcagcccaaggcaccuguccucugacccaccggcagcgagugcgcaggugugaguguaagu

SEQ ID NO: 309769 - RNA, 64 nt, Human
cuuccagaaacuuuauauggguagaggaagccagggcggcaaaugcgagaccaaauaucauuuu

SEQ ID NO: 309770 - RNA, 64 nt, Human
auauccacccccagcccaaccgagggcggcccuuggcggcaacaugcaagaaggagggacuguc

SEQ ID NO: 309771 - RNA, 62 nt, Human
uaguuccagagagaaaaaagcuaauuuuccuaaggacacagcaagaauauucauuaaggaua

SEQ ID NO: 309772 - RNA, 64 nt, Human
ucccccuuugaaacucaagcacagcugcgaggagggcagcgaggagggaccccucucucauggu

SEQ ID NO: 309773 - RNA, 64 nt, Human
gaacucccagagcuaccucuugggggagcgugguggcagcgaugauggggagacgccuggaagc

SEQ ID NO: 309774 - RNA, 64 nt, Human
ccauccuccaaagggccugggcccgccccgagggggcagcgagaggagcuuccccauccccggu

SEQ ID NO: 309775 - RNA, 64 nt, Human
ucacaguccaauggaggaggcagauguguccucaggcagcgacugggcagggcugguauagggg

SEQ ID NO: 309776 - RNA, 64 nt, Human
gaccuccauucagguggaggucccgagugggcggggcagcgacugggagaugggucggucaccc

SEQ ID NO: 309777 - RNA, 64 nt, Human
agaggugcagccucgaggaaucugagggcgucggggcagcgaaccuuugcauccacggacuccu

SEQ ID NO: 309778 - RNA, 64 nt, Human
gugucggagcacauguguggcacccgcucccucuggcagcgaauguaggaagucgccaaauuua

SEQ ID NO: 309779 - RNA, 64 nt, Human
ucggcugcgcggaggccguggcacaccugcgggaggcagcgacggcccccacgcagacgccggg

SEQ ID NO: 309780 - RNA, 64 nt, Human
ugcaccugcccaggggcuguucagagcuggcaauggcagcgacagcagcaacagcagcagaucc

SEQ ID NO: 309781 - RNA, 64 nt, Human
cuauuuuaacugacagcuuuccuuuggggugccaggcagcgaggccccccaccccuauccugcc

SEQ ID NO: 309782 - RNA, 64 nt, Human
uuuuccagcugucaggcaucacugcggcuaguccggcagcgaccuagaugggguccacccccau

SEQ ID NO: 309783 - RNA, 62 nt, Human
caacacuuuuauucucugaauuuugaucucaaaggacacagaaaaaaaauggccccaggaga

SEQ ID NO: 309784 - RNA, 62 nt, Human
gucggguacauaugguagugcccacaagaaagaggacacaaguuuugcacaaaauugcaagu

SEQ ID NO: 309785 - RNA, 57 nt, Human
gaaaacauucaucaaagugacauccucaggacacacccauguggcuccuggacaauc

SEQ ID NO: 309786 - RNA, 62 nt, Human
gaguaggagagaccaugaguauguguaacaggaggacacagcauuauucuagugcuguacug

SEQ ID NO: 309787 - RNA, 64 nt, Human; identical to SEQ ID NO: 218988

SEQ ID NO: 309788 - RNA, 64 nt, Human; identical to SEQ ID NO: 218992

SEQ ID NO: 309789 - RNA, 64 nt, Human; identical to SEQ ID NO: 218993

SEQ ID NO: 309790 - RNA, 64 nt, Human; identical to SEQ ID NO: 218994

SEQ ID NO: 309791 - RNA, 64 nt, Human; identical to SEQ ID NO: 218995

SEQ ID NO: 309792 - RNA, 64 nt, Human; identical to SEQ ID NO: 218996

SEQ ID NO: 309793 - RNA, 64 nt, Human; identical to SEQ ID NO: 218997

SEQ ID NO: 309794 - RNA, 64 nt, Human; identical to SEQ ID NO: 218998

SEQ ID NO: 309795 - RNA, 64 nt, Human; identical to SEQ ID NO: 218999

SEQ ID NO: 309796 - RNA, 64 nt, Human; identical to SEQ ID NO: 219000

SEQ ID NO: 309797 - RNA, 64 nt, Human; identical to SEQ ID NO: 219001

SEQ ID NO: 309798 - RNA, 64 nt, Human; identical to SEQ ID NO: 219002

SEQ ID NO: 309799 - RNA, 64 nt, Human; identical to SEQ ID NO: 219003

SEQ ID NO: 309800 - RNA, 64 nt, Human; identical to SEQ ID NO: 219004

SEQ ID NO: 309801 - RNA, 64 nt, Human; identical to SEQ ID NO: 219005

SEQ ID NO: 309802 - RNA, 64 nt, Human; identical to SEQ ID NO: 219006

SEQ ID NO: 309803 - RNA, 62 nt, Human
auuuaacaggcucccagcugaauuucacucacaggacacaguuuacugaucucuguucuagu

SEQ ID NO: 309804 - RNA, 62 nt, Human
guggggccuggucagucuguccauccucggcaaggacacaacacugccccagagggugggac

SEQ ID NO: 309805 - RNA, 62 nt, Human
gauccaggggaagccagugacacuaaaacaagaggacacaauggcaccucugcccuuccccu

SEQ ID NO: 309806 - RNA, 56 nt, Human; identical to SEQ ID NO: 219007

SEQ ID NO: 309807 - RNA, 64 nt, Human; identical to SEQ ID NO: 219011

SEQ ID NO: 309808 - RNA, 64 nt, Human; identical to SEQ ID NO: 219012

SEQ ID NO: 309809 - RNA, 64 nt, Human; identical to SEQ ID NO: 219013

SEQ ID NO: 309810 - RNA, 64 nt, Human; identical to SEQ ID NO: 219014

SEQ ID NO: 309811 - RNA, 64 nt, Human; identical to SEQ ID NO: 219015

SEQ ID NO: 309812 - RNA, 64 nt, Human; identical to SEQ ID NO: 219016

SEQ ID NO: 309813 - RNA, 64 nt, Human; identical to SEQ ID NO: 19157

SEQ ID NO: 309814 - RNA, 64 nt, Human; identical to SEQ ID NO: 19158

SEQ ID NO: 309815 - RNA, 64 nt, Human; identical to SEQ ID NO: 19159

SEQ ID NO: 309816 - RNA, 54 nt, Human; identical to SEQ ID NO: 19160

SEQ ID NO: 309817 - RNA, 64 nt, Human; identical to SEQ ID NO: 19161

SEQ ID NO: 309818 - RNA, 64 nt, Human; identical to SEQ ID NO: 19162

SEQ ID NO: 309819 - RNA, 64 nt, Human; identical to SEQ ID NO: 19163

SEQ ID NO: 309820 - RNA, 64 nt, Human; identical to SEQ ID NO: 19164

SEQ ID NO: 309821 - RNA, 64 nt, Human
acucugggacucacuagauucugcagucaaagaugacuaauauccuugcauuuuugaaaugaag

SEQ ID NO: 309822 - RNA, 64 nt, Human
ucugcacagccuugagugauuggaguccccuaaugacuaauaaacuugaacauguaacacacac

SEQ ID NO: 309823 - RNA, 64 nt, Human
uauuacuggguauaguaugugacuccucuucucagacuaauaaauuaucuuuugaauccuuggu

SEQ ID NO: 309824 - RNA, 64 nt, Human; identical to SEQ ID NO: 19165

SEQ ID NO: 309825 - RNA, 64 nt, Human; identical to SEQ ID NO: 19166

SEQ ID NO: 309826 - RNA, 64 nt, Human; identical to SEQ ID NO: 19167

SEQ ID NO: 309827 - RNA, 64 nt, Human; identical to SEQ ID NO: 19168

SEQ ID NO: 309828 - RNA, 64 nt, Human; identical to SEQ ID NO: 19169

SEQ ID NO: 309829 - RNA, 64 nt, Human; identical to SEQ ID NO: 19170

SEQ ID NO: 309830 - RNA, 64 nt, Human; identical to SEQ ID NO: 19171

SEQ ID NO: 309831 - RNA, 64 nt, Human; identical to SEQ ID NO: 19172

SEQ ID NO: 309832 - RNA, 64 nt, Human; identical to SEQ ID NO: 19173

SEQ ID NO: 309833 - RNA, 64 nt, Human; identical to SEQ ID NO: 19174

SEQ ID NO: 309834 - RNA, 64 nt, Human; identical to SEQ ID NO: 19175

SEQ ID NO: 309835 - RNA, 64 nt, Human; identical to SEQ ID NO: 19176

SEQ ID NO: 309836 - RNA, 64 nt, Human; identical to SEQ ID NO: 19177

SEQ ID NO: 309837 - RNA, 64 nt, Human; identical to SEQ ID NO: 19178

SEQ ID NO: 309838 - RNA, 64 nt, Human; identical to SEQ ID NO: 19179

SEQ ID NO: 309839 - RNA, 64 nt, Human; identical to SEQ ID NO: 19180

SEQ ID NO: 309840 - RNA, 64 nt, Human
uacugugaauaaugugugugaaggacuuuauuccgacuaauacucuuuuugucgcauuauauac

SEQ ID NO: 309841 - RNA, 64 nt, Human
ucaccaucaagcaauccauaguauagggaaacuugacuaauauaaugauugucacaaaguuuuc

SEQ ID NO: 309842 - RNA, 64 nt, Human
aaguggggaagacagacuuuaggaucacgugugugacuaauacagaaaggaaacauggcgucgg

SEQ ID NO: 309843 - RNA, 64 nt, Human; identical to SEQ ID NO: 19181

SEQ ID NO: 309844 - RNA, 64 nt, Human; identical to SEQ ID NO: 19182

SEQ ID NO: 309845 - RNA, 64 nt, Human; identical to SEQ ID NO: 19183

SEQ ID NO: 309846 - RNA, 56 nt, Human; identical to SEQ ID NO: 19184

SEQ ID NO: 309847 - RNA, 64 nt, Human; identical to SEQ ID NO: 19185

SEQ ID NO: 309848 - RNA, 64 nt, Human; identical to SEQ ID NO: 19186

SEQ ID NO: 309849 - RNA, 64 nt, Human; identical to SEQ ID NO: 19187

SEQ ID NO: 309850 - RNA, 52 nt, Human; identical to SEQ ID NO: 19188

SEQ ID NO: 309851 - RNA, 64 nt, Human; identical to SEQ ID NO: 19189

SEQ ID NO: 309852 - RNA, 64 nt, Human; identical to SEQ ID NO: 19190

SEQ ID NO: 309853 - RNA, 64 nt, Human; identical to SEQ ID NO: 19191

SEQ ID NO: 309854 - RNA, 64 nt, Human; identical to SEQ ID NO: 19192

SEQ ID NO: 309855 - RNA, 64 nt, Human; identical to SEQ ID NO: 19193

SEQ ID NO: 309856 - RNA, 64 nt, Human; identical to SEQ ID NO: 19194

SEQ ID NO: 309857 - RNA, 64 nt, Human; identical to SEQ ID NO: 19195

SEQ ID NO: 309858 - RNA, 64 nt, Human; identical to SEQ ID NO: 19196

SEQ ID NO: 309859 - RNA, 64 nt, Human
ugcauccccauccucaagacaguauauuuaccuugacuaauacagaacucuaccccaaagugaa

SEQ ID NO: 309860 - RNA, 64 nt, Human
uuuugaaugcccaacuguugcauucaaguuuucugacuaauaagaaauuaagcauucauccuuc

SEQ ID NO: 309861 - RNA, 64 nt, Human
guauuaaugaagugauuaauuggcuccauauuuagacuaauaaaacauuaagaaucuuccauaa

SEQ ID NO: 309862 - RNA, 64 nt, Human; identical to SEQ ID NO: 19197

SEQ ID NO: 309863 - RNA, 64 nt, Human; identical to SEQ ID NO: 19198

SEQ ID NO: 309864 - RNA, 64 nt, Human; identical to SEQ ID NO: 19199

SEQ ID NO: 309865 - RNA, 64 nt, Human; identical to SEQ ID NO: 19200

SEQ ID NO: 309866 - RNA, 64 nt, Human; identical to SEQ ID NO: 19201

SEQ ID NO: 309867 - RNA, 64 nt, Human; identical to SEQ ID NO: 19202

SEQ ID NO: 309868 - RNA, 64 nt, Human; identical to SEQ ID NO: 19203

SEQ ID NO: 309869 - RNA, 64 nt, Human; identical to SEQ ID NO: 19204

SEQ ID NO: 309870 - RNA, 64 nt, Human; identical to SEQ ID NO: 19205

SEQ ID NO: 309871 - RNA, 64 nt, Human; identical to SEQ ID NO: 19206

SEQ ID NO: 309872 - RNA, 64 nt, Human; identical to SEQ ID NO: 19207

SEQ ID NO: 309873 - RNA, 64 nt, Human; identical to SEQ ID NO: 19208

SEQ ID NO: 309874 - RNA, 64 nt, Human; identical to SEQ ID NO: 19209

SEQ ID NO: 309875 - RNA, 64 nt, Human; identical to SEQ ID NO: 19210

SEQ ID NO: 309876 - RNA, 64 nt, Human; identical to SEQ ID NO: 19211

SEQ ID NO: 309877 - RNA, 64 nt, Human; identical to SEQ ID NO: 19212

SEQ ID NO: 309878 - RNA, 64 nt, Human
gagccccagucuauaaauacagucacacccaggagacuaauaauaguaaccccagccaccaugu

SEQ ID NO: 309879 - RNA, 64 nt, Human
auagaaguauucgaaguauaguuccauuuuuugagacuaauaaaacauauguuuaaaaggacac

SEQ ID NO: 309880 - RNA, 64 nt, Human
ugccaagugaucaugagugucauuuuuguucuaagacuaauauuuuuagaucuuuuuacuucac

SEQ ID NO: 309881 - RNA, 64 nt, Human; identical to SEQ ID NO: 19213

SEQ ID NO: 309882 - RNA, 64 nt, Human; identical to SEQ ID NO: 19214

SEQ ID NO: 309883 - RNA, 64 nt, Human; identical to SEQ ID NO: 19215

SEQ ID NO: 309884 - RNA, 64 nt, Human; identical to SEQ ID NO: 19216

SEQ ID NO: 309885 - RNA, 64 nt, Human; identical to SEQ ID NO: 19217

SEQ ID NO: 309886 - RNA, 64 nt, Human; identical to SEQ ID NO: 19218

SEQ ID NO: 309887 - RNA, 57 nt, Human; identical to SEQ ID NO: 19219

SEQ ID NO: 309888 - RNA, 64 nt, Human; identical to SEQ ID NO: 19220

SEQ ID NO: 309889 - RNA, 64 nt, Human; identical to SEQ ID NO: 19221

SEQ ID NO: 309890 - RNA, 64 nt, Human; identical to SEQ ID NO: 19222

SEQ ID NO: 309891 - RNA, 64 nt, Human; identical to SEQ ID NO: 19223

SEQ ID NO: 309892 - RNA, 64 nt, Human; identical to SEQ ID NO: 19224

SEQ ID NO: 309893 - RNA, 64 nt, Human; identical to SEQ ID NO: 19225

SEQ ID NO: 309894 - RNA, 64 nt, Human; identical to SEQ ID NO: 19226

SEQ ID NO: 309895 - RNA, 64 nt, Human; identical to SEQ ID NO: 19227

SEQ ID NO: 309896 - RNA, 64 nt, Human; identical to SEQ ID NO: 19228

SEQ ID NO: 309897 - RNA, 62 nt, Human
cuaugugguccaucgccuucauuguguaaaugaggacacagacuggcuuggucgcagugacu

SEQ ID NO: 309898 - RNA, 62 nt, Human
ccccaguacccccagcccagccagccaauaagaggacacaaaugaggacacguggcuuuuau

SEQ ID NO: 309899 - RNA, 62 nt, Human
agaaaagcagaauuugguucaacuguugacagaggacacaaauacguuguuccagagcucag

SEQ ID NO: 309900 - RNA, 64 nt, Human; identical to SEQ ID NO: 19229

SEQ ID NO: 309901 - RNA, 64 nt, Human; identical to SEQ ID NO: 19230

SEQ ID NO: 309902 - RNA, 64 nt, Human; identical to SEQ ID NO: 19231

SEQ ID NO: 309903 - RNA, 64 nt, Human; identical to SEQ ID NO: 19232

SEQ ID NO: 309904 - RNA, 64 nt, Human; identical to SEQ ID NO: 19233

SEQ ID NO: 309905 - RNA, 64 nt, Human; identical to SEQ ID NO: 19234

SEQ ID NO: 309906 - RNA, 64 nt, Human; identical to SEQ ID NO: 19235

SEQ ID NO: 309907 - RNA, 64 nt, Human; identical to SEQ ID NO: 19236

SEQ ID NO: 309908 - RNA, 64 nt, Human; identical to SEQ ID NO: 19237

SEQ ID NO: 309909 - RNA, 64 nt, Human; identical to SEQ ID NO: 19238

SEQ ID NO: 309910 - RNA, 64 nt, Human; identical to SEQ ID NO: 19239

SEQ ID NO: 309911 - RNA, 64 nt, Human; identical to SEQ ID NO: 19240

SEQ ID NO: 309912 - RNA, 64 nt, Human; identical to SEQ ID NO: 19241

SEQ ID NO: 309913 - RNA, 64 nt, Human; identical to SEQ ID NO: 19242

SEQ ID NO: 309914 - RNA, 64 nt, Human; identical to SEQ ID NO: 19243

SEQ ID NO: 309915 - RNA, 64 nt, Human; identical to SEQ ID NO: 19244

SEQ ID NO: 309916 - RNA, 64 nt, Human
aucuuaaacccuacaaauuguucuuguuaaaaaugacuaauacugggggugcucaauaugcaua

SEQ ID NO: 309917 - RNA, 64 nt, Human
ucauaaucccaacuacaauaacaagaauuuuauugacuaauaagggaauauguauggaagaagg

SEQ ID NO: 309918 - RNA, 64 nt, Human
acccgccucuuccccuuucugucccgggauaccuggcggcaagagacuucuuggcuauugucca

SEQ ID NO: 309919 - RNA, 64 nt, Human; identical to SEQ ID NO: 19245

SEQ ID NO: 309920 - RNA, 64 nt, Human; identical to SEQ ID NO: 19246

SEQ ID NO: 309921 - RNA, 64 nt, Human; identical to SEQ ID NO: 19247

SEQ ID NO: 309922 - RNA, 64 nt, Human; identical to SEQ ID NO: 19248

SEQ ID NO: 309923 - RNA, 64 nt, Human; identical to SEQ ID NO: 19249

SEQ ID NO: 309924 - RNA, 50 nt, Human; identical to SEQ ID NO: 19250

SEQ ID NO: 309925 - RNA, 64 nt, Human; identical to SEQ ID NO: 19251

SEQ ID NO: 309926 - RNA, 64 nt, Human; identical to SEQ ID NO: 19252

SEQ ID NO: 309927 - RNA, 64 nt, Human; identical to SEQ ID NO: 19253

SEQ ID NO: 309928 - RNA, 64 nt, Human; identical to SEQ ID NO: 19254

SEQ ID NO: 309929 - RNA, 64 nt, Human; identical to SEQ ID NO: 19255

SEQ ID NO: 309930 - RNA, 64 nt, Human; identical to SEQ ID NO: 19256

SEQ ID NO: 309931 - RNA, 64 nt, Human; identical to SEQ ID NO: 19257

SEQ ID NO: 309932 - RNA, 64 nt, Human; identical to SEQ ID NO: 19258

SEQ ID NO: 309933 - RNA, 64 nt, Human; identical to SEQ ID NO: 19259

SEQ ID NO: 309934 - RNA, 64 nt, Human; identical to SEQ ID NO: 19260

SEQ ID NO: 309935 - RNA, 64 nt, Human
uugcaauagaugccacugggccacggggugccuggacuaauaacuauucucacaguaaaagagg

SEQ ID NO: 309936 - RNA, 64 nt, Human
ggagacacucagacacuugaacucaucuuuuuaugacuaauaguuuuuugauuaaaaaugugaa

SEQ ID NO: 309937 - RNA, 64 nt, Human
uugauaugucugcaugcaaaguggaacagaguugggcggcaaugacagaagagcuuccuuggcc

SEQ ID NO: 309938 - RNA, 64 nt, Human; identical to SEQ ID NO: 19261

SEQ ID NO: 309939 - RNA, 64 nt, Human; identical to SEQ ID NO: 19262

SEQ ID NO: 309940 - RNA, 64 nt, Human; identical to SEQ ID NO: 19263

SEQ ID NO: 309941 - RNA, 64 nt, Human; identical to SEQ ID NO: 19264

SEQ ID NO: 309942 - RNA, 64 nt, Human; identical to SEQ ID NO: 19265

SEQ ID NO: 309943 - RNA, 64 nt, Human; identical to SEQ ID NO: 19266

SEQ ID NO: 309944 - RNA, 64 nt, Human; identical to SEQ ID NO: 19267

SEQ ID NO: 309945 - RNA, 64 nt, Human; identical to SEQ ID NO: 19268

SEQ ID NO: 309946 - RNA, 64 nt, Human; identical to SEQ ID NO: 19269

SEQ ID NO: 309947 - RNA, 64 nt, Human; identical to SEQ ID NO: 19270

SEQ ID NO: 309948 - RNA, 64 nt, Human; identical to SEQ ID NO: 19271

SEQ ID NO: 309949 - RNA, 64 nt, Human; identical to SEQ ID NO: 19272

SEQ ID NO: 309950 - RNA, 64 nt, Human; identical to SEQ ID NO: 19273

SEQ ID NO: 309951 - RNA, 64 nt, Human; identical to SEQ ID NO: 19274

SEQ ID NO: 309952 - RNA, 64 nt, Human; identical to SEQ ID NO: 19275

SEQ ID NO: 309953 - RNA, 64 nt, Human; identical to SEQ ID NO: 19276

SEQ ID NO: 309954 - RNA, 64 nt, Human
ccucuagagggcuggugauugaggggcccgggcuggcggcaaagagggguuuggucucggggcu

SEQ ID NO: 309955 - RNA, 53 nt, Human
agcuccaagacucaaaguagcccggcggcaagaggcccauguuccggagagaa

SEQ ID NO: 309956 - RNA, 64 nt, Human
ggaagcccugacaacaacuaucaccaaaagacgaggcggcaaagauccagcggggcuucugggc

SEQ ID NO: 309957 - RNA, 64 nt, Human; identical to SEQ ID NO: 19277

SEQ ID NO: 309958 - RNA, 64 nt, Human; identical to SEQ ID NO: 19278

SEQ ID NO: 309959 - RNA, 64 nt, Human; identical to SEQ ID NO: 19279

SEQ ID NO: 309960 - RNA, 64 nt, Human; identical to SEQ ID NO: 19280

SEQ ID NO: 309961 - RNA, 64 nt, Human; identical to SEQ ID NO: 19281

SEQ ID NO: 309962 - RNA, 64 nt, Human; identical to SEQ ID NO: 19282

SEQ ID NO: 309963 - RNA, 64 nt, Human; identical to SEQ ID NO: 19283

SEQ ID NO: 309964 - RNA, 64 nt, Human; identical to SEQ ID NO: 19284

SEQ ID NO: 309965 - RNA, 64 nt, Human; identical to SEQ ID NO: 19285

SEQ ID NO: 309966 - RNA, 64 nt, Human; identical to SEQ ID NO: 19286

SEQ ID NO: 309967 - RNA, 64 nt, Human; identical to SEQ ID NO: 19287

SEQ ID NO: 309968 - RNA, 64 nt, Human; identical to SEQ ID NO: 19288

SEQ ID NO: 309969 - RNA, 64 nt, Human; identical to SEQ ID NO: 19289

SEQ ID NO: 309970 - RNA, 64 nt, Human; identical to SEQ ID NO: 19290

SEQ ID NO: 309971 - RNA, 64 nt, Human; identical to SEQ ID NO: 19291

SEQ ID NO: 309972 - RNA, 64 nt, Human; identical to SEQ ID NO: 19292

SEQ ID NO: 309973 - RNA, 64 nt, Human
guuucagugcagcaugguuacuaacgcuaugucagacuaauauuaaaaucagaaaauuuaaaug

SEQ ID NO: 309974 - RNA, 64 nt, Human
auauuuugcacuacacaaacgauaacauuuuaaggacuaauauugcugauacuugaauaaucaa

SEQ ID NO: 309975 - RNA, 64 nt, Human
uagcggggaugauguuaaguguggccaagcgcacggcggcaaguuuucaagcacugaguuucua

SEQ ID NO: 309976 - RNA, 64 nt, Human; identical to SEQ ID NO: 19293

SEQ ID NO: 309977 - RNA, 64 nt, Human; identical to SEQ ID NO: 19294

SEQ ID NO: 309978 - RNA, 64 nt, Human; identical to SEQ ID NO: 19295

SEQ ID NO: 309979 - RNA, 64 nt, Human; identical to SEQ ID NO: 19296

SEQ ID NO: 309980 - RNA, 64 nt, Human; identical to SEQ ID NO: 19297

SEQ ID NO: 309981 - RNA, 64 nt, Human; identical to SEQ ID NO: 19298

SEQ ID NO: 309982 - RNA, 64 nt, Human; identical to SEQ ID NO: 19299

SEQ ID NO: 309983 - RNA, 64 nt, Human; identical to SEQ ID NO: 19300

SEQ ID NO: 309984 - RNA, 64 nt, Human; identical to SEQ ID NO: 19301

SEQ ID NO: 309985 - RNA, 64 nt, Human; identical to SEQ ID NO: 19302

SEQ ID NO: 309986 - RNA, 64 nt, Human; identical to SEQ ID NO: 19303

SEQ ID NO: 309987 - RNA, 64 nt, Human; identical to SEQ ID NO: 19304

SEQ ID NO: 309988 - RNA, 64 nt, Human; identical to SEQ ID NO: 19305

SEQ ID NO: 309989 - RNA, 64 nt, Human; identical to SEQ ID NO: 19306

SEQ ID NO: 309990 - RNA, 64 nt, Human; identical to SEQ ID NO: 19307

SEQ ID NO: 309991 - RNA, 64 nt, Human; identical to SEQ ID NO: 19308

SEQ ID NO: 309992 - RNA, 64 nt, Human
agaaucguuccuuccuugcugcauuuccuccuuagacuaauagacguuuuggaaaguucggcua

SEQ ID NO: 309993 - RNA, 64 nt, Human
gaauuaacauuuggugauuaugccuagcuuuuuugacuaauauaaagaucauagcuccccuuca

SEQ ID NO: 309994 - RNA, 64 nt, Human
agccuggaugugggccaaguccacuguccuccuuggcggcaaaagcccauugaagaagaaccag

SEQ ID NO: 309995 - RNA, 53 nt, Human; identical to SEQ ID NO: 19309

SEQ ID NO: 309996 - RNA, 64 nt, Human; identical to SEQ ID NO: 19310

SEQ ID NO: 309997 - RNA, 64 nt, Human; identical to SEQ ID NO: 19311

SEQ ID NO: 309998 - RNA, 64 nt, Human; identical to SEQ ID NO: 19312

SEQ ID NO: 309999 - RNA, 64 nt, Human; identical to SEQ ID NO: 19313

SEQ ID NO: 310000 - RNA, 64 nt, Human; identical to SEQ ID NO: 19314

SEQ ID NO: 310001 - RNA, 64 nt, Human; identical to SEQ ID NO: 19315

SEQ ID NO: 310002 - RNA, 64 nt, Human; identical to SEQ ID NO: 19316

SEQ ID NO: 310003 - RNA, 64 nt, Human; identical to SEQ ID NO: 19317

SEQ ID NO: 310004 - RNA, 64 nt, Human; identical to SEQ ID NO: 19318

SEQ ID NO: 310005 - RNA, 64 nt, Human; identical to SEQ ID NO: 19319

SEQ ID NO: 310006 - RNA, 64 nt, Human; identical to SEQ ID NO: 19320

SEQ ID NO: 310007 - RNA, 64 nt, Human; identical to SEQ ID NO: 19321

SEQ ID NO: 310008 - RNA, 56 nt, Human; identical to SEQ ID NO: 19322

SEQ ID NO: 310009 - RNA, 64 nt, Human; identical to SEQ ID NO: 19323

SEQ ID NO: 310010 - RNA, 64 nt, Human; identical to SEQ ID NO: 19324

SEQ ID NO: 310011 - RNA, 64 nt, Human
aaggcaacacaacuaaugucaucuuuucauuaaagacuaauagaaauuuagaaaucauuguguu

SEQ ID NO: 310012 - RNA, 64 nt, Human
uuugacauuaugugaauauuuuacuggaaaauaagacuaauaaauuguuaaaaguuuuuaaaau

SEQ ID NO: 310013 - RNA, 64 nt, Human
uaucacuauguauuuuaugaacagaauugacugggacuaauaucacaggaucaaucaucucaga

SEQ ID NO: 310014 - RNA, 64 nt, Human; identical to SEQ ID NO: 19325

SEQ ID NO: 310015 - RNA, 64 nt, Human; identical to SEQ ID NO: 19326

SEQ ID NO: 310016 - RNA, 64 nt, Human; identical to SEQ ID NO: 19327

SEQ ID NO: 310017 - RNA, 64 nt, Human; identical to SEQ ID NO: 19328

SEQ ID NO: 310018 - RNA, 64 nt, Human; identical to SEQ ID NO: 19329

SEQ ID NO: 310019 - RNA, 64 nt, Human; identical to SEQ ID NO: 19330

SEQ ID NO: 310020 - RNA, 64 nt, Human; identical to SEQ ID NO: 19331

SEQ ID NO: 310021 - RNA, 64 nt, Human; identical to SEQ ID NO: 19332

SEQ ID NO: 310022 - RNA, 64 nt, Human; identical to SEQ ID NO: 19333

SEQ ID NO: 310023 - RNA, 64 nt, Human; identical to SEQ ID NO: 19334

SEQ ID NO: 310024 - RNA, 64 nt, Human; identical to SEQ ID NO: 19335

SEQ ID NO: 310025 - RNA, 64 nt, Human; identical to SEQ ID NO: 19336

SEQ ID NO: 310026 - RNA, 64 nt, Human; identical to SEQ ID NO: 19337

SEQ ID NO: 310027 - RNA, 64 nt, Human; identical to SEQ ID NO: 19338

SEQ ID NO: 310028 - RNA, 64 nt, Human; identical to SEQ ID NO: 19339

SEQ ID NO: 310029 - RNA, 64 nt, Human; identical to SEQ ID NO: 19340

SEQ ID NO: 310030 - RNA, 64 nt, Human
gugcuucuugcagcagguggucaaagaaaagcaugacuaauacgaccuauuagaguaaucuaca

SEQ ID NO: 310031 - RNA, 64 nt, Human
uuuguuuuuguuguuggauaacaagaaaugucuagacuaauauucaucaguuuuacaaacauaa

SEQ ID NO: 310032 - RNA, 64 nt, Human
aauguaugucuagcaucaaaugaguauuguaaaagacuaauauaaaaugguuuauaagacugau

SEQ ID NO: 310033 - RNA, 64 nt, Human; identical to SEQ ID NO: 19341

SEQ ID NO: 310034 - RNA, 64 nt, Human; identical to SEQ ID NO: 19342

SEQ ID NO: 310035 - RNA, 64 nt, Human; identical to SEQ ID NO: 19343

SEQ ID NO: 310036 - RNA, 64 nt, Human; identical to SEQ ID NO: 19344

SEQ ID NO: 310037 - RNA, 64 nt, Human; identical to SEQ ID NO: 19345

SEQ ID NO: 310038 - RNA, 64 nt, Human; identical to SEQ ID NO: 19346

SEQ ID NO: 310039 - RNA, 64 nt, Human; identical to SEQ ID NO: 19347

SEQ ID NO: 310040 - RNA, 64 nt, Human; identical to SEQ ID NO: 19348

SEQ ID NO: 310041 - RNA, 64 nt, Human; identical to SEQ ID NO: 19349

SEQ ID NO: 310042 - RNA, 64 nt, Human; identical to SEQ ID NO: 19350

SEQ ID NO: 310043 - RNA, 64 nt, Human; identical to SEQ ID NO: 19351

SEQ ID NO: 310044 - RNA, 64 nt, Human; identical to SEQ ID NO: 19352

SEQ ID NO: 310045 - RNA, 64 nt, Human; identical to SEQ ID NO: 19353

SEQ ID NO: 310046 - RNA, 64 nt, Human; identical to SEQ ID NO: 19354

SEQ ID NO: 310047 - RNA, 64 nt, Human; identical to SEQ ID NO: 19355

SEQ ID NO: 310048 - RNA, 64 nt, Human; identical to SEQ ID NO: 19356

SEQ ID NO: 310049 - RNA, 64 nt, Human
auuuaggauuugccgcuuccauaaaucaaagcaugacuaauagggggucucugaaauguaaggg

SEQ ID NO: 310050 - RNA, 64 nt, Human
ggaucagaaaauauacacuauauuuauuagagaagacuaauaaauggacacuuaauucaaaaau

SEQ ID NO: 310051 - RNA, 64 nt, Human
cgggggcuggagaaggccuggauaaagacagaagggcggcaacacaccaccccagcccccaccc

SEQ ID NO: 310052 - RNA, 64 nt, Human; identical to SEQ ID NO: 19357

SEQ ID NO: 310053 - RNA, 64 nt, Human; identical to SEQ ID NO: 19358

SEQ ID NO: 310054 - RNA, 64 nt, Human; identical to SEQ ID NO: 19359

SEQ ID NO: 310055 - RNA, 64 nt, Human; identical to SEQ ID NO: 19360

SEQ ID NO: 310056 - RNA, 64 nt, Human; identical to SEQ ID NO: 19361

SEQ ID NO: 310057 - RNA, 64 nt, Human; identical to SEQ ID NO: 19362

SEQ ID NO: 310058 - RNA, 64 nt, Human; identical to SEQ ID NO: 19363

SEQ ID NO: 310059 - RNA, 64 nt, Human; identical to SEQ ID NO: 19364

SEQ ID NO: 310060 - RNA, 64 nt, Human; identical to SEQ ID NO: 19365

SEQ ID NO: 310061 - RNA, 64 nt, Human; identical to SEQ ID NO: 19366

SEQ ID NO: 310062 - RNA, 64 nt, Human; identical to SEQ ID NO: 19367

SEQ ID NO: 310063 - RNA, 58 nt, Human; identical to SEQ ID NO: 19368

SEQ ID NO: 310064 - RNA, 64 nt, Human; identical to SEQ ID NO: 19369

SEQ ID NO: 310065 - RNA, 64 nt, Human; identical to SEQ ID NO: 19370

SEQ ID NO: 310066 - RNA, 64 nt, Human; identical to SEQ ID NO: 19371

SEQ ID NO: 310067 - RNA, 64 nt, Human; identical to SEQ ID NO: 19372

SEQ ID NO: 310068 - RNA, 64 nt, Human
ccaaguggugccuaaaguuuaaccaaaaagaccagacuaauauauuaauauauaucugcugucc

SEQ ID NO: 310069 - RNA, 64 nt, Human
ugagaccugguacaacacggaaaugauucuuauagacuaauacagcagcucacacuucgacaag

SEQ ID NO: 310070 - RNA, 64 nt, Human
gucaugggcaguccuuuacagcagcaugagaauggacuaauacacuccucaaauguuuugaaga

SEQ ID NO: 310071 - RNA, 64 nt, Human; identical to SEQ ID NO: 19373

SEQ ID NO: 310072 - RNA, 64 nt, Human; identical to SEQ ID NO: 19374

SEQ ID NO: 310073 - RNA, 64 nt, Human; identical to SEQ ID NO: 19375

SEQ ID NO: 310074 - RNA, 64 nt, Human; identical to SEQ ID NO: 19376

SEQ ID NO: 310075 - RNA, 64 nt, Human; identical to SEQ ID NO: 19377

SEQ ID NO: 310076 - RNA, 64 nt, Human; identical to SEQ ID NO: 19378

SEQ ID NO: 310077 - RNA, 64 nt, Human; identical to SEQ ID NO: 19379

SEQ ID NO: 310078 - RNA, 64 nt, Human; identical to SEQ ID NO: 19380

SEQ ID NO: 310079 - RNA, 64 nt, Human; identical to SEQ ID NO: 19381

SEQ ID NO: 310080 - RNA, 62 nt, Human; identical to SEQ ID NO: 19382

SEQ ID NO: 310081 - RNA, 64 nt, Human; identical to SEQ ID NO: 19383

SEQ ID NO: 310082 - RNA, 64 nt, Human; identical to SEQ ID NO: 19384

SEQ ID NO: 310083 - RNA, 64 nt, Human; identical to SEQ ID NO: 19385

SEQ ID NO: 310084 - RNA, 64 nt, Human; identical to SEQ ID NO: 19386

SEQ ID NO: 310085 - RNA, 64 nt, Human; identical to SEQ ID NO: 19387

SEQ ID NO: 310086 - RNA, 64 nt, Human; identical to SEQ ID NO: 19388

SEQ ID NO: 310087 - RNA, 64 nt, Human
gguuaucuccucucauacaucaagccccagaggaggcggcaagaggaacagccacaaacaagua

SEQ ID NO: 310088 - RNA, 64 nt, Human
uaggauguaacauaaugaaacacaccugucuaggggcggcaaucaacagucuuacacagagagg

SEQ ID NO: 310089 - RNA, 62 nt, Human
gucccacuugggggucuagaccaggauuauagaggacacagcaagugaguccuccccacucu

SEQ ID NO: 310090 - RNA, 64 nt, Human; identical to SEQ ID NO: 19389

SEQ ID NO: 310091 - RNA, 64 nt, Human; identical to SEQ ID NO: 19390

SEQ ID NO: 310092 - RNA, 64 nt, Human; identical to SEQ ID NO: 19391

SEQ ID NO: 310093 - RNA, 64 nt, Human; identical to SEQ ID NO: 19392

SEQ ID NO: 310094 - RNA, 64 nt, Human; identical to SEQ ID NO: 19393

SEQ ID NO: 310095 - RNA, 64 nt, Human; identical to SEQ ID NO: 19394

SEQ ID NO: 310096 - RNA, 64 nt, Human; identical to SEQ ID NO: 19395

SEQ ID NO: 310097 - RNA, 64 nt, Human; identical to SEQ ID NO: 19396

SEQ ID NO: 310098 - RNA, 64 nt, Human; identical to SEQ ID NO: 19397

SEQ ID NO: 310099 - RNA, 64 nt, Human; identical to SEQ ID NO: 19398

SEQ ID NO: 310100 - RNA, 64 nt, Human; identical to SEQ ID NO: 19399

SEQ ID NO: 310101 - RNA, 64 nt, Human; identical to SEQ ID NO: 19400

SEQ ID NO: 310102 - RNA, 64 nt, Human; identical to SEQ ID NO: 19401

SEQ ID NO: 310103 - RNA, 64 nt, Human; identical to SEQ ID NO: 19402

SEQ ID NO: 310104 - RNA, 64 nt, Human; identical to SEQ ID NO: 19403

SEQ ID NO: 310105 - RNA, 64 nt, Human; identical to SEQ ID NO: 19404

SEQ ID NO: 310106 - RNA, 64 nt, Human
ucaaaaucaacacaauguguucugaaacuuucgugacuaauaccaugcaucugugaucaaugaa

SEQ ID NO: 310107 - RNA, 64 nt, Human
cuuuauuuuaauagugaucuugauccuguugugggacuaauacaagaucuauauuuaaguuuua

SEQ ID NO: 310108 - RNA, 64 nt, Human
ugaaaccugguucaacauggaaaugauccugauugacuaauacauuaucucacacuuucaugag

SEQ ID NO: 310109 - RNA, 64 nt, Human; identical to SEQ ID NO: 19405

SEQ ID NO: 310110 - RNA, 64 nt, Human; identical to SEQ ID NO: 19406

SEQ ID NO: 310111 - RNA, 64 nt, Human; identical to SEQ ID NO: 19407

SEQ ID NO: 310112 - RNA, 64 nt, Human; identical to SEQ ID NO: 19408

SEQ ID NO: 310113 - RNA, 64 nt, Human; identical to SEQ ID NO: 19409

SEQ ID NO: 310114 - RNA, 64 nt, Human; identical to SEQ ID NO: 19410

SEQ ID NO: 310115 - RNA, 64 nt, Human; identical to SEQ ID NO: 19411

SEQ ID NO: 310116 - RNA, 64 nt, Human; identical to SEQ ID NO: 19412

SEQ ID NO: 310117 - RNA, 64 nt, Human; identical to SEQ ID NO: 19413

SEQ ID NO: 310118 - RNA, 64 nt, Human; identical to SEQ ID NO: 19414

SEQ ID NO: 310119 - RNA, 64 nt, Human; identical to SEQ ID NO: 19415

SEQ ID NO: 310120 - RNA, 64 nt, Human; identical to SEQ ID NO: 19416

SEQ ID NO: 310121 - RNA, 64 nt, Human; identical to SEQ ID NO: 19417

SEQ ID NO: 310122 - RNA, 64 nt, Human; identical to SEQ ID NO: 19418

SEQ ID NO: 310123 - RNA, 64 nt, Human; identical to SEQ ID NO: 19419

SEQ ID NO: 310124 - RNA, 64 nt, Human; identical to SEQ ID NO: 19420

SEQ ID NO: 310125 - RNA, 64 nt, Human
cacgugcagguggagcucugggaugcuauguuggggcggcaagcggugggccgagggccgggua

SEQ ID NO: 310126 - RNA, 64 nt, Human
cgggcguggaccacccgcccuggcaguugaauggggcggcaauugcggggcccaccuuagaccg

SEQ ID NO: 310127 - RNA, 64 nt, Human
gaugaaggagagauacuuaggaaauccuaaaagaggcggcaagaagguaccucccuguguaacu

SEQ ID NO: 310128 - RNA, 64 nt, Human; identical to SEQ ID NO: 19421

SEQ ID NO: 310129 - RNA, 64 nt, Human; identical to SEQ ID NO: 19422

SEQ ID NO: 310130 - RNA, 64 nt, Human; identical to SEQ ID NO: 19423

SEQ ID NO: 310131 - RNA, 64 nt, Human; identical to SEQ ID NO: 19424

SEQ ID NO: 310132 - RNA, 64 nt, Human; identical to SEQ ID NO: 19425

SEQ ID NO: 310133 - RNA, 64 nt, Human; identical to SEQ ID NO: 19426

SEQ ID NO: 310134 - RNA, 64 nt, Human; identical to SEQ ID NO: 19427

SEQ ID NO: 310135 - RNA, 64 nt, Human; identical to SEQ ID NO: 19428

SEQ ID NO: 310136 - RNA, 64 nt, Human; identical to SEQ ID NO: 19429

SEQ ID NO: 310137 - RNA, 64 nt, Human; identical to SEQ ID NO: 19430

SEQ ID NO: 310138 - RNA, 64 nt, Human; identical to SEQ ID NO: 19431

SEQ ID NO: 310139 - RNA, 64 nt, Human; identical to SEQ ID NO: 19432

SEQ ID NO: 310140 - RNA, 64 nt, Human; identical to SEQ ID NO: 19433

SEQ ID NO: 310141 - RNA, 64 nt, Human; identical to SEQ ID NO: 19434

SEQ ID NO: 310142 - RNA, 64 nt, Human; identical to SEQ ID NO: 19435

SEQ ID NO: 310143 - RNA, 64 nt, Human; identical to SEQ ID NO: 19436

SEQ ID NO: 310144 - RNA, 64 nt, Human
aguaaccaguaguucaucaaaaccaacuuguacagacuaauaaaucuuuuucacaguauucagu

SEQ ID NO: 310145 - RNA, 64 nt, Human
gauccccaguguuuggaacauaagucacuaugcagacuaauaaacaucaacuagagagaacucc

SEQ ID NO: 310146 - RNA, 64 nt, Human
uauuacugcuaccacuaacagguuguaaauagaagacuaauacuuaauuaaagucaccuuccua

SEQ ID NO: 310147 - RNA, 64 nt, Human; identical to SEQ ID NO: 19437

SEQ ID NO: 310148 - RNA, 59 nt, Human; identical to SEQ ID NO: 19438

SEQ ID NO: 310149 - RNA, 64 nt, Human; identical to SEQ ID NO: 19439

SEQ ID NO: 310150 - RNA, 64 nt, Human; identical to SEQ ID NO: 19440

SEQ ID NO: 310151 - RNA, 64 nt, Human; identical to SEQ ID NO: 19441

SEQ ID NO: 310152 - RNA, 64 nt, Human; identical to SEQ ID NO: 19442

SEQ ID NO: 310153 - RNA, 64 nt, Human; identical to SEQ ID NO: 19443

SEQ ID NO: 310154 - RNA, 64 nt, Human; identical to SEQ ID NO: 19444

SEQ ID NO: 310155 - RNA, 64 nt, Human; identical to SEQ ID NO: 19445

SEQ ID NO: 310156 - RNA, 64 nt, Human; identical to SEQ ID NO: 19446

SEQ ID NO: 310157 - RNA, 64 nt, Human; identical to SEQ ID NO: 19447

SEQ ID NO: 310158 - RNA, 64 nt, Human; identical to SEQ ID NO: 19448

SEQ ID NO: 310159 - RNA, 64 nt, Human; identical to SEQ ID NO: 19449

SEQ ID NO: 310160 - RNA, 64 nt, Human; identical to SEQ ID NO: 19450

SEQ ID NO: 310161 - RNA, 64 nt, Human; identical to SEQ ID NO: 19451

SEQ ID NO: 310162 - RNA, 64 nt, Human; identical to SEQ ID NO: 19452

SEQ ID NO: 310163 - RNA, 64 nt, Human
acaaaugauugcaugaggccauguuuauaugugugacuaauaaggcuugucaugauuaacauaa

SEQ ID NO: 310164 - RNA, 64 nt, Human
cuuuggcuguguuuuaucuuuaaugaacguuucugacuaauauuuuguuguaaaccauuaagua

SEQ ID NO: 310165 - RNA, 64 nt, Human
uacauauuccacauauguauuuaguauaaucugugacuaauaaagacauuuuaaaaaaccaugc

SEQ ID NO: 310166 - RNA, 64 nt, Human; identical to SEQ ID NO: 19453

SEQ ID NO: 310167 - RNA, 64 nt, Human; identical to SEQ ID NO: 19454

SEQ ID NO: 310168 - RNA, 64 nt, Human; identical to SEQ ID NO: 19455

SEQ ID NO: 310169 - RNA, 64 nt, Human; identical to SEQ ID NO: 19456

SEQ ID NO: 310170 - RNA, 64 nt, Human; identical to SEQ ID NO: 19457

SEQ ID NO: 310171 - RNA, 64 nt, Human; identical to SEQ ID NO: 19458

SEQ ID NO: 310172 - RNA, 64 nt, Human; identical to SEQ ID NO: 19459

SEQ ID NO: 310173 - RNA, 64 nt, Human; identical to SEQ ID NO: 19460

SEQ ID NO: 310174 - RNA, 64 nt, Human; identical to SEQ ID NO: 19461

SEQ ID NO: 310175 - RNA, 64 nt, Human; identical to SEQ ID NO: 19462

SEQ ID NO: 310176 - RNA, 64 nt, Human; identical to SEQ ID NO: 19463

SEQ ID NO: 310177 - RNA, 64 nt, Human; identical to SEQ ID NO: 19464

SEQ ID NO: 310178 - RNA, 64 nt, Human; identical to SEQ ID NO: 19465

SEQ ID NO: 310179 - RNA, 64 nt, Human; identical to SEQ ID NO: 19466

SEQ ID NO: 310180 - RNA, 64 nt, Human; identical to SEQ ID NO: 19467

SEQ ID NO: 310181 - RNA, 64 nt, Human; identical to SEQ ID NO: 19468

SEQ ID NO: 310182 - RNA, 64 nt, Human
ucacaaaauauauuuuaucugugauuagccauuugacuaauaauacuggcuaacagauguugaa

SEQ ID NO: 310183 - RNA, 64 nt, Human
aaauuaaagaauaaaguuagacaagcaacugguugacuaauacauuaagcguuugagucuaaga

SEQ ID NO: 310184 - RNA, 64 nt, Human
ggaguacccccagcccaagagaugaacaucuggggacuaauaucauagacccaucuggaggcuc

SEQ ID NO: 310185 - RNA, 64 nt, Human; identical to SEQ ID NO: 19469

SEQ ID NO: 310186 - RNA, 64 nt, Human; identical to SEQ ID NO: 19470

SEQ ID NO: 310187 - RNA, 64 nt, Human; identical to SEQ ID NO: 19471

SEQ ID NO: 310188 - RNA, 64 nt, Human; identical to SEQ ID NO: 19472

SEQ ID NO: 310189 - RNA, 64 nt, Human; identical to SEQ ID NO: 19473

SEQ ID NO: 310190 - RNA, 64 nt, Human; identical to SEQ ID NO: 19474

SEQ ID NO: 310191 - RNA, 64 nt, Human; identical to SEQ ID NO: 19475

SEQ ID NO: 310192 - RNA, 64 nt, Human; identical to SEQ ID NO: 19476

SEQ ID NO: 310193 - RNA, 64 nt, Human; identical to SEQ ID NO: 19477

SEQ ID NO: 310194 - RNA, 64 nt, Human; identical to SEQ ID NO: 19478

SEQ ID NO: 310195 - RNA, 64 nt, Human; identical to SEQ ID NO: 19479

SEQ ID NO: 310196 - RNA, 64 nt, Human; identical to SEQ ID NO: 19480

SEQ ID NO: 310197 - RNA, 64 nt, Human; identical to SEQ ID NO: 19481

SEQ ID NO: 310198 - RNA, 64 nt, Human; identical to SEQ ID NO: 19482

SEQ ID NO: 310199 - RNA, 64 nt, Human; identical to SEQ ID NO: 19483

SEQ ID NO: 310200 - RNA, 64 nt, Human; identical to SEQ ID NO: 19484

SEQ ID NO: 310201 - RNA, 64 nt, Human
cugccauuaacacaucugguuacugcuguaacaugacuaauaaaaccgaacgccuguuccccuu

SEQ ID NO: 310202 - RNA, 64 nt, Human
auaucauauugauuuugucucucuggagaacccugacuaauaaaaugaggcaucuaaaauucua

SEQ ID NO: 310203 - RNA, 64 nt, Human
uaaaauguuguagugaagcccacaauugaccuuugacuaauaggaguuuuaaguauguuaaaaa

SEQ ID NO: 310204 - RNA, 64 nt, Human; identical to SEQ ID NO: 19485

SEQ ID NO: 310205 - RNA, 64 nt, Human; identical to SEQ ID NO: 19486

SEQ ID NO: 310206 - RNA, 64 nt, Human; identical to SEQ ID NO: 19487

SEQ ID NO: 310207 - RNA, 64 nt, Human; identical to SEQ ID NO: 19488

SEQ ID NO: 310208 - RNA, 64 nt, Human; identical to SEQ ID NO: 19489

SEQ ID NO: 310209 - RNA, 64 nt, Human; identical to SEQ ID NO: 19490

SEQ ID NO: 310210 - RNA, 64 nt, Human; identical to SEQ ID NO: 19491

SEQ ID NO: 310211 - RNA, 64 nt, Human; identical to SEQ ID NO: 19492

SEQ ID NO: 310212 - RNA, 64 nt, Human; identical to SEQ ID NO: 19493

SEQ ID NO: 310213 - RNA, 64 nt, Human; identical to SEQ ID NO: 19494

SEQ ID NO: 310214 - RNA, 64 nt, Human; identical to SEQ ID NO: 19495

SEQ ID NO: 310215 - RNA, 64 nt, Human; identical to SEQ ID NO: 19496

SEQ ID NO: 310216 - RNA, 64 nt, Human; identical to SEQ ID NO: 19497

SEQ ID NO: 310217 - RNA, 64 nt, Human; identical to SEQ ID NO: 19498

SEQ ID NO: 310218 - RNA, 64 nt, Human; identical to SEQ ID NO: 19499

SEQ ID NO: 310219 - RNA, 64 nt, Human; identical to SEQ ID NO: 19500

SEQ ID NO: 310220 - RNA, 64 nt, Human
ugaaaacugguucaacauggcaaugauccugauugacuaauacauuaucucacacuuucaugag

SEQ ID NO: 310221 - RNA, 64 nt, Human; identical to SEQ ID NO: 310220

SEQ ID NO: 310222 - RNA, 64 nt, Human
accucgugcucacggauuuuauuacacagauaguggcggcaauggccucagcccagcccacccu

SEQ ID NO: 310223 - RNA, 64 nt, Human; identical to SEQ ID NO: 19501

SEQ ID NO: 310224 - RNA, 64 nt, Human; identical to SEQ ID NO: 19502

SEQ ID NO: 310225 - RNA, 64 nt, Human; identical to SEQ ID NO: 19503

SEQ ID NO: 310226 - RNA, 64 nt, Human; identical to SEQ ID NO: 19504

SEQ ID NO: 310227 - RNA, 64 nt, Human; identical to SEQ ID NO: 19505

SEQ ID NO: 310228 - RNA, 64 nt, Human; identical to SEQ ID NO: 19506

SEQ ID NO: 310229 - RNA, 64 nt, Human; identical to SEQ ID NO: 19507

SEQ ID NO: 310230 - RNA, 64 nt, Human; identical to SEQ ID NO: 19508

SEQ ID NO: 310231 - RNA, 64 nt, Human; identical to SEQ ID NO: 19509

SEQ ID NO: 310232 - RNA, 64 nt, Human; identical to SEQ ID NO: 19510

SEQ ID NO: 310233 - RNA, 64 nt, Human; identical to SEQ ID NO: 19511

SEQ ID NO: 310234 - RNA, 64 nt, Human; identical to SEQ ID NO: 19512

SEQ ID NO: 310235 - RNA, 64 nt, Human; identical to SEQ ID NO: 19513

SEQ ID NO: 310236 - RNA, 64 nt, Human; identical to SEQ ID NO: 19514

SEQ ID NO: 310237 - RNA, 64 nt, Human; identical to SEQ ID NO: 19515

SEQ ID NO: 310238 - RNA, 64 nt, Human; identical to SEQ ID NO: 19516

SEQ ID NO: 310239 - RNA, 64 nt, Human
cuguaaaugggggcuccauuaguucugcugccgagacuaauaaagauuugguuggcucuagcag

SEQ ID NO: 310240 - RNA, 64 nt, Human
cauuugauuauuuucacuauuaguuauuauguaugacuaauaaaagcucucggcuuaaaauuau

SEQ ID NO: 310241 - RNA, 64 nt, Human
auggaaaguaauugguauucuuaauauccugggugacuaauauccaggcagagaagcuccugga

SEQ ID NO: 310242 - RNA, 64 nt, Human; identical to SEQ ID NO: 19517

SEQ ID NO: 310243 - RNA, 64 nt, Human; identical to SEQ ID NO: 19518

SEQ ID NO: 310244 - RNA, 64 nt, Human; identical to SEQ ID NO: 19519

SEQ ID NO: 310245 - RNA, 64 nt, Human; identical to SEQ ID NO: 19520

SEQ ID NO: 310246 - RNA, 64 nt, Human; identical to SEQ ID NO: 19521

SEQ ID NO: 310247 - RNA, 64 nt, Human; identical to SEQ ID NO: 19522

SEQ ID NO: 310248 - RNA, 64 nt, Human; identical to SEQ ID NO: 19523

SEQ ID NO: 310249 - RNA, 64 nt, Human; identical to SEQ ID NO: 19524

SEQ ID NO: 310250 - RNA, 64 nt, Human; identical to SEQ ID NO: 19525

SEQ ID NO: 310251 - RNA, 64 nt, Human; identical to SEQ ID NO: 19526

SEQ ID NO: 310252 - RNA, 64 nt, Human; identical to SEQ ID NO: 19527

SEQ ID NO: 310253 - RNA, 64 nt, Human; identical to SEQ ID NO: 19528

SEQ ID NO: 310254 - RNA, 64 nt, Human; identical to SEQ ID NO: 19529

SEQ ID NO: 310255 - RNA, 64 nt, Human; identical to SEQ ID NO: 19530

SEQ ID NO: 310256 - RNA, 64 nt, Human; identical to SEQ ID NO: 19531

SEQ ID NO: 310257 - RNA, 64 nt, Human; identical to SEQ ID NO: 19532

SEQ ID NO: 310258 - RNA, 64 nt, Human
acugauguaacuuucuagacuggacaacaaagaugacuaauaguaaucacuccaaguugauguu

SEQ ID NO: 310259 - RNA, 64 nt, Human
ccgcauuuuuaaaugguugggaaaagaaaucaaagacuaauaauucaugacgugaaaauuauca

SEQ ID NO: 310260 - RNA, 64 nt, Human
guguuuuggggcauuuguggaacuuacccauggggacuaauauggaaaaggucuguccauagug

SEQ ID NO: 310261 - RNA, 64 nt, Human; identical to SEQ ID NO: 19533

SEQ ID NO: 310262 - RNA, 64 nt, Human; identical to SEQ ID NO: 19534

SEQ ID NO: 310263 - RNA, 64 nt, Human; identical to SEQ ID NO: 19535

SEQ ID NO: 310264 - RNA, 64 nt, Human; identical to SEQ ID NO: 19536

SEQ ID NO: 310265 - RNA, 64 nt, Human; identical to SEQ ID NO: 19537

SEQ ID NO: 310266 - RNA, 64 nt, Human; identical to SEQ ID NO: 19538

SEQ ID NO: 310267 - RNA, 64 nt, Human; identical to SEQ ID NO: 19539

SEQ ID NO: 310268 - RNA, 64 nt, Human; identical to SEQ ID NO: 19540

SEQ ID NO: 310269 - RNA, 64 nt, Human; identical to SEQ ID NO: 19541

SEQ ID NO: 310270 - RNA, 64 nt, Human; identical to SEQ ID NO: 19542

SEQ ID NO: 310271 - RNA, 64 nt, Human; identical to SEQ ID NO: 19543

SEQ ID NO: 310272 - RNA, 54 nt, Human
uuuggcaaugcaaagaaugaagaugacuaauaguacuuguacuucccaccacug

SEQ ID NO: 310273 - RNA, 64 nt, Human
cugaacugcuaauguggcugcuuuguagggaauggacuaauaucaguguguuagaucuuaaggu

SEQ ID NO: 310274 - RNA, 64 nt, Human
cugaccuguuuuugguccacuuuugcccuuccaugacuaauaaggaagauauguguguauuuca

SEQ ID NO: 310275 - RNA, 64 nt, Human
cacacuuugcaaagccacagcguuucugguuuuggguguacagucuugugugccuggcgagaag

SEQ ID NO: 310276 - RNA, 64 nt, Human
cuauuacaggaaugugacuuuuccuucucuuagggguguacaacucuaaaaacuuuuuacuugg

SEQ ID NO: 310277 - RNA, 64 nt, Human
gggccuuaugagaaaaccuguguggacaucccuugguguacacuaagacagagcagagcccagc

SEQ ID NO: 310278 - RNA, 64 nt, Human
aauuaugggaaucaagauuuaauccuagagauuugguguacaauucaggcuuuggauguuucuu

SEQ ID NO: 310279 - RNA, 64 nt, Human
ucuauuccugccgggaggaaccucaguuggguaagguguacauaccuguacaguuuuggucauc

SEQ ID NO: 310280 - RNA, 64 nt, Human
agcugauggccaguguauacagagcguggcccgcgguguacaauacccauauaagguacauugu

SEQ ID NO: 310281 - RNA, 64 nt, Human
uaauugcacaaaacccaugccagcucagaguuuagguguacacauuuacccaguugagcguucu

SEQ ID NO: 310282 - RNA, 64 nt, Human
uuccuuguuugaauauagaauuguaacacuacacgguguacauuuccagagccuuguguauauu

SEQ ID NO: 310283 - RNA, 64 nt, Human
guuucucauuuggaugaaaaccccuucaacuggugguguacaacugaagcuacuauaucuuuuu

SEQ ID NO: 310284 - RNA, 64 nt, Human
uuuugucagcuuuguccaagaucagaugauuguagguguacagcauuauuucuggacucucugu

SEQ ID NO: 310285 - RNA, 64 nt, Human
uaaaauguaagcccuacuguaagguuuagcacuggguguacauauuuauuaaaaauuuuuauua

SEQ ID NO: 310286 - RNA, 64 nt, Human
aacuaaauaccauucacuacucaugcgugagauggguguacaaacucauccucuuuuaauggca

SEQ ID NO: 310287 - RNA, 64 nt, Human
gcuuugauuucucccaaagaauaacuuggagguugacuaauaagaaaguuggcauaaacuuuca

SEQ ID NO: 310288 - RNA, 64 nt, Human
accugcugggguccuuuguuaggucauuuucagugacuaauagggauaauccagguaacuuuga

SEQ ID NO: 310289 - RNA, 64 nt, Human
uccuuugcaaauggcucagugacuggaagaggcggacuaauagccagaguuaaauauaaauaca

SEQ ID NO: 310290 - RNA, 64 nt, Human
ucaaauugauaaaauauuuagguacaaauaacaagacuaauaauauuuucuuauuuaaaaaaag

SEQ ID NO: 310291 - RNA, 64 nt, Human
aauaaaaggguauguaaaauauguaugaagaaaagguguacaaaaauuugcccuuaugcacgga

SEQ ID NO: 310292 - RNA, 64 nt, Human
accuuggugauguugcaaccuuuccuucugcuaggguguacaccuagccugugcaggugucagc

SEQ ID NO: 310293 - RNA, 64 nt, Human
ccauuuucugguaagguuucuaggaggucuguuagguguacauccugcagcuuauuggcuuaaa

SEQ ID NO: 310294 - RNA, 64 nt, Human
augcaacauacgggaaguuuauuuccugacagcagguguacacaugccaacacuuaaucauuuu

SEQ ID NO: 310295 - RNA, 64 nt, Human
ugaaccggucucuuagaagaagacacacauccuggguguacaguggugaaauggggagugggug

SEQ ID NO: 310296 - RNA, 64 nt, Human
gggagaaauaacuaguagaaaguucugggugugagguguacagcagucuagguggcauagugau

SEQ ID NO: 310297 - RNA, 64 nt, Human
uccucauucuugccuugaguuccaguuccucuuugguguacagacuucuugguacccagucacc

SEQ ID NO: 310298 - RNA, 64 nt, Human
ccaaauucuggcugcgggucucagaaccgagugagguguacauugccguccugcagagauccag

SEQ ID NO: 310299 - RNA, 64 nt, Human
cuaauuuaguagugaugcuuuccuugguuguacagguguacauuuguaaaccuucaugcuguaa

SEQ ID NO: 310300 - RNA, 64 nt, Human
ggacacacuugagaaguagcuuuuuauuccuagugguguacauuuaauuuuaaaaagguugcaa

SEQ ID NO: 310301 - RNA, 64 nt, Human
uugguguuccuauuuaaugagauuauuuaauaaggguguacaguaauagaggcuugcugccuuc

SEQ ID NO: 310302 - RNA, 64 nt, Human
auaaaacuuaaggaaaaccacaauaaaccaugaagguguacacaucuuauaacacagauaaagu

SEQ ID NO: 310303 - RNA, 64 nt, Human
auucuucaccuuaggaauaaucuccuguuaauaugguguacauucuuccugauuauuuucuaca

SEQ ID NO: 310304 - RNA, 64 nt, Human
auaaaaauucugaaaucaauccauuuggguuggugguguacagaacacacuuaaguguguuaac

SEQ ID NO: 310305 - RNA, 64 nt, Human
caccaaccagcagaagccuguggacaccaaguacgguguacagaaagccaguggcuccuuucuc

SEQ ID NO: 310306 - RNA, 64 nt, Human
uagaaucaaacauuuugaaagucuguccuugaaggacuaauagaaaaguauguucuaaccuuua

SEQ ID NO: 310307 - RNA, 64 nt, Human
uuguuuuuuuuucuuuuguacugagcucagcauagacuaauacuaccuuaauguuaaaaucuga

SEQ ID NO: 310308 - RNA, 64 nt, Human
aaucaugucauacauuuuugguuuucuaagcagagacuaauacaaaugcagccacauaaaggca

SEQ ID NO: 310309 - RNA, 56 nt, Human
ccuuaagugcugggcaguaaggacuggacuaauauucaggacccacuaaaguagac

SEQ ID NO: 310310 - RNA, 64 nt, Human
agggcagagaacugucuuucauuuuugaacccucgguguacacagaggcgggucuauaacaggc

SEQ ID NO: 310311 - RNA, 64 nt, Human
cuguggacuaaugugccaccaguuuucuaacaaggguguacauaaaauggauuugugcagaccu

SEQ ID NO: 310312 - RNA, 64 nt, Human
gagcaagucaccuacauaacccugccuguacuaagguguacaccugucuauuguaaguuugccu

SEQ ID NO: 310313 - RNA, 64 nt, Human
uacaccugucuauuguaaguuugccuaggcuguugguguacagagaccagaggagagagacaca

SEQ ID NO: 310314 - RNA, 64 nt, Human
aaagucucaccuuuacaggaucauuuguaaugcugguguacaugcagggaacucacaagcugug

SEQ ID NO: 310315 - RNA, 64 nt, Human
uacaccaucaaagaaaacacaacccuuucccuuugguguacaguuauuuauuaaguugauuuug

SEQ ID NO: 310316 - RNA, 64 nt, Human
gcucuagugucuaugauucugcucuccacguccagguguacacauuguuuaucucccacuuacg

SEQ ID NO: 310317 - RNA, 64 nt, Human
agcuccgugggccacacugcugcugugccaagaagguguacagccuccccaggauggggccuca

SEQ ID NO: 310318 - RNA, 64 nt, Human
uguaaauuugaaauuuaaaaaaaucuaugaagcugguguacauauguuacaauuacguauauuu

SEQ ID NO: 310319 - RNA, 64 nt, Human
acauaaauauauuuucaauuguguacaaauuaaggguguacaaauuauaauaaugcaucucuau

SEQ ID NO: 310320 - RNA, 64 nt, Human
agcuaagcucagaaacuuuccuacuguaaguucugguguacaucugaggggaaaaagaauuuua

SEQ ID NO: 310321 - RNA, 64 nt, Human
caaaaguggaguuguuuuaacagaugccaauuacgguguacaguuuaacagaguuuucuguugc

SEQ ID NO: 310322 - RNA, 64 nt, Human
guguuuuuaaauccguguuucuuugaauuuaaaggguguacaggucuuucuguagggaaaauua

SEQ ID NO: 310323 - RNA, 64 nt, Human
uuguuuucuaagauguaaaucacucaaaguauaugguguacaguuuuuaacuuagguuuuaauu

SEQ ID NO: 310324 - RNA, 64 nt, Human
acauggaaucaaucuuuaacaaccucugagccuugguguacagaccaccuuucacaaaacgaaa

SEQ ID NO: 310325 - RNA, 64 nt, Human
cugaacauuuuugcuuugcugccagaguaacccugacuaauaauacaauaacagcaauuuuuuu

SEQ ID NO: 310326 - RNA, 64 nt, Human
gaacuccugacuaccauucuaugacugaucaaaagacuaauaguuaaaaaccucagcaggccuu

SEQ ID NO: 310327 - RNA, 64 nt, Human
ugauagugguguucacuaggagacguggaauugagacuaauaacuuggauguuaacacuguuua

SEQ ID NO: 310328 - RNA, 64 nt, Human
ggcgcaggauccaggcgcugcccgugcguucagugacuaauaaaaugacccuuagggccaggaa

SEQ ID NO: 310329 - RNA, 64 nt, Human
ccuacagguaugcgugauugugugugugugcauggguguacagccacgugucuaccuauguguc

SEQ ID NO: 310330 - RNA, 64 nt, Human
cuuguauuuguguacaggugugccagcccaugcagguguacacagacacaccugugggaggcug

SEQ ID NO: 310331 - RNA, 64 nt, Human
agcaauccucccaccugggccucccaaaaugcuggguguacaggcaugagccgcugugccuggc

SEQ ID NO: 310332 - RNA, 64 nt, Human
gcauuaaaaagcaaagggaaaaaggauguguaaugguguacacagucuguauauuuuaauaaug

SEQ ID NO: 310333 - RNA, 64 nt, Human
uaaagugccuauugaaacucuuaucauuuaaagugguguacaguacacucugcugugaugguau

SEQ ID NO: 310334 - RNA, 64 nt, Human
uugccacaaggcaagaggaugcaucuuucuuccugguguacaagccuuuaaagacuucugcugc

SEQ ID NO: 310335 - RNA, 64 nt, Human
gcuuuguguccaaaaugccuccccauuguacacagguguacaccaugcaugcaccaacaccuaa

SEQ ID NO: 310336 - RNA, 64 nt, Human
uuuucguguggaucuugccacauuucugaucagagguguacacuaacauuucccccgagcucuu

SEQ ID NO: 310337 - RNA, 64 nt, Human
agcggagcuugcugagugagagauggagccucaugguguacaacugaggguaguuaacucauca

SEQ ID NO: 310338 - RNA, 64 nt, Human
gcauaagauuuuuuuccaguuacuggguuuaacugguguacauuaauuagauguccauacugua

SEQ ID NO: 310339 - RNA, 64 nt, Human
ccaucuuuucccugucuucauccuguuauccccugguguacacauggaagaggaccaggacaua

SEQ ID NO: 310340 - RNA, 64 nt, Human
ugaaaggaaauagaagacaguuugcaagagaagugguguacaggaaauuacuucauuugacagg

SEQ ID NO: 310341 - RNA, 64 nt, Human
aaggaaacuggaaggaaaaccauugcgauuucgugguguacaucaugcauuugcaaaaaucuua

SEQ ID NO: 310342 - RNA, 64 nt, Human
cuucucacuagucaggcuaguggagagaugaccagguguacaguucugaccauccuguguugua

SEQ ID NO: 310343 - RNA, 64 nt, Human
agaguuuuuuuucuuucuaugggguugcagggaugguguacaacagguccuagcauguauagcu

SEQ ID NO: 310344 - RNA, 64 nt, Human
uauggauauaaauguaggcaaaaugaaagauuaugacuaauauucagauuccauuuucaauaag

SEQ ID NO: 310345 - RNA, 64 nt, Human
uauauuaagugcacuugaguggaauucaacauuugacuaauaaaaugaguucaucauguuggca

SEQ ID NO: 310346 - RNA, 64 nt, Human
uagauaaauucccagguguagcauuacagcuucugacuaauauagcugccauucagacaauuaa

SEQ ID NO: 310347 - RNA, 64 nt, Human
ugcuuauauuggccaaaauauggacacaaauauagacuaauauggguaauuacccuuugguuua

SEQ ID NO: 310348 - RNA, 64 nt, Human
uacuccuugccccauugaauauauagugguagcagguguacaaauuggucaaguugcaauuauu

SEQ ID NO: 310349 - RNA, 64 nt, Human
gcgccagccuugaagcaccacggcccaaggaugcgguguacauacuguauuucuagauucuccu

SEQ ID NO: 310350 - RNA, 64 nt, Human
cuaagaauugccuugucuggcaguuucaucauuugguguacaucauagaguguacuuacacaga

SEQ ID NO: 310351 - RNA, 64 nt, Human
cauuagccaguaguaggugggucacauaguaccugguguacacaucgggguggguugauauaug

SEQ ID NO: 310352 - RNA, 64 nt, Human
ucuccuucuuccacaaagacccauaucuggagaagguguacaacuuucaaacacaagcccccca

SEQ ID NO: 310353 - RNA, 64 nt, Human; identical to SEQ ID NO: 310351

SEQ ID NO: 310354 - RNA, 64 nt, Human
uguucuauagaucaauuacaugucacagggguuugguguacauauuauuucauuacccagguaa

SEQ ID NO: 310355 - RNA, 64 nt, Human
gcugucuuuucauuuuaguuuuccauacuguggugguguacacaggauagaacacccuuuuuua

SEQ ID NO: 310356 - RNA, 64 nt, Human
auuuuaaaauaaaauauuuuaaaaucuacuuuuugguguacaguucugaguuuuggcaaaugca

SEQ ID NO: 310357 - RNA, 64 nt, Human
uuaugcaaaagucagcgugacaauauacuucacugguguacaucguuuacuuuuuaacuggcuu

SEQ ID NO: 310358 - RNA, 64 nt, Human
auagaauguuacuuggaaaaagucuggaauaugugguguacacaagcagugcuucgugaaugag

SEQ ID NO: 310359 - RNA, 64 nt, Human
guuugcuuugugcuguuaccuaaaaucagagacugguguacaguaugacuuccaucugaacuug

SEQ ID NO: 310360 - RNA, 64 nt, Human
auuugcaagauccuacacuuuuaccuucuuuaaggguguacauuuugauguugaacaucaguuu

SEQ ID NO: 310361 - RNA, 64 nt, Human
guguauuaaaauuccagagugaccguggcacuuggguguacagguaauuccuccagagcuguuu

SEQ ID NO: 310362 - RNA, 64 nt, Human
ggccgcucuguccgggagccauccccacccgccggguguacauacgcgucucugccacucccca

SEQ ID NO: 310363 - RNA, 64 nt, Human
uauagcauugauacuaggugaacagaaauuaccugacuaauaauuugucuaacaucauauauca

SEQ ID NO: 310364 - RNA, 64 nt, Human
guaaguucggcauuuguuacauguauagagagaagacuaauaaucucuauuuauaacuaaauca

SEQ ID NO: 310365 - RNA, 64 nt, Human
cauuaaauuugguuuguuuugcuauguacagucugacuaauaacugcuaauuugugauccaaca

SEQ ID NO: 310366 - RNA, 64 nt, Human
cacuucguugauccauccagcccuaaaguucauugacuaauagcucaugcaucuuauuaaaugg

SEQ ID NO: 310367 - RNA, 64 nt, Human
caagacugggguagaauuuuaaagauucaacacugguguacauauguccgcugggugaguugac

SEQ ID NO: 310368 - RNA, 64 nt, Human
aacuugguucugaauuucucauaugcauauuaaagguguacauaccuauacauccuguacaaau

SEQ ID NO: 310369 - RNA, 64 nt, Human
ucuaauuuucauuauuauaaaguugcagaaauuugguguacauaaaacugucuccauauaauug

SEQ ID NO: 310370 - RNA, 64 nt, Human
acaccugccucuuccaaaguccccagcaguggcagguguacacugagcccugguugcuggcccc

SEQ ID NO: 310371 - RNA, 64 nt, Human
agacagggcccaggcuuggggaacagagagagcagguguacacccaaccaaagugauugugccc

SEQ ID NO: 310372 - RNA, 64 nt, Human
gaaagacggugugugucgugugaaggcgaaacccgguguacauaaccccucccccuccgccccg

SEQ ID NO: 310373 - RNA, 64 nt, Human
gagaauaacuccuuagagaccaaugucuguagcagguguacagcaucuugugaaaguuauggag

SEQ ID NO: 310374 - RNA, 64 nt, Human
gaugucucagagcucugcuaucgcuugcaugcucgguguacagucucccggcaacuguuuuguu

SEQ ID NO: 310375 - RNA, 64 nt, Human
aacuuagagaacccuuugaauauuugcuuuuacugguguacaguaugaguggaauauaaacugu

SEQ ID NO: 310376 - RNA, 64 nt, Human
ugaaaucuacuucccugcuaaagggcacaggggugguguacaaagaaagcuaccuucccagagc

SEQ ID NO: 310377 - RNA, 64 nt, Human
auaugucagcagacaauguguuuggaagaaacaagguguacaacuucacaaagcaaguuuuuuc

SEQ ID NO: 310378 - RNA, 64 nt, Human
uacuuuuuucaccaaaagcuuauaauggaacuaagguguacaugugcaugugcauggaaggaua

SEQ ID NO: 310379 - RNA, 64 nt, Human
ugugggugauagaguuggguuccuuuuuaugcuggguguacagguggguuugggagagaggagc

SEQ ID NO: 310380 - RNA, 64 nt, Human
gauggaauuacuucucccauguugccauuuuugagguguacaaaggucaggccguacacaccuc

SEQ ID NO: 310381 - RNA, 64 nt, Human
cuaacauuauucuuugauuccagcuuuuagaauggguguacaaugcccuguuuguacuuacugg

SEQ ID NO: 310382 - RNA, 64 nt, Human
aaagggaauuauuucucagucuuucaaggcuugagacuaauauaggccauugugauucaggaag

SEQ ID NO: 310383 - RNA, 64 nt, Human
guuaauuacaugucagacuccuagagggccuccagacuaauaggaagcauuucuguaaccaacc

SEQ ID NO: 310384 - RNA, 64 nt, Human
agaagauauguuuuaucuuuuuuuaacuuuauuugacuaauaugacugucaauacuaaaauuua

SEQ ID NO: 310385 - RNA, 64 nt, Human
ugaaauagccaggaaacuucuuugaauggaauuugacuaauauguguguuuucuuuucuuuugu

SEQ ID NO: 310386 - RNA, 64 nt, Human
acucccaacgccucucguucugggaggcuuacaggguguacacacaagaaggugggcugggcac

SEQ ID NO: 310387 - RNA, 64 nt, Human
gcacuuguuuacuaaagauauaaguuguuccauggguguacacguagacagacacacauacacc

SEQ ID NO: 310388 - RNA, 64 nt, Human
aggaggcagagguguaccugcggaagcugcagcagguguacaagcugaacaggaaggaggcagc

SEQ ID NO: 310389 - RNA, 64 nt, Human
agugcaauaccuggacugucaccguccugugagugguguacacaaugggaagauaauaagccgu

SEQ ID NO: 310390 - RNA, 64 nt, Human
uccaugggaagcuaaguuauaaaaauaggugcuugguguacaaaacuuuuuauaucaaaaggcu

SEQ ID NO: 310391 - RNA, 64 nt, Human
cccucugggagcuggagaaucgcucugguggauggguguacagauuuguauauaaugucauuuu

SEQ ID NO: 310392 - RNA, 64 nt, Human
ggaggcuggucccuuuuugggaaaccuggagccagguguacaaccacuugccaugaagggccag

SEQ ID NO: 310393 - RNA, 64 nt, Human
acacacagauugguauaauggagaagaugguuuagguguacagcaaauuuaaaauagucagugg

SEQ ID NO: 310394 - RNA, 64 nt, Human
ucuuuuggcuuucagagugauagagcuccuaacagguguacaggcccaagaguugaaggugauu

SEQ ID NO: 310395 - RNA, 64 nt, Human
uguuuuacagcauggccucacaccacuguuacuugguguacaugagcaaaaacagcaaguggug

SEQ ID NO: 310396 - RNA, 64 nt, Human
uaccugucaagguuuguguuacccuccuguaaaugguguacauaauguauuguugguaauuauu

SEQ ID NO: 310397 - RNA, 64 nt, Human
uggaaaaguaguaugaugaacaaucauucccaaugguguacaauguaaggguuuuagggagcaa

SEQ ID NO: 310398 - RNA, 64 nt, Human
uuccuauggaauuguccuuaugugaagcuuugaagguguacagccacucucccgggucuucagg

SEQ ID NO: 310399 - RNA, 64 nt, Human
gaccaacugguaaacuaacagagugauuaagcaugguguacagaaaagcauuacgcugagucuu

SEQ ID NO: 310400 - RNA, 64 nt, Human
gggacuacgccacacaggccagcccaggcccccagguguacaucggccacucggaacccgugca

SEQ ID NO: 310401 - RNA, 64 nt, Human
uucuccgagagacuuuccauuuccuuggaguuauggcggcaaguaaguaucauaguauuaagaa

SEQ ID NO: 310402 - RNA, 64 nt, Human
cuuccaugacccuuugccuguuccgcauccuggaggcggcaaagggugaaauccgcauugaugg

SEQ ID NO: 310403 - RNA, 64 nt, Human
gucugucuggauugaguccuacagugucagauagggcggcaaaugccaaagcagggaaacaggg

SEQ ID NO: 310404 - RNA, 64 nt, Human
agucccggccucacucagcucacagggcgugccaggcggcaacaccagaaucuuccagaagccc

SEQ ID NO: 310405 - RNA, 64 nt, Human
uaguaauuuaccaagugacauuugcagagaaacagguguacaguuaucguuguacuuuuguaca

SEQ ID NO: 310406 - RNA, 64 nt, Human
cugucaucauggaggucauacaugcauacaaagagguguacagguaccaucuuguauacacaua

SEQ ID NO: 310407 - RNA, 64 nt, Human
uguaauuucccacauuuguacaugugcuuuuaaagguguacauaaagcuucaaauggcaauaaa

SEQ ID NO: 310408 - RNA, 64 nt, Human
ccagaauaugcaaauugguauuaauuuauucaaagguguacauugcuguguacauauauuuaga

SEQ ID NO: 310409 - RNA, 64 nt, Human
guuccuacccauagucuuugugugcuugcuaaaugguguacauuucuuguuaaccacguuauua

SEQ ID NO: 310410 - RNA, 64 nt, Human
cuacaguucccgauucuuucuuauuacaggcucagguguacagguuauucuggguuaauuuuau

SEQ ID NO: 310411 - RNA, 64 nt, Human
ugcccaucaagcaaugaguggauaaagacaaugcgguguacauauacaccauggaauacuauuc

SEQ ID NO: 310412 - RNA, 64 nt, Human
ccugagggcuucucccucuggacacugcgggccagguguacauagagcagcgcggcacaguggc

SEQ ID NO: 310413 - RNA, 64 nt, Human
cucuggccacugaccucagggccgaaggggaggugguguacauaggaacgcguugcggaguccg

SEQ ID NO: 310414 - RNA, 64 nt, Human
gccaccaagacaggcucggagccaucagcugggugguguacaagcauuuguuccaugccugcug

SEQ ID NO: 310415 - RNA, 64 nt, Human
cuuaguuacaacuguuaaugugugaccugcuguugguguacauguggguacaggguguuuuuaa

SEQ ID NO: 310416 - RNA, 64 nt, Human
ggaggcgugugucuggccgggcccccucuccguagguguacagaggacauguaaauacacagcg

SEQ ID NO: 310417 - RNA, 64 nt, Human
ugaagccaggcaccuccuuccucaggaaaaugcugguguacaaauacacacaaagcucuucagg

SEQ ID NO: 310418 - RNA, 64 nt, Human
agugggcucgguagugcccagcuggcaggccugagguguacauaguccuucccggccauauuaa

SEQ ID NO: 310419 - RNA, 64 nt, Human
uguuaaauguacagcugagaauuuaauuuuuucugguguacaaugcuaauaaaauggugcuuua

SEQ ID NO: 310420 - RNA, 64 nt, Human
gccuaguccagugguucucaaagugugauccauagacuaauagcauagcauuaccugagaacuu

SEQ ID NO: 310421 - RNA, 64 nt, Human
auaguguucaguaaaaugaagcagucuuaagagugacuaauaauuucaaagugauuuuucgucu

SEQ ID NO: 310422 - RNA, 64 nt, Human
uaaucaugugaaacuuuuccuagaugcaaaugcugacuaauaaagacaaagccacccugaaccu

SEQ ID NO: 310423 - RNA, 64 nt, Human
ggaucagcaggagcuuuauaaaugacuuuacagagacuaauaagggauuugaucuuucuuuuuu

SEQ ID NO: 310424 - RNA, 64 nt, Human
uaauaaaucaugcuucugagaacauacuugucuugguguacauacauguauuucucuuguguau

SEQ ID NO: 310425 - RNA, 64 nt, Human
aggccuuccugaguccggaguaccggcgggaggagguguacauccgcagcacggacuuugaccg

SEQ ID NO: 310426 - RNA, 64 nt, Human
uggcauuuccaguuguuccacacucccugacacugguguacacaaauaaauaauacagaaaaaa

SEQ ID NO: 310427 - RNA, 64 nt, Human
gggugggcacagggcuuauuccucggaguagaaggguguacagggggcccagacuccacaguga

SEQ ID NO: 310428 - RNA, 64 nt, Human
cuguaaauauguuuuuauaauuccauguauaguugguguacacucaaaaccuguccccggcagc

SEQ ID NO: 310429 - RNA, 64 nt, Human
ucuuuuagcuaauucuaauuaaaaauuacagacugguguacaagauacuugugaaaucuguaac

SEQ ID NO: 310430 - RNA, 64 nt, Human
caggggcucuuacuguguuuucuguaacaacaaagguguacaaugagagaguccacacagugcu

SEQ ID NO: 310431 - RNA, 64 nt, Human
aucaucuuuuacacugccauccauuaugacugaugguguacagcucccaagugcucccuaucca

SEQ ID NO: 310432 - RNA, 64 nt, Human
aagcagcagcauccugggggauggccgugcaugggguguacacucgcuauaggcauaggcccgg

SEQ ID NO: 310433 - RNA, 64 nt, Human
guugagcugguucuccagggcugcagucucuccagguguacagcugcugucccugcccuguccu

SEQ ID NO: 310434 - RNA, 64 nt, Human
aaucuuugcaaguuaguguugcaucugauuuucagguguacauuuauuuuugacugggcagaua

SEQ ID NO: 310435 - RNA, 64 nt, Human
gcacuuuauuuuacuucuaaccuuguuuccugacgguguacagaaucaacaaaauaaaacauuu

SEQ ID NO: 310436 - RNA, 64 nt, Human
cgucuuuugaaaacuugcugaagugcggcauggagguguacaaaggcuacauggaugacccgag

SEQ ID NO: 310437 - RNA, 64 nt, Human
gugacagugacacuuccuggaguguagagcuugagguguacagaugcuguauuauauccgcucc

SEQ ID NO: 310438 - RNA, 64 nt, Human
uaaaucaggacagguggugcaaauggcgcugggagguguacacggaggucucuguaaaagcaga

SEQ ID NO: 310439 - RNA, 64 nt, Human
aauucauuagagaagaauuuuuaguagauacacagacuaauauuuguguggagguucuuuugac

SEQ ID NO: 310440 - RNA, 64 nt, Human
gccucaguucauuuucaguuguuugauuauaugugacuaauauguauuuuuuauucaaacaaga

SEQ ID NO: 310441 - RNA, 64 nt, Human
ggauggagaaucagcaagagaaaugcuguauuaggacuaauaauccaucuacgcugcuuaagca

SEQ ID NO: 310442 - RNA, 64 nt, Human
aaagaaccgacuucugaaucgcagcuccacucaugacuaauaccucauuauuucagcugucugc

SEQ ID NO: 310443 - RNA, 64 nt, Human
gacacacagcagggccaccauuccaugaaugggagguguacagaucacuuucucuuugugcuca

SEQ ID NO: 310444 - RNA, 64 nt, Human
uccucuccuuauucauuaauuucaccuuuuuggagguguacagggucucacacauaaauuauug

SEQ ID NO: 310445 - RNA, 64 nt, Human
cuugccaucuauaggggccaaauauauucucuuugguguacaaaauggaauucauucuggucuc

SEQ ID NO: 310446 - RNA, 64 nt, Human
aaaauuaacuauagcaagcucuagguacuccaaugguguacaaugucuuuugcacaaacuuugu

SEQ ID NO: 310447 - RNA, 64 nt, Human
uugaguucuucuuuucauggcuuuuauucacugugacuaauaagcuuccuaauaaauccuugcc

SEQ ID NO: 310448 - RNA, 64 nt, Human
gaagagguaacuaaaucucacaugcaggucuaaugacuaauaauuggaguacggcugcuagaca

SEQ ID NO: 310449 - RNA, 64 nt, Human
cgggaacuuauccccgacagugacugaacucacugacuaauaacuucauuuaugaaucuucuca

SEQ ID NO: 310450 - RNA, 64 nt, Human
uuggaauucacuauucuggcaauaaauuuugguagacuaauacaguacagcuagacccagaaau

SEQ ID NO: 310451 - RNA, 64 nt, Human
auggugauuaguguuaaaaaucaauuuaaaucaugacuaauaugguaaaaagauaaagcaucaa

SEQ ID NO: 310452 - RNA, 64 nt, Human
aauuguggucucucuuaacuugagguucucuuuugacuaauagagcuccauuuccccucuuaaa

SEQ ID NO: 310453 - RNA, 64 nt, Human
ugggugugcccuggcucccaagggaggcccaugugacuaauaaaaaacugugaacccuguggag

SEQ ID NO: 310454 - RNA, 64 nt, Human
aaauacuugcaauauauuuuuccuuuauuuuuaugacuaauauaaaucaagaaaauuuguuguu

SEQ ID NO: 310455 - RNA, 64 nt, Human
ccuuuccccuuaagagacaguuggaauaccaguugacuaauauuacaagcucuuguagggggaa

SEQ ID NO: 310456 - RNA, 64 nt, Human
gucccauccuuuuaaucaaggugauugugauuuugacuaauaaaaaagaauuuguaauuguggg

SEQ ID NO: 310457 - RNA, 64 nt, Human
gaaugugcauuucuugacuucacagcagccacuugacuaauaccuuguguuccgggaauaacau

SEQ ID NO: 310458 - RNA, 64 nt, Human
uaugcucucauuccucagguguuuugagaaacaugacuaauaaccacacaauuaaguagaguca

SEQ ID NO: 310459 - RNA, 64 nt, Human
uuacuuuuucuuuauguguuugacgggaaacaaaacuagguaaaaucuacaguacaccacaagg

SEQ ID NO: 310460 - RNA, 64 nt, Human
uauaauauuuuuaugagaguggacuuuguauuucacuagguacaauggaauacaaccuuugaca

SEQ ID NO: 310461 - RNA, 64 nt, Human
uauuacaugacuguuucuuuuguaaagagaaucaacuagguauuuaagacugauaauuuuacaa

SEQ ID NO: 310462 - RNA, 64 nt, Human
acucaauaccaucaucucuuaucucuauacagggacuagguaauaaaaccuucaaagguuguca

SEQ ID NO: 310463 - RNA, 64 nt, Human
cacaugugagauuugcugcuguugcaguauaaacacuagguauaauaggauuugaaauugcauu

SEQ ID NO: 310464 - RNA, 64 nt, Human
uuaugggcauuuguuuuguuucaagucaucauaaacuagguauugcauugcuauccguggauac

SEQ ID NO: 310465 - RNA, 64 nt, Human
uuagguuacagauuaucacauuaauuuaauuacuacuagguaauaauaaugggagacuugagug

SEQ ID NO: 310466 - RNA, 64 nt, Human
cccaaucuuucuuuuaagcuucugggucuauuaaacuagguagaucuuuucguauugaucauaa

SEQ ID NO: 310467 - RNA, 64 nt, Human
aacugccuuauguuugggcauguaacuccaaaauacuagguaguauaaggcuuucucaaucagu

SEQ ID NO: 310468 - RNA, 64 nt, Human
gaauaugcuguuuccucaguucagagagguagcaacuagguaaacuccuuauaaaaagcaaaua

SEQ ID NO: 310469 - RNA, 64 nt, Human
acuaauuucauuuagaauauuaucaaacauuucaacuagguaucagaaaaaggcuuucuuucau

SEQ ID NO: 310470 - RNA, 64 nt, Human
aauuuuuuaaagaauccaagacaaacuaaacuuuacuagguacauaagcuucucaaugagucac

SEQ ID NO: 310471 - RNA, 64 nt, Human
uuauauuauuguuuuuuaauauuuuauuuucuugacuagguauuaagcuuuuguaauuauuuuu

SEQ ID NO: 310472 - RNA, 64 nt, Human
aacaucaacaauuaucaaguuaauuaauaaaaauacuagguauugcaaaaaaggcuuaauuuga

SEQ ID NO: 310473 - RNA, 64 nt, Human
gugacccauuucaggaggugccgguaccagccugacuagguacaggcaagcuugugugggccca

SEQ ID NO: 310474 - RNA, 64 nt, Human
gccucauuucauccuugcaacagcucugcagggccccgcagaugaggaaauccguaggcaggag

SEQ ID NO: 310475 - RNA, 64 nt, Human
aggggcacacagacuguggcagagcugcgcccaucccgcagaggccccuguccaccuggagacc

SEQ ID NO: 310476 - RNA, 64 nt, Human
gggaggauuccagaacagcagcacugagcucccacccgcagagccucuggacggccuuggcaac

SEQ ID NO: 310477 - RNA, 64 nt, Human
acugagucuuuuggaggcuccaagccucaaagugcccgcagagcccaccuugaggguuuugcua

SEQ ID NO: 310478 - RNA, 64 nt, Human
ucuaaauaaaaagagaacccaugcuuuuauggacacuagguaaacaccuucagcuuaaauuuuu

SEQ ID NO: 310479 - RNA, 64 nt, Human
agucuuauuuccaaguaagaguacugggagaaucacuagguaacuuauuagaaacccaaauugg

SEQ ID NO: 310480 - RNA, 64 nt, Human
gauagcuuaguguaaacacaagccuaggacauggacuagguaaagacaaaguccuugcauucuu

SEQ ID NO: 310481 - RNA, 64 nt, Human
uuugaauuuaaacauucauauuuacugaguaccuacuagguaccaaguacucuuuuaggcacug

SEQ ID NO: 310482 - RNA, 64 nt, Human
gcuacauaauuacuuucaauuuccuccaggcaugacuagguauaaacauauauuuacaugauua

SEQ ID NO: 310483 - RNA, 64 nt, Human
guagccugacaagacauuuuuuucaguguauaaaacuagguaguauugugcacugauuugacca

SEQ ID NO: 310484 - RNA, 64 nt, Human
agaugauacuuccaagugauaauuuuauuuauaaacuagguaaaauuuguuguugguuccuuuu

SEQ ID NO: 310485 - RNA, 64 nt, Human
aguuuucacuauccaugaagcagcgcugcaugucacuagguaacacagauccauccagauggug

SEQ ID NO: 310486 - RNA, 64 nt, Human
ggcaguaauuccuuugaacuacugcuuagcuaauacuagguagugcuaaaagacauguucccau

SEQ ID NO: 310487 - RNA, 64 nt, Human
uuuuccccucacccucugcccuucuaagucauagacuagguaggaaggcccuauauuggucccc

SEQ ID NO: 310488 - RNA, 64 nt, Human
accuguugagaggaauugaugguuucugagaaauacuagguacauucauccucacagauugcaa

SEQ ID NO: 310489 - RNA, 64 nt, Human
guuagugugcaugugaugagucuugaagcuggaaacuagguaacagguucuuaaauaguucaug

SEQ ID NO: 310490 - RNA, 64 nt, Human
uucaaaccucacaaggcaauauucugaauuguuaacuagguauuucaaaacaggaauuaaauuc

SEQ ID NO: 310491 - RNA, 64 nt, Human
uaggcuuagaguaugauuuuaacaaugauguaacacuagguaauggaaaacucauguaagaugu

SEQ ID NO: 310492 - RNA, 64 nt, Human
agggagacacugugagccagggauacaacaaaauacuagguaagucacugcagaccgaccuccc

SEQ ID NO: 310493 - RNA, 62 nt, Human
acuuugcaaacauccuggccaccaugggcaccaggacacagggauggauaccaccuacccuc

SEQ ID NO: 310494 - RNA, 62 nt, Human
uuggggaggaguuuuagggcuuggggagagggaggacacaucuggaggaaauggccuucuuu

SEQ ID NO: 310495 - RNA, 64 nt, Human
gagggccaaggacaauugggagggcagcaggcagcccgcagaugguggccauguggcacgcugc

SEQ ID NO: 310496 - RNA, 64 nt, Human
guacgggggcgcggcagggguccccggccccucccccgcagaggucaaugccaacgaacaaacg

SEQ ID NO: 310497 - RNA, 64 nt, Human
accuauuagaaugagaguagccaaggaaagaguuacuagguaauaagcuucacuuuuuguguuc

SEQ ID NO: 310498 - RNA, 64 nt, Human
uguccuuguguggcugcuccagcgagagcugguaacuagguagacugcugcucuaauggggaaa

SEQ ID NO: 310499 - RNA, 64 nt, Human
uauuuaugaaguggugaaauuucaaguguggcucacuagguacuucaggccuucuuggacuguu

SEQ ID NO: 310500 - RNA, 64 nt, Human
uccuugugacuaaguugcaagaucuuauuuauuaacuagguaugaaguauaaacccauuuuggu

SEQ ID NO: 310501 - RNA, 64 nt, Human
uugucguggcagccaguggugacuggauugaccuacuagguacccaguggcagucucagguuaa

SEQ ID NO: 310502 - RNA, 64 nt, Human
aggguuucugucaucauggaagagguggucugggacuagguacuucucgucuugugagcuaagg

SEQ ID NO: 310503 - RNA, 64 nt, Human
agagcuaggcuguggaguagaguuuguauagguaacuagguaacuuauuguggcccagauaagg

SEQ ID NO: 310504 - RNA, 64 nt, Human
ggaggagggacuccuaaaguaggugagaugugggacuagguaacacuuuaaauacuuuuuuacu

SEQ ID NO: 310505 - RNA, 64 nt, Human
aaaacuuacaaaagaauauucucauuuggucuuaacuagguagauguaauauaugacuuuuuau

SEQ ID NO: 310506 - RNA, 64 nt, Human
guuucauuaugaccagaucucugauuguauggucacuagguaugcaaucacgcauucaaagagg

SEQ ID NO: 310507 - RNA, 64 nt, Human
cauaucaccaauacugauuaacauucucuuuggaacuagguaagaguggucucuucuuauugaa

SEQ ID NO: 310508 - RNA, 64 nt, Human
uuuuucuuggcccaugauuaauggaauguauguaacuagguaggguuccuuucuuagaucuaga

SEQ ID NO: 310509 - RNA, 64 nt, Human
caggcuauucugagcucagaaaaguccccugggcacuagguaaagcccagugaaugucucuugg

SEQ ID NO: 310510 - RNA, 64 nt, Human
ccuuaagugaacaaaucuagcuaacagugaaugaacuagguaauauaacuugcauauuuuuaau

SEQ ID NO: 310511 - RNA, 64 nt, Human
ugcaaguuugaaaaguucaaauuaaccacuuuugacuagguaagucuuucuaaaaaccauuuaa

SEQ ID NO: 310512 - RNA, 62 nt, Human
aauaagucauuggaacauuauuuaaaauauguaggacacauuauuagaauuguugggaucuc

SEQ ID NO: 310513 - RNA, 62 nt, Human
uccacaaaagaggggagaaaaggcgacgaaucaggacacagugaacuugggaaugaagaggu

SEQ ID NO: 310514 - RNA, 62 nt, Human
agagagggacagguucugucaggggugacaccaggacacagggacagguucugucgggggug

SEQ ID NO: 310515 - RNA, 62 nt, Human
agcagagcccauccaggacacuccacacugccaggacacacccaggcggcccgcccuugccu

SEQ ID NO: 310516 - RNA, 64 nt, Human
uuuuuaucuuagaaauggaugauucgugaauaaaacuagguacauaguaaguguaugauagaug

SEQ ID NO: 310517 - RNA, 61 nt, Human
uacaaaaaaaaaagaauuaauaagucacaaccccuucaaauaagcuuucuuuccagucgcu

SEQ ID NO: 310518 - RNA, 61 nt, Human
aguugugccuugcccuaucgccucccauuuucccuucaaaguagaaugucuuguaaagaca

SEQ ID NO: 310519 - RNA, 61 nt, Human
auuuccaugaguuacacuggaugaaaauguucccuucaaguauaauauuaauaauaccuau

SEQ ID NO: 310520 - RNA, 61 nt, Human
cucaagaaauguucauauuaauugaggauuucccuucaauaaaucucauguccucaauuag

SEQ ID NO: 310521 - RNA, 61 nt, Human
aguuuugacaucagccagcugcccuaaauaacccuucaacguuucuucacuuuugcaaggu

SEQ ID NO: 310522 - RNA, 61 nt, Human
uucccgaggcauuaggaagaaaggauuuaaucccuucaauuuggggcuuaaucuuguuuaa

SEQ ID NO: 310523 - RNA, 61 nt, Human
uuaauacauuauuauuugguauucuguauaccccuucaagcaguuguuucccauucccaac

SEQ ID NO: 310524 - RNA, 61 nt, Human
guguuaauuugucuucuaaacuguguaaggccccuucaaguuccucuuguugguuucaauu

SEQ ID NO: 310525 - RNA, 61 nt, Human
ccccgccccgcccgccaggggccuugccggccccuucaagcaauagggucccgaggggaga

SEQ ID NO: 310526 - RNA, 61 nt, Human
ccccguaaugcuuagccaacuuuaaaguguacccuucaauauccccauuggcaacugcagc

SEQ ID NO: 310527 - RNA, 61 nt, Human
ggugggaaggaaaggagcuuggcauugggagcccuucaagaagguaccagaaggaacccuc

SEQ ID NO: 310528 - RNA, 61 nt, Human
ccccugacccauucuggauuuuuacuacaggcccuucaauauccauggagucucuucugag

SEQ ID NO: 310529 - RNA, 61 nt, Human
acuuagaaaccacaaaaauaggaauccuuaccccuucaauuccuguucaacccuaaaaacu

SEQ ID NO: 310530 - RNA, 61 nt, Human
acacguggguuucaguguauuugccuuugaacccuucaaacuaaacuuuagccuuuuggcu

SEQ ID NO: 310531 - RNA, 61 nt, Human
gcugaugguuaacauuccaccuucuuucuagcccuucaaagaugcugccaguguucgcccu

SEQ ID NO: 310532 - RNA, 64 nt, Human
ggguccggaagggugaucaucgacccccaagggacccgcagacccuuaaaaaaaucacccacaa

SEQ ID NO: 310533 - RNA, 64 nt, Human
gacuaggcguggaccugcccauggugccugucagcccgcagagcccaucuacgcccaacacaga

SEQ ID NO: 310534 - RNA, 64 nt, Human
agcuaccugagccugacgcccgagcaguggaggucccgcagaagcuacagcugccaggucaugc

SEQ ID NO: 310535 - RNA, 64 nt, Human
ccucccugcaagacagaugggaauguguauaauaacuagguauuugagaaguucugaaguuuga

SEQ ID NO: 310536 - RNA, 64 nt, Human
aauuauuuuuucacgggacuguguaaagcauguaacuagguauugcuuugguauauaacuauug

SEQ ID NO: 310537 - RNA, 64 nt, Human
cuuacagccuuauguuuuuguauuuucuugguagacuagguaauuuuuuuuuaaaggacaggaa

SEQ ID NO: 310538 - RNA, 64 nt, Human
gugagucgugacugacaggggugguugagacuagacuagguagaguaguuaccaggagauguga

SEQ ID NO: 310539 - RNA, 64 nt, Human
cacacuccuuggucuugcuuaccaacuggaggacacuagguagaauaaccgaguaugacaauuc

SEQ ID NO: 310540 - RNA, 64 nt, Human
uagaggccaaggugcugccagcaauccuuuccauacuagguacuggugaaaauuguuuuuguuu

SEQ ID NO: 310541 - RNA, 64 nt, Human
uuaaagccaaagaccauaguuuuaguuuuaagccacuagguagauauuuaggggaauagucaaa

SEQ ID NO: 310542 - RNA, 64 nt, Human
uguaauuuuuggggaaaaaagcacauacauuaaaacuagguaauguuuuguauauacaguuauu

SEQ ID NO: 310543 - RNA, 64 nt, Human
agaaagaagucacuguuacagaggcaagcggugaacuagguaagaguucacucaugaagaaacg

SEQ ID NO: 310544 - RNA, 64 nt, Human
uaaauugaagagucuacauucagaacauaaaagcacuagguauacaaguuugaaauaugauuua

SEQ ID NO: 310545 - RNA, 64 nt, Human
uuguaaauuuaguuuauugcuuuaccauuauuuuacuagguaaaauuagagaacagauuuuguu

SEQ ID NO: 310546 - RNA, 64 nt, Human
aaauuauuaagcucugugcgaggcugucagccacacuagguaucagggaucccgagauggguac

SEQ ID NO: 310547 - RNA, 64 nt, Human
guguuaucuuuauagcaacacucauccuuaaccaacuagguaccgugaguuuacauacaggaga

SEQ ID NO: 310548 - RNA, 64 nt, Human
guuuuuauuuuacaaaggcagaaaaugaaacaccacuagguaaaagaauuaaaaaucuaauccu

SEQ ID NO: 310549 - RNA, 64 nt, Human
uucaauuguaaauugaaucaguauaaacaaaguuacuagguaacuucauauugcugagagaaau

SEQ ID NO: 310550 - RNA, 62 nt, Human
uuacauaaauuguaugagacuuuuuguugcaaaggacacauuuaucauauucauucacacau

SEQ ID NO: 310551 - RNA, 62 nt, Human
uauuagagcuuacucaggacuuuucaaacaucaggacacacauagcaauuuggauguuguaa

SEQ ID NO: 310552 - RNA, 64 nt, Human
uaagaaguuugugucuuugucuggccacaucuugacuagguauugucuacucugaagaccuuua

SEQ ID NO: 310553 - RNA, 64 nt, Human
cagcccuccuuggguugaacuauucuccuuaguaacuagguaagugggaaagccuuuugaugug

SEQ ID NO: 310554 - RNA, 64 nt, Human
aggguaccugaaagagccuucugggaguuagugaacuagguagauuguuuuguucacauaacgc

SEQ ID NO: 310555 - RNA, 64 nt, Human
uccuaagucccugcccccuccccuucacaccauaacuagguaacaguuugauaacuagggaaga

SEQ ID NO: 310556 - RNA, 64 nt, Human
uguuuauauuuaacaugaagaccaaguuuauauaacuagguaucuguauaaugcaacaacauug

SEQ ID NO: 310557 - RNA, 64 nt, Human
ccucucauuuguaacugcaugcauuauucuugaaacuagguaaaacucacugaauuguugugua

SEQ ID NO: 310558 - RNA, 64 nt, Human
aaauagguuccagugaugaaaacauucaagcagaacuagguagaaacagagggccaaaauugaa

SEQ ID NO: 310559 - RNA, 64 nt, Human
uaagaagaaaauuguuucuauuacuuucccauucacuagguaaagaaucauggacagaacuuac

SEQ ID NO: 310560 - RNA, 64 nt, Human
auuaaauuguauacaguuuuuauucuaaccacuaacuagguaguguaugccccuucagaacaug

SEQ ID NO: 310561 - RNA, 64 nt, Human
guuuaccaaaauuagugacauaaugaguggaauuacuagguaagucaaauccuaaagagugaau

SEQ ID NO: 310562 - RNA, 64 nt, Human
uccuugggaacguguaggccacggcucugccaccacuagguaccugcugagggcgcuggcucug

SEQ ID NO: 310563 - RNA, 64 nt, Human
ccuugcagauuauuuuuuaaauuagagguuuaucacuagguauaucuccuaaugcuaucccucc

SEQ ID NO: 310564 - RNA, 64 nt, Human
uaagccuuuauguggaguucacaucuggcucaguacuagguaauuuuuaauguaguguaauuaa

SEQ ID NO: 310565 - RNA, 64 nt, Human
accagucagagucaagucaggaaauagaaaccacacuagguauuucaaacagaggggauauaag

SEQ ID NO: 310566 - RNA, 64 nt, Human
cuuugggcugccuugcucaucuuuaugccccagcacuagguacggggcccaacacgugguaggc

SEQ ID NO: 310567 - RNA, 62 nt, Human
acggacucgccacagcugaacuccucacuuuuaggacacaagacuaccauuguacacuugau

SEQ ID NO: 310568 - RNA, 62 nt, Human
cagauuugaccuuuuaggggcagcaaugcugaaggacacagcaauuuaaauuauaauguguc

SEQ ID NO: 310569 - RNA, 62 nt, Human
ugugcaaacaagcgauugaguugggcuuuaggaggacacaucauaggagagaauccaggguc

SEQ ID NO: 310570 - RNA, 62 nt, Human
auuuuauagugauuugguucaaagauguuuacaggacacacacacacacacacacacacaca

SEQ ID NO: 310571 - RNA, 64 nt, Human
ccagcaacccugugggggaaguguuuucacacccacuagguauuugaggacacugcccaacccc

SEQ ID NO: 310572 - RNA, 64 nt, Human
gcgauaauccaagcaaaaguuaaugguggcuucaacuagguaguagcaauaagggugauaagaa

SEQ ID NO: 310573 - RNA, 64 nt, Human
ucagccuucagaaaugaaaguuaaggauuuuagcacuagguaaaauucaguauaauaggcugaa

SEQ ID NO: 310574 - RNA, 64 nt, Human
cugcuuacuucugggguauuggaaauguuuggggacuagguagaggugaauguacuaaaugcca

SEQ ID NO: 310575 - RNA, 64 nt, Human
augagcagauacagauauauccaaacccuuaccuacuagguauccugcuaggguuuucaauucc

SEQ ID NO: 310576 - RNA, 64 nt, Human
uuucuaagugggaagaggaagggagaggcaagcaacuagguacaaugucuaucaggaaagcaaa

SEQ ID NO: 310577 - RNA, 64 nt, Human
uuaaauuaugguauuuaacuauuuuuauguuuauacuagguagggucuuucuuauguuucugug

SEQ ID NO: 310578 - RNA, 64 nt, Human
uggauagauucucaauuguuauguccacuuauucacuagguaaauuuucaguuuuaauacuuuu

SEQ ID NO: 310579 - RNA, 64 nt, Human
uuagcugugucccuguagcucuggaacugaaggaacuagguaggagaggaaggauuugagaaau

SEQ ID NO: 310580 - RNA, 64 nt, Human
ucccagccaauugcucccuucugcuuuagaagugacuagguacugagaguacaaacacucccac

SEQ ID NO: 310581 - RNA, 64 nt, Human; identical to SEQ ID NO: 252770

SEQ ID NO: 310582 - RNA, 64 nt, Human; identical to SEQ ID NO: 252771

SEQ ID NO: 310583 - RNA, 64 nt, Human; identical to SEQ ID NO: 252772

SEQ ID NO: 310584 - RNA, 64 nt, Human; identical to SEQ ID NO: 252773

SEQ ID NO: 310585 - RNA, 64 nt, Human; identical to SEQ ID NO: 252774

SEQ ID NO: 310586 - RNA, 62 nt, Human
aauuccagagggguguguguauagagaggcaaaggacacagaguagcuaaccuaguuuugaa

SEQ ID NO: 310587 - RNA, 62 nt, Human
aauuuuucugcccuacaaaggguggaagagaaaggacacaguauuuucaugaauuuaccaua

SEQ ID NO: 310588 - RNA, 62 nt, Human
ccagccuaaguguugcccugcacuauggcuggaggacacauuugguagaggucacacugcag

SEQ ID NO: 310589 - RNA, 62 nt, Human
uuucccucuccauuuucccuaacuaaaugaaaaggacacauucugaaaucccuuuuguugga

SEQ ID NO: 310590 - RNA, 64 nt, Human; identical to SEQ ID NO: 252775

SEQ ID NO: 310591 - RNA, 64 nt, Human; identical to SEQ ID NO: 252779

SEQ ID NO: 310592 - RNA, 64 nt, Human; identical to SEQ ID NO: 252780

SEQ ID NO: 310593 - RNA, 64 nt, Human; identical to SEQ ID NO: 252781

SEQ ID NO: 310594 - RNA, 64 nt, Human; identical to SEQ ID NO: 252782

SEQ ID NO: 310595 - RNA, 64 nt, Human; identical to SEQ ID NO: 252783

SEQ ID NO: 310596 - RNA, 64 nt, Human; identical to SEQ ID NO: 252784

SEQ ID NO: 310597 - RNA, 64 nt, Human; identical to SEQ ID NO: 252785

SEQ ID NO: 310598 - RNA, 64 nt, Human; identical to SEQ ID NO: 252786

SEQ ID NO: 310599 - RNA, 64 nt, Human; identical to SEQ ID NO: 252787

SEQ ID NO: 310600 - RNA, 64 nt, Human; identical to SEQ ID NO: 252788

SEQ ID NO: 310601 - RNA, 64 nt, Human; identical to SEQ ID NO: 252789

SEQ ID NO: 310602 - RNA, 64 nt, Human; identical to SEQ ID NO: 252790

SEQ ID NO: 310603 - RNA, 64 nt, Human; identical to SEQ ID NO: 252791

SEQ ID NO: 310604 - RNA, 64 nt, Human; identical to SEQ ID NO: 252795

SEQ ID NO: 310605 - RNA, 62 nt, Human
ccccaauucccccccccaucaccuuaucucccaggacacacuugagaaguagcuuuuuauuc

SEQ ID NO: 310606 - RNA, 62 nt, Human
gguuggugugauaguuuccgaguaagaccuuaaggacacagccaaaucuuaaguacugugug

SEQ ID NO: 310607 - RNA, 62 nt, Human
ucuaucagaaauggacucacucgccuggcaaaaggacacagauuagauuauucuaaucucaa

SEQ ID NO: 310608 - RNA, 62 nt, Human
cucgggaagccacgccugggaaggcaggacacaggacacagcagcuuucuuuggaaaucucc

SEQ ID NO: 310609 - RNA, 64 nt, Human; identical to SEQ ID NO: 252796

SEQ ID NO: 310610 - RNA, 64 nt, Human; identical to SEQ ID NO: 252797

SEQ ID NO: 310611 - RNA, 64 nt, Human; identical to SEQ ID NO: 252798

SEQ ID NO: 310612 - RNA, 64 nt, Human; identical to SEQ ID NO: 252799

SEQ ID NO: 310613 - RNA, 64 nt, Human; identical to SEQ ID NO: 252800

SEQ ID NO: 310614 - RNA, 64 nt, Human; identical to SEQ ID NO: 252801

SEQ ID NO: 310615 - RNA, 64 nt, Human; identical to SEQ ID NO: 252802

SEQ ID NO: 310616 - RNA, 64 nt, Human; identical to SEQ ID NO: 252803

SEQ ID NO: 310617 - RNA, 64 nt, Human; identical to SEQ ID NO: 252804

SEQ ID NO: 310618 - RNA, 64 nt, Human; identical to SEQ ID NO: 252805

SEQ ID NO: 310619 - RNA, 64 nt, Human; identical to SEQ ID NO: 252806

SEQ ID NO: 310620 - RNA, 64 nt, Human; identical to SEQ ID NO: 252807

SEQ ID NO: 310621 - RNA, 64 nt, Human; identical to SEQ ID NO: 252811

SEQ ID NO: 310622 - RNA, 64 nt, Human; identical to SEQ ID NO: 252812

SEQ ID NO: 310623 - RNA, 64 nt, Human; identical to SEQ ID NO: 252813

SEQ ID NO: 310624 - RNA, 62 nt, Human
ccuuuugucugaaaaccagccaagcuuuauucaggacacacuucuugccuucacuuucccac

SEQ ID NO: 310625 - RNA, 62 nt, Human
acaaacauuagcuauuuuaugcugcaagaaccaggacacacaauucgccaaucaucccacca

SEQ ID NO: 310626 - RNA, 62 nt, Human
ccuauaacaaauucuuuuacaaguuacuauaaaggacacaaagagaaaacuuuaccuuccag

SEQ ID NO: 310627 - RNA, 62 nt, Human
gaagauggcuucuaagaaaacaagaugcacagaggacacagaaggacuuggcagcaggguga

SEQ ID NO: 310628 - RNA, 64 nt, Human; identical to SEQ ID NO: 252814

SEQ ID NO: 310629 - RNA, 64 nt, Human; identical to SEQ ID NO: 252815

SEQ ID NO: 310630 - RNA, 64 nt, Human; identical to SEQ ID NO: 252816

SEQ ID NO: 310631 - RNA, 64 nt, Human; identical to SEQ ID NO: 252817

SEQ ID NO: 310632 - RNA, 64 nt, Human; identical to SEQ ID NO: 252818

SEQ ID NO: 310633 - RNA, 64 nt, Human; identical to SEQ ID NO: 252819

SEQ ID NO: 310634 - RNA, 64 nt, Human; identical to SEQ ID NO: 252820

SEQ ID NO: 310635 - RNA, 64 nt, Human; identical to SEQ ID NO: 252821

SEQ ID NO: 310636 - RNA, 64 nt, Human; identical to SEQ ID NO: 252822

SEQ ID NO: 310637 - RNA, 64 nt, Human; identical to SEQ ID NO: 252823

SEQ ID NO: 310638 - RNA, 64 nt, Human; identical to SEQ ID NO: 252827

SEQ ID NO: 310639 - RNA, 64 nt, Human; identical to SEQ ID NO: 252828

SEQ ID NO: 310640 - RNA, 64 nt, Human; identical to SEQ ID NO: 252829

SEQ ID NO: 310641 - RNA, 64 nt, Human; identical to SEQ ID NO: 252830

SEQ ID NO: 310642 - RNA, 64 nt, Human; identical to SEQ ID NO: 252831

SEQ ID NO: 310643 - RNA, 64 nt, Human
gguuggcaccucaaucuacaccagagcccagggagucccagaggcaaguuucacagaauuguca

SEQ ID NO: 310644 - RNA, 64 nt, Human
aaaaauuagccaagugugguagagugugccugaagucccagauacuuggggggcugagguggga

SEQ ID NO: 310645 - RNA, 64 nt, Human
guaauccuacaccuuuugcuaacaccccuacuaggucccagagggccagaaacaccugacuuac

SEQ ID NO: 310646 - RNA, 64 nt, Human; identical to SEQ ID NO: 252832

SEQ ID NO: 310647 - RNA, 64 nt, Human; identical to SEQ ID NO: 252833

SEQ ID NO: 310648 - RNA, 64 nt, Human; identical to SEQ ID NO: 252834

SEQ ID NO: 310649 - RNA, 64 nt, Human; identical to SEQ ID NO: 252835

SEQ ID NO: 310650 - RNA, 64 nt, Human; identical to SEQ ID NO: 252836

SEQ ID NO: 310651 - RNA, 64 nt, Human; identical to SEQ ID NO: 252837

SEQ ID NO: 310652 - RNA, 64 nt, Human; identical to SEQ ID NO: 252838

SEQ ID NO: 310653 - RNA, 64 nt, Human; identical to SEQ ID NO: 252839

SEQ ID NO: 310654 - RNA, 64 nt, Human; identical to SEQ ID NO: 252843

SEQ ID NO: 310655 - RNA, 64 nt, Human; identical to SEQ ID NO: 252844

SEQ ID NO: 310656 - RNA, 64 nt, Human; identical to SEQ ID NO: 252845

SEQ ID NO: 310657 - RNA, 64 nt, Human; identical to SEQ ID NO: 252846

SEQ ID NO: 310658 - RNA, 64 nt, Human; identical to SEQ ID NO: 252847

SEQ ID NO: 310659 - RNA, 64 nt, Human; identical to SEQ ID NO: 252848

SEQ ID NO: 310660 - RNA, 64 nt, Human; identical to SEQ ID NO: 252849

SEQ ID NO: 310661 - RNA, 62 nt, Human
aaugaaagccaaauuuauaugccaccgauugcaggacacaagcacaguuuuaagaguuguau

SEQ ID NO: 310662 - RNA, 62 nt, Human
guucaaaagaaaauuccaacugcuguuggggaaggacacagaaaagaaaaauaaccacccaa

SEQ ID NO: 310663 - RNA, 62 nt, Human
acacaacaaggacagucacaacaaggacaacaaggacacaacacaacacacaacaaggacag

SEQ ID NO: 310664 - RNA, 62 nt, Human
gucugcaccuccuggaaauccugccaccaaccaggacacagcagccaccguauugaucagag

SEQ ID NO: 310665 - RNA, 64 nt, Human; identical to SEQ ID NO: 252850

SEQ ID NO: 310666 - RNA, 64 nt, Human; identical to SEQ ID NO: 252851

SEQ ID NO: 310667 - RNA, 64 nt, Human; identical to SEQ ID NO: 252852

SEQ ID NO: 310668 - RNA, 64 nt, Human; identical to SEQ ID NO: 252853

SEQ ID NO: 310669 - RNA, 64 nt, Human; identical to SEQ ID NO: 252854

SEQ ID NO: 310670 - RNA, 64 nt, Human; identical to SEQ ID NO: 252855

SEQ ID NO: 310671 - RNA, 64 nt, Human; identical to SEQ ID NO: 252859

SEQ ID NO: 310672 - RNA, 64 nt, Human; identical to SEQ ID NO: 252860

SEQ ID NO: 310673 - RNA, 64 nt, Human; identical to SEQ ID NO: 252861

SEQ ID NO: 310674 - RNA, 64 nt, Human; identical to SEQ ID NO: 252862

SEQ ID NO: 310675 - RNA, 64 nt, Human; identical to SEQ ID NO: 252863

SEQ ID NO: 310676 - RNA, 64 nt, Human; identical to SEQ ID NO: 252864

SEQ ID NO: 310677 - RNA, 64 nt, Human; identical to SEQ ID NO: 252865

SEQ ID NO: 310678 - RNA, 64 nt, Human; identical to SEQ ID NO: 252866

SEQ ID NO: 310679 - RNA, 64 nt, Human; identical to SEQ ID NO: 252867

SEQ ID NO: 310680 - RNA, 62 nt, Human
cagaaaaauaaaguaggcaugaauaaauguucaggacacacacauacacucacacacaucac

SEQ ID NO: 310681 - RNA, 62 nt, Human
uguuuucacauucaccauggcaucccagagcaaggacacaggagcccacaggccaguugagg

SEQ ID NO: 310682 - RNA, 62 nt, Human
uguuugcaugcuggaugcuauacuguccagccaggacacaagacuucugauuucuacccuca

SEQ ID NO: 310683 - RNA, 62 nt, Human
uuccccuccuguaagaguauuaacaaaaccaaaggacacaagggugcaagccccauucacgg

SEQ ID NO: 310684 - RNA, 64 nt, Human; identical to SEQ ID NO: 252868

SEQ ID NO: 310685 - RNA, 64 nt, Human; identical to SEQ ID NO: 252869

SEQ ID NO: 310686 - RNA, 64 nt, Human; identical to SEQ ID NO: 252870

SEQ ID NO: 310687 - RNA, 64 nt, Human; identical to SEQ ID NO: 252871

SEQ ID NO: 310688 - RNA, 64 nt, Human; identical to SEQ ID NO: 252875

SEQ ID NO: 310689 - RNA, 64 nt, Human; identical to SEQ ID NO: 252876

SEQ ID NO: 310690 - RNA, 64 nt, Human; identical to SEQ ID NO: 252877

SEQ ID NO: 310691 - RNA, 64 nt, Human; identical to SEQ ID NO: 252878

SEQ ID NO: 310692 - RNA, 64 nt, Human; identical to SEQ ID NO: 252864

SEQ ID NO: 310693 - RNA, 64 nt, Human; identical to SEQ ID NO: 252880

SEQ ID NO: 310694 - RNA, 64 nt, Human; identical to SEQ ID NO: 252881

SEQ ID NO: 310695 - RNA, 64 nt, Human; identical to SEQ ID NO: 252882

SEQ ID NO: 310696 - RNA, 64 nt, Human; identical to SEQ ID NO: 252883

SEQ ID NO: 310697 - RNA, 64 nt, Human; identical to SEQ ID NO: 252884

SEQ ID NO: 310698 - RNA, 64 nt, Human; identical to SEQ ID NO: 252885

SEQ ID NO: 310699 - RNA, 62 nt, Human
cuugaagccucccgacuuccacagagugcuucaggacacauuuugagugguauuuucuuuuc

SEQ ID NO: 310700 - RNA, 62 nt, Human
agaccucccaggcuaagccucagauucagugcaggacacaagcucaugcccccgucuugcca

SEQ ID NO: 310701 - RNA, 62 nt, Human
gcaguuucauuuagauaauaaacuauguacauaggacacauuuuuuaucucuaggcuuaguc

SEQ ID NO: 310702 - RNA, 62 nt, Human
agagauuuuauggggcuacugcagauaaaaauaggacacaauauuaaaggagcuacagaagg

SEQ ID NO: 310703 - RNA, 64 nt, Human; identical to SEQ ID NO: 252886

SEQ ID NO: 310704 - RNA, 64 nt, Human; identical to SEQ ID NO: 252887

SEQ ID NO: 310705 - RNA, 64 nt, Human; identical to SEQ ID NO: 252891

SEQ ID NO: 310706 - RNA, 64 nt, Human; identical to SEQ ID NO: 252892

SEQ ID NO: 310707 - RNA, 64 nt, Human; identical to SEQ ID NO: 252893

SEQ ID NO: 310708 - RNA, 64 nt, Human; identical to SEQ ID NO: 252894

SEQ ID NO: 310709 - RNA, 64 nt, Human; identical to SEQ ID NO: 252895

SEQ ID NO: 310710 - RNA, 64 nt, Human; identical to SEQ ID NO: 252896

SEQ ID NO: 310711 - RNA, 64 nt, Human; identical to SEQ ID NO: 252897

SEQ ID NO: 310712 - RNA, 64 nt, Human; identical to SEQ ID NO: 252898

SEQ ID NO: 310713 - RNA, 64 nt, Human; identical to SEQ ID NO: 252899

SEQ ID NO: 310714 - RNA, 64 nt, Human; identical to SEQ ID NO: 252900

SEQ ID NO: 310715 - RNA, 64 nt, Human; identical to SEQ ID NO: 252901

SEQ ID NO: 310716 - RNA, 64 nt, Human; identical to SEQ ID NO: 252902

SEQ ID NO: 310717 - RNA, 64 nt, Human; identical to SEQ ID NO: 252903

SEQ ID NO: 310718 - RNA, 62 nt, Human
ccucggccugggcaggcccaaggccacggucuaggacacaccuucccugagacucaugacau

SEQ ID NO: 310719 - RNA, 58 nt, Human
gcccagaguugcaguuguaacuguugccaggacacauggccauaaauaauagaaagaa

SEQ ID NO: 310720 - RNA, 62 nt, Human
gugggagagggcacaugggcuugagaguggggaggacacagucuggacuugauccugcuaca

SEQ ID NO: 310721 - RNA, 62 nt, Human
cccaaaggccugucugggcccaucuggggcugaggacacacagauacauaaugacaccugca

SEQ ID NO: 310722 - RNA, 64 nt, Human; identical to SEQ ID NO: 252907

SEQ ID NO: 310723 - RNA, 64 nt, Human; identical to SEQ ID NO: 252908

SEQ ID NO: 310724 - RNA, 64 nt, Human; identical to SEQ ID NO: 252909

SEQ ID NO: 310725 - RNA, 64 nt, Human; identical to SEQ ID NO: 252910

SEQ ID NO: 310726 - RNA, 64 nt, Human; identical to SEQ ID NO: 252911

SEQ ID NO: 310727 - RNA, 64 nt, Human; identical to SEQ ID NO: 252912

SEQ ID NO: 310728 - RNA, 64 nt, Human; identical to SEQ ID NO: 252913

SEQ ID NO: 310729 - RNA, 64 nt, Human; identical to SEQ ID NO: 252914

SEQ ID NO: 310730 - RNA, 64 nt, Human; identical to SEQ ID NO: 252915

SEQ ID NO: 310731 - RNA, 64 nt, Human; identical to SEQ ID NO: 252916

SEQ ID NO: 310732 - RNA, 64 nt, Human; identical to SEQ ID NO: 252917

SEQ ID NO: 310733 - RNA, 64 nt, Human; identical to SEQ ID NO: 252918

SEQ ID NO: 310734 - RNA, 64 nt, Human; identical to SEQ ID NO: 252919

SEQ ID NO: 310735 - RNA, 64 nt, Human; identical to SEQ ID NO: 252923

SEQ ID NO: 310736 - RNA, 64 nt, Human; identical to SEQ ID NO: 252924

SEQ ID NO: 310737 - RNA, 62 nt, Human
agauccucagaguggaaggagggggaagcagcaggacacauuggcaagucaagcaggaagga

SEQ ID NO: 310738 - RNA, 62 nt, Human
gccauggggagaauuugacauuuauucacuauaggacacacucccaagggaacuggugcuug

SEQ ID NO: 310739 - RNA, 62 nt, Human
cagaauaaaauuaauuauauucuggucuucaaaggacacacagaacagauaucagcagaauc

SEQ ID NO: 310740 - RNA, 62 nt, Human
gaccuguucaaaaaggaaaaaauuaauacugaaggacacagcagugguauuggggggucuuc

SEQ ID NO: 310741 - RNA, 64 nt, Human; identical to SEQ ID NO: 252925

SEQ ID NO: 310742 - RNA, 64 nt, Human; identical to SEQ ID NO: 252926

SEQ ID NO: 310743 - RNA, 64 nt, Human; identical to SEQ ID NO: 252927

SEQ ID NO: 310744 - RNA, 64 nt, Human; identical to SEQ ID NO: 252928

SEQ ID NO: 310745 - RNA, 64 nt, Human; identical to SEQ ID NO: 252929

SEQ ID NO: 310746 - RNA, 64 nt, Human; identical to SEQ ID NO: 252930

SEQ ID NO: 310747 - RNA, 64 nt, Human; identical to SEQ ID NO: 252931

SEQ ID NO: 310748 - RNA, 64 nt, Human; identical to SEQ ID NO: 252932

SEQ ID NO: 310749 - RNA, 64 nt, Human; identical to SEQ ID NO: 252933

SEQ ID NO: 310750 - RNA, 64 nt, Human; identical to SEQ ID NO: 252934

SEQ ID NO: 310751 - RNA, 64 nt, Human; identical to SEQ ID NO: 252935

SEQ ID NO: 310752 - RNA, 64 nt, Human; identical to SEQ ID NO: 252939

SEQ ID NO: 310753 - RNA, 64 nt, Human; identical to SEQ ID NO: 252940

SEQ ID NO: 310754 - RNA, 64 nt, Human; identical to SEQ ID NO: 252941

SEQ ID NO: 310755 - RNA, 64 nt, Human; identical to SEQ ID NO: 252942

SEQ ID NO: 310756 - RNA, 62 nt, Human
guguguuaugggcugaggaugcagaaacaggcaggacacagugcuguccuagcagugcacug

SEQ ID NO: 310757 - RNA, 62 nt, Human
aaguuugcccuggaugucauauuggcaguuggaggacacaguuucuauuguaaauuuggauu

SEQ ID NO: 310758 - RNA, 61 nt, Human
uggcuucuggaagaaucugaaauaagauaaaaggacacacuaucaaaacacuuuaguuuuu

SEQ ID NO: 310759 - RNA, 62 nt, Human
agauccucaaguaacuggggaguacaugcuuuaggacacaaacaaaaacaaagggcaugaaa

SEQ ID NO: 310760 - RNA, 64 nt, Human; identical to SEQ ID NO: 252943

SEQ ID NO: 310761 - RNA, 64 nt, Human; identical to SEQ ID NO: 252944

SEQ ID NO: 310762 - RNA, 64 nt, Human; identical to SEQ ID NO: 252945

SEQ ID NO: 310763 - RNA, 64 nt, Human; identical to SEQ ID NO: 252946

SEQ ID NO: 310764 - RNA, 64 nt, Human; identical to SEQ ID NO: 252947

SEQ ID NO: 310765 - RNA, 64 nt, Human; identical to SEQ ID NO: 252948

SEQ ID NO: 310766 - RNA, 64 nt, Human; identical to SEQ ID NO: 252949

SEQ ID NO: 310767 - RNA, 64 nt, Human; identical to SEQ ID NO: 252950

SEQ ID NO: 310768 - RNA, 64 nt, Human; identical to SEQ ID NO: 252951

SEQ ID NO: 310769 - RNA, 64 nt, Human; identical to SEQ ID NO: 252955

SEQ ID NO: 310770 - RNA, 64 nt, Human; identical to SEQ ID NO: 252956

SEQ ID NO: 310771 - RNA, 64 nt, Human; identical to SEQ ID NO: 252957

SEQ ID NO: 310772 - RNA, 64 nt, Human; identical to SEQ ID NO: 252958

SEQ ID NO: 310773 - RNA, 54 nt, Human; identical to SEQ ID NO: 252550

SEQ ID NO: 310774 - RNA, 64 nt, Human; identical to SEQ ID NO: 252960

SEQ ID NO: 310775 - RNA, 62 nt, Human
guccuaggauuggaaaaaaauguuaaagguuuaggacacaccuaauaguauguccuuugaau

SEQ ID NO: 310776 - RNA, 62 nt, Human
auaccuuuacuuuaaggaccacacagucccagaggacacaucccucgggaacucugccccuc

SEQ ID NO: 310777 - RNA, 62 nt, Human
uucacauuuuaccccaacugaccugcaugcccaggacacaaguaaaacauuugugagauagu

SEQ ID NO: 310778 - RNA, 62 nt, Human
ccagaagccaauauugagauguaauucagauuaggacacagugugugacgcagauaacuggu

SEQ ID NO: 310779 - RNA, 64 nt, Human; identical to SEQ ID NO: 252961

SEQ ID NO: 310780 - RNA, 64 nt, Human; identical to SEQ ID NO: 252962

SEQ ID NO: 310781 - RNA, 64 nt, Human; identical to SEQ ID NO: 252963

SEQ ID NO: 310782 - RNA, 64 nt, Human; identical to SEQ ID NO: 252964

SEQ ID NO: 310783 - RNA, 64 nt, Human; identical to SEQ ID NO: 252965

SEQ ID NO: 310784 - RNA, 64 nt, Human; identical to SEQ ID NO: 252966

SEQ ID NO: 310785 - RNA, 64 nt, Human; identical to SEQ ID NO: 252967

SEQ ID NO: 310786 - RNA, 64 nt, Human; identical to SEQ ID NO: 252971

SEQ ID NO: 310787 - RNA, 64 nt, Human; identical to SEQ ID NO: 252972

SEQ ID NO: 310788 - RNA, 64 nt, Human; identical to SEQ ID NO: 252973

SEQ ID NO: 310789 - RNA, 64 nt, Human; identical to SEQ ID NO: 252974

SEQ ID NO: 310790 - RNA, 64 nt, Human; identical to SEQ ID NO: 252975

SEQ ID NO: 310791 - RNA, 64 nt, Human; identical to SEQ ID NO: 252976

SEQ ID NO: 310792 - RNA, 64 nt, Human; identical to SEQ ID NO: 252977

SEQ ID NO: 310793 - RNA, 64 nt, Human; identical to SEQ ID NO: 252978

SEQ ID NO: 310794 - RNA, 62 nt, Human
ccccgcccaggcccuguagggacagcauuugaaggacacauauugcaguugcuugguugaaa

SEQ ID NO: 310795 - RNA, 62 nt, Human
cugcuaagagucccucccugccacgcccuggcaggacacaggcacuuuuccaaugggcaagc

SEQ ID NO: 310796 - RNA, 62 nt, Human
gcuguggcccagcagcauggccugcaucuggaaggacacagguugccagagccccuggcaca

SEQ ID NO: 310797 - RNA, 60 nt, Human
acuaugaaagcuguaaguaaacuuggugaaaggacacagguacuaucauugaaaaccuug

SEQ ID NO: 310798 - RNA, 64 nt, Human; identical to SEQ ID NO: 252979

SEQ ID NO: 310799 - RNA, 64 nt, Human; identical to SEQ ID NO: 252980

SEQ ID NO: 310800 - RNA, 64 nt, Human; identical to SEQ ID NO: 252981

SEQ ID NO: 310801 - RNA, 64 nt, Human; identical to SEQ ID NO: 252982

SEQ ID NO: 310802 - RNA, 64 nt, Human; identical to SEQ ID NO: 252983

SEQ ID NO: 310803 - RNA, 64 nt, Human; identical to SEQ ID NO: 252987

SEQ ID NO: 310804 - RNA, 64 nt, Human; identical to SEQ ID NO: 252988

SEQ ID NO: 310805 - RNA, 64 nt, Human; identical to SEQ ID NO: 252989

SEQ ID NO: 310806 - RNA, 64 nt, Human; identical to SEQ ID NO: 252990

SEQ ID NO: 310807 - RNA, 64 nt, Human; identical to SEQ ID NO: 252991

SEQ ID NO: 310808 - RNA, 64 nt, Human; identical to SEQ ID NO: 252992

SEQ ID NO: 310809 - RNA, 64 nt, Human; identical to SEQ ID NO: 252993

SEQ ID NO: 310810 - RNA, 64 nt, Human; identical to SEQ ID NO: 252994

SEQ ID NO: 310811 - RNA, 64 nt, Human; identical to SEQ ID NO: 252995

SEQ ID NO: 310812 - RNA, 64 nt, Human; identical to SEQ ID NO: 252996

SEQ ID NO: 310813 - RNA, 62 nt, Human
aguccaucgugugagccucggccuggcuggccaggacacacugaaaagcagccuuuuucacc

SEQ ID NO: 310814 - RNA, 62 nt, Human
aauguuaaaggguaagauaauuucccugcaaaaggacacagaaggcagucuuaagaagauga

SEQ ID NO: 310815 - RNA, 64 nt, Human
gggcuacugaauggcuauuacuuucaucacgacugauccccaccuccucagggucaaagggcua

SEQ ID NO: 310816 - RNA, 64 nt, Human
aguacacacuuguugauuaauggaaauguuuacagauccccaagccuggcaagggaauuucuuc

SEQ ID NO: 310817 - RNA, 64 nt, Human; identical to SEQ ID NO: 252997

SEQ ID NO: 310818 - RNA, 64 nt, Human; identical to SEQ ID NO: 252998

SEQ ID NO: 310819 - RNA, 64 nt, Human; identical to SEQ ID NO: 252999

SEQ ID NO: 310820 - RNA, 64 nt, Human; identical to SEQ ID NO: 253003

SEQ ID NO: 310821 - RNA, 64 nt, Human; identical to SEQ ID NO: 253004

SEQ ID NO: 310822 - RNA, 64 nt, Human; identical to SEQ ID NO: 253005

SEQ ID NO: 310823 - RNA, 64 nt, Human; identical to SEQ ID NO: 253006

SEQ ID NO: 310824 - RNA, 64 nt, Human; identical to SEQ ID NO: 253007

SEQ ID NO: 310825 - RNA, 64 nt, Human; identical to SEQ ID NO: 253008

SEQ ID NO: 310826 - RNA, 64 nt, Human; identical to SEQ ID NO: 253009

SEQ ID NO: 310827 - RNA, 64 nt, Human; identical to SEQ ID NO: 253010

SEQ ID NO: 310828 - RNA, 64 nt, Human; identical to SEQ ID NO: 253011

SEQ ID NO: 310829 - RNA, 64 nt, Human; identical to SEQ ID NO: 253012

SEQ ID NO: 310830 - RNA, 64 nt, Human; identical to SEQ ID NO: 253013

SEQ ID NO: 310831 - RNA, 64 nt, Human; identical to SEQ ID NO: 253014

SEQ ID NO: 310832 - RNA, 62 nt, Human
cauagcugaccagggcugugcuugagguacagaggacacacauuguagacaggccuguguca

SEQ ID NO: 310833 - RNA, 62 nt, Human
caacuguauugaguugaggcuguggagaaauaaggacacauauaugggaauggaaugcaaaa

SEQ ID NO: 310834 - RNA, 62 nt, Human
agcuaaucugauuuggggauucacuguuucagaggacacagacaaaagcuguugcaucaaaa

SEQ ID NO: 310835 - RNA, 62 nt, Human
auaaggaguuccaauuuggggccaaaugaggaaggacacagacucugcccugggaucuccug

SEQ ID NO: 310836 - RNA, 64 nt, Human; identical to SEQ ID NO: 253015

SEQ ID NO: 310837 - RNA, 64 nt, Human; identical to SEQ ID NO: 253019

SEQ ID NO: 310838 - RNA, 64 nt, Human; identical to SEQ ID NO: 253020

SEQ ID NO: 310839 - RNA, 64 nt, Human; identical to SEQ ID NO: 253021

SEQ ID NO: 310840 - RNA, 64 nt, Human; identical to SEQ ID NO: 253022

SEQ ID NO: 310841 - RNA, 64 nt, Human; identical to SEQ ID NO: 253023

SEQ ID NO: 310842 - RNA, 64 nt, Human; identical to SEQ ID NO: 253024

SEQ ID NO: 310843 - RNA, 64 nt, Human; identical to SEQ ID NO: 253025

SEQ ID NO: 310844 - RNA, 64 nt, Human; identical to SEQ ID NO: 253026

SEQ ID NO: 310845 - RNA, 64 nt, Human; identical to SEQ ID NO: 253027

SEQ ID NO: 310846 - RNA, 64 nt, Human; identical to SEQ ID NO: 253028

SEQ ID NO: 310847 - RNA, 64 nt, Human; identical to SEQ ID NO: 253029

SEQ ID NO: 310848 - RNA, 64 nt, Human; identical to SEQ ID NO: 253030

SEQ ID NO: 310849 - RNA, 64 nt, Human; identical to SEQ ID NO: 253031

SEQ ID NO: 310850 - RNA, 64 nt, Human; identical to SEQ ID NO: 253035

SEQ ID NO: 310851 - RNA, 62 nt, Human
agaggggacaucacuuagaaguucuuauagaaaggacacaaguuuguuuccuggcuuuaccu

SEQ ID NO: 310852 - RNA, 62 nt, Human
aaccaggcuuuucaggaugggacuucagaccaaggacacaaguugggcuugcuuagguguuu

SEQ ID NO: 310853 - RNA, 62 nt, Human
cccgcugggauuucuucgcugcucuagcuggcaggacacaucccggccucuuccacccauuc

SEQ ID NO: 310854 - RNA, 62 nt, Human
ccuucuuccugccacaggccaugccucuaccaaggacacauggccuuucccuguuaggacug

SEQ ID NO: 310855 - RNA, 64 nt, Human; identical to SEQ ID NO: 253036

SEQ ID NO: 310856 - RNA, 64 nt, Human; identical to SEQ ID NO: 253037

SEQ ID NO: 310857 - RNA, 64 nt, Human; identical to SEQ ID NO: 253038

SEQ ID NO: 310858 - RNA, 64 nt, Human; identical to SEQ ID NO: 253039

SEQ ID NO: 310859 - RNA, 64 nt, Human; identical to SEQ ID NO: 253040

SEQ ID NO: 310860 - RNA, 64 nt, Human; identical to SEQ ID NO: 253041

SEQ ID NO: 310861 - RNA, 64 nt, Human; identical to SEQ ID NO: 253042

SEQ ID NO: 310862 - RNA, 64 nt, Human; identical to SEQ ID NO: 253043

SEQ ID NO: 310863 - RNA, 64 nt, Human; identical to SEQ ID NO: 253044

SEQ ID NO: 310864 - RNA, 64 nt, Human; identical to SEQ ID NO: 253045

SEQ ID NO: 310865 - RNA, 64 nt, Human; identical to SEQ ID NO: 253046

SEQ ID NO: 310866 - RNA, 64 nt, Human; identical to SEQ ID NO: 253047

SEQ ID NO: 310867 - RNA, 64 nt, Human; identical to SEQ ID NO: 253051

SEQ ID NO: 310868 - RNA, 64 nt, Human; identical to SEQ ID NO: 253052

SEQ ID NO: 310869 - RNA, 64 nt, Human; identical to SEQ ID NO: 253053

SEQ ID NO: 310870 - RNA, 62 nt, Human
ccuugcagaggacgaagaggaggaggaugaggaggacacagaagauggcgucagcuuccagc

SEQ ID NO: 310871 - RNA, 62 nt, Human
ugaggacauggugacucggugacuguaacaguaggacacaucccaucaugcggucagagugc

SEQ ID NO: 310872 - RNA, 62 nt, Human
acaccgcacccccuggaucuggcugagggcucaggacacaggcccagccacccccaggggcc

SEQ ID NO: 310873 - RNA, 62 nt, Human
cagcuaaucuguagggcuggaccuauguccuaaggacacacuaaucgaacuaugaacuacaa

SEQ ID NO: 310874 - RNA, 64 nt, Human; identical to SEQ ID NO: 253054

SEQ ID NO: 310875 - RNA, 64 nt, Human; identical to SEQ ID NO: 253055

SEQ ID NO: 310876 - RNA, 64 nt, Human; identical to SEQ ID NO: 253056

SEQ ID NO: 310877 - RNA, 64 nt, Human; identical to SEQ ID NO: 253057

SEQ ID NO: 310878 - RNA, 64 nt, Human; identical to SEQ ID NO: 253058

SEQ ID NO: 310879 - RNA, 64 nt, Human; identical to SEQ ID NO: 253059

SEQ ID NO: 310880 - RNA, 64 nt, Human; identical to SEQ ID NO: 253060

SEQ ID NO: 310881 - RNA, 64 nt, Human; identical to SEQ ID NO: 253061

SEQ ID NO: 310882 - RNA, 64 nt, Human; identical to SEQ ID NO: 253062

SEQ ID NO: 310883 - RNA, 64 nt, Human; identical to SEQ ID NO: 253063

SEQ ID NO: 310884 - RNA, 64 nt, Human; identical to SEQ ID NO: 253067

SEQ ID NO: 310885 - RNA, 64 nt, Human; identical to SEQ ID NO: 253068

SEQ ID NO: 310886 - RNA, 64 nt, Human; identical to SEQ ID NO: 253069

SEQ ID NO: 310887 - RNA, 64 nt, Human; identical to SEQ ID NO: 253070

SEQ ID NO: 310888 - RNA, 64 nt, Human; identical to SEQ ID NO: 253071

SEQ ID NO: 310889 - RNA, 62 nt, Human
agggcucccgcaggggccugcaucuggccagcaggacacagggaugcgcagggcgcccccuu

SEQ ID NO: 310890 - RNA, 62 nt, Human
ucauggggcugacaguccuaaaaucaagugcuaggacacaguggccauugagcugggagcau

SEQ ID NO: 310891 - RNA, 62 nt, Human
augggcagaaucaacaaagaugaaaccgccugaggacacauuuaacaaguaacauuucuagg

SEQ ID NO: 310892 - RNA, 62 nt, Human
aaggaaauauuuuauguaaagagcaacucagcaggacacagaacuaaaacuacuacuuacau

SEQ ID NO: 310893 - RNA, 64 nt, Human; identical to SEQ ID NO: 253072

SEQ ID NO: 310894 - RNA, 64 nt, Human; identical to SEQ ID NO: 253073

SEQ ID NO: 310895 - RNA, 64 nt, Human; identical to SEQ ID NO: 253074

SEQ ID NO: 310896 - RNA, 64 nt, Human; identical to SEQ ID NO: 253075

SEQ ID NO: 310897 - RNA, 64 nt, Human; identical to SEQ ID NO: 253076

SEQ ID NO: 310898 - RNA, 64 nt, Human; identical to SEQ ID NO: 253077

SEQ ID NO: 310899 - RNA, 64 nt, Human; identical to SEQ ID NO: 253078

SEQ ID NO: 310900 - RNA, 64 nt, Human; identical to SEQ ID NO: 253079

SEQ ID NO: 310901 - RNA, 64 nt, Human; identical to SEQ ID NO: 253083

SEQ ID NO: 310902 - RNA, 64 nt, Human; identical to SEQ ID NO: 253084

SEQ ID NO: 310903 - RNA, 64 nt, Human; identical to SEQ ID NO: 253085

SEQ ID NO: 310904 - RNA, 64 nt, Human; identical to SEQ ID NO: 253086

SEQ ID NO: 310905 - RNA, 64 nt, Human; identical to SEQ ID NO: 253087

SEQ ID NO: 310906 - RNA, 64 nt, Human; identical to SEQ ID NO: 253088

SEQ ID NO: 310907 - RNA, 64 nt, Human; identical to SEQ ID NO: 253089

SEQ ID NO: 310908 - RNA, 62 nt, Human
cacauggaaagaggguuuaacagacccucucuaggacacaacuguuucugcuuugagcaaua

SEQ ID NO: 310909 - RNA, 62 nt, Human
ccaauacauugaauguaugaugacuauuugggaggacacauuuauguacccagaggccccca

SEQ ID NO: 310910 - RNA, 62 nt, Human
gacuggccuuaacagagcccaacuuucuuggaaggacacagcugggggucgaggguccugca

SEQ ID NO: 310911 - RNA, 62 nt, Human
gcguguccaucaucagcugaccaagacaccugaggacacaucuuggcacccagaggagcagc

SEQ ID NO: 310912 - RNA, 64 nt, Human; identical to SEQ ID NO: 253090

SEQ ID NO: 310913 - RNA, 64 nt, Human; identical to SEQ ID NO: 253091

SEQ ID NO: 310914 - RNA, 64 nt, Human; identical to SEQ ID NO: 253092

SEQ ID NO: 310915 - RNA, 64 nt, Human; identical to SEQ ID NO: 253093

SEQ ID NO: 310916 - RNA, 64 nt, Human; identical to SEQ ID NO: 253094

SEQ ID NO: 310917 - RNA, 64 nt, Human; identical to SEQ ID NO: 253095

SEQ ID NO: 310918 - RNA, 64 nt, Human; identical to SEQ ID NO: 253099

SEQ ID NO: 310919 - RNA, 64 nt, Human; identical to SEQ ID NO: 253100

SEQ ID NO: 310920 - RNA, 64 nt, Human; identical to SEQ ID NO: 253101

SEQ ID NO: 310921 - RNA, 64 nt, Human; identical to SEQ ID NO: 253102

SEQ ID NO: 310922 - RNA, 64 nt, Human; identical to SEQ ID NO: 253103

SEQ ID NO: 310923 - RNA, 64 nt, Human; identical to SEQ ID NO: 253104

SEQ ID NO: 310924 - RNA, 64 nt, Human; identical to SEQ ID NO: 253105

SEQ ID NO: 310925 - RNA, 64 nt, Human; identical to SEQ ID NO: 253106

SEQ ID NO: 310926 - RNA, 64 nt, Human; identical to SEQ ID NO: 253107

SEQ ID NO: 310927 - RNA, 62 nt, Human
cccuggggaagacauuugcaacugacuuggggaggacacagcuucagcacagccucuccugc

SEQ ID NO: 310928 - RNA, 62 nt, Human
uaacaugaagauuuuagaaggagagaacuuacaggacacagauuugugauucuuugacugug

SEQ ID NO: 310929 - RNA, 62 nt, Human
caccagagccagagcagcugcuugucugcagcaggacacaguuccuacauacguuucaguuc

SEQ ID NO: 310930 - RNA, 62 nt, Human
acagccucuccuggugagucgggacucagcugaggacacauccccacccugccucccaucug

SEQ ID NO: 310931 - RNA, 64 nt, Human; identical to SEQ ID NO: 253108

SEQ ID NO: 310932 - RNA, 64 nt, Human; identical to SEQ ID NO: 253109

SEQ ID NO: 310933 - RNA, 64 nt, Human; identical to SEQ ID NO: 253110

SEQ ID NO: 310934 - RNA, 64 nt, Human; identical to SEQ ID NO: 253111

SEQ ID NO: 310935 - RNA, 64 nt, Human; identical to SEQ ID NO: 253115

SEQ ID NO: 310936 - RNA, 64 nt, Human; identical to SEQ ID NO: 253116

SEQ ID NO: 310937 - RNA, 64 nt, Human; identical to SEQ ID NO: 253117

SEQ ID NO: 310938 - RNA, 60 nt, Human; identical to SEQ ID NO: 252710

SEQ ID NO: 310939 - RNA, 64 nt, Human; identical to SEQ ID NO: 253119

SEQ ID NO: 310940 - RNA, 64 nt, Human; identical to SEQ ID NO: 253120

SEQ ID NO: 310941 - RNA, 64 nt, Human; identical to SEQ ID NO: 253121

SEQ ID NO: 310942 - RNA, 64 nt, Human; identical to SEQ ID NO: 253122

SEQ ID NO: 310943 - RNA, 64 nt, Human; identical to SEQ ID NO: 253123

SEQ ID NO: 310944 - RNA, 64 nt, Human; identical to SEQ ID NO: 253124

SEQ ID NO: 310945 - RNA, 64 nt, Human; identical to SEQ ID NO: 253125

SEQ ID NO: 310946 - RNA, 62 nt, Human
gacagggaccuucaaaccucgacagugaugcaaggacacagagaguaccagauagguagcag

SEQ ID NO: 310947 - RNA, 62 nt, Human
agagagggacagguucuguugggggugacaccaggacacaggaauagguucugucgggagga

SEQ ID NO: 310948 - RNA, 62 nt, Human
acacagggacagguucugucaugggugacacgaggacacagggacagguucuaucaugggug

SEQ ID NO: 310949 - RNA, 62 nt, Human
acacagggacagguucugucgggggugacaccaggacacagggacagguucugucaugggug

SEQ ID NO: 310950 - RNA, 64 nt, Human; identical to SEQ ID NO: 253126

SEQ ID NO: 310951 - RNA, 64 nt, Human; identical to SEQ ID NO: 253127

SEQ ID NO: 310952 - RNA, 64 nt, Human; identical to SEQ ID NO: 253131

SEQ ID NO: 310953 - RNA, 64 nt, Human; identical to SEQ ID NO: 253132

SEQ ID NO: 310954 - RNA, 64 nt, Human; identical to SEQ ID NO: 253133

SEQ ID NO: 310955 - RNA, 64 nt, Human; identical to SEQ ID NO: 253134

SEQ ID NO: 310956 - RNA, 64 nt, Human; identical to SEQ ID NO: 253135

SEQ ID NO: 310957 - RNA, 64 nt, Human; identical to SEQ ID NO: 253136

SEQ ID NO: 310958 - RNA, 64 nt, Human; identical to SEQ ID NO: 253137

SEQ ID NO: 310959 - RNA, 64 nt, Human; identical to SEQ ID NO: 253138

SEQ ID NO: 310960 - RNA, 64 nt, Human; identical to SEQ ID NO: 253139

SEQ ID NO: 310961 - RNA, 64 nt, Human; identical to SEQ ID NO: 253140

SEQ ID NO: 310962 - RNA, 64 nt, Human; identical to SEQ ID NO: 253141

SEQ ID NO: 310963 - RNA, 64 nt, Human; identical to SEQ ID NO: 253142

SEQ ID NO: 310964 - RNA, 64 nt, Human; identical to SEQ ID NO: 253143

SEQ ID NO: 310965 - RNA, 62 nt, Human
caauaugacugguuuccuuguaugaaaaggagaggacacagagacagaggagaugcggggaa

SEQ ID NO: 310966 - RNA, 62 nt, Human
gucaaggugacggaugaagccagcugcuccuaaggacacagggcuggguugguaaagagaag

SEQ ID NO: 310967 - RNA, 62 nt, Human
ccaugcccuugucgagggaaagagacccagaaaggacacaacccgucagagaccugggagca

SEQ ID NO: 310968 - RNA, 62 nt, Human
ucacacccugcauggaaucaggcuccucagccaggacacagggugaggccccccagccagga

SEQ ID NO: 310969 - RNA, 64 nt, Human; identical to SEQ ID NO: 253147

SEQ ID NO: 310970 - RNA, 64 nt, Human; identical to SEQ ID NO: 253148

SEQ ID NO: 310971 - RNA, 64 nt, Human; identical to SEQ ID NO: 253149

SEQ ID NO: 310972 - RNA, 64 nt, Human; identical to SEQ ID NO: 253150

SEQ ID NO: 310973 - RNA, 64 nt, Human; identical to SEQ ID NO: 253151

SEQ ID NO: 310974 - RNA, 64 nt, Human; identical to SEQ ID NO: 253152

SEQ ID NO: 310975 - RNA, 64 nt, Human; identical to SEQ ID NO: 253153

SEQ ID NO: 310976 - RNA, 64 nt, Human; identical to SEQ ID NO: 253154

SEQ ID NO: 310977 - RNA, 64 nt, Human; identical to SEQ ID NO: 253155

SEQ ID NO: 310978 - RNA, 64 nt, Human; identical to SEQ ID NO: 253156

SEQ ID NO: 310979 - RNA, 64 nt, Human; identical to SEQ ID NO: 253157

SEQ ID NO: 310980 - RNA, 64 nt, Human; identical to SEQ ID NO: 253158

SEQ ID NO: 310981 - RNA, 64 nt, Human; identical to SEQ ID NO: 253159

SEQ ID NO: 310982 - RNA, 64 nt, Human; identical to SEQ ID NO: 253163

SEQ ID NO: 310983 - RNA, 64 nt, Human; identical to SEQ ID NO: 253164

SEQ ID NO: 310984 - RNA, 62 nt, Human
ggcagccucaguuggccccuggcagaggaacaaggacacagacauucccucagugugggggg

SEQ ID NO: 310985 - RNA, 62 nt, Human
gcccagguuuggacacaacuacaaagaacagcaggacacagaggugaccucuguccugaggc

SEQ ID NO: 310986 - RNA, 62 nt, Human
gggugugugggaaaccugaagauggcgugcacaggacacagcgugggcggccugggcagaag

SEQ ID NO: 310987 - RNA, 62 nt, Human
ccagggacuguucaggcuuguccucagcugagaggacacaggcuagagggacugugcagaac

SEQ ID NO: 310988 - RNA, 64 nt, Human; identical to SEQ ID NO: 253165

SEQ ID NO: 310989 - RNA, 64 nt, Human; identical to SEQ ID NO: 253166

SEQ ID NO: 310990 - RNA, 64 nt, Human; identical to SEQ ID NO: 253167

SEQ ID NO: 310991 - RNA, 64 nt, Human; identical to SEQ ID NO: 253168

SEQ ID NO: 310992 - RNA, 64 nt, Human; identical to SEQ ID NO: 253169

SEQ ID NO: 310993 - RNA, 64 nt, Human; identical to SEQ ID NO: 253170

SEQ ID NO: 310994 - RNA, 64 nt, Human; identical to SEQ ID NO: 253171

SEQ ID NO: 310995 - RNA, 64 nt, Human; identical to SEQ ID NO: 253172

SEQ ID NO: 310996 - RNA, 64 nt, Human; identical to SEQ ID NO: 253173

SEQ ID NO: 310997 - RNA, 64 nt, Human; identical to SEQ ID NO: 253174

SEQ ID NO: 310998 - RNA, 62 nt, Human
agcguggagggcucggcguggauggcagccucaggacacacaccccugccucaaggugcuga

SEQ ID NO: 310999 - RNA, 62 nt, Human
gucucugucccaggcgggauggggcacagugcaggacacagccauguacaccaagaagagag

SEQ ID NO: 311000 - RNA, 62 nt, Human
gacuuauaaagcagcaacagcugaggcgcaccaggacacagcuuccauuucuuuaacgucug

SEQ ID NO: 311001 - RNA, 62 nt, Human
uaccuuguauguuuacauaaugcuuuagcccaaggacacaucaccaacccauggacucgcag

SEQ ID NO: 311002 - RNA, 62 nt, Human
gaaugaaaugcaguguagggagaggagauggcaggacacagcaaacaggacacauuugccug

SEQ ID NO: 311003 - RNA, 62 nt, Human
guagggagaggagauggcaggacacagcaaacaggacacauuugccugcuucucucuugccu

SEQ ID NO: 311004 - RNA, 62 nt, Human
guagaaaugacagacuuuuucauugaaugaugaggacacagcagccauauuaugccaagagg

SEQ ID NO: 311005 - RNA, 62 nt, Human
aaguuggauugcugcuauuuaaaaaaaaaaaaaggacacagaucaaaaaaacacccaaaggc

SEQ ID NO: 311006 - RNA, 62 nt, Human
gcagagagcuggcauucacucaaaugcuaaacaggacacaggggucugauuugaagccccuc

SEQ ID NO: 311007 - RNA, 62 nt, Human
acacucuaauaaggauaaugcugaauuuugaaaggacacaaaacaucuaaugccaauauaua

SEQ ID NO: 311008 - RNA, 62 nt, Human
augacauuugcuuugggcagaggcagcuagccaggacacauuuccacuauaauuuuacaaag

SEQ ID NO: 311009 - RNA, 62 nt, Human
cacagaacucaguguaccaaacaugcauacaaaggacacacagggauuuugaaaaugcugca

SEQ ID NO: 311010 - RNA, 62 nt, Human
cuguccguuuugcagauggacaggaaggagccaggacacagcucagcuugcucacgcccaga

SEQ ID NO: 311011 - RNA, 62 nt, Human
ggucuuugguuuugauggcacacuauggagaaaggacacacugguuuuaaucuguagaacug

SEQ ID NO: 311012 - RNA, 62 nt, Human
agggccagccgcuaccaggacggcccugaaacaggacacaucuguuuuuugucccucacccu

SEQ ID NO: 311013 - RNA, 62 nt, Human
ucagaucagccacuugcugacccugguucuuaaggacacaugacauuaguccaaucuuucaa

SEQ ID NO: 311014 - RNA, 62 nt, Human
ugguaaccccccauguggcacccagggacugaaggacacagugcguggagacggcccugagc

SEQ ID NO: 311015 - RNA, 62 nt, Human
cugccugcguaaaaagugccacccacggaggcaggacacaggcagcguguggcccauucagc

SEQ ID NO: 311016 - RNA, 62 nt, Human
ugguuuagugcucaguuggcucuaguaaccagaggacacagaaaguaucuuuuggaaaguuu

SEQ ID NO: 311017 - RNA, 62 nt, Human
ggaacagccgcagcgugucacagguguuggugaggacacacacuaggcccaaggugccugug

SEQ ID NO: 311018 - RNA, 52 nt, Human
ggcuccgcaaauaccacugaagaggacacacucugcacccccccaccccacg

SEQ ID NO: 311019 - RNA, 62 nt, Human
gggcagggugggcagggcuuuuguggguuaugaggacacagaagucccugaggcccccagac

SEQ ID NO: 311020 - RNA, 62 nt, Human
cugaaucugucauuuuuuagaagaugcuucauaggacacaggacuauccauuucuacagaca

SEQ ID NO: 311021 - RNA, 62 nt, Human
gaucccucaggucugcugcaaacacagcauggaggacacagaugacucuuugguguuggucu

SEQ ID NO: 311022 - RNA, 62 nt, Human
uugucccuuuaggaggacaaaauggggucaagaggacacagaagaguuguauagcaccagau

SEQ ID NO: 311023 - RNA, 62 nt, Human
auuaaaaaacaauaacuuuuuaaagaaacauaaggacacauuuucaaauuaauaaaaauaaa

SEQ ID NO: 311024 - RNA, 62 nt, Human
gaaaggggcacugaccuguagugaaaggccacaggacacagccuuauuacugcugggguggg

SEQ ID NO: 311025 - RNA, 62 nt, Human
acaucacucuggccucaucaccaaggugacagaggacacaggggagggggaaaacccacaca

SEQ ID NO: 311026 - RNA, 62 nt, Human
gaggcugugggacuccaggggcccccguguucaggacacaucuauugcagagacucauuuca

SEQ ID NO: 311027 - RNA, 62 nt, Human
gccugaaguuucccuuuggaguuccaaaguaaaggacacauaagcaacacuuccaaaaacaa

SEQ ID NO: 311028 - RNA, 62 nt, Human
gggcaagccuaggagaguaggaagagcuguggaggacacacucucaguuuguuuuugacuuu

SEQ ID NO: 311029 - RNA, 62 nt, Human
acgcuccucccagaucgcucuacaugacauucaggacacacacacacacacacacacaccac

SEQ ID NO: 311030 - RNA, 62 nt, Human
ccucuugcaaugacagcugaucugucggaaccaggacacaaaagcagcaagaagcggggaga

SEQ ID NO: 311031 - RNA, 62 nt, Human
guggauauccagccagaaugcccucucuccagaggacacacagcucuggauuucuacccccu

SEQ ID NO: 311032 - RNA, 62 nt, Human
cuugaggucugggaggguggcccuggccagccaggacacaugcagaccccuggcuuuagucu

SEQ ID NO: 311033 - RNA, 62 nt, Human
uccucaagguuuuuaauauuaaacacaucugcaggacacauuuugccauguaaacuaacauu

SEQ ID NO: 311034 - RNA, 62 nt, Human
cagaugcaauuuucaacuauucugaaaccagcaggacacaccugacuuuaauaguuuuagcu

SEQ ID NO: 311035 - RNA, 62 nt, Human
cagcaaugugugcacagaacaaagaccaggagaggacacagugagaaggcaguuaucugcaa

SEQ ID NO: 311036 - RNA, 51 nt, Human
aggaggagggggaauccuagcaggacacagccuuggaucaggacagagacu

SEQ ID NO: 311037 - RNA, 51 nt, Human; identical to SEQ ID NO: 311036

SEQ ID NO: 311038 - RNA, 62 nt, Human
auuuagagcuuuaaaagaugcacugcccaaauaggacacacgaugguguuagcugaaguuug

SEQ ID NO: 311039 - RNA, 62 nt, Human
guauaggacguugcuuauuuuaaaacaagggaaggacacaaaauggaaugacugcuuagucc

SEQ ID NO: 311040 - RNA, 62 nt, Human
agugccauggcuccagugcucuggugucacccaggacacagccacucggggccccgcugccc

SEQ ID NO: 311041 - RNA, 62 nt, Human
cuguauuuuccaccuuuuguuuuuccaguuccaggacacagauuaucaacuggggggaccaa

SEQ ID NO: 311042 - RNA, 62 nt, Human
guuccauaauucauuauuaagcucugaaauucaggacacauacauuuauagagugugaggcu

SEQ ID NO: 311043 - RNA, 62 nt, Human
gauuuggugccugucuuaaaggaaggccuuugaggacacaccugucugccacaaaugcuuua

SEQ ID NO: 311044 - RNA, 62 nt, Human
uuggucaaguuuuucucucaaaugauacagucaggacacaucguucgauuuaagccaucauc

SEQ ID NO: 311045 - RNA, 62 nt, Human
ccuauucacucggaaaauuagguucauuucacaggacacagcaguguagaucaggcuucaac

SEQ ID NO: 311046 - RNA, 62 nt, Human
acauaaguucucuggaaauaucuacaacuaauaggacacauguaaauccuugaagacacauc

SEQ ID NO: 311047 - RNA, 62 nt, Human
aguuuguaauuacugaaagucugauuucauucaggacacauuuuuuccuucauauuuuuucu

SEQ ID NO: 311048 - RNA, 62 nt, Human
agggggucuggcagcacggcguccuggggagcaggacacauggucauccccagggcuguaua

SEQ ID NO: 311049 - RNA, 62 nt, Human
ugggugggggauggauccuccccacacaucugaggacacacaaccacuugguacauuuucuc

SEQ ID NO: 311050 - RNA, 62 nt, Human
ggaauaggaaggagaaauuaauugagauuuucaggacacagacauaugaugugaaugccuac

SEQ ID NO: 311051 - RNA, 62 nt, Human
ccugugcccagagaagggucucgacccacucaaggacacacagcagguccguggaugggcug

SEQ ID NO: 311052 - RNA, 62 nt, Human
cuugaaugcggacaauuggggccaaacgaggaaggacacagacccaaaagccagacccaggu

SEQ ID NO: 311053 - RNA, 62 nt, Human
uguguugucuugaccaagcuccuacuaaguauaggacacaaauguuuuuuaucuuccaaggc

SEQ ID NO: 311054 - RNA, 55 nt, Human
agacaauagugaaagcaugaaaaagaggacacauggaaucuggaggccauuuaga

SEQ ID NO: 311055 - RNA, 62 nt, Human
ggucaagaaguuuucccucuuuuguggugaggaggacacaggccugggaaaaauaggaacag

SEQ ID NO: 311056 - RNA, 55 nt, Human
uccuggugcaccucaucuagaagggaggacacaaggacauuggugcuucagagcc

SEQ ID NO: 311057 - RNA, 62 nt, Human
acuguggacccugguaugcccacgugggacagaggacacagagguggaagauugaucuugcc

SEQ ID NO: 311058 - RNA, 62 nt, Human
ccucugugucacugacacaggaaaucauuucuaggacacagugaucagggaagggugccugg

SEQ ID NO: 311059 - RNA, 62 nt, Human
agaggaaaucaaccaggaccaaagagccuuaaaggacacacagcaaugcacagccacuuccc

SEQ ID NO: 311060 - RNA, 62 nt, Human
ccacaauucucggauauagggauucaaaagacaggacacagaacuaacacagugaaaaaaau

SEQ ID NO: 311061 - RNA, 62 nt, Human
uauucauuaacagugugugcaaaugcaaccccaggacacauuauuguucugauagaugcuca

SEQ ID NO: 311062 - RNA, 62 nt, Human
agacuaacagcaguacauguuauuauguaauuaggacacauuuaaaauuuggcaaauaaugc

SEQ ID NO: 311063 - RNA, 62 nt, Human
uuucacuacauugagacaguuacugugagaauaggacacaaacaccagcuauugccugcauc

SEQ ID NO: 311064 - RNA, 62 nt, Human
gccacauaaaggaucuuccauuagagggacacaggacacaaagcuccauucccaugacccuc

SEQ ID NO: 311065 - RNA, 62 nt, Human
gauuucagggaagcccugacuguguggagcuaaggacacaguggagauucucuggcacucug

SEQ ID NO: 311066 - RNA, 62 nt, Human
guuggugcuuuaccaccgcuuggagucucccgaggacacaaacaggcagagagggacgugua

SEQ ID NO: 311067 - RNA, 62 nt, Human
uuacauuccagugggucuaaugaccauaucuuaggacacagaugugcccagggagguggugu

SEQ ID NO: 311068 - RNA, 62 nt, Human
caccuucccauccuagcccuuaucagggucccaggacacagaauauaagugacuacagggca

SEQ ID NO: 311069 - RNA, 62 nt, Human
agagagcccgcucuccguggggcaccccauggaggacacaguaccagaguuuacagagaggg

SEQ ID NO: 311070 - RNA, 62 nt, Human
ccccacccaccuuccuuccucuucccucuucuaggacacaggcuguggaccccuucaggugc

SEQ ID NO: 311071 - RNA, 62 nt, Human
aggacugccuucagggcauccggagcuuccugaggacacaccagcaggucgccuccagccug

SEQ ID NO: 311072 - RNA, 62 nt, Human
guuacuuuguagccuuggccagaggcucaaaaaggacacaaccaguuuggggaagggguggc

SEQ ID NO: 311073 - RNA, 62 nt, Human
auacagaaaaaaagaaauauagugagcccuaaaggacacauacauugaauaaauaauuggaa

SEQ ID NO: 311074 - RNA, 62 nt, Human
ggacgugaaaucacugccuguuguggucuccgaggacacaugguaauggugaugcugugccu

SEQ ID NO: 311075 - RNA, 62 nt, Human
aacugaaguuuccgcccccgccccacagggcaaggacacagcgcgguuuuuuccacgcagca

SEQ ID NO: 311076 - RNA, 62 nt, Human
uuccugaccguccguguucucaggagugguugaggacacagggccccagcccagcccucugc

SEQ ID NO: 311077 - RNA, 62 nt, Human
gcccugggcagacaggcagagggccagagcagaggacacauggccuugcgugugugaaagcu

SEQ ID NO: 311078 - RNA, 62 nt, Human
aaauguaauguuuuuaagccuucuaucuuuuuaggacacaguuuguuuaagcaauauguuuu

SEQ ID NO: 311079 - RNA, 62 nt, Human
gaccuccaauguacacugccaaacacaagaguaggacacaucuguucuggguucuugaccua

SEQ ID NO: 311080 - RNA, 62 nt, Human
caugaggaucuuuccuuugacugggugcugugaggacacaccugggucugugccugagauug

SEQ ID NO: 311081 - RNA, 62 nt, Human
agccagcccagcccagaccccagggcugccuaaggacacagagauucuccaugggaagggga

SEQ ID NO: 311082 - RNA, 62 nt, Human
ugguagaugucaaaauccugcaugugcuauucaggacacacuuauaaacacaaaugcacugu

SEQ ID NO: 311083 - RNA, 62 nt, Human
uaucuucuaucaaagcacauaaaaccaguuauaggacacaguuggaagcagagccagucuuc

SEQ ID NO: 311084 - RNA, 62 nt, Human
gaaugaucauucaauggaucacagugaagcaaaggacacaacuuuuuauuguaccccuuaau

SEQ ID NO: 311085 - RNA, 62 nt, Human
uauccuuagaauccaaaugucuagauaaguugaggacacauaccugcauuguugagcuucuc

SEQ ID NO: 311086 - RNA, 62 nt, Human
cugcugucuccaguuucugggguuaagcacuaaggacacaagaaucaaucagaccuucuccc

SEQ ID NO: 311087 - RNA, 62 nt, Human
gcuuauuguauugagaaccaagaugggaccugaggacacaaagaugagcucaacagucucag

SEQ ID NO: 311088 - RNA, 62 nt, Human
ggcuuccaccauccaggugcaccacugaagugaggacacaccggagccaggcgccugcucau

SEQ ID NO: 311089 - RNA, 62 nt, Human
ccgugcugaaacccaguagagaaaccugucucaggacacacuugccaucuagggcuagcuug

SEQ ID NO: 311090 - RNA, 62 nt, Human
uuaagugauagaagaaacuguuguuugguuaaaggacacagauuugaaggaaaaaaauuuug

SEQ ID NO: 311091 - RNA, 62 nt, Human
cacacccucccuuacccuccuccagaccauucaggacacagggaaaucaggguuacaaaucu

SEQ ID NO: 311092 - RNA, 62 nt, Human
ccacuugacuuguggaaggccaucuugaugccaggacacacaggaagccccugugugacauc

SEQ ID NO: 311093 - RNA, 62 nt, Human
aucuuuguugucaaagacagcacaggguauuaaggacacagaaaaaaaaucagaauuagucu

SEQ ID NO: 311094 - RNA, 62 nt, Human
cuucaagcaauaacaagcagaggccuggagagaggacacaaggagggugcguggugcccuca

SEQ ID NO: 311095 - RNA, 62 nt, Human
guggguucucgguguucaaacucuucuaaggaaggacacacaguagcucucugcuugcugau

SEQ ID NO: 311096 - RNA, 62 nt, Human
acaagcuagaggaacuugcgaguauauuaacaaggacacaucugacauccuguguuugguua

SEQ ID NO: 311097 - RNA, 62 nt, Human
accgcuacaccacucuggcagccacacuucucaggacacaggccuguguagcugugaccugc

SEQ ID NO: 311098 - RNA, 62 nt, Human
auauuccgucuuggcaaaauaguggagaacgcaggacacaguuuccaggacauggccgugga

SEQ ID NO: 311099 - RNA, 62 nt, Human
guagggcuauuuccacccacccggcagcucuuaggacacauucccagaagagcggaaagauc

SEQ ID NO: 311100 - RNA, 62 nt, Human
auggaccaacaccuccuucaagaaaaggugguaggacacaaaguucuucaguccugagcccu

SEQ ID NO: 311101 - RNA, 62 nt, Human
ucaaacaauauuuucccuauaacaaaggcaauaggacacaaaauucacauccugcugggccu

SEQ ID NO: 311102 - RNA, 62 nt, Human
uguuacuucccagcauugacugacuauaagaaaggacacaucuguacucugcucugcagccu

SEQ ID NO: 311103 - RNA, 62 nt, Human
ucgcgcacagcucugcauguugcugcagcugaaggacacaucgaaguuguuaaauuccugau

SEQ ID NO: 311104 - RNA, 62 nt, Human
uguaaacccauucagauaaauggcaguacuuuaggacacacacaaacacacagacacaccuu

SEQ ID NO: 311105 - RNA, 62 nt, Human
ccugagcuucagacucgcgucccacugcccacaggacacauccaccuggaugugacucacag

SEQ ID NO: 311106 - RNA, 62 nt, Human
aaagaaaacaauuacauucuuauacaauaaaaaggacacauuuguguauguuuaaaauuacu

SEQ ID NO: 311107 - RNA, 62 nt, Human
ugacaugaaaugugguuaccauuaauagguuuaggacacaagucauauuccccauugcucuc

SEQ ID NO: 311108 - RNA, 62 nt, Human
ggaggggaacaggaugcccagcccagggggcaaggacacagcugcuccccucuggcuaugaa

SEQ ID NO: 311109 - RNA, 62 nt, Human
ugccugggcuucaggccuucuggcaccuucucaggacacaaguggcugcccaacccugacuc

SEQ ID NO: 311110 - RNA, 62 nt, Human
cggaggccaccgagggggcugggccuaucaggaggacacaggcugcagccuggcacccaccc

SEQ ID NO: 311111 - RNA, 62 nt, Human
cauucacacuaugaaacagaaagaucuguccaaggacacagcuuguaugaaaggguugaauu

SEQ ID NO: 311112 - RNA, 62 nt, Human
cuucucuccacgcauuuagacaaaaaaagcacaggacacagacacuaaauauaugagauccc

SEQ ID NO: 311113 - RNA, 62 nt, Human
ugaggacaagagaaaaaagccagguuccacagaggacacagagaagguuuggguguccuccu

SEQ ID NO: 311114 - RNA, 62 nt, Human
ggauugcuacaauucaagguuagauuugggugaggacacagagccauaccauaucagcccag

SEQ ID NO: 311115 - RNA, 62 nt, Human
aauggaagcccuuaaaggugcuuugauacugaaggacacaaaugugaccguccauccuccuu

SEQ ID NO: 311116 - RNA, 62 nt, Human
aguaggccagguaggcgauuggaagagugagcaggacacagaggggaggggaauguuuuggc

SEQ ID NO: 311117 - RNA, 62 nt, Human
uggagcacacucuucacccuacccucuaccacaggacacauaucccuguuagcauuccccgg

SEQ ID NO: 311118 - RNA, 62 nt, Human
cacacagaugauucugauucauagccaagaugaggacacacugauguagcugaucucucauu

SEQ ID NO: 311119 - RNA, 62 nt, Human
gcguuauagcggggccuugucucuuccucugcaggacacagaucuggaggacguggacuggg

SEQ ID NO: 311120 - RNA, 62 nt, Human
ccacgacucugguggggaaaaccguuuuuuaaaggacacacacacacacagcgaugcaucuc

SEQ ID NO: 311121 - RNA, 62 nt, Human
gaguacuaauuuucacugcuaauaauucuguaaggacacaucaaagcuggccaaaauaauga

SEQ ID NO: 311122 - RNA, 62 nt, Human
cacacgcaaaagaugacgcccagcacagcagcaggacacaccaugugccaggaaaugaccuc

SEQ ID NO: 311123 - RNA, 62 nt, Human
gcaucagcggcaaaucuuuucaugaagccccaaggacacaaaacauuuucccauuuaaagga

SEQ ID NO: 311124 - RNA, 62 nt, Human
agaacaagaacuucauuucagauagcaaacgcaggacacaccaagaguguccgugcacguag

SEQ ID NO: 311125 - RNA, 62 nt, Human
acacugaaacuguaugugcuguaauuuaauuuaggacacauuuagaugcacuaccauugcug

SEQ ID NO: 311126 - RNA, 62 nt, Human
aauuauauaaugagaaaaaaauguauccaacuaggacacauaucuuuugaguuauuuggacu

SEQ ID NO: 311127 - RNA, 62 nt, Human
ucaggaggagcauuaguagaacagcagugaugaggacacagagggagcagacaguggguacc

SEQ ID NO: 311128 - RNA, 62 nt, Human
ccagguaggacagcugcuccccaagccuccugaggacacaggaagagacggaaggagcaccu

SEQ ID NO: 311129 - RNA, 62 nt, Human
ggucuguacagugacaacccgggccggcagcaaggacacagaugcagccacaguaaggcucc

SEQ ID NO: 311130 - RNA, 62 nt, Human
ugugaaguaaggaugugggggaagaccuggcaaggacacagaugaaacacaaacaauaguaa

SEQ ID NO: 311131 - RNA, 62 nt, Human
uggugauugggaauggaugggggacagugaggaggacacaccagcccauuaguuguuaauca

SEQ ID NO: 311132 - RNA, 62 nt, Human
aucgaguacccugucauacaggaacaaguuaaaggacacaauugagguuaggcuagcuucua

SEQ ID NO: 311133 - RNA, 62 nt, Human
cagugcaacaccaaacuucaggggcacaagcgaggacacaucuaagggaccagaauaagacu

SEQ ID NO: 311134 - RNA, 62 nt, Human
gcuuuauagauagagcuggcuuuaagugcuaaaggacacaguagauuuuugacaaacagugg

SEQ ID NO: 311135 - RNA, 62 nt, Human
cacugauauuucaagaaaccccauuuuguauuaggacacaaagauaauuuaaacuuuguuug

SEQ ID NO: 311136 - RNA, 62 nt, Human
cuucuucccucccuccugugaaguuacacuguaggacacaagcugugagcaaucugcagucu

SEQ ID NO: 311137 - RNA, 62 nt, Human
auaccaagacaccauggcucagacaugggaucaggacacaccuuugagaucccacuguuagc

SEQ ID NO: 311138 - RNA, 62 nt, Human
aacuaggcugagcaaucugacccuaugggucuaggacacaguuccugggaacaucacauucc

SEQ ID NO: 311139 - RNA, 62 nt, Human
ucuccucuugucaggcuacagagugguggaagaggacacacacacaucuccuccauguuccu

SEQ ID NO: 311140 - RNA, 62 nt, Human
cugggaauagguuucaacauaugaauugggggaggacacauuuggaccacagcaugaaccuu

SEQ ID NO: 311141 - RNA, 62 nt, Human
uuggggcccucuaugcuggcuuuucaccccagaggacacaggcagcuuccaaaauauauuua

SEQ ID NO: 311142 - RNA, 62 nt, Human
gucccaguuguauucucacagguguuaugugcaggacacaauccaaaucauaaaccuggcuc

SEQ ID NO: 311143 - RNA, 62 nt, Human
cuccgucccuguccccgacugugccacgugguaggacacauaggacacaggaauuccugggu

SEQ ID NO: 311144 - RNA, 62 nt, Human
uguccccgacugugccacgugguaggacacauaggacacaggaauuccuggguccuugccca

SEQ ID NO: 311145 - RNA, 62 nt, Human
cuggguccuugcccaugacugugccaugugguaggacacaggacacaggaauuccuggaaag

SEQ ID NO: 311146 - RNA, 62 nt, Human
cuugcccaugacugugccaugugguaggacacaggacacaggaauuccuggaaagugguggc

SEQ ID NO: 311147 - RNA, 62 nt, Human
ccaacuuggcaggacuuggccagcagcugcccaggacacagugcaggccagagcgggcuuga

SEQ ID NO: 311148 - RNA, 62 nt, Human
gccugcagcuucauuugcgagagcgccgaggcaggacacagagcacagcugugcuggaagug

SEQ ID NO: 311149 - RNA, 62 nt, Human
gggaggccccuggccucuccgggaucaguccuaggacacaggcucagccucagguugauggg

SEQ ID NO: 311150 - RNA, 62 nt, Human
gugaaagcagccagcucaucccagugacucacaggacacagccauccagcggcaucuuuccu

SEQ ID NO: 311151 - RNA, 62 nt, Human
cuuagguggaaggcacacagagaggccacgugaggacacagugagaagguggccgucugcaa

SEQ ID NO: 311152 - RNA, 62 nt, Human
ccuucugaccugggcuggcacugcugggggugaggacacauugccccaugagacagucccag

SEQ ID NO: 311153 - RNA, 62 nt, Human
auggugcaaguguugggggggagaauggggaaaggacacacacaggauaugggagccagggg

SEQ ID NO: 311154 - RNA, 62 nt, Human
auugggaagacuuggggcucuuucugugacugaggacacaggcacccaggauaaggacaagg

SEQ ID NO: 311155 - RNA, 62 nt, Human
cuagcaggcgccagcgguggaggcugagucgcaggacacaugccggccaguuaauucauucu

SEQ ID NO: 311156 - RNA, 62 nt, Human
aagguggccuucaguguccaccuguggaacccaggacacagcaccugacugcacacaguggc

SEQ ID NO: 311157 - RNA, 62 nt, Human
uaccuggggggcaggaugccuggggacaguucaggacacacacacaguaggcccgcaauaaa

SEQ ID NO: 311158 - RNA, 62 nt, Human
gcccagcuuucccugccaggcccuuugcacugaggacacagaucccggggagcugugagggc

SEQ ID NO: 311159 - RNA, 62 nt, Human
gacccaggguccccuccccagcucccuugggaaggacacagcaguauuggacgguuucuagc

SEQ ID NO: 311160 - RNA, 62 nt, Human
gggaccacccuaagggcuggguggcugucucaaggacacauugaauacguugugaccaucca

SEQ ID NO: 311161 - RNA, 62 nt, Human
acucagaugauagugacgaaugucuggcagugaggacacauuuuggcauucuugcugacucu

SEQ ID NO: 311162 - RNA, 62 nt, Human
gcagcuuccuucagagaagacugcagcucccaaggacacaagcuguugggaugcuacuucuc

SEQ ID NO: 311163 - RNA, 62 nt, Human
cuguuacaaauagaaaacgauuccagucauacaggacacaucccacuccaaaugauauuucc

SEQ ID NO: 311164 - RNA, 62 nt, Human
uuuucagcacauccuagaagcagcggauggugaggacacagcuaugaucagggaauuuugga

SEQ ID NO: 311165 - RNA, 62 nt, Human
uuagccggaagucaguccuccucauucaccagaggacacacaggggagacgccccagucugc

SEQ ID NO: 311166 - RNA, 62 nt, Human
uuagccggaagucagaccuccucagucaccagaggacacacacaggggagaagccuuauguc

SEQ ID NO: 311167 - RNA, 62 nt, Human
ucagugauaagucagauguuauuacacaccaaaggacacacacaggggggaagcccuacguc

SEQ ID NO: 311168 - RNA, 62 nt, Human
aaaggggagagggaaguuuccagaaagaagagaggacacaucucccaccauuaccagagggu

SEQ ID NO: 311169 - RNA, 62 nt, Human
aaugguguuuugucagacuuccaaauccuggaaggacacagugaugaauguacuaugucuga

SEQ ID NO: 311170 - RNA, 62 nt, Human
ucacacaacugagucaucucaaguacucuuuaaggacacacagcccaggcuguucugaguca

SEQ ID NO: 311171 - RNA, 62 nt, Human
gggcaggugcccggggcugggugaguggaauuaggacacacacaggcuugggcuucaaguuc

SEQ ID NO: 311172 - RNA, 62 nt, Human
aauucgaaaacaaccguccugcugucccugucaggacacauggauuuuggcagggcgggggg

SEQ ID NO: 311173 - RNA, 62 nt, Human
aaaguggggguugcuaccauuucuagagagagaggacacagucccggccugggcugcccccg

SEQ ID NO: 311174 - RNA, 62 nt, Human
gaugcucugacagaugccaugguaugggccacaggacacacuugcucgagaaccaaagugca

SEQ ID NO: 311175 - RNA, 62 nt, Human
uccuguggagcccuagagcagguuacuaaggaaggacacauuguuuuccagaagccuccccu

SEQ ID NO: 311176 - RNA, 62 nt, Human
acuauuuuuuaaaaaaagccauuucccacccaaggacacaguggauguguuuucccugacuc

SEQ ID NO: 311177 - RNA, 62 nt, Human
agcagccucaaggaccaagaaccaucugcgaaaggacacacacaggaaauucauaaaagaaa

SEQ ID NO: 311178 - RNA, 62 nt, Human
aauugcuccccuuuuuauauauagacacacacaggacacauauauuaaacagauuguuucau

SEQ ID NO: 311179 - RNA, 62 nt, Human
ggcaacuccuggaacagcacaacaaguggcaaaggacacagcuagcaacgggcuggaaaaag

SEQ ID NO: 311180 - RNA, 62 nt, Human
ccaaaguuaugcaagggacuguguguugccacaggacacagucagauuuccagucuccacca

SEQ ID NO: 311181 - RNA, 62 nt, Human
cgucuccaaccucagaggcccuuuguggggucaggacacagagugggagggagacugaugca

SEQ ID NO: 311182 - RNA, 62 nt, Human
aaaagugucuuucaaagaaaaaaaaaucaagaaggacacaagcgaagaaauggcaucaaucu

SEQ ID NO: 311183 - RNA, 62 nt, Human
caguuguagaccauucuucugugcugacuauuaggacacauggagugggauugaugucauuc

SEQ ID NO: 311184 - RNA, 62 nt, Human
aaacuuaagcccaggagugauuugugcagccaaggacacacagcaaguuaguggcugcacca

SEQ ID NO: 311185 - RNA, 62 nt, Human
gagcugggcaggccugcaggguguggggaaggaggacacaaccucaagaaaggaagcgugaa

SEQ ID NO: 311186 - RNA, 62 nt, Human
ccaggaucuguucccuauuucagugccuuccuaggacacaggggacuccuugacgcucccca

SEQ ID NO: 311187 - RNA, 62 nt, Human
uuaaauggaauuuauucuaucaacugccugagaggacacaaugggggaggggcuucggacca

SEQ ID NO: 311188 - RNA, 62 nt, Human
gccgcagacccauagccgccugcaaggcagagaggacacaggagagccagcccugagugccg

SEQ ID NO: 311189 - RNA, 62 nt, Human
cucccuccccagcucgagaucauucuucacucaggacacaaaccagacagguuuaauagcga

SEQ ID NO: 311190 - RNA, 62 nt, Human
agaaaaaccaaucaauguuuacaaaauggaaaaggacacagcauguccuuugaacucccuaa

SEQ ID NO: 311191 - RNA, 62 nt, Human
ugaggcuuacgauguuuuguagucuuggcguaaggacacagcccaaguaacugacguuuccc

SEQ ID NO: 311192 - RNA, 62 nt, Human
gccucugacaaauaaacaagccaugaguggugaggacacagucuccuuacaguuuccauugc

SEQ ID NO: 311193 - RNA, 62 nt, Human
uccugaccagcauuuguaacacugcucuaacuaggacacagcaugcagcagccacacucaca

SEQ ID NO: 311194 - RNA, 62 nt, Human
aagggaagauggauguaaagugugggagaccgaggacacaguggagcccacgagcacgagcu

SEQ ID NO: 311195 - RNA, 62 nt, Human
aauaauuuaggaagauauuaaaaguagaugagaggacacaagauguagucgauccuuaugcg

SEQ ID NO: 311196 - RNA, 62 nt, Human
ggagccgcccuccauuguggguuccugagaguaggacacauugccaugguuuugugggaauc

SEQ ID NO: 311197 - RNA, 62 nt, Human
ggcgaccuccugccugccaggagcccccuuucaggacacagcgggggucucacacuugcugu

SEQ ID NO: 311198 - RNA, 62 nt, Human
gcaacuuacuucuggaguucucucccaaggagaggacacagacacaguuguuugcuguguua

SEQ ID NO: 311199 - RNA, 62 nt, Human
ucagaucugucaaaaaucuucgauuucauaaaaggacacacacuggagagaaacccugugaa

SEQ ID NO: 311200 - RNA, 62 nt, Human
ucagaucugucaagaaccuuucaauuuaugaaaggacacacacuggagagaaacccuaugaa

SEQ ID NO: 311201 - RNA, 62 nt, Human
ucagaucugccucacaccuucaaauucaugaaaggacacaaacacacauaagaauacacucu

SEQ ID NO: 311202 - RNA, 62 nt, Human
ucagaucugccaagaaccuucgaauucaugaaaggacacaaacacacguaagaaugcacucu

SEQ ID NO: 311203 - RNA, 62 nt, Human
cgacucugucuccaaaaaaaagagaagaggagaggacacagagacacacagagaagaaagcc

SEQ ID NO: 311204 - RNA, 62 nt, Human
aaaaacaauggaaggcagacagcaagucccugaggacacaucacacaguguccuguagcuaa

SEQ ID NO: 311205 - RNA, 62 nt, Human
ugaaggaugagagauguuuugaaaaacuagccaggacacacccacaggauccuacuggcucc

SEQ ID NO: 311206 - RNA, 62 nt, Human
uuagccaggagucauacuucaucagacaccagaggacacacacagugcuguggcuuuuucag

SEQ ID NO: 311207 - RNA, 62 nt, Human
ucuaucaaagucccucauucaugaggguggugaggacacagacugcgaccagaacagaaaua

SEQ ID NO: 311208 - RNA, 62 nt, Human
ugucucugaagacuucucgcucaguuucagugaggacacacacaaagacgugggugaccaug

SEQ ID NO: 311209 - RNA, 62 nt, Human
ccaggacuguggaguccgacaaagcuacuugaaggacacaagagagaaaagcucacuaagaa

SEQ ID NO: 311210 - RNA, 62 nt, Human
ccaaccccuggccaccuugggacuccucuugaaggacacaagcuguuucucggaagacccug

SEQ ID NO: 311211 - RNA, 62 nt, Human
ucaaugaucgcucaacccuuaguaaacacgagaggacacacacuggaggcaaacccuaugaa

SEQ ID NO: 311212 - RNA, 62 nt, Human
agaagccggacccauccccgagguccccagcgaggacacacacuccacgagagcagccccuc

SEQ ID NO: 311213 - RNA, 62 nt, Human
uggguuucggggcuugguuugggguuuuuuguaggacacaaggaauccgagaccccgcacag

SEQ ID NO: 311214 - RNA, 62 nt, Human
gaacaagccacagaaacgggcucgcucgugccaggacacagcagugucuuucaaaaaaucaa

SEQ ID NO: 311215 - RNA, 62 nt, Human
acgggcugcaugcugggcgggcccuccagagaaggacacaaacguguuucguaagcccaggc

SEQ ID NO: 311216 - RNA, 62 nt, Human
aguaguuuagcuggggccucacucagauaccuaggacacagaguuggaaauaacucuuaaga

SEQ ID NO: 311217 - RNA, 62 nt, Human
cacucguuucaaacccacaaaauuucucacacaggacacaaaccauaugauuguaaggaaug

SEQ ID NO: 311218 - RNA, 62 nt, Human
cuggggcaggggcguuuaauugaugaugacagaggacacagguuuuugccagcaaaaaggaa

SEQ ID NO: 311219 - RNA, 62 nt, Human
gcauuuucuuacuguugauguuuccugcccaaaggacacauuugggcagugccacccacucc

SEQ ID NO: 311220 - RNA, 62 nt, Human
gguagaaccacuuggcugcucauuccuucuggaggacacacagucucaguccagaugccuuc

SEQ ID NO: 311221 - RNA, 62 nt, Human
acugagccucaauuuccucaucugggucucccaggacacaucacauacccacccuuacuucc

SEQ ID NO: 311222 - RNA, 62 nt, Human
uuaaauuuaaaccauugagacuucagaagagcaggacacaaugcuguggacaggcaccaauu

SEQ ID NO: 311223 - RNA, 62 nt, Human
gaaucuggggguuucuucuggaacggggcgugaggacacaaggaggccucugggccacgccu

SEQ ID NO: 311224 - RNA, 62 nt, Human
uguggugguuucugugagaauuggccauccugaggacacagccaggacggcagaggccuccu

SEQ ID NO: 311225 - RNA, 62 nt, Human
cugaguccccucagcuaucaguguucuucucaaggacacauuuggaagguuuuaacauugaa

SEQ ID NO: 311226 - RNA, 62 nt, Human
cagugcuggguuagaaaugucugucuggaaacaggacacaucuugccaccacaaguccacac

SEQ ID NO: 311227 - RNA, 62 nt, Human
cccuaggucagcgugcagagcagugaugcuggaggacacaccauggggugaagccaucccaa

SEQ ID NO: 311228 - RNA, 62 nt, Human
caacugcucagcucugguccaggcccuguggcaggacacacauggugagccuagcccuggga

SEQ ID NO: 311229 - RNA, 62 nt, Human
gcuuccuggagcaguaaaugaagacagaguggaggacacaaauguacaaaaugcacaagacu

SEQ ID NO: 311230 - RNA, 62 nt, Human
cauggagaaggguucugcccugccugaggaggaggacacagcacaagggcacauugcccaug

SEQ ID NO: 311231 - RNA, 62 nt, Human
gccagggaaaggaagagcuccccugaaucccgaggacacaguccccugcguacuugcucaug

SEQ ID NO: 311232 - RNA, 62 nt, Human
ugaccacacuuaccugcaagaggaguaaccagaggacacacuuccuuccuucuuuggugucu

SEQ ID NO: 311233 - RNA, 62 nt, Human
uaaaagaaaaauuaccuucuaguccuaggaugaggacacacuauuaguuugaauuaaaugcu

SEQ ID NO: 311234 - RNA, 62 nt, Human
gcaauaaguuaaaccucaucuuguacuaaaggaggacacacucagggagaagaccucugugg

SEQ ID NO: 311235 - RNA, 62 nt, Human
guagccaucagucagccuugagcaugcacaaaaggacacacuuaggagagaaguuuaugugu

SEQ ID NO: 311236 - RNA, 62 nt, Human
ugccaggcugucauuccugucgaugaccugaaaggacacaaacuggaauuuucaggucuguc

SEQ ID NO: 311237 - RNA, 62 nt, Human
guaguucgucuuuaguuacuaagaaaggguguaggacacauuagccuucuggaaacaaguag

SEQ ID NO: 311238 - RNA, 62 nt, Human
uguccuguggcccuucuauuuucugcucugugaggacacaaugcuccucccuuccaaaagau

SEQ ID NO: 311239 - RNA, 62 nt, Human
ucaucuugaaguuauaucucaccauccaucagaggacacacucaggagaguaacuuugcuuu

SEQ ID NO: 311240 - RNA, 62 nt, Human
ucuguuagggcaaccaccaccaccugucuuccaggacacauuuuuagauacucugacaggcc

SEQ ID NO: 311241 - RNA, 62 nt, Human
cugggccgcggccucuggagcugggauuugggaggacacagcaggcagcgcuggccuucucc

SEQ ID NO: 311242 - RNA, 62 nt, Human
gcuugaaaucuugcuguacuauagagcucagaaggacacagcccguccuccccugccugccu

SEQ ID NO: 311243 - RNA, 62 nt, Human
aguagauuucagauaauuuacuguucagcaacaggacacaccucccuaaaugccuuguaaua

SEQ ID NO: 311244 - RNA, 62 nt, Human
ugauggguguuaccauccuaauuuuacaggcaaggacacagcagcugcgagagguacagaaa

SEQ ID NO: 311245 - RNA, 62 nt, Human
caucacuaaacagaguaaaaucuuggaaagccaggacacaacgcugcugccugcuuugugca

SEQ ID NO: 311246 - RNA, 62 nt, Human
ucaguguuauaccaaacccaguguuaggagaaaggacacagcguaauggagaaaggggaagu

SEQ ID NO: 311247 - RNA, 62 nt, Human
ugcagggauggcccgcagccucaucggggccaaggacacacgccuccugucagacacuucua

SEQ ID NO: 311248 - RNA, 62 nt, Human
ggcagaggcugagccgggaggcccuugaggugaggacacagcaggcccaggaccauggcugg

SEQ ID NO: 311249 - RNA, 62 nt, Human
accaagcugggccugcagaggaggggcacaguaggacacagugacugcccagguguccacac

SEQ ID NO: 311250 - RNA, 62 nt, Human
agugucuccagcagaagagauggaugaauggaaggacacacagauggacagagagcaggaaa

SEQ ID NO: 311251 - RNA, 62 nt, Human
cuagcacccagaaacagggaggguccucgaggaggacacaccagggucucagccuuuugggg

SEQ ID NO: 311252 - RNA, 62 nt, Human
aaccugguucuuuggacugcaguacacaaucaaggacacaguggccuggcucaaaauggaca

SEQ ID NO: 311253 - RNA, 62 nt, Human
ucuucccuuugcccuucuccuccaauacauaaaggacacagacaaggaacuugcugaaaggc

SEQ ID NO: 311254 - RNA, 62 nt, Human
acccacauggggacauaagcuaauuuuuuuacaggacacagaauucuguucaaugcuguuaa

SEQ ID NO: 311255 - RNA, 62 nt, Human
cagcuccuuggugguuucaucuccucugugggaggacacaucucugcagccucaagaguuag

SEQ ID NO: 311256 - RNA, 62 nt, Human
uggagccuccugggacaagccucaggaugaaaaggacacagaaggccagaugagaaaggucu

SEQ ID NO: 311257 - RNA, 58 nt, Human
gccgggggaagacccacugaagcugggcaggacacaggcgagcucaggugaugccggc

SEQ ID NO: 311258 - RNA, 62 nt, Human
cagaacccucaagacaaggaugacagagcuggaggacacaucuagcugccauugcaaccuca

SEQ ID NO: 311259 - RNA, 62 nt, Human
cuccucccacccccucccccugggggcaaaucaggacacaacagagggcagaggccccauua

SEQ ID NO: 311260 - RNA, 62 nt, Human
gaguaacaucuguucccaucuuccuuggaagcaggacacaccagcuccuccgucagugucug

SEQ ID NO: 311261 - RNA, 62 nt, Human
augaccagcauuaugaaaaugcgagagugggaaggacacagugugagacuuccacuagaaaa

SEQ ID NO: 311262 - RNA, 62 nt, Human
cgccuccagcagccuggaacccacgccuccugaggacacagccaucagcagcuugcgcccuc

SEQ ID NO: 311263 - RNA, 62 nt, Human
uccacaagaggauuuaagggaggaauguuuauaggacacacacacaaaagcucuuucuauuu

SEQ ID NO: 311264 - RNA, 62 nt, Human
ugggugcugcaguugcuuuugucugcagcagcaggacacaucuuuccucuuacucagcccuu

SEQ ID NO: 311265 - RNA, 62 nt, Human
ucucuuucuucucucugggaaaaugaacguccaggacacaccuguaucccagagagcaaagu

SEQ ID NO: 311266 - RNA, 62 nt, Human
aggcccucucugcaguccucggcagcuccggaaggacacagucaggggccgggcaaacacuu

SEQ ID NO: 311267 - RNA, 62 nt, Human
gaggauguucaacaccacucggaucccgggcaaggacacagaugugcuacagcaccucucag

SEQ ID NO: 311268 - RNA, 62 nt, Human
ugugaagcacagaugagcucuuucacacuccaaggacacagcucauccuaugcuuuuggaca

SEQ ID NO: 311269 - RNA, 62 nt, Human
agaucagcagaauccagacuauaagaaacuacaggacacaugaccuaguuucuucuguaaau

SEQ ID NO: 311270 - RNA, 62 nt, Human
gaaacuacuaaucucaauuuaagauacaaauaaggacacaaacuuucaaguauuauauuuua

SEQ ID NO: 311271 - RNA, 62 nt, Human
ucugguagcaccugaauucuuuuucuucaauuaggacacagccagauggacaucuaagacag

SEQ ID NO: 311272 - RNA, 62 nt, Human
cugagcuucagacagggggugggcuuugccuaaggacacacaaauuugguugggaguugaug

SEQ ID NO: 311273 - RNA, 62 nt, Human
ggggggggguggggggacuuaucccuggccuuaggacacaggacaaaucuauuuuggauaga

SEQ ID NO: 311274 - RNA, 62 nt, Human
uggcuccaagccuugccauagggcugccuccaaggacacagaaggaugccaguugccacagg

SEQ ID NO: 311275 - RNA, 62 nt, Human
guuaagauuuuuacaaauuauaauaauaggacaggacacagagcuggaauauuggaguuugg

SEQ ID NO: 311276 - RNA, 62 nt, Human
gugugaacccaggugucccggaaaggggcugcaggacacagcaaaaugccagcagcgugccg

SEQ ID NO: 311277 - RNA, 61 nt, Human
uccuuuuuugcaugugcaaaugugcuggucacccuucaacgcucccagacggucaggaaaa

SEQ ID NO: 311278 - RNA, 61 nt, Human
auagauauuguuccaccaucccccuccuuggcccuucaagugggcugaagcccuuggaaag

SEQ ID NO: 311279 - RNA, 61 nt, Human
cccccagugaugucuagcugagucuucaugacccuucaacccugauuacuacagaauucca

SEQ ID NO: 311280 - RNA, 61 nt, Human
uucuuuuaaacagggaugauucuucaagagacccuucaaacuuggguagaguuuacagcuc

SEQ ID NO: 311281 - RNA, 61 nt, Human
ccaggaggccgccuucacccucauuggccugcccuucaacaauggccucaugggccggggg

SEQ ID NO: 311282 - RNA, 61 nt, Human
ccggaauuaaugcauccuaaugaauguuguccccuucaaugguguuaccuuaggagcugaa

SEQ ID NO: 311283 - RNA, 61 nt, Human
gugccaaucucuccucaggacugagucaacccccuucaaccuccucaccucucuaaacacc

SEQ ID NO: 311284 - RNA, 51 nt, Human
aaagaggaacagcugucuaaucccuucaagaacuguuuauagaagcuugag

SEQ ID NO: 311285 - RNA, 64 nt, Human
augaggugggauggccccaucuggauguucugcagauccccacaugggaggagauucccaagua

SEQ ID NO: 311286 - RNA, 64 nt, Human
ucucaacagaugggaaguggcuguggucucacuggauccccacuggcaccagcagugugggugg

SEQ ID NO: 311287 - RNA, 61 nt, Human
uucuuuuuuaacagcuuguauagucuuggggcccuucaagcugugaaauuguccuuguacu

SEQ ID NO: 311288 - RNA, 61 nt, Human
uuaaggguuaccccacccugcccacucccaucccuucaaccccacuuccuacuguaauaga

SEQ ID NO: 311289 - RNA, 61 nt, Human
agguggcagggcuguucccuccaggcaaaugcccuucaaaccgacgaucauugugcccacu

SEQ ID NO: 311290 - RNA, 61 nt, Human
cauaggaacuaucugccuguguccucaaucucccuucaaacaagaugcugauuuguagggu

SEQ ID NO: 311291 - RNA, 61 nt, Human
gcaaauaaaccauccuauuuuguaacucucccccuucaaaaugcuacaugagccuugccac

SEQ ID NO: 311292 - RNA, 61 nt, Human
gcucauuguuuucgucucccacuuaucuucccccuucaaagugauuuucuuuauaagaaaa

SEQ ID NO: 311293 - RNA, 61 nt, Human
uaauagaaaagcagagaaauaaauuucccuccccuucaagaugcaccucauguuuguuuua

SEQ ID NO: 311294 - RNA, 61 nt, Human
ggaaauaacaguuauuucaucauaaaacagucccuucaaacacacaauuguucugcugaag

SEQ ID NO: 311295 - RNA, 61 nt, Human
ugggcaaaaggaauugucagcccuaccccaacccuucaacuaccagaaucugggccacccc

SEQ ID NO: 311296 - RNA, 61 nt, Human
aagggguagaguuucucauuuggaugaaaaccccuucaacuggugguguacaacugaagcu

SEQ ID NO: 311297 - RNA, 61 nt, Human
gcaagagaaaggaugauucgaggcaccuuggcccuucaaggucaugcagugggucgagcgc

SEQ ID NO: 311298 - RNA, 61 nt, Human
guuuuggguuuuguccuucaucuuucccuuucccuucaaaucuuuuaaugguaagaaagca

SEQ ID NO: 311299 - RNA, 61 nt, Human
uuuucuucaacaaauuuugggggcaggagaucccuucaagaggcugcaccuuaauuuuucu

SEQ ID NO: 311300 - RNA, 61 nt, Human
cauguucccuugaguauuucaauguagaaagcccuucaagugguauuauauuuuaaccuuu

SEQ ID NO: 311301 - RNA, 61 nt, Human
cccagccuccaaacauaguuaauagaaauuucccuucaaagaacugucuggggaugugaug

SEQ ID NO: 311302 - RNA, 61 nt, Human
cauagucaccaucaaagacucaacccuaaggcccuucaagaucucaaagugccuucugaag

SEQ ID NO: 311303 - RNA, 64 nt, Human
ggcaucaccugucaaaaauggaguuccacuucuccccgcagaccuaggucagacuuuuccuuuc

SEQ ID NO: 311304 - RNA, 64 nt, Human
ggagaggcaguacgcauccuuacccaggggaggacccgcagauccuguagacuaucugccagca

SEQ ID NO: 311305 - RNA, 64 nt, Human
accgauuuguacuaagcugugccugccuuguugugauccccauagaaacauaauaaauauacaa

SEQ ID NO: 311306 - RNA, 61 nt, Human
gaaacaaggaauuucugggauuacccagucccccuucaacccaguugauguaaccaccuca

SEQ ID NO: 311307 - RNA, 61 nt, Human
ggcuaaaaggucuugcaguggcuuuucauggcccuucaaauuggaauggaacuacuguacu

SEQ ID NO: 311308 - RNA, 61 nt, Human
cuaccaucuuuuauucuuaauaauuauuaaucccuucaaugaaacuuuaaaaaaacugaau

SEQ ID NO: 311309 - RNA, 61 nt, Human
cgucugcccgcuggugggggaccugagcagacccuucaacugcacucccuccucaggagcc

SEQ ID NO: 311310 - RNA, 61 nt, Human
gcucuaacuuuucuuaagguuuuguugcuagcccuucaagugcacugagcuaugugacucg

SEQ ID NO: 311311 - RNA, 61 nt, Human
uaugagugauacccauuugagggccucuaaacccuucaauuugguacucacgugaagaggg

SEQ ID NO: 311312 - RNA, 61 nt, Human
agcacagaagugcuaugggccagaagccccucccuucaaggaucucaccuucacaggugag

SEQ ID NO: 311313 - RNA, 61 nt, Human
gggguggguggagcccuuuuaaaauacccuucccuucaacaacucuccagcucugaaugga

SEQ ID NO: 311314 - RNA, 61 nt, Human
cuuuucauuuuuugguugauuuuuuugccuucccuucaauuuuaaacugaagcauuuuaau

SEQ ID NO: 311315 - RNA, 61 nt, Human
acucagauuguucaaauguauauagaagguccccuucaaguguuguuucuccaaguaguca

SEQ ID NO: 311316 - RNA, 61 nt, Human
gaauuaggacaguccucaucucauugcuuggcccuucaagcaaccuagcuaaaaggugcug

SEQ ID NO: 311317 - RNA, 61 nt, Human
aaaaaccacacagccuggaaauuggcccuggcccuucaagauagccuucuuuagaauauga

SEQ ID NO: 311318 - RNA, 61 nt, Human
aaauggacaguucuuuguggacucuacccuucccuucaaggaguaugucauauaucacaaa

SEQ ID NO: 311319 - RNA, 61 nt, Human
aaugcauauggauaaaguugcacuuauaacacccuucaacaaaaucuaauuuuaaauuguc

SEQ ID NO: 311320 - RNA, 61 nt, Human
ccauggggccugccugugagaaacagugggucccuucaaauacauaguggauagcucaucc

SEQ ID NO: 311321 - RNA, 61 nt, Human
uguuuaauuuagaguuuugaagaaauagucucccuucaauuaagaaauuuucauaauggaa

SEQ ID NO: 311322 - RNA, 64 nt, Human
cuguuauaagaauuaggauuccagauuguaaaaagauccccaaaugauucuggacacuagauuu

SEQ ID NO: 311323 - RNA, 64 nt, Human
uaaaagugguucugugugauugucauuuauaucugauccccaaauagcucauacaauaauccau

SEQ ID NO: 311324 - RNA, 64 nt, Human
ugaaaggaagugcagaggauuuagaaaaguacaugauccccagaccacaacaaaccaaaacaua

SEQ ID NO: 311325 - RNA, 61 nt, Human
gucucugucuuugaauaucugaauguucuggcccuucaacaaauucuuuaaaucaugcuaa

SEQ ID NO: 311326 - RNA, 61 nt, Human
guaaugaauauuuaaugggacauuaaauaugcccuucaaaucuauaauuuuacuuugguaa

SEQ ID NO: 311327 - RNA, 61 nt, Human
ugaucugucaugccccaccgccaccccuacucccuucaacccucccucuuucugcccauuu

SEQ ID NO: 311328 - RNA, 61 nt, Human
caaagugcacaaagcugaguaaaaagcugcccccuucaaacagaacuagacucaguuuuca

SEQ ID NO: 311329 - RNA, 61 nt, Human
uaccccagcuuguuugcaauuuauaaaccuccccuucaaaacuaaggaguugcagaaaaaa

SEQ ID NO: 311330 - RNA, 61 nt, Human
uuccuguaauaccacugagugacaguccccccccuucaagauggaagccuggacagaaacc

SEQ ID NO: 311331 - RNA, 61 nt, Human
ccuccuuagacacugacagcauucucuguaccccuucaaauccuuacucuccuaaaggcag

SEQ ID NO: 311332 - RNA, 61 nt, Human
gccaggagugcggcaggcaguaccugccugacccuucaaggccugaccuucguccagagug

SEQ ID NO: 311333 - RNA, 61 nt, Human
uuagguauauacuguaauuugauuuuuugcucccuucaaagauuucuguagaaauaacuua

SEQ ID NO: 311334 - RNA, 61 nt, Human
gcaaaaguggcacagaguuagcacuccauaccccuucaaacauguugcuuugcuuucuugu

SEQ ID NO: 311335 - RNA, 61 nt, Human
gggagccucauaaagauggcuuuuguuucuucccuucaaggucauuuacuuguacgagaca

SEQ ID NO: 311336 - RNA, 61 nt, Human
guuagugccacuaccuucuucccuccuuucccccuucaauuuggaaauaaauuucuguaua

SEQ ID NO: 311337 - RNA, 61 nt, Human
cagcccuaguagggaccagugaccaucacaucccuucaagaguccugaagaucaagccagu

SEQ ID NO: 311338 - RNA, 61 nt, Human
guucuguauuuauuuauuggggagacacuaacccuucaaagaagcaggcugugaacauugg

SEQ ID NO: 311339 - RNA, 61 nt, Human
ugugcuuucuuagucuuugcaggcaccucuucccuucaauaucuguucuucguauuuuuaa

SEQ ID NO: 311340 - RNA, 58 nt, Human
cacuucuggcccagcaguaggaaaaccacccuucaaccugggugaugcuccuuggggc

SEQ ID NO: 311341 - RNA, 64 nt, Human
cccugcauugcagguuggcaccuuacuucccugggauccccagaguugguccaaggagggagag

SEQ ID NO: 311342 - RNA, 64 nt, Human
cagguggccaggugggacuguuucaaauuucccugauccccaggcuuggggcaauugguaaagg

SEQ ID NO: 311343 - RNA, 64 nt, Human
ugaaggcagacuccuccucccagcagagcagcaggauccccagccagacucuguacccacagga

SEQ ID NO: 311344 - RNA, 61 nt, Human
guuuucaauggcugauaguuuuguuuucucacccuucaauauuucuagaaaacauccuugc

SEQ ID NO: 311345 - RNA, 61 nt, Human
ucauucuuggggguugccauucccacauucccccuucaacaaacaguguaacagguccuuc

SEQ ID NO: 311346 - RNA, 61 nt, Human
ggacccuguaaauacauccuuuuucugcuaacccuucaacccccucgccuccuacucugag

SEQ ID NO: 311347 - RNA, 61 nt, Human
uaugaaaagguccugaugcccaaccucccaccccuucaauguggggacgagacccccucau

SEQ ID NO: 311348 - RNA, 61 nt, Human
ggaggguuacacuugugauuuauuagucaggcccuucaaagaugauauguggaggaauuaa

SEQ ID NO: 311349 - RNA, 61 nt, Human
ugacaaugguacuggcauacacagggagccucccuucaaaaagacagcgccccuagucagg

SEQ ID NO: 311350 - RNA, 61 nt, Human
uggagccauuggccuccuuuucuucagcgggcccuucaaccucucugcaccauguugucug

SEQ ID NO: 311351 - RNA, 61 nt, Human
ugugggagggacuuugcugauuuccccucuucccuucaacaugaaaauauauaccccccca

SEQ ID NO: 311352 - RNA, 61 nt, Human
ugaaagcagaaagcaguagugacacagcuuucccuucaaagagccauugagaaacauuucu

SEQ ID NO: 311353 - RNA, 61 nt, Human
acuaaucccucuccucucugauuccuuucuucccuucaauuuaucuuuuucccuguuacac

SEQ ID NO: 311354 - RNA, 61 nt, Human
guuguaauaggagaguucaaacguacagucucccuucaaccuaucucugucugcccauauc

SEQ ID NO: 311355 - RNA, 61 nt, Human
acucaguuacuccagagaaaaaacugccuuucccuucaaagugcucccucgagguuccuua

SEQ ID NO: 311356 - RNA, 61 nt, Human
aaacuguuuacucacauuguccuacuccagccccuucaauuauuucccaucuccacaaaua

SEQ ID NO: 311357 - RNA, 61 nt, Human
uaguaguugauauuaaguugaugacuuguuucccuucaaggaaacauuaaauuguauggac

SEQ ID NO: 311358 - RNA, 61 nt, Human
guagcaugauggcuguagcuguuucaugggccccuucaaaccucauagcaaccagaggaag

SEQ ID NO: 311359 - RNA, 61 nt, Human
cccaacuacuauuguagaguggucuauuucucccuucaauccugucaauguuugcuuuacg

SEQ ID NO: 311360 - RNA, 64 nt, Human
ccuccacuccaccuccacccacuguccgccucugcccgcagagcccacgcccgacuagcaggca

SEQ ID NO: 311361 - RNA, 64 nt, Human
ggugugaggggcuuggccugcgccccgccagcugcccgcagaggugcagccucgaggaaucuga

SEQ ID NO: 311362 - RNA, 64 nt, Human
ugggagagaaggggaaauggacccugacccccuugauccccaaagaagcugcgccccaccuuuc

SEQ ID NO: 311363 - RNA, 61 nt, Human
cucuauucaaaaucauauuccacagauguuccccuucaaagggaaaacauuugggguucua

SEQ ID NO: 311364 - RNA, 61 nt, Human
uauugacuuguccaaauuucaaaagugccuacccuucaauaaaacuuuuuuauucugaucu

SEQ ID NO: 311365 - RNA, 61 nt, Human
aucaucuccaucauaugccugaccccuugcucccuucaaugcuagaaaaucgaguuggcaa

SEQ ID NO: 311366 - RNA, 61 nt, Human
cuuuguucccaacucuuuuacaucucccuaccccuucaaccuuuggccuuucagcccuucu

SEQ ID NO: 311367 - RNA, 61 nt, Human
ccuggagagacauggccccugccaagcuggucccuucaaauggauccuuuguggacuuuag

SEQ ID NO: 311368 - RNA, 61 nt, Human
aucuaaucaacuuaagggaagccggcauguacccuucaaggcccugucaccaccuauuucc

SEQ ID NO: 311369 - RNA, 61 nt, Human
cccugaguaauccaccccagcuaaaggcaaacccuucaaucaaguuuauacagcaaacccu

SEQ ID NO: 311370 - RNA, 61 nt, Human
guaauauuuauuaaagaugaagauccacauacccuucaacugagcaguuucacuaguggaa

SEQ ID NO: 311371 - RNA, 61 nt, Human
gagucuuccauuuuguuggaauuagauccuccccuucaaaugcuguaauuaacaacacuua

SEQ ID NO: 311372 - RNA, 61 nt, Human
acagcaggacacugagggaauauuucccuaucccuucaaauggacggucacuacagaaacg

SEQ ID NO: 311373 - RNA, 61 nt, Human
ucaguguuggcucugcagaagcucugggguucccuucaagugcacgagggguuaggcugcu

SEQ ID NO: 311374 - RNA, 61 nt, Human
uuucccaugaacuugugauaucauuuugaaacccuucaaucuggcuuuguugcugccaaag

SEQ ID NO: 311375 - RNA, 61 nt, Human
gaaucccucacccucucugggccucaguuuccccuucaaaaaaugaauaagucggacuuau

SEQ ID NO: 311376 - RNA, 61 nt, Human
ggugcgaauccugacccaaggccuccugucucccuucaaagggagacccuuuugggggaug

SEQ ID NO: 311377 - RNA, 61 nt, Human
accuaauguauauucuccuugagccccagaucccuucaagcuggaagggauggggcuguug

SEQ ID NO: 311378 - RNA, 61 nt, Human
aaacucuccgccuuugaaacuuucuaccccucccuucaaucuuauccuaaccaaaugagaa

SEQ ID NO: 311379 - RNA, 64 nt, Human
ugagaaguacagagugagacuuaaagaaccccuagauccccaccaguucaacacuccauuaacu

SEQ ID NO: 311380 - RNA, 64 nt, Human
acaacugcacacuugugagcugucauggaaaccugauccccaacagcuuuugagguuguuuguu

SEQ ID NO: 311381 - RNA, 64 nt, Human
cucagcuguuuggccaaugugcauaaccuacucggauccccaccugacacuaaccagagucagc

SEQ ID NO: 311382 - RNA, 61 nt, Human
uuuuggugcuguuggcuacuuuaucaaaaaacccuucaauagcauccuuaagauuuaaaaa

SEQ ID NO: 311383 - RNA, 61 nt, Human
ugugcgcuuugcauuucauugauugacgccucccuucaacaagcauuuacugagcgccuac

SEQ ID NO: 311384 - RNA, 61 nt, Human
agauaguucugcaaauucaaagauacaguaucccuucaaaacaaauaggaguucagggaag

SEQ ID NO: 311385 - RNA, 61 nt, Human
caccaagcaucguuuccucagauuaaugagacccuucaacaagccugaaucagucacuuuu

SEQ ID NO: 311386 - RNA, 61 nt, Human
cucacauuaaauuauuuuaaaauaagcagugcccuucaaaacagaugcagacauguguguu

SEQ ID NO: 311387 - RNA, 61 nt, Human
aaacuacuccaguggcugacugaauugcugacccuucaagcucuguccuuauccauuaccu

SEQ ID NO: 311388 - RNA, 61 nt, Human
aucaaaagacuuuuauuauuagauugggacccccuucaaaccuaaaaaucaaguuauuucc

SEQ ID NO: 311389 - RNA, 61 nt, Human
gcagagaucacacacugacccuccgcccuuccccuucaagcauuuuccucuucccuuuuca

SEQ ID NO: 311390 - RNA, 61 nt, Human
ucaccuuugauccccucacuccucugugacccccuucaagucuuccuucaccacuccagug

SEQ ID NO: 311391 - RNA, 61 nt, Human
uuugccuucuucugccaccuaaauauuacuucccuucaaaucugccuuugaaucaucauuu

SEQ ID NO: 311392 - RNA, 61 nt, Human
agaaggggagcagagugauuucuugcuuccucccuucaaagcacuaccacaccuagacugg

SEQ ID NO: 311393 - RNA, 61 nt, Human
uuuugaaagcaaaaaauauauauuugauauacccuucaauugccaaauuugauauguugca

SEQ ID NO: 311394 - RNA, 61 nt, Human
agacucagcuuaucugaucaaggugaacuugcccuucaauagacuugcccuuguuacugcc

SEQ ID NO: 311395 - RNA, 61 nt, Human
uguaguauuuucaguuuguuuauuuuguucacccuucaagacaagaaguaaaagaaguaua

SEQ ID NO: 311396 - RNA, 61 nt, Human
acgcacacgcgcuucuucucccacccccacccccuucaaacuuuauucggaaccuuccuuu

SEQ ID NO: 311397 - RNA, 61 nt, Human
gaguguguugcagacuacagaacauuguucucccuucaagcgcuguaaagcaccaacccgg

SEQ ID NO: 311398 - RNA, 64 nt, Human
cugaaucacccucgcuccgucaggcgggacucgugucccagagaggaaggggcugcugaggucu

SEQ ID NO: 311399 - RNA, 61 nt, Human
ugccauuauuccaagcaaaauaagagauaaucccuucaaguuaaauugaaaauuuuccuga

SEQ ID NO: 311400 - RNA, 61 nt, Human
gcagauacccaaauguuuauuguuuucucagcccuucaauuuugcuuuucucucucaaaug

SEQ ID NO: 311401 - RNA, 61 nt, Human
ugggggcuccagggugacucccaugaggccucccuucaaccaggcuuuuuggccccacaaa

SEQ ID NO: 311402 - RNA, 61 nt, Human
uauuauuucuauaauugagauacucauucuucccuucaaaacccagccucuugcaagaagc

SEQ ID NO: 311403 - RNA, 61 nt, Human
acuggauguugacguauauauaaacagaacucccuucaaaagccaaaacugucuucaguca

SEQ ID NO: 311404 - RNA, 61 nt, Human
gaaaagagaaaaaaaaacacacaaaaagucccccuucaaucucguuuagugccaauguugu

SEQ ID NO: 311405 - RNA, 61 nt, Human
aguucuucugccuccugcuggagaacagagacccuucaagaggugaggguuagauuucauu

SEQ ID NO: 311406 - RNA, 61 nt, Human
gucaggauucaccuuagaaguuuagcacacgcccuucaaaaccuguugaauaauuugauug

SEQ ID NO: 311407 - RNA, 61 nt, Human
cccugguguacggugggaagagauuccucagcccuucaaaucucagaugguaucuuccugc

SEQ ID NO: 311408 - RNA, 61 nt, Human
gucauacugucgguuaaucagagaguagcaucccuucaaucacagccccuuccccuuucug

SEQ ID NO: 311409 - RNA, 61 nt, Human
ucuccgugcguccucccugcacucauacccccccuucaacccgcccaaauguccgaucccc

SEQ ID NO: 311410 - RNA, 61 nt, Human
aagagaaaauaagcucaugagaugacauucacccuucaacauaaaagaacauuggguuaau

SEQ ID NO: 311411 - RNA, 61 nt, Human
agauuuacuguuuggacaaauuuagccccaucccuucaaaaauacacuuguaaccagguuu

SEQ ID NO: 311412 - RNA, 61 nt, Human
caggcuugaaaaacccuugcccaguuuugaucccuucaagacuuugucacagccucuauca

SEQ ID NO: 311413 - RNA, 61 nt, Human
gucucauauaaauauagaauggguccauaaacccuucaacucauuuccauggcaaaacuca

SEQ ID NO: 311414 - RNA, 61 nt, Human
ugugugucacuaucuccguuugcucucgguucccuucaauaacaaugaauggugcuuucuu

SEQ ID NO: 311415 - RNA, 64 nt, Human
uaagggacgauuggaguuucuucccagagagucugucccagaaggacuguggcuuguguguguc

SEQ ID NO: 311416 - RNA, 64 nt, Human
gauggcaggaugggcacugccgagaacagcauuggucccagagcccugggcaucagaccuuaac

SEQ ID NO: 311417 - RNA, 64 nt, Human
uccccaccaauccccgccacagcaggcgccucgggucccagaugucugcagcccucagcagcug

SEQ ID NO: 311418 - RNA, 61 nt, Human
uggcaaucucuuuuauuuguugacucuagcucccuucaaagucgaggaaagaucuuuacuc

SEQ ID NO: 311419 - RNA, 64 nt, Human
agcaagcuaauugagucucuguuauauaccaagcacuggggauaccauggcgaaaaacaacuuu

SEQ ID NO: 311420 - RNA, 64 nt, Human
agagaagaugacaucaaugugggaguucaguauaacuggggauaaacuagaagaaccugugauu

SEQ ID NO: 311421 - RNA, 64 nt, Human
ugggcugggcaguaucccccgccuuuaguucuccacuggggaggaauccuggaccaagcacaaa

SEQ ID NO: 311422 - RNA, 64 nt, Human
gaacagacaagaggugggcuuaauagaggcagagacuggggauauaccuuuguuucccuagcau

SEQ ID NO: 311423 - RNA, 64 nt, Human
acugagucuggaacaauaauacccuaugauuagaacuggggaaacagaacugaauugcuguguu

SEQ ID NO: 311424 - RNA, 64 nt, Human
agauaaugucaaaaucaugaauauuucaaaauaaacuggggaguuauaaaaauacaacuagaga

SEQ ID NO: 311425 - RNA, 64 nt, Human
cggucggccgggugcuuugugucagugcugcagcacuggggagccaggcgaggggggcuugggg

SEQ ID NO: 311426 - RNA, 64 nt, Human
caccuauauagaugcagcauuuuguauuugucuaacuggggauauaauacuauauuuauacugu

SEQ ID NO: 311427 - RNA, 64 nt, Human
guuuauagaauugaagguucuuaucagaugggauacuggggacuauaaacaauggaaauaaagc

SEQ ID NO: 311428 - RNA, 64 nt, Human
aacggagaccaucaagccacacccccuucuuaaaacuggggacaugagccugagcagaaagggu

SEQ ID NO: 311429 - RNA, 64 nt, Human
caguccacagagucgguagaccagggguuacgugacuggggaaaaucucacaucuccuugucug

SEQ ID NO: 311430 - RNA, 64 nt, Human
auauaccucccugcaccguuacgcugugauggcaacuggggauagaaaaaaaauggggaaagac

SEQ ID NO: 311431 - RNA, 64 nt, Human
auccaaucaccucccaccaggcuccaccucgaauacuggggauuaccauucagcaugagauuug

SEQ ID NO: 311432 - RNA, 64 nt, Human
uggggaagcaaggaaauaagucaucuguaugcugacuggggauaauggcaucaaaugucagucc

SEQ ID NO: 311433 - RNA, 64 nt, Human
gcauuugucuccuccaaaccucauguugagauuugauccccaguguuggagguggggccuaaug

SEQ ID NO: 311434 - RNA, 64 nt, Human
cucacucccggaggccucugccugcggcugaccugauccccaagggacuguccuuuccucuccu

SEQ ID NO: 311435 - RNA, 64 nt, Human
gguagccuggguguaaaaccuggagaugguggaugauccccacgccacagcccuuuugucucug

SEQ ID NO: 311436 - RNA, 61 nt, Human
ucuguuccucuucccaucuacuccccuacgccccuucaaccuuuuuucucugucugcuuca

SEQ ID NO: 311437 - RNA, 61 nt, Human
aaggaaaccuuucuuaaagacaggcugaaaccccuucaaaggcagaugaggagguacagac

SEQ ID NO: 311438 - RNA, 61 nt, Human
acuuucccacauuuuccugucuucuucugagcccuucaaacuguuccaaccucugccuguu

SEQ ID NO: 311439 - RNA, 61 nt, Human
cguuuucuacaauagguugggagaugcugaucccuucaaguggggacagcaaaaagacaag

SEQ ID NO: 311440 - RNA, 61 nt, Human
uuguuauuuguaaggacugaaauguacaaaacccuucaaugggauguguguuuuauuaacu

SEQ ID NO: 311441 - RNA, 61 nt, Human
ccaagccuggcccuuaaacaacugcagaaagcccuucaacuucagaaggccucacucaagc

SEQ ID NO: 311442 - RNA, 61 nt, Human
gagcccugccccucucacaguccaaggggcccccuucaauacugaaggggaaaaggacagu

SEQ ID NO: 311443 - RNA, 61 nt, Human
uuucuagggaauauggcucaguagggccugccccuucaagggcagcaagaacgaagcagga

SEQ ID NO: 311444 - RNA, 61 nt, Human
uccccccaauuacaaaaucuaaguauuuuggcccuucaauuuggaggagggcaaaaguugg

SEQ ID NO: 311445 - RNA, 61 nt, Human
ugccuaggagcuggggagggagagaucuaaucccuucaaggaagugauaacacuggagugg

SEQ ID NO: 311446 - RNA, 61 nt, Human
ugcaaaucccaucaggccacuuggaugaaaacccuucaaggauuacuggauagaauucagg

SEQ ID NO: 311447 - RNA, 61 nt, Human
ggaagggaggcagggacuggcagcugccacccccuucaagaggcgccauagacccuagcgg

SEQ ID NO: 311448 - RNA, 61 nt, Human
uccucugcugccauuuaugugcuuuuauucccccuucaaaaauuuuuuauuggauauauau

SEQ ID NO: 311449 - RNA, 61 nt, Human
ucagacagaaugcuucaggaaucguugucaccccuucaacuggagcaggacggaagguugu

SEQ ID NO: 311450 - RNA, 61 nt, Human
cagguuccaugggugacagccugagaucugucccuucaacgggcugggcuggguaugugcc

SEQ ID NO: 311451 - RNA, 61 nt, Human
uucugacuucugaccuucuccucuucgcucccccuucaaacccugcucccacuuugugaga

SEQ ID NO: 311452 - RNA, 64 nt, Human
acacggucguguagaguagcagcugauuugaccugucccagauuuuaagugauauuccaaaagg

SEQ ID NO: 311453 - RNA, 64 nt, Human
uuuguuuuuuuucuuuuguaaaggcaaugagcuagucccagaaaggauccuucaguuacauaca

SEQ ID NO: 311454 - RNA, 64 nt, Human
ccagaaugcugggaguuuuacagugccauuccaagucccagaugucccucuucccccaaacuug

SEQ ID NO: 311455 - RNA, 61 nt, Human
aagccuucaggagaggagcugccuuuccacccccuucaaggcaaggagggauggagguccc

SEQ ID NO: 311456 - RNA, 61 nt, Human
uaagacuaagaucugucuuuuuggugacuaacccuucaauucuuucaacuccuguuaauac

SEQ ID NO: 311457 - RNA, 61 nt, Human
uuacaagccccugaucugucucaccacacaucccuucaacccacacggucugcaaccaaac

SEQ ID NO: 311458 - RNA, 61 nt, Human
acaaaggugccagccuuuaugcuucucucaacccuucaagaaaguacaugucaggaaccua

SEQ ID NO: 311459 - RNA, 61 nt, Human
aaaaauacauugaaccaagggauccucccuccccuucaaggcagacguucaguacaaacau

SEQ ID NO: 311460 - RNA, 61 nt, Human
agcugcuguucccaucccagcucagaagacacccuucaacccugggaugaccacaauuccu

SEQ ID NO: 311461 - RNA, 61 nt, Human
cuccuugaacuaccccuccacacgcucuagucccuucaaccuaccggucuauuaaguggug

SEQ ID NO: 311462 - RNA, 61 nt, Human
auuaagugaaaggucacacuaccauuauuuccccuucaaacaaauaauauuuuuacagaag

SEQ ID NO: 311463 - RNA, 61 nt, Human
agcaccagcucacagacgcucuuguugugcccccuucaagcccagauugugccaggucagc

SEQ ID NO: 311464 - RNA, 61 nt, Human
uacuguuuccacuccagcaacuacauguccucccuucaacugccugccuuuuggggaaaga

SEQ ID NO: 311465 - RNA, 61 nt, Human
agagagagaaauugggagugguccccaaagacccuucaaccuccccagucccccaccagac

SEQ ID NO: 311466 - RNA, 61 nt, Human
cucccuccuuuucucuucucccaaaucuuuucccuucaaaggaaaaaaaaauguucagagg

SEQ ID NO: 311467 - RNA, 61 nt, Human
gcuuaucauguuccauuucgugccgcuuucccccuucaagaugccauuuggaggguagggg

SEQ ID NO: 311468 - RNA, 61 nt, Human
gugucaucucagucauuugacuuagaaagugcccuucaaaaggacccuguucacugcugca

SEQ ID NO: 311469 - RNA, 61 nt, Human
cuaauaacauugcugucaaguguagauuccccccuucaaaaaaagcuugugaccauuuugu

SEQ ID NO: 311470 - RNA, 61 nt, Human
aguauauuucaaaauauguacuugcgggauucccuucaaguaaaccaucccugaaaccuaa

SEQ ID NO: 311471 - RNA, 64 nt, Human
cugggccucggcccuucccgcaccgccgccagcgcccgcagacacccuggcaucucaagaggga

SEQ ID NO: 311472 - RNA, 64 nt, Human
ccccuccuaccccugggcagguguccagcgcagccccgcagagcuccaggguggccaaguggau

SEQ ID NO: 311473 - RNA, 64 nt, Human
cggggugcagaucuccuggcguguccaccauggccccgcagaacgccagggaccgccugcugcc

SEQ ID NO: 311474 - RNA, 61 nt, Human
ggaaguuucacaacggauugaucugaucaaucccuucaaggagcugaaggcaaaaugugua

SEQ ID NO: 311475 - RNA, 61 nt, Human
uacauacagaugguuuccuuguuagcagaugcccuucaaauauauuuuacguuugcagcac

SEQ ID NO: 311476 - RNA, 61 nt, Human
gucagguaccuagacauagcggaacagaaaacccuucaaaaguucagucuagucuggaaaa

SEQ ID NO: 311477 - RNA, 61 nt, Human
ggguccugcuccuaucucuccaaaccccauacccuucaaugcuguggccccucagugacuu

SEQ ID NO: 311478 - RNA, 61 nt, Human
augaagauaauaauaucuuuauucuuuaucccccuucaaagaaauuaccuuugugucaaau

SEQ ID NO: 311479 - RNA, 61 nt, Human
gauuucguuuccgucaacuuaaacauuguugcccuucaacaaggcucuugaauuaauaaaa

SEQ ID NO: 311480 - RNA, 61 nt, Human
cuaagugguuccaagcuuaacuugagaccuucccuucaaaucuaaaauuggcaaaaaguca

SEQ ID NO: 311481 - RNA, 61 nt, Human
agccaacuguuucccugcugaaugccucgcucccuucaagacgaggggcagggaaggacag

SEQ ID NO: 311482 - RNA, 61 nt, Human
uuguggacaauguggguuuuugaaauuugcacccuucaaacaaugauuuaucagagaaagg

SEQ ID NO: 311483 - RNA, 61 nt, Human
aaguuuuccucuuuuuuaacuguucccuuugcccuucaaacugcagauauuuuuuuuuuua

SEQ ID NO: 311484 - RNA, 61 nt, Human
uaguaaugguucuagaaggaugaacaguucucccuucaacuguauaccgugugcuccagug

SEQ ID NO: 311485 - RNA, 61 nt, Human
guuuguuuacaguuuguucuuucccuccuuccccuucaagugcacuuguuaaacugugaug

SEQ ID NO: 311486 - RNA, 61 nt, Human
aucaaacucuaagugaaaacuucccauuugucccuucaaagauuuuuuuuuauuaaauggu

SEQ ID NO: 311487 - RNA, 61 nt, Human
guaaacuuuuccucuggagucacuuuuuucccccuucaaaguauguuacugaggaaguaaa

SEQ ID NO: 311488 - RNA, 61 nt, Human
gauugcuaugccucaacucauagaagaugaacccuucaagaaaacgugaaguagaacgggu

SEQ ID NO: 311489 - RNA, 61 nt, Human
cguggcuucccgcucagcccucccugccccucccuucaaccauuccccaugggaaauguca

SEQ ID NO: 311490 - RNA, 64 nt, Human
ccaaggacgccuaccccgaaaccggccccgacgccccgcagaggcccgccugaagccagcccgg

SEQ ID NO: 311491 - RNA, 61 nt, Human; identical to SEQ ID NO: 179003

SEQ ID NO: 311492 - RNA, 64 nt, Human
ccaaaccacucaggacaguacccguggcacugggcccgcagaagcaagggaugacuugguucuu

SEQ ID NO: 311493 - RNA, 61 nt, Human
cugggcucccacuuuggcagcacuugaggagcccuucaacccgccgcugcacuguaggagc

SEQ ID NO: 311494 - RNA, 61 nt, Human
augugugauuuuuuauuaaacaaauaguaaacccuucaauuauaguuagucuuggugaagu

SEQ ID NO: 311495 - RNA, 61 nt, Human
acguguccuugcuggcggcccgccacaggcccccuucaauggccgcauucaggauggcucu

SEQ ID NO: 311496 - RNA, 61 nt, Human
gcugcggaagcccagcgguucacacaggccucccuucaacguagucauccccugguggugg

SEQ ID NO: 311497 - RNA, 61 nt, Human
gccacaccaagucugugcacugcccaccacccccuucaaccccuccuacaccaugcuccgg

SEQ ID NO: 311498 - RNA, 61 nt, Human
auuuugaaaaacuaacaagacugguccaguacccuucaaccaugcugugaucggugcaagu

SEQ ID NO: 311499 - RNA, 61 nt, Human
augacauugucuuuaucauccuuuccccuuucccuucaacucuucguacauucaaugcaug

SEQ ID NO: 311500 - RNA, 61 nt, Human
aggcaccaugcaaaugucuuccagguccaaacccuucaacuccuggcuccgcagggguuug

SEQ ID NO: 311501 - RNA, 61 nt, Human
cagucuggcacugccaggaccuccuguggcacccuucaagcugcccagccggcccucuggg

SEQ ID NO: 311502 - RNA, 61 nt, Human
gaagaugauagccagggcuguuguuuuggggcccuucaaggcaaaagaccaggcugacugg

SEQ ID NO: 311503 - RNA, 61 nt, Human
ccugagggguauuuuuaaaggguuuuuuuuucccuucaagaggagggaaaaugcaaccagu

SEQ ID NO: 311504 - RNA, 61 nt, Human
augaacugccguccucaguaaaagcagccaccccuucaagagucacaggcauccauccagu

SEQ ID NO: 311505 - RNA, 61 nt, Human
cucuacagucucacaucacgacccggagguccccuucaaccacagcuucaucgagccgccc

SEQ ID NO: 311506 - RNA, 61 nt, Human
uggugggcuuugggguauccccaccaacuuucccuucaaaauagcaccuuacaccccaucu

SEQ ID NO: 311507 - RNA, 61 nt, Human
accaaaauguggugaacucuuaaggacuuuucccuucaagugugaaggaaggugugaugaa

SEQ ID NO: 311508 - RNA, 61 nt, Human
cacccuccccaucuuugcugagcucucaguucccuucaauuaaagagauacccgguagacc

SEQ ID NO: 311509 - RNA, 64 nt, Human
cagaggcccccgagguguguguaggaggcggaggcccgcagagcacagagcaggagaagggcuu

SEQ ID NO: 311510 - RNA, 64 nt, Human
ccgaguuggggggaggggguguggcaacgugccccccgcagaggccacgcauguuugaccaaag

SEQ ID NO: 311511 - RNA, 64 nt, Human
cauaguguagauggacauuugccacaacacacugcccgcagaaauggacuuaccgugaagccaa

SEQ ID NO: 311512 - RNA, 61 nt, Human
guuccucccccugcuccccuacuucucaguccccuucaauuuguagacucuugcuccugcu

SEQ ID NO: 311513 - RNA, 61 nt, Human
ucuaaaacaaaaaagaauccuagauaguuuucccuucaagucaagcgucuuguuguuuaaa

SEQ ID NO: 311514 - RNA, 61 nt, Human
cuccgcaucauauggccagugaccgcuuucucccuucaagaaaauucuguggcugugcagu

SEQ ID NO: 311515 - RNA, 61 nt, Human
agagguggucuuguaagcgcugcauggcgcucccuucaacagcaagccugacuguucucga

SEQ ID NO: 311516 - RNA, 61 nt, Human
cucucccacccggaccccuccagccaagcagcccuucaaguucuuuuauuucuggguaaca

SEQ ID NO: 311517 - RNA, 61 nt, Human
gauucuaaaauuuguuugcucguaugcuguucccuucaaugugauaucagagauuacuaug

SEQ ID NO: 311518 - RNA, 61 nt, Human
uuucccccugugaaagcaaaauagcuuggaccccuucaaguugagaacuggucagggcaaa

SEQ ID NO: 311519 - RNA, 61 nt, Human
ccaagugggaaagccuucauuucuucuaguucccuucaauaucaugaaaggacucacacug

SEQ ID NO: 311520 - RNA, 61 nt, Human
cauggcccagcccuggccagaagcaucgcuccccuucaaccaaccgcguugauggacaccc

SEQ ID NO: 311521 - RNA, 61 nt, Human
cacacccaggucucuuccuuugcucugaggucccuucaaggccuccccaauccaggccaaa

SEQ ID NO: 311522 - RNA, 61 nt, Human
gcuuccuccuccccaacugugggggugugcccccuucaagccugugcaaugcauuagggau

SEQ ID NO: 311523 - RNA, 61 nt, Human
cccaaucuccccucaacuccaauccauaacccccuucaaaccauccucaacuaagcuccuc

SEQ ID NO: 311524 - RNA, 61 nt, Human
ccuucuuucuuuugauugucucaagcugccacccuucaaggacagggaagagaccacugug

SEQ ID NO: 311525 - RNA, 61 nt, Human
guuguagcugccaucagaugccggagacucgcccuucaauaaaaaaucucuucuagcugau

SEQ ID NO: 311526 - RNA, 61 nt, Human
aaaugugggaaagccuuuagugaucuuuauucccuucaaaaucaugagacaacucauaugg

SEQ ID NO: 311527 - RNA, 61 nt, Human
caaugugggaaagccuucagugcuuccacuucccuucaaagacgugaaaccacucacagug

SEQ ID NO: 311528 - RNA, 64 nt, Human
gauugaggugguaggaguucaaggcucaguccccgucccagauggcaguggagagucucauccc

SEQ ID NO: 311529 - RNA, 64 nt, Human
gcagcacauaggcucaggcuucuguaggcuuccugucccagagccaauuauggaaguaagggcu

SEQ ID NO: 311530 - RNA, 64 nt, Human
ccugggucugggaaguagcucugaugagaauggggucccagauggcucaggcugugaccucccu

SEQ ID NO: 311531 - RNA, 61 nt, Human
gccgcguugucccaagagccugccacccucccccuucaaugcaccucuggugguggagugg

SEQ ID NO: 311532 - RNA, 61 nt, Human
guggaagauagggacagcugcccccagaacucccuucaagggaggacuuccccagcuaugg

SEQ ID NO: 311533 - RNA, 61 nt, Human
gugagccccacagcccugcucauuccucacgcccuucaaugcugcaggauggacuggcccc

SEQ ID NO: 311534 - RNA, 61 nt, Human
gugcccagaaauuaccccaagaccacaggaacccuucaagaagcucccaucacaagcuugg

SEQ ID NO: 311535 - RNA, 61 nt, Human
ugccuuuuacuucuaccuguacaucccccaucccuucaauucuuucauucccugaccagug

SEQ ID NO: 311536 - RNA, 61 nt, Human
uuccuugcauuaggcuuucuaaacccggagccccuucaaacuuccaauaaagggaucauuu

SEQ ID NO: 311537 - RNA, 61 nt, Human
gggccucgcagagaugcgugcauccagcagccccuucaagacauaagagggcggggcgagg

SEQ ID NO: 311538 - RNA, 61 nt, Human
uuuucuacguguaggcgugaauagggggcaccccuucaaaacuguacaaagaagacgacug

SEQ ID NO: 311539 - RNA, 61 nt, Human
agauucaggggagaaaauaaguugucaccuccccuucaaaguuccagaguaaacaaauggu

SEQ ID NO: 311540 - RNA, 61 nt, Human
auaguaggaagaguucuuggugguguccccccccuucaauucuucaguuguauaguaguua

SEQ ID NO: 311541 - RNA, 61 nt, Human
uuugcuucugauagggucagcuuucccauuucccuucaaugcuugggaaccuucucccuua

SEQ ID NO: 311542 - RNA, 61 nt, Human
ggagcacauccucgccuccguccggcugcugcccuucaacaacaagcccugauuuuuccag

SEQ ID NO: 311543 - RNA, 61 nt, Human
uaacccugcaagcuguuuccacaucagaacucccuucaaacacaaagauugcugugaaaac

SEQ ID NO: 311544 - RNA, 61 nt, Human
aaucagaauuuucuaccguuccacacccaaccccuucaaauacacacaaccuuguuacuuu

SEQ ID NO: 311545 - RNA, 61 nt, Human
uuuuaacuuguuccccugcauccuggcaugucccuucaagaaggaaaaggugacaucaguu

SEQ ID NO: 311546 - RNA, 61 nt, Human
cgguacuggcccuguccucaguucccguccacccuucaaccaguggcuccugggagacuuu

SEQ ID NO: 311547 - RNA, 64 nt, Human
ggccccuccuucugcugccuggccaagccccacacccgcagacccuccuucccauccucugaaa

SEQ ID NO: 311548 - RNA, 64 nt, Human
acgguacccggccgccguucugcaaugcaucacucccgcagaggggggugcagaucaggcgccg

SEQ ID NO: 311549 - RNA, 64 nt, Human
cacugaacagaacgucgcugauggagaaagggcucccgcagaaggaacggccuguaccgugcgc

SEQ ID NO: 311550 - RNA, 61 nt, Human
aagaacacuggcaucuuuuucuauucauucccccuucaacauauuuuuuguaguuuuuuau

SEQ ID NO: 311551 - RNA, 61 nt, Human
uuggucuuggcuucauggcaaccacugcucacccuucaacaugccugguuuaggcagcagc

SEQ ID NO: 311552 - RNA, 61 nt, Human
uuuccccuuuugucuugcccacuccuguuuacccuucaaguuucaaguucaugucacuguc

SEQ ID NO: 311553 - RNA, 61 nt, Human
ggggguucgagggacuuaguggaguucucaucccuucaaugcccccucccuuucugaaggc

SEQ ID NO: 311554 - RNA, 61 nt, Human; identical to SEQ ID NO: 311313

SEQ ID NO: 311555 - RNA, 61 nt, Human
ucagaaacaauuucuguguccuguuuuuauucccuucaaugcaaaauacaugaugauuuca

SEQ ID NO: 311556 - RNA, 61 nt, Human
gcugagcuggucguauggggaagaugucaagcccuucaagccaccccugagcgaugcugag

SEQ ID NO: 311557 - RNA, 61 nt, Human
uggccacauccuucucuuccauuagaagaagcccuucaagggcaaggaccaugucuuaucu

SEQ ID NO: 311558 - RNA, 61 nt, Human
cgaaggguuggacgggaugaccuccagaagucccuucaauuucuaguaccugugacucuua

SEQ ID NO: 311559 - RNA, 61 nt, Human
ccuucccuuucuaagcaaccacacugcuuggcccuucaagggucagggugagacgugaugg

SEQ ID NO: 311560 - RNA, 61 nt, Human
uuucaguuuuuuuguuguuguuagugagucucccuucaaaauacgcaguagguaguguaaa

SEQ ID NO: 311561 - RNA, 61 nt, Human
aacaaauauacucauuuggauauaaaucuuacccuucaauguuaaaucuacaaacuuuuau

SEQ ID NO: 311562 - RNA, 61 nt, Human
ucucuccagcagcuggugaguaaggaaaugacccuucaauuuccucuucuuuuuccucuga

SEQ ID NO: 311563 - RNA, 61 nt, Human
uuccccauugccaugaguccuggucaagccccccuucaauuuguuuccuguucagcaugua

SEQ ID NO: 311564 - RNA, 61 nt, Human
cuucugauauucuuuauacaaaccaaaaguccccuucaacauuuuuuaugucaaaauguua

SEQ ID NO: 311565 - RNA, 61 nt, Human
cccgacuucuuuuuaauuaaaauaagguaagcccuucaauuuguuucuucaauauuucuuu

SEQ ID NO: 311566 - RNA, 64 nt, Human
ggguggcgcuucucagccggcugucccagccagccccgcagagcgcccacggacaguguccacu

SEQ ID NO: 311567 - RNA, 64 nt, Human
cuuuccaggagccccaggcccggaggaggcgaagcccgcagagcaaagguggaaacacgugccu

SEQ ID NO: 311568 - RNA, 64 nt, Human
ccgcccccuccgccgccccuuccccagcccugcccccgcagacucccccugccgccaagacuuc

SEQ ID NO: 311569 - RNA, 61 nt, Human
uuucaguuuuuuuguuguuguuagugagucucccuucaaaauacacaguagguaguguaaa

SEQ ID NO: 311570 - RNA, 61 nt, Human
uaaaaaguacagagagccugugcugugaacccccuucaaugggaaaaagcugcagugguga

SEQ ID NO: 311571 - RNA, 64 nt, Human
ucugagggucccagggagcugcagaugcagaccccgucguuaguccagccccugcuucaccccc

SEQ ID NO: 311572 - RNA, 64 nt, Human
accuugcuucauaguaaccaguugagaugaagcacgucguuagaacguuguuggacaccauguu

SEQ ID NO: 311573 - RNA, 64 nt, Human
agccucaccuggcucauuuggcugucaguuugaucgucguuagauugaagaaaacaucuagaug

SEQ ID NO: 311574 - RNA, 64 nt, Human
ucgaauugagauucaucaucaaagagcaaugcagcgucguuaaaauaaaaacugugccuuuuaa

SEQ ID NO: 311575 - RNA, 64 nt, Human
gcccagcuggggcuaggcccggugggaaggagagcgucguuaauuuauuucuuauugcuccuaa

SEQ ID NO: 311576 - RNA, 64 nt, Human
uucaccacaguuguauuuaagugaucgugugagucgucguuaaaugccugucuccccgcggauc

SEQ ID NO: 311577 - RNA, 64 nt, Human
caacaguuacuaaaacaccauuuaauaguuauaacgucguuacuuguacuaugaaggaaaauac

SEQ ID NO: 311578 - RNA, 64 nt, Human
uaccaagcugugaaacuaaaccuucuccacuaaacgucguuagggccucaguucuagacgaguc

SEQ ID NO: 311579 - RNA, 64 nt, Human
ucucuauaaaugacacuuuuauaucuucuuuauucgucguuaaaacgcgguaggaaauuacccu

SEQ ID NO: 311580 - RNA, 64 nt, Human
caggucucugcugacaauggggguucaaggaagacgucguuaucuccccuccccacuuacucga

SEQ ID NO: 311581 - RNA, 64 nt, Human
gcuggcacccgguuuacagggaggugauugaggacgucguuaugauuugauuugaccuuggcac

SEQ ID NO: 311582 - RNA, 64 nt, Human
cuuuaaaaaaaaagagcguaaauacaaacaggaguggugcaagccgccuugguguggguuugug

SEQ ID NO: 311583 - RNA, 64 nt, Human
ggggucuuccucuguugcccaggcuggagugcaguggugcaaucuuggcucacuguaaccuccg

SEQ ID NO: 311584 - RNA, 64 nt, Human
uauuuguaggaccugccauauuugaguccuaacuuggugcaagucuggcagcuagguagaaaag

SEQ ID NO: 311585 - RNA, 64 nt, Human
gcgguuucggggcucccccuuccucucccucccucccgcagaaggggguuuuaggggccugggc

SEQ ID NO: 311586 - RNA, 64 nt, Human
gggcugggccccuccaggagucacagaugaggcccccgcagagacuggugaguggugacccugu

SEQ ID NO: 311587 - RNA, 64 nt, Human
cuacuuuaucuuauugaucucugcagacuugugcuggugcaaguacaugcugacaggcaauuug

SEQ ID NO: 311588 - RNA, 64 nt, Human
cauucuucauccuuaggauguggcaaugaaaugauggugcaaguuccuuucucuuuugugaauc

SEQ ID NO: 311589 - RNA, 64 nt, Human
aaaugcuuggaguuuugccugggcuagugagaguuggugcaaauucuuguguguguuugcauag

SEQ ID NO: 311590 - RNA, 64 nt, Human
acggucugacucugucacccaggcuagaguacaguggugcaaucuuggcucacugcaaccuccg

SEQ ID NO: 311591 - RNA, 64 nt, Human
uauucuccagaaacaguaaauaggugaguagggguggugcaagugaauucguuuucauuuagaa

SEQ ID NO: 311592 - RNA, 64 nt, Human
uagagauggauggaacagaaaauaaaucuaaauuuggugcaaaugccauucugggagugucccu

SEQ ID NO: 311593 - RNA, 64 nt, Human
gcuugaaacaaucacacaggacacuuuucuacauuggugcaaaauggaauauuuuguacauuuu

SEQ ID NO: 311594 - RNA, 64 nt, Human
accuucucaccagauuccccugaauccaaacucguggugcaaaccucuaccuuuuuuacaaaaa

SEQ ID NO: 311595 - RNA, 64 nt, Human
gguaagggaaagaauaucuuauuucuuuuaugauuggugcaaauuggcuaaagugcauuuuuaa

SEQ ID NO: 311596 - RNA, 64 nt, Human
auaaguucagacuaaagagaauggagaacuauuguggugcaaccuggcaaaucccucagaggac

SEQ ID NO: 311597 - RNA, 64 nt, Human
caaaucuuuuaaugguaagaaagcaagugaagcuuggugcaagcuaaaauuuuuaaauggugug

SEQ ID NO: 311598 - RNA, 64 nt, Human
gccaccagggggagugggcugaagggagaguagauggugcaaagcaagcccaucucuaaguaga

SEQ ID NO: 311599 - RNA, 64 nt, Human
acucaccacagcugccuccugagcugccugagccuggugcaaaaggauuggcccccauuauggu

SEQ ID NO: 311600 - RNA, 64 nt, Human
aaugcccacaggcaaaugcauggaggguuguuaauggugcaaauccuacugaaugcucugugcg

SEQ ID NO: 311601 - RNA, 56 nt, Human; identical to SEQ ID NO: 179022

SEQ ID NO: 311602 - RNA, 64 nt, Human
guggaggucagaguggaagcaggugugagagggucccgcagaagaaaacauggcugccaaagug

SEQ ID NO: 311603 - RNA, 64 nt, Human
uccgggagcugauggccccucucucccggcuccgcccgcagacucuggcuccuccgacuacacc

SEQ ID NO: 311604 - RNA, 64 nt, Human
gcccauccccccucagauccagacaugccccucccccgcagacacaccccaaggcagcccaacc

SEQ ID NO: 311605 - RNA, 64 nt, Human
aaaacccaaccaaaccaagcccuguugugcucacuggugcaaagagaagaucagggcagcuuaa

SEQ ID NO: 311606 - RNA, 64 nt, Human
cuuaaaauuagucguauuuuaauggcuugggauuuggugcaaacaaacaugauugauagcugga

SEQ ID NO: 311607 - RNA, 64 nt, Human
gaguuucacucuugcugcccaggcuggagugcaauggugcaaugaccucggcucacugcaaccu

SEQ ID NO: 311608 - RNA, 64 nt, Human
aacauuauagaacuuuuaggguugugacuggcuuuggugcaaaugugugcucaagcuaauaagu

SEQ ID NO: 311609 - RNA, 64 nt, Human
agggucucacuuugucacccaggcuagagugcaguggugcaaucucagcucacugcagccucug

SEQ ID NO: 311610 - RNA, 64 nt, Human
ggaguuuugcucuguugcccaggcuggagugcaguggugcaaucauagcucauugaagccucgc

SEQ ID NO: 311611 - RNA, 64 nt, Human
aagcuaugagaauaacuucagucacucccuugaauggugcaaugaauuaaccagcugauuuuuc

SEQ ID NO: 311612 - RNA, 64 nt, Human
ggugcccugagcccguuagguuuucuuuucuugguggugcaaagugguauaacugugugcaaau

SEQ ID NO: 311613 - RNA, 64 nt, Human
uagacucgaggagacagaaacugaaucccacaccuggugcaauuagaagcauaauuagaagcag

SEQ ID NO: 311614 - RNA, 64 nt, Human
aaaagcaggcaagaggucuucuugauuaugcuacuggugcaauuggaucaguguaugauaugga

SEQ ID NO: 311615 - RNA, 64 nt, Human
uucuuuuuccccccaucagggcaaauggucuaacuggugcaaucaugaagagaguuaaugguua

SEQ ID NO: 311616 - RNA, 64 nt, Human
ucagucgcugaguauuauuugacuccggucuccuuggugcaaaaacaaaaugggaaaaauaaau

SEQ ID NO: 311617 - RNA, 64 nt, Human
ugugugccuagugauguagaaagauacacugacuuggugcaaggccaucugcuuaccacaucac

SEQ ID NO: 311618 - RNA, 64 nt, Human
ucagguuuuaguuuuuaaaauaucuuuugaccuguggugcaaaagcagaaaauacagcuggauu

SEQ ID NO: 311619 - RNA, 64 nt, Human
cugggacaucugaggauugggauucuuuguucaccccgcagauaguuaaugaauggucugcccu

SEQ ID NO: 311620 - RNA, 64 nt, Human
agauuaacggugcuaaccccgucugcuccucccucccgcagagacuggggccuggacuggacau

SEQ ID NO: 311621 - RNA, 64 nt, Human
gccccguccucugcugcuggccucugggucgugccccgcagacugagcugcgcuuggggguccu

SEQ ID NO: 311622 - RNA, 60 nt, Human; identical to SEQ ID NO: 179032

SEQ ID NO: 311623 - RNA, 64 nt, Human
auuucacagacaucuaugcauuaauuuaaauucuuggugcaaaugugugcuuuguaguucaacc

SEQ ID NO: 311624 - RNA, 64 nt, Human
ggagucuugcucugucacccaggcuggagugcaauggugcaauuucgacucacugcaaccucug

SEQ ID NO: 311625 - RNA, 64 nt, Human
uucccaaccacaacauucuucuauuuugccaggcuggugcaaaguaauuaaagaugucaaucag

SEQ ID NO: 311626 - RNA, 64 nt, Human
gacucaaccugcaaaccuuuaagaguuugccgccuggugcaacuggagcagugguuggaacuug

SEQ ID NO: 311627 - RNA, 64 nt, Human
uacuuuuauagaguuguaauguuuuauauguguauggugcaagagaaaauuggaucaaaucaau

SEQ ID NO: 311628 - RNA, 64 nt, Human
aaucuuuuccagggauaggcagguagcucacucuuggugcaauuucuugaggaugggaacaugu

SEQ ID NO: 311629 - RNA, 64 nt, Human
aauagggaaggaugggcuggguaaguauggaauuuggugcaaagcaggcugucugugguuggaa

SEQ ID NO: 311630 - RNA, 64 nt, Human
ugccacaguugauggugaggaagcuccuuugacguggugcaauuuugaugagaugucucugggg

SEQ ID NO: 311631 - RNA, 64 nt, Human
cucuccagaaaggguugcuagccuuaacuucagcuggugcaaaacaucugacuguagccgaacu

SEQ ID NO: 311632 - RNA, 64 nt, Human
ggaaucuugcucuguugcucaggcuggagugcaguggugcaaucuuggcucacugcaaccuaca

SEQ ID NO: 311633 - RNA, 64 nt, Human
augcuaaaucauggauaaacugugaaccaaaauauggugcaacauacgagacaugaauauaguc

SEQ ID NO: 311634 - RNA, 64 nt, Human
gcugggucuucaggcuccaugccaacagagccccuggugcaaugcggucacagguuuuauggga

SEQ ID NO: 311635 - RNA, 64 nt, Human
gcuuuaaugcaacccuuuagcccuugguucuuuuuggugcaagaauucuggcuguuuaccucag

SEQ ID NO: 311636 - RNA, 64 nt, Human
gcuuguucugagguuucaccuccauguguuucauuggugcaaaaguggaucucuuaguugguca

SEQ ID NO: 311637 - RNA, 64 nt, Human
aaugcaccauguccugaaagauggcacccucccacccgcagagugcuuccugcaagcuggcguu

SEQ ID NO: 311638 - RNA, 64 nt, Human
uuaaggagguagcucccagcacucaaccaaccuccccgcagagcucccuuccugacccuccgcu

SEQ ID NO: 311639 - RNA, 64 nt, Human
aaggccccaggaguggcaccuuagugugggucggcccgcagauggcacccaaggccgggaaggg

SEQ ID NO: 311640 - RNA, 64 nt, Human
cacccaggguggggaggccacccuuccugcccuacccgcagaauggugcucuccuuugcccucc

SEQ ID NO: 311641 - RNA, 64 nt, Human
aguuuugaagugccuaagaugaccuauuugucaguggugcaaaauuaauucucuucuuuuuuga

SEQ ID NO: 311642 - RNA, 64 nt, Human
cagcuucuaugaccaaaaugaguuguaaauucucuggugcaagauaaaaggucuugggaaaaca

SEQ ID NO: 311643 - RNA, 64 nt, Human
ugaauuuagucauuauuauuacuuuuuaaaauguuggugcaauuaacucuggaccucucuugug

SEQ ID NO: 311644 - RNA, 64 nt, Human
ggagucucgcucugucgcccaagcuggaguacaguggugcaaucucacugcaagcucugccucc

SEQ ID NO: 311645 - RNA, 64 nt, Human
auuacccaggaagguugagcugcugagauuucaguggugcaaugucuuuaaaaaaacaggcuuu

SEQ ID NO: 311646 - RNA, 64 nt, Human
uaguguagagaaauugaaaacagaucuauuagguuggugcaauugcuuuugcaccaaccuaaua

SEQ ID NO: 311647 - RNA, 64 nt, Human
acagugucucacuguugcccaggcuggagugcaguggugcaaucucaguucagugcaaucuccg

SEQ ID NO: 311648 - RNA, 64 nt, Human
ugagucucacuccaucagccaggcuggagugcaguggugcaaucucggcucacugcaaccucug

SEQ ID NO: 311649 - RNA, 64 nt, Human
aagugccuccuuuugugguguaaaaaacaaauuauggugcaaaaaguaaucacuagauugaaau

SEQ ID NO: 311650 - RNA, 64 nt, Human
gcaugcuuagaggucaaggaccuuccuguguaguuggugcaaaagcaaucuccacaggacagca

SEQ ID NO: 311651 - RNA, 64 nt, Human
gaguuucgcucuuguugcccaggcuggagugcaauggugcaauuucagcucacugcaaucucug

SEQ ID NO: 311652 - RNA, 64 nt, Human
uauuccauggaguugugcaaagcuauggcuuccuuggugcaauauucuuaaaaccugcuuugca

SEQ ID NO: 311653 - RNA, 64 nt, Human
cuugucuccauguguauccaugcauuauauacccuggugcaaucacacgacugucaucuaaagu

SEQ ID NO: 311654 - RNA, 64 nt, Human
ugauucacauauaaagaugcaggcuggaguacaauggugcaaucucagcucaccacaaccucug

SEQ ID NO: 311655 - RNA, 64 nt, Human
ugccccucuccaauagguguggccccuaccagaccccgcagacccgggcacuucucagcauggc

SEQ ID NO: 311656 - RNA, 64 nt, Human
ggccuaaguauguggagcucugcuuuggcacugccccgcagaggccacgccuauuuauucuguu

SEQ ID NO: 311657 - RNA, 64 nt, Human
ccuguccccaaauuggccucgguggcaggggagccccgcagagcuggacagcgacacgcagggg

SEQ ID NO: 311658 - RNA, 64 nt, Human
auuccugaccauccucagaaucucaugccauuuucccgcagagcugagggauguggucagcagu

SEQ ID NO: 311659 - RNA, 64 nt, Human
uggcuguggcagccuagcuuggagaagcugcuguuggugcaagggagauggucucaagucagag

SEQ ID NO: 311660 - RNA, 64 nt, Human
gggugcugaauguaaggaggggagccuccaaguguggugcaagccgggggucuccacaucuucc

SEQ ID NO: 311661 - RNA, 64 nt, Human
acagagucucacuguugcccaggcuggagugcaguggugcaaucucggcucacugcaagcucug

SEQ ID NO: 311662 - RNA, 64 nt, Human
aguugggaaauuuuuccaugaggaaaaugugcuuuggugcaagguacaaggcccacacccucuc

SEQ ID NO: 311663 - RNA, 64 nt, Human
aauuuugauccauauguuaagugauagaagauuuuggugcaacaguaguaggauauauuucucc

SEQ ID NO: 311664 - RNA, 64 nt, Human
uuauaaaugaauguugucccugaacuuagcuaaauggugcaacuuaguuucuccuugcuuucau

SEQ ID NO: 311665 - RNA, 64 nt, Human
uuucccauaauaauaacuaacauuuauauuagguuggugcaaaacuaguugcgguuuuucccau

SEQ ID NO: 311666 - RNA, 64 nt, Human
ugccugugaacugcaaacuugcuuaugauugacuuggugcaauaaaguuccuuucuaaccauuu

SEQ ID NO: 311667 - RNA, 64 nt, Human
auggaugcauugaaauuauauguaauuguauaaauggugcaacaguaauaaaguuaaacaauua

SEQ ID NO: 311668 - RNA, 64 nt, Human
uucaauauauacaguuugaugaugugcuugaaauuggugcaaauauauacacacccuuguaagu

SEQ ID NO: 311669 - RNA, 64 nt, Human
gaguuucacuccuguugcccaggcuggagugcaauggugcaauuucggcucaccgcaaccuacg

SEQ ID NO: 311670 - RNA, 64 nt, Human
cagaaucacucuggcaauugucugcagcugccacuggugcaaggccuuaccagcccuagccucu

SEQ ID NO: 311671 - RNA, 64 nt, Human
cagaaucucacuuugucaccaggcuggagugcaguggugcaaucucaccucacugcaaccuccg

SEQ ID NO: 311672 - RNA, 64 nt, Human
agaacaagagaaccucugacgguggagaaccauguggugcaagaagagaucuuaggucucuucu

SEQ ID NO: 311673 - RNA, 61 nt, Human; identical to SEQ ID NO: 178993

SEQ ID NO: 311674 - RNA, 64 nt, Human
ugaaggucaggaggcaaguggaggauggacugggcccgcagaugcccugaccucugcccccagg

SEQ ID NO: 311675 - RNA, 64 nt, Human
uucucugagccgcggacaugcccucgcauugcuucccgcagagugcagagacaggaagcuggag

SEQ ID NO: 311676 - RNA, 64 nt, Human
gcugaggauggagccgcccccagccgacuccaagcccgcagagggcagacgccacccuggacug

SEQ ID NO: 311677 - RNA, 64 nt, Human
augaagucucacaguuggugauuucuccgcucuguggugcaauaucccuauuuguaggugaguu

SEQ ID NO: 311678 - RNA, 64 nt, Human
gaaggaaaggggcgagggaggggggugggauuuuuggugcaaguagcacaugguuuaaauauga

SEQ ID NO: 311679 - RNA, 64 nt, Human
ccuccaaaacacauauguuggaaaucgcuuuugcuggugcaaaguauauuaaugagcaggaaua

SEQ ID NO: 311680 - RNA, 64 nt, Human
aaaagauaccuaagcacuagaauauccagcuaaauggugcaauaggcuaggaauugagccagga

SEQ ID NO: 311681 - RNA, 64 nt, Human
ggucugccaggucagauggagacgcagaaccugcuggugcaagcugggcagguccugaccaacc

SEQ ID NO: 311682 - RNA, 64 nt, Human
aacgaaauacugcucuguccagaggcuuuaaaacuggugcaauuacagcaaaaagggauucugu

SEQ ID NO: 311683 - RNA, 64 nt, Human
aauggccauuuuuuuuuuagauggaguuuugcaguggugcaaucauagcucauugcagccuuca

SEQ ID NO: 311684 - RNA, 64 nt, Human
ggagucucacucugucgcccaggcuagacugcaguggugcaaucucagcucacugcaaccuccc

SEQ ID NO: 311685 - RNA, 64 nt, Human
ugacuugcagcgugcuguuuaaguuaaguuucucuggugcaaucugugaagauugccuaauacu

SEQ ID NO: 311686 - RNA, 64 nt, Human
gaguuucguucuuguugcccaaccuggagugcaauggugcaaucucagcucacugcaaccucug

SEQ ID NO: 311687 - RNA, 64 nt, Human
uauauguaugcaccacaugugcacacacggguguuggugcaacucaccagcaggugugcaguag

SEQ ID NO: 311688 - RNA, 64 nt, Human
auuuauuaacuagguaugaaguauaaacccauuuuggugcaauauucuugacuccuuggugcua

SEQ ID NO: 311689 - RNA, 64 nt, Human
guucaggcauaaauuagagaaaugguucuggauauggugcaaaaaugaguuuucaccugguauc

SEQ ID NO: 311690 - RNA, 64 nt, Human
uuuugaggcagagucuugcucugcuggagugcgguggugcaaucucggcucacugcaaccucca

SEQ ID NO: 311691 - RNA, 64 nt, Human
agagaggcccgcccgcccaccgugggcagugccacccgcagaugacacgcgcucuccaccaccc

SEQ ID NO: 311692 - RNA, 64 nt, Human
guggucacagcggagguguggagccgaggccuaccccgcagacaccuuggacauccuccuccca

SEQ ID NO: 311693 - RNA, 64 nt, Human
gcgguagggcguggaaaggggcaggccagagcuacccgcagaguucucagaaucaugcugagag

SEQ ID NO: 311694 - RNA, 64 nt, Human
guggggcccagacaccagccuagccuggcucugccccgcagacggucugugugcuguuugaaaa

SEQ ID NO: 311695 - RNA, 64 nt, Human
gugaggcaggaggcuggaaacccaggaaagcugauggugcaagguccaguccaaagguaucugu

SEQ ID NO: 311696 - RNA, 64 nt, Human
aagcgcugggccugccagacagaggccccucuuguggugcaagcccagcucugucaccugagau

SEQ ID NO: 311697 - RNA, 64 nt, Human
uuugaggaguguuaagauugcagauagcaagguuuggugcaaaguauuguaaugagugaauuga

SEQ ID NO: 311698 - RNA, 64 nt, Human
ccuuaggguguggauuaggcucuggcuucugugauggugcaagaggcaggauggucuccagaca

SEQ ID NO: 311699 - RNA, 64 nt, Human
cuaaaaauuuauuugaaacaaucuagaauuuucuuggugcaaaguguaucauguggaauauccu

SEQ ID NO: 311700 - RNA, 64 nt, Human
ggagaaaagagugaggaacagaauguuuuaaaucuggugcaaaagaacuauaucugcuggauga

SEQ ID NO: 311701 - RNA, 64 nt, Human
agguaucuucuaaccuagaaauucaccauaauuauggugcaaggucagugugucucugagaucu

SEQ ID NO: 311702 - RNA, 64 nt, Human
ggagucuuguucuguugcccaggagggagugcaguggugcaaccucggcucacugcaaccuuug

SEQ ID NO: 311703 - RNA, 64 nt, Human
ggaguuucgcccuuuucgcccaggcugaguacaguggugcaaucucacugcaaccuccgccuuc

SEQ ID NO: 311704 - RNA, 64 nt, Human
auuguuggcgcugaggugucuggccugaggucaauggugcaaaggagccgccaccgggcauguc

SEQ ID NO: 311705 - RNA, 64 nt, Human
uucguggaacucuccauuuuccuaaauguuagguuggugcaaaacuaaucgugguuuuugccau

SEQ ID NO: 311706 - RNA, 64 nt, Human
cauucagagcuccaggccuggaagcagugccucuuggugcaacaagaaacuucucccucacccc

SEQ ID NO: 311707 - RNA, 64 nt, Human
uuaaaaccaaacccuaugccuuuuguagcugucauggugcaauuugucuuuggaaaauucagau

SEQ ID NO: 311708 - RNA, 64 nt, Human
ggcaguucacucugucucccaggcuggagugcaauggugcaaucuuggcucacuauagccuuga

SEQ ID NO: 311709 - RNA, 64 nt, Human
cacgcacgaccccaagcccgcggaggcaccgaugcccgcagagcccgcaccccccggcccugcc

SEQ ID NO: 311710 - RNA, 64 nt, Human
ccgacuuguggcucggacccagggaccuucagggcccgcagacccucccggcgccuugagaccc

SEQ ID NO: 311711 - RNA, 64 nt, Human
uguguaugcgagcgcccgccucccagccccggugcccgcagaagacgcuuuuccccagcagguc

SEQ ID NO: 311712 - RNA, 64 nt, Human
gggcccucgggaagccuuggacagaacccuccaccccgcagaccaggcgucguguguguguggg

SEQ ID NO: 311713 - RNA, 64 nt, Human
ugagucuugcucuaucacccaggcuggagugcaguggugcaaucucagcucacugcaaccuccg

SEQ ID NO: 311714 - RNA, 64 nt, Human
guuaugauuuacacagaagcaacugccaaaucuguggugcaaccacuaucuccagugaaauauu

SEQ ID NO: 311715 - RNA, 64 nt, Human
cucguguguccucauggagaacccaggggacagcuggugcaaauucagaacugagggcucuguu

SEQ ID NO: 311716 - RNA, 64 nt, Human
gauuuguauaaaccagugcucuccauuagaaauauggugcaagccacauauguaauuuuaaaua

SEQ ID NO: 311717 - RNA, 64 nt, Human
ugaaaauaugcuuccuguaucaaagguacguauguggugcaaacaaggcagaaacuuccuuuua

SEQ ID NO: 311718 - RNA, 64 nt, Human
gaggucucacuccgucauccaagcuggagugcaguggugcaauccucaacucacugcaaccucc

SEQ ID NO: 311719 - RNA, 64 nt, Human
ccugaaccccccuaggugggcuggaaucagcaucuggugcaaagcucugugaccacugcuguac

SEQ ID NO: 311720 - RNA, 64 nt, Human
uauuuaaauuuuauuuuggaaaauaaauuauuuuuggugcaaaagucaacauggcaguuuuaau

SEQ ID NO: 311721 - RNA, 64 nt, Human
aaaguauuuaugugguauuaaaauuucauggugauggugcaagggagagaugauuaggaagaaa

SEQ ID NO: 311722 - RNA, 64 nt, Human
cacuaacuagacuuuuaaaagauuuugugugguuuggugcaagucagaauaaauucuggcuagu

SEQ ID NO: 311723 - RNA, 64 nt, Human
uaaucucauucaugauguugauuuuuuuucaauguggugcaauauauacaauaaaauuugucau

SEQ ID NO: 311724 - RNA, 64 nt, Human
guauucuugaaaacugcuguagcaaauucaucuguggugcaauacacuuuuugauuaaagcucu

SEQ ID NO: 311725 - RNA, 64 nt, Human
uucgagacacucugucacccaggcuggagugcaauggugcaaucucggcucacugcgaccucug

SEQ ID NO: 311726 - RNA, 64 nt, Human
cugucaucacaccagcguacaguagcuaaauuuuuggugcaauuauagcaaaugauaauguucc

SEQ ID NO: 311727 - RNA, 64 nt, Human
agacccguucagacacugcguugcgggcuccuuccccgcagaggccggggccucccugacuuug

SEQ ID NO: 311728 - RNA, 64 nt, Human
gugccaguagccuaggugucucaggccccugggccccgcagauggccauuuccggugccugccc

SEQ ID NO: 311729 - RNA, 64 nt, Human
ccagugugaaguuucuggcauagaguccuggcuucccgcagacgacuuucacacucugccaugu

SEQ ID NO: 311730 - RNA, 64 nt, Human
aagcgcugagcugagggacgaggaagagcuggagcccgcagaagccguccacagcccugccuca

SEQ ID NO: 311731 - RNA, 64 nt, Human
auaggaagcccacaaccgcuaacacuuacaauuuuggugcaaaagcaaacaguuccagcaggcu

SEQ ID NO: 311732 - RNA, 64 nt, Human
agaaaaacucauuguaacuuauuaaaauaauaucuggugcaaaguaucuguuuugagcuuuuga

SEQ ID NO: 311733 - RNA, 64 nt, Human
cucauuucuuuccuacacuuaaauaccucguguauggugcaaucagaccacaaaaucagaagcu

SEQ ID NO: 311734 - RNA, 64 nt, Human
gcaacaaaacgugggaaccuggugacuaagggccuggugcaaggacuugggaaaugucauugau

SEQ ID NO: 311735 - RNA, 64 nt, Human
ggagcuguugcccaaaaaaauggaucuguugcaguggugcaaucugggcucacugaaaccacca

SEQ ID NO: 311736 - RNA, 64 nt, Human
guguaguaucuguuuuauuugacugcagucuccuuggugcaaaaacaaaaugggaaaaauaagg

SEQ ID NO: 311737 - RNA, 64 nt, Human
uuaauucaguccaaaaugaaauuauagggcaguuuggugcaauuuauguuaaaugccauuugaa

SEQ ID NO: 311738 - RNA, 64 nt, Human
ugguuacacaguugaccucugccuggcucccccuuggugcaacuccugccuccaucccccuugc

SEQ ID NO: 311739 - RNA, 64 nt, Human
cggagucuuguucuguugccaggcuggagugcgguggugcaaucucagcucacugcaaucucca

SEQ ID NO: 311740 - RNA, 64 nt, Human
ucugacuuucauggaaguguugcugaggucagccuggugcaaguugggauacaaaugaaacuua

SEQ ID NO: 311741 - RNA, 64 nt, Human
uguggcacugucuuugaugcagugauguacuuaauggugcaauaaagcugcuucgauuugguuu

SEQ ID NO: 311742 - RNA, 64 nt, Human
cuccuaggagugguccaaaggccuucagccuagauggugcaaagcuggggccagccugucuuca

SEQ ID NO: 311743 - RNA, 64 nt, Human
aagacugaaagcuuugaugaaauuuguuuuuguauggugcaauaugacagccugucauugaauc

SEQ ID NO: 311744 - RNA, 64 nt, Human
ugacaggaaggaaggguguggggucagcagggacuggugcaaauggguccagaauuuucaaauc

SEQ ID NO: 311745 - RNA, 64 nt, Human
aacggaauaguguggggugugugcagggcugcaucccgcagauggcuggaauauuaaaauucuu

SEQ ID NO: 311746 - RNA, 64 nt, Human
gauccuggccugagaauugaggggagguggccagcccgcagagguggggugcuggggcugcaug

SEQ ID NO: 311747 - RNA, 64 nt, Human
cccugggucgcagacgaggucggccucgucauuccccgcagaccgccgcgcgucccucuugugc

SEQ ID NO: 311748 - RNA, 64 nt, Human
cuuuaucuuccgaggccaccguuuaacaggaguccccgcagauggguucugcccuguggaguau

SEQ ID NO: 311749 - RNA, 64 nt, Human
uaaacucaguuauuuuuaaugcuuaauacauacauggugcaaaauuuaaaaagcgcaaauaggu

SEQ ID NO: 311750 - RNA, 64 nt, Human
ggagucucacucugucacccaggcuggagugcuguggugcaaucucggcucacugcaaccucug

SEQ ID NO: 311751 - RNA, 64 nt, Human
gggaaccccuucuuuguagaacugcccauuuccauggugcaaaaacucuuauggccaaauucaa

SEQ ID NO: 311752 - RNA, 64 nt, Human
gugaaaacugaaggaaauguuaaagguuuuuuaauggugcaagugaaggugccaguugcuauuu

SEQ ID NO: 311753 - RNA, 53 nt, Human
aaagagaaggggcuuugugaacauggugcaaggccaggaauuuugggagcaaa

SEQ ID NO: 311754 - RNA, 64 nt, Human
aaaagacaaaacaaaaaaccaacucugacuuuucuggugcaacaguggagaaucuuaccauugg

SEQ ID NO: 311755 - RNA, 64 nt, Human
ggacucaggagcuaauacugucuacaguggagcuuggugcaauuagaagcaaaagacuguaccu

SEQ ID NO: 311756 - RNA, 64 nt, Human
ccucagaaaucccuuggccuccagagauuaaacauggugcaauggcaccucuguccaaccuccu

SEQ ID NO: 311757 - RNA, 64 nt, Human
uuuguuuguuugagaugcagagucuagagugcaguggugcaagcucagcuuacuguaaccucug

SEQ ID NO: 311758 - RNA, 64 nt, Human
acaguuucacugugucgcccaggcuggcguucaguggugcaaucucagcucacugcaaacucug

SEQ ID NO: 311759 - RNA, 64 nt, Human
uuagagacagggacuguauaaacaagccuaacauuggugcaaagauugccucuugaauuaaaaa

SEQ ID NO: 311760 - RNA, 64 nt, Human
agauucucacucugucucccaggcuagagugcaguggugcaaucucagcucacugcagccucaa

SEQ ID NO: 311761 - RNA, 64 nt, Human
cuucuccuuuggacauggaaagaaaaguuauugcuggugcaaagauagauggcugaacaucagg

SEQ ID NO: 311762 - RNA, 64 nt, Human
uuuaagauauauguauauaaaguguaugcuguauuggugcaauaaugguaauuaaaaauaugaa

SEQ ID NO: 311763 - RNA, 64 nt, Human
aucagguggccuggcuguuucuuuggaucccucugucccagagccacccagaacccugacucuu

SEQ ID NO: 311764 - RNA, 64 nt, Human
gcaacccuuauggagaaacuugcaaccaggaccugucccagagugaugcuucuccugccccuuu

SEQ ID NO: 311765 - RNA, 64 nt, Human
accaguuaucuuuaagaacggucagcucaggggcuggugcaaaggaugaacugcacauuguuga

SEQ ID NO: 311766 - RNA, 64 nt, Human
gcaugccccugagugugaacagguuugccuacguuggugcaagugugcauggcuggggacuucu

SEQ ID NO: 311767 - RNA, 64 nt, Human
guggccaaauguaaacuaaaagccuuaauuaaaguggugcaauuuuguauaacuuagcaucagu

SEQ ID NO: 311768 - RNA, 64 nt, Human
ucuaugggagccuuauuucagaaauauuucaaacuggugcaaauggaaaagacuuucucuuuuc

SEQ ID NO: 311769 - RNA, 64 nt, Human
ggagucucacuuugucacucaggcucaagugcaguggugcaaucucugcucacugcaacaucug

SEQ ID NO: 311770 - RNA, 64 nt, Human
uggaguuucucuugucaaccgggcuggagugcaguggugcaaucuuggcucacugcaaccucca

SEQ ID NO: 311771 - RNA, 64 nt, Human
cuccaguaacugcugucgcucccauauuuaucccuggugcaagugcugucagcccugugugguc

SEQ ID NO: 311772 - RNA, 64 nt, Human
ggggucuggcuguguugcccugacuggaguucaguggugcaaacacagcucucuccacaaccuc

SEQ ID NO: 311773 - RNA, 64 nt, Human
uuggaguucaugccuggagugguucaacagucucuggugcaagucuaauaagagaucaggcaua

SEQ ID NO: 311774 - RNA, 64 nt, Human
ccacaucccccuucccugucugugucucaauaaauggugcaacugcagcuagcugucuguggcu

SEQ ID NO: 311775 - RNA, 64 nt, Human
agggucucacucuguugcccaggcuagagugcaauggugcaaucacagcucacugcagccucaa

SEQ ID NO: 311776 - RNA, 64 nt, Human
auaagucugcuuuucagggauucucugcuggugcuggugcaaggacuucuguuccaaaggcugg

SEQ ID NO: 311777 - RNA, 64 nt, Human
aagguauuauaauaauauauugguguaauuuaauuggugcaacaugcuuuauggcuccugucaa

SEQ ID NO: 311778 - RNA, 64 nt, Human
cucaccugaaaacaccuguucccaaccuacuucuuggugcaaguugaccaaaucguuuuaagug

SEQ ID NO: 311779 - RNA, 64 nt, Human
cccuggcaccaugcacggccagcaagaaucaaggcccgcagaugcuaagagggccuauugucag

SEQ ID NO: 311780 - RNA, 64 nt, Human
auuacaagccuuuuuaagauaugaaauaugccuacccgcagagcuuggcacaaaguggagucaa

SEQ ID NO: 311781 - RNA, 64 nt, Human
gcggcguggaccgagggucccagccugcaggcuccccgcagagagcacaggaagaggcaggggc

SEQ ID NO: 311782 - RNA, 64 nt, Human
ccccaggugccccccucaccuugaugggugcguucccgcagaccaaagagagugugacucccuu

SEQ ID NO: 311783 - RNA, 64 nt, Human
aaaaaaaaaaaaaaaaaagacggauccuuuuuuuuggugcaaaugggugacuuagugcauugau

SEQ ID NO: 311784 - RNA, 64 nt, Human
gucuugugauuguuaaaacuuguuuguaauggguuggugcaaaaguaauugugguuuuuccauu

SEQ ID NO: 311785 - RNA, 64 nt, Human
gucgcugauguacacacauuucauuauuugccaauggugcaauaaccacugcugaccaacccac

SEQ ID NO: 311786 - RNA, 64 nt, Human
ugaggucaggaguuugagaccagccgggccaacauggugcaaccucgucuuuacuaaaaauaca

SEQ ID NO: 311787 - RNA, 64 nt, Human
aacuuagaucuccaggagaacugccauccagcuuuggugcaauggcugagugcacaagugaguu

SEQ ID NO: 311788 - RNA, 64 nt, Human
ugcagauauucuagcauauugucagaaggaaggauggugcaaauuagcuuuuuaucuucuagca

SEQ ID NO: 311789 - RNA, 64 nt, Human
uuuuaauuuggagugggcaaaguaaccucuugcuuggugcaacuauuuguuucaaauaaaaaca

SEQ ID NO: 311790 - RNA, 64 nt, Human
agggaccuugacagaagagagcccugggugcuuguggugcaaagaucuucaugcccaguuccaa

SEQ ID NO: 311791 - RNA, 64 nt, Human
ggcuuaacagaaacagucuguaaaaaccuaacaguggugcaaucauguugucuguguuguguua

SEQ ID NO: 311792 - RNA, 64 nt, Human
auggagucauuuuuacaauguaauuauuuauguauggugcaauguguguauauggacaaaacaa

SEQ ID NO: 311793 - RNA, 64 nt, Human
aauucuguuuaaacugugauuuucuuuauuguguuggugcaauauuuuauuaucauuuaaccuc

SEQ ID NO: 311794 - RNA, 64 nt, Human
agaaguuuaugcaacuuaaaauguuuacacacuguggugcaaucuacuguuugugaaugucugu

SEQ ID NO: 311795 - RNA, 64 nt, Human
ucucaucacacucugucacccaggccaaguucaauggugcaaucuggcucacugcauccucaac

SEQ ID NO: 311796 - RNA, 64 nt, Human
ggagucuugcucugucacccaggcuggagugcuguggugcaaucucggcucacugcaaccucug

SEQ ID NO: 311797 - RNA, 64 nt, Human
guuguuuagcuuaccuuucugcuaggauuggcuucccgcagagggcagggcccauccuaagcag

SEQ ID NO: 311798 - RNA, 64 nt, Human
augcgcuuguuggcgcgacuguggcucgagcuggcccgcagacacguggguuucaucacucuga

SEQ ID NO: 311799 - RNA, 64 nt, Human
ccccacgccucggggcccccgccgccccuccggacccgcagagcuggggacauggcaugcccug

SEQ ID NO: 311800 - RNA, 64 nt, Human
ggugagcuagcccuuagagaaggcugucccggggcccgcagaggugcccuuacugaggugacag

SEQ ID NO: 311801 - RNA, 64 nt, Human
agccgcgacccaucgcacaccugcacuccaguccuggugcaacagauggagauccuuucaggga

SEQ ID NO: 311802 - RNA, 64 nt, Human
agagccuuguucugucaccuaggcuggaaugcaguggugcaaucauagcucacugcagccuuga

SEQ ID NO: 311803 - RNA, 64 nt, Human
uaucguaaauuuagauucuggaauugggguuugguggugcaauguguugcucacaaguggccag

SEQ ID NO: 311804 - RNA, 64 nt, Human
gugcugagccgaagggacggugggagggggguuauggugcaaguguugggggggagaaugggga

SEQ ID NO: 311805 - RNA, 64 nt, Human
cuuucucucuggaauggaaccuucuuaggccuccuggugcaacuuaauuuuuuuuuuuaaugcu

SEQ ID NO: 311806 - RNA, 64 nt, Human
agggucucauucuaucggccaggcuggagugcaguggugcaaucacagcucacugcagccuugu

SEQ ID NO: 311807 - RNA, 64 nt, Human
aaguuuugcucuugucacccaggcuggagugcaguggugcaaucuuggcucgcaaccuccgccu

SEQ ID NO: 311808 - RNA, 64 nt, Human
ggagucuuguucuguugcccaggcuggagugcaauggugcaaucuuggcucacugcaaccucug

SEQ ID NO: 311809 - RNA, 64 nt, Human
cucuccuuggcaggacaugggcaaacaugcugauuggugcaaauguggugccgagcuguccaua

SEQ ID NO: 311810 - RNA, 64 nt, Human
cuagaaacacuucugaugcaugaaaaaugugugauggugcaaggaauggauucaggauguuguu

SEQ ID NO: 311811 - RNA, 64 nt, Human
gaguuucgcucuuguugcccaggcuggagugcaauggugcaaucucagcucacugcaacuuccg

SEQ ID NO: 311812 - RNA, 64 nt, Human
ugaaagaaacaaacauugaauuacuaaacaaagauggugcaauaucuuuguuuuuuuuuuauga

SEQ ID NO: 311813 - RNA, 64 nt, Human
ugcuguguccacucaggguuaaauggauuaaggguggugcaagaugugcuuuguuaaacagaug

SEQ ID NO: 311814 - RNA, 64 nt, Human
agguacuuugaccucuuucuaaagccgcagacccuggugcaaugcucugguggcuagggaugua

SEQ ID NO: 311815 - RNA, 64 nt, Human
gcagagcuggcugcuggacgcaccgugcucgcugcccgcagaagcggcacugugcuggcgggcu

SEQ ID NO: 311816 - RNA, 64 nt, Human
cugagacucuguuuaucacuagccuucugucccucccgcagaagacuguuggauugaacaaaau

SEQ ID NO: 311817 - RNA, 64 nt, Human
aagcagguggugguggaaauuccagcaggugggucccgcagaggcccugaggccucacuuuucg

SEQ ID NO: 311818 - RNA, 64 nt, Human
ugagacuccccgcccgcccuccucugcccccucccccgcagacagacagacagacggacgggac

SEQ ID NO: 311819 - RNA, 64 nt, Human
gaaaaauaaacguggauuuuaaaaaaucaaucaauggugcaaaaaaaaacuuaaagcaaaauag

SEQ ID NO: 311820 - RNA, 64 nt, Human
uucucuugauguaaugaaaugcaauuuuaugguuuggugcaaaaacuccuauuuuccaguaaau

SEQ ID NO: 311821 - RNA, 64 nt, Human
cuuuacccaauauauauucuggagguagguauacuggugcaacccauuugccagcugugugacu

SEQ ID NO: 311822 - RNA, 64 nt, Human
ucaauguugcucagugggugagauccagacccacuggugcaaugucuuaaauacacaugacugu

SEQ ID NO: 311823 - RNA, 64 nt, Human
aagaugaggcaucgugccucacauccgcuccacauggugcaagagccucuagcggcuuccaguu

SEQ ID NO: 311824 - RNA, 63 nt, Human
aauaauauaccaaggucuaauaaauuuuaacuauuggugcaacaaacauaucuuuuuuuuuuc

SEQ ID NO: 311825 - RNA, 64 nt, Human
caggcgguaggaaccccggcccucgcucugcagcuggugcaaaagcuguggcugccaggucugg

SEQ ID NO: 311826 - RNA, 64 nt, Human
gaggucacaagaugaugauugcguagauguugccuggugcaaagugccccaaacagcaauagaa

SEQ ID NO: 311827 - RNA, 64 nt, Human
uccccaaguucauuguuaacuuugcauuugcaauuggugcaaaaauacagauuucugucgucug

SEQ ID NO: 311828 - RNA, 64 nt, Human
gccaacuuuguuagcugcgugcgugcuuugggguuggugcaaccucaguacacgcauuugucuu

SEQ ID NO: 311829 - RNA, 64 nt, Human
uaugucaggcuguguauugugacuaucagcauucuggugcaaaugaacuuuucuccaucaucga

SEQ ID NO: 311830 - RNA, 64 nt, Human
caucuugggaaugaaugcccagccgcucguggguuggugcaaagaaguauaaacauauaucacu

SEQ ID NO: 311831 - RNA, 64 nt, Human
ccuuuuucuaacuuaauggacauuuuguugguguuggugcaagggcaauaggauguaaauuugu

SEQ ID NO: 311832 - RNA, 64 nt, Human
aaauaauaaaacagaguguuauauauauauuuuuuggugcaagauaagauuuucuguuuuuuga

SEQ ID NO: 311833 - RNA, 64 nt, Human
ugaagucacgccuuggcccugacauccccacaugcccgcagagauccucuuugagugucugucu

SEQ ID NO: 311834 - RNA, 64 nt, Human
uccugcccauauauuauaccaguugcuucugcagcccgcagaugccagcgaugccaggaaacaa

SEQ ID NO: 311835 - RNA, 64 nt, Human
ggaucaugucccauccaguccagugaauccacgacccgcagaccuguccccccgcaacagcuua

SEQ ID NO: 311836 - RNA, 64 nt, Human
uggcaugccccccagcuacuguaugcccccgacccccgcagaggcagaaugaacccauagggag

SEQ ID NO: 311837 - RNA, 64 nt, Human
aaagccagugguuccugggaacgcucuuguugcuuggugcaacagaagcacaaaaaucaauaaa

SEQ ID NO: 311838 - RNA, 64 nt, Human
gcuguggaguuuccacggcgacacacagccucaguggugcaagauuuaaaauuaccuuccuuuu

SEQ ID NO: 311839 - RNA, 64 nt, Human
acgaaacuuccaauggacaccagaaccuuuaacuuggugcaaaguugagccuuugaauucugca

SEQ ID NO: 311840 - RNA, 64 nt, Human
aagcucucgcucugucacccaggcuggagugcaguggugcaaucaugguucacugcagucuuga

SEQ ID NO: 311841 - RNA, 64 nt, Human
cacgauccuccuugacgaguuuuguuuuucaaaauggugcaauaauuuaaguggcaucuucucu

SEQ ID NO: 311842 - RNA, 64 nt, Human
gauggagucucacugucaccaggcuggagugcaguggugcaaucucgguucacugcaaccucca

SEQ ID NO: 311843 - RNA, 64 nt, Human
agcgucucacucugucgcccaggcuggaguacgguggugcaaucucagcucacugcagccucug

SEQ ID NO: 311844 - RNA, 64 nt, Human
uaagccuugcucugucucccaggcuggagugcuauggugcaauuuuuguucacugcaaccucug

SEQ ID NO: 311845 - RNA, 64 nt, Human
agagucucacugugucacccaggcuggagugcaguggugcaaucucgccucacugcaaccuuca

SEQ ID NO: 311846 - RNA, 58 nt, Human
auguuggagaaaaaccuuagugaugugauggugcaauaaagucuucacucagucuuca

SEQ ID NO: 311847 - RNA, 64 nt, Human
gagcgcagacaccgugugaggggacagcagcccuuggugcaaagccagagacugauccuggcuc

SEQ ID NO: 311848 - RNA, 64 nt, Human
agccccuggggucgugguuugacauuugucugccuggugcaaacaaggaauccuugccuuuaag

SEQ ID NO: 311849 - RNA, 64 nt, Human
agacccuugcucugucaccuaggcugaagugcgguggugcaaucauggcucacugcagccucaa

SEQ ID NO: 311850 - RNA, 64 nt, Human
gggaaucggccacaccugguguccaugggcagccuggugcaauuccauucauuuguacagaaac

SEQ ID NO: 311851 - RNA, 64 nt, Human
ugagcauccugguguuccuuacaggaaacauucuuggugcaagaggaacaaagaaagggacucc

SEQ ID NO: 311852 - RNA, 64 nt, Human
gagucucacucuuguugcccaagcuggagugcaguggugcaaugugggcucacugcaaccucug

SEQ ID NO: 311853 - RNA, 64 nt, Human
uuuuuuuuugagacacacccaggcuggaguccaguggugcaaucuuggcucacugcaaccuccg

SEQ ID NO: 311854 - RNA, 64 nt, Human
agggucugacucuguccuccaggccagaguccaguggugcaaucucagcucacuguagccucaa

SEQ ID NO: 311855 - RNA, 64 nt, Human
ggagucucauucugucacccaggcuggagugcaguggugcaaucuuggcucacugcaacuuggg

SEQ ID NO: 311856 - RNA, 64 nt, Human
aggguuucacucugucacccaggcuggagugcaguggugcaaucacuguuuauugcagccgcga

SEQ ID NO: 311857 - RNA, 64 nt, Human
gauagcccuagcccuagauagauagcuauuagguuggugcaaaaguaauugugguuuuugccau

SEQ ID NO: 311858 - RNA, 64 nt, Human
ucuuccaucccagcccugucagugagcccaggucuggugcaacugcugcaggaugccuguagua

SEQ ID NO: 311859 - RNA, 64 nt, Human
uauuauaaguuuuuauauuuucuacuuguucauuuggugcaaacucaagauuucuuuuaauagg

SEQ ID NO: 311860 - RNA, 64 nt, Human
ugugcgacccuuucugucuuauuuuaccaaaagauggugcaaaucuaugaccuucacauuuuuu

SEQ ID NO: 311861 - RNA, 64 nt, Human
aggguuggucucuguugcccaagcuugagggcaguggugcaaucauaacucauugcagccucga

SEQ ID NO: 311862 - RNA, 64 nt, Human
aacgguuccuuaauggcacuuuaaccaguuaacuuggugcaaaacuuuugauucucuuuuguag

SEQ ID NO: 311863 - RNA, 64 nt, Human
guuuguggcugggggcaggagggcccuaccugauuggugcaacccuuaccccuuagccucccug

SEQ ID NO: 311864 - RNA, 64 nt, Human
uauuucaaacagaucuuugaaaccucagauucuguggugcaauuuuaauguuuucuuguuucuc

SEQ ID NO: 311865 - RNA, 64 nt, Human
ggaaaaacuucaagaagaaaagaaucgucacgaccccgcagacuguccuccggauaaacagcau

SEQ ID NO: 311866 - RNA, 64 nt, Human
aagcaaagaggcucuuuagaggcagcgggggaggcccgcagagcgcgccccuagccgguuccug

SEQ ID NO: 311867 - RNA, 64 nt, Human
ucugucuugcugccggccuugauaccaccccucacccgcagagucacugcauucccucccagcc

SEQ ID NO: 311868 - RNA, 64 nt, Human
acuuccaugcugagugaugcucagggaagugaugcccgcagaaggcgucugggccuaaggaucc

SEQ ID NO: 311869 - RNA, 64 nt, Human
cuuuugagaugaagucgcccgggcugcaguucaguggugcaaucucagcucacugcaagcucug

SEQ ID NO: 311870 - RNA, 64 nt, Human
aagaaugcuucccuaggaaaaaggucgcuggcuuuggugcaagaggaagaagaauguuccacug

SEQ ID NO: 311871 - RNA, 64 nt, Human
gaguuuugcucuuguugcccaggcuggagggcaauggugcaaucucagcucacugcaaccucca

SEQ ID NO: 311872 - RNA, 64 nt, Human
cuuaaauaauauguuguuauuugauacauuuuuguggugcaaguaauuaauguuauuauuugau

SEQ ID NO: 311873 - RNA, 64 nt, Human
ucagguggacccgggcugacauuucccugggagcuggugcaaggagaagcgucauuuuaaaugu

SEQ ID NO: 311874 - RNA, 64 nt, Human
agguggauauuaaaaaucuguaaaucaggacagguggugcaaauggcgcugggagguguacacg

SEQ ID NO: 311875 - RNA, 64 nt, Human
agagucuugcucuguugcccaggcuagagugcaguggugcaaucucaguucacugcaaccucug

SEQ ID NO: 311876 - RNA, 64 nt, Human
agaaaggcuaguuuuagcuuccuuuguggcucccuggugcaaaacaauuagcaguuaugcaaug

SEQ ID NO: 311877 - RNA, 64 nt, Human
guggcucucuguugugagaucuucagcuaccucauggugcaauaacacacacacgcuuaaccau

SEQ ID NO: 311878 - RNA, 64 nt, Human
ucguuuucuuucccuuuucucugguggccuguuguggugcaacgagcugauggcauuugaucuu

SEQ ID NO: 311879 - RNA, 60 nt, Human
cuggccugcagcucuucugauggccaucccuggugcaaguguucauccagccgugccagg

SEQ ID NO: 311880 - RNA, 64 nt, Human
aaauagauuccugcuccauggaguucaugcaaccuggugcaagacaaguuggaaguuccuaagu

SEQ ID NO: 311881 - RNA, 64 nt, Human
ccuuuuccacccugggccccaaugccguccuuuccccgcagagacuggucuuggaaacccucag

SEQ ID NO: 311882 - RNA, 64 nt, Human
acccuuaccgguggcucuuccugccugggacccucccgcagagucccacuagccagcggccuca

SEQ ID NO: 311883 - RNA, 64 nt, Human
ccagagcagccaggcuggggccccucugucucaacccgcagacccuugacugaaugagagaggc

SEQ ID NO: 311884 - RNA, 64 nt, Human
agcuggcauggucagguaacacuaguggcccagccccgcagacccacaagcccuacccgugcug

SEQ ID NO: 311885 - RNA, 64 nt, Human
ugggacaugaggggcagcuagacuucacccccuucccgcagaccugccuccagagcaaggagaa

SEQ ID NO: 311886 - RNA, 64 nt, Human
uguauguuuguguacacacacgugcccaucugcugucccagaggggagggguugugugugcgag

SEQ ID NO: 311887 - RNA, 64 nt, Human
caugcggaaguccaccgaaggguuagaacagggugucccagacucucucuucugagggaagguu

SEQ ID NO: 311888 - RNA, 64 nt, Human
ugccauauucauaggguguccaugcacacauggugucccagaucuaggcaggccuaggauggug

SEQ ID NO: 311889 - RNA, 64 nt, Human
guacccugaugcuguauaauguauguugaauguggucccagauuauuucuguaagaagacacuc

SEQ ID NO: 311890 - RNA, 64 nt, Human
guuggcauuucaguuaaaagaaaaaaagaaacuagucccagauuugaaaacuuguaauaaaauu

SEQ ID NO: 311891 - RNA, 64 nt, Human
guccugccagcugccuuccucauccccucguccugucccagagguuaucugccuggccuggcuc

SEQ ID NO: 311892 - RNA, 64 nt, Human
agcagcuuucugguucuugugauuguauccugaggucccagaacccuauucucccacgaggauc

SEQ ID NO: 311893 - RNA, 64 nt, Human
cugagcugccggucuuggcuuccuggucgccucugucccagagauggucccagggagccauccu

SEQ ID NO: 311894 - RNA, 64 nt, Human
gaggggucuuggcacucucuucuuacuuaaaccagucccagacaccuagacacggaccccuuuu

SEQ ID NO: 311895 - RNA, 64 nt, Human
ucugguuacugccuggccgauccaaggcuguggagucccagagccagcaguucacuggugcuca

SEQ ID NO: 311896 - RNA, 64 nt, Human
ccaaucuuauugcaacaacucugugaauugcaaggucccagaaucugccuucucacauacucua

SEQ ID NO: 311897 - RNA, 64 nt, Human
gggcuugucugaaaagccacucuggaccuagccugucccagaagaggagaaugcacaaguguaa

SEQ ID NO: 311898 - RNA, 64 nt, Human
uggguuucaggaggagggagacugcccugcuuuggucccagagaggcccucugcagauaggcgu

SEQ ID NO: 311899 - RNA, 64 nt, Human
ggacucucugccugcuuccuggaccggggccuuggucccagacagcuggacccauuugccagga

SEQ ID NO: 311900 - RNA, 64 nt, Human
ggguuccgugacuccagugggccagugguagccugucccagacaacuccgucaccccagcucug

SEQ ID NO: 311901 - RNA, 64 nt, Human
caggggauggggugggguaccggauuucgguaucgucccagacccaagugagucacgcuuccug

SEQ ID NO: 311902 - RNA, 64 nt, Human
agcauuccauugacugccuguauggaacacauuugucccagaucugagcauucuaggccuguuu

SEQ ID NO: 311903 - RNA, 64 nt, Human
cauggcugggcucauuucggucccuuucuccuuggucccagaccuugggggaaaggaaggaagu

SEQ ID NO: 311904 - RNA, 64 nt, Human
uuucucaucuuuccuuuucuaaccuaaugagaaugucccagauucaauuaccuggaugucaaag

SEQ ID NO: 311905 - RNA, 64 nt, Human
cacagacccuucucuggcucccaaaaggaguucagucccagagggguggucaccccacccuuca

SEQ ID NO: 311906 - RNA, 64 nt, Human
auuaacagaccucccuacagcuguaggaacuacugucccagagcugaggcaaggggauuucuca

SEQ ID NO: 311907 - RNA, 64 nt, Human
cacacuuaaaaggcuuaauguuucucuggaaagcgucccagaauauuagccaguuuucugucac

SEQ ID NO: 311908 - RNA, 64 nt, Human
ccagggcaggaugccaccugcuacacucuugccugucccagagcccuugggagaccagcuguug

SEQ ID NO: 311909 - RNA, 64 nt, Human
gcagggcugaggaugaagaugcagccccuggauggucccagacucucaggacaugcccagcuca

SEQ ID NO: 311910 - RNA, 64 nt, Human
ucugggcaucuguggauuuuuggcuacuagaagugucccagaagucacuguauuuuugaaacuu

SEQ ID NO: 311911 - RNA, 64 nt, Human
cgccccuuccucaucucuggaauuuggccaggcagucccagaagacucuggagugaccuccuuu

SEQ ID NO: 311912 - RNA, 64 nt, Human
acugugcuggccugcuguacaagcuucaaaaagugucccagagcccacacggcucggugucaga

SEQ ID NO: 311913 - RNA, 64 nt, Human
cuuccccccucauuugcucucuucccuaaaaugugucccagaugccuucauuugcuguuuuacu

SEQ ID NO: 311914 - RNA, 64 nt, Human
cggccccgggaggaucucaauaaagaacucgagcgucccagacccguaucuccuuucgcugccc

SEQ ID NO: 311915 - RNA, 64 nt, Human
uuccaccuggcagcugaaggcagccagucagucugucccagaaagggcccuuuucagcacccaa

SEQ ID NO: 311916 - RNA, 64 nt, Human
uucccauggucacaggaugcacugucagcaucaggucccagagggccaccguguccauuacagc

SEQ ID NO: 311917 - RNA, 64 nt, Human
ccucagaucaaugcagucagaaccugggaaguaggucccagacaucaggaccuuuuuaaagcuc

SEQ ID NO: 311918 - RNA, 64 nt, Human
cucagauuucuggauauuuuggugguagcuucuagucccagaaucuguguuuuuaaaauacuac

SEQ ID NO: 311919 - RNA, 64 nt, Human
auaaaugaguuagaagggccagauuucauucucagucccagagcauugcuauuuaucucaaaaa

SEQ ID NO: 311920 - RNA, 64 nt, Human
aaaaaacuagcuggcaugguagcacacaccuguagucccagauacuugggaggccaaggcagga

SEQ ID NO: 311921 - RNA, 64 nt, Human
ucaacuggucagaaacacagauuguauucuaugagucccagaagaugaaaaaaauuuuauacgu

SEQ ID NO: 311922 - RNA, 64 nt, Human
agcuaacacuauauauguaaaguuuccaguacuagucccagaauuuagaauaugcucaacacaa

SEQ ID NO: 311923 - RNA, 64 nt, Human
ucugugagagcgcgggagugcauggcagcucugggucccagaccuggcccgaccccucugcuuc

SEQ ID NO: 311924 - RNA, 64 nt, Human
ggccuggcgaugugggcauccugggguucuuagggucccagaacaagccccaggcaagcuggaa

SEQ ID NO: 311925 - RNA, 64 nt, Human
cgaguuccaccccaucggcuuccauaucuuccaggucccagaggguggaaggagccaggacgca

SEQ ID NO: 311926 - RNA, 64 nt, Human
ccaccgccugacccuguguaaccugcugucccgggucccagagugcacucugccccgcugcucu

SEQ ID NO: 311927 - RNA, 64 nt, Human
agguuuguuuugugaauuuucuaaaagcuuucaugucccagaacuuagccuuuaccugugaagu

SEQ ID NO: 311928 - RNA, 64 nt, Human
guucguuugcucuucugggaagagaaguucaggggucccagaaagggacagggaaauaaauggu

SEQ ID NO: 311929 - RNA, 64 nt, Human
uauuccuaugccagagcagugccaacucuuggaggucccagagugcagccaaugccuuugugug

SEQ ID NO: 311930 - RNA, 64 nt, Human
uuuucacagugugcuccagauggugcuagaggaagucccagagccuguaaggugagagaaacug

SEQ ID NO: 311931 - RNA, 64 nt, Human
ucuggguggauggggcaggaggggcugagggccugucccagacaauaaaggugcccucagcgga

SEQ ID NO: 311932 - RNA, 64 nt, Human
aacucacuaugcuaggaauagacugugugcaccagucccagacacuuggcagaaguguagcagc

SEQ ID NO: 311933 - RNA, 64 nt, Human
ggaaauagugauuuccacagugacuccacucugagucccagagccaaucaguagccagcaucug

SEQ ID NO: 311934 - RNA, 64 nt, Human
uggcaguagccuuggggcagagggcacccgcagagucccagagaugaugugggcagugggcaga

SEQ ID NO: 311935 - RNA, 64 nt, Human
aguccagugucugucaugccccugaguucuuuuggucccagagaggcagccugggcagucuguu

SEQ ID NO: 311936 - RNA, 64 nt, Human
agagauuucuuauugaggccaagagauguuuccugucccagaggaaccauuaggagucgcuuuu

SEQ ID NO: 311937 - RNA, 64 nt, Human
uggagagaaugucaaaaguggcauuucagaccccgucccagaugggucugaggaaaggaaggcu

SEQ ID NO: 311938 - RNA, 64 nt, Human
cugguuuucggccuuucuugagaaagcaaagugggucccagacauugaagaaaagcauuuuuau

SEQ ID NO: 311939 - RNA, 64 nt, Human
aaaauccccaaauccauuaaaagugacuucagaggucccagauagggaccaacauuuguuuaaa

SEQ ID NO: 311940 - RNA, 64 nt, Human
gaaaauuagccaagagugguggcacaugccuguagucccagauacuugggagugggcugagaug

SEQ ID NO: 311941 - RNA, 64 nt, Human
cauuuuaggauaccuuuacuuuaaggaccacacagucccagaggacacaucccucgggaacucu

SEQ ID NO: 311942 - RNA, 64 nt, Human
cugaugggagcugcuucucccccaugccucacuggucccagaucagggcuccagggacagauga

SEQ ID NO: 311943 - RNA, 64 nt, Human
gggauuuucugguauuuuggugacguuguacauugucccagacuguuuguaaacaugaggucag

SEQ ID NO: 311944 - RNA, 64 nt, Human
uuuucuuuguaauuuaugcuuucauauauccuuggucccagagauguuuagacaauuuuaggcu

SEQ ID NO: 311945 - RNA, 64 nt, Human
uuuuuuuuuauuuuuuuucugcugugacguuuuagucccagacugaauuccaaauuugcucuag

SEQ ID NO: 311946 - RNA, 64 nt, Human
auauaaaaaaaaggcuugucaauuaugaaggugugucccagauauuacaugaagaucaugcaaa

SEQ ID NO: 311947 - RNA, 64 nt, Human
auuugagaauaguuuucccuauucuguggauacagucccagaguuuucagggaguacacaggua

SEQ ID NO: 311948 - RNA, 64 nt, Human
aucucagcugugccggcgcuacgggacccgagccgucccagaaaccaaagggcaggcacggcag

SEQ ID NO: 311949 - RNA, 64 nt, Human
cagucacaacugccauuuccagucucugcugagugucccagacccucgaggcugccacuccguc

SEQ ID NO: 311950 - RNA, 64 nt, Human
ggugagcuuaaagaacaaccaaacucugccaggggucccagaaagcccaggguccagcagucuc

SEQ ID NO: 311951 - RNA, 64 nt, Human
uggggauguuguuccaaauccagacaacuggacugucccagacuugcagcaucagagucuccug

SEQ ID NO: 311952 - RNA, 64 nt, Human
guccuuacuuagaggagacagagaggccaaucaggucccagagcuugaaugcuaacaagcccag

SEQ ID NO: 311953 - RNA, 64 nt, Human
gcccuccaggauggcugguuuagucuggguccaugucccagaccccucuauucugcuccaggac

SEQ ID NO: 311954 - RNA, 64 nt, Human
gucuuggcacuggccaggcuuggguggagccugugucccagacagauccccuaggccuaucuga

SEQ ID NO: 311955 - RNA, 64 nt, Human
uccuaacaaguguaucucgauuaauaaccugccagucccagaucacacaucaucaucgaagucu

SEQ ID NO: 311956 - RNA, 64 nt, Human
auugcuguagagugacggcugcugcccagagcgugucccagacaucacagcggggcucagcagu

SEQ ID NO: 311957 - RNA, 64 nt, Human
uucuauguggaauagauccuguuuuuccaucugugucccagauugugacccuagacuuucaauu

SEQ ID NO: 311958 - RNA, 64 nt, Human
ucacugugcuuuucugagcuucuuacuccugugagucccagagcuaaagaaccuucuaggcaag

SEQ ID NO: 311959 - RNA, 64 nt, Human
gucaugggaagagcguagacagguguuacuuacagucccagauacacuaaaguuacaaacagac

SEQ ID NO: 311960 - RNA, 64 nt, Human
aagaagucaaggguggagccagagaaggaaggcagucccagaugagccucuauuuucaucagcu

SEQ ID NO: 311961 - RNA, 64 nt, Human
cccaggcuuucuccccuggaaaacuccagcuugagucccagauacacucaugggcugcccuggg

SEQ ID NO: 311962 - RNA, 64 nt, Human
caaacgugcauccucuugguuggcccccuugucagucccagacguccacuugcucuuccuuaug

SEQ ID NO: 311963 - RNA, 64 nt, Human
guuggauucugcuacagagaguaaucugauacaagucccagaguggaacuuuuaacucaggccu

SEQ ID NO: 311964 - RNA, 64 nt, Human
aaggcuguacacugcacgaauggaagaggcaccugucccagaaaaagcaucauggcuaucugug

SEQ ID NO: 311965 - RNA, 64 nt, Human
aaugauuacuagucaaauccgucagugaucccgagucccagaaaccaaaggcucuuuucagagc

SEQ ID NO: 311966 - RNA, 64 nt, Human
ccccuucuccccacaccugaucugcucucggcuggucccagagcggggugagggggcuuaugcc

SEQ ID NO: 311967 - RNA, 64 nt, Human
auuauucucaccaaaguuaugucaagccccauuggucccagaguagcugaagggaagccaaccc

SEQ ID NO: 311968 - RNA, 64 nt, Human
uucuguuuugaguuuugcccuggggcuugaaugagucccagagagucguucggauggugggagg

SEQ ID NO: 311969 - RNA, 64 nt, Human
ccugcugacuucccucuggauucuucugcaaccagucccagauauugugccauuuuauccaugg

SEQ ID NO: 311970 - RNA, 64 nt, Human
ggaaaaggguucuuggaggccaggggaauacggggucccagagaaagauuuccuucucuuagaa

SEQ ID NO: 311971 - RNA, 64 nt, Human
aagggaguuagggcuuaaacuauucugucuagaugucccagauaguucccauucuacuuggaga

SEQ ID NO: 311972 - RNA, 64 nt, Human
accuguaaggcccgggucugcggagagaggccuugucccagaggcugccccaccccuccccauu

SEQ ID NO: 311973 - RNA, 64 nt, Human
ccucuuggugccccgacccccaggguucgucuaggucccagagacccucugccuggaggcgggc

SEQ ID NO: 311974 - RNA, 64 nt, Human
ugccugaggugcuggguagcccauccuuuccucugucccagauucaaaugaggaguaagagccc

SEQ ID NO: 311975 - RNA, 64 nt, Human
uccaaaugucucuggugauguuccuaagacccuugucccagauacucuaaaugugaauguauga

SEQ ID NO: 311976 - RNA, 64 nt, Human
uccuuuaugaugacugcuuaacuccccacugccugucccagagaggcuuuccaauguagcucag

SEQ ID NO: 311977 - RNA, 64 nt, Human
gugacuccaccagccaucaugggugccagccagggucccagaaaugaggccauggcucacuguu

SEQ ID NO: 311978 - RNA, 64 nt, Human
auccucccaucgaugugccacgugggugucacgugucccagaugcaguauucggcagccagccg

SEQ ID NO: 311979 - RNA, 64 nt, Human
ccugguaugggagccaggaguccuggcaucauuagucccagauagcugcauuacucacuugcug

SEQ ID NO: 311980 - RNA, 64 nt, Human
uuugggcgucauucacccacuaccccuagugcuagucccagaggaugcugcggagggggcagcc

SEQ ID NO: 311981 - RNA, 64 nt, Human
gcuggcugggcuuccuguuuccagaugcauuccugucccagagucaccacagagacuguuugga

SEQ ID NO: 311982 - RNA, 64 nt, Human
aauauuuaccccugguuggaacaauauuugaaaugucccagauauuucuaugcuacuuagauau

SEQ ID NO: 311983 - RNA, 64 nt, Human
ugggcccaugcccagacuucugguuuaaggaauggucccagagcuugggccagcuugcucagaa

SEQ ID NO: 311984 - RNA, 64 nt, Human
uaauuuuggaguuuauuuuucaaaucauguucuugucccagaguucuuuagguuaacacuaggg

SEQ ID NO: 311985 - RNA, 64 nt, Human
gacccucagcugccuucuaggacaccugugcagggucccagacccaggccccagagcagcccag

SEQ ID NO: 311986 - RNA, 64 nt, Human
cagccauccucccuccaccucaagacccccauuugucccagacuaaaggauccagagagcagcu

SEQ ID NO: 311987 - RNA, 64 nt, Human
ucuuccugccuuucugcuaggugucagauagauggucccagagcuaggugcugugucaggcccu

SEQ ID NO: 311988 - RNA, 64 nt, Human
agucagcuuuagcucucaagagucguauguaacugucccagacuccucugucaguuucagcaac

SEQ ID NO: 311989 - RNA, 64 nt, Human
gccagaucaacucccccacccgucuucuuccucugucccagaauggaaaaugauguauggucag

SEQ ID NO: 311990 - RNA, 64 nt, Human
uuuauuagauucuccguuuuccagaaugccuuccgucccagauuucaaacuuggauuuugaacu

SEQ ID NO: 311991 - RNA, 64 nt, Human
gcucagcucaugacucacccauggcaggcggagggucccagaggggcugaguccucaaauccgg

SEQ ID NO: 311992 - RNA, 64 nt, Human
ggggacuugucuagaccagaaugaaagggacagggucccagacacguuuggggguccugauucu

SEQ ID NO: 311993 - RNA, 64 nt, Human
gaccacgagaagugaccuucagggucaucaggcugucccagagagguccgcguucuccccaccc

SEQ ID NO: 311994 - RNA, 64 nt, Human
caagcaaggcucuuaggggacacuguugagccuggucccagaaucugugaucuccacagggcca

SEQ ID NO: 311995 - RNA, 64 nt, Human
aaaaguuagccagguaugguggcauauacuuguggucccagauacuugggaggcugagauagga

SEQ ID NO: 311996 - RNA, 64 nt, Human
uggacgucuuuucucaaguugcuaagagugaucugucccagaaaagcggcccugcaaguuugag

SEQ ID NO: 311997 - RNA, 64 nt, Human
aggaucgucuuuaccugaggauuucuagccagaggucccagaugccugggcugagaacccagcg

SEQ ID NO: 311998 - RNA, 64 nt, Human
caaagucugagauggauugcauauacagugugcagucccagagccuccuaaaauucuagccauu

SEQ ID NO: 311999 - RNA, 64 nt, Human
cagaggcccugaggccucacuuuucggaucuucugucccagauccugcucccucccugcugagc

SEQ ID NO: 312000 - RNA, 64 nt, Human
gugucccaggccagagcagccucuuccucuccuggucccagaaaaacccuugcaguaaauggug

SEQ ID NO: 312001 - RNA, 64 nt, Human
gggggcucugcauagccaggaugacggcuuucaugucccagagaccuguugugcuguguauuuu

SEQ ID NO: 312002 - RNA, 64 nt, Human
aaaaccaauugaggguagugaauguaagaagacagucccagaaguaaacccucacugugaauca

SEQ ID NO: 312003 - RNA, 64 nt, Human
cugagagugaaggcugccaaugucagcuuuggaggucccagaagucuucuguucucuggccuca

SEQ ID NO: 312004 - RNA, 64 nt, Human
uuuauccucauucaacacaggcccagaaaauugugucccagaaggaugucaguaauugugacua

SEQ ID NO: 312005 - RNA, 64 nt, Human
cauuuucugaugcccaccgaggagccccagccccgucccagaggccgcugccccugaguucuga

SEQ ID NO: 312006 - RNA, 64 nt, Human
gauggacuccaaaugccucaaguuauguauaccugucccagauguaaacuucauuguccuuugu

SEQ ID NO: 312007 - RNA, 64 nt, Human
gugggguuguggagguugugggggcgguggggaggucccagaggugggaggccggcauccaggu

SEQ ID NO: 312008 - RNA, 64 nt, Human
cacucgaugucauccgugucgaugucauccgugugucccagacugucugcuguagaaaacacuu

SEQ ID NO: 312009 - RNA, 64 nt, Human
cucucugggagaggaggggccuggagggccaggagucccagacucacgcacccugggccacagg

SEQ ID NO: 312010 - RNA, 64 nt, Human
ucucguccucccgugccagcccccgcccgcccgugucccagaaugcacugcugaggagcaugcc

SEQ ID NO: 312011 - RNA, 64 nt, Human
gaugagaacaguaugaagaaagggggcuguuggagucccagaauugcugacagcagaggcuuug

SEQ ID NO: 312012 - RNA, 64 nt, Human
ugcggcuuaggcuucaucugcuugcacauugccugucccagagccccuguggguccacaagccc

SEQ ID NO: 312013 - RNA, 64 nt, Human
gaaagguggccccagcuguugacuuccagucacugucccagacggcacaagguuuucuguagga

SEQ ID NO: 312014 - RNA, 64 nt, Human
cucuauguauuuucuacugcaccugagcaggcaggucccagauuucuuaaggcuuuguuugacc

SEQ ID NO: 312015 - RNA, 64 nt, Human
aggaauguccaccaugaacuugauacguccgugugucccagaugcugucauuagucuauauggu

SEQ ID NO: 312016 - RNA, 64 nt, Human
cagccggacugcccucgccuuccgggugugcccugucccagaagauggaauggggguguggggg

SEQ ID NO: 312017 - RNA, 64 nt, Human
gagaguucugaccuggauggcccauagaccugacgucccagaauccaugcuucucaucugcaaa

SEQ ID NO: 312018 - RNA, 64 nt, Human
gcagcaaugccguucagugacugcacagagccgugucccagacacgcugucagugccuucaaca

SEQ ID NO: 312019 - RNA, 64 nt, Human
gucggccgguucccugcauucguuuuacuuuggugucccagaaacacgcgagugugcaauguuu

SEQ ID NO: 312020 - RNA, 64 nt, Human
aucgagucuaaagacaugaauucucaccacuaaagucccagauagcaucauauuuacgccugua

SEQ ID NO: 312021 - RNA, 64 nt, Human
acagaaccacagggcuauuuuguuugcuucaugugucccagaagaugacugagggugaguuggc

SEQ ID NO: 312022 - RNA, 64 nt, Human
ugguugacuaauuaaacaauaauucaaguagagugucccagaaaaaaaccacuugggcucccug

SEQ ID NO: 312023 - RNA, 64 nt, Human
cauaaauucauucuguaggaucuuaagaaaaagagucccagaauguugcuucuauuauugugca

SEQ ID NO: 312024 - RNA, 64 nt, Human
gguacagccccucucuuccaaccgagaaguuccugucccagaauggacccagggacaagagacc

SEQ ID NO: 312025 - RNA, 64 nt, Human
cuaauauaauagaugacaguggcaacugaaaacagucccagaaugaccccaucgagaugaaauu

SEQ ID NO: 312026 - RNA, 64 nt, Human
ggcugacacaugggguaugccgggcacugggcaggucccagagccggggaaccagcucaccucu

SEQ ID NO: 312027 - RNA, 64 nt, Human
gugggccugaugaaagcuuccugaguggugucgggucccagagagggagcccaccugcugccug

SEQ ID NO: 312028 - RNA, 64 nt, Human
ucuguaaagcuaggcagaugagcccagaagaauggucccagagaaagcagacuggcuccaauag

SEQ ID NO: 312029 - RNA, 64 nt, Human
gugcuguuccacucuuggcuccagcagacccacugucccagaaaagccugauccuguaguuuau

SEQ ID NO: 312030 - RNA, 64 nt, Human
cugggaagcuugagccucccccaaagcaaugugagucccagagcccgcuuuuguucuuccccac

SEQ ID NO: 312031 - RNA, 64 nt, Human
cagcuugcccuccggggagcaggggcucugucuugucccagaugagcugagagccccugagagg

SEQ ID NO: 312032 - RNA, 64 nt, Human
ccggcuugcgcaggaggggccagcagccccaggagucccagacccgugccgaucacacuggugc

SEQ ID NO: 312033 - RNA, 64 nt, Human
aggucggcccuguggcggguaggcaggaaggacugucccagacgaggggcuuccucuagagucu

SEQ ID NO: 312034 - RNA, 64 nt, Human
gaccugggccauagucauucugccugcccugaaagucccagaucaagccugccucaaucaguau

SEQ ID NO: 312035 - RNA, 64 nt, Human
uauguccuauacucacaucagacaugugaucauagucccagagacagaguugaggucucgaaga

SEQ ID NO: 312036 - RNA, 64 nt, Human
uuucccaacauaugcccucagaaaagugacaguggucccagaaccuauucccuuucuugaggga

SEQ ID NO: 312037 - RNA, 64 nt, Human
gcccagcaaccugccagcuacaggagcccccugcgucccagagacucccucacccaggcaggcu

SEQ ID NO: 312038 - RNA, 64 nt, Human
acuaauuuuuuuuuuuuuuuaaaugaugacaguggucccagaacuuggaaaaguuguagggauu

SEQ ID NO: 312039 - RNA, 64 nt, Human
aggcguccgcgcgccagcacagaaacagaggagagucccagagcaggaggccccuggcccagcg

SEQ ID NO: 312040 - RNA, 64 nt, Human
gaagauguggggcagggacagugacauuucuguagucccagaugcacagaauuaugggagagaa

SEQ ID NO: 312041 - RNA, 64 nt, Human
cacugcuucgugauuccagggccagagccaugcagucccagaaaccccaaccuagcuggggcag

SEQ ID NO: 312042 - RNA, 64 nt, Human
gagucuacuuggcccuagaagagaaaguugaagagucccagaccuacuagcauuuugcaacuau

SEQ ID NO: 312043 - RNA, 64 nt, Human
aguuccguggguuuccccuuugauucuguaaauagucccagagagaauucgugggcugagggca

SEQ ID NO: 312044 - RNA, 64 nt, Human
guucauuacccuccccuacucagacugagcagcagucccagauaaccaagcaagcucagcucug

SEQ ID NO: 312045 - RNA, 64 nt, Human
ucuucccuccggccacugggcuaccucuccuucagucccagaagacaagucucaccaacccagg

SEQ ID NO: 312046 - RNA, 64 nt, Human
aucauuguuaguccgggaccuucaguacugccaagucccagagaaaacccuuuuacucugggga

SEQ ID NO: 312047 - RNA, 64 nt, Human
uuuguuuaaaacauuucuccaucacucauuccaggucccagagcaaacucucucugcucucgga

SEQ ID NO: 312048 - RNA, 64 nt, Human
cgacauguacugcuaguaccuguaagcauuuuaggucccagaauggaaaaaaaaaucagcuauu

SEQ ID NO: 312049 - RNA, 64 nt, Human
uaggauuccugacucaggcugaccucucucucuggucccagacugccuccuugcccaggccucu

SEQ ID NO: 312050 - RNA, 64 nt, Human
aaauauauauauauaugaaaaauaaagcuuaauugucccagaaaucauacauugcuuuuuauuc

SEQ ID NO: 312051 - RNA, 64 nt, Human
ucugacccacagccuccaagucaggugggguggagucccagagcugcacaggguuuggcccaag

SEQ ID NO: 312052 - RNA, 64 nt, Human
augaauguaagcaaaacaggaccaaugaaagaaagucccagaagcugagagaaacuuuaacaag

SEQ ID NO: 312053 - RNA, 64 nt, Human
ggagaucaagucggcacuggggaagcaggcagcggucccagagccacccugugguccugauagc

SEQ ID NO: 312054 - RNA, 64 nt, Human
ugcuaaaagagagggucuguccccuccucuccacgucccagaacuggcccagcugcaggcacua

SEQ ID NO: 312055 - RNA, 64 nt, Human
ccucucucucccaggucccagccccuuuuccccagucccagacaauuccauucaaucuuuggag

SEQ ID NO: 312056 - RNA, 64 nt, Human
uccuucucccuucccaucuccaggccuucugucugucccagauaaaggcgcuguucucccaucc

SEQ ID NO: 312057 - RNA, 64 nt, Human
gagcgaguagagagcagcccucauucaccaccuggucccagacgugcuucaguccucguccucu

SEQ ID NO: 312058 - RNA, 64 nt, Human
augaaccagaaaaugugggaacucauucauucuugucccagaauucuguugagaacauccauuc

SEQ ID NO: 312059 - RNA, 64 nt, Human
gccccuacucacauuuccuuggguuggagcaacagucccagagagggccacggugggagcugcg

SEQ ID NO: 312060 - RNA, 64 nt, Human
gaccuggagaucuaauucuguuuagacauuuuuugucccagaaauacagaagcuugaaaugcua

SEQ ID NO: 312061 - RNA, 64 nt, Human
auucccuucugauaaagguacuccccaacccugagucccagaaggagcugaguucucuagacca

SEQ ID NO: 312062 - RNA, 64 nt, Human
uccaaacuccugccuguguuuguguggauacccagucccagaaccacacuguugaguuggacac

SEQ ID NO: 312063 - RNA, 64 nt, Human
gugaaucaugccaccccaaauccuggcuuaucaagucccagacuauaaauuaugaacucccauu

SEQ ID NO: 312064 - RNA, 54 nt, Human
cccgcagcgcguccccguagacccgucccagacacgucuuuucauuccagucca

SEQ ID NO: 312065 - RNA, 64 nt, Human
ucagggagggcugcccagcccuggccucacagccgucccagauguuaggugagccacugagcuc

SEQ ID NO: 312066 - RNA, 64 nt, Human
accauuacaguaguguaauauauguuuaacuggagucccagaaggagaggagaaaaugaagagg

SEQ ID NO: 312067 - RNA, 64 nt, Human
guucuuggauuacuuuacaccucaguauugauuugucccagaauuuucuggccuuucauggcaa

SEQ ID NO: 312068 - RNA, 64 nt, Human
uuacugcacuguuaggugauggcacacagagcaugucccagaacauuucugugcuuaauuaccc

SEQ ID NO: 312069 - RNA, 64 nt, Human
cacagcuguuguuuucguggcauuuggcaccucugucccagauacguuugccagcaaagcugcu

SEQ ID NO: 312070 - RNA, 64 nt, Human
uuuuuuuuuuuuaaagacagguuacgaagacaaagucccagaauuguaucucauacugucuggg

SEQ ID NO: 312071 - RNA, 64 nt, Human
ggggcucagccaucaaggggcugguguugcuccugucccagacaaggaagccccucuuuacauc

SEQ ID NO: 312072 - RNA, 64 nt, Human
cacccagcauguccuaggaaugcagccccaggaagucccagaccuaaaacaaccagauucuuac

SEQ ID NO: 312073 - RNA, 64 nt, Human
cagaagaagccuucucuuccuccugccuguaggugucccagaagugagaaggcagccuucgaag

SEQ ID NO: 312074 - RNA, 64 nt, Human
guccaucagcaagagagagcagcuggaacagcaggucccagagaacuacuucuaugugccagac

SEQ ID NO: 312075 - RNA, 64 nt, Human
uuggccaucuccgccugccuaaggcucugagcaggucccagagcugcuguuccuccacugcuug

SEQ ID NO: 312076 - RNA, 64 nt, Human
acucccuacgacacgugacucguuuuagagcucugucccagaggcguucguaugugacccacag

SEQ ID NO: 312077 - RNA, 64 nt, Human
gauuccugcugcuccagguguccucagcucaccugucccagacugaggacaggggaguuccugc

SEQ ID NO: 312078 - RNA, 64 nt, Human
ugcugggggugaggacacauugccccaugagacagucccagaacacggcagcugcuggcuguga

SEQ ID NO: 312079 - RNA, 64 nt, Human
agugacuccccagcccagcaccccuuccucgugggucccagagaccucaucagccuugggauag

SEQ ID NO: 312080 - RNA, 64 nt, Human
guuuuucagugaacgagauaauugggagagacaugucccagauuucuguuucccaaggagcagg

SEQ ID NO: 312081 - RNA, 64 nt, Human
cuauuguguaccaccacauagcacaugcacgucugucccagacuuugacaaccugcacaagaca

SEQ ID NO: 312082 - RNA, 64 nt, Human
gugggguggcccaggcagcagaagguucccugaggucccagagccuguuccguuggcccugggc

SEQ ID NO: 312083 - RNA, 64 nt, Human
aaggacugccuacguucauuucauuuuauggagggucccagaaaagggaaggaggagccccagg

SEQ ID NO: 312084 - RNA, 64 nt, Human
ugugcuguguuucuggaguccuuuggaaacaugugucccagaggagaagagguuugacuugcgu

SEQ ID NO: 312085 - RNA, 64 nt, Human
cuuauuuauaaaccagauacauguucuuagucuggucccagaccaaggagcuggucagacggcc

SEQ ID NO: 312086 - RNA, 64 nt, Human
agccuggaagcagcagggagcagccugggucucugucccagacucgccacucucgaccagcaca

SEQ ID NO: 312087 - RNA, 64 nt, Human
gaggaaagccgucucccugcuugacucgacugcugucccagaggagaguccugugcgaccugag

SEQ ID NO: 312088 - RNA, 64 nt, Human
uuuacucgcaacaacuuaauuucuaaggguccaagucccagagaauccauagucgucaaagcuu

SEQ ID NO: 312089 - RNA, 64 nt, Human
agucacucagcguuugcgggaaaauaaaccacuggucccagagcagaggaaggcuacuugagcc

SEQ ID NO: 312090 - RNA, 64 nt, Human
gcacucccaacccugggcuggggaggaggagagagucccagagcucauccccccugcugcccag

SEQ ID NO: 312091 - RNA, 64 nt, Human
ugggggaggagaugggaagggaugggauuucugggucccagagcgggugggauacucacgcaca

SEQ ID NO: 312092 - RNA, 64 nt, Human
accgugguggaggaagucacccagcuguuucucagucccagaggccgguggcugguuuugaacu

SEQ ID NO: 312093 - RNA, 64 nt, Human
guaaucacucagugcccuuagcuagccugacuaagucccagauccccuacagcuuccuucggug

SEQ ID NO: 312094 - RNA, 64 nt, Human
agccccuggcagaucccagaccccuugguggcaggucccagagccuaggugguaggagcuugau

SEQ ID NO: 312095 - RNA, 64 nt, Human
caaggaccacgaucaagggguccgggggaccgaggucccagaucagugaggggagaagguugag

SEQ ID NO: 312096 - RNA, 64 nt, Human
cccaaggccuagguuauggguacggcaaccacaugucccagaucgucuccaauucgaaaacaac

SEQ ID NO: 312097 - RNA, 64 nt, Human
gauguguccugauaagcugagcuccuuagccuuugucccagaaugccuccugcagggauucuuc

SEQ ID NO: 312098 - RNA, 64 nt, Human
uggaccuuuccugaggaagagggacuguucuuuugucccagaaaagcaguggcuccauuggugu

SEQ ID NO: 312099 - RNA, 64 nt, Human
ucugucuggggagcacccacaggcugccuuuggggucccagagccugcucugugcacugacccc

SEQ ID NO: 312100 - RNA, 64 nt, Human
cugaggguuagggaugucuccacccugauggggugucccagagacauuuucccauggcaguccu

SEQ ID NO: 312101 - RNA, 64 nt, Human
ggugcaggggccaggggugggagcaucggagggagucccagagcccuggaccuugggccuagac

SEQ ID NO: 312102 - RNA, 64 nt, Human
gccauggauugaggccucuggccggagcugccuggucccagaguggcugcaccacuuccagggu

SEQ ID NO: 312103 - RNA, 64 nt, Human
cuaauuaggaacauucucccaugucucuuguguggucccagaaggagaagugaguuugccaagg

SEQ ID NO: 312104 - RNA, 64 nt, Human
auggugcccaccucggcgaauugaagggcuaagagucccagauagcuaggccagagcuggaagc

SEQ ID NO: 312105 - RNA, 64 nt, Human
ugccccguggccccugugccuguucggugggggugucccagagaagccuggcaccaguaccccc

SEQ ID NO: 312106 - RNA, 64 nt, Human
accgcugggccccagcucagaagggcuauagcuggucccagaggccuggccuggccuuccuucc

SEQ ID NO: 312107 - RNA, 64 nt, Human
uuuccaugacagacacuugcuucccuugggacaagucccagaagaacuaccugaagcaccaaag

SEQ ID NO: 312108 - RNA, 64 nt, Human
ggggugggaucaaucuuaggaaaagcaaaaaagggucccagaucccuuggcccuuuccuccgag

SEQ ID NO: 312109 - RNA, 64 nt, Human
aagacaaaaguuaaaaacagacuuuaaaaauacugucccagaaauguaauuuuaugaucccagc

SEQ ID NO: 312110 - RNA, 64 nt, Human
gggcagcccauuucucaaaguccagaaaauuagggucccagaagggggcagcagcaggcuggga

SEQ ID NO: 312111 - RNA, 64 nt, Human
gcuggggguccagcacaggcuguaucugcagagggucccagaggaacgcuggagccaagagaag

SEQ ID NO: 312112 - RNA, 64 nt, Human
aauugcuaugacauuccaagcuccaauaaagacugucccagacuuuggccugugaccauucauu

SEQ ID NO: 312113 - RNA, 64 nt, Human
cgcaacuucguggcguccugcacggcacuugggggucccagaaggccccggccugaggaggccg

SEQ ID NO: 312114 - RNA, 64 nt, Human
gcccccucccuauaugcaccccuggaaccagcaagucccagacaaggagagcggaggaggaagu

SEQ ID NO: 312115 - RNA, 64 nt, Human
caugggggauacacuagugggcagaaauagccccgucccagagccggccaugguggcucauacc

SEQ ID NO: 312116 - RNA, 64 nt, Human
uucaaccuguuuaguucaacucaagccucccugugucccagacccuccugcugccaccaccacc

SEQ ID NO: 312117 - RNA, 64 nt, Human
caucccaggaggccugugcacacaucccaggcaugucccagacacaucccacacguguccgugu

SEQ ID NO: 312118 - RNA, 64 nt, Human
ugcugggaacauugaaguuuauuuggauaucaaggucccagaacaaggaagucacuuuucagug

SEQ ID NO: 312119 - RNA, 64 nt, Human
ccuuugagaaacagcagugagcacauaggcaguagucccagaggggccguguucuguccugcac

SEQ ID NO: 312120 - RNA, 64 nt, Human
agaauggagugagcucuuccagcacagcugacaagucccagaagcagucccugacccccagcuu

SEQ ID NO: 312121 - RNA, 64 nt, Human
guaaauuuuuuugugggagggugggcagggaggggucccagaggguagagcucaaggauuuugg

SEQ ID NO: 312122 - RNA, 64 nt, Human
cgcggcagccugagcaccggggggugccccuccagucccagacggcaauguuccucccuccaac

SEQ ID NO: 312123 - RNA, 64 nt, Human
uugaggaauucuuauuuguguuagagcagaggaggucccagauaccaaguggcgccucccagga

SEQ ID NO: 312124 - RNA, 64 nt, Human
cccaggacugggccacuucuggguggggcagugggucccagauuggcucacacugagaauguaa

SEQ ID NO: 312125 - RNA, 64 nt, Human
gcgggcagggggugaccccuggagcuaguugcgugucccagaauggaggguguucugacacccc

SEQ ID NO: 312126 - RNA, 64 nt, Human
cccccgugcuggcggagcggacgccgcgcucugggucccagaggggccggguggcucagacgac

SEQ ID NO: 312127 - RNA, 64 nt, Human
gaggcugguucacguccccuaccacggaagcgaggucccagaaggccagcggugguuccaggag

SEQ ID NO: 312128 - RNA, 64 nt, Human
ccacugauggcucugacaccguguugguggcgaugucccagacaaucccaccaggacggcccag

SEQ ID NO: 312129 - RNA, 64 nt, Human
uuucuguauggacccuuccugccauuuguauuuugucccagagagaaaggcucuuuggggggcc

SEQ ID NO: 312130 - RNA, 64 nt, Human
uguaucacagccgccuacgcccaccuaguggccagucccagagccgcauggcagacagcuuaaa

SEQ ID NO: 312131 - RNA, 64 nt, Human
caucacuucgguuccugauuggucccgggccaaggucccagaccaagcugaaucacgcuuucuc

SEQ ID NO: 312132 - RNA, 64 nt, Human
gcccccagccccuuccccacacagccccagaagggucccagagcugaccccacuccaggaccua

SEQ ID NO: 312133 - RNA, 64 nt, Human
gucacacccccaaccccagggaggggcugucauagucccagaggauaagcaauaccuauuucug

SEQ ID NO: 312134 - RNA, 64 nt, Human
gcaauacugccuguagccauuggguggcagcagagucccagaauaugagaccguuacucggaug

SEQ ID NO: 312135 - RNA, 64 nt, Human
cccuagaguucaaacagauacagcaugguccagagucccagauguacaaaaacagggauucauc

SEQ ID NO: 312136 - RNA, 64 nt, Human
cugcacugcuacccucuauuucccacucagggcugucccagagagaaggcagccgaacugagga

SEQ ID NO: 312137 - RNA, 64 nt, Human
gagacagagacuuuguggaaguaucucugagggagucccagacacaggcagagagggccacaua

SEQ ID NO: 312138 - RNA, 64 nt, Human
gccagccuggguggcgcugcucccagagccgugggucccagaccuugcguuccuuuuguuccug

SEQ ID NO: 312139 - RNA, 64 nt, Human
accacagugguccuuccugccugagcccugcacugucccagaccacacagaagucuggucaccu

SEQ ID NO: 312140 - RNA, 64 nt, Human
cucagcagcacccugcagugcccaggacggccccgucccagagaacaauccagccccgaauguc

SEQ ID NO: 312141 - RNA, 64 nt, Human
cucaccaaaucuugguggaagagcccaggggcuggucccagaacaggcagucucacaagcacgc

SEQ ID NO: 312142 - RNA, 64 nt, Human
cauccacccucguaacaacagucucccugggugggucccagaagugaucuuugugucgcucggg

SEQ ID NO: 312143 - RNA, 64 nt, Human
gagccaggguuaggauucaaaccccauccaacuggucccagagcuggagcuucuugcacugccc

SEQ ID NO: 312144 - RNA, 64 nt, Human
gugacuguccuacccacccacccaccucuguagagucccagaaacaaaacuaugcugacaccuc

SEQ ID NO: 312145 - RNA, 64 nt, Human
ccuaggggaggccuaaaacccuuuuggggauaaugucccagaguccccccacuagacacagguc

SEQ ID NO: 312146 - RNA, 64 nt, Human
cgaugugcaccucccggaagugcagcucccgaaagucccagagaugaaacucccuaaaaugccu

SEQ ID NO: 312147 - RNA, 64 nt, Human
cgaugugcaccucccagaagugcagcuuccaaaagucccagagaugaagcucccugagaugaaa

SEQ ID NO: 312148 - RNA, 64 nt, Human
guagccaaggucagcccugaggccagggugaaaggucccagacuucgaaugcccaccuuugggc

SEQ ID NO: 312149 - RNA, 64 nt, Human
gaguccugcucccucacuccucgccccgcccccugucccagagucccaccugggggcucucucc

SEQ ID NO: 312150 - RNA, 64 nt, Human
aauccgggcaggacccucgaagaggagaccgagggucccagaggaccaaugcuacaagccagca

SEQ ID NO: 312151 - RNA, 64 nt, Human
uuccccuagugaccccccccccacuucaccccaugucccagagccucagaacccacccucccug

SEQ ID NO: 312152 - RNA, 64 nt, Human
cccaucccuucucugcagcucugacccaaauuuagucccagaaauaaacugagaaguggaaucu

SEQ ID NO: 312153 - RNA, 64 nt, Human
ugaaauauucacagaaucagaucugaaaacacaugucccagacugcauacuggggucgucauga

SEQ ID NO: 312154 - RNA, 64 nt, Human
cauaagauggacaaaaguguuucuguaucacugugucccagacaauauuuagaauuacccagcu

SEQ ID NO: 312155 - RNA, 64 nt, Human
ucucauucacacacacaaaucucaggaacaaacggucccagaguccuccggaccccugcccagg

SEQ ID NO: 312156 - RNA, 64 nt, Human
gauuuucuuacagcgaagacuugaguuccuccaagucccagaaccccaagaaugggcaagaagg

SEQ ID NO: 312157 - RNA, 64 nt, Human
gugcagcugugaagcucgggcugauucccccucugucccagaagguuggccagagggugugacc

SEQ ID NO: 312158 - RNA, 64 nt, Human
uggggacuaagguugcaggccuuagccucgucucgucccagaggcauuggaucaggagaauggg

SEQ ID NO: 312159 - RNA, 64 nt, Human
aggugcagcugugccacgggucagcugagccacagucccagaaccaagcucucggugucucggg

SEQ ID NO: 312160 - RNA, 64 nt, Human
gagaugcugcugcaacuggaagaagcuggaaccagucccagagaggcucggccuggaaacaguc

SEQ ID NO: 312161 - RNA, 64 nt, Human
gacagaaaacccaugcuuuacuuuguacagcccugucccagaguuaguaagccucggcuuguca

SEQ ID NO: 312162 - RNA, 64 nt, Human
gugugcucaggagucgcgggcagcguggacaucugucccagagggggcagaaucuccaauagag

SEQ ID NO: 312163 - RNA, 64 nt, Human
ggucacggcaaaggaagacgugaugccaggaccagucccagagcaggaaugggaaggaugaagg

SEQ ID NO: 312164 - RNA, 64 nt, Human
gcacuggcccagcagccucuucucugagcuccaugucccagauaaaccaggccagacugagaag

SEQ ID NO: 312165 - RNA, 64 nt, Human
ucuuugauguuucugagaggcagacucccauguggucccagauccuugguccauggaugacacc

SEQ ID NO: 312166 - RNA, 64 nt, Human
ggaugggcuuuucccugugggccagggaugcucggucccagaggaggaccuagugacaucaugg

SEQ ID NO: 312167 - RNA, 64 nt, Human
ugcugggcacacucuccagcucaauaaaccaucagucccagaagcaaaggucacacagccccug

SEQ ID NO: 312168 - RNA, 64 nt, Human
ccagaagguaccccugagguuggcgucuuccuacgucccagaagcagcccccaccccacacaug

SEQ ID NO: 312169 - RNA, 64 nt, Human
ugugagcuccugccgguuucuuggcugucagucagucccagaguggggaggaagauauggguga

SEQ ID NO: 312170 - RNA, 64 nt, Human
cuccucuguccaccgagacucuggacuugcucaggucccagacuggggaagggaggugucuaga

SEQ ID NO: 312171 - RNA, 64 nt, Human
ucccuuggaggcuguggcaaguccucaauccugugucccagaggucccucugggccacaaccca

SEQ ID NO: 312172 - RNA, 64 nt, Human
ugccccggcccggacucccugucccacgucccuagucccagacuaccccggacccugucccugc

SEQ ID NO: 312173 - RNA, 64 nt, Human
ccagauaccauuucuccuaguauuucuuuguuaugucccagaacugauguuuuuuuuuuaaggu

SEQ ID NO: 312174 - RNA, 64 nt, Human
uggagggagauaaaagaaccccagaccucugaaugucccagaggcuagucucuucucagagcag

SEQ ID NO: 312175 - RNA, 64 nt, Human
acauucuggcuccaccgggagggacagucuggaggucccagacaugcugcccacccccugcugg

SEQ ID NO: 312176 - RNA, 63 nt, Human
augggcuaaaacagguguaauagucaauaaaauggucccagaaaaccaucgaccaggucaaaa

SEQ ID NO: 312177 - RNA, 64 nt, Human
agagagcagccaggagagcuuagggucucagggugucccagaccccgacaccggccaguggcgg

SEQ ID NO: 312178 - RNA, 64 nt, Human
uccugacgcggugccguccccagcacggugauuagucccagagcucggcugccaccuccaccgg

SEQ ID NO: 312179 - RNA, 64 nt, Human
gcugaccuugcccauccccccagggaagucuggggucccagagucauucucugaccccaugaga

SEQ ID NO: 312180 - RNA, 64 nt, Human
gcugaacuugccuauccccccagggaagucuggggucccagagucauucucugaccccaugaga

SEQ ID NO: 312181 - RNA, 64 nt, Human
cucgugugaucauucucguggggcugccgugagcgucccagaggccgggagcgugggcccugcg

SEQ ID NO: 312182 - RNA, 64 nt, Human
ccaggccagcccccaaugguccccuuacggacaggucccagagauggacagaggcacccagggc

SEQ ID NO: 312183 - RNA, 64 nt, Human
agcccagaccagaggcucugagcccugaaccaaagucccagagcugggcugggacgugaccugu

SEQ ID NO: 312184 - RNA, 64 nt, Human
ggugcucuccacacacaagcucgcaaacacacaugucccagaauagcucuguuggguuguguug

SEQ ID NO: 312185 - RNA, 64 nt, Human
aggaucacuuuuuaaaaaaucaccacuuguggcugucccagagugcgguuguacauccucccca

SEQ ID NO: 312186 - RNA, 64 nt, Human
gaaagcaggaauggcuugccuaagacuugcccaagucccagagcaccucaccucccgaagccac

SEQ ID NO: 312187 - RNA, 64 nt, Human
uccagccaaaauguuuagaaacacucagucucuggucccagaggauggcuucucagggcaugcc

SEQ ID NO: 312188 - RNA, 64 nt, Human
ggaacgggucggguccgugucggagaagugacaggucccagagccaaagccggcccucaagcau

SEQ ID NO: 312189 - RNA, 64 nt, Human
agggucuguguucuccaggagaaugaggguguuggucccagaauugggaccggggccccgcugg

SEQ ID NO: 312190 - RNA, 64 nt, Human
gguguugacccagggauggggcuggguaguuggggucccagaaagccggggguaggggccaccc

SEQ ID NO: 312191 - RNA, 64 nt, Human
aguuccccuggagccccuucgggagcagggcugugucccagaugggccacggcugagccuucag

SEQ ID NO: 312192 - RNA, 64 nt, Human
aacaaaguaaaacuuuuuuuuuucauuaaaagaugucccagaggaaaggcccugugcagccagu

SEQ ID NO: 312193 - RNA, 64 nt, Human
gauuggccuccacuuggguaugugaauuauucaugucccagaagaccaaaaagugcucugguuc

SEQ ID NO: 312194 - RNA, 64 nt, Human
aauggagaaggaaucauucaugggccucggcuaggucccagacugauuacaugagacuggggag

SEQ ID NO: 312195 - RNA, 64 nt, Human
aaaaauuagccgggcgugguggcaggcaccuguagucccagauacucgggaggcuaaggcagga

SEQ ID NO: 312196 - RNA, 64 nt, Human
gcaucccgcgcagaugacaccaucaaccgccagagucccagacaccgguuuuccuagaagcccc

SEQ ID NO: 312197 - RNA, 64 nt, Human
ucuguauccagggacaggacuccaaaggcuuuuggucccagagcugggguauguuggccccagc

SEQ ID NO: 312198 - RNA, 64 nt, Human
cugccuccucugaggaaucuggcccugucugacagucccagaccccccguucucuccucuuuag

SEQ ID NO: 312199 - RNA, 64 nt, Human
cuuccccaaaauggaccuuuuuuuuuucuaaagagucccagagaauggggaauuguuccuguaa

SEQ ID NO: 312200 - RNA, 64 nt, Human
gcuagguauaccuacagcagcuacaaugauucuugucccagagagggcuaugcugcuuuuccaa

SEQ ID NO: 312201 - RNA, 64 nt, Human
ccuagaaagcugcugugaucccaguagaaaauaugucccagaaaugucaugagauugcugugug

SEQ ID NO: 312202 - RNA, 64 nt, Human
cuacaucuucucucuuccccaucuugcauuggaggucccagaaaacaauuagcuucuggcaaag

SEQ ID NO: 312203 - RNA, 54 nt, Human
ucagcuuucugaugaguuaaaaaggucccagagauauauagacacuggaguacu

SEQ ID NO: 312204 - RNA, 64 nt, Human
caagccccgcucuuccagcacuuccaccggcagagucccagagccacuucacccuggggguggg

SEQ ID NO: 312205 - RNA, 64 nt, Human
auuuuacucuauuuuauuuuuccaucacuucuuugucccagauucaugaaauuugcugaugucc

SEQ ID NO: 312206 - RNA, 64 nt, Human
caacagaaggaaggaggagggcgcccauucgucugucccagagcuuauuggccacugggucuca

SEQ ID NO: 312207 - RNA, 64 nt, Human; identical to SEQ ID NO: 311398

SEQ ID NO: 312208 - RNA, 64 nt, Human; identical to SEQ ID NO: 311415

SEQ ID NO: 312209 - RNA, 64 nt, Human; identical to SEQ ID NO: 311416

SEQ ID NO: 312210 - RNA, 64 nt, Human; identical to SEQ ID NO: 311417

SEQ ID NO: 312211 - RNA, 64 nt, Human; identical to SEQ ID NO: 311452

SEQ ID NO: 312212 - RNA, 64 nt, Human; identical to SEQ ID NO: 311453

SEQ ID NO: 312213 - RNA, 64 nt, Human; identical to SEQ ID NO: 311454

SEQ ID NO: 312214 - RNA, 64 nt, Human; identical to SEQ ID NO: 311528

SEQ ID NO: 312215 - RNA, 64 nt, Human; identical to SEQ ID NO: 311529

SEQ ID NO: 312216 - RNA, 64 nt, Human; identical to SEQ ID NO: 311530

SEQ ID NO: 312217 - RNA, 64 nt, Human; identical to SEQ ID NO: 311763

SEQ ID NO: 312218 - RNA, 64 nt, Human; identical to SEQ ID NO: 311764

SEQ ID NO: 312219 - RNA, 64 nt, Human; identical to SEQ ID NO: 310643

SEQ ID NO: 312220 - RNA, 64 nt, Human; identical to SEQ ID NO: 310644

SEQ ID NO: 312221 - RNA, 64 nt, Human; identical to SEQ ID NO: 310645

SEQ ID NO: 312222 - RNA, 64 nt, Human; identical to SEQ ID NO: 311886

SEQ ID NO: 312223 - RNA, 64 nt, Human; identical to SEQ ID NO: 311887

SEQ ID NO: 312224 - RNA, 64 nt, Human; identical to SEQ ID NO: 311888

SEQ ID NO: 312225 - RNA, 64 nt, Human; identical to SEQ ID NO: 311889

SEQ ID NO: 312226 - RNA, 64 nt, Human; identical to SEQ ID NO: 311890

SEQ ID NO: 312227 - RNA, 64 nt, Human; identical to SEQ ID NO: 311891

SEQ ID NO: 312228 - RNA, 64 nt, Human; identical to SEQ ID NO: 311892

SEQ ID NO: 312229 - RNA, 64 nt, Human; identical to SEQ ID NO: 311893

SEQ ID NO: 312230 - RNA, 64 nt, Human; identical to SEQ ID NO: 311894

SEQ ID NO: 312231 - RNA, 64 nt, Human; identical to SEQ ID NO: 311895

SEQ ID NO: 312232 - RNA, 64 nt, Human; identical to SEQ ID NO: 311896

SEQ ID NO: 312233 - RNA, 64 nt, Human; identical to SEQ ID NO: 311897

SEQ ID NO: 312234 - RNA, 64 nt, Human; identical to SEQ ID NO: 311898

SEQ ID NO: 312235 - RNA, 64 nt, Human; identical to SEQ ID NO: 311899

SEQ ID NO: 312236 - RNA, 64 nt, Human; identical to SEQ ID NO: 311900

SEQ ID NO: 312237 - RNA, 64 nt, Human; identical to SEQ ID NO: 311901

SEQ ID NO: 312238 - RNA, 64 nt, Human; identical to SEQ ID NO: 311902

SEQ ID NO: 312239 - RNA, 64 nt, Human; identical to SEQ ID NO: 311903

SEQ ID NO: 312240 - RNA, 64 nt, Human; identical to SEQ ID NO: 311904

SEQ ID NO: 312241 - RNA, 64 nt, Human; identical to SEQ ID NO: 311905

SEQ ID NO: 312242 - RNA, 64 nt, Human; identical to SEQ ID NO: 311906

SEQ ID NO: 312243 - RNA, 64 nt, Human; identical to SEQ ID NO: 311907

SEQ ID NO: 312244 - RNA, 64 nt, Human; identical to SEQ ID NO: 311908

SEQ ID NO: 312245 - RNA, 64 nt, Human; identical to SEQ ID NO: 311909

SEQ ID NO: 312246 - RNA, 64 nt, Human; identical to SEQ ID NO: 311910

SEQ ID NO: 312247 - RNA, 64 nt, Human; identical to SEQ ID NO: 311911

SEQ ID NO: 312248 - RNA, 64 nt, Human; identical to SEQ ID NO: 311912

SEQ ID NO: 312249 - RNA, 64 nt, Human; identical to SEQ ID NO: 311913

SEQ ID NO: 312250 - RNA, 64 nt, Human; identical to SEQ ID NO: 311914

SEQ ID NO: 312251 - RNA, 64 nt, Human; identical to SEQ ID NO: 311915

SEQ ID NO: 312252 - RNA, 64 nt, Human; identical to SEQ ID NO: 311916

SEQ ID NO: 312253 - RNA, 64 nt, Human; identical to SEQ ID NO: 311917

SEQ ID NO: 312254 - RNA, 64 nt, Human; identical to SEQ ID NO: 311918

SEQ ID NO: 312255 - RNA, 64 nt, Human; identical to SEQ ID NO: 311919

SEQ ID NO: 312256 - RNA, 64 nt, Human; identical to SEQ ID NO: 311920

SEQ ID NO: 312257 - RNA, 64 nt, Human; identical to SEQ ID NO: 311921

SEQ ID NO: 312258 - RNA, 64 nt, Human; identical to SEQ ID NO: 311922

SEQ ID NO: 312259 - RNA, 64 nt, Human; identical to SEQ ID NO: 311923

SEQ ID NO: 312260 - RNA, 64 nt, Human; identical to SEQ ID NO: 311924

SEQ ID NO: 312261 - RNA, 64 nt, Human; identical to SEQ ID NO: 311925

SEQ ID NO: 312262 - RNA, 64 nt, Human; identical to SEQ ID NO: 311926

SEQ ID NO: 312263 - RNA, 64 nt, Human; identical to SEQ ID NO: 311927

SEQ ID NO: 312264 - RNA, 64 nt, Human; identical to SEQ ID NO: 311928

SEQ ID NO: 312265 - RNA, 64 nt, Human; identical to SEQ ID NO: 311929

SEQ ID NO: 312266 - RNA, 64 nt, Human; identical to SEQ ID NO: 311930

SEQ ID NO: 312267 - RNA, 64 nt, Human; identical to SEQ ID NO: 311931

SEQ ID NO: 312268 - RNA, 64 nt, Human; identical to SEQ ID NO: 311932

SEQ ID NO: 312269 - RNA, 64 nt, Human; identical to SEQ ID NO: 311933

SEQ ID NO: 312270 - RNA, 64 nt, Human; identical to SEQ ID NO: 311934

SEQ ID NO: 312271 - RNA, 64 nt, Human; identical to SEQ ID NO: 311935

SEQ ID NO: 312272 - RNA, 64 nt, Human; identical to SEQ ID NO: 311936

SEQ ID NO: 312273 - RNA, 64 nt, Human; identical to SEQ ID NO: 311937

SEQ ID NO: 312274 - RNA, 64 nt, Human; identical to SEQ ID NO: 311938

SEQ ID NO: 312275 - RNA, 64 nt, Human; identical to SEQ ID NO: 311939

SEQ ID NO: 312276 - RNA, 64 nt, Human; identical to SEQ ID NO: 311940

SEQ ID NO: 312277 - RNA, 64 nt, Human; identical to SEQ ID NO: 311941

SEQ ID NO: 312278 - RNA, 64 nt, Human; identical to SEQ ID NO: 311942

SEQ ID NO: 312279 - RNA, 64 nt, Human; identical to SEQ ID NO: 311943

SEQ ID NO: 312280 - RNA, 64 nt, Human; identical to SEQ ID NO: 311944

SEQ ID NO: 312281 - RNA, 64 nt, Human; identical to SEQ ID NO: 311945

SEQ ID NO: 312282 - RNA, 64 nt, Human; identical to SEQ ID NO: 311946

SEQ ID NO: 312283 - RNA, 64 nt, Human; identical to SEQ ID NO: 311947

SEQ ID NO: 312284 - RNA, 64 nt, Human; identical to SEQ ID NO: 311948

SEQ ID NO: 312285 - RNA, 64 nt, Human; identical to SEQ ID NO: 311949

SEQ ID NO: 312286 - RNA, 64 nt, Human; identical to SEQ ID NO: 311950

SEQ ID NO: 312287 - RNA, 64 nt, Human; identical to SEQ ID NO: 311951

SEQ ID NO: 312288 - RNA, 64 nt, Human; identical to SEQ ID NO: 311952

SEQ ID NO: 312289 - RNA, 64 nt, Human; identical to SEQ ID NO: 311953

SEQ ID NO: 312290 - RNA, 64 nt, Human; identical to SEQ ID NO: 311954

SEQ ID NO: 312291 - RNA, 64 nt, Human; identical to SEQ ID NO: 311955

SEQ ID NO: 312292 - RNA, 64 nt, Human; identical to SEQ ID NO: 311956

SEQ ID NO: 312293 - RNA, 64 nt, Human; identical to SEQ ID NO: 311957

SEQ ID NO: 312294 - RNA, 64 nt, Human; identical to SEQ ID NO: 311958

SEQ ID NO: 312295 - RNA, 64 nt, Human; identical to SEQ ID NO: 311959

SEQ ID NO: 312296 - RNA, 64 nt, Human; identical to SEQ ID NO: 311960

SEQ ID NO: 312297 - RNA, 64 nt, Human; identical to SEQ ID NO: 311961

SEQ ID NO: 312298 - RNA, 64 nt, Human; identical to SEQ ID NO: 311962

SEQ ID NO: 312299 - RNA, 64 nt, Human; identical to SEQ ID NO: 311963

SEQ ID NO: 312300 - RNA, 64 nt, Human; identical to SEQ ID NO: 311964

SEQ ID NO: 312301 - RNA, 64 nt, Human; identical to SEQ ID NO: 311965

SEQ ID NO: 312302 - RNA, 64 nt, Human; identical to SEQ ID NO: 311966

SEQ ID NO: 312303 - RNA, 64 nt, Human; identical to SEQ ID NO: 311967

SEQ ID NO: 312304 - RNA, 64 nt, Human; identical to SEQ ID NO: 311968

SEQ ID NO: 312305 - RNA, 64 nt, Human; identical to SEQ ID NO: 311969

SEQ ID NO: 312306 - RNA, 64 nt, Human; identical to SEQ ID NO: 311970

SEQ ID NO: 312307 - RNA, 64 nt, Human; identical to SEQ ID NO: 311971

SEQ ID NO: 312308 - RNA, 64 nt, Human; identical to SEQ ID NO: 311972

SEQ ID NO: 312309 - RNA, 64 nt, Human; identical to SEQ ID NO: 311973

SEQ ID NO: 312310 - RNA, 64 nt, Human; identical to SEQ ID NO: 311974

SEQ ID NO: 312311 - RNA, 64 nt, Human; identical to SEQ ID NO: 311975

SEQ ID NO: 312312 - RNA, 64 nt, Human; identical to SEQ ID NO: 311976

SEQ ID NO: 312313 - RNA, 64 nt, Human; identical to SEQ ID NO: 311977

SEQ ID NO: 312314 - RNA, 64 nt, Human; identical to SEQ ID NO: 311978

SEQ ID NO: 312315 - RNA, 64 nt, Human; identical to SEQ ID NO: 311979

SEQ ID NO: 312316 - RNA, 64 nt, Human; identical to SEQ ID NO: 311980

SEQ ID NO: 312317 - RNA, 64 nt, Human; identical to SEQ ID NO: 311981

SEQ ID NO: 312318 - RNA, 64 nt, Human; identical to SEQ ID NO: 311982

SEQ ID NO: 312319 - RNA, 64 nt, Human; identical to SEQ ID NO: 311983

SEQ ID NO: 312320 - RNA, 64 nt, Human; identical to SEQ ID NO: 311984

SEQ ID NO: 312321 - RNA, 64 nt, Human; identical to SEQ ID NO: 311985

SEQ ID NO: 312322 - RNA, 64 nt, Human; identical to SEQ ID NO: 311986

SEQ ID NO: 312323 - RNA, 64 nt, Human; identical to SEQ ID NO: 311987

SEQ ID NO: 312324 - RNA, 64 nt, Human; identical to SEQ ID NO: 311988

SEQ ID NO: 312325 - RNA, 64 nt, Human; identical to SEQ ID NO: 311989

SEQ ID NO: 312326 - RNA, 64 nt, Human; identical to SEQ ID NO: 311990

SEQ ID NO: 312327 - RNA, 64 nt, Human; identical to SEQ ID NO: 311991

SEQ ID NO: 312328 - RNA, 64 nt, Human; identical to SEQ ID NO: 311992

SEQ ID NO: 312329 - RNA, 64 nt, Human; identical to SEQ ID NO: 311993

SEQ ID NO: 312330 - RNA, 64 nt, Human; identical to SEQ ID NO: 311994

SEQ ID NO: 312331 - RNA, 64 nt, Human; identical to SEQ ID NO: 311995

SEQ ID NO: 312332 - RNA, 64 nt, Human; identical to SEQ ID NO: 311996

SEQ ID NO: 312333 - RNA, 64 nt, Human; identical to SEQ ID NO: 311997

SEQ ID NO: 312334 - RNA, 64 nt, Human; identical to SEQ ID NO: 311998

SEQ ID NO: 312335 - RNA, 64 nt, Human; identical to SEQ ID NO: 311999

SEQ ID NO: 312336 - RNA, 64 nt, Human; identical to SEQ ID NO: 312000

SEQ ID NO: 312337 - RNA, 64 nt, Human; identical to SEQ ID NO: 312001

SEQ ID NO: 312338 - RNA, 64 nt, Human; identical to SEQ ID NO: 312002

SEQ ID NO: 312339 - RNA, 64 nt, Human; identical to SEQ ID NO: 312003

SEQ ID NO: 312340 - RNA, 64 nt, Human; identical to SEQ ID NO: 312004

SEQ ID NO: 312341 - RNA, 64 nt, Human; identical to SEQ ID NO: 312005

SEQ ID NO: 312342 - RNA, 64 nt, Human; identical to SEQ ID NO: 312006

SEQ ID NO: 312343 - RNA, 64 nt, Human; identical to SEQ ID NO: 312007

SEQ ID NO: 312344 - RNA, 64 nt, Human; identical to SEQ ID NO: 312008

SEQ ID NO: 312345 - RNA, 64 nt, Human; identical to SEQ ID NO: 312009

SEQ ID NO: 312346 - RNA, 64 nt, Human; identical to SEQ ID NO: 312010

SEQ ID NO: 312347 - RNA, 64 nt, Human; identical to SEQ ID NO: 312011

SEQ ID NO: 312348 - RNA, 64 nt, Human; identical to SEQ ID NO: 312012

SEQ ID NO: 312349 - RNA, 64 nt, Human; identical to SEQ ID NO: 312013

SEQ ID NO: 312350 - RNA, 64 nt, Human; identical to SEQ ID NO: 312014

SEQ ID NO: 312351 - RNA, 64 nt, Human; identical to SEQ ID NO: 312015

SEQ ID NO: 312352 - RNA, 64 nt, Human; identical to SEQ ID NO: 312016

SEQ ID NO: 312353 - RNA, 64 nt, Human; identical to SEQ ID NO: 312017

SEQ ID NO: 312354 - RNA, 64 nt, Human; identical to SEQ ID NO: 312018

SEQ ID NO: 312355 - RNA, 64 nt, Human; identical to SEQ ID NO: 312019

SEQ ID NO: 312356 - RNA, 64 nt, Human; identical to SEQ ID NO: 312020

SEQ ID NO: 312357 - RNA, 64 nt, Human; identical to SEQ ID NO: 312021

SEQ ID NO: 312358 - RNA, 64 nt, Human; identical to SEQ ID NO: 312022

SEQ ID NO: 312359 - RNA, 64 nt, Human; identical to SEQ ID NO: 312023

SEQ ID NO: 312360 - RNA, 64 nt, Human; identical to SEQ ID NO: 312024

SEQ ID NO: 312361 - RNA, 64 nt, Human; identical to SEQ ID NO: 312025

SEQ ID NO: 312362 - RNA, 64 nt, Human; identical to SEQ ID NO: 312026

SEQ ID NO: 312363 - RNA, 64 nt, Human; identical to SEQ ID NO: 312027

SEQ ID NO: 312364 - RNA, 64 nt, Human; identical to SEQ ID NO: 312028

SEQ ID NO: 312365 - RNA, 64 nt, Human; identical to SEQ ID NO: 312029

SEQ ID NO: 312366 - RNA, 64 nt, Human; identical to SEQ ID NO: 312030

SEQ ID NO: 312367 - RNA, 64 nt, Human; identical to SEQ ID NO: 312031

SEQ ID NO: 312368 - RNA, 64 nt, Human; identical to SEQ ID NO: 312032

SEQ ID NO: 312369 - RNA, 64 nt, Human; identical to SEQ ID NO: 312033

SEQ ID NO: 312370 - RNA, 64 nt, Human; identical to SEQ ID NO: 312034

SEQ ID NO: 312371 - RNA, 64 nt, Human; identical to SEQ ID NO: 312035

SEQ ID NO: 312372 - RNA, 64 nt, Human; identical to SEQ ID NO: 312036

SEQ ID NO: 312373 - RNA, 64 nt, Human; identical to SEQ ID NO: 312037

SEQ ID NO: 312374 - RNA, 64 nt, Human; identical to SEQ ID NO: 312038

SEQ ID NO: 312375 - RNA, 64 nt, Human; identical to SEQ ID NO: 312039

SEQ ID NO: 312376 - RNA, 64 nt, Human; identical to SEQ ID NO: 312040

SEQ ID NO: 312377 - RNA, 64 nt, Human; identical to SEQ ID NO: 312041

SEQ ID NO: 312378 - RNA, 64 nt, Human; identical to SEQ ID NO: 312042

SEQ ID NO: 312379 - RNA, 64 nt, Human; identical to SEQ ID NO: 312043

SEQ ID NO: 312380 - RNA, 64 nt, Human; identical to SEQ ID NO: 312044

SEQ ID NO: 312381 - RNA, 64 nt, Human; identical to SEQ ID NO: 312045

SEQ ID NO: 312382 - RNA, 64 nt, Human; identical to SEQ ID NO: 312046

SEQ ID NO: 312383 - RNA, 64 nt, Human; identical to SEQ ID NO: 312047

SEQ ID NO: 312384 - RNA, 64 nt, Human; identical to SEQ ID NO: 312048

SEQ ID NO: 312385 - RNA, 64 nt, Human; identical to SEQ ID NO: 312049

SEQ ID NO: 312386 - RNA, 64 nt, Human; identical to SEQ ID NO: 312050

SEQ ID NO: 312387 - RNA, 64 nt, Human; identical to SEQ ID NO: 312051

SEQ ID NO: 312388 - RNA, 64 nt, Human; identical to SEQ ID NO: 312052

SEQ ID NO: 312389 - RNA, 64 nt, Human; identical to SEQ ID NO: 312053

SEQ ID NO: 312390 - RNA, 64 nt, Human; identical to SEQ ID NO: 312054

SEQ ID NO: 312391 - RNA, 64 nt, Human; identical to SEQ ID NO: 312055

SEQ ID NO: 312392 - RNA, 64 nt, Human; identical to SEQ ID NO: 312056

SEQ ID NO: 312393 - RNA, 64 nt, Human; identical to SEQ ID NO: 312057

SEQ ID NO: 312394 - RNA, 64 nt, Human; identical to SEQ ID NO: 312058

SEQ ID NO: 312395 - RNA, 64 nt, Human; identical to SEQ ID NO: 312059

SEQ ID NO: 312396 - RNA, 64 nt, Human; identical to SEQ ID NO: 312060

SEQ ID NO: 312397 - RNA, 64 nt, Human; identical to SEQ ID NO: 312061

SEQ ID NO: 312398 - RNA, 64 nt, Human; identical to SEQ ID NO: 312062

SEQ ID NO: 312399 - RNA, 64 nt, Human; identical to SEQ ID NO: 312063

SEQ ID NO: 312400 - RNA, 54 nt, Human; identical to SEQ ID NO: 312064

SEQ ID NO: 312401 - RNA, 64 nt, Human; identical to SEQ ID NO: 312065

SEQ ID NO: 312402 - RNA, 64 nt, Human; identical to SEQ ID NO: 312066

SEQ ID NO: 312403 - RNA, 64 nt, Human; identical to SEQ ID NO: 312067

SEQ ID NO: 312404 - RNA, 64 nt, Human; identical to SEQ ID NO: 312068

SEQ ID NO: 312405 - RNA, 64 nt, Human; identical to SEQ ID NO: 312069

SEQ ID NO: 312406 - RNA, 64 nt, Human; identical to SEQ ID NO: 312070

SEQ ID NO: 312407 - RNA, 64 nt, Human; identical to SEQ ID NO: 312071

SEQ ID NO: 312408 - RNA, 64 nt, Human; identical to SEQ ID NO: 312072

SEQ ID NO: 312409 - RNA, 64 nt, Human; identical to SEQ ID NO: 312073

SEQ ID NO: 312410 - RNA, 64 nt, Human; identical to SEQ ID NO: 312074

SEQ ID NO: 312411 - RNA, 64 nt, Human; identical to SEQ ID NO: 312075

SEQ ID NO: 312412 - RNA, 64 nt, Human; identical to SEQ ID NO: 312076

SEQ ID NO: 312413 - RNA, 64 nt, Human; identical to SEQ ID NO: 312077

SEQ ID NO: 312414 - RNA, 64 nt, Human; identical to SEQ ID NO: 312078

SEQ ID NO: 312415 - RNA, 64 nt, Human; identical to SEQ ID NO: 312079

SEQ ID NO: 312416 - RNA, 64 nt, Human; identical to SEQ ID NO: 312080

SEQ ID NO: 312417 - RNA, 64 nt, Human; identical to SEQ ID NO: 312081

SEQ ID NO: 312418 - RNA, 64 nt, Human; identical to SEQ ID NO: 312082

SEQ ID NO: 312419 - RNA, 64 nt, Human; identical to SEQ ID NO: 312083

SEQ ID NO: 312420 - RNA, 64 nt, Human; identical to SEQ ID NO: 312084

SEQ ID NO: 312421 - RNA, 64 nt, Human; identical to SEQ ID NO: 312085

SEQ ID NO: 312422 - RNA, 64 nt, Human; identical to SEQ ID NO: 312086

SEQ ID NO: 312423 - RNA, 64 nt, Human; identical to SEQ ID NO: 312087

SEQ ID NO: 312424 - RNA, 64 nt, Human; identical to SEQ ID NO: 312088

SEQ ID NO: 312425 - RNA, 64 nt, Human; identical to SEQ ID NO: 312089

SEQ ID NO: 312426 - RNA, 64 nt, Human; identical to SEQ ID NO: 312090

SEQ ID NO: 312427 - RNA, 64 nt, Human; identical to SEQ ID NO: 312091

SEQ ID NO: 312428 - RNA, 64 nt, Human; identical to SEQ ID NO: 312092

SEQ ID NO: 312429 - RNA, 64 nt, Human; identical to SEQ ID NO: 312093

SEQ ID NO: 312430 - RNA, 64 nt, Human; identical to SEQ ID NO: 312094

SEQ ID NO: 312431 - RNA, 64 nt, Human; identical to SEQ ID NO: 312095

SEQ ID NO: 312432 - RNA, 64 nt, Human; identical to SEQ ID NO: 312096

SEQ ID NO: 312433 - RNA, 64 nt, Human; identical to SEQ ID NO: 312097

SEQ ID NO: 312434 - RNA, 64 nt, Human; identical to SEQ ID NO: 312098

SEQ ID NO: 312435 - RNA, 64 nt, Human; identical to SEQ ID NO: 312099

SEQ ID NO: 312436 - RNA, 64 nt, Human; identical to SEQ ID NO: 312100

SEQ ID NO: 312437 - RNA, 64 nt, Human; identical to SEQ ID NO: 312101

SEQ ID NO: 312438 - RNA, 64 nt, Human; identical to SEQ ID NO: 312102

SEQ ID NO: 312439 - RNA, 64 nt, Human; identical to SEQ ID NO: 312103

SEQ ID NO: 312440 - RNA, 64 nt, Human; identical to SEQ ID NO: 312104

SEQ ID NO: 312441 - RNA, 64 nt, Human; identical to SEQ ID NO: 312105

SEQ ID NO: 312442 - RNA, 64 nt, Human; identical to SEQ ID NO: 312106

SEQ ID NO: 312443 - RNA, 64 nt, Human; identical to SEQ ID NO: 312107

SEQ ID NO: 312444 - RNA, 64 nt, Human; identical to SEQ ID NO: 312108

SEQ ID NO: 312445 - RNA, 64 nt, Human; identical to SEQ ID NO: 312109

SEQ ID NO: 312446 - RNA, 64 nt, Human; identical to SEQ ID NO: 312110

SEQ ID NO: 312447 - RNA, 64 nt, Human; identical to SEQ ID NO: 312111

SEQ ID NO: 312448 - RNA, 64 nt, Human; identical to SEQ ID NO: 312112

SEQ ID NO: 312449 - RNA, 64 nt, Human; identical to SEQ ID NO: 312113

SEQ ID NO: 312450 - RNA, 64 nt, Human; identical to SEQ ID NO: 312114

SEQ ID NO: 312451 - RNA, 64 nt, Human; identical to SEQ ID NO: 312115

SEQ ID NO: 312452 - RNA, 64 nt, Human; identical to SEQ ID NO: 312116

SEQ ID NO: 312453 - RNA, 64 nt, Human; identical to SEQ ID NO: 312117

SEQ ID NO: 312454 - RNA, 64 nt, Human; identical to SEQ ID NO: 312118

SEQ ID NO: 312455 - RNA, 64 nt, Human; identical to SEQ ID NO: 312119

SEQ ID NO: 312456 - RNA, 64 nt, Human; identical to SEQ ID NO: 312120

SEQ ID NO: 312457 - RNA, 64 nt, Human; identical to SEQ ID NO: 312121

SEQ ID NO: 312458 - RNA, 64 nt, Human; identical to SEQ ID NO: 312122

SEQ ID NO: 312459 - RNA, 64 nt, Human; identical to SEQ ID NO: 312123

SEQ ID NO: 312460 - RNA, 64 nt, Human; identical to SEQ ID NO: 312124

SEQ ID NO: 312461 - RNA, 64 nt, Human; identical to SEQ ID NO: 312125

SEQ ID NO: 312462 - RNA, 64 nt, Human; identical to SEQ ID NO: 312126

SEQ ID NO: 312463 - RNA, 64 nt, Human; identical to SEQ ID NO: 312127

SEQ ID NO: 312464 - RNA, 64 nt, Human; identical to SEQ ID NO: 312128

SEQ ID NO: 312465 - RNA, 64 nt, Human; identical to SEQ ID NO: 312129

SEQ ID NO: 312466 - RNA, 64 nt, Human; identical to SEQ ID NO: 312130

SEQ ID NO: 312467 - RNA, 64 nt, Human; identical to SEQ ID NO: 312131

SEQ ID NO: 312468 - RNA, 64 nt, Human; identical to SEQ ID NO: 312132

SEQ ID NO: 312469 - RNA, 64 nt, Human; identical to SEQ ID NO: 312133

SEQ ID NO: 312470 - RNA, 64 nt, Human; identical to SEQ ID NO: 312134

SEQ ID NO: 312471 - RNA, 64 nt, Human; identical to SEQ ID NO: 312135

SEQ ID NO: 312472 - RNA, 64 nt, Human; identical to SEQ ID NO: 312136

SEQ ID NO: 312473 - RNA, 64 nt, Human; identical to SEQ ID NO: 312137

SEQ ID NO: 312474 - RNA, 64 nt, Human; identical to SEQ ID NO: 312138

SEQ ID NO: 312475 - RNA, 64 nt, Human; identical to SEQ ID NO: 312139

SEQ ID NO: 312476 - RNA, 64 nt, Human; identical to SEQ ID NO: 312140

SEQ ID NO: 312477 - RNA, 64 nt, Human; identical to SEQ ID NO: 312141

SEQ ID NO: 312478 - RNA, 64 nt, Human; identical to SEQ ID NO: 312142

SEQ ID NO: 312479 - RNA, 64 nt, Human; identical to SEQ ID NO: 312143

SEQ ID NO: 312480 - RNA, 64 nt, Human; identical to SEQ ID NO: 312144

SEQ ID NO: 312481 - RNA, 64 nt, Human; identical to SEQ ID NO: 312145

SEQ ID NO: 312482 - RNA, 64 nt, Human; identical to SEQ ID NO: 312146

SEQ ID NO: 312483 - RNA, 64 nt, Human; identical to SEQ ID NO: 312147

SEQ ID NO: 312484 - RNA, 64 nt, Human; identical to SEQ ID NO: 312148

SEQ ID NO: 312485 - RNA, 64 nt, Human; identical to SEQ ID NO: 312149

SEQ ID NO: 312486 - RNA, 64 nt, Human; identical to SEQ ID NO: 312150

SEQ ID NO: 312487 - RNA, 64 nt, Human; identical to SEQ ID NO: 312151

SEQ ID NO: 312488 - RNA, 64 nt, Human; identical to SEQ ID NO: 312152

SEQ ID NO: 312489 - RNA, 64 nt, Human; identical to SEQ ID NO: 312153

SEQ ID NO: 312490 - RNA, 64 nt, Human; identical to SEQ ID NO: 312154

SEQ ID NO: 312491 - RNA, 64 nt, Human; identical to SEQ ID NO: 312155

SEQ ID NO: 312492 - RNA, 64 nt, Human; identical to SEQ ID NO: 312156

SEQ ID NO: 312493 - RNA, 64 nt, Human; identical to SEQ ID NO: 312157

SEQ ID NO: 312494 - RNA, 64 nt, Human; identical to SEQ ID NO: 312158

SEQ ID NO: 312495 - RNA, 64 nt, Human; identical to SEQ ID NO: 312159

SEQ ID NO: 312496 - RNA, 64 nt, Human; identical to SEQ ID NO: 312160

SEQ ID NO: 312497 - RNA, 64 nt, Human; identical to SEQ ID NO: 312161

SEQ ID NO: 312498 - RNA, 64 nt, Human; identical to SEQ ID NO: 312162

SEQ ID NO: 312499 - RNA, 64 nt, Human; identical to SEQ ID NO: 312163

SEQ ID NO: 312500 - RNA, 64 nt, Human; identical to SEQ ID NO: 312164

SEQ ID NO: 312501 - RNA, 64 nt, Human; identical to SEQ ID NO: 312165

SEQ ID NO: 312502 - RNA, 64 nt, Human; identical to SEQ ID NO: 312166

SEQ ID NO: 312503 - RNA, 64 nt, Human; identical to SEQ ID NO: 312167

SEQ ID NO: 312504 - RNA, 64 nt, Human; identical to SEQ ID NO: 312168

SEQ ID NO: 312505 - RNA, 64 nt, Human; identical to SEQ ID NO: 312169

SEQ ID NO: 312506 - RNA, 64 nt, Human; identical to SEQ ID NO: 312170

SEQ ID NO: 312507 - RNA, 64 nt, Human; identical to SEQ ID NO: 312171

SEQ ID NO: 312508 - RNA, 64 nt, Human; identical to SEQ ID NO: 312172

SEQ ID NO: 312509 - RNA, 64 nt, Human; identical to SEQ ID NO: 312173

SEQ ID NO: 312510 - RNA, 64 nt, Human; identical to SEQ ID NO: 312174

SEQ ID NO: 312511 - RNA, 64 nt, Human; identical to SEQ ID NO: 312175

SEQ ID NO: 312512 - RNA, 63 nt, Human; identical to SEQ ID NO: 312176

SEQ ID NO: 312513 - RNA, 64 nt, Human; identical to SEQ ID NO: 312177

SEQ ID NO: 312514 - RNA, 64 nt, Human; identical to SEQ ID NO: 312178

SEQ ID NO: 312515 - RNA, 64 nt, Human; identical to SEQ ID NO: 312179

SEQ ID NO: 312516 - RNA, 64 nt, Human; identical to SEQ ID NO: 312180

SEQ ID NO: 312517 - RNA, 64 nt, Human; identical to SEQ ID NO: 312181

SEQ ID NO: 312518 - RNA, 64 nt, Human; identical to SEQ ID NO: 312182

SEQ ID NO: 312519 - RNA, 64 nt, Human; identical to SEQ ID NO: 312183

SEQ ID NO: 312520 - RNA, 64 nt, Human; identical to SEQ ID NO: 312184

SEQ ID NO: 312521 - RNA, 64 nt, Human; identical to SEQ ID NO: 312185

SEQ ID NO: 312522 - RNA, 64 nt, Human; identical to SEQ ID NO: 312186

SEQ ID NO: 312523 - RNA, 64 nt, Human; identical to SEQ ID NO: 312187

SEQ ID NO: 312524 - RNA, 64 nt, Human; identical to SEQ ID NO: 312188

SEQ ID NO: 312525 - RNA, 64 nt, Human; identical to SEQ ID NO: 312189

SEQ ID NO: 312526 - RNA, 64 nt, Human; identical to SEQ ID NO: 312190

SEQ ID NO: 312527 - RNA, 64 nt, Human; identical to SEQ ID NO: 312191

SEQ ID NO: 312528 - RNA, 64 nt, Human; identical to SEQ ID NO: 312192

SEQ ID NO: 312529 - RNA, 64 nt, Human; identical to SEQ ID NO: 312193

SEQ ID NO: 312530 - RNA, 64 nt, Human; identical to SEQ ID NO: 312194

SEQ ID NO: 312531 - RNA, 64 nt, Human; identical to SEQ ID NO: 312195

SEQ ID NO: 312532 - RNA, 64 nt, Human; identical to SEQ ID NO: 312196

SEQ ID NO: 312533 - RNA, 64 nt, Human; identical to SEQ ID NO: 312197

SEQ ID NO: 312534 - RNA, 64 nt, Human; identical to SEQ ID NO: 312198

SEQ ID NO: 312535 - RNA, 64 nt, Human; identical to SEQ ID NO: 312199

SEQ ID NO: 312536 - RNA, 64 nt, Human; identical to SEQ ID NO: 312200

SEQ ID NO: 312537 - RNA, 64 nt, Human; identical to SEQ ID NO: 312201

SEQ ID NO: 312538 - RNA, 64 nt, Human; identical to SEQ ID NO: 312202

SEQ ID NO: 312539 - RNA, 54 nt, Human; identical to SEQ ID NO: 312203

SEQ ID NO: 312540 - RNA, 64 nt, Human; identical to SEQ ID NO: 312204

SEQ ID NO: 312541 - RNA, 64 nt, Human; identical to SEQ ID NO: 312205

SEQ ID NO: 312542 - RNA, 64 nt, Human; identical to SEQ ID NO: 312206

SEQ ID NO: 312543 - RNA, 64 nt, Human
gagcaagggcgaguggccgguccccgcugugccaggugggcaggcaggagcaaggccugcgagg

SEQ ID NO: 312544 - RNA, 64 nt, Human
gccagagguuccuccaggcaggagcugagcauggggugggcagugaggucccuguaccagcgac

SEQ ID NO: 312545 - RNA, 64 nt, Human
auucaacccacccaacaaaaccuaacauugagguggugggcacacggccccugccguggggcuc

SEQ ID NO: 312546 - RNA, 64 nt, Human
agaagugcuuuaaguguguuugcaugcgccaggcggugggcagcgggggccuguccagcccucu

SEQ ID NO: 312547 - RNA, 64 nt, Human
ucacgccuggaaucccagcacuuugggaagccgaggugggcagaucauaaggucgggagauuaa

SEQ ID NO: 312548 - RNA, 64 nt, Human
agccuuggaggacugcaggaggagggcaggguugggugggcaauggaaggagggaggagagaaa

SEQ ID NO: 312549 - RNA, 64 nt, Human
gaccagccuguaccuugcuguggggcuacaggauggugggcaggaucucaagccagcccccucc

SEQ ID NO: 312550 - RNA, 64 nt, Human
gaccuugacccagaccugagucggcugcucuuggggugggcaccaggucaacccuucuccuccu

SEQ ID NO: 312551 - RNA, 64 nt, Human
agagugaucaaggguguaugaugugcacuacaauggugggcaaaacaggcuccugcucuugugg

SEQ ID NO: 312552 - RNA, 64 nt, Human
gauucauaaacuuuuaugacuuauauuguuuccaggugggcaugguuuauuucccaguuuaaca

SEQ ID NO: 312553 - RNA, 64 nt, Human
aggagggaauacuggcuccaucuuugagagcucuggugggcagggcagaaacaggccacagugc

SEQ ID NO: 312554 - RNA, 64 nt, Human
aaggaacuggaugggcugcagugaggugggggcgggugggcagggaaugggagaggggaagucu

SEQ ID NO: 312555 - RNA, 64 nt, Human
cuucauucccaaccccugccucugguggaccucuggugggcaggagcuuggacugcucuggcua

SEQ ID NO: 312556 - RNA, 64 nt, Human
cugggggggcgggcaguggacaaggauggcaaggggugggcauuggggugccaggcaggcaugu

SEQ ID NO: 312557 - RNA, 64 nt, Human
cugaacuggcuggcaggaccaagacugcggcuggggugggcagggaagggaagccgggggcugc

SEQ ID NO: 312558 - RNA, 64 nt, Human
cccaaaucaccuaacccucauccagggcuauuuuggugggcagggacugccuccucccggaauu

SEQ ID NO: 312559 - RNA, 64 nt, Human
cauaucuagggaccacccccgaugcauuggugagggugggcacuuauaaaugccugcuauuguu

SEQ ID NO: 312560 - RNA, 64 nt, Human
ccuuauuuuccugggcugagccguuuggagggagggugggcacagcugggccugcugugaccac

SEQ ID NO: 312561 - RNA, 64 nt, Human
ggucaaaaggaaggaagaaguuggaguggaguggggugggcaauuuccauuuuaaagaguguag

SEQ ID NO: 312562 - RNA, 64 nt, Human
aggcgcccucccuuccugaggagcuguuggccugggugggcaggaacugcaguauggccauggg

SEQ ID NO: 312563 - RNA, 64 nt, Human
auugccagagaggcucuuagcauaaaaggcauuaggugggcauuuuucugugugcccccaaaaa

SEQ ID NO: 312564 - RNA, 64 nt, Human
uuaguuacauguaaaauuuuagauuucuaaaacaggugggcaaucauuuugaauacuguucugu

SEQ ID NO: 312565 - RNA, 64 nt, Human
uguggcaaagugcuguacccuuccaccuccuagaggugggcagcugggccccaccuacuuguga

SEQ ID NO: 312566 - RNA, 64 nt, Human
cuacuaaaaguacaaaaaauuagcugggcgugguggugggcaccuguagucccagcuacucggg

SEQ ID NO: 312567 - RNA, 64 nt, Human
acgcuuugcugcuaccgcccugggcuggacuggaggugggcaugccacccucacacacacagcu

SEQ ID NO: 312568 - RNA, 64 nt, Human
ggcucuaggacaucuguccaggaggcugggcggaggugggcaggaugugagagguggggaguac

SEQ ID NO: 312569 - RNA, 64 nt, Human
cugugccaacacaaaaaacaacuuuggcacagguggugggcaggggguagagagauuucagcuu

SEQ ID NO: 312570 - RNA, 64 nt, Human
cucaggugaccuguuccagcccaggcagagaucaggugggcagaggcuggcagugcugauucag

SEQ ID NO: 312571 - RNA, 64 nt, Human
ucacaccuguaaucccagcacuuugggaggccgaggugggcagaucaugggucaagagaucgag

SEQ ID NO: 312572 - RNA, 64 nt, Human
ugugugugugugugugugugcacgugcgccugagggugggcaugagucuugccagaaugugagu

SEQ ID NO: 312573 - RNA, 64 nt, Human
cccauggugaugcuguggcaucagacauguccguggugggcacagugccuguugcccugggaaa

SEQ ID NO: 312574 - RNA, 64 nt, Human
gaggguggcccugacccccucagggcucauuccuggugggcaugacucgguaaggagguucugu

SEQ ID NO: 312575 - RNA, 64 nt, Human
ucuauuaaaaauacaaaaauuagcuggcugugguggugggcaccuguaaucccagcuacucggg

SEQ ID NO: 312576 - RNA, 64 nt, Human
aagugagcgcugggcuguuuuagugccaggcugcggugggcagccaugagaacaaaaccucuuc

SEQ ID NO: 312577 - RNA, 50 nt, Human
uggagcccaggggcuugugaggugggcagcucucugggccuucagaaccu

SEQ ID NO: 312578 - RNA, 64 nt, Human
ucacaccuguaaucccagcacuuugggaggccgaggugggcagaucacgaggucaggaguuuga

SEQ ID NO: 312579 - RNA, 64 nt, Human
ucacgccuguaaucccagcacuuugggaggcugaggugggcagaucacgaggucaagagaucga

SEQ ID NO: 312580 - RNA, 64 nt, Human
guagcaggggaagguuuggugugugggggugggaggugggcagaagucuuggggaggaaugggc

SEQ ID NO: 312581 - RNA, 64 nt, Human
agcccuggaagcagggcuuuuccggaugccuaggggugggcagugccagccccuccucaccacu

SEQ ID NO: 312582 - RNA, 64 nt, Human
aaacaguggcuccugggagcagaaaaggaauugaggugggcaggcagaagagccuggauugcuc

SEQ ID NO: 312583 - RNA, 64 nt, Human
ucauaccuguaaucccagcacuuugggaggcuacggugggcagaucaucugaggccaggaguuc

SEQ ID NO: 312584 - RNA, 64 nt, Human
uuuuggguuucugcccugcccacccucuggagaaggugggcacuggauuaguuaacagacaaca

SEQ ID NO: 312585 - RNA, 64 nt, Human
gggauaucuauuacuaaucagcacacaauagcugggugggcacccccucucucugcagcuggug

SEQ ID NO: 312586 - RNA, 64 nt, Human
gagguccacaacacacagauuugagcucagcccuggugggcagagagguagggauggggcugug

SEQ ID NO: 312587 - RNA, 64 nt, Human
uuaugcgucuccagggaagccucggugccagaguggugggcagaucugaccauccccacagacc

SEQ ID NO: 312588 - RNA, 64 nt, Human
acgaggcauuccugcucauucccucugcuuagcuggugggcaggggagagagggaaaugccaaa

SEQ ID NO: 312589 - RNA, 64 nt, Human
acugagcccgguuuccauguaaaaucucuguuguggugggcauagguggcaccaucuaaagaaa

SEQ ID NO: 312590 - RNA, 64 nt, Human
acaugaauggaguggcauuuuguuccaagucagaggugggcaccuauaauaaaugacuaggguu

SEQ ID NO: 312591 - RNA, 64 nt, Human
cuuucaaaucgguccccugucgaguucggcucugggugggcaguaggaccaccagugugggguu

SEQ ID NO: 312592 - RNA, 64 nt, Human
ucaugccuguaaucccagcacuuugggaggcugaggugggcauaucaccugaggucagcaguua

SEQ ID NO: 312593 - RNA, 64 nt, Human
uacauauuacugggauggggggugguucgggaugggugggcagcugcugaacccuuuagggcau

SEQ ID NO: 312594 - RNA, 64 nt, Human
ccuccagaccuccuaggccugauuguccugccagggugggcagacagacagauggaccggccca

SEQ ID NO: 312595 - RNA, 50 nt, Human
augucaccuccaaugacuagggugggcaaccacaaacccacgagggcaga

SEQ ID NO: 312596 - RNA, 64 nt, Human
gaagaaggaaaggcacagguggagaacaguaaaaggugggcagaugucuuugaagaaaugcuca

SEQ ID NO: 312597 - RNA, 64 nt, Human
ugugcuuggcuugcuugugcagcuccaggcacccggugggcacucuggugguguuuguggugaa

SEQ ID NO: 312598 - RNA, 64 nt, Human
ugcguccagcuuacacaaucauaauucaaagguuggugggcaauguaauacuuaauuaaaauaa

SEQ ID NO: 312599 - RNA, 64 nt, Human
auaugugcuugccucaguaaaaugaaccccacugggugggcagagguucauuucaaauacaucu

SEQ ID NO: 312600 - RNA, 64 nt, Human
ucaugcuuguaaucccagcacuuugggaggccgaggugggcagaucacuugagaucaggaccag

SEQ ID NO: 312601 - RNA, 50 nt, Human
uggagggggaugaguccugaggugggcauuucacgggaaggguuggugug

SEQ ID NO: 312602 - RNA, 64 nt, Human
aggauaugacugcccuggagaaggauuacaaggaggugggcauggauaguguggagugggggga

SEQ ID NO: 312603 - RNA, 64 nt, Human
aaggccugugccagguucccugugcccuccucgaggugggcagccaucaccagccacaguuaag

SEQ ID NO: 312604 - RNA, 64 nt, Human
aucugaugugcagaagcugggcugcaccugcgggggugggcauagaccgggcugggucugcagc

SEQ ID NO: 312605 - RNA, 64 nt, Human
aagaagucaauaugcuuauuuaaauauuauggauggugggcagaucacuugaggucaggaguuc

SEQ ID NO: 312606 - RNA, 64 nt, Human
cccugaacucacuguguauucucuuggagccuugggugggcagggacggcccagguaccugcuc

SEQ ID NO: 312607 - RNA, 64 nt, Human
aaaaggggaaaaccacuugagucuugugguguguggugggcagacaccacaggguggcaucacc

SEQ ID NO: 312608 - RNA, 64 nt, Human
ucacgccuguaaucccagcacuuugggaggccgaggugggcagaucaugaggucagaagaucga

SEQ ID NO: 312609 - RNA, 64 nt, Human
cuguuccucugcuggaccugggguaggcugcaggggugggcagaagccccucuuaaauuguggu

SEQ ID NO: 312610 - RNA, 64 nt, Human
ucacgccuguaaucccagcauuuugggaggcugaggugggcagaucacuugaggccaggaguuc

SEQ ID NO: 312611 - RNA, 64 nt, Human
ccuguaggccucaucuuaggaaccccuugggaggggugggcaggggggcugcuagcaagggucc

SEQ ID NO: 312612 - RNA, 64 nt, Human
caggcuggcagagucaguccuuagaagucacugaggugggcaucugccuuuuguaaagccucca

SEQ ID NO: 312613 - RNA, 64 nt, Human
aucugagcuuaaacauuuucucaauuguaaaauaggugggcacaaguauuacacaucagaaaau

SEQ ID NO: 312614 - RNA, 64 nt, Human
uugugagguugacacugggaggggcuagaagauuggugggcagcagacuaaagaguuauguugg

SEQ ID NO: 312615 - RNA, 64 nt, Human
gcagugcagucacuaacucugauuuccuaagaaaggugggcagcauuagcagaugguuauuuuu

SEQ ID NO: 312616 - RNA, 64 nt, Human
gaaacauggaagaagaagggaaccgauuugaguuggugggcaaaacucuaaaaaucuaaaucug

SEQ ID NO: 312617 - RNA, 64 nt, Human
aagacgaauagaguuaggaaaaggaagacaagcaggugggcaggaaggacaugcaccgagacca

SEQ ID NO: 312618 - RNA, 64 nt, Human
uccacuaaaaauacaaaaauuagccgggcgugauggugggcaccucuaaucccagcuacuuggg

SEQ ID NO: 312619 - RNA, 64 nt, Human
ucaugccuguaauccuagcacuuugggaggcugaggugggcagaucacuugaggccaauaguuc

SEQ ID NO: 312620 - RNA, 64 nt, Human
ccaccucccucaugccuccgaggggguggaagggggugggcacacuccagggccccccaugccc

SEQ ID NO: 312621 - RNA, 64 nt, Human
auguaauugauuguauauagucucaagaaugguuggugggcaugaguuccuagagaacugucca

SEQ ID NO: 312622 - RNA, 64 nt, Human
cgagcagcgcggcggcggcagggaguuggguuggggugggcauuugaugcgggagguggguggu

SEQ ID NO: 312623 - RNA, 64 nt, Human
ucaagccuauaaucccagcauguugagaggcugaggugggcagaucauuugaggccaggaguuc

SEQ ID NO: 312624 - RNA, 64 nt, Human
uuccccacaucucuucuugccaguaagcagcuuuggugggcagcagcagcucaugaauggcaag

SEQ ID NO: 312625 - RNA, 64 nt, Human
uucccgugucauuaguaauaaggagaggguugggggugggcagggcuccagaaagucagcagug

SEQ ID NO: 312626 - RNA, 64 nt, Human
cugcaugacaguuuuaguuugccuuuuugccucuggugggcaugaagacugagcaaagcuggga

SEQ ID NO: 312627 - RNA, 64 nt, Human
uuuuuuuuuuuuaacagaaaaccugaugucaagaggugggcaauagaaauggaaacaaauuguc

SEQ ID NO: 312628 - RNA, 64 nt, Human
gaccuguguuccugugccaaaguccugucaggcuggugggcaccaggaaaggccugcacccucu

SEQ ID NO: 312629 - RNA, 64 nt, Human
uugacagcuggucaagacggucacgggagcucuaggugggcacaaccaaccccucuccugggag

SEQ ID NO: 312630 - RNA, 64 nt, Human
aggugggagcuuagggaaugcagagccuacuugaggugggcaucugggaauacaggguagaaag

SEQ ID NO: 312631 - RNA, 64 nt, Human
ucaugccuguaaucccagcacuuugggaggccgaggugggcagaucaccugaggucaggaguuc

SEQ ID NO: 312632 - RNA, 64 nt, Human
uggccucuggcaggcaggcagcuguacccaagcuggugggcagggggcuggaaggcaccaggcc

SEQ ID NO: 312633 - RNA, 64 nt, Human
uggccaccugcaggccagucucaacccucccccaggugggcaggcacuugauggcuacaaauaa

SEQ ID NO: 312634 - RNA, 64 nt, Human
ccaggaucuucuccuuucugggcaucccuuugugggugggcagagcccugacccacagcugugu

SEQ ID NO: 312635 - RNA, 64 nt, Human
caucucccaggugagagccuuuugaggaagggagggugggcaguggucuggaagcuugaugcag

SEQ ID NO: 312636 - RNA, 64 nt, Human
uuacgccuauaaucccagcauuuugggaguccgaggugggcagaucacuugagcucaggagguc

SEQ ID NO: 312637 - RNA, 64 nt, Human
gcccaaggacuugguacaggaagggagaagggcaggugggcagggagcagacagggucuggcuu

SEQ ID NO: 312638 - RNA, 64 nt, Human
uccaaguauacucucaaauguaugaagcaacuggggugggcagaagacauuuuagaaugagggc

SEQ ID NO: 312639 - RNA, 64 nt, Human
ucuacuaaaaauacaaaaguuagcuggggcugguggugggcaucuguagucccagcuaauugga

SEQ ID NO: 312640 - RNA, 61 nt, Human
gguucaggaagacugacugaggccacuuccaggugggcagcagaggcaggccccaguguga

SEQ ID NO: 312641 - RNA, 64 nt, Human
uuggggugauggcuugucgggggugggaggggaaggugggcagagacugauguauaauggacag

SEQ ID NO: 312642 - RNA, 64 nt, Human
cacuucuuuggcugguggguaaugccagggguggggugggcacaggcccucaagagccccuuuu

SEQ ID NO: 312643 - RNA, 64 nt, Human
gcaauaggaugacagcccagugucggccuggccgggugggcagccucaggucuugagaggauaa

SEQ ID NO: 312644 - RNA, 64 nt, Human
ucucuauuaaaaaugcaaaaaauuagccgggcguggugggcacccguaaucccagcuacucagg

SEQ ID NO: 312645 - RNA, 64 nt, Human
ugguagggaugagccugagguuauacaggaguuaggugggcaugaaauuuguuucccccagucc

SEQ ID NO: 312646 - RNA, 64 nt, Human
uacuccguaacagauuuuguuggcauagcucuggggugggcaguuuuuugaaaaugggcucaac

SEQ ID NO: 312647 - RNA, 64 nt, Human
gguuagucaagaagcugaggcagaacucacugggggugggcaguuaagguggaggcugauucua

SEQ ID NO: 312648 - RNA, 64 nt, Human
gccaucucuccuagcccccagcccuggugccacuggugggcagguucccauucuuuggggcugg

SEQ ID NO: 312649 - RNA, 64 nt, Human
agcagucucgucuccuguguguaugugugugaguggugggcaggccaguggcagggccggcccc

SEQ ID NO: 312650 - RNA, 64 nt, Human
ugaaaucaaguccugcuucauuuacaagaauuuuggugggcaucuaauccuacauaaugaaaaa

SEQ ID NO: 312651 - RNA, 64 nt, Human
ucaguugcuuugcaggaagugucuagaggaauauggugggcacagaaguagcucuggugaccuu

SEQ ID NO: 312652 - RNA, 64 nt, Human
aagaauuaacacuuugacuccuaaaugugauacuggugggcacauauuaauuuguaucgcuuuu

SEQ ID NO: 312653 - RNA, 64 nt, Human
cauuuacauuagggccuucucccagggugugcucggugggcagugugggacuggggguguggga

SEQ ID NO: 312654 - RNA, 64 nt, Human
ucaugccaguuaucccagcacuuugggaggccgaggugggcaaaucaugaggucaggagauuga

SEQ ID NO: 312655 - RNA, 64 nt, Human
uuacaccuauaaucccagcaauuugggaggccaaggugggcagaucacuugaggucaggaguuc

SEQ ID NO: 312656 - RNA, 64 nt, Human
agcuguauuuccauucuuggguuucugcgccgucggugggcacuuguuauuuuccaggaaccuu

SEQ ID NO: 312657 - RNA, 64 nt, Human
cuaggcccucaggguuuuguagagugugagcccuggugggcaggguuggggggucugucuucug

SEQ ID NO: 312658 - RNA, 64 nt, Human
cagagagccaguguuuguacaaucagaccagcagggugggcaacuccucccuggaggugagugu

SEQ ID NO: 312659 - RNA, 64 nt, Human
guggggugacaucguucccuggggacauugggaaggugggcaggggcaagugaacucagcacuc

SEQ ID NO: 312660 - RNA, 64 nt, Human
agggaggugcuuccugcaccucaggaugggcgagggugggcauugggggagagggggaccuggg

SEQ ID NO: 312661 - RNA, 64 nt, Human
gacgaaaagacaaagaauacuggagaagagagagggugggcagagccacaaccucauccuccca

SEQ ID NO: 312662 - RNA, 64 nt, Human
cacaccuguuaaucccagcacuucgggaggccaaggugggcaguucgcuugggcccaagaguuc

SEQ ID NO: 312663 - RNA, 64 nt, Human
aguguguguguguguguguguguguauaccugggggugggcagugcucuuuuucuaaaacuaau

SEQ ID NO: 312664 - RNA, 64 nt, Human
ccucaggaauguauccacaguggccuuccuugcuggugggcaguguauccugauggcaggguac

SEQ ID NO: 312665 - RNA, 64 nt, Human
ucaugccuguaaucccagcacuuugagaggccgaggugggcagaucacuugaggccuggaguuc

SEQ ID NO: 312666 - RNA, 64 nt, Human
accaucaucacagucagcccugggggugggggguggugggcagggaugggacgcaccacacaga

SEQ ID NO: 312667 - RNA, 51 nt, Human
ucuaucgauacuuacaguaauggugggcagguggauacccgcuuccauggu

SEQ ID NO: 312668 - RNA, 64 nt, Human
cucugcccugugggggccugguccucuccucaggggugggcacccaucccucuccccacugagc

SEQ ID NO: 312669 - RNA, 64 nt, Human
ggccagccugaagucacgguccuggcccagcacaggugggcagcagcgagcuggcaggugaagu

SEQ ID NO: 312670 - RNA, 64 nt, Human
cuuguugaugaugguugcugacaccaucaucgggggugggcacacggcccuucggagccugggc

SEQ ID NO: 312671 - RNA, 64 nt, Human
gagccugcaaaugcauuguguuugcucugguggaggugggcauggggucuguucugaaauguaa

SEQ ID NO: 312672 - RNA, 64 nt, Human
cagccaacccccuagguguggaccagcugaggcaggugggcagauaugcagagggacuuggggc

SEQ ID NO: 312673 - RNA, 64 nt, Human
uuuuguggugucaguggaauggauagguaacuugggugggcaacuuggggagcugaccauucuc

SEQ ID NO: 312674 - RNA, 64 nt, Human
auuuugccacuuucaugugaauguuagucaauucggugggcaauuuuuggacaugaaccagaaa

SEQ ID NO: 312675 - RNA, 64 nt, Human
cucacaccuguaucccagcaauuugggaggccgaggugggcagaucacuugaggucaggaguuc

SEQ ID NO: 312676 - RNA, 64 nt, Human
ugauacuuagcugacauggauuugcagaccccagggugggcagaugucuccaguggggucagug

SEQ ID NO: 312677 - RNA, 64 nt, Human
guaguguagugcggugugcuuuuacgugauggcgggugggcagcgggcggcgggcuccgcgcag

SEQ ID NO: 312678 - RNA, 64 nt, Human
acauuucuauggccuugcucucugcuguccuguuggugggcacgacacaucagugguguucagu

SEQ ID NO: 312679 - RNA, 64 nt, Human
ggaaaacuaacagagggggagccagggaugauggggugggcaggggauuugcaugaugaggagu

SEQ ID NO: 312680 - RNA, 64 nt, Human
ccaaaguuugcuuaagguuugacccuagagcagaggugggcaaacuaugaccuggaaaccaaau

SEQ ID NO: 312681 - RNA, 64 nt, Human
auugcagcccagauccccuaucagggggacagcuggugggcaaagcagccaccccacagccuug

SEQ ID NO: 312682 - RNA, 64 nt, Human
ucaugugguuaguuuggucuguucucucggaguuggugggcacccuaaauauuuguaaguuggu

SEQ ID NO: 312683 - RNA, 64 nt, Human
ucauucccuguucguaggaaggugcaggagaggaggugggcaagcuuauggguuucuugguaaa

SEQ ID NO: 312684 - RNA, 64 nt, Human
cacgucgcucagagcuggggugcucacggugggcggugggcaagaagccagcauggaagaaaga

SEQ ID NO: 312685 - RNA, 64 nt, Human
cacguccuauagucgcagcacuuugggaggccaaggugggcaguucacgugagguggggaguuc

SEQ ID NO: 312686 - RNA, 64 nt, Human
aagauacucugugaggugcaagacuucaggguggggugggcaugggguggggguaugggaacag

SEQ ID NO: 312687 - RNA, 64 nt, Human
ucacaccuguaaucccaacacuuugggaggcugaggugggcagaucaccugaggucaggaguuc

SEQ ID NO: 312688 - RNA, 64 nt, Human
gucauuccuucaaaacuguguuuugaccacacaaggugggcauuaacaaaccaaauuucaacuu

SEQ ID NO: 312689 - RNA, 64 nt, Human
ucacaaauuacaguaaaaaugugcucuuuuuuaaggugggcagauuaguuugucaaagucucag

SEQ ID NO: 312690 - RNA, 64 nt, Human
cacuguaccccagcucucuucuaaaagagaagugggugggcacacugaacuguuugguggcccc

SEQ ID NO: 312691 - RNA, 64 nt, Human
cacccccucgauuugggcagaugguggagucaagggugggcagcguacuucuaacucauuguuu

SEQ ID NO: 312692 - RNA, 64 nt, Human
uuuucacucaucccugagaagcccuuuccaguagggugggcaauucccaacuuccuugccacaa

SEQ ID NO: 312693 - RNA, 64 nt, Human
ugagauggcccccacugugaaggccacgccugugggugggcagccaccuggugccaccacaggg

SEQ ID NO: 312694 - RNA, 64 nt, Human
cuuuucugggucuguucaaaaagcaaacauuaagggugggcacauaauccacaagccagaaagu

SEQ ID NO: 312695 - RNA, 64 nt, Human
uuggcugccugugggcuuccccagguggccuggaggugggcaaagggaaguaacagacacacga

SEQ ID NO: 312696 - RNA, 64 nt, Human
gagaggugcucccccugggacaggagggugggcuggugggcaaacauugggcccaugcagacac

SEQ ID NO: 312697 - RNA, 64 nt, Human
ccuggguggaguguugaguuggaaccauuguaaaggugggcaaagccuaguagagaaccagugc

SEQ ID NO: 312698 - RNA, 64 nt, Human
cuacuaaaaauacaaacaauuaacugagcauaguggugggcaccuauaauaccagcuacuccgg

SEQ ID NO: 312699 - RNA, 64 nt, Human
ucagugcucggcagucauacuggggugcgagagaggugggcagcagcucagccuccccccgcug

SEQ ID NO: 312700 - RNA, 64 nt, Human
uugcuuucccugauuucuugauuugaucuucaaaggugggcaaaguucccucugacucuucccc

SEQ ID NO: 312701 - RNA, 64 nt, Human
gugggaaguguuuacacauggagagaugccccauggugggcaggcagaugaugaaguacuggca

SEQ ID NO: 312702 - RNA, 64 nt, Human
gggcggcuuuuauauguaauugcagcguggggugggugggcaugggagguaggggugggcccug

SEQ ID NO: 312703 - RNA, 64 nt, Human
ggugagaggcagugggcaagugaucuuggagaugggugggcaggugauucugugggcaggggau

SEQ ID NO: 312704 - RNA, 64 nt, Human
uugcucagucuucugaacuccagggaccagcccuggugggcaugggguggggagcagggaguug

SEQ ID NO: 312705 - RNA, 64 nt, Human
acuagcauaugagacuucugguaccaauggggcuggugggcaugcuguccacuguguggugcua

SEQ ID NO: 312706 - RNA, 64 nt, Human
ggcacccuggauuacucuuuggaaaucacuccuuggugggcagcauccugaggcuuccccagaa

SEQ ID NO: 312707 - RNA, 64 nt, Human
gucaggcucacagcugggguggccugggggugggggugggcaaggcugacacuggaaaaugggu

SEQ ID NO: 312708 - RNA, 64 nt, Human
uuuaaaaaauguauaggugcagauauugaaacuaggugggcacuucaaugccaaguauauacuc

SEQ ID NO: 312709 - RNA, 64 nt, Human
cgcggagccucagcaggagggguggcgaguugcgggugggcagggccaggacgguguggcgcca

SEQ ID NO: 312710 - RNA, 64 nt, Human
gccuguaaucccagcacuuacuuugggaggccaaggugggcagauaaccugcggucaggaguuu

SEQ ID NO: 312711 - RNA, 64 nt, Human
ucaugccuguaaucccagcacuuugggaggccgaggugggcagauugccugagcucaagaguuc

SEQ ID NO: 312712 - RNA, 64 nt, Human
aacccuggaagcuguaugccacagugggccugcuggugggcauggauguccucacucucgccau

SEQ ID NO: 312713 - RNA, 64 nt, Human
gcucuacccuuccucccaguaagaagggaaggugggugggcaccugagagauuaagacuauucu

SEQ ID NO: 312714 - RNA, 64 nt, Human
acuucucacaggccuccucuuucaaauaaggcauggugggcagcaaagaaaggguguauugaua

SEQ ID NO: 312715 - RNA, 64 nt, Human
ccucccugccaggaugcuagauuauuggcugggaggugggcaaguggcagcccagcugaagcaa

SEQ ID NO: 312716 - RNA, 64 nt, Human
ucucuugccugaggcuugaaucugacaaacccuuggugggcacugcucccuuagguucuucccc

SEQ ID NO: 312717 - RNA, 64 nt, Human
ccaggcuccaggaaguugagggacccacaggagaggugggcagagcuggaguucucauccaggg

SEQ ID NO: 312718 - RNA, 64 nt, Human
cucacaaugcaaagacaugcuggcuggcgggacaggugggcaggacugacccugaggaggccuu

SEQ ID NO: 312719 - RNA, 55 nt, Human
ugauggagagcacggucuaggugggggugggcaugcucccuuuccugugcgcagg

SEQ ID NO: 312720 - RNA, 64 nt, Human
uccaccccgcagccugguccucggcucucccacaggugggcaccccccacuuuggugcuaauag

SEQ ID NO: 312721 - RNA, 64 nt, Human
uacuaaaauaguacaaaaauuagccgggcgugguggugggcacugguaaucccagguacucaag

SEQ ID NO: 312722 - RNA, 64 nt, Human
uuacgccuguuaucccagcacuuugggaggucgaggugggcagaucaccugagguuaggaguuc

SEQ ID NO: 312723 - RNA, 64 nt, Human
gagaguccugaacgguuugauguggggaugggguggugggcaguggggaauagaugguugacuu

SEQ ID NO: 312724 - RNA, 64 nt, Human
cauguaagcugguaggggauuuuugagaaaagaaggugggcacuaguauaucuaaauuaacaau

SEQ ID NO: 312725 - RNA, 64 nt, Human
uuuugugauuuuuaacugguaaauuucuacuuuaggugggcauuuucuucccuagaauaugccc

SEQ ID NO: 312726 - RNA, 64 nt, Human
guuuugauuucugcugugcuuauaaaucacuuucggugggcaagggagagaggggaaaaugggu

SEQ ID NO: 312727 - RNA, 64 nt, Human
uugggguucggcucagcucaacauggcuugacauggugggcacacuggcgcccaguaagagaga

SEQ ID NO: 312728 - RNA, 64 nt, Human
aguggggguggcgugccaggcgcguaccccaccaggugggcaaagcagaaaccugcggggagcg

SEQ ID NO: 312729 - RNA, 64 nt, Human
uggcgcuuccagcugagacaggaguccggacagaggugggcaggguggauggcuucgggcaggg

SEQ ID NO: 312730 - RNA, 64 nt, Human
cugcaucaaagauaugagauuuuuuuuuuuauuaggugggcauuauuuaugaccuuuucugugg

SEQ ID NO: 312731 - RNA, 64 nt, Human
gcugaaucagagauaugagagauucuuuuuuauaggugggcauuauuuaugccccuuucugugg

SEQ ID NO: 312732 - RNA, 64 nt, Human
ucaagaagccagaccgcaagaagcgcuacaccguggugggcaaccccuacuggauggcaccuga

SEQ ID NO: 312733 - RNA, 64 nt, Human
ucuacuaaaauuauaaaaauuagccgggcaugauggugggcaccuguaaucccagcuacuuggg

SEQ ID NO: 312734 - RNA, 64 nt, Human
ugguuuuggaguguuauuaauagauuuuguuaucggugggcaugcacugcaagaauuaaguauc

SEQ ID NO: 312735 - RNA, 64 nt, Human
uuacaccuguaacccuggcauuuugggaggccaaggugggcagauugccugagcucaggaguuc

SEQ ID NO: 312736 - RNA, 64 nt, Human
gcuacaagguaaaauaucuuugaaaaagauagaaggugggcaaggggagcuugagaagaauaaa

SEQ ID NO: 312737 - RNA, 64 nt, Human
ucaugccuauaaucccagcacuuugggaggccaaggugggcagaucaggaggucaggagaucga

SEQ ID NO: 312738 - RNA, 64 nt, Human
ucugaauuacaaguccucuuuggguguaggagggggugggcaggggacaaguccaggagggguc

SEQ ID NO: 312739 - RNA, 64 nt, Human
ggccucagcgcagagcccugcuuggggccagcacggugggcagcugccggccgcuggggacugg

SEQ ID NO: 312740 - RNA, 64 nt, Human
cuuugcugucaucugugaaugagcuucgccagguggugggcaccugggagccaugcagaggcug

SEQ ID NO: 312741 - RNA, 64 nt, Human
ucuacaaaaaacauaaaaauuagccaggugugguggugggcaccuguaaucucagcuacuuggg

SEQ ID NO: 312742 - RNA, 64 nt, Human
agauuuucuagaaauguuuagguuacuaaaacagggugggcaaacucucuaaacugguacaauu

SEQ ID NO: 312743 - RNA, 64 nt, Human
acacagcaauaccugcaggcuggggcaggcccugggugggcagagaucacacguggccugagaa

SEQ ID NO: 312744 - RNA, 64 nt, Human
uagccucuuugaaaaguucugccuugcccccacaggugggcacauccugugucucauucaccau

SEQ ID NO: 312745 - RNA, 64 nt, Human
gcuuacgccuguaaucccagcagugggagaccgaggugggcagaucacuugaguucaagaccag

SEQ ID NO: 312746 - RNA, 64 nt, Human
ccagccgcugcuacugugggccgccccggggcagggugggcagggcuuuuguggguuaugagga

SEQ ID NO: 312747 - RNA, 64 nt, Human
caaaaacaucugccccgaugcucuaguguuuggaggugggcaggauggagaacagugccuguuu

SEQ ID NO: 312748 - RNA, 64 nt, Human
uucugucucagucuccucaguagcuggggcuuuaggugggcacugccacaccguacuaauuuuu

SEQ ID NO: 312749 - RNA, 64 nt, Human
cugcccccaacccacccuccaccccgucccccacggugggcacugcccagcaccgcaugccacg

SEQ ID NO: 312750 - RNA, 64 nt, Human
uggagucgcagacccuguuggggccgcucgagcuggugggcagccucuuggagcagagugcccc

SEQ ID NO: 312751 - RNA, 64 nt, Human
ccuacacacuccauaggagauccuggcuuuccagggugggcaagggcaaggagcaggcuuggag

SEQ ID NO: 312752 - RNA, 64 nt, Human
accucagccucucgaguagcugggacuacuggcaggugggcaccaugccuggcuacuuuuuugu

SEQ ID NO: 312753 - RNA, 64 nt, Human
cugaguuuuguuucacuuugacauuuggggaucuggugggcagucgaaccauggugaacuccac

SEQ ID NO: 312754 - RNA, 64 nt, Human
cccuggugugucugaacgauggccgcaugacuuuggugggcaucaucagcuggggccugggcug

SEQ ID NO: 312755 - RNA, 64 nt, Human
gaauauacauaaauaaucauuuucagugguuuauggugggcaauauugcaauauuugaaauggu

SEQ ID NO: 312756 - RNA, 64 nt, Human
agcagccugauaggacucuccuaguccaacuuggggugggcaaggcagucagcaucaccagcaa

SEQ ID NO: 312757 - RNA, 64 nt, Human
ugagggcuuccccgaaagucugggaccagguccaggugggcauggaaugcugaugacuuggagc

SEQ ID NO: 312758 - RNA, 64 nt, Human
uugauacggagccaugucaugugccacgaccuggggugggcacagggaggcugcaguuuccugc

SEQ ID NO: 312759 - RNA, 64 nt, Human
uugauacggagccaugucaugugccacgaccuggggugggcacagggaggcugcaguucccuac

SEQ ID NO: 312760 - RNA, 64 nt, Human
gggccaggucugcggcagugcugggguggcaccaggugggcagugguaggugggguggcuugag

SEQ ID NO: 312761 - RNA, 64 nt, Human
cuacuaaaaauacaaaaaauuagcugggcgugguggugggcaccuguagucccagcuacucagg

SEQ ID NO: 312762 - RNA, 64 nt, Human
accucaagccaugaagugucagcuggagaacaguggugggcauggagaggauaugacaugaaau

SEQ ID NO: 312763 - RNA, 64 nt, Human
auucuguuucuuuccuuuccuaaggcugggacauggugggcaucagggacuuugugcuaagccu

SEQ ID NO: 312764 - RNA, 64 nt, Human
uggggggcuccccaucuguguccaaauaaaaagcggugggcaagggcuggccgcagcuccugug

SEQ ID NO: 312765 - RNA, 64 nt, Human
uccaagucagauagucuucugcugcugguaccugggugggcaauggccaccaugucugcacaca

SEQ ID NO: 312766 - RNA, 64 nt, Human
ucaugccuauaaucccagcacuuugggaggccgaggugggcagaucacuugaggccaggagauu

SEQ ID NO: 312767 - RNA, 64 nt, Human
ucccccuugauguguuauuguuguuguuggguggggugggcauuuuguuuauuuguuugguggc

SEQ ID NO: 312768 - RNA, 64 nt, Human
gaauaaaugcuagacuaaaauacagagucuuccaggugggcauuucaaccaacucagucaagga

SEQ ID NO: 312769 - RNA, 64 nt, Human
agcagcccuccugcccccaaagcuuuccgagucuggugggcaggacuucucgcugcccuuccaa

SEQ ID NO: 312770 - RNA, 64 nt, Human
ccuaggguggauggcugcugguguggggacuucgggugggcagaggcaccuugcugggucugug

SEQ ID NO: 312771 - RNA, 60 nt, Human
acuuugccaaucaugucuaaacagauggauggugggcacagauggguccuccaugcuggc

SEQ ID NO: 312772 - RNA, 64 nt, Human
ugugcagaacucuccacuuccccaacccuccccaggugggcagggcggagggagccucagccuc

SEQ ID NO: 312773 - RNA, 64 nt, Human
gggcaggcccuccacuuccaagcaagcagaugggggugggcaccugaggcccaauaauauuugg

SEQ ID NO: 312774 - RNA, 64 nt, Human
cuucacugggggcccagaggcagaugggugggugggugggcagguggccugccaggccaggagu

SEQ ID NO: 312775 - RNA, 64 nt, Human
cuuucagauagcaggcagggaagcaauguaguguggugggcagagccccacacagaaucagaag

SEQ ID NO: 312776 - RNA, 64 nt, Human
auuggaaaauggacaaaagugccuugacguggagggugggcaccagauggggaccagccuugcc

SEQ ID NO: 312777 - RNA, 64 nt, Human
caggcgcccuccucaggccaaccacagcgucuugggugggcaggacaggcucuggagggaaaag

SEQ ID NO: 312778 - RNA, 64 nt, Human
gcaagggaugagucaagaaggugagacccuucccggugggcacgugggccaggcugugugagau

SEQ ID NO: 312779 - RNA, 64 nt, Human
gguggagagaugagauuuagggggugccucauggggugggcaggccuggggugaaaugagaaag

SEQ ID NO: 312780 - RNA, 64 nt, Human
gaacggagcuucaagucagacagaucccugccuuggugggcaguucugccuuccaaggaagaag

SEQ ID NO: 312781 - RNA, 64 nt, Human
ccugcaggggcccuggaaugggggcaagcagcugggugggcagaaugcagaguagacucggggg

SEQ ID NO: 312782 - RNA, 64 nt, Human
ggagaugaguuuuaggaccagcauuacuaaggcaggugggcagacagugaccucucuaggugug

SEQ ID NO: 312783 - RNA, 64 nt, Human
gagguuugcagggucagggaggaggaacggugggggugggcagucacugccuguuccccacugc

SEQ ID NO: 312784 - RNA, 64 nt, Human
gagccuguccucuguggcagguccacacggugugggugggcagggcuuggacccccgucuccau

SEQ ID NO: 312785 - RNA, 64 nt, Human
gcacagaggucaggaagcagggguggggggugcaggugggcacuggagcaugcagaggagguga

SEQ ID NO: 312786 - RNA, 64 nt, Human
uaggaacugagacucugguacccacaggagccugggugggcaaagagcgcucaauccagcuccu

SEQ ID NO: 312787 - RNA, 64 nt, Human
ucuacuaaaaauacaaaaaauagccgggugugguggugggcaccugugaucccagcuuccuggg

SEQ ID NO: 312788 - RNA, 64 nt, Human
cuacuaaaaauacacaaaauuagccgggcgugguggugggcaccuguagucccagcuacucggg

SEQ ID NO: 312789 - RNA, 64 nt, Human
ucaugccuguaaucccaguacuuugggaggcugaggugggcaaaucaccugaggucaggaguuc

SEQ ID NO: 312790 - RNA, 64 nt, Human
ccccagauaucauuuaggaguauuauauaaagguggugggcaaaaacaauguaaggagccuuuc

SEQ ID NO: 312791 - RNA, 64 nt, Human
ugaaaaucccucacaggcccuaacauguuuccugggugggcaggggccucaugacaagcgacaa

SEQ ID NO: 312792 - RNA, 64 nt, Human
gugcaugggugaagggagagccagcucccccgacggugggcauuugugaggcccaugguugaga

SEQ ID NO: 312793 - RNA, 64 nt, Human
ugauagcauuaagcccugauggcgccgguggcgcggugggcaugguucuucacugagagccggc

SEQ ID NO: 312794 - RNA, 64 nt, Human
gcagcccggcaagggcaggaauugggaggccuagggugggcaugaaagcuugggaagcacuguc

SEQ ID NO: 312795 - RNA, 64 nt, Human
cuccugggaaccccucucagggcugcagcuuacaggugggcagcugugauugcacaacuugaag

SEQ ID NO: 312796 - RNA, 64 nt, Human
cuuggcuaucugccuagcacugggcaggggccuuggugggcagauggcaauugaggguagcaac

SEQ ID NO: 312797 - RNA, 64 nt, Human
acagcaaaagacagcugaaaacaagaacuucaccggugggcaggcaagaauucucuucuggaaa

SEQ ID NO: 312798 - RNA, 64 nt, Human
ucuuggugaaccggcgaggggccgagucccgccuggugggcauuugccgccgccuccccaccac

SEQ ID NO: 312799 - RNA, 64 nt, Human
gugguggcucacacuuguaaucccagcacuuugaggugggcaauggcuugagcccaggaguucg

SEQ ID NO: 312800 - RNA, 64 nt, Human
ucacgccuguaaucccagcacuuugggaggccaaggugggcagaucaugaggucaggagaucga

SEQ ID NO: 312801 - RNA, 64 nt, Human
agaaaccaaccagauacaucugcuggagagcccaggugggcacagagaaggguggagagagaau

SEQ ID NO: 312802 - RNA, 64 nt, Human
gugccuccaaguuaccuccagaucagcaggcacaggugggcauugccagguauuuucugagccc

SEQ ID NO: 312803 - RNA, 64 nt, Human
uaaaaacacaccauggaggccacuggugacugcuggugggcaggcuggcccugccugggggagu

SEQ ID NO: 312804 - RNA, 64 nt, Human
ugucuacacccgucauacuaccagcugagaugguggugggcauaaggagaauuugugccuauaa

SEQ ID NO: 312805 - RNA, 64 nt, Human
auuaacaugugccaggucuuaggaugugucuuggggugggcacaguacccggugacucuugggg

SEQ ID NO: 312806 - RNA, 64 nt, Human
cugaugaacaaaucugcaccccacuucagaccucggugggcauucacaccaccccccaugccac

SEQ ID NO: 312807 - RNA, 64 nt, Human
uugccacagaaggcugcugucucccuucugauuuggugggcagguauuguuuuugagccaguau

SEQ ID NO: 312808 - RNA, 64 nt, Human
ugaaaacggccucgggagacgggagcugcgagcaggugggcagaugagggcccuaugcgcacuc

SEQ ID NO: 312809 - RNA, 54 nt, Human
ggcaucuggggagcgggugagcggggugggcacagcccccuucacugcccucga

SEQ ID NO: 312810 - RNA, 64 nt, Human
gccugccugguggccuucuggggccaggaccccuggugggcaacguagccacaggaacaggccc

SEQ ID NO: 312811 - RNA, 64 nt, Human
gcugugacgggguggccagcagggacgcgccccaggugggcagcuguggcagagcagcgacccg

SEQ ID NO: 312812 - RNA, 64 nt, Human
gccgugacggggcggccagcagggacgcgccccaggugggcagcuguggcagagcagucccgac

SEQ ID NO: 312813 - RNA, 64 nt, Human
uauauuagccuagccauuauguuagccuuuguuaggugggcagcuuuucugcuuuuucccuucc

SEQ ID NO: 312814 - RNA, 64 nt, Human
cuaaguccuguaagaauagggaagggcggaggggggugggcagugacuaggggacgagaagcau

SEQ ID NO: 312815 - RNA, 64 nt, Human
ccaccuggagaggguugggaagccuuccgucugcggugggcaggcagccucacccugggcccac

SEQ ID NO: 312816 - RNA, 64 nt, Human
gcgcucaggguggcuugcagucccuggcccuucuggugggcauuugguauguccuuucucuugg

SEQ ID NO: 312817 - RNA, 64 nt, Human
ucacgccuguaaucccagcccuuugggaggccgaggugggcagaucacgaagucaguaguuuga

SEQ ID NO: 312818 - RNA, 64 nt, Human
acagcucggccgccccuccacuuguggaagcuguggugggcagagccccaaaacaagcagccuu

SEQ ID NO: 312819 - RNA, 64 nt, Human
ugcacauucaccgcagcugccagccaggggucugggugggcaccacccugacccacagcgucac

SEQ ID NO: 312820 - RNA, 64 nt, Human
uucuacccccaaggauccucaccacccaaaggguggugggcacugcugugaccaccccagcugc

SEQ ID NO: 312821 - RNA, 64 nt, Human
ucuguguuugugacugauuacuggcugugucuugggugggcagaaacucgaacuugcuauguaa

SEQ ID NO: 312822 - RNA, 64 nt, Human
acacucacagucugugaaaaacugaaaauccccuggugggcacucccuggagcccaagcagcuc

SEQ ID NO: 312823 - RNA, 64 nt, Human
auuuuaaaaacaugagaaaugugaacugugauggggugggcagggcugggagaacuuuguacag

SEQ ID NO: 312824 - RNA, 64 nt, Human
gagggugaggcccaacaccugccuuagggcccugggugggcaagucugggcccugggguaggga

SEQ ID NO: 312825 - RNA, 64 nt, Human
ggccccugauguaccaaucugaccaguggcauguggugggcaucguuaguuggggcuauggcug

SEQ ID NO: 312826 - RNA, 64 nt, Human
uuggaaggauacuuggaacgggaagcacaugagaggugggcacccggugccgaggacauggacg

SEQ ID NO: 312827 - RNA, 64 nt, Human
aagcuuuaaccucuguaaucugccuguaucuauaggugggcaucucacuccaccaaaggagccc

SEQ ID NO: 312828 - RNA, 64 nt, Human
aauguuuuugguuguauuuuuuugggggggugagggugggcaaaaacauggggguaguucugag

SEQ ID NO: 312829 - RNA, 64 nt, Human
cacguggcccuugcuucauccagcacagcucucaggugggcacugcagggacacuggugucuuc

SEQ ID NO: 312830 - RNA, 64 nt, Human
gcgcgcagcagcaggcgaacucccagaaggugguggugggcacugugagaacguggccugcccu

SEQ ID NO: 312831 - RNA, 64 nt, Human
gucugccugggcgaaugcagugggacggaccuggggugggcacucaccucagcagagccucaau

SEQ ID NO: 312832 - RNA, 64 nt, Human
gcccgcgaggcagcuuugcccuguccaccuguugggugggcagagccaccaggaacccagacac

SEQ ID NO: 312833 - RNA, 64 nt, Human
ggccagacaggcagaccccuccagaggcccgccaggugggcauggucccccauuuucuuuaagg

SEQ ID NO: 312834 - RNA, 64 nt, Human
ccaugcagacacgcgcccuggcauguggggccugggugggcaggcaggaccugggcccucccac

SEQ ID NO: 312835 - RNA, 64 nt, Human
ggggugagguggggagggaggcugcagggggggaggugggcagaggggccuuacagcagcagag

SEQ ID NO: 312836 - RNA, 64 nt, Human
auucccauccguccuggcgauccugccagcagugggugggcagccugagcucccucgggcucgc

SEQ ID NO: 312837 - RNA, 64 nt, Human
aacucacccucauccuggugcuuagguggcagagggugggcagcaggggacagggaugggaugg

SEQ ID NO: 312838 - RNA, 64 nt, Human
ucuguccuuacgaggcgucauacagaggcaguggggugggcacagaugagcagaguggaugguu

SEQ ID NO: 312839 - RNA, 64 nt, Human
ucuacuaaaaauacaaaaauuagccgggugugguggugggcaccuguagucccagcuacucggg

SEQ ID NO: 312840 - RNA, 64 nt, Human
gacaggggaggauggggaaugugggacacgguguggugggcaugagggcuuggaggggugggga

SEQ ID NO: 312841 - RNA, 64 nt, Human
uagaagcccgugugccaggcacugugcuaggcguggugggcaguauaaagaaaucugucuccac

SEQ ID NO: 312842 - RNA, 64 nt, Human
cucccuccucuguaacuucuuucugggggauuggggugggcaguaccuauccccaguccccucc

SEQ ID NO: 312843 - RNA, 64 nt, Human
cguugucauagugcucaccuugggaaaaggauuaggugggcacauaagauuccgaucagacccc

SEQ ID NO: 312844 - RNA, 64 nt, Human
ggcacaugugaggguccccagagagaagggagugggugggcagggguagaggagggggccgcug

SEQ ID NO: 312845 - RNA, 64 nt, Human
cccucucccaccccucccugcaggcggcuggccaggugggcaggugccagccggagcuguaaau

SEQ ID NO: 312846 - RNA, 64 nt, Human
gaagacuuggccuuccgcucugacgcagggccgaggugggcaguccaggccgagaggccggcgg

SEQ ID NO: 312847 - RNA, 64 nt, Human
uauuuccagcuugaaugagugggguugggggcggggugggcaggguucuaccacguguaggaua

SEQ ID NO: 312848 - RNA, 64 nt, Human
aagcaagugggguggcaugggagagaagggaggaggugggcacagguggugagcuuaugugugg

SEQ ID NO: 312849 - RNA, 64 nt, Human
gagcccauggugggcagugggcaaggcgguggguggugggcaaggugggaccuccugcagccug

SEQ ID NO: 312850 - RNA, 64 nt, Human
cagagccacagaccucaggguggagugagcccauggugggcagugggcaaggcgguggguggug

SEQ ID NO: 312851 - RNA, 64 nt, Human
cuaagggauuaaggcucagacaccucugagagcaggugggcacuggcuggguacggugcccucc

SEQ ID NO: 312852 - RNA, 64 nt, Human
cuuaaguauaucuggaaagcagucugccccuggaggugggcagaaaaaaguaaaacuugcugcu

SEQ ID NO: 312853 - RNA, 64 nt, Human
acuucucugacaaccuaggccgguguguggugauggugggcaugcccuuccccaacaucagguc

SEQ ID NO: 312854 - RNA, 64 nt, Human
gaacgguagggaagggugagcagauuccuauguuggugggcaccaauauuccaagggcagcucu

SEQ ID NO: 312855 - RNA, 64 nt, Human
uaacaaaaguguauuguuuaaaaaauaaaaagaaggugggcagaaaugugcccaguggaaggcu

SEQ ID NO: 312856 - RNA, 64 nt, Human
gcuccagaauuccuccuucuuggugugucuggagggugggcaaggcugggagggauaucaacuu

SEQ ID NO: 312857 - RNA, 64 nt, Human
gcuggcagcuccucccacucauccagagacggccggugggcaggcggggagagcagcuuuccuu

SEQ ID NO: 312858 - RNA, 64 nt, Human
cuacuaaaaauacgaaaaauuagccaggcgugguggugggcaccuguagucccagcuacucagg

SEQ ID NO: 312859 - RNA, 64 nt, Human
aaagacaaguuaugaguagcugcuacccuggaacggugggcagagagccuacuaggaaaugugc

SEQ ID NO: 312860 - RNA, 64 nt, Human
uauaggcaagaaguguuuccagauccuuuggaaaggugggcauggggcaggugcuuggagagug

SEQ ID NO: 312861 - RNA, 64 nt, Human
uucuuuaugugggagcagaaucagcugaugaaggggugggcagcaguguggggcaggcacccca

SEQ ID NO: 312862 - RNA, 64 nt, Human
ccacacacauauccaagagcucagggccaguucuggugggcagcagagaccugcucugccaagu

SEQ ID NO: 312863 - RNA, 64 nt, Human
cagccuuccuguuaguagauggggguacuucuguggugggcagaagccuuacuaaaggggaaga

SEQ ID NO: 312864 - RNA, 64 nt, Human
cgugcagagggcagaagaggacgaaaugccuuugggugggcagggcauuaaacugcuaaaagcu

SEQ ID NO: 312865 - RNA, 64 nt, Human
agggcccagccacaaauucagcugaagggaccaaggugggcauugaguggacucugugcucacu

SEQ ID NO: 312866 - RNA, 64 nt, Human
ccauuucauucuaggcucacacuguccuugucaaggugggcagaagagcagaggucuucucugc

SEQ ID NO: 312867 - RNA, 64 nt, Human
aggggguaggggacacagcugggcagguggagugggugggcaggauggcugucccagucugccc

SEQ ID NO: 312868 - RNA, 64 nt, Human
cugcaucauaaccacucugagaauugccccauugggugggcaugugaagcccagcucuguucca

SEQ ID NO: 312869 - RNA, 64 nt, Human
guggggagggcguuuugggguaggggaagcccagggugggcaggggguggguuggggugggggu

SEQ ID NO: 312870 - RNA, 64 nt, Human
ucacaccuguaauccuagcacuuugggaggccgaggugggcagaucacgaagucaggagaucaa

SEQ ID NO: 312871 - RNA, 64 nt, Human
ggacccagccccguggcuccuugauuggccuuagggugggcaucagcagacguucccgugcacc

SEQ ID NO: 312872 - RNA, 64 nt, Human
cuacuaaacauacaaaaaauuagccggguguaguggugggcaccuguaguccuagcuacucgag

SEQ ID NO: 312873 - RNA, 64 nt, Human
gaccaaccuggcauuacaguuggccucuccuugaggugggcacagccuggcaguguggccaggg

SEQ ID NO: 312874 - RNA, 64 nt, Human
gaaaugcccuuggaagaaguggaguugguggaugggugggcauggaacaggaugggcagagaaa

SEQ ID NO: 312875 - RNA, 64 nt, Human
cuccaccuccaagcugagcuaggguggagggcagggugggcaggaagugacaggaaguuaagcu

SEQ ID NO: 312876 - RNA, 64 nt, Human
uuuguuuauuucucucccucugccugcuguggguggugggcacucuggacacauaguccagcuu

SEQ ID NO: 312877 - RNA, 64 nt, Human
gagcaggcaccagcagcagaauggggaauggagaggugggcagggguuccagcuucccuuugau

SEQ ID NO: 312878 - RNA, 64 nt, Human
caugugggguggaguagggagaugcggggagcagggugggcaggaauacuguuaucuaugugac

SEQ ID NO: 312879 - RNA, 64 nt, Human
ccugguaggggaagugaugucguggauggggaggggugggcaggguaguuucccccgcuuguuu

SEQ ID NO: 312880 - RNA, 64 nt, Human
caaaggccgugccugguggggcggacggaaaaggggugggcaucccuccugguaccaagcugcu

SEQ ID NO: 312881 - RNA, 64 nt, Human
gucgacuguggggucauuuggugccaaacauggaggugggcaggcucaccuguuccugggacug

SEQ ID NO: 312882 - RNA, 64 nt, Human
ucacgcuuguaaucccagcacuuugggaggccgaggugggcagaucacgaggucaggagaucaa

SEQ ID NO: 312883 - RNA, 64 nt, Human
gagcauuucaaucugcuuuccugccuuacaucaaggugggcaagggauuauaauuaauugcagg

SEQ ID NO: 312884 - RNA, 64 nt, Human
accaucucugggacagaggcaagaauccccaaggggugggcagucgggguugcaggacuguaau

SEQ ID NO: 312885 - RNA, 64 nt, Human
ucacgccuguaaucccagcacuuugggaggcugaggugggcagaucacaaggucaggaguuuga

SEQ ID NO: 312886 - RNA, 50 nt, Human
guaaaaaauguggcagguaaggugggcagcgcuguccccgcugggacccc

SEQ ID NO: 312887 - RNA, 64 nt, Human
ggcagucggcuucuucagucgcucccuggaggcaggugggcacugcagaggaucacuggaaucc

SEQ ID NO: 312888 - RNA, 64 nt, Human
uggcagagacugcccucagaaguuccuuguccagggugggcacccacagugacucagaggacag

SEQ ID NO: 312889 - RNA, 64 nt, Human
aguuggcuguaggagggugucaccuuugauggggggugggcaauggggagcaguggcuugaacc

SEQ ID NO: 312890 - RNA, 64 nt, Human
gcugagaggagggggugaccagcuuggagucucuggugggcagagagggauggggucccugagc

SEQ ID NO: 312891 - RNA, 64 nt, Human
ggguucauaggucacuggcucuccaagugccagaggugggcaggugguggcacugagccccccc

SEQ ID NO: 312892 - RNA, 50 nt, Human
agugcgauggggccacguagggugggcaccccaugggacucaguggcuca

SEQ ID NO: 312893 - RNA, 64 nt, Human
uggcuuucccguugcagugagagccacgagccaaggugggcacuugaugucggaucucuucaac

SEQ ID NO: 312894 - RNA, 64 nt, Human
gccugaagcaaaucuugguugccuucuaacggcaggugggcauaaggcuguccuucaggaccag

SEQ ID NO: 312895 - RNA, 64 nt, Human
ucugggugaagaggagacguguuacggcagagcaggugggcaaggccagggcuaccccaggccc

SEQ ID NO: 312896 - RNA, 64 nt, Human
acugucuggguucaggggcauggccuggagggcuggugggcagcacugucaggcucagguuucc

SEQ ID NO: 312897 - RNA, 64 nt, Human
ccuggguuguggggugagaggaugugaguggccgggugggcacuuugcugcuucuuucuggguu

SEQ ID NO: 312898 - RNA, 64 nt, Human
ggccugucuagaaugccgccgggaguccgggcauggugggcacaguucucccugccccucagcc

SEQ ID NO: 312899 - RNA, 64 nt, Human
cccucaccucggacaugguggugggggaaggacgggugggcaaggcuggugcguuccccagcuc

SEQ ID NO: 312900 - RNA, 64 nt, Human
ugacugggugcaggcgggcgccaggcccgcugugggugggcaccaguucucagcaccgcucacu

SEQ ID NO: 312901 - RNA, 64 nt, Human
gaggcccuggccagccaucugcccagccucggagggugggcaaccuggugcuucccggguggac

SEQ ID NO: 312902 - RNA, 64 nt, Human
cccgcuuccuugggcuccccggcccugggugggcggugggcagcuggucuccagggacucagug

SEQ ID NO: 312903 - RNA, 64 nt, Human
aagggcugcaggcccaguucucaugcugcccuugggugggcaucuguuaacagaggagaacguc

SEQ ID NO: 312904 - RNA, 64 nt, Human
gagcuugucauaugcaaguccugucaagaaaacaggugggcaugguggcucaggucuguagucu

SEQ ID NO: 312905 - RNA, 64 nt, Human
cuuucuccccucuuuguguggccccagccagggcggugggcaguccugguguagagcacaagcc

SEQ ID NO: 312906 - RNA, 64 nt, Human
guaggcgugaugucagcagaagcccugcaggcugggugggcaggacacguggugggggccacug

SEQ ID NO: 312907 - RNA, 64 nt, Human
cccgccgaccugcaccugucugugaaguauguagggugggcagaagccacagucgccgccgcca

SEQ ID NO: 312908 - RNA, 64 nt, Human
ugacacuaccagagagacucaagcaauaauuagaggugggcagagcugcccucucggcauuacc

SEQ ID NO: 312909 - RNA, 64 nt, Human
uaaccaaguuucucugaauccuuuccugagagguggugggcaggagggaggagugagacuuauc

SEQ ID NO: 312910 - RNA, 64 nt, Human
acugggagccuggccuggcacugauaccccucuuggugggcagcugcucugguggaguugggaa

SEQ ID NO: 312911 - RNA, 64 nt, Human
ucacgccuguaaccccagcacuuugggaggccaaggugggcagaucacgaggucaagagaucga

SEQ ID NO: 312912 - RNA, 64 nt, Human
cuacuaaaaauacaaaaaauuagccgggugugguggugggcaccugucgucccagcuacuaggg

SEQ ID NO: 312913 - RNA, 64 nt, Human
agcugucaauucucaugucccccacauggcccaaggugggcaucuugacguuaccucugccacg

SEQ ID NO: 312914 - RNA, 64 nt, Human
cccuggcccccuccaccccugcugggccagagcgggugggcagugucaaggcccgcugucuccc

SEQ ID NO: 312915 - RNA, 64 nt, Human
ugugcuuggcuguuggugcacaugguuggcacacggugggcagagggcagagaaugccacugcu

SEQ ID NO: 312916 - RNA, 64 nt, Human
ucacuuuuuaauggcuaucuaacacuccauauguggugggcaagucugguuggccuccgggggg

SEQ ID NO: 312917 - RNA, 64 nt, Human
aggacacagaucccggggagcugugagggccaccggugggcaguggguggauccugguuucgug

SEQ ID NO: 312918 - RNA, 64 nt, Human
gacaccuggcccagcacaggcagcuagaagggccggugggcaccggggccgggaagcccccacc

SEQ ID NO: 312919 - RNA, 64 nt, Human
cuccucagagggcggcacaggcugggcuccagcaggugggcaggggaggucugggcaaggcgcu

SEQ ID NO: 312920 - RNA, 64 nt, Human
gguggucccaccuaaagaugcuagccccucuccaggugggcauaaggaguaacagauggcaaaa

SEQ ID NO: 312921 - RNA, 64 nt, Human
aucucagauucuguggcaucuaaggccuagcaggggugggcacacgggucacccgaggcccaua

SEQ ID NO: 312922 - RNA, 64 nt, Human
cccaauggagaacaggugguguggcaggcgagcgggugggcagcccgcaucauccagcacgaga

SEQ ID NO: 312923 - RNA, 64 nt, Human
ggguggagugaggccccugcagagcugcugaugaggugggcacagcggccguuggcagcugcug

SEQ ID NO: 312924 - RNA, 64 nt, Human
ggcuucucugccgaugggcccggguugggguuaaggugggcauccuccagguacaacgagccug

SEQ ID NO: 312925 - RNA, 64 nt, Human
ccucuugggagggcuuugucccugccucugagcuggugggcaggauggcuggguggcccccaga

SEQ ID NO: 312926 - RNA, 64 nt, Human
ucuucagauuauuaaaauuagugcuguaaaucagggugggcaauucacagccuuucugaacuga

SEQ ID NO: 312927 - RNA, 64 nt, Human
uuaugcucugagcagcaaggaccauugggauggaggugggcacaaagacugcugcuuccagggu

SEQ ID NO: 312928 - RNA, 64 nt, Human
acugacuucuaggcuaugaaacuuacaggguaugggugggcacauuauccuuuauuuuaugaaa

SEQ ID NO: 312929 - RNA, 64 nt, Human
aggaaacuguccuuggcucagacagaccugggguggugggcaucuggcugaaccuugaggaggg

SEQ ID NO: 312930 - RNA, 64 nt, Human
uucucaccagccuggagguuagcagaccagagugggugggcaggaccuuggccuggugccccug

SEQ ID NO: 312931 - RNA, 64 nt, Human
aaguuuggaauguggugggucaaaggacaauaugggugggcauucuggagaguuguuuuucagc

SEQ ID NO: 312932 - RNA, 64 nt, Human
cccagccggugacuuacuguacagcaggcaggagggugggcaggcaaccuccccgggcaggguc

SEQ ID NO: 312933 - RNA, 64 nt, Human
cucuuccccucuaaugcucacgcucccaacacaaggugggcagggaggcaccauucaggaaccu

SEQ ID NO: 312934 - RNA, 64 nt, Human
ucuggaggccucugggccuccucuaacaggggcuggugggcaccaagagccaauggaguagacc

SEQ ID NO: 312935 - RNA, 64 nt, Human
aggagcugacagguccucuuucggggcucaggagggugggcacacacccagcggccugcagagu

SEQ ID NO: 312936 - RNA, 64 nt, Human
gaggauauucccccaucccccccccaucaaguuuggugggcagagcuacagaugggacccaagg

SEQ ID NO: 312937 - RNA, 64 nt, Human
acagccuguuugggaggcuggaguggaaacaaagggugggcaucaaagaugagaagccaaagcc

SEQ ID NO: 312938 - RNA, 64 nt, Human
uggagucauccaggugcugccacaugacaggcacggugggcaccgauccacagugggccccgcc

SEQ ID NO: 312939 - RNA, 64 nt, Human
aacuccaagauaaagacaccaugaggggacugaaggugggcaaggugagaguuaaggaucuugg

SEQ ID NO: 312940 - RNA, 64 nt, Human
aaacagauuccucggggaguuccugaaggaaccaggugggcaaaccuuugcuuauauacaugcg

SEQ ID NO: 312941 - RNA, 64 nt, Human
ccuuugauccagacuuagggacgaggcugucacuggugggcacccucuguuccuguuugugugu

SEQ ID NO: 312942 - RNA, 64 nt, Human
uaccuguggguuaaggauguaguuccuuuguaagggugggcaggccucguaagaaagauguagc

SEQ ID NO: 312943 - RNA, 64 nt, Human
agccaggcugugaagggccguguugcuuucagugggugggcagagguuuagaaaggugguucug

SEQ ID NO: 312944 - RNA, 64 nt, Human
gccucaaugucacuugguggcgggguggggugggggugggcagcagcaucccagccuugagaug

SEQ ID NO: 312945 - RNA, 64 nt, Human
uucccuccaucuggccacagcuuuugggagauggggugggcaggggugguccuggcuggcauug

SEQ ID NO: 312946 - RNA, 64 nt, Human
uuacuaaaaauacaaaaaacuagccaggcgugguggugggcaccuguaaucccagcuacuuggg

SEQ ID NO: 312947 - RNA, 64 nt, Human
aaggggccaucugggcccagcuguguacagcgagggugggcagcccccuccacuccacucugcu

SEQ ID NO: 312948 - RNA, 64 nt, Human
aaauaagccaagcagugcagaaugccucagaaagggugggcagggggcccuuaagaagguucag

SEQ ID NO: 312949 - RNA, 64 nt, Human
acacuccacagaagacguuggcaugugaggccagggugggcaccaaagaccaggcccagagcca

SEQ ID NO: 312950 - RNA, 64 nt, Human
agaaucccacugacuuuagugggucuugauguagggugggcaagccccgacacuggagcuuagc

SEQ ID NO: 312951 - RNA, 64 nt, Human
ucacgccuguaaucccagcucuuugggaggccgaggugggcagaucacgaggucaggagaucga

SEQ ID NO: 312952 - RNA, 64 nt, Human
gggacugcugucccuuguacaguuuucugucacuggugggcacuggacaggcauagcagacucu

SEQ ID NO: 312953 - RNA, 64 nt, Human
aaggcuuugaacgccaggcugaugguugagggauggugggcagggagggagggcgaagaggcuc

SEQ ID NO: 312954 - RNA, 64 nt, Human
cucuugaccacuguguuaugggauaaggggagggggugggcauauucuggagaggagcagaggu

SEQ ID NO: 312955 - RNA, 64 nt, Human
augguuuaacuucugccuguggaacuggggauugggugggcaggaaaaggugauauccauucuu

SEQ ID NO: 312956 - RNA, 64 nt, Human
ugcuacucuguaccuugcugguacagacagggguggugggcagccaggcucuaugagugggccc

SEQ ID NO: 312957 - RNA, 64 nt, Human
aauguucuguuuuggccaccaggaaaugggguggggugggcauacacagagaggaccccucucu

SEQ ID NO: 312958 - RNA, 64 nt, Human
ucaugccuguaaucccagcacuuugggaggcugaggugggcagaucaccugaggucaggaguuc

SEQ ID NO: 312959 - RNA, 64 nt, Human
uagcguggguuaggggaacgugugugcgcgugcuggugggcaugugagaugagugacugccggu

SEQ ID NO: 312960 - RNA, 64 nt, Human
caccacugccaugcccgaacacuauccaugcuauggugggcaccaucucucugaugacaguucu

SEQ ID NO: 312961 - RNA, 64 nt, Human
gaccaauagacaagaucagcuguucuuagaugcuggugggcauuugaacaugcuccuccaugau

SEQ ID NO: 312962 - RNA, 64 nt, Human
gggaggccuauuccugcuggccccuucuggggguggugggcaggugacacggaguggcuugagc

SEQ ID NO: 312963 - RNA, 64 nt, Human
cccaauggccaguguugcuuaucgcuucaggguaggugggcacaggcuuggacuagagaggaga

SEQ ID NO: 312964 - RNA, 64 nt, Human
cuggcuucagcacagaggcgugcacugccagggaggugggcauucaugggguaccuugugccca

SEQ ID NO: 312965 - RNA, 64 nt, Human
ccacuacugucuuuaagaugcagaguggaggggaggugggcacccacccugcgauucuccaccc

SEQ ID NO: 312966 - RNA, 64 nt, Human
guccuuuuccuccuuggagccugggccagcucaaggugggcacgggggcccagacaguacucuc

SEQ ID NO: 312967 - RNA, 64 nt, Human
uccugccucugccucccaaguagcugggaccacaggugggcagcaccacaccuggcuaauuuuu

SEQ ID NO: 312968 - RNA, 64 nt, Human
ccacucaggccuggcuuagagguagcggguggcuggugggcaggccacugcugggacagggucu

SEQ ID NO: 312969 - RNA, 64 nt, Human
augacugcucacccacuuccaccgugggguugggggugggcaacagaggaggggagcaaguagg

SEQ ID NO: 312970 - RNA, 64 nt, Human
ccccgcacgcgggagccacgaaccucggggugggggugggcagugagugcaggggauggggugg

SEQ ID NO: 312971 - RNA, 64 nt, Human
agcgcccccugccccaaucucccacagggugcugggugggcaucucaguuaggagauagaagaa

SEQ ID NO: 312972 - RNA, 64 nt, Human
ccugccccugcccgccucucagaaaagcugcuguggugggcaggggauugggccaucugucucc

SEQ ID NO: 312973 - RNA, 64 nt, Human
gaaaagucagggccuucccggcgggggggaaggaggugggcaucgggggcauggggccuggccu

SEQ ID NO: 312974 - RNA, 64 nt, Human
uucagcuuuugcuauuuuuuuuaagugggagaagggugggcaguuaucacuggggaagagagga

SEQ ID NO: 312975 - RNA, 64 nt, Human
ggccaggccggggccuggcucuuacccggggaguggugggcaucucgaugcuucuuugccuuaa

SEQ ID NO: 312976 - RNA, 64 nt, Human
uggggucacuugagccggagcacaugggggaaggggugggcaguggggcaggaggggcuggccu

SEQ ID NO: 312977 - RNA, 64 nt, Human
agguuaugcucuuuucuuucucaggguccucuuuggugggcagccacuccccgagauguugcca

SEQ ID NO: 312978 - RNA, 64 nt, Human
ccuggaugaccugucuugaggcggcaccucagugggugggcagggcuuggucccccuccccaca

SEQ ID NO: 312979 - RNA, 64 nt, Human
uucaucuuuguuaaggacagaaaauucccugacaggugggcaaguaucagguuaccuauuuuuu

SEQ ID NO: 312980 - RNA, 64 nt, Human
uggggucuccaucagccucuguggggugucucagggugggcaguggggguggggcugggacgcu

SEQ ID NO: 312981 - RNA, 64 nt, Human
uauaacuguagcgcuguaaauuuuuuugugggagggugggcagggaggggucccagaggguaga

SEQ ID NO: 312982 - RNA, 64 nt, Human
aggugaagaaaucaggggauugaggacuugggugggugggcaucucucaggagccccaucuccg

SEQ ID NO: 312983 - RNA, 64 nt, Human
ugccugauugugaaccauguccaccaguaucuggggugggcacguggucggggacccucagcag

SEQ ID NO: 312984 - RNA, 64 nt, Human
aggaggugcucgguugacaccaucagggagggagggugggcacugcugggcugaguucaccccc

SEQ ID NO: 312985 - RNA, 64 nt, Human
agccaucccucuggaccaggcagagggcggaccgggugggcaggggccugaggguggcucgggc

SEQ ID NO: 312986 - RNA, 64 nt, Human
agaccccagacacccaaguggcaucuugggggugggugggcagaggacgggguaaugugaggac

SEQ ID NO: 312987 - RNA, 64 nt, Human
auaggagcccuugguuuccagaauuucuagagugggugggcaugauuccagucaaugggggacc

SEQ ID NO: 312988 - RNA, 64 nt, Human
gcacacgccucccacugggguccagggagcaggcggugggcacccacccugggaccuaggggcg

SEQ ID NO: 312989 - RNA, 64 nt, Human
ucacaccuguaaucccagcacuuuaggaggucaaggugggcagaucaugaggucaggaguuuga

SEQ ID NO: 312990 - RNA, 64 nt, Human
ugacaaauauuguauuacuguacauagagagacaggugggcauuuuugggcuaccugguucguu

SEQ ID NO: 312991 - RNA, 64 nt, Human
ucacaccugcaaucccagcacuuuggaaggccgaggugggcagaucaucugaggccaggaguuc

SEQ ID NO: 312992 - RNA, 64 nt, Human
ucuaccaaaaauacaaaaauuagccaggcgugguggugggcaccuguacuggggaggugcccac

SEQ ID NO: 312993 - RNA, 64 nt, Human
aggauccagaaucaaaagcucaagagugacgugaggugggcaccggccccaagugcagagucaa

SEQ ID NO: 312994 - RNA, 64 nt, Human
ggucaccuggucccccgacucuccccaggcccccggugggcauggagcagcccggggagggguc

SEQ ID NO: 312995 - RNA, 64 nt, Human
cauaauuuucuguuuuuuuucucacaaaguaaauggugggcauccauguuuacauugcaccuuc

SEQ ID NO: 312996 - RNA, 64 nt, Human
uggagauagccuccaacugggucagccucugucuggugggcauugcucagggucucaaacaugg

SEQ ID NO: 312997 - RNA, 64 nt, Human
gcaaagcacucucugcaguccuccggggugggugggugggcagggaggggcuggggcaggcucu

SEQ ID NO: 312998 - RNA, 64 nt, Human
ccuaauucuuagggugcucuaugaggacauggguggugggcaaagugacagccgccugagcccc

SEQ ID NO: 312999 - RNA, 64 nt, Human
gugauggauacacaucuaucaggcacagggcggaggugggcaccacugaguugcacucagcaaa

SEQ ID NO: 313000 - RNA, 64 nt, Human
guggagcccugugcccacccugcacuggggggagggugggcagggauacucagggacagggcau

SEQ ID NO: 313001 - RNA, 64 nt, Human
agccccuaguuccaacacugaggacgcgugacauggugggcaccggaaaggaggggacuucucc

SEQ ID NO: 313002 - RNA, 64 nt, Human
cccuuauuuuuaugcaauaacugagcuugaugggggugggcagggggccaguugagccaagccc

SEQ ID NO: 313003 - RNA, 64 nt, Human
acugaaggaagcaggggcugaggaacacuuagagggugggcagaagcggggguucccagucugc

SEQ ID NO: 313004 - RNA, 64 nt, Human
uggggcacucccaaugcagcgccuugucagccaaggugggcaggcagggacuguggcagcuuau

SEQ ID NO: 313005 - RNA, 64 nt, Human
gagauuaaauauugucugauuuagagagcauggaggugggcagaguaacauaaaacugaugacc

SEQ ID NO: 313006 - RNA, 64 nt, Human
cuacuaaaaauacaaaaacuuagccgggcaugguggugggcaccuguagucucagcuacucagg

SEQ ID NO: 313007 - RNA, 64 nt, Human
ggcagguuuaucugucucauguuugucuugugcuggugggcaagggguuugucuagcacaccag

SEQ ID NO: 313008 - RNA, 64 nt, Human
cucacgccuguaacccagcacuaugggaggucgaggugggcagauuaccugaggucaggaguuc

SEQ ID NO: 313009 - RNA, 64 nt, Human
ucuuguuuugcuccuggcccugccccuaggucugggugggcaguggccccauagccucuggaac

SEQ ID NO: 313010 - RNA, 64 nt, Human
cuacuaaaaauauaaaaaauuagccaggcgugguggugggcaccuguagucccagcaacucggg

SEQ ID NO: 313011 - RNA, 64 nt, Human
gccgcuacuaagucccacucgcugcgaguuuucgggugggcagacgcacuguugaaucugguag

SEQ ID NO: 313012 - RNA, 64 nt, Human
aggggguuggcaggacauggcaaugggcaacuggggugggcacagggcuuauuccucggaguag

SEQ ID NO: 313013 - RNA, 64 nt, Human
cucuacugaaaauacaaaaaauuuagccagguguggugggcaccuguaaucccagcuacuuggg

SEQ ID NO: 313014 - RNA, 64 nt, Human
aguggcugcaccgacgguccuggaaaucucacauggugggcacugcagcguuggaacgugagcc

SEQ ID NO: 313015 - RNA, 64 nt, Human
cacaguggcucacgccuguaaucccagcacuuagggugggcaaauugcuugaccucaggaauuu

SEQ ID NO: 313016 - RNA, 64 nt, Human
ucauccuacaaacggggaggugggggggacuucuggugggcaagggccccugggcucuaauagg

SEQ ID NO: 313017 - RNA, 64 nt, Human
uccuucacggacucgaagugaccuuccuggaggaggugggcagcucagacuccacaugcuggug

SEQ ID NO: 313018 - RNA, 64 nt, Human
cggcaucaaagauaggagaguuucuuuuuuuuuaggugggcauuauuuaugaccuuuucuuugg

SEQ ID NO: 313019 - RNA, 64 nt, Human
ucacgccuguaaugccagcacuuugggaggcugaggugggcagaucaugaggucaacagauuga

SEQ ID NO: 313020 - RNA, 64 nt, Human
gcucaugccuguaaucccagcacuuugggaggccggugggcagaucaugaggucaggaguucga

SEQ ID NO: 313021 - RNA, 64 nt, Human
cgcccagccaucuucccugagccagccggcggguggugggcaugccugccucaccuucaucagg

SEQ ID NO: 313022 - RNA, 64 nt, Human
uggguggggggaugggacugggccaagggaucugggugggcauuuuuaacuuuggaggccuucc

SEQ ID NO: 313023 - RNA, 64 nt, Human
ucaugccuguaaccccagcacuuugggaggccgaggugggcaaauuacgaggucaggagaucca

SEQ ID NO: 313024 - RNA, 64 nt, Human
ucacgccuguaaucccagcacuuugggagguugaggugggcagaucgccugaggucgggaguuc

SEQ ID NO: 313025 - RNA, 64 nt, Human
ucaugccuguaaucccagcacuuugggaggccaaggugggcagaucaccugagaucaaguauuu

SEQ ID NO: 313026 - RNA, 64 nt, Human
ggcuccacuucggcgagagguucguccaugcagaggugggcaagaacuggggucuccgacaggu

SEQ ID NO: 313027 - RNA, 64 nt, Human
ugcuuguucagcccccacucugggcuguggagugggugggcaacgggccuggguagcugggccc

SEQ ID NO: 313028 - RNA, 64 nt, Human
agaguagcaagaaacagcaccccuguaggugacaggugggcagccugguaggggucgccagccu

SEQ ID NO: 313029 - RNA, 63 nt, Human
aauucagccaaaggggcugacugucauuggagcggugggcacuguuaagaagcagccaucaca

SEQ ID NO: 313030 - RNA, 64 nt, Human
ucaugccuguaaucccagcacuuugcgaggccgaggugggcagaucacuugaggugaggaguuc

SEQ ID NO: 313031 - RNA, 64 nt, Human
agaaaugagaaaucgcauuuggauccaggccccaggugggcaccaucagcagucuugcuuccau

SEQ ID NO: 313032 - RNA, 64 nt, Human
gaucgcugaaggagagggagcuuugcucucucuaggugggcaaguuuccugggcucucuguguu

SEQ ID NO: 313033 - RNA, 64 nt, Human
gcagcgggaaaggcugacugggaaauccauuuugggugggcaauuuccuucaacgaagccggaa

SEQ ID NO: 313034 - RNA, 64 nt, Human
ugggauggggaggccucccugcuuccaccugcauggugggcauggccuggcuuacaccaaaggc

SEQ ID NO: 313035 - RNA, 64 nt, Human
uucuguucacucacagaacuguccccugcuccguggugggcaggagggaaguggugcagggcug

SEQ ID NO: 313036 - RNA, 64 nt, Human
gacagccagcauggaaguuucgggaaugggaacuggugggcaguguccagcucuccagaggggu

SEQ ID NO: 313037 - RNA, 64 nt, Human
ucucgggaggaaggccguggggcugggacccuguggugggcaaguggguggagucuggcagcug

SEQ ID NO: 313038 - RNA, 64 nt, Human
uuggccucucugcugcugcguuggcagaacccugggugggcaggcacccggaggaggagcagca

SEQ ID NO: 313039 - RNA, 64 nt, Human
uccccugcauggggacucagaacccagguuugcaggugggcauacguggugggaggguggaggg

SEQ ID NO: 313040 - RNA, 64 nt, Human
ucaacuguucuuaugucacagagggcuccuugcuggugggcaguggguuguaaauacuuuuuaa

SEQ ID NO: 313041 - RNA, 64 nt, Human
aucggggguccccaggguaugggguaggggugggggugggcaccagcucaggggcuuccauuug

SEQ ID NO: 313042 - RNA, 64 nt, Human
uaugccccuucuugggccccagaccccagggcagggugggcagccuaugggggcucucggaaau

SEQ ID NO: 313043 - RNA, 64 nt, Human
gaaagugcuugccugaggucccacuguguuagugggugggcaggacuggaacucgguucuccaa

SEQ ID NO: 313044 - RNA, 64 nt, Human
aauugcccccuggcaaucugggaaggguucagaaggugggcacccagccaacagcaugaacuca

SEQ ID NO: 313045 - RNA, 64 nt, Human
cacccagccgugggaggaagggggcguggcaaggggugggcacauuggugucugugcgaaagga

SEQ ID NO: 313046 - RNA, 64 nt, Human
gagcgggaaugaaaaucgagcacugucagaaucuggugggcagccccugacuugaaccacuccc

SEQ ID NO: 313047 - RNA, 64 nt, Human
aggggaaacuguguuuuuuaucuucauacaugacggugggcagagaggccugucuuaaaguuuc

SEQ ID NO: 313048 - RNA, 64 nt, Human
uuacaaaagcaccggugcuccucucuaggcagcgggugggcacagccccucaccacggacacgg

SEQ ID NO: 313049 - RNA, 64 nt, Human
agugccuuauccccacacuugacugggcuguggaggugggcaugugggccccugggcccaggcu

SEQ ID NO: 313050 - RNA, 64 nt, Human
aaaaaaacaaaaaacagguuaagaaaauuacuugggugggcagacuuaggaacgcucuacucgg

SEQ ID NO: 313051 - RNA, 64 nt, Human
uugcugccacuuccaacugaagcucagugaccugggugggcaguggccaagcugcuguuccuau

SEQ ID NO: 313052 - RNA, 64 nt, Human
agcuggauaagaugauuucugaagacgcuuccauggugggcacugaggcacagaggaggccaag

SEQ ID NO: 313053 - RNA, 64 nt, Human
gcaugauuuuuggguucaucuuaucaguuccccuggugggcagauacacaguguucugcauucc

SEQ ID NO: 313054 - RNA, 64 nt, Human
gcuccacgguuuacagacaauugcacaagcguggggugggcaggccaggacugcuuuuuuuuaa

SEQ ID NO: 313055 - RNA, 64 nt, Human
gaaaaucccucccugugcuuuggaagggaagggaggugggcagcagugggucagagauagaccu

SEQ ID NO: 313056 - RNA, 64 nt, Human
ggaagagagcacacagauaagacagaggggaggaggugggcauuuccuacauuccuccuuguuu

SEQ ID NO: 313057 - RNA, 64 nt, Human
ucccugagcugucugcugggcuccguagagcgguggugggcaggcaccuuggcaucugugcaga

SEQ ID NO: 313058 - RNA, 64 nt, Human
ucccuucccgggagacgaggagggcgggcagggaggugggcaucaggccccagccuuggccuga

SEQ ID NO: 313059 - RNA, 64 nt, Human
ggaagccuuggcaggugggaaaugccgcugcccuggugggcauggcacugagaugcauccacuc

SEQ ID NO: 313060 - RNA, 64 nt, Human
ugcagggccaagccacaggaagggcugagcuggaggugggcagggcugcuccaggcaggucaga

SEQ ID NO: 313061 - RNA, 64 nt, Human
aagcccuguucucugcauguaggaggucagcaggggugggcaggcccagcuggaggcagcuggg

SEQ ID NO: 313062 - RNA, 64 nt, Human
aguuugcuucugagugucugcuuuguuuaguagaggugggcaggaggagcugaggggcuggggc

SEQ ID NO: 313063 - RNA, 64 nt, Human
gacucuccaggcuuuaucaaggugcuaaggcccgggugggcagcuccucgucucagagcccucc

SEQ ID NO: 313064 - RNA, 64 nt, Human
ggacugcugggcgggggacaucucgggguuucagggugggcaggggguuaguuuggggaggggg

SEQ ID NO: 313065 - RNA, 64 nt, Human
cccagagggagcugcucaccugagcacccuugggggugggcagagaggcagggugggauuuuag

SEQ ID NO: 313066 - RNA, 64 nt, Human
cacgcuccuguugucauggcagacagccgccuugggugggcaccacccuggcaguuccagccug

SEQ ID NO: 313067 - RNA, 64 nt, Human
gaccagacuugcugccaagggcuucugcauccagggugggcaguggcagcuugucacccuugcc

SEQ ID NO: 313068 - RNA, 64 nt, Human
uaggaacccaucuccgucugggcgcugugaguggggugggcacguccgggcagcccagugcguc

SEQ ID NO: 313069 - RNA, 64 nt, Human
gcugcucugcuuccggucguuaccgaccacuaggggugggcagggccgccccggccauguuuac

SEQ ID NO: 313070 - RNA, 64 nt, Human
cccaggcugcagaaauaccuggugcucaagucauggugggcaaguaacuauguaaguuccugcc

SEQ ID NO: 313071 - RNA, 64 nt, Human
ucaggccuguaaucccagcacuuugggaggccgaggugggcagaucaccggaggucaggaguuc

SEQ ID NO: 313072 - RNA, 64 nt, Human
uauagagauuuuuuaaccauggcagggugcuaguggugggcagaaugcuuuuuuuucuuucuga

SEQ ID NO: 313073 - RNA, 64 nt, Human
uucagggcacuugauuuagauuuggaggggcuggggugggcagagagcaagaggcgaguaaaga

SEQ ID NO: 313074 - RNA, 64 nt, Human
caguuuuaccguguguuugccauuugagcuguguggugggcagggggcugguuuggguuuaugg

SEQ ID NO: 313075 - RNA, 64 nt, Human
cauaaaaauaaaaaaaauacaaauagcugacccgggugggcauuccaaaauguccgcauggacg

SEQ ID NO: 313076 - RNA, 64 nt, Human
ucccagacaccugaggcagauagauggaugggcuggugggcagggggguggcuggggcugggcc

SEQ ID NO: 313077 - RNA, 64 nt, Human
ggugguucugcgguguaaguggcucuguccucagggugggcagagccacuaaacuuguuuuacc

SEQ ID NO: 313078 - RNA, 64 nt, Human
gcacgcagcccaggaauggacauuccuaacggguggugggcaugggagaugccuguguaauuuc

SEQ ID NO: 313079 - RNA, 64 nt, Human
uccugucuauaaucgcagcacuuugggaggccgaggugggcagaucagcugaggucaggagauc

SEQ ID NO: 313080 - RNA, 64 nt, Human
uggauggauggauggaugagcgagaacccgcgcccgcgaacaaagagcgaaccaaagcgaugcu

SEQ ID NO: 313081 - RNA, 64 nt, Human
gaagagcuuuuacuugggcgcccgccgucucuggcgcgaacacuggaaugcauauacuacuuua

SEQ ID NO: 313082 - RNA, 64 nt, Human
gacggcacaaggagguugaacucauguuucaguucgcgaacauugacuccuuacgaaagucacu

SEQ ID NO: 313083 - RNA, 64 nt, Human
ccucaggcgccagccuguccaguagcaugaacaccgcgaacagccucugucugggugggacccc

SEQ ID NO: 313084 - RNA, 64 nt, Human
ggagcgcagccuggagagucgggaccaccugcaccgcgaacagcgggaguaccugugagugggc

SEQ ID NO: 313085 - RNA, 64 nt, Human
uccccccaagcccuagagcucccuccacucuucccgcgaacaucacaccguuccccgaccaagc

SEQ ID NO: 313086 - RNA, 64 nt, Human
aguggucaccccaugggacaggcacagcuacuuacgcgaacacagcagguugguguggcuggcu

SEQ ID NO: 313087 - RNA, 64 nt, Human
cccagcuacucaggaggcugaggcaggagaauggcgcgaacaugggaggcguagcuugcaguga

SEQ ID NO: 313088 - RNA, 64 nt, Human
aacaaucagauuagacacuauguguuagaguccccccgaccagauccuuuuccaucccacucca

SEQ ID NO: 313089 - RNA, 64 nt, Human
agacucuaggucaggcuccaggagcaugagaauugauccccagaagaaccauuuuaacuccauc

SEQ ID NO: 313090 - RNA, 64 nt, Human
ugaggggaaaguuuuacugugaaagucuucuucagauccccaccugcaucauuccgaauguguc

SEQ ID NO: 313091 - RNA, 64 nt, Human
gaagccgucuccaggcucucugucagcauuacaggauccccagaaagcuguugaauaagcccua

SEQ ID NO: 313092 - RNA, 64 nt, Human
cccccuacccccucacucuccccgucuccauggucccgaccaggaagggaagccaucgguaccu

SEQ ID NO: 313093 - RNA, 64 nt, Human
ccuccccucgugucagcucaggcagcucgaggcccccgaccaacacuugcaggggucccugcua

SEQ ID NO: 313094 - RNA, 64 nt, Human
guuucugagauucuccaagcuugucuuacccacccccgaccaugcauuccuagcccaguccuga

SEQ ID NO: 313095 - RNA, 64 nt, Human
cccuuccaugucgccucugcauucaggaucaaaccccgaccaccugcccaaccugcucuccucu

SEQ ID NO: 313096 - RNA, 64 nt, Human
ggaccuucugugggguuuggggaucuccaggaagcccgaccaagcuguccccuuccccugugcc

SEQ ID NO: 313097 - RNA, 64 nt, Human
caaagugcugggauuacaggugugagccacuauacccgaccagaucaaaucuuuuuuugacauu

SEQ ID NO: 313098 - RNA, 64 nt, Human
uagguuuccuguugguuuucuuaucugccuauuucccgaccaucuucuccuauuuccuggggag

SEQ ID NO: 313099 - RNA, 64 nt, Human
cuggaccacauucggaaggggaacuuagagaucacccgaccaacccuucguuuuacaguugccc

SEQ ID NO: 313100 - RNA, 64 nt, Human
ggugggucaccugagguugggaguucgagaccagcccgaccaacauggugaaaccccgucucua

SEQ ID NO: 313101 - RNA, 64 nt, Human
cccaccgcccagcugcccacacccggugcaggcucccgaccagugcugcccuguuugcccuggu

SEQ ID NO: 313102 - RNA, 64 nt, Human
cauccugaugccccagguuauccacagccuccuucccgaccaagacccuauccaccuggaccuc

SEQ ID NO: 313103 - RNA, 64 nt, Human
guggcacggugguacugggggugcggcagggacacccgaccacaccagagcgugggagacggug

SEQ ID NO: 313104 - RNA, 64 nt, Human
ccagccugggucacaguccaucaaaccccaugagcccgaccacucucgcucuuccuuacauucc

SEQ ID NO: 313105 - RNA, 64 nt, Human
aguuccgggagagcggcugcccgacucagguccgcccgaccaggaucagccccgcuccuccccu

SEQ ID NO: 313106 - RNA, 64 nt, Human
gcaggacuugggagguuccagcaggcgggggagccccgaccaguggggacacuccucccucccc

SEQ ID NO: 313107 - RNA, 64 nt, Human
gacccccaacucugcgccccuacuccaugcugcugauccccaccugcgcacuauagcucagggu

SEQ ID NO: 313108 - RNA, 64 nt, Human
cugcagcugaggucaguuucaggagggugaagcugauccccaggaauggaucagcugccauggg

SEQ ID NO: 313109 - RNA, 64 nt, Human
guggauguuuagugcagccacagacuuguauuuugauccccaauuuuuuuuugaaagaguucuc

SEQ ID NO: 313110 - RNA, 64 nt, Human
acaacaaaucugccugguucuccgggaucaccuggauccccaggaucuccaggcucuccuggau

SEQ ID NO: 313111 - RNA, 64 nt, Human
ugcuucuuagggcccucucccugccccagcuuuccccgaccaaucacgccuacagugcuuugaa

SEQ ID NO: 313112 - RNA, 64 nt, Human
uggauucauuuccauaaaccaaguuaaaguauggcccgaccauuuaagaaaacaaccaucugag

SEQ ID NO: 313113 - RNA, 64 nt, Human
gacacugagggcuccuagccgcagcagcgcaggccccgaccagggcacacccaccggcccggcc

SEQ ID NO: 313114 - RNA, 64 nt, Human
ugcugggauuacaggcaugagucaccgcacccagcccgaccaguaucuuuuucuuaugcaguga

SEQ ID NO: 313115 - RNA, 64 nt, Human
uacccacuguggccccggugcucugcccccacgccccgaccaucuggucuugguagaugucccu

SEQ ID NO: 313116 - RNA, 64 nt, Human
gcgccgccugcccuccugcccacccucccacccacccgaccagcagagcuuuuuaauacaagaa

SEQ ID NO: 313117 - RNA, 64 nt, Human
gcccccguggccaagcccaggucacagaucuucccccgaccaugcugggaauccagaaacaggg

SEQ ID NO: 313118 - RNA, 64 nt, Human
uccaccugcagccucccuggguggccuaggcucccccgaccaagagaccucccucucaugauca

SEQ ID NO: 313119 - RNA, 64 nt, Human
caggcgagcuccucgaccucugagggaccaucuccccgaccacugcccagcccucugcucccuc

SEQ ID NO: 313120 - RNA, 64 nt, Human
aaaggguugcuuggaggaccugggguggcagccccccgaccagaagcacccuauuuuauagaua

SEQ ID NO: 313121 - RNA, 64 nt, Human
ucccuccacucuucccgcgaacaucacaccguuccccgaccaagccgugugcaauacaacagag

SEQ ID NO: 313122 - RNA, 64 nt, Human
uagacuuguagcaggccugggcugcaggcuuccccccgaccauucccugcagccaugcggcaga

SEQ ID NO: 313123 - RNA, 64 nt, Human
ucccccagggucccaaggccccgcagcuuccucccccgaccaaaccccaagaccuggaucccag

SEQ ID NO: 313124 - RNA, 64 nt, Human
cccagaagcauuugucucuaacccauguggguagcccgaccaugacagcaccacgcuaacagug

SEQ ID NO: 313125 - RNA, 64 nt, Human
cucgagccuggggcugcccuaccucuacccauuccccgaccagagcuuugcccuugcuuggcug

SEQ ID NO: 313126 - RNA, 64 nt, Human
augcugaggcccuggcccggacucuggccucccagauccccagcugccucacuucucucuugag

SEQ ID NO: 313127 - RNA, 64 nt, Human
cgggggcccccugcccgcacccggacacuugaucgauccccaccgacgcccccugcaccgccuc

SEQ ID NO: 313128 - RNA, 64 nt, Human
auaguacauaauuuaauaccaaaaaaggcgccuggauccccaaaaaaccgaggcugggagcuag

SEQ ID NO: 313129 - RNA, 64 nt, Human
ggagccagucucuggcuguggcuccccagaacaggauccccagaagcaggcugaagaggaaagg

SEQ ID NO: 313130 - RNA, 64 nt, Human
guggugaagaaaagugaacgcccuuguagagcagcccgaccacaggagcauggccgcugccagc

SEQ ID NO: 313131 - RNA, 64 nt, Human
ccugggucucccuccgagucacucugcagcuuggcccgaccacaaacaggacagagccaggcug

SEQ ID NO: 313132 - RNA, 64 nt, Human
aagagaggggccccaggaguggcaggagaggauccccgaccacccuagggaaacuucgugcgau

SEQ ID NO: 313133 - RNA, 64 nt, Human
gcugcccugccuggcccgaccuguacauaggacccccgaccaccugacccccgcccggcccgcg

SEQ ID NO: 313134 - RNA, 64 nt, Human
gcaggcccaggcagcgucagccggagagcuucuccccgaccagcccagccccaggaugugucgc

SEQ ID NO: 313135 - RNA, 64 nt, Human
gcgaggcacucacugggcagcacauccagccagacccgaccagcuccgggauggggugggucac

SEQ ID NO: 313136 - RNA, 64 nt, Human
uccggaucugaccccacagccuuuggccugcucacccgaccagccugggccgcauucccugcag

SEQ ID NO: 313137 - RNA, 64 nt, Human
gcugagcauguaccgcaggccagggcaggccccgcccgaccaggaggcccugcagguaauacag

SEQ ID NO: 313138 - RNA, 64 nt, Human
acccucuaccaucuguaaacaacugggugccuuccccgaccacaccccaaugccuucccagcuu

SEQ ID NO: 313139 - RNA, 64 nt, Human
ggcggaucaccugaggucgggaguuugagaccagcccgaccaacauggagaaacccugucucua

SEQ ID NO: 313140 - RNA, 64 nt, Human
uucuggaucacgggauaccacuuccuguccacaccccgaccaggggcuagaaaauuuguuugag

SEQ ID NO: 313141 - RNA, 64 nt, Human
gagcugugaguucucccuguacaguguuaccauccccgaccaucugauuaaaaugcuuccuccc

SEQ ID NO: 313142 - RNA, 64 nt, Human
ggccuccugcuguggcagaggagcagcugggauucccgaccaaagccccagggggugcagaaga

SEQ ID NO: 313143 - RNA, 64 nt, Human
aaaacccaaagcaaguagugaucauaguacagaacccgaccaaaguaggcuggugaggaagucc

SEQ ID NO: 313144 - RNA, 64 nt, Human
aggaaaagccucuuuccacagacuuaggaagccccccgaccacgcggacgcucgcugggcugca

SEQ ID NO: 313145 - RNA, 64 nt, Human
gaguuaguggaaggcaaguuaagagccaaucacugauccccaaguguuucuugagcaucugguc

SEQ ID NO: 313146 - RNA, 64 nt, Human
ccaaaacuggcgagagccccuccuagccaccagugauccccaagcauccaguacagaaccaggc

SEQ ID NO: 313147 - RNA, 64 nt, Human
gcaaggguuacaaagugagggagggcaguguccagauccccagagccacacauacauacacaua

SEQ ID NO: 313148 - RNA, 64 nt, Human
ccuucaucugaaacccacagaugucucuggggcagauccccacuguccuaccaguugcccuagc

SEQ ID NO: 313149 - RNA, 64 nt, Human
caagcguucggaugagucugguuauugguccacccccgaccagauucccuuacacuuaacucac

SEQ ID NO: 313150 - RNA, 64 nt, Human
ggaaccucucacguugcuguguccuggugagcagcccgaccaauaaaccugcuuuucuaaaagg

SEQ ID NO: 313151 - RNA, 64 nt, Human
ggcuucucuagaucggaaccucuuuggugacauucccgaccagcccugcaagagaaacgacagu

SEQ ID NO: 313152 - RNA, 64 nt, Human
uuauuauugaaauguauuguuugagcucaaaaggcccgaccaccccccuucgggcugcuauaua

SEQ ID NO: 313153 - RNA, 64 nt, Human
cgggaggaagccugacuguccuuuggcugcaucucccgaccauggccaaggagggcuuuucugu

SEQ ID NO: 313154 - RNA, 64 nt, Human
gccugugucgggcguggggccugcaggugggcgccccgaccacgacuuggcuuccuugugccuu

SEQ ID NO: 313155 - RNA, 64 nt, Human
uuuuaaggagcccccagcccuccucccuucugggcccgaccagcuuauacugcuccaucuuccc

SEQ ID NO: 313156 - RNA, 64 nt, Human
uuccccuccacuccuccccucacuccccugcucccccgaccaccuccuccucugccucaaagac

SEQ ID NO: 313157 - RNA, 64 nt, Human
accuguuugccagccgugaccaccugcugugaggcccgaccacccacccagaaucugcccaguc

SEQ ID NO: 313158 - RNA, 64 nt, Human
ucugccaaggcuccagcuucuucccccagcugcucccgaccaggagggggagagcagccuccac

SEQ ID NO: 313159 - RNA, 64 nt, Human
gccccgcuucggccccucccgggagauccgugcgcccgaccagcaccagcaucgcggaccgcaa

SEQ ID NO: 313160 - RNA, 64 nt, Human
cuggggcuggggaccacuucuccaggccucucuccccgaccaugagagccccuggcccuggccc

SEQ ID NO: 313161 - RNA, 64 nt, Human
ccaaccaaaucccuuguuuuguauuuucuugaaccccgaccacuaccccagguuucuaacuuug

SEQ ID NO: 313162 - RNA, 64 nt, Human
ccucucucucuuuguggguuggccaggagguucccccgaccagguuggggagacuuggggccag

SEQ ID NO: 313163 - RNA, 64 nt, Human
ggacccucagcccuggccuuuuucuuuaaggucccccgaccaauccccagccuaggacgccaac

SEQ ID NO: 313164 - RNA, 64 nt, Human
augaaacguguaucguaaaauguauuuuuauuuuacccacgagaauguuguuauuuuuagcaaa

SEQ ID NO: 313165 - RNA, 64 nt, Human
cggaccccccucgaagcccccuggacugauucccacccacgacucacaggcauuccucccacag

SEQ ID NO: 313166 - RNA, 64 nt, Human
ggaauauaaggggguagugggaaaagugguacuaacccacgauucugagcccugaguaugccug

SEQ ID NO: 313167 - RNA, 64 nt, Human
ccucuacaccuucugccaccaccugcaccugccuacccacgacaaggagacagaggagcuggua

SEQ ID NO: 313168 - RNA, 64 nt, Human
cgagucuuccagaaggggugaaaggguugcaggucccgaccacugacccuucccggcugcccuc

SEQ ID NO: 313169 - RNA, 64 nt, Human
ugaaggcccaggggguccagggcggaccuggggccccgaccaccaaggacagcucacgacugcc

SEQ ID NO: 313170 - RNA, 64 nt, Human
cugguguccauccagcacugaccagcccugauuccccgaccaccgcccaggguggagaaggagg

SEQ ID NO: 313171 - RNA, 64 nt, Human
auuuauugcugaucacaaggacagacaguuuuuucccgaccauacucaucaaagauuuacguuu

SEQ ID NO: 313172 - RNA, 64 nt, Human
gaugacagggcagggggcagucuuccucccccuccccgaccaaaccucggggagcccuccugug

SEQ ID NO: 313173 - RNA, 64 nt, Human
cguuggccacgucuuccuucugccugagcuuccccccgaccacaggcccuuuccucaggcaagg

SEQ ID NO: 313174 - RNA, 64 nt, Human
uacuuaucacuucaccacgaacucucugccugagacuggggaaguaagcggguaucuucucagu

SEQ ID NO: 313175 - RNA, 64 nt, Human
cauuuggggaucugaaacaaucugggaguuaauaacuggggaaagaaguugugaucuguugccu

SEQ ID NO: 313176 - RNA, 62 nt, Human
gauccuucaucaacgucuagcggccccgcgggacuggggacugagcccaggagguuugcaca

SEQ ID NO: 313177 - RNA, 64 nt, Human
cucccccccagcacaacccccccaaaacaacccaacccacgaggaccaucgggggcagagucgu

SEQ ID NO: 313178 - RNA, 64 nt, Human
uccugccuccacgcccacccagcgucgacccuugacccacgaagugcguagcaugcaguauuua

SEQ ID NO: 313179 - RNA, 64 nt, Human
ccaggcaugguagcaggugccuguaaucccagcuacuggggaaagcugaggcaggagaauugcu

SEQ ID NO: 313180 - RNA, 64 nt, Human
ccaggaugagggaauuagacaauggaagucgagcacuggggaaagcaggcauucugcgugggga

SEQ ID NO: 313181 - RNA, 64 nt, Human
gguccugagccucaggggagggagguugauagcuacuggggauuuuguauauggcaacaguaua

SEQ ID NO: 313182 - RNA, 64 nt, Human
acauucagcuacccuauaacccaguuaauccaauacuggggauaaauccuagagaaacucauac

SEQ ID NO: 313183 - RNA, 64 nt, Human
uacaaugcuucuaugaauauuuccauguauuuugacuggggagaggcauggagaagaaacucuc

SEQ ID NO: 313184 - RNA, 64 nt, Human
cagcuccugcauggaucugggucaaguagaagguacuggggauggggacauuccugcccauaaa

SEQ ID NO: 313185 - RNA, 64 nt, Human
cccccccaaauauuaacuccagaaacuaggccugacuggggacaccugagaguaguauaguagu

SEQ ID NO: 313186 - RNA, 64 nt, Human
uccucuaccugugacuucucauuuuccuguuuacacuggggauuuggagggggcaggcaaaguc

SEQ ID NO: 313187 - RNA, 64 nt, Human
gcccugagaagccuggaagacuuucuggcucuuaacuggggaguaguggagaccauaggagagg

SEQ ID NO: 313188 - RNA, 64 nt, Human
aaacaaacugcuaagccccaccucaaacuuguucacuggggacuuugcuuaccguucugugggu

SEQ ID NO: 313189 - RNA, 64 nt, Human
uccugggaggacaggcaggccagauggccccuccacuggggaaugcucccagcugugcugugga

SEQ ID NO: 313190 - RNA, 64 nt, Human
uuugcaaugaaauuuugggacccaaagaguauccacuggggauguuuuuuggccaaaacucuuc

SEQ ID NO: 313191 - RNA, 64 nt, Human
ucgucuuuccugcccaaguaaagcuuacagacuaacuggggagauguagugugcauacaaaaca

SEQ ID NO: 313192 - RNA, 64 nt, Human
cauugcagagcuaagcagucgugguaugggggcgacuggggaguccucauugaauccucauuuu

SEQ ID NO: 313193 - RNA, 64 nt, Human
ggcuccgcaacugagugacacccagcgacaaccgacuggggagugguagaagcaacugaacgga

SEQ ID NO: 313194 - RNA, 64 nt, Human
ccauuugccuuucugggagcagaaacagccauugcggccccaggaggggaacugagucacgcug

SEQ ID NO: 313195 - RNA, 64 nt, Human
acccacggucacugcuguguucagccccucagcucggccccagccuauuucccgccuccauuug

SEQ ID NO: 313196 - RNA, 64 nt, Human
caugcgcauugucacuuggaucuuguggugaggacggccccaucuuucuugccacagauugagg

SEQ ID NO: 313197 - RNA, 64 nt, Human
guggugucuacugaagaucccuuugaccaggaugacuggggagcuuggcagaaguucacggcca

SEQ ID NO: 313198 - RNA, 64 nt, Human
cucacucccaccacucugggccccuugggggaggacuggggagggggccgugggagagcccuga

SEQ ID NO: 313199 - RNA, 64 nt, Human
acagaguggccucccugcugugccaugcugggccacuggggacuuuauuuauuucuaguucuuu

SEQ ID NO: 313200 - RNA, 64 nt, Human
ccuccacuguccuaagauaaagccucucauaggcacuggggacccugcacagucuggccaugug

SEQ ID NO: 313201 - RNA, 64 nt, Human
cccaauguucagagcugggacuugagcucacaaaacuggggagcugagacauuuguucucuugg

SEQ ID NO: 313202 - RNA, 64 nt, Human
uucuaaccuaaguaaaggccccagugaaaaacauacuggggaaauaaaaccucugagaaaaggu

SEQ ID NO: 313203 - RNA, 64 nt, Human
cugccaccacucugcuuugcccaagugugacagcacuggggaggagagacaggauaaagggcag

SEQ ID NO: 313204 - RNA, 64 nt, Human
uaggaauaacuuuuacacgaccauuugauagggaacuggggaaugggguauggaaguuuuccua

SEQ ID NO: 313205 - RNA, 64 nt, Human
uuguguguguugggggagcuuccacaggagccacacuggggaaaagcuguaguaucuucuuugu

SEQ ID NO: 313206 - RNA, 64 nt, Human
ccuuacccuaccucugccaaaaagugggggcuguacuggggacugcucggaugaucuuucuuag

SEQ ID NO: 313207 - RNA, 64 nt, Human
uuucuaggugacccuguuuaauaggcuuucacagacuggggaaugcucaagaugugaugggccu

SEQ ID NO: 313208 - RNA, 64 nt, Human
augaauugaauugugcaauguugcuguucuggggacuggggagauuagcaucccauuugcccac

SEQ ID NO: 313209 - RNA, 64 nt, Human
caggggaggacuaggaaaagaccaucugcccggcacuggggacuuaggggugcggggaggggaa

SEQ ID NO: 313210 - RNA, 64 nt, Human
gcccccacccuguuccugcugcugucugggugcuacuggggaaacuggccauggccugcaaacu

SEQ ID NO: 313211 - RNA, 64 nt, Human
gaagcuggggggagaggcugcuucgaagggcaggacuggggauaaucagaaccugccugucacc

SEQ ID NO: 313212 - RNA, 64 nt, Human
gugagcccggugagggcggcaggcagggguuauccggccccacuuucuggaugacagacuugag

SEQ ID NO: 313213 - RNA, 64 nt, Human
aagugcugggauuacaggcaugagccaccgcgcccggccccaaucaucuguuuuuaaacaaucg

SEQ ID NO: 313214 - RNA, 64 nt, Human
gacgcgccagaagcacccagcccugcccagcaaccggccccagcagcagguccuggugcuggcg

SEQ ID NO: 313215 - RNA, 64 nt, Human
gcuguuuguucccaaagguugguaauaaggggccacuggggaagccugggucaguauaugguug

SEQ ID NO: 313216 - RNA, 64 nt, Human
acccaggagcaagcgagacacuaccauugaaucagggaaugagaauuaagaauggacaggacca

SEQ ID NO: 313217 - RNA, 64 nt, Human
cuuguuaccuauaguuuacuuugggugauuggaggggaaugacuuaguuaugacuggacaucuu

SEQ ID NO: 313218 - RNA, 64 nt, Human
caggaugggggcaaugggaggggaugcuacugaugggaaugauuaagggagcugcuguuuaggu

SEQ ID NO: 313219 - RNA, 64 nt, Human
aaaaucucaacaccugugggagaguaagaacuaagggaaugaguuugggcggccccucauaaag

SEQ ID NO: 313220 - RNA, 64 nt, Human
agguauuuauucucaauaccugacaggggcccaugggaaugacuucagaagcaucccggauaau

SEQ ID NO: 313221 - RNA, 64 nt, Human
auauuucuuucuaauauaauauugcauccuuugugggaaugacuauagguaaaauguaguaagu

SEQ ID NO: 313222 - RNA, 64 nt, Human
uuuagaauaacaaguauuauucuuuuuuaguagagggaaugacugucaauaugauuuauuuguu

SEQ ID NO: 313223 - RNA, 64 nt, Human
agagacgcgggcccagugagcuucuugcggcccagggaaugagauggagcucacggcuuaaagc

SEQ ID NO: 313224 - RNA, 64 nt, Human
aagaaguaaacauggcuagaaagaaccacguucagggaaugacguugugcccagccuuuuuuuu

SEQ ID NO: 313225 - RNA, 64 nt, Human
uuuuaaaauucugagugauccaggguaugaccuagggaaugaacuagcuaugaaauacucaggg

SEQ ID NO: 313226 - RNA, 64 nt, Human
uaacugugcuuguugaaugucaaucauauuuaaagggaaugacuuugaaguaaaaccuuuuuuc

SEQ ID NO: 313227 - RNA, 64 nt, Human
cuuccuggggaaauugucuuugguguuuagaggagggaaugagaacacaaauuggauaauccac

SEQ ID NO: 313228 - RNA, 64 nt, Human
aucuccgguccauuccuuggaugcuaaggacugcgggaaugagggagucagauaaagaacaaac

SEQ ID NO: 313229 - RNA, 64 nt, Human
caggagguugaggcugcagugaauuaugauuguggcauugcacuccagccugggugguagauca

SEQ ID NO: 313230 - RNA, 64 nt, Human
acgucucugucucugggccuuuguuccccuauaugcauugcaggccugcuccacccuccucagc

SEQ ID NO: 313231 - RNA, 64 nt, Human
uuuacuuugaauacuauuucacugacguuacuaagcauugcagcacaauguagaaauuggcuug

SEQ ID NO: 313232 - RNA, 64 nt, Human
ugaacauuucuuaugauuuuuaaaaguugcuaguacuggggagaaauaauuguugauuaauuug

SEQ ID NO: 313233 - RNA, 64 nt, Human
gccucugccuuggagggaggggaggucuguuaccacuggggaaggcagcaggagucuguccuuc

SEQ ID NO: 313234 - RNA, 64 nt, Human
uguaacuuuaacacauuguuaugugagaaauguuacuggggaaauagaucagccacuuuuaagg

SEQ ID NO: 313235 - RNA, 64 nt, Human
ucuugcucuugaaauuuuggccccaacuccagggacuggggauuugugccuggcagcugccugc

SEQ ID NO: 313236 - RNA, 64 nt, Human
acccacuccuagcccugaggcucgugccccucagacuggggaagaguccaaggaagggagggag

SEQ ID NO: 313237 - RNA, 64 nt, Human
aagaaagauuguccccaggcacaguaucugaaucacuggggauuaugauucacccucuuuggag

SEQ ID NO: 313238 - RNA, 64 nt, Human
gaugggccagaguccuuguggcccacagcauagcacuggggacagagcgcucuaugcaggugag

SEQ ID NO: 313239 - RNA, 64 nt, Human
gaagaaacacacccagaagagagaugcacuaacaacuggggauagggauggggucagggggagc

SEQ ID NO: 313240 - RNA, 64 nt, Human
uuugccuugaugagcuugccuuuugugacuugacacuggggacguggaguggcgguguccaggg

SEQ ID NO: 313241 - RNA, 64 nt, Human
gauuucuauaguuauuguuuucugucauuugccuacuggggaagaaagugaaggaggggaaacu

SEQ ID NO: 313242 - RNA, 64 nt, Human
uaucuuuucugagagagggggagucacccccccuacuggggauuccucugggcuuuauucacuc

SEQ ID NO: 313243 - RNA, 64 nt, Human
gaggaugcauauuauucagcaucagacagccgacacuggggaggagccuuaucaaugcagugag

SEQ ID NO: 313244 - RNA, 64 nt, Human
ccugcuggcggcucucauggggaagcgccugggcacuggggauugcuuguggcccacucaacuc

SEQ ID NO: 313245 - RNA, 64 nt, Human
cuaucagcauuguuucaaaauagucauuuuuagcacuggggaaaaauaaacaauaagacaugcu

SEQ ID NO: 313246 - RNA, 64 nt, Human
cuuuaaaugauguacaggcagaugaaaccaggucacuggggagucugcuucauuuccucugagc

SEQ ID NO: 313247 - RNA, 64 nt, Human
uuauauguuuucuuugugauuccuggucaagaaagauccccaaaacuguaucccuaaccuuuaa

SEQ ID NO: 313248 - RNA, 64 nt, Human
gucccaguuuuaucugcuccugagacugagcccagauccccaaaucuaaucugauuuacaguuc

SEQ ID NO: 313249 - RNA, 64 nt, Human
gcuaggagguagucuggagggcuggucauucacagauccccauggucuucagcagacaagugag

SEQ ID NO: 313250 - RNA, 64 nt, Human
caauuuaaaguguuuuucucuauagccuuuuuugacuggggaagcaagggguaauguuaauuag

SEQ ID NO: 313251 - RNA, 64 nt, Human
gcaggcugccucuucugccccggagcuggggugcacuggggacccccgugguggggaccuuggc

SEQ ID NO: 313252 - RNA, 64 nt, Human
ucuuuuuaucgccauuccaggggccucagguccuacuggggaaacuuccuauaccggagcucca

SEQ ID NO: 313253 - RNA, 64 nt, Human
ugccucuggcgucagucuuuucccucauccacucacuggggagauuggacuagaggaguccuga

SEQ ID NO: 313254 - RNA, 64 nt, Human
guccucguucacucucugaaguuggccuccuuucacuggggauugaaaagcaccuccaccccua

SEQ ID NO: 313255 - RNA, 64 nt, Human
ccugcauguucaggccccucgggggauuggggggacuggggaggcgcagccuagacccaauugc

SEQ ID NO: 313256 - RNA, 64 nt, Human
acaaccaaccccucuccugggaggccccugccccacuggggauaggagccugugucccuggugc

SEQ ID NO: 313257 - RNA, 64 nt, Human
ccugcccacagguaagccccugggagcauccacaacuggggaccugcucagugcccccccugcc

SEQ ID NO: 313258 - RNA, 64 nt, Human
ugaacaggcagguaggauucagugugcucagugcacuggggauuuggagagagaugggcuugcu

SEQ ID NO: 313259 - RNA, 64 nt, Human
gcuuucgugugaccacauguuuucuguaccagucacuggggaaagaagugaguuuaucucguuu

SEQ ID NO: 313260 - RNA, 64 nt, Human
aguuaggaguugcuggacuggaugcauuacgaggacuggggacaggguagagggacauccaggg

SEQ ID NO: 313261 - RNA, 64 nt, Human
caucucacuuaccauggcuagagaugggggugagacuggggaaggacaaaagcagggaacagau

SEQ ID NO: 313262 - RNA, 64 nt, Human
cggugccucacaaacuugauugugcauaaaaaucacuggggaucuuguuaauacagcuucuaac

SEQ ID NO: 313263 - RNA, 64 nt, Human
cuacucgggaggcugaggcaggagaauugcuugaacuggggaggcagagguugcagugagacaa

SEQ ID NO: 313264 - RNA, 64 nt, Human
gugaaaaaagcagcauuagagugccagaauuagcacuggggaaaacuggccaggggaacacaaa

SEQ ID NO: 313265 - RNA, 64 nt, Human
cucucugggccuuggcuugggaccagguacgaaggauccccaagcccuucaggccugagaucag

SEQ ID NO: 313266 - RNA, 64 nt, Human
uucuucucccuccagacucuuggaugacuaccuagauccccagcuuaccgguuaguuuccucca

SEQ ID NO: 313267 - RNA, 62 nt, Human
cacauuacaaugggcugugacucuccaccucagcauugcaucguaucaucauuuucgcuacg

SEQ ID NO: 313268 - RNA, 64 nt, Human
aggccgggucugcccuaaggauaaaugaucacuuacuggggaagaaaugagagagcaggggcac

SEQ ID NO: 313269 - RNA, 64 nt, Human
ggggcucccaauccccuuugccaucucugcucucacuggggacccuccuccccuucccaccugc

SEQ ID NO: 313270 - RNA, 64 nt, Human
uggcugaguuauuaauagccagagccacugggagacuggggagacuggcuguaacccccuucac

SEQ ID NO: 313271 - RNA, 64 nt, Human
acuugagacuuugacugugccauguauaagauauacuggggaucauuguauggauccuaauuaa

SEQ ID NO: 313272 - RNA, 64 nt, Human
auucucguauccaacccaaggaccuuuuggaaugacuggggagggcugcagucacauugaugua

SEQ ID NO: 313273 - RNA, 64 nt, Human
ccauggcagaagucaacgccucgguggcauacagacuggggacccuggacaugcgggccuuucu

SEQ ID NO: 313274 - RNA, 64 nt, Human
ugggaagggcugcgaggccugcccuccaaaccugacuggggaugggcggcacugugcgggugag

SEQ ID NO: 313275 - RNA, 64 nt, Human
cacuaaaccuaaggacagcuacaaaggaaagacaacuggggaaagaagaccuaggacuggggga

SEQ ID NO: 313276 - RNA, 64 nt, Human
aagccuagguagauuuaaaauggggugcucagggacuggggaacaagacgggguggggugggga

SEQ ID NO: 313277 - RNA, 64 nt, Human
ggaggugcuuucacucaaccaagggggccacagcacuggggagugaaacugccccgccucaccc

SEQ ID NO: 313278 - RNA, 64 nt, Human
cccaggacagggaaaagcagugcggagggaugggacuggggagucagcugcucaucugcaggcu

SEQ ID NO: 313279 - RNA, 64 nt, Human
guggaaagggcacuggcccugccacagagaugccacuggggacccccagacaccaguggcuuga

SEQ ID NO: 313280 - RNA, 64 nt, Human
cuuuuucuucugucagaggaccauucuuaguggcacuggggaaaucuuggcacccagaagaauu

SEQ ID NO: 313281 - RNA, 64 nt, Human
cuagcagauuuauauuauaugcagauaauaauuaacuggggauaaaagaauggcaaggggugac

SEQ ID NO: 313282 - RNA, 64 nt, Human
cuaaaucuuuaaauucuguuaagauccucaaguaacuggggaguacaugcuuuaggacacaaac

SEQ ID NO: 313283 - RNA, 64 nt, Human
ccgggcucuguaggaaaguugguccuugacuguggcauugcacucugcacuguuucucucugca

SEQ ID NO: 313284 - RNA, 64 nt, Human
auaguaaugugacaaacuaaaguuaauacaugaagcauugcaauauggaauuuugcacauuuuu

SEQ ID NO: 313285 - RNA, 62 nt, Human
agaagugccggguuuggugaucuucaaaagaagcauugcagcccuuggcuagacuugccaac

SEQ ID NO: 313286 - RNA, 64 nt, Human
uaaaguguuuuuaguaugcuuuuagucucuuguaacuggggagaagcaguguuuuuuuuuuagg

SEQ ID NO: 313287 - RNA, 64 nt, Human
acugguucacugcgucuggacaagccucauggggacuggggauucuggccaguguaauuucugu

SEQ ID NO: 313288 - RNA, 64 nt, Human
aacuuucguuuugacucaaaagcagugggucucaacuggggaugauucgcuuaucugaacagca

SEQ ID NO: 313289 - RNA, 64 nt, Human
uccaaaugagaacuaaauaaaguguugaacaucaacuggggaauugaagccaauaaaccuuccu

SEQ ID NO: 313290 - RNA, 64 nt, Human
aaauucagauuaggagauauuuuaggccccugcaacuggggaaggcuacuguuuguuuuuguuu

SEQ ID NO: 313291 - RNA, 64 nt, Human
uucucccuuggggugggaaucuaugauggagguuacuggggaaacagcucagcagauuuuugga

SEQ ID NO: 313292 - RNA, 50 nt, Human
gaggccugcaugcuccgugaacuggggaucuuugguagccguccaugucu

SEQ ID NO: 313293 - RNA, 64 nt, Human
ccuaacccuaaacccucuaugcucaggggcuggaacuggggaauggaguaagucaccuucugac

SEQ ID NO: 313294 - RNA, 64 nt, Human
aauggacaggaccaagacagaacucaagaaagccacuggggaaaacucgagaagaaagggagua

SEQ ID NO: 313295 - RNA, 64 nt, Human
gcuccagucccacuccugucaccccacgcucugcacuggggagaaaacgggaggugcucgugcu

SEQ ID NO: 313296 - RNA, 64 nt, Human
uuuaguucaucucucaaauaauccaagacuucucacuggggaauaagggaauaauaaauagggu

SEQ ID NO: 313297 - RNA, 64 nt, Human
caaugaugggaccaaggacauuauuaguuugacaacuggggaaagaaguguucuucacccccua

SEQ ID NO: 313298 - RNA, 64 nt, Human
caguaaaugacagaacuauuuuucauuauggguaacuggggaauaaaugggucacuggaguagg

SEQ ID NO: 313299 - RNA, 64 nt, Human
aaauccugccucucucacuuggaagcuguguuacacuggggauguuauuuacuuguuuauuagu

SEQ ID NO: 313300 - RNA, 64 nt, Human
cugucuucuauccauuaguucugcccuggagcacacuggggaagcaggcugcgggccuuccaaa

SEQ ID NO: 313301 - RNA, 64 nt, Human
auuuuccucuagugcucaaacaaauacaaaauaagauccccaagguuuaaacugcccaguuagc

SEQ ID NO: 313302 - RNA, 64 nt, Human
aagagacagaaagaccccaugacccccccauguggauccccaucugugucucaguugcaucugu

SEQ ID NO: 313303 - RNA, 64 nt, Human
gaugucauggcauugccucagcaccccagcaagagcauugcaucuuugcugaauccagaugggu

SEQ ID NO: 313304 - RNA, 64 nt, Human
uuuccuuuuuuuuuuuuuuuaacucggaaacacaacuggggaaauauauucuuucccagugauu

SEQ ID NO: 313305 - RNA, 64 nt, Human
aaguugucuccaacgaacagaaaacuauaaacuuacuggggacaggaugugugcuaaagggcac

SEQ ID NO: 313306 - RNA, 64 nt, Human
auuauuauuuugaaaguauggaaguuuuccauucacuggggaaaggagggaaaagugcauuuau

SEQ ID NO: 313307 - RNA, 64 nt, Human
aguucugcccaugggaaguaaacugcagcaggccacuggggacagaagggcccauguacuuguu

SEQ ID NO: 313308 - RNA, 64 nt, Human
agcaugcccaauuuuagcccugaagcagggcugaacuggggagccccuuucccugggagcuccc

SEQ ID NO: 313309 - RNA, 64 nt, Human
ucccccaaggugcaggagggcaggauccagcagcacuggggaugccgaggcaaugcuguacuug

SEQ ID NO: 313310 - RNA, 64 nt, Human
uugcugccaaaggagauaacuguuggaaguucacacuggggaaacucauuuuccccugcagcuc

SEQ ID NO: 313311 - RNA, 54 nt, Human
aguccugcugcauccaguaacaccacuggggaugugcuggcuggacggcaccac

SEQ ID NO: 313312 - RNA, 64 nt, Human
uguacaccagucccugaacugagcuguuuacaggacuggggaggcuccacccagaaggcuuuca

SEQ ID NO: 313313 - RNA, 64 nt, Human
auguauuuacucugcaccaggucccaugccaagcacuggggacacaguuauggcaaaguagaca

SEQ ID NO: 313314 - RNA, 64 nt, Human
uugacagaggguauggaagacuugcaauuugaaaacuggggaccaguuccaaagucaguaauug

SEQ ID NO: 313315 - RNA, 64 nt, Human
acaggcgugguguugggugccuguaaucccagcuacuggggaggcugaggcgggagaaucgcuu

SEQ ID NO: 313316 - RNA, 64 nt, Human
guuucauuauuauuauugugaaaauauuauuaacacuggggacuccuuaagaguacaucagagu

SEQ ID NO: 313317 - RNA, 64 nt, Human
ccuaaucacauuaugaucuugacaggugcacuuuacuggggagaauaaaaaggaccauacggua

SEQ ID NO: 313318 - RNA, 64 nt, Human
aauuuuucauaggggaguuuuggacaaaacagucacuggggagaucacugccauuuuuacacac

SEQ ID NO: 313319 - RNA, 64 nt, Human
uuuuucauucuuccuccucuccauucgaaguaaagauccccaguuaguuuuuauauaaauaauc

SEQ ID NO: 313320 - RNA, 64 nt, Human
cgaguaccgcugaacuguggguggguggccgcgggauccccaggcgaccuuccccguguuugag

SEQ ID NO: 313321 - RNA, 64 nt, Human
gaauucugcccuggacagggcuuugcccuuggaggauccccagguggccuuacccgugauucuu

SEQ ID NO: 313322 - RNA, 64 nt, Human
caccccgccugcccucauggccccucugaccugcacuggggagcccgucucaguguugagccuu

SEQ ID NO: 313323 - RNA, 64 nt, Human
ucagauggugcgaacagcagagcaggcaagggaaacuggggagauggggauggaggaggaaggc

SEQ ID NO: 313324 - RNA, 64 nt, Human
ccagccucucccuacucccaucccauuuccaccaacuggggaacugugacuaucuaucuccccc

SEQ ID NO: 313325 - RNA, 64 nt, Human
gucucagaacuguugcauggauccuguguuugcaacuggggagacagaaacugugguugauagc

SEQ ID NO: 313326 - RNA, 64 nt, Human
ggcauaaacuugaugcagcugccucccucauucaacuggggaguucuugaguuccucauuuguu

SEQ ID NO: 313327 - RNA, 64 nt, Human
aaucaccaagcaugcaccaaacacugcuuuaggcacuggggacacaaaggggacagagccaucc

SEQ ID NO: 313328 - RNA, 64 nt, Human
cugaagcucucccacuguuuucaauguuuaaccaacuggggaccccugcucuuuaaguauauua

SEQ ID NO: 313329 - RNA, 64 nt, Human
gguuuggccauaagcucauaugcugcccccaaagacuggggagagcugugugccucaguguugc

SEQ ID NO: 313330 - RNA, 64 nt, Human
ugcugauuugaaauuuagauuuuuuaaauuauguacuggggacagguuuuugucgcuuuacauu

SEQ ID NO: 313331 - RNA, 64 nt, Human
aaagaagucugauaucuugggcagcuugcugcuuacuggggagaccagcaugcuuagacacuua

SEQ ID NO: 313332 - RNA, 64 nt, Human
aaugaagauguuauuuuggacuucggacaccuccacuggggacucuuccaggauggguuggaga

SEQ ID NO: 313333 - RNA, 64 nt, Human
gagcuguagaauugaaucaaugugaacucagggaacuggggaaggcugagccuccucuuuggug

SEQ ID NO: 313334 - RNA, 64 nt, Human
acucccugccucucacuccagaccuguucccacaacuggggagguaggcugggagcaaaaggag

SEQ ID NO: 313335 - RNA, 64 nt, Human
guggggaaccccucccauuaaagauccgggcaggacuggggacagguuggaagugugaugggug

SEQ ID NO: 313336 - RNA, 64 nt, Human
ccaggcaugguggcucgcaccuguauucccagccacuggggaggcugaggccggaggagugcuu

SEQ ID NO: 313337 - RNA, 64 nt, Human
ucaggaugccaccaccuugaacaccuaggccagggauccccaccaugucccggguuucuuucuu

SEQ ID NO: 313338 - RNA, 58 nt, Human
gcacagaggcaagcagcuaagaguccgggauccccagccuacugccucuccagcacuu

SEQ ID NO: 313339 - RNA, 64 nt, Human
uugcauuccuauguaagauaggaggggcugaggggauccccaguguuuggaacauaagucacua

SEQ ID NO: 313340 - RNA, 64 nt, Human
caaagcagacucaucagcuccauaucugcauuccacuggggaaagagagagagaaaagagcaga

SEQ ID NO: 313341 - RNA, 64 nt, Human
uaaagacuucacacagaaggcucugaacugagccacuggggaagggaaguuucaguaacaugac

SEQ ID NO: 313342 - RNA, 64 nt, Human
agcuaucuucauguaaauugacuguacuaggccuacuggggaucagaguucccaagaaaggaaa

SEQ ID NO: 313343 - RNA, 64 nt, Human
gucaaggucuuacuccagcccuuccuggguguuaacuggggacucucuugaccucccugcauca

SEQ ID NO: 313344 - RNA, 64 nt, Human
uaagaguaaguugguuacuucaaaaagagcaaacacuggggaucaaauuauuuuaagagguauu

SEQ ID NO: 313345 - RNA, 64 nt, Human
auacucaauccuuaguacacauaagaaaauucauacuggggagaaaccccacaaauguggagaa

SEQ ID NO: 313346 - RNA, 64 nt, Human
ggccaaagcccgggaccucuacuugaacaguucuacuggggaggcuggagaacuaaggaaacac

SEQ ID NO: 313347 - RNA, 64 nt, Human
ggagggcccugccacgggccacuggcugcuggggacuggggacugggcagagacugagccaggc

SEQ ID NO: 313348 - RNA, 63 nt, Human
ucacaggaaauucuauuugagccacccuuccgcacuggggagaaucuaugcaagccucgucaa

SEQ ID NO: 313349 - RNA, 64 nt, Human
aguguuagggcuggggcucagccugggggagccuacuggggacugagcccccaggagggccagc

SEQ ID NO: 313350 - RNA, 64 nt, Human
gccagccucucuguccaaugcugccuggacauuuacuggggaggugaguagcaggcccagcucc

SEQ ID NO: 313351 - RNA, 64 nt, Human
auuuauauaacugguuaugugaauauauuuaaauacuggggaaauugcuucacugucuuagaac

SEQ ID NO: 313352 - RNA, 64 nt, Human
ugacaggaaguaaaaguuuacauggugaaauaauacuggggaaaucggagcaacaaugucaguu

SEQ ID NO: 313353 - RNA, 64 nt, Human
ggcucacccaggucuccagcaaacggaggacugaacuggggagagucacccugagccagcccuu

SEQ ID NO: 313354 - RNA, 64 nt, Human
gagccugcagagcugcgggcuggguguggucuccacuggggauugggccccugccagacccccu

SEQ ID NO: 313355 - RNA, 64 nt, Human
caggaguucgagaccagccugggcagcauagcaagauccccaucuuuuaaaaacaaaauaaaac

SEQ ID NO: 313356 - RNA, 64 nt, Human
ccauggcccugagcgaguggagucugccacccaggauccccaaggcacuugagggggaaggauu

SEQ ID NO: 313357 - RNA, 64 nt, Human
ccucaggaagaacacaggugggcuccuagcagcugauccccaaugccuggccuuaaagccgagc

SEQ ID NO: 313358 - RNA, 64 nt, Human
ccgggcaugguggcaggcgccuauaaucccagcuacuggggaggcugaggcaggagaaucacuu

SEQ ID NO: 313359 - RNA, 64 nt, Human
caccccaagugccguuuggauggggaagggaaagacuggggagggagagugaacuccgaggggu

SEQ ID NO: 313360 - RNA, 64 nt, Human
uuagcucuagccuucugccuuaagaaugcacucuacuggggauuuccuggcauaguuaagagcg

SEQ ID NO: 313361 - RNA, 64 nt, Human
ucugggggccgcagaggauccaucacagacggauacuggggaguaaacggcccaggccaggugc

SEQ ID NO: 313362 - RNA, 64 nt, Human
aaagggcaggguggcucaggcuuuaggcccagguacuggggaggccugaggagcccuccuggag

SEQ ID NO: 313363 - RNA, 64 nt, Human
gcagugucauaggaguggagggggauaaguggggacuggggacaugugaaaugaugggcauucc

SEQ ID NO: 313364 - RNA, 64 nt, Human
cagccugggcuagagcuccugggcugugccguccacuggggacuggggaugggacaccugagga

SEQ ID NO: 313365 - RNA, 64 nt, Human
ggcuagagcuccugggcugugccguccacuggggacuggggaugggacaccugaggacauucug

SEQ ID NO: 313366 - RNA, 64 nt, Human
uaguaauaccugaguacccaugggaauaauagacacuggggagguaggguggggagcgggagca

SEQ ID NO: 313367 - RNA, 64 nt, Human
uggggagcgggagcaagagcugaaaaacuuaccuacuggggacugugcucacuaccugggugac

SEQ ID NO: 313368 - RNA, 64 nt, Human
acuuggcuagcuguccuuuggauaugugcuguuaacuggggaaggcaucuaacuaguagccugc

SEQ ID NO: 313369 - RNA, 64 nt, Human
auucccagcaguaucaacccucagaggagcgggaacuggggaauucuggcccuacgugcauuca

SEQ ID NO: 313370 - RNA, 64 nt, Human
cugcccaaaaggaaacccaaauuauuugugggauacuggggaaauuguagugaagggcuuaaug

SEQ ID NO: 313371 - RNA, 64 nt, Human
agucgguaugcuuucuaaaaacugagggaaacuuacuggggaaauagaauaacaaucuccauuu

SEQ ID NO: 313372 - RNA, 64 nt, Human
accuguuaagucaaaaccaucuuggcuaauauguacuggggaaauaauccauaagagauaucac

SEQ ID NO: 313373 - RNA, 64 nt, Human
acgcccagccacagcaagcccugucccuuugccggauccccaaacacuagagaagcucuccuaa

SEQ ID NO: 313374 - RNA, 64 nt, Human
augagcuggucccucagaacaugacuccuugggagauccccaucacaaaagguacccugacccu

SEQ ID NO: 313375 - RNA, 64 nt, Human
gccugaggcagucaccuauuuguagaacucaauugauccccaaccugccaggcuuccuaucuca

SEQ ID NO: 313376 - RNA, 64 nt, Human
uauguguguguguuuuuuucacuauuaaagcaguacuggggaauuuuguacaauaaaaugugug

SEQ ID NO: 313377 - RNA, 55 nt, Human
cuguugugaaacuuguuugagagagacuggggagguggccauaaaggggcagagu

SEQ ID NO: 313378 - RNA, 64 nt, Human
ugugagcugguggacggugaugaggaaggacuugacuggggauggcgcaugcaugggaggaauu

SEQ ID NO: 313379 - RNA, 64 nt, Human
uguauuagguguaaaauauuuauaagauauauggacuggggaauuugauuauuccucccuuuga

SEQ ID NO: 313380 - RNA, 64 nt, Human
auuuugaaugaauucucaacaaaaugugcuagccacuggggacgcaaaacaaguaagaucccug

SEQ ID NO: 313381 - RNA, 64 nt, Human
gagcccuuccccgagacugcugaugucuguaaccacuggggagcacugccaaaaauacagcuuu

SEQ ID NO: 313382 - RNA, 64 nt, Human
gccacaggaucggcccgagacccaggccaugcccacuggggacacacugugccgugcuccuucu

SEQ ID NO: 313383 - RNA, 64 nt, Human
cucuaccaauuccuauucccaaaaugaacauauuacuggggaaaguuaguugagaaucagagca

SEQ ID NO: 313384 - RNA, 64 nt, Human
cugguccgugagaugccgcggguccuguuuccuuacuggggauuucagggcuggggguucaggg

SEQ ID NO: 313385 - RNA, 64 nt, Human
uauuuuauauacagauggacagauauuuuuuuaaacuggggaguuuuccugaucuuggguccuc

SEQ ID NO: 313386 - RNA, 64 nt, Human
cuacucaggaggccgaggcagaagaauugcuugaacuggggaggcagagguugcggugagccca

SEQ ID NO: 313387 - RNA, 64 nt, Human
uuggcucagcucggggagccuuagccgcccaugcacuggggacgcuccgcugccgugccgccug

SEQ ID NO: 313388 - RNA, 64 nt, Human
ccuuagaggcuccuucuguguagucugggucuguacuggggagggucacagcccacgggcuggc

SEQ ID NO: 313389 - RNA, 64 nt, Human
gugaccacuuuugacaaaggaaugaagaacauacacuggggaaaagauaaugucuuuaauaaau

SEQ ID NO: 313390 - RNA, 64 nt, Human
aaagccuuucugaaucuauaauaaugguacuucuacuggggagaguguaauauuuuggacugcu

SEQ ID NO: 313391 - RNA, 64 nt, Human
ggaggaaaugagcgaguucccucugacaccagcagauccccaggggcugcugggcaguggccug

SEQ ID NO: 313392 - RNA, 64 nt, Human
aagcucacuguguaauuagcauuuagaagcugaagauccccaacugcuccagccucugccgcug

SEQ ID NO: 313393 - RNA, 64 nt, Human
guguacccucaacugccuccuuuuugcagagaacgauccccacaggaacuggucuaagaacacu

SEQ ID NO: 313394 - RNA, 64 nt, Human
cucuguuccccauguggaggucggaggggcugggacuggggagggggcagccaccuccauccaa

SEQ ID NO: 313395 - RNA, 64 nt, Human
ccgggcgugguggcacacuccuguaaucccagcuacuggggaggcugaggcacgagaaucacuu

SEQ ID NO: 313396 - RNA, 64 nt, Human
ggaaguagauugcugccucuagccagagaccugaacuggggaauuugaacauuccuuuacauug

SEQ ID NO: 313397 - RNA, 64 nt, Human
uuaagugaaaaauacaauaguaaauuaagauuacacuggggaaaaaaaugcagguaucacuuua

SEQ ID NO: 313398 - RNA, 64 nt, Human
gaaugcuguucuuaaagcauuauuuacaguaggaacuggggaguaaaucuguucccuacaguuu

SEQ ID NO: 313399 - RNA, 64 nt, Human
aaaagagguuuaauuggacuuacaguuccacaugacuggggaggccucagaaucauggugggag

SEQ ID NO: 313400 - RNA, 64 nt, Human
ugcucgccugcagagcagcccagaaagagcccugacuggggagagaacauuuuagaaucucuag

SEQ ID NO: 313401 - RNA, 64 nt, Human
auguggaucuuuuacaccacaucacagugaacacacuggggagacgugcuuuuuuggaaaacuc

SEQ ID NO: 313402 - RNA, 64 nt, Human
cugugggugagagcagggcacuguccagcuguccacuggggaagucaagauguccuaaggccca

SEQ ID NO: 313403 - RNA, 64 nt, Human
cucaggcaggggccuccaugggccccaggggaacacuggggacuuggccucucucuaggguaca

SEQ ID NO: 313404 - RNA, 64 nt, Human
ccagauguuuugaguuauuucccuuaaguguuucacuggggagagaacagggagugcuccucca

SEQ ID NO: 313405 - RNA, 64 nt, Human
uuucucucucgcuacaaguauucuuucacucagcacuggggaaguugggaacagcuggucacca

SEQ ID NO: 313406 - RNA, 64 nt, Human
ccagacaugauggcgggugccucuaaucccagcuacuggggaggcugaggugggagaaucgcuu

SEQ ID NO: 313407 - RNA, 54 nt, Human
agcgacgaacugagcuguaaccagacuggggaggggcagggggagaggccccca

SEQ ID NO: 313408 - RNA, 64 nt, Human
cuugggccacucaggaccccucuggcugugucggacuggggagggauaugauggagagccagcc

SEQ ID NO: 313409 - RNA, 64 nt, Human
cggucagggucuucuugcgacccggcccgcuccagauccccacagcucucggccgcggacccgg

SEQ ID NO: 313410 - RNA, 64 nt, Human
aggagggauggaggucccuuauuuccuucagaaugauccccaucccccauagucgccagacuuu

SEQ ID NO: 313411 - RNA, 64 nt, Human
ugcuuggaagugucuguggggucuccuccucccagauccccaagaucugugucacuggucgauu

SEQ ID NO: 313412 - RNA, 64 nt, Human
agcucuuuguagguucugggcuggguugugggggacuggggagcugggcucuaccaucccuccc

SEQ ID NO: 313413 - RNA, 64 nt, Human
cuuugugcaaaucugccauaagcucaaggcugugacuggggaaaaagauugagcuuaguuuuca

SEQ ID NO: 313414 - RNA, 64 nt, Human
ccaagcuuggugguaugugccuguggucccagcuacuggggaggcugaggugggaggaucguuu

SEQ ID NO: 313415 - RNA, 64 nt, Human
ucaagccaagcagccaagcuccuugggaggccccacuggggaaauaacagcuguggcucacgug

SEQ ID NO: 313416 - RNA, 64 nt, Human
agcuaaaguaaaacccuuuugagggaagagggagacuggggagaagggaaaagagagaaggcag

SEQ ID NO: 313417 - RNA, 64 nt, Human
uaauguaggauugagagcugggcaaacaggucccacuggggacugugacucuuggagauuaaag

SEQ ID NO: 313418 - RNA, 64 nt, Human
cuuuguguaucaagugucgcucacagccccauucacuggggagccuuucggaucuauuuggucu

SEQ ID NO: 313419 - RNA, 53 nt, Human
ggcagcgcaaaggccucugaacuacuggggacuucggaccgcuuguggggacc

SEQ ID NO: 313420 - RNA, 64 nt, Human
aaaguaccauagccaguuuccagaugggccacagacuggggaggagaaucaguggcccagccag

SEQ ID NO: 313421 - RNA, 64 nt, Human
uguugccaaggucaacccaucaccaggaacugucacuggggacgaguccauguucccaagggca

SEQ ID NO: 313422 - RNA, 64 nt, Human
gcugaagcagagugcuucuagauggagaguggucacuggggaaaaggaccuggccaucaccuuc

SEQ ID NO: 313423 - RNA, 64 nt, Human
cuccuugguagcgugcacgguguugaacugggacacuggggagaaaggggcuuucaugucguuu

SEQ ID NO: 313424 - RNA, 64 nt, Human
uugaggacacauaccugcauuguugagcuucucuacuggggacgccccggcauuauuuuauucc

SEQ ID NO: 313425 - RNA, 64 nt, Human
acuggggucuuagaggcaccagugggaaagcaggacuggggagagauccaggacugagccagcc

SEQ ID NO: 313426 - RNA, 64 nt, Human
gagaggcugggcaggggcugauggggcuggguacacuggggaauguuagcaagacugggaagga

SEQ ID NO: 313427 - RNA, 64 nt, Human
auaaugcugauuccugagauaagaaaguggauuugauccccagucucauugcuuaguagaauaa

SEQ ID NO: 313428 - RNA, 64 nt, Human
caugcaccuuccagcccggggccagcuuggcagggauccccaggaggccugggccgcccagagg

SEQ ID NO: 313429 - RNA, 64 nt, Human
uucucaucugcaaaauggggacaauggggauaaugauccccaccucgaagcacaguugugagug

SEQ ID NO: 313430 - RNA, 64 nt, Human
gccgggcacuggggauauacacaaagccauaagcacuggggacugccagguuggcacuguaggg

SEQ ID NO: 313431 - RNA, 64 nt, Human
gagcaucuauuaugugccaggcacugugccgggcacuggggauauacacaaagccauaagcacu

SEQ ID NO: 313432 - RNA, 64 nt, Human
aaccucaccuucucugauugugggaguggcaagaacuggggagacguccuccauaaguggagca

SEQ ID NO: 313433 - RNA, 64 nt, Human
ccaccucggcugcuaggccccucgccuggacuggacuggggagggaaagcgccuuuuccugcag

SEQ ID NO: 313434 - RNA, 64 nt, Human
auaacauacauucccuuugguaucacaggaaguuacuggggauuacucgaccucauuacuuagc

SEQ ID NO: 313435 - RNA, 64 nt, Human
uuuuuugaguauuuaggaaagagagcuauuaaaaacuggggauuucucaaugugacuaacucua

SEQ ID NO: 313436 - RNA, 64 nt, Human
gacaguugagggagaccugggagaucaagucggcacuggggaagcaggcagcggucccagagcc

SEQ ID NO: 313437 - RNA, 64 nt, Human
cacacccccacccccaaaucccucccuguucuacacuggggacagcagaauuuucuccccgucu

SEQ ID NO: 313438 - RNA, 64 nt, Human
auucuagucuugggaagaaaaguuucuacucagaacuggggaaggaguggaacuuaugacuugg

SEQ ID NO: 313439 - RNA, 64 nt, Human
ccacuggggugcacuuuaauguuccggcagcaagacuggggaacuucaggcucccaguggucac

SEQ ID NO: 313440 - RNA, 64 nt, Human
uucuuccuccugccccuuuugcuuuuuuaaagaaacuggggaaggauuuaugaauacaccacca

SEQ ID NO: 313441 - RNA, 64 nt, Human
uuuauauagacuucagcccuuuguaaauauuguaacuggggaguauagaguagaaaaaaaguau

SEQ ID NO: 313442 - RNA, 64 nt, Human
cgcaaaagcguguagcgagccugccacgcuugugacuggggaggggcuccguauaaucucaccu

SEQ ID NO: 313443 - RNA, 64 nt, Human
ccuuucucucucauagucuuaaugcgucuggaccacuggggaaaauauuuuucuuuucaaaaag

SEQ ID NO: 313444 - RNA, 64 nt, Human
guggacagcgauacagcaggagucagugaaaucaacuggggagcucacuugagcucuugauaag

SEQ ID NO: 313445 - RNA, 64 nt, Human
auaucaaugguuaucucaaaaucgucuuuuaggagauccccaauugacucagaguuugaggagu

SEQ ID NO: 313446 - RNA, 64 nt, Human
auugaaaauuagcuuaugugacaacccucaucuugauccccaucccuucugaaaguaggaaguu

SEQ ID NO: 313447 - RNA, 64 nt, Human
auuucuaggaauguauccugaggaaauuauccgagauccccacaaacugcaauguuuaggaauu

SEQ ID NO: 313448 - RNA, 64 nt, Human
aagucaagucucuuaagcuauuagaaauauucccacuggggaugagggaaaaccccaugaaugc

SEQ ID NO: 313449 - RNA, 64 nt, Human
aguucuccucucccugggauaaguuacugcagaaacuggggauuuagaagcuuauucagggcug

SEQ ID NO: 313450 - RNA, 64 nt, Human
agugaugauaugcauaagugcuguaaggcuuguaacuggggaaauauuccaccugauaauagcc

SEQ ID NO: 313451 - RNA, 64 nt, Human
ugacauguuugguguucucugaccuguuccccacacuggggauuccuggucuguaacuugaauu

SEQ ID NO: 313452 - RNA, 64 nt, Human
agagccccucccuucagagauuacggguacuugcacuggggagguggcugcuggcuggcccaag

SEQ ID NO: 313453 - RNA, 64 nt, Human
agccuucuccucuucaguccaucguccacacagcacuggggaaggggagccacuugaaacaaaa

SEQ ID NO: 313454 - RNA, 64 nt, Human
ucgggcgugguggugcaugccuguaaucccagcuacuggggaggcugaggcaggagaaucgcuu

SEQ ID NO: 313455 - RNA, 64 nt, Human
cuggcccggcggaccucccaccacccagcagugcacuggggauggacaggccuggugugcugcg

SEQ ID NO: 313456 - RNA, 64 nt, Human
agcgccuggagcgaucguagaaacacagaaugggacuggggaagcccuuuggaaauccagcugc

SEQ ID NO: 313457 - RNA, 64 nt, Human
aaugccccucugagaugggcccuaaauuccaguaacuggggaaagaaccagcugcuguguccug

SEQ ID NO: 313458 - RNA, 64 nt, Human
ggucuaaaauuugaauggaaauucaagcacaaguacuggggacacaucaaagugugguguuugg

SEQ ID NO: 313459 - RNA, 64 nt, Human
cuaguucuuugcaaucccuuuauugagcuccuccacuggggagauauaagaaugggaugcaugu

SEQ ID NO: 313460 - RNA, 64 nt, Human
aaaagagauaagaaagacucaagucuguauguacacuggggagaagcagccuguugaguaagau

SEQ ID NO: 313461 - RNA, 64 nt, Human
auuugcaaacucaggaugcuuuccaaagccaaucacuggggagaccgagcacagggaggaccaa

SEQ ID NO: 313462 - RNA, 64 nt, Human
accccagggaacuuccaaggaaggagccugagccacuggggacuaagugggcagaagaaacccu

SEQ ID NO: 313463 - RNA, 64 nt, Human
uguuucauagacccaagaccaaacgcaucuaaaggauccccagcccccaagaccuagccuuugu

SEQ ID NO: 313464 - RNA, 64 nt, Human
ucugacaagaugguccauuuguuccugcuuccgagauccccagggcagccuggaucccugcccu

SEQ ID NO: 313465 - RNA, 64 nt, Human
ucauugggcagacagagucuucuaagcccacagggauccccagauggauuuuucaggacaaaug

SEQ ID NO: 313466 - RNA, 64 nt, Human
cccagcccuacacagcagucuggccugagacgucacuggggacuuaucuguggagccuggugcu

SEQ ID NO: 313467 - RNA, 64 nt, Human
ccuuggcaaagaccaagauauuuuuucccgggccacuggggaaucugaggggugaugggagaga

SEQ ID NO: 313468 - RNA, 64 nt, Human
gucuuuccugugcucugaagaugccagcuacaucacuggggaaacaguggugguggguggagga

SEQ ID NO: 313469 - RNA, 64 nt, Human
ccuuggcaaagaccaagauauuuuuuccugggccacuggggaaucugaggggugaugggagaga

SEQ ID NO: 313470 - RNA, 64 nt, Human
ugugaugaguacagcagagaccuuccugcuuuuuacuggggacuccagauuuuccccaaacuug

SEQ ID NO: 313471 - RNA, 64 nt, Human
cucuaucugcacacacaaaaugcccaaggcacucacuggggaggaagcaaggaagcaaacaguc

SEQ ID NO: 313472 - RNA, 64 nt, Human
agagucauuguuugcaauacaaagcuggauaauaacuggggaagggaagaaagacagucgguuu

SEQ ID NO: 313473 - RNA, 64 nt, Human
gagcagcuugggagccccccauuggcgccgcccuacuggggaagccgguccguacguaggccuu

SEQ ID NO: 313474 - RNA, 64 nt, Human
ggaccuggacagggccagcugcugggggagcggcacuggggacuggaggcuggaagcggguggu

SEQ ID NO: 313475 - RNA, 64 nt, Human
uaacuuugguagcucagugugcaucuagagugggacuggggagggagcuaagcuugggcugggc

SEQ ID NO: 313476 - RNA, 64 nt, Human
ccagcagguggcgcucuggcuuugcacugcaaaaacuggggaccagcccccuucucccacaaau

SEQ ID NO: 313477 - RNA, 64 nt, Human
aaaaauaaaauaauaaaaacaaauuuuuuuaagcacuggggauaaaaagacaucauggaaguau

SEQ ID NO: 313478 - RNA, 64 nt, Human
ucuaagcuuacagagaccagaccaggugaauguaacuggggaaaaucaagaugguaccucucug

SEQ ID NO: 313479 - RNA, 64 nt, Human
gggggaugagauuaggcugaggcagugcuagucaacuggggaaaaggaugauggaaaaaucacc

SEQ ID NO: 313480 - RNA, 64 nt, Human
gggugugguugugcccugagcacguguguaaaggacuggggaggcgugucuugaaaaagcaacu

SEQ ID NO: 313481 - RNA, 64 nt, Human
guacaguguuuucaucucuuggucauaauuccgagauccccagagaccacuguuucuggaguau

SEQ ID NO: 313482 - RNA, 64 nt, Human
uugggagccugaaauagugguucuuggaaaaauggauccccagugaaaacuagagcucuaagcc

SEQ ID NO: 313483 - RNA, 64 nt, Human
gugcccggcauggccauccugauguugcuggcgggauccccaugcaccuuguccuucuccacug

SEQ ID NO: 313484 - RNA, 64 nt, Human
uaccccagcugcugccacuccugcuggagggugaacuggggacccugcacccuccgggaagcca

SEQ ID NO: 313485 - RNA, 64 nt, Human
agugaaggagucagugaccuaugucugccaucuuacuggggaaaagagcaaguagccugucuuc

SEQ ID NO: 313486 - RNA, 64 nt, Human
cauuauccccauggaacguuucacuuuaacccugacuggggagcaauauguucugugaaaauau

SEQ ID NO: 313487 - RNA, 64 nt, Human
agaguggggggauucugguuguuaaggaacuuacacuggggagcuuuacucuuccgugucaaca

SEQ ID NO: 313488 - RNA, 64 nt, Human
caguaacacagcaucaucgcacugacuguggcgcacuggggaauaacagucugagcuagcacca

SEQ ID NO: 313489 - RNA, 64 nt, Human
cacucaagaaccucaggagcgcugccagcuugacacuggggaauccagccaguccagcacacuc

SEQ ID NO: 313490 - RNA, 64 nt, Human
cuguuuuccucucacucuccuguuuauucaccagacuggggaugccuauagguugucugugaaa

SEQ ID NO: 313491 - RNA, 64 nt, Human
uuguucuuguuguucucguuguuguuuuaaguuuacuggggaaagugcauuuggccaaaugaaa

SEQ ID NO: 313492 - RNA, 64 nt, Human
ugggcguagguggugcacaccuguagucccagcuacuggggaggcugaggcaggagaauggugu

SEQ ID NO: 313493 - RNA, 64 nt, Human
uagguuuaacaaaccuuccuaggacaaaaaggagacuggggagggaagaggauuacuuuaaagc

SEQ ID NO: 313494 - RNA, 64 nt, Human
uucucagccccuuuaaaucaccauagggcuggggacuggggaaggggaggguguucagaggcag

SEQ ID NO: 313495 - RNA, 64 nt, Human
aauaaaggagggggaauucccuugaacaagaagaacuggggauaguuauauuuccaccugcccu

SEQ ID NO: 313496 - RNA, 64 nt, Human
ugucguggagaucuggaacuuugcacaugucacuacuggggagguguuccugcucuagcuucca

SEQ ID NO: 313497 - RNA, 64 nt, Human
gggggcaggggaaagacaccacccucgccccaagacuggggauccuggccacuguucccauccc

SEQ ID NO: 313498 - RNA, 64 nt, Human
ugagacuccagcagaguuggggcuggaacuuggcacuggggacucauguuuggaaucguagggg

SEQ ID NO: 313499 - RNA, 64 nt, Human
ccgcccaccagggccaugcucugugacuugggcugauccccacccuuucugggccuacagcacc

SEQ ID NO: 313500 - RNA, 64 nt, Human
cgccccaggaccugcagcccucaugggggcuggggauccccaucagcacagccaggcagagaug

SEQ ID NO: 313501 - RNA, 64 nt, Human
ggcguuuuuucugccaccccaucccugcaugccugauccccaguuccuauacccuaccccugac

SEQ ID NO: 313502 - RNA, 64 nt, Human
gaugucugcucucuggaccccacgugaucuggccacuggggacccccacccgaccccacuccca

SEQ ID NO: 313503 - RNA, 64 nt, Human
caaaggcguaucaguucauggcaucacaucuuucacuggggaagccaguuuccacaggcagcau

SEQ ID NO: 313504 - RNA, 64 nt, Human
uuacuugggaggcugaggcaggagaauggcuugaacuggggaagcagagcuugcagugagccaa

SEQ ID NO: 313505 - RNA, 64 nt, Human
gacuuuuguguccaugcuugugucuagaaaacagacuggggaaccuuaugugagcagcacaucc

SEQ ID NO: 313506 - RNA, 64 nt, Human
ggcaucuaccauuuccucuggauuaaaacuacggacuggggacaacaguauuaauucgauugaa

SEQ ID NO: 313507 - RNA, 64 nt, Human
agggccgacgcugugccggucguggggaaaucucacuggggaagagaaaagcccaagccuuguu

SEQ ID NO: 313508 - RNA, 64 nt, Human
gcuucuccggguauuuaguacuguggugaggagcacuggggaaagccucagcccaauucgggcc

SEQ ID NO: 313509 - RNA, 64 nt, Human
acagauucagacuuggacuaugauuaucuacagaacuggggaccucguuuuaagaaacuagcag

SEQ ID NO: 313510 - RNA, 64 nt, Human
uuacauaccagauuugacugaccacuaauguaguacuggggauaacuuaauauccuauguugug

SEQ ID NO: 313511 - RNA, 64 nt, Human
uguccuuccccacaggugaccgagauccucgauuacuggggacccaauuccggcccauugacgu

SEQ ID NO: 313512 - RNA, 64 nt, Human
aagagcccgccgucugcaggggccuggaggaaucacuggggaugguggcacaggcacugaacag

SEQ ID NO: 313513 - RNA, 64 nt, Human
gggcaaagggggaucuggggggagcucagcagugacuggggagcuggucugccucagagacaga

SEQ ID NO: 313514 - RNA, 64 nt, Human
uugguaucagaaauugccacccucuuaauuucucacuggggagagcagggguggcagauccugg

SEQ ID NO: 313515 - RNA, 64 nt, Human
cuauagcccuuuacccugagcaccaccccaacagacuggggaccagcccccucgccugccugug

SEQ ID NO: 313516 - RNA, 64 nt, Human
accaauagcuaggacccggcugcugugcacugggacuggggauuccacauguuugccuugggag

SEQ ID NO: 313517 - RNA, 64 nt, Human
gcguuuccugccugcggaccagaugaauguagcagauccccagccucuggccuccuguucgccu

SEQ ID NO: 313518 - RNA, 64 nt, Human
ugugauugaauuuuuucuccugcauccauggcaggauccccagccaguauagagacuugguugg

SEQ ID NO: 313519 - RNA, 64 nt, Human
aucuucacuccuuauccgagggcaaauucacaaggauccccaagauccacuuuuagaagccauu

SEQ ID NO: 313520 - RNA, 64 nt, Human
cacuacagaggauucugucuuccaggcccaguccacuggggagugcuggaauggggaccugggg

SEQ ID NO: 313521 - RNA, 64 nt, Human
auucccuucugcauacugcaaucugaucugucagacuggggaauguuggguucuggggucuggu

SEQ ID NO: 313522 - RNA, 64 nt, Human
uacuugugagcgaugugacuuuaaggaaaugaagacuggggaagaauaauuaguguuuauaaga

SEQ ID NO: 313523 - RNA, 64 nt, Human
ggaagggguccagccucguuggaagaggaacagcacuggggagucuuuguggauucugaggccc

SEQ ID NO: 313524 - RNA, 64 nt, Human
gcaggugccuggacauuugccuugcuggacggggacuggggaugugggagggagcagacaggag

SEQ ID NO: 313525 - RNA, 64 nt, Human
accagcccugcccccaccugcccucccgggcaguacuggggaccuucccugggggacggggagg

SEQ ID NO: 313526 - RNA, 64 nt, Human
augaaauaacuaucuccccuuccucugucccccaacuggggagucuccccaggcugcuuuucua

SEQ ID NO: 313527 - RNA, 64 nt, Human
cucuccuuccaggauccuggaggugaugggauagacuggggagacgaugcuguugcuuugcaga

SEQ ID NO: 313528 - RNA, 64 nt, Human
aguguagcagccuccaggcaggauucagcacaacacuggggagucacccuucccucgggccucu

SEQ ID NO: 313529 - RNA, 64 nt, Human
aagcaagcccuggccagagguccuaaagaugcugacuggggagucugaggugucuacaaauguc

SEQ ID NO: 313530 - RNA, 64 nt, Human
ccgggcgugguggcaggcgccuguaaucccagcuacuggggaggcugaggcaggagaauggcau

SEQ ID NO: 313531 - RNA, 64 nt, Human
cgguggucccaauguccaccccugccuccccuucacuggggacugggguuuucgccccaugcug

SEQ ID NO: 313532 - RNA, 64 nt, Human
uauucagacgcugguaugggggcucggaccccucacuggggacagggccaguguuggagaauuc

SEQ ID NO: 313533 - RNA, 64 nt, Human
auuuuaauacgcaagcuguuucuaaggcgcugccacuggggaggguggcuguugccgccugccc

SEQ ID NO: 313534 - RNA, 64 nt, Human
cuggcgucuccccucccggcgauccgcccccagcacuggggaggcgccacugaaccgagaaggg

SEQ ID NO: 313535 - RNA, 64 nt, Human
cuuaaaaacuuuuugcucuggucaguuacagguggauccccaauaaucuguuuuugguuuucug

SEQ ID NO: 313536 - RNA, 64 nt, Human
gggaugggguugggagaggugagggcaggauuaagauccccacugucaaugggggauuguccca

SEQ ID NO: 313537 - RNA, 64 nt, Human
ggguaacugugcugaaugcuuuagaugaggaaaugauccccaaguggugaaugacacgccuaag

SEQ ID NO: 313538 - RNA, 64 nt, Human
uuggauaucugcugccuguggucaggaaccuugcacuggggaaacaaucauguaauccacagac

SEQ ID NO: 313539 - RNA, 64 nt, Human
gaccccgccuucuugggcugggcccgggggcgggacuggggagggaacuccgccccucgcggga

SEQ ID NO: 313540 - RNA, 64 nt, Human
acucuagccaaaugguuuaacuucugccuguggaacuggggauugggugggcaggaaaagguga

SEQ ID NO: 313541 - RNA, 64 nt, Human
caaguggagcccuacuacccccgaagucugcaggacuggggaggcaucccugaggaggucagcg

SEQ ID NO: 313542 - RNA, 64 nt, Human
aaacucagcagcagucaugacugucugucacuacacuggggaucccaauuccacauaagcacuu

SEQ ID NO: 313543 - RNA, 64 nt, Human
acauuccugcaucuucucacccccucaaccaggaacuggggauuugggaugagauauggucaga

SEQ ID NO: 313544 - RNA, 64 nt, Human
uauauauugucucaaugcaaucaaaucaucuuuuacuggggauucaaauaaaauguagcaaaua

SEQ ID NO: 313545 - RNA, 64 nt, Human
aagugggauggcucuccuucucccaagcugcaguacuggggaagggcugggcgcuuuuccugga

SEQ ID NO: 313546 - RNA, 64 nt, Human
aggugccacuuaccguggcuuaggagccuuuuguacuggggaagauuuuauuucuugggugggg

SEQ ID NO: 313547 - RNA, 64 nt, Human
ugauuccauucuacaaugaauaccuugacccuucacuggggacacagaaaugcuacaaagccac

SEQ ID NO: 313548 - RNA, 64 nt, Human
uuuguugcacagucccuccuguugccacacuuucacuggggaucccgugcuggaagacuuagau

SEQ ID NO: 313549 - RNA, 64 nt, Human
uuuggcagcacgcaggcggggcaguaugugauggacuggggagcacaggugucugccuagaucc

SEQ ID NO: 313550 - RNA, 64 nt, Human
ccgggcaugguggugugcgccuguaaucccagcuacuggggaggcugaggcagaagaaucgcuu

SEQ ID NO: 313551 - RNA, 64 nt, Human
uuuuuuuuaagugggagaagggugggcaguuaucacuggggaagagaggaccggccaccugucc

SEQ ID NO: 313552 - RNA, 64 nt, Human
gaguguaagggucaaugugcuugcuuggagguggacuggggagacagccuuggugcagcaagaa

SEQ ID NO: 313553 - RNA, 64 nt, Human
aagcgcccugaaccccagccuguccgucaccccggauccccaccccauccccauuuuuuuaagc

SEQ ID NO: 313554 - RNA, 64 nt, Human
ugagacuugaggggaauaauagaaaauuaagguagauccccaauauuuuggaauaccaaaauug

SEQ ID NO: 313555 - RNA, 64 nt, Human
augcugggaaugagacauaggccaugaaaaaaaugauccccaagugugaacaaaagaugcucuu

SEQ ID NO: 313556 - RNA, 64 nt, Human
gaagaccuaaccagcuauuggugggaaugacggaacuggggauugcgaugauugaucugggaac

SEQ ID NO: 313557 - RNA, 64 nt, Human
cucuagcaaugagguucacuggauacagcuggauacuggggaggacgugggcugcgaggagaag

SEQ ID NO: 313558 - RNA, 64 nt, Human
ccucccaauucucugccccaggcuaauauuagggacuggggaggggaccaccagaggggagagg

SEQ ID NO: 313559 - RNA, 64 nt, Human
acaguuguuuucuaguguggucuguagcccaauaacuggggaacgaguuacagacaaacaucac

SEQ ID NO: 313560 - RNA, 64 nt, Human
acccaaaucacaauaaaauugucauuuaggauaaacuggggagaauagacugaacauaugguua

SEQ ID NO: 313561 - RNA, 64 nt, Human
cacuuugcuuauuuuuaaaaaauuuauuggcaaaacuggggauuuuguuuguaacuuugguuau

SEQ ID NO: 313562 - RNA, 64 nt, Human
uuucaagauuucugcauccacaaguuaguagcaaacuggggaauacucgcugcagcugggguuc

SEQ ID NO: 313563 - RNA, 54 nt, Human
agccguggcaggcccucuaggggcacuggggaacgucuugggauccgaccccgg

SEQ ID NO: 313564 - RNA, 64 nt, Human
cucaacuuccagcuacaccccgugcacccuuuugacuggggacuugcugguugaaggagcucau

SEQ ID NO: 313565 - RNA, 64 nt, Human
gcugcuugugguggggccccaaccgcccucgggcacuggggagcugggcuggggcugcugcucu

SEQ ID NO: 313566 - RNA, 64 nt, Human
uuccaguucuuuucaauaucaugaaaggacucacacuggggagaaaccguaucaauguaagcaa

SEQ ID NO: 313567 - RNA, 64 nt, Human
caaaaauuagccaggcgugguggugggcaccuguacuggggaggugcccacccagcuacugggg

SEQ ID NO: 313568 - RNA, 64 nt, Human
ugggcaccuguacuggggaggugcccacccagcuacuggggaggcugagucaggagaaucgcuu

SEQ ID NO: 313569 - RNA, 64 nt, Human
agauccucccuuauuuaacaucagaaaaauguauacuggggaaaaguuguaugaagguggugaa

SEQ ID NO: 313570 - RNA, 64 nt, Human
acauauguccugugaccgcccugucgccaagaggacuggggaagggaggggagacuauguguga

SEQ ID NO: 313571 - RNA, 64 nt, Human
uauuaggucacccugaaaacaauacaagaaaagggauccccagguaaucugguggagcgaauac

SEQ ID NO: 313572 - RNA, 64 nt, Human
gcacaugaccccagagacagcugguucacuggcagauccccaugauggacuuacuaagggaaag

SEQ ID NO: 313573 - RNA, 64 nt, Human
gggguccauuugggggguccugcuacacuccaccgauccccaaggaaguauaauaaacgauacc

SEQ ID NO: 313574 - RNA, 64 nt, Human
ccaggcgccugagccccagcuccgggaagcaggcacuggggagggggcuucaaggagggagugc

SEQ ID NO: 313575 - RNA, 64 nt, Human
guacucccucucaggauccaagcuaagcacugccacuggggaaaacuccaccuucccacuuucc

SEQ ID NO: 313576 - RNA, 64 nt, Human
cacaaucauucauaucuacucaccuaacagcaacacuggggagagccuggagcauccggacuug

SEQ ID NO: 313577 - RNA, 64 nt, Human
ccaaaaugaauaagcuggacuuucuccccauggcacuggggaaccauggaaguucagggaacuu

SEQ ID NO: 313578 - RNA, 64 nt, Human
uauguagccucuggguguggagcugggaucuucaacuggggacaguacaguaaagaacaucaca

SEQ ID NO: 313579 - RNA, 64 nt, Human
gggguggcauuuggccuugaacaaaaccaaguccacuggggacagaggcaggggcaaguggcuc

SEQ ID NO: 313580 - RNA, 64 nt, Human
augaaaauauaaacagaggaagacaacauaugucacuggggaggcugggggagcuagacaaaau

SEQ ID NO: 313581 - RNA, 64 nt, Human
accacagaccccucaccacucacagauuccucacacuggggaaauaaagccauuucagaggaau

SEQ ID NO: 313582 - RNA, 64 nt, Human
gguugggggguugggggguuagggcagggaggggacuggggaagugcgcacacagcccacacag

SEQ ID NO: 313583 - RNA, 64 nt, Human
aggggccagccuagcagacaagagaccacaagggacuggggaucagggucugggcucugucagc

SEQ ID NO: 313584 - RNA, 64 nt, Human
ggccugcuggggaugucuccuggggacuuugccuacuggggaccucggcuguuggggacuuuac

SEQ ID NO: 313585 - RNA, 64 nt, Human
gggaccuugccagcuggggcuggggauggugccuacuggggaccuugcuuucuggaggcugcac

SEQ ID NO: 313586 - RNA, 64 nt, Human
guuuggcgagagagcgauggcugccguggggaguacuggggagcccucgcggcaagcagggugg

SEQ ID NO: 313587 - RNA, 64 nt, Human
ggugucccuguucucucugaagacaugaaaacucacuggggagaaacccuaugaauguaaaaau

SEQ ID NO: 313588 - RNA, 64 nt, Human
guaaagacaggcauaggaaaucacaaggguauugacuggggaagugauaaguguccaugaaauc

SEQ ID NO: 313589 - RNA, 64 nt, Human
uguauagcuuuaacauuuuguuuccaaagcugaagauccccauucuuucucuuugaaaaaaaaa

SEQ ID NO: 313590 - RNA, 64 nt, Human
uguguugacacuguuuuccuuaccuauuuccucagauccccagcuuucuccucugcuaugcauu

SEQ ID NO: 313591 - RNA, 64 nt, Human
cacaaguuugagaccagccugguuagcaaggcaagauccccaacucuacaaaaaaauaaaaauu

SEQ ID NO: 313592 - RNA, 64 nt, Human
uuccucaugccuaaguaugcaugaaagaauucacacuggggagaaauacuaugaauguaaggau

SEQ ID NO: 313593 - RNA, 64 nt, Human
ggcagaucacuugagcccaggaguuggagaccagacuggggaacauggcaagaccccaucucua

SEQ ID NO: 313594 - RNA, 64 nt, Human
guaaaaagggaaaaagaccucguggagaauuuuuacuggggauucuugaacuugaaaaaaaaaa

SEQ ID NO: 313595 - RNA, 64 nt, Human
uuacaguucuuaucuaagacaugaaagaacacguacuggggagaaacuguaugaauguaagcag

SEQ ID NO: 313596 - RNA, 64 nt, Human
agaagcuucugcuguuuugccggaauuggcggugacuggggagggcuggguggguggggggccu

SEQ ID NO: 313597 - RNA, 64 nt, Human
gcagguuucugucugcgucgucgucggagggauuacuggggagugcgcugcauccggaagucgc

SEQ ID NO: 313598 - RNA, 64 nt, Human
ugagcccugcccuggcacuuggacucuccuagugacuggggaugggacaagaagccuguuuggu

SEQ ID NO: 313599 - RNA, 64 nt, Human
cugggcaugguggcgggugccuguaaucccagcuacuggggaggcugaggcaggagaaucacuu

SEQ ID NO: 313600 - RNA, 64 nt, Human
uucagccagggcugaggucucaucugaaggcucaacuggggaaggauccacauccagacuaaca

SEQ ID NO: 313601 - RNA, 64 nt, Human
caggaauucuguguaugacagugcuauugaaaucacuggggaaugaauggcuuauuuaauaaau

SEQ ID NO: 313602 - RNA, 64 nt, Human
ggacugaauuccugaugucugaguccucaaggugacuggggacuuggaaccccuaggaccugaa

SEQ ID NO: 313603 - RNA, 64 nt, Human
uuagccuugggaggucugggaagggcuggaaaucacuggggacaggaaaccacuuccuuuugcc

SEQ ID NO: 313604 - RNA, 64 nt, Human
cucccugguuuuaccccagcuccauccuugcaucacuggggaggacgugaugagugaggacuug

SEQ ID NO: 313605 - RNA, 64 nt, Human
uuuucaccccauuauggccaaauaguauagggccacuggggagggggaagggaaucauuuugug

SEQ ID NO: 313606 - RNA, 64 nt, Human
uucgagacuggccccgucugaaccuucucugggcacuggggacuaagguugcaggccuuagccu

SEQ ID NO: 313607 - RNA, 64 nt, Human
ucugugccucucagacaaauucugaucucuaagagauccccagaccucacuugccucugccucc

SEQ ID NO: 313608 - RNA, 64 nt, Human
uuucauugaugaccauaucuccagggauguuguugauccccacacugccuuaagguauauuaua

SEQ ID NO: 313609 - RNA, 64 nt, Human
ccuucacaagcagggaucagagcaacuccccggggauccccaauccacgcccuucuaguccaac

SEQ ID NO: 313610 - RNA, 64 nt, Human
caucaccuacuaugugucaggcucuaugcuagguacuggggauacaggagagaaucaagcguaa

SEQ ID NO: 313611 - RNA, 64 nt, Human
uuuaccacguuucucuucucugcuccccuugcccacuggggacuccucuuuggcuccuugaagu

SEQ ID NO: 313612 - RNA, 64 nt, Human
gcucgcugcucaggcgaauuucucauuucaagccacuggggaaacugaggcaaaaccauacuua

SEQ ID NO: 313613 - RNA, 64 nt, Human
uuuucucaccacaucucuugcaugacuucaugguacuggggacaaguuuguaugccuucacccc

SEQ ID NO: 313614 - RNA, 64 nt, Human
ccuuugugugccauggaaugcugaaagaugggugacuggggacccuucuuaaaaccuuuggcaa

SEQ ID NO: 313615 - RNA, 64 nt, Human
agagaguagauugugcaugugugagcacccagcuacuggggacgggggcucucccacgaccccu

SEQ ID NO: 313616 - RNA, 64 nt, Human
acuuuuccucuuugaaaucaaacuuuucuauuucacuggggaaagaaaacaugacugaaagucc

SEQ ID NO: 313617 - RNA, 64 nt, Human
guccaccgagacucuggacuugcucaggucccagacuggggaagggaggugucuagaaacccag

SEQ ID NO: 313618 - RNA, 64 nt, Human
cugucuccugucuuggccuccccuuucaugagauacuggggagaagagaacauuccuccuggcu

SEQ ID NO: 313619 - RNA, 64 nt, Human
uccuuguaaguuauugaugagagggaaaagauugacuggggagggcuuaaaaugauuugggaaa

SEQ ID NO: 313620 - RNA, 64 nt, Human
acuuuuaucaaauguuucucgacaaaaguuuuccacuggggaaauuauuaacuugaugucagca

SEQ ID NO: 313621 - RNA, 64 nt, Human
aaggcaccuacaacuuaguuuuaaauuacuugcuacuggggauuacccauggauauccuuaaua

SEQ ID NO: 313622 - RNA, 64 nt, Human
gauauaaaacagcucuuuuuccaaggcccggaguacuggggauugauguuucaaggccaaucaa

SEQ ID NO: 313623 - RNA, 64 nt, Human
ccugaguggccuuuagagaugugaguugugaggcacuggggaggcaggcacacguccuccagcc

SEQ ID NO: 313624 - RNA, 64 nt, Human
cagcggguacuccagcuuguggcauucccaugugacuggggagaagacaaaauugguguuuaga

SEQ ID NO: 313625 - RNA, 64 nt, Human
cuagacuggugcguuguggucuccgguggggccagauccccagaacagggagagacugcauaca

SEQ ID NO: 313626 - RNA, 64 nt, Human
ccuggaacugaggucaaacaaguaccaccaaggugauccccagccugcggcccucgugaaaaga

SEQ ID NO: 313627 - RNA, 64 nt, Human
uguuucucuuucagagaaucuccaccggacuuuugauccccacuuucugagggugcccugcugg

SEQ ID NO: 313628 - RNA, 64 nt, Human
aacuccugaaaaucuugaaauggauuucuaggucacuggggacuccggcagcacauucggcuuc

SEQ ID NO: 313629 - RNA, 64 nt, Human
gccuggcugcggugcucgcgccgugggaaagcacacuggggaggggucagugcuucccuuggug

SEQ ID NO: 313630 - RNA, 64 nt, Human
cagcuugggcacagcagacuggccuggcccugagacuggggaguggcuccaacagccuccugcc

SEQ ID NO: 313631 - RNA, 64 nt, Human
agauccucaccucuuggaauuaaaauuguuggucacuggggaaagccugaguuugcaaccaguu

SEQ ID NO: 313632 - RNA, 64 nt, Human
agaagaaggugccccuuccucugggagauuguggacuggggagcgugggcuggacuucugccuc

SEQ ID NO: 313633 - RNA, 64 nt, Human
uggaugcuuuuuaauaauuaugcuucccaucauaacuggggagaaagggaagucaggguucuag

SEQ ID NO: 313634 - RNA, 64 nt, Human
uggguggaagcugccuauauuucuucccaguuuaacuggggaccaucugugaaauuaauuuucc

SEQ ID NO: 313635 - RNA, 64 nt, Human
caccaucuucacuacaaacacgccugagaguggcacuggggaaacauaacuccaucuacaccuu

SEQ ID NO: 313636 - RNA, 64 nt, Human
guaguuaauuuuagguuauguuuuauauuaggcuacuggggacauaaacggucauaacuaauga

SEQ ID NO: 313637 - RNA, 64 nt, Human
gugugugagugugaguguguguguacgcacacacacuggggauagauaagcuaccugguaaagg

SEQ ID NO: 313638 - RNA, 64 nt, Human
gggccucggcuaggucccagacugauuacaugagacuggggaguccuucccugccaguuuucuc

SEQ ID NO: 313639 - RNA, 64 nt, Human
ggcuuaggggaaagaaccagaggggcaggggaggacuggggagggcuggcuagccagaggaguu

SEQ ID NO: 313640 - RNA, 64 nt, Human
auugaagauacucucaagccuguaucccugccccacuggggagcaaugacuuucaaagcacugu

SEQ ID NO: 313641 - RNA, 64 nt, Human
acaucccacaucagguauauuagagcuuauccgaacuggggaaagacggauugagauuaacugc

SEQ ID NO: 313642 - RNA, 64 nt, Human
uuuugaggauguugugugaggguguuugacugugacuggggaagcucagacuacuuuguaugug

SEQ ID NO: 313643 - RNA, 64 nt, Human
cugaaaggacccaggagucugggaccccuccugggauccccagcacauucuccugcuccuggga

SEQ ID NO: 313644 - RNA, 64 nt, Human
ccacccucccagccaaggaggcugcugugguggggauccccaggggggcuuugacacaguccuc

SEQ ID NO: 313645 - RNA, 64 nt, Human
uuuuaaugcaauauuuuuuuucugaauucauuaugauccccauauuggguaaugcugaacauuu

SEQ ID NO: 313646 - RNA, 64 nt, Human
cuugugacuuuuuaaagagguggggcucacugcaacuggggagaacacuuagcauauggauaug

SEQ ID NO: 313647 - RNA, 64 nt, Human
cugacaaagcuauucccugguguuuuuuucccccacuggggagggggugagguggaauggggug

SEQ ID NO: 313648 - RNA, 64 nt, Human
cagcgcacugauggucacugguggaacuccacucacuggggaacguucucuuugguuauguuug

SEQ ID NO: 313649 - RNA, 64 nt, Human
cucgggcuaaucccucccucuuccuccacccggcacuggggaagucaagaauggggccuggggc

SEQ ID NO: 313650 - RNA, 64 nt, Human
aagcggguuucugugcuuuugccauagcuuuauaacuggggauaacccuuccuucgauaccaaa

SEQ ID NO: 313651 - RNA, 64 nt, Human
uuguguuugugaagguauuuuuugcuuuuuaaauacuggggaccgauaucacuguugauagugc

SEQ ID NO: 313652 - RNA, 64 nt, Human
aucuguagcugauuaaauuuuucccaacaaccucacuggggagaaaguguguucauguuuuguc

SEQ ID NO: 313653 - RNA, 64 nt, Human
ugugguuagaaauuggugccucagcccuaucuagacuggggaaaaauugaggaucucuguuuuu

SEQ ID NO: 313654 - RNA, 64 nt, Human
uacuaguggcugggaaaaggggugugcgaggggaacuggggaugcuuaauguguacaaaaacua

SEQ ID NO: 313655 - RNA, 64 nt, Human
caccuccaaccucgggccagugucuucaggcuuuacuggggaccugcgagcuggccuaaugugg

SEQ ID NO: 313656 - RNA, 64 nt, Human
uaauccaggcgugagaguguucucuugggaaaugacuggggagacaccugaaaggagcaaccuc

SEQ ID NO: 313657 - RNA, 64 nt, Human
uggccuuggaugcccggccccucccuuucugugcacuggggacgcugauggaggcugaagcugc

SEQ ID NO: 313658 - RNA, 63 nt, Human
gagauuccugguugcugugaugaaaugggauacacuggggauccagcugcacaacuuuucgga

SEQ ID NO: 313659 - RNA, 64 nt, Human; identical to SEQ ID NO: 141728

SEQ ID NO: 313660 - RNA, 64 nt, Human; identical to SEQ ID NO: 141729

SEQ ID NO: 313661 - RNA, 64 nt, Human
ccuuuggauuucauaguuucucugucaguagcaugauccccaccgcuauggucuaucuaugauc

SEQ ID NO: 313662 - RNA, 64 nt, Human
ugcacucggccauuucccucuuccuguguccccagauccccacuacagcuccaagaggaugggc

SEQ ID NO: 313663 - RNA, 64 nt, Human
acaguggcucaugcagccacaggucaccuucugugauccccaucccaaggcacugguggugacu

SEQ ID NO: 313664 - RNA, 64 nt, Human; identical to SEQ ID NO: 141730

SEQ ID NO: 313665 - RNA, 64 nt, Human; identical to SEQ ID NO: 141731

SEQ ID NO: 313666 - RNA, 55 nt, Human; identical to SEQ ID NO: 141732

SEQ ID NO: 313667 - RNA, 64 nt, Human; identical to SEQ ID NO: 141733

SEQ ID NO: 313668 - RNA, 64 nt, Human; identical to SEQ ID NO: 141734

SEQ ID NO: 313669 - RNA, 64 nt, Human; identical to SEQ ID NO: 141735

SEQ ID NO: 313670 - RNA, 64 nt, Human; identical to SEQ ID NO: 141736

SEQ ID NO: 313671 - RNA, 64 nt, Human; identical to SEQ ID NO: 141737

SEQ ID NO: 313672 - RNA, 64 nt, Human; identical to SEQ ID NO: 141738

SEQ ID NO: 313673 - RNA, 64 nt, Human; identical to SEQ ID NO: 141739

SEQ ID NO: 313674 - RNA, 64 nt, Human; identical to SEQ ID NO: 141740

SEQ ID NO: 313675 - RNA, 60 nt, Human; identical to SEQ ID NO: 141741

SEQ ID NO: 313676 - RNA, 64 nt, Human; identical to SEQ ID NO: 141742

SEQ ID NO: 313677 - RNA, 64 nt, Human; identical to SEQ ID NO: 141743

SEQ ID NO: 313678 - RNA, 64 nt, Human
auaugcucccuaaaaauccuuaaguugucaaucugauccccagugugagguuaaugagcaaaau

SEQ ID NO: 313679 - RNA, 64 nt, Human
guuuacuuacuccucuauuucagaaauugaaaaagauccccaaggaucuguuacuacugcauuu

SEQ ID NO: 313680 - RNA, 64 nt, Human
aguuauuuuuuuuuccaaacaccaacuugaaccagauccccaauuaaaacaacaguauuuuuua

SEQ ID NO: 313681 - RNA, 64 nt, Human; identical to SEQ ID NO: 141744

SEQ ID NO: 313682 - RNA, 64 nt, Human; identical to SEQ ID NO: 141745

SEQ ID NO: 313683 - RNA, 64 nt, Human; identical to SEQ ID NO: 141746

SEQ ID NO: 313684 - RNA, 64 nt, Human; identical to SEQ ID NO: 141747

SEQ ID NO: 313685 - RNA, 64 nt, Human; identical to SEQ ID NO: 141748

SEQ ID NO: 313686 - RNA, 64 nt, Human; identical to SEQ ID NO: 141749

SEQ ID NO: 313687 - RNA, 64 nt, Human; identical to SEQ ID NO: 141750

SEQ ID NO: 313688 - RNA, 64 nt, Human; identical to SEQ ID NO: 141751

SEQ ID NO: 313689 - RNA, 64 nt, Human; identical to SEQ ID NO: 141752

SEQ ID NO: 313690 - RNA, 64 nt, Human; identical to SEQ ID NO: 141753

SEQ ID NO: 313691 - RNA, 64 nt, Human; identical to SEQ ID NO: 141754

SEQ ID NO: 313692 - RNA, 64 nt, Human; identical to SEQ ID NO: 141755

SEQ ID NO: 313693 - RNA, 64 nt, Human; identical to SEQ ID NO: 141756

SEQ ID NO: 313694 - RNA, 64 nt, Human; identical to SEQ ID NO: 141757

SEQ ID NO: 313695 - RNA, 64 nt, Human
ggaaaaucgaucucuacaaauucaauuaaauaaugauccccaaaugcugaaaaagugaaauaca

SEQ ID NO: 313696 - RNA, 64 nt, Human
gcuaacuagcuuaauugaccuuuuuacaaaguuugauccccaagcauccucaacuaaaucauug

SEQ ID NO: 313697 - RNA, 64 nt, Human
agguccccuauccuuaaauaagagaccucuaagagauccccauggcugaauacuccaaauaauc

SEQ ID NO: 313698 - RNA, 64 nt, Human; identical to SEQ ID NO: 141758

SEQ ID NO: 313699 - RNA, 64 nt, Human; identical to SEQ ID NO: 141759

SEQ ID NO: 313700 - RNA, 64 nt, Human; identical to SEQ ID NO: 141760

SEQ ID NO: 313701 - RNA, 64 nt, Human; identical to SEQ ID NO: 141761

SEQ ID NO: 313702 - RNA, 64 nt, Human; identical to SEQ ID NO: 141762

SEQ ID NO: 313703 - RNA, 64 nt, Human; identical to SEQ ID NO: 141763

SEQ ID NO: 313704 - RNA, 64 nt, Human; identical to SEQ ID NO: 141764

SEQ ID NO: 313705 - RNA, 64 nt, Human; identical to SEQ ID NO: 141765

SEQ ID NO: 313706 - RNA, 64 nt, Human; identical to SEQ ID NO: 141766

SEQ ID NO: 313707 - RNA, 64 nt, Human; identical to SEQ ID NO: 141767

SEQ ID NO: 313708 - RNA, 64 nt, Human; identical to SEQ ID NO: 141768

SEQ ID NO: 313709 - RNA, 64 nt, Human; identical to SEQ ID NO: 141769

SEQ ID NO: 313710 - RNA, 64 nt, Human; identical to SEQ ID NO: 141770

SEQ ID NO: 313711 - RNA, 64 nt, Human; identical to SEQ ID NO: 141771

SEQ ID NO: 313712 - RNA, 64 nt, Human
augggguaucuccucuucccccaacccaucuugggauccccaagaagagggaaggcaggagggg

SEQ ID NO: 313713 - RNA, 64 nt, Human
caggugggggaggggggagagucaggaauaaggggauccccagaagugcagagcugagcaggcu

SEQ ID NO: 313714 - RNA, 64 nt, Human
gagcaagauccucaucugagagugcuuaaaaugggauccccagagaccauuaaccaauacugga

SEQ ID NO: 313715 - RNA, 52 nt, Human; identical to SEQ ID NO: 141772

SEQ ID NO: 313716 - RNA, 64 nt, Human; identical to SEQ ID NO: 141773

SEQ ID NO: 313717 - RNA, 64 nt, Human; identical to SEQ ID NO: 141774

SEQ ID NO: 313718 - RNA, 64 nt, Human; identical to SEQ ID NO: 141775

SEQ ID NO: 313719 - RNA, 64 nt, Human; identical to SEQ ID NO: 141776

SEQ ID NO: 313720 - RNA, 64 nt, Human; identical to SEQ ID NO: 141777

SEQ ID NO: 313721 - RNA, 64 nt, Human; identical to SEQ ID NO: 141778

SEQ ID NO: 313722 - RNA, 64 nt, Human; identical to SEQ ID NO: 141779

SEQ ID NO: 313723 - RNA, 64 nt, Human; identical to SEQ ID NO: 141780

SEQ ID NO: 313724 - RNA, 64 nt, Human; identical to SEQ ID NO: 141781

SEQ ID NO: 313725 - RNA, 64 nt, Human; identical to SEQ ID NO: 141782

SEQ ID NO: 313726 - RNA, 64 nt, Human; identical to SEQ ID NO: 141783

SEQ ID NO: 313727 - RNA, 64 nt, Human; identical to SEQ ID NO: 141784

SEQ ID NO: 313728 - RNA, 64 nt, Human; identical to SEQ ID NO: 141785

SEQ ID NO: 313729 - RNA, 64 nt, Human
uuaauuuauuuuccaggcaccacuguaguuuagugauccccagugucccccuucccuaugggaa

SEQ ID NO: 313730 - RNA, 64 nt, Human
ucuucaaguuuaucugaaucuguggggagugcaugauccccauguugcaauauggagucucugc

SEQ ID NO: 313731 - RNA, 64 nt, Human
gggagacaaagacuggcuucuggacuuccucccugauccccacccuuacucaucaccugcagug

SEQ ID NO: 313732 - RNA, 54 nt, Human; identical to SEQ ID NO: 141786

SEQ ID NO: 313733 - RNA, 64 nt, Human; identical to SEQ ID NO: 141787

SEQ ID NO: 313734 - RNA, 64 nt, Human; identical to SEQ ID NO: 141788

SEQ ID NO: 313735 - RNA, 64 nt, Human; identical to SEQ ID NO: 141789

SEQ ID NO: 313736 - RNA, 64 nt, Human; identical to SEQ ID NO: 141790

SEQ ID NO: 313737 - RNA, 64 nt, Human; identical to SEQ ID NO: 141791

SEQ ID NO: 313738 - RNA, 62 nt, Human; identical to SEQ ID NO: 141792

SEQ ID NO: 313739 - RNA, 64 nt, Human; identical to SEQ ID NO: 141793

SEQ ID NO: 313740 - RNA, 64 nt, Human; identical to SEQ ID NO: 141794

SEQ ID NO: 313741 - RNA, 64 nt, Human; identical to SEQ ID NO: 141795

SEQ ID NO: 313742 - RNA, 64 nt, Human; identical to SEQ ID NO: 141796

SEQ ID NO: 313743 - RNA, 64 nt, Human; identical to SEQ ID NO: 141797

SEQ ID NO: 313744 - RNA, 64 nt, Human; identical to SEQ ID NO: 141798

SEQ ID NO: 313745 - RNA, 64 nt, Human; identical to SEQ ID NO: 141799

SEQ ID NO: 313746 - RNA, 64 nt, Human
acccuaccuccagggcauagucagucugggcugagauccccaugaucagauauuugauggaaag

SEQ ID NO: 313747 - RNA, 64 nt, Human
cccuuguuuccacaccuaccauuccuccucuccugauccccagcauccagcugagguccaaggu

SEQ ID NO: 313748 - RNA, 64 nt, Human
acaucacuuuuguugaacauuccaacuccagaaugauccccaaucacccuaaucucagaaugcu

SEQ ID NO: 313749 - RNA, 64 nt, Human; identical to SEQ ID NO: 141800

SEQ ID NO: 313750 - RNA, 52 nt, Human; identical to SEQ ID NO: 141801

SEQ ID NO: 313751 - RNA, 64 nt, Human; identical to SEQ ID NO: 141802

SEQ ID NO: 313752 - RNA, 59 nt, Human; identical to SEQ ID NO: 141803

SEQ ID NO: 313753 - RNA, 64 nt, Human; identical to SEQ ID NO: 141804

SEQ ID NO: 313754 - RNA, 64 nt, Human; identical to SEQ ID NO: 141805

SEQ ID NO: 313755 - RNA, 54 nt, Human; identical to SEQ ID NO: 141806

SEQ ID NO: 313756 - RNA, 64 nt, Human; identical to SEQ ID NO: 141807

SEQ ID NO: 313757 - RNA, 64 nt, Human; identical to SEQ ID NO: 141808

SEQ ID NO: 313758 - RNA, 55 nt, Human; identical to SEQ ID NO: 141809

SEQ ID NO: 313759 - RNA, 64 nt, Human; identical to SEQ ID NO: 141810

SEQ ID NO: 313760 - RNA, 64 nt, Human; identical to SEQ ID NO: 141811

SEQ ID NO: 313761 - RNA, 64 nt, Human; identical to SEQ ID NO: 141812

SEQ ID NO: 313762 - RNA, 64 nt, Human; identical to SEQ ID NO: 141813

SEQ ID NO: 313763 - RNA, 64 nt, Human
uggucaccaccugcgccugaggaucgggcccccagauccccacuuuuccccuccagugccuccc

SEQ ID NO: 313764 - RNA, 64 nt, Human
aaguuucgguuccuaugagcccggggcaugaucugauccccaagacauguggaggggcagccug

SEQ ID NO: 313765 - RNA, 64 nt, Human
cuggagcgaggugugggccgccauccccaugucagauccccaggugcugcaccugcagggaggc

SEQ ID NO: 313766 - RNA, 64 nt, Human; identical to SEQ ID NO: 141814

SEQ ID NO: 313767 - RNA, 61 nt, Human; identical to SEQ ID NO: 141815

SEQ ID NO: 313768 - RNA, 64 nt, Human; identical to SEQ ID NO: 141816

SEQ ID NO: 313769 - RNA, 64 nt, Human; identical to SEQ ID NO: 141817

SEQ ID NO: 313770 - RNA, 64 nt, Human; identical to SEQ ID NO: 141818

SEQ ID NO: 313771 - RNA, 64 nt, Human; identical to SEQ ID NO: 141819

SEQ ID NO: 313772 - RNA, 64 nt, Human; identical to SEQ ID NO: 141820

SEQ ID NO: 313773 - RNA, 64 nt, Human; identical to SEQ ID NO: 141821

SEQ ID NO: 313774 - RNA, 64 nt, Human; identical to SEQ ID NO: 141822

SEQ ID NO: 313775 - RNA, 64 nt, Human; identical to SEQ ID NO: 141823

SEQ ID NO: 313776 - RNA, 64 nt, Human; identical to SEQ ID NO: 141824

SEQ ID NO: 313777 - RNA, 64 nt, Human; identical to SEQ ID NO: 141825

SEQ ID NO: 313778 - RNA, 64 nt, Human; identical to SEQ ID NO: 141826

SEQ ID NO: 313779 - RNA, 64 nt, Human; identical to SEQ ID NO: 141827

SEQ ID NO: 313780 - RNA, 64 nt, Human
cuguguuggugucuaauauuuggguagggugggggauccccaacaaucagguccccugagauag

SEQ ID NO: 313781 - RNA, 64 nt, Human
cgagggccggggagggggcagccacgcggccgaggauccccagcugaugagcagcagcgggcca

SEQ ID NO: 313782 - RNA, 64 nt, Human
aaguaagcccaacaaaaauuuuuaaaaauuugaugauccccaauauaucuaccauuguauguua

SEQ ID NO: 313783 - RNA, 64 nt, Human; identical to SEQ ID NO: 141828

SEQ ID NO: 313784 - RNA, 64 nt, Human; identical to SEQ ID NO: 141829

SEQ ID NO: 313785 - RNA, 64 nt, Human; identical to SEQ ID NO: 141830

SEQ ID NO: 313786 - RNA, 64 nt, Human; identical to SEQ ID NO: 141831

SEQ ID NO: 313787 - RNA, 64 nt, Human; identical to SEQ ID NO: 141832

SEQ ID NO: 313788 - RNA, 56 nt, Human; identical to SEQ ID NO: 141833

SEQ ID NO: 313789 - RNA, 64 nt, Human; identical to SEQ ID NO: 141834

SEQ ID NO: 313790 - RNA, 64 nt, Human; identical to SEQ ID NO: 141835

SEQ ID NO: 313791 - RNA, 64 nt, Human; identical to SEQ ID NO: 141836

SEQ ID NO: 313792 - RNA, 64 nt, Human; identical to SEQ ID NO: 141837

SEQ ID NO: 313793 - RNA, 64 nt, Human; identical to SEQ ID NO: 141838

SEQ ID NO: 313794 - RNA, 64 nt, Human; identical to SEQ ID NO: 141839

SEQ ID NO: 313795 - RNA, 64 nt, Human; identical to SEQ ID NO: 141840

SEQ ID NO: 313796 - RNA, 64 nt, Human; identical to SEQ ID NO: 141841

SEQ ID NO: 313797 - RNA, 64 nt, Human
ggacacagccacucggggccccgcugccccagcugauccccacucauuccacaccucuucucau

SEQ ID NO: 313798 - RNA, 64 nt, Human
gcucacaccggcacugugcacucuacucugcgacgauccccauggaacagcccugcacgcccag

SEQ ID NO: 313799 - RNA, 64 nt, Human
acauucaucccuuaauguucucaaggaggcccaggauccccaaaauauuauaagcauugcaguc

SEQ ID NO: 313800 - RNA, 64 nt, Human; identical to SEQ ID NO: 141842

SEQ ID NO: 313801 - RNA, 64 nt, Human; identical to SEQ ID NO: 141843

SEQ ID NO: 313802 - RNA, 64 nt, Human; identical to SEQ ID NO: 141844

SEQ ID NO: 313803 - RNA, 64 nt, Human; identical to SEQ ID NO: 141845

SEQ ID NO: 313804 - RNA, 51 nt, Human; identical to SEQ ID NO: 141846

SEQ ID NO: 313805 - RNA, 64 nt, Human; identical to SEQ ID NO: 141847

SEQ ID NO: 313806 - RNA, 64 nt, Human; identical to SEQ ID NO: 141848

SEQ ID NO: 313807 - RNA, 64 nt, Human; identical to SEQ ID NO: 141849

SEQ ID NO: 313808 - RNA, 64 nt, Human; identical to SEQ ID NO: 141850

SEQ ID NO: 313809 - RNA, 64 nt, Human; identical to SEQ ID NO: 141851

SEQ ID NO: 313810 - RNA, 64 nt, Human; identical to SEQ ID NO: 141852

SEQ ID NO: 313811 - RNA, 64 nt, Human; identical to SEQ ID NO: 141853

SEQ ID NO: 313812 - RNA, 64 nt, Human; identical to SEQ ID NO: 141854

SEQ ID NO: 313813 - RNA, 64 nt, Human; identical to SEQ ID NO: 141855

SEQ ID NO: 313814 - RNA, 64 nt, Human
gcagggagagcaugggcaauggagacccaccaaugauccccaaccccgguggguacuggcugcc

SEQ ID NO: 313815 - RNA, 64 nt, Human
agcuucagagauacaguccacagguggacaaagggauccccagccagagagagagagaccagcc

SEQ ID NO: 313816 - RNA, 64 nt, Human
auucuauuuccaaaauugguaauagagccagaaggauccccaguacccagcccucugccuggca

SEQ ID NO: 313817 - RNA, 64 nt, Human; identical to SEQ ID NO: 141856

SEQ ID NO: 313818 - RNA, 64 nt, Human; identical to SEQ ID NO: 141857

SEQ ID NO: 313819 - RNA, 64 nt, Human; identical to SEQ ID NO: 141858

SEQ ID NO: 313820 - RNA, 64 nt, Human; identical to SEQ ID NO: 141859

SEQ ID NO: 313821 - RNA, 64 nt, Human; identical to SEQ ID NO: 141860

SEQ ID NO: 313822 - RNA, 64 nt, Human; identical to SEQ ID NO: 141861

SEQ ID NO: 313823 - RNA, 61 nt, Human; identical to SEQ ID NO: 141862

SEQ ID NO: 313824 - RNA, 64 nt, Human; identical to SEQ ID NO: 141863

SEQ ID NO: 313825 - RNA, 64 nt, Human; identical to SEQ ID NO: 141864

SEQ ID NO: 313826 - RNA, 64 nt, Human; identical to SEQ ID NO: 141865

SEQ ID NO: 313827 - RNA, 64 nt, Human; identical to SEQ ID NO: 141866

SEQ ID NO: 313828 - RNA, 56 nt, Human; identical to SEQ ID NO: 141867

SEQ ID NO: 313829 - RNA, 64 nt, Human; identical to SEQ ID NO: 141868

SEQ ID NO: 313830 - RNA, 64 nt, Human; identical to SEQ ID NO: 141869

SEQ ID NO: 313831 - RNA, 64 nt, Human
aguuuacuccuacccuuccagggaccccuauccugauccccaacugaagcuucaaaaagccacu

SEQ ID NO: 313832 - RNA, 64 nt, Human
gguuauaaagauucccauggaaaguguccaaucagauccccaaaacgguauccacugcauugcc

SEQ ID NO: 313833 - RNA, 64 nt, Human
gggucccuggucuccuacaaauccugggacauuggauccccaagcugugccaauacugccuacu

SEQ ID NO: 313834 - RNA, 64 nt, Human; identical to SEQ ID NO: 141870

SEQ ID NO: 313835 - RNA, 64 nt, Human; identical to SEQ ID NO: 141871

SEQ ID NO: 313836 - RNA, 64 nt, Human; identical to SEQ ID NO: 141872

SEQ ID NO: 313837 - RNA, 64 nt, Human; identical to SEQ ID NO: 141873

SEQ ID NO: 313838 - RNA, 64 nt, Human; identical to SEQ ID NO: 141874

SEQ ID NO: 313839 - RNA, 64 nt, Human; identical to SEQ ID NO: 141875

SEQ ID NO: 313840 - RNA, 64 nt, Human; identical to SEQ ID NO: 141876

SEQ ID NO: 313841 - RNA, 64 nt, Human; identical to SEQ ID NO: 141877

SEQ ID NO: 313842 - RNA, 64 nt, Human; identical to SEQ ID NO: 141878

SEQ ID NO: 313843 - RNA, 64 nt, Human; identical to SEQ ID NO: 141879

SEQ ID NO: 313844 - RNA, 64 nt, Human; identical to SEQ ID NO: 141880

SEQ ID NO: 313845 - RNA, 64 nt, Human; identical to SEQ ID NO: 141881

SEQ ID NO: 313846 - RNA, 64 nt, Human; identical to SEQ ID NO: 141882

SEQ ID NO: 313847 - RNA, 64 nt, Human; identical to SEQ ID NO: 141883

SEQ ID NO: 313848 - RNA, 64 nt, Human
guccagcaggagcagauccaggagcagcucauaugauccccacagucgauccagguaugaacag

SEQ ID NO: 313849 - RNA, 64 nt, Human
cucagggcccagaccuuccugcucuccagcaggggauccccacaaccucacacuugucuguucu

SEQ ID NO: 313850 - RNA, 64 nt, Human
uaaaauuuacugucuaagauuaauagcauucgaagauccccagacuucauagaauacucaggga

SEQ ID NO: 313851 - RNA, 64 nt, Human; identical to SEQ ID NO: 141884

SEQ ID NO: 313852 - RNA, 64 nt, Human; identical to SEQ ID NO: 141885

SEQ ID NO: 313853 - RNA, 64 nt, Human; identical to SEQ ID NO: 141886

SEQ ID NO: 313854 - RNA, 64 nt, Human; identical to SEQ ID NO: 141887

SEQ ID NO: 313855 - RNA, 64 nt, Human; identical to SEQ ID NO: 141888

SEQ ID NO: 313856 - RNA, 64 nt, Human; identical to SEQ ID NO: 141889

SEQ ID NO: 313857 - RNA, 64 nt, Human; identical to SEQ ID NO: 141890

SEQ ID NO: 313858 - RNA, 64 nt, Human; identical to SEQ ID NO: 141891

SEQ ID NO: 313859 - RNA, 64 nt, Human
gaaugagacugaacugugugaacuaacaugcaaagauccccaaaacaggccaggugugguugcu

SEQ ID NO: 313860 - RNA, 50 nt, Human
ggggcugucccauucucugagauccccaaggccuuuccuacaugcccccu

SEQ ID NO: 313861 - RNA, 64 nt, Human
cuauggccccaagaguaguccuaggaagcccacugauccccaacgggagcaagacuucuaacgg

SEQ ID NO: 313862 - RNA, 64 nt, Human
cagagcguguagugaaucacguaaagcuagaaaugauccccagcuguuuaugcauagauaaucu

SEQ ID NO: 313863 - RNA, 64 nt, Human
acuaacaacugggaaauaagcaaaaaacugcaucgauccccagccugguguuguucuucccuau

SEQ ID NO: 313864 - RNA, 64 nt, Human
uguucauuuggguuugcuuacuugacccuguggagauccccacagccauugggcauccuaggug

SEQ ID NO: 313865 - RNA, 64 nt, Human
agagaaauaguuucugaagccaguuuauugugaagauccccaagggggagguucgguagagaaa

SEQ ID NO: 313866 - RNA, 64 nt, Human
gcacacugggugcagauaaucaggacauuccagagauccccaauuuaagagggucauuuccauc

SEQ ID NO: 313867 - RNA, 64 nt, Human
ggccagggagagaccuaggggguccccuggccuggauccccaugguaugcuugaaucugcuccc

SEQ ID NO: 313868 - RNA, 64 nt, Human
ucagcuuuuuaaaaacaguccucagaggauccaugauccccagcacugucccauccuccacaaa

SEQ ID NO: 313869 - RNA, 64 nt, Human
auauauaugacguuguacauugcacauacccuuggauccccacaguuugguccuccucccagcu

SEQ ID NO: 313870 - RNA, 64 nt, Human
augguuuuccugaucuugccgcaucacuuaaugugauccccauacugcaacugugaugcugaug

SEQ ID NO: 313871 - RNA, 64 nt, Human
gaaagaaguuaacuacaguguuuuccuuugcaccgauccccaccccaauucaaucccggaaggg

SEQ ID NO: 313872 - RNA, 64 nt, Human
aguguugucuauggaaguggggaguagaaaagaagauccccauugacagugaggagggagggug

SEQ ID NO: 313873 - RNA, 64 nt, Human
uacuaaagcuguuuauaaaccacaggugccauaagauccccaaacggacuaaaguuaucucugc

SEQ ID NO: 313874 - RNA, 64 nt, Human
uuuccaggaggcaaacuuguguuuauccaaaccugauccccaugauggggacuuuucuagagca

SEQ ID NO: 313875 - RNA, 64 nt, Human
aucaguguaaauucaggcuucagcacgccguccagauccccaggauaagagaccacuuagccuu

SEQ ID NO: 313876 - RNA, 64 nt, Human
cccagucccauaaaccuggcccucuuuggggaaagauccccacagagcauccuccucucaucug

SEQ ID NO: 313877 - RNA, 64 nt, Human
gggugcggccaagaugagcagaacagagcuucacgauccccaucccugaacaaccagaccucuu

SEQ ID NO: 313878 - RNA, 64 nt, Human
aguauuacacagccauaaaaaggaaugaagcagugauccccacuacacuguggaugaaccuuga

SEQ ID NO: 313879 - RNA, 64 nt, Human
ucccaggauggugaagggggaccugguacccagugauccccaccccaggauccuaaaucaugac

SEQ ID NO: 313880 - RNA, 64 nt, Human
ccggaccccagccucauacugggcaacuuauuuggauccccaucuccacuguggagagcuuuuu

SEQ ID NO: 313881 - RNA, 64 nt, Human
cagugaagauacaggacauucucaucaccacagggauccccaggaugcccacuucccuccaccc

SEQ ID NO: 313882 - RNA, 64 nt, Human
aagaagccaccaacaaugaguacucagagaucaagauccccaaguaagaaaaugcagaggcucg

SEQ ID NO: 313883 - RNA, 64 nt, Human
ggagaucaguguugugagugcaugugaaaugggggauccccacccccagugcccuuccccuucc

SEQ ID NO: 313884 - RNA, 64 nt, Human
agcucagggaugggccuuccagccggagcaccccgauccccauccggcaccccccaauccccca

SEQ ID NO: 313885 - RNA, 64 nt, Human
uagugaaacgcuggauccuagauccccaaccccagauccccaugccucgagcccuggaucucca

SEQ ID NO: 313886 - RNA, 64 nt, Human
cagauccaguguccuagugaaacgcuggauccuagauccccaaccccagauccccaugccucga

SEQ ID NO: 313887 - RNA, 64 nt, Human
ccuagacuccuaugccccaaccacugggucaugcgauccccacccuucagccacuagaucccag

SEQ ID NO: 313888 - RNA, 64 nt, Human
ccagagaagggggauucuggaacugggaaggacugauccccagaagcgauggcugaccagauug

SEQ ID NO: 313889 - RNA, 64 nt, Human
acagugguauaagccugcugaaaacaguauggcagauccccagauuaaaauauagaaauaacau

SEQ ID NO: 313890 - RNA, 51 nt, Human
acagaaggaaugaacuuuagugauccccauuggauauaaggaugacuggua

SEQ ID NO: 313891 - RNA, 64 nt, Human
cccccagccccuccucccucaaaccaaggguacagauccccagccccuccucccucagacccag

SEQ ID NO: 313892 - RNA, 64 nt, Human
gauacaggagagaagcuggucuagacuguuugcugauccccaaccugcacggggcauuccugcu

SEQ ID NO: 313893 - RNA, 64 nt, Human
gaaaaagccaaacucuucucuccacuuagcuuuugauccccacuguuugcuuauuuguauaagu

SEQ ID NO: 313894 - RNA, 64 nt, Human
gccacacagcccagaaggccagaaaaggcagccagauccccagggcagccucguuaggacaagg

SEQ ID NO: 313895 - RNA, 64 nt, Human
acaagcaggcacuguauuuuuuuauucgccaucugauccccaugccuagcagagugcuggcacu

SEQ ID NO: 313896 - RNA, 64 nt, Human
ggggacaacuccagaaggucauuccagauccagagauccccaucgaacugaaggaucacugggu

SEQ ID NO: 313897 - RNA, 64 nt, Human
caugaaguuugcguguguuuuuuggugauucauggauccccagaguugauccacaagauaagaa

SEQ ID NO: 313898 - RNA, 64 nt, Human
ccuuuuccuccugagccugcucucugaucagcuggauccccacgugagcaacagcuggcccagg

SEQ ID NO: 313899 - RNA, 64 nt, Human
uuuuucguugcaugugaugguucuguggacauaugauccccacaaacugugggagugauuggcc

SEQ ID NO: 313900 - RNA, 64 nt, Human
cucaucccuuggccgcccccuuccuaaacacaaggauccccagcuggacuccccacccccuggc

SEQ ID NO: 313901 - RNA, 64 nt, Human
agaaccucagagcuucccuggugggcucccccgggauccccagugucucucugcaccuccaccc

SEQ ID NO: 313902 - RNA, 64 nt, Human
ugguggccacagucccccuucucaccucagcaaugauccccaaagugagagguggcucccccgg

SEQ ID NO: 313903 - RNA, 64 nt, Human
gagagcccucccucccucuccccacccucagaaggauccccaccgauggggaccugugcuggcc

SEQ ID NO: 313904 - RNA, 64 nt, Human
cagcgcucccaccuagaugggucugauccuccaggauccccacccaaagccugauggcaccccg

SEQ ID NO: 313905 - RNA, 64 nt, Human
cucgugggcugggaaugggggagagaagggaaaagauccccaagacccccuggggugggaucug

SEQ ID NO: 313906 - RNA, 64 nt, Human
ggguacuccaggacugucuccauaacaucauugggauccccaucccguugcuauuucuuuuuca

SEQ ID NO: 313907 - RNA, 64 nt, Human
acuuuggcuggcagucucugagaugacccugaaugauccccaccuccugguauucucacucuua

SEQ ID NO: 313908 - RNA, 58 nt, Human
acacccugcuggccucuugauggagccagauccccauccuauaguucauaguccucuc

SEQ ID NO: 313909 - RNA, 64 nt, Human
uccucaccuucucuccccuuuccaugccguccaugauccccaccccauguguuuuaaaaaggca

SEQ ID NO: 313910 - RNA, 64 nt, Human
cgcuguucuacaauaguucaggucagacaucuaagauccccaggccaaaccaugccacacacgu

SEQ ID NO: 313911 - RNA, 63 nt, Human
aguguucuuccacacagcguugcccccacaaccacgccggacgugcccccucgccaccuuuuc

SEQ ID NO: 313912 - RNA, 63 nt, Human
aauuaaagaccgcaauaaacuuucuacagaggaacgccggaaguuguuugagcaagagguggc

SEQ ID NO: 313913 - RNA, 63 nt, Human
ucagacguggaccucaacuucugauuccagaacacgccggagauugcugcugcuuucugagcc

SEQ ID NO: 313914 - RNA, 63 nt, Human
gaugcuaugccuggauaccagucuccacuuugcacgccggaacugccuugggaccacaguuac

SEQ ID NO: 313915 - RNA, 63 nt, Human
cccagggacgccgcuuuccgggaucccggccaaacgccggacccucagucgcuccaggccccc

SEQ ID NO: 313916 - RNA, 63 nt, Human
cuaggaccaccaggagcacacaaccccagacccacgccggagggcaucccuccaccagaagau

SEQ ID NO: 313917 - RNA, 63 nt, Human
aaaagccuuauagaagcaguaagaggcuugaccacgccggaagaguccuggagcuaaagcugg

SEQ ID NO: 313918 - RNA, 63 nt, Human
auaugccaugcagcuacaccuaccggcccugggacgccggaggacagggcauuguccucaguc

SEQ ID NO: 313919 - RNA, 63 nt, Human
gcaucuucggaccgaagugagagccgugcucggacgccggaggagcaggacugagcagaggcg

SEQ ID NO: 313920 - RNA, 63 nt, Human
uucagcuguggccucucgggcucggcagaagggacgccggaucaggggccuggucuccagcac

SEQ ID NO: 313921 - RNA, 63 nt, Human
ugaaaaucaguacaaucacacaaggaggaugaaacgccggaacaaaaaugagguguguagaac

SEQ ID NO: 313922 - RNA, 64 nt, Human
cguaaacaugaauuuuuuuucaauguagccccuggggaaugaaugaaauuuugagcuucuucaa

SEQ ID NO: 313923 - RNA, 64 nt, Human
auuccauauuugaacaccagcugauugagagaaggggaaugagaagagcuggaugaguuuaaau

SEQ ID NO: 313924 - RNA, 64 nt, Human
gauccaccaaggcagcucacagcgggaaaacucugggaaugaaccacugaauucaggggauggg

SEQ ID NO: 313925 - RNA, 64 nt, Human
augcggcuauaaugcagagcccuacaauuaaggcgggaaugaggggcuggaggcagcaaacgga

SEQ ID NO: 313926 - RNA, 64 nt, Human
acaaagcauagcaguucucuaggggagaggccuggcauugcacaugguguuacauggcuacaag

SEQ ID NO: 313927 - RNA, 64 nt, Human
guggacugcuguuuggucaaagaauaccuucuuagcauugcagaaagguggucagaugaccagu

SEQ ID NO: 313928 - RNA, 64 nt, Human
uguuguuaauaauauaaacaaaccuuugaaauuagcauugcaaaagaaucccauuuuuguuucg

SEQ ID NO: 313929 - RNA, 64 nt, Human
auagcaugcuuuggaaaagcaaauaggaauuguugggaaugauuuaaucuuguuguuguuguug

SEQ ID NO: 313930 - RNA, 64 nt, Human
ccaccuuggugagucauaugccacucaucagcuugggaaugauggcugccaacucccaaucucc

SEQ ID NO: 313931 - RNA, 64 nt, Human
ccaagucccuauaaacaaggaccuuccaguccaggggaaugacugugcaagguaguaucuaagc

SEQ ID NO: 313932 - RNA, 64 nt, Human
guccuggaaaaagaacucugaaaaccugggucaggggaaugauuccuaaggaaaacggucugca

SEQ ID NO: 313933 - RNA, 64 nt, Human
auccuaaugccgugaaugaaacacagucuguguagggaaugagcaaaaaaguugaauuccaauu

SEQ ID NO: 313934 - RNA, 64 nt, Human
uucugggccacaugcuauggcaugauggggguuugggaaugagauucccacaguucuucagaua

SEQ ID NO: 313935 - RNA, 64 nt, Human
cacagauguccagagugauuggagaauguccugggggaaugaaguuccuuccacaaacacagcu

SEQ ID NO: 313936 - RNA, 64 nt, Human
gcuugcuuuucuguauuuuauuuagacaagagaugggaaugaggugggagguggaagaagggag

SEQ ID NO: 313937 - RNA, 64 nt, Human
uaagaagagagagauacuuguagaauuggguggggggaaugagcaugaacuguccuuccauuug

SEQ ID NO: 313938 - RNA, 64 nt, Human
uaaauuaaaccagaagaggugacuuaauaaaaaagggaaugacauuuaggguauaaagaucuca

SEQ ID NO: 313939 - RNA, 64 nt, Human
uaagcugaggcuuaccuuuaauaacagccuccaagggaaugaauuauucaguuaauguaauagc

SEQ ID NO: 313940 - RNA, 64 nt, Human
ugaacccuccacacugaggccaaaguggcaaccugggaaugaaggcuccauaaaccauggcaug

SEQ ID NO: 313941 - RNA, 64 nt, Human
uuuguccuucauucauggauucagagaaagcucugggaaugacuuaugguccaaaaaagugacc

SEQ ID NO: 313942 - RNA, 64 nt, Human
cccugcuggcccggguaucgggaaggaggagcgagggaaugacggagguagggugcagggucag

SEQ ID NO: 313943 - RNA, 64 nt, Human
gcaggcuuggggagcuuuaagccucaguuauauaacccacgaaaaacagagccuccuagaugua

SEQ ID NO: 313944 - RNA, 58 nt, Human; identical to SEQ ID NO: 162154

SEQ ID NO: 313945 - RNA, 64 nt, Human
gcaggcuggcgugagaggagcggcagccacacugcggccccacgcccaaggacugggcugcucu

SEQ ID NO: 313946 - RNA, 64 nt, Human
ugccaaggcucuccagggcaggaccugacugguggggaaugaguguucagaagccuugggagag

SEQ ID NO: 313947 - RNA, 64 nt, Human
gccaguaauuccggggugcucagaaguuuuaggagggaaugagccucagggaggagugagcacc

SEQ ID NO: 313948 - RNA, 64 nt, Human
uggcccggccccuccugacucauccgccuggcccgggaaugaauggggaggccgcugaacccac

SEQ ID NO: 313949 - RNA, 64 nt, Human
gcggguauauguaauauauaugugggaaauacaggggaaugagcaaaucucaaagagcuggcgu

SEQ ID NO: 313950 - RNA, 64 nt, Human
gcaagagaaucugaucaauuugaagucccuguuugggaaugaggcacuuaucagcaugaagaau

SEQ ID NO: 313951 - RNA, 64 nt, Human
aaggugugaacugaccucuaaagcagcgugagaugggaaugaucuagaaaacuuuggauuuuug

SEQ ID NO: 313952 - RNA, 64 nt, Human
ccugaaucuaggcuuccucuuuggaugugaacgcgggaaugaacaguggcuguuuuccacccaa

SEQ ID NO: 313953 - RNA, 64 nt, Human
agagaaaaggaagaaggggccugcaggacccauugggaaugaguuuaauacugaagucuggaau

SEQ ID NO: 313954 - RNA, 64 nt, Human
guggauuaguucuuuuguuaaccccacugucuuggggaaugaugccagcugggaaauugaguuu

SEQ ID NO: 313955 - RNA, 64 nt, Human
aaaucaagcaaacuggaaucaaggggagggggaagggaaugaaauggaaagggaggcugauucc

SEQ ID NO: 313956 - RNA, 64 nt, Human
aggcugggagagaaagggugccaacaggucccuugggaaugaguuggcucuggacguuucugcc

SEQ ID NO: 313957 - RNA, 64 nt, Human
cuccaaagaaucugugaugccacugaaaugagaugggaaugauccagcucuuucagcaucuugg

SEQ ID NO: 313958 - RNA, 64 nt, Human
gugguagaggaagagaagcaugucugaguuggaugggaaugaggaaggagugaggggaagaaca

SEQ ID NO: 313959 - RNA, 64 nt, Human
aaaaccacuggacagagggccagaguggguaguggggaaugaaggggacuggcauguugguggg

SEQ ID NO: 313960 - RNA, 64 nt, Human
uuggucucggaccagaccccccuccacagcugcccggccccagacccaucucuuggauugaggg

SEQ ID NO: 313961 - RNA, 64 nt, Human
uggaguggcgguguccaggggcgccccgccccugcggccccaccagguacugaaagacccgcag

SEQ ID NO: 313962 - RNA, 64 nt, Human
auaccucuaaggacaaaaccgagucggucaccagcggccccauguccccagagggcucaccuuc

SEQ ID NO: 313963 - RNA, 64 nt, Human
cucaugcuguccugugagagccccugccccagagcggccccacuaagcgcauguggcuccuggg

SEQ ID NO: 313964 - RNA, 64 nt, Human
guuugacuccuuaccaauagccugaauuugaggagggaaugauugguagcaaaggaugggggaa

SEQ ID NO: 313965 - RNA, 64 nt, Human
uccaaguucuauuucuucccuuauaguuuucuaugggaaugaggcggauacaggaaacacccua

SEQ ID NO: 313966 - RNA, 64 nt, Human
uuucagggacuucccuccagcugccucuucaucugggaaugagcuaagcaaggcugagccuccu

SEQ ID NO: 313967 - RNA, 64 nt, Human
aaccucugcuuggacaaguuucucuuaacugcaggggaaugaagauuucuaguccucgacaaga

SEQ ID NO: 313968 - RNA, 64 nt, Human
ggagcagcccagaggaaauucgugugaaagaggagggaaugagauuauucggaggaagggaaug

SEQ ID NO: 313969 - RNA, 64 nt, Human
aaaggucucagaugaaagagaggguacaacuaaagggaaugagaaggaggacgcugcaggaaca

SEQ ID NO: 313970 - RNA, 64 nt, Human
guaaucuccuagauacuauuacgcuaucuuguuugggaaugauguuucauagguuugugaugau

SEQ ID NO: 313971 - RNA, 64 nt, Human
ucguguaaguugcugaaaggccucagaggaauucgggaaugacacgucuucugaucccaugaga

SEQ ID NO: 313972 - RNA, 64 nt, Human
gagggaaguccuuguuggcagagggauguggggcgggaaugaggaaaggggagggcaugauccu

SEQ ID NO: 313973 - RNA, 64 nt, Human
cacaagacuggcaguccaaauugaaagagauccagggaaugaugacaacaaucucaauuccauu

SEQ ID NO: 313974 - RNA, 64 nt, Human
acaaaaacaacuuauuauugaagaucccuauuaugggaaugacucugacuuugagacgguguac

SEQ ID NO: 313975 - RNA, 64 nt, Human
cccuuuacuggguuugggggguuguuaaaagauagggaaugaagaaugcaaaaugguuuaucgu

SEQ ID NO: 313976 - RNA, 64 nt, Human
uggaaaaaaaaauaagcuucaaacuagguauucugggaaugauguaaugcucugaauuuaguau

SEQ ID NO: 313977 - RNA, 64 nt, Human
acaauuugaagaugaaacuugucauuagguuggcgggaaugagacuaaagauugcgcugugggc

SEQ ID NO: 313978 - RNA, 56 nt, Human
uccggagaguccagcacuaggcuccacggccccagacaccuucccugaggacacuc

SEQ ID NO: 313979 - RNA, 64 nt, Human
ccaagcgguugagccuggcagaguaccaugcgcucggccccagcugcaggaaacagcaggcccc

SEQ ID NO: 313980 - RNA, 64 nt, Human
uuccgacaagacccccggggaaugcaggugcugccggccccaggaccccucuucaagagccacu

SEQ ID NO: 313981 - RNA, 64 nt, Human
agaaguugggcagaaagggaggaggagggcaacagggaaugaagcugguugaguguggggcagg

SEQ ID NO: 313982 - RNA, 64 nt, Human
gggacauuccucuaggacugguuuggggacgggugggaaugaccccuaggcaaggggaugagac

SEQ ID NO: 313983 - RNA, 64 nt, Human
uuuauguuugcaggguuuaaaaaucaguaaaaaugggaaugauugagcuaaaacccacucuaug

SEQ ID NO: 313984 - RNA, 64 nt, Human
agaagacaccuauuuagaauguuacauuuaugaugggaaugaaugaacauuaucuuagacuugc

SEQ ID NO: 313985 - RNA, 64 nt, Human
gaguugaaaccggcaguuacacuaaguaaguggagggaaugaaaguguuucgaggugaaugugg

SEQ ID NO: 313986 - RNA, 64 nt, Human
cuaucuuauaguaauucaggcucuaauuagcugagggaaugaaacacacaaaaaucacugaauu

SEQ ID NO: 313987 - RNA, 64 nt, Human
cauccuuucaccccuucccuggagaugggagguggggaaugaauggaagcugacgggcagagag

SEQ ID NO: 313988 - RNA, 64 nt, Human
ccuccuucucugucagggcuggggugcucugucugggaaugagggaguuaaccaaguuuggugc

SEQ ID NO: 313989 - RNA, 64 nt, Human
aucguugcagagaagacucacccagaccuggccagggaaugauguaucuggggagagaaugagc

SEQ ID NO: 313990 - RNA, 64 nt, Human
gguugcugguagcaguagagagcacugugcaccugggaaugaggaaucaggccccaagacagaa

SEQ ID NO: 313991 - RNA, 64 nt, Human
acagaaaaauaguguaaacauuauuuccuuaccggggaaugaggguuuuuucuuuuucuuuuuu

SEQ ID NO: 313992 - RNA, 64 nt, Human
cugaccuuccucgcagagaggccaggugcagguugggaaugaggcuugcugagaggggcugucc

SEQ ID NO: 313993 - RNA, 64 nt, Human
acaauguugaggacucaaaugaaucaaaccccgugggaaugacagaagugaagaaucugguccc

SEQ ID NO: 313994 - RNA, 64 nt, Human
cacagcccuguaacugcacgugccuucugucauugggaaugaaauaaauuauuacgagaaaggg

SEQ ID NO: 313995 - RNA, 64 nt, Human
uagucuguaguuaaugucaacaguuaauuuaugaacccacgaucguuccacacugcaccaaagu

SEQ ID NO: 313996 - RNA, 64 nt, Human
gguguuauuauacaaaauaauuuuuaaucugcagacccacgaaaagggucucagggacuccucc

SEQ ID NO: 313997 - RNA, 64 nt, Human
aagcaggguaaugcucauaaaaggacuguucccgcggccccaaggugccuguuguucacacuua

SEQ ID NO: 313998 - RNA, 64 nt, Human
aucaucuuugccaccaccuggggagagccugcuugggaaugaaauuaacacaaaggaaguccaa

SEQ ID NO: 313999 - RNA, 64 nt, Human
uuaugggccaccuuucccgcugcgggaccaagccgggaaugagcuugugugcccugauaccccu

SEQ ID NO: 314000 - RNA, 64 nt, Human
uuuaggcaguuauauuacuagauuaagcuugugagggaaugaaaauguuuuuuauuuguuaucu

SEQ ID NO: 314001 - RNA, 64 nt, Human
aggugagggaauaguaaguggugagaacuacucagggaaugaaggugucagaauaauaagaggu

SEQ ID NO: 314002 - RNA, 64 nt, Human
cauauuuacaaguucuuacuccaucauacauauugggaaugagcuggcauuuucaagcauauac

SEQ ID NO: 314003 - RNA, 64 nt, Human
aaugggauucuugguaaacugaagacuuuuauuugggaaugaaaaaccuuaaaaaaaucucuuc

SEQ ID NO: 314004 - RNA, 64 nt, Human
guucauguccaaacguccucuuuaguuuuugguugggaaugaggaaaauucuuaaaaggcccau

SEQ ID NO: 314005 - RNA, 64 nt, Human
gggauggucaggcccaguucucgugcccuuagaggggaaugaaccauggcaccuuugagagagg

SEQ ID NO: 314006 - RNA, 64 nt, Human
cccaccugccaucuugguugucaaagucaaaggagggaaugaaguuaugaauugaauugggcaa

SEQ ID NO: 314007 - RNA, 64 nt, Human
aggcucagaaacaacagcaacagaugcagaaccugggaaugacaucaccacugcccuaugacuc

SEQ ID NO: 314008 - RNA, 64 nt, Human
ggaaugagugugcauggaggcccuccugugcugggggaaugagcccagagaacagcgaaguagc

SEQ ID NO: 314009 - RNA, 64 nt, Human
acuguuaguacgcauaccucaguucaaaccuuuagggaaugauuaaaauuuaaaaaaaaaacau

SEQ ID NO: 314010 - RNA, 64 nt, Human
caauauauaguuuguccagauuagcuuucauuuggggaaugaaguucugaaauaucuaaagcag

SEQ ID NO: 314011 - RNA, 64 nt, Human
gagaaaaggcgacgaaucaggacacagugaacuugggaaugaagagguagcaggaggguggagu

SEQ ID NO: 314012 - RNA, 64 nt, Human
ccccauguccuuggccaggcccaaggagaggacucggccccauggggugugccagucuugcagu

SEQ ID NO: 314013 - RNA, 64 nt, Human
ucacacuggaacaagccccuccagaugagugccccggccccaggccagcuucacugccgucucu

SEQ ID NO: 314014 - RNA, 64 nt, Human
uuuucugauaaaagauggccauauuaccccuuuucggccccauguaucucaguaccccauggag

SEQ ID NO: 314015 - RNA, 64 nt, Human
uguguauugauugaagucacuuuaaauccuucuugggaaugacacaguauauaaauaaggaaga

SEQ ID NO: 314016 - RNA, 64 nt, Human
cuucagugccagcacucagaagucuggcaggugggggaaugagaugagaaaguggacauuuaag

SEQ ID NO: 314017 - RNA, 64 nt, Human
ccaggcuaugaugagucugcuuuugaaggagguagggaaugacaucuuccuuggacccaaagcu

SEQ ID NO: 314018 - RNA, 62 nt, Human
cuggauaccagagaaucuaauuguugcccggggggaaugaaaauaauggaauuuagagaacu

SEQ ID NO: 314019 - RNA, 64 nt, Human
augaguguuaaagaggcaggcuggagcagggcuggggaaugaugggacuggaggaccugggaau

SEQ ID NO: 314020 - RNA, 64 nt, Human
ggaagacccauaacugguuuuaacacuaacuagagggaaugacuucuuugcauagugagugacu

SEQ ID NO: 314021 - RNA, 64 nt, Human
cugaauaaccaggggcacaugggggaacguggaugggaaugauaguguaucucagcggggggug

SEQ ID NO: 314022 - RNA, 64 nt, Human
guguauguguuuaagggggugugauggaugcaaagggaaugaggaauucagcacugcauucucu

SEQ ID NO: 314023 - RNA, 64 nt, Human
caguuucaccaaauguauugaugugauuuacagugggaaugaaagaacagauuaagcauugaua

SEQ ID NO: 314024 - RNA, 64 nt, Human
acaccugggcuuaagaaaucuaguauuucaugcugggaaugagacauaggccaugaaaaaaaug

SEQ ID NO: 314025 - RNA, 64 nt, Human
auagccauuuuccaagugguggcugacuguugcagggaaugagaauuucauaauacacugcuau

SEQ ID NO: 314026 - RNA, 64 nt, Human
cagugcaugcugucccuuacgugaguccuggcaugggaaugaaugucagugugacugaucucuc

SEQ ID NO: 314027 - RNA, 64 nt, Human
uuuucuuugaaguuuuauacacuggauuuguuaggggaaugaaauuuucucaucuaaaauuuuu

SEQ ID NO: 314028 - RNA, 64 nt, Human
aguucuaccuagauuugaaugaguguuuuuuuaagggaaugagaaugucauggugcuaaaccug

SEQ ID NO: 314029 - RNA, 64 nt, Human
guucuccauucugcuuucuugccacacagugggccggccccaggcuccccuggucuccuccccg

SEQ ID NO: 314030 - RNA, 64 nt, Human
ucuaccucgucagggcccugcagugacggcgccccggccccacacucgccucccgggccccacg

SEQ ID NO: 314031 - RNA, 64 nt, Human
augaugcccuccccucagcgcaggcugcagagcccggccccaccucccugcgcccuugaggggc

SEQ ID NO: 314032 - RNA, 64 nt, Human
augaagaaggguaagguaaugaaucucuccaucugggaaugauuaacacaaauguuggagcaug

SEQ ID NO: 314033 - RNA, 64 nt, Human
uuuuuuauaaauaucaugcacaacuauaaccuaugggaaugauguaguaacacagauuauucau

SEQ ID NO: 314034 - RNA, 64 nt, Human
auuauucucauagaccagaguuggagccacccaggggaaugaucucugaugaccuaaccuaagc

SEQ ID NO: 314035 - RNA, 64 nt, Human
cuaccuuugaguguaaacuaagguagacuacuuugggaaugagaacaugcaaaaucaggaaagg

SEQ ID NO: 314036 - RNA, 64 nt, Human
uuuuucacugcuaugauauauuuauuauaaaauagggaaugaaugaaugaauauggauugcugu

SEQ ID NO: 314037 - RNA, 64 nt, Human
auuuuugccauaauguguccucccuguccaaauugggaaugacuuaaugucaauuuguuuguug

SEQ ID NO: 314038 - RNA, 64 nt, Human
auuguuuaaaauuaguucugggaaguugaaaguggggaaugaagagauaauaaauaaaacuaga

SEQ ID NO: 314039 - RNA, 64 nt, Human
agaaagcuaaugcuaguauauacugcaauguuaggggaaugaacauguuuuccuacugcauugg

SEQ ID NO: 314040 - RNA, 64 nt, Human
ccagaacuuguaacuguguuguuauguggcaaaggggaaugaaggcugcagauggaaguaaaau

SEQ ID NO: 314041 - RNA, 64 nt, Human
gggguuuuaugcaaacgcacucaccuccgccuuggggaaugaaagggucacuucugcaucauca

SEQ ID NO: 314042 - RNA, 64 nt, Human
cguuuucuggcuucugcuucauccugcuccaucggggaaugacacacugcggugucugcagcuc

SEQ ID NO: 314043 - RNA, 64 nt, Human
ugcaggaggaaugcugucuccgauaucucaccgugggaaugagugcacugauucaaacguugcu

SEQ ID NO: 314044 - RNA, 64 nt, Human
gcacccugacccuauucagcagagaugcagcucugggaaugagaacaaggaucugcuucuucuc

SEQ ID NO: 314045 - RNA, 64 nt, Human
ucauucuacagaugaacucauugaaacaauuuaggggaaugaggggcaaaaggggagaaauacu

SEQ ID NO: 314046 - RNA, 64 nt, Human
ggacugauucccaggaagaaaagcccaaagggaaacccacgauuccuuucgaguagauguggga

SEQ ID NO: 314047 - RNA, 64 nt, Human
aaguggcuuccaauuuuuggccaugaggaagagaacccacgaacauuccuggacuugucuuuug

SEQ ID NO: 314048 - RNA, 64 nt, Human
auggcccugccugagcccgggccggccucgggccacccacgagggccucccggccuagggcccg

SEQ ID NO: 314049 - RNA, 64 nt, Human
cggcugccagcccugaggccaagcacggcuggagacccacgaccuggccugccguugcccugag

SEQ ID NO: 314050 - RNA, 64 nt, Human
auuguuucaugcuauacuuugugggauaaaacuugggaaugagugugguaagaaauuuauaaag

SEQ ID NO: 314051 - RNA, 64 nt, Human; identical to SEQ ID NO: 190078

SEQ ID NO: 314052 - RNA, 64 nt, Human; identical to SEQ ID NO: 190079

SEQ ID NO: 314053 - RNA, 64 nt, Human; identical to SEQ ID NO: 190080

SEQ ID NO: 314054 - RNA, 64 nt, Human; identical to SEQ ID NO: 190081

SEQ ID NO: 314055 - RNA, 64 nt, Human; identical to SEQ ID NO: 190082

SEQ ID NO: 314056 - RNA, 64 nt, Human; identical to SEQ ID NO: 190083

SEQ ID NO: 314057 - RNA, 64 nt, Human; identical to SEQ ID NO: 190084

SEQ ID NO: 314058 - RNA, 64 nt, Human; identical to SEQ ID NO: 190085

SEQ ID NO: 314059 - RNA, 64 nt, Human; identical to SEQ ID NO: 190440

SEQ ID NO: 314060 - RNA, 64 nt, Human; identical to SEQ ID NO: 190459

SEQ ID NO: 314061 - RNA, 64 nt, Human; identical to SEQ ID NO: 190460

SEQ ID NO: 314062 - RNA, 64 nt, Human; identical to SEQ ID NO: 190461

SEQ ID NO: 314063 - RNA, 64 nt, Human; identical to SEQ ID NO: 190462

SEQ ID NO: 314064 - RNA, 64 nt, Human; identical to SEQ ID NO: 190463

SEQ ID NO: 314065 - RNA, 64 nt, Human; identical to SEQ ID NO: 190464

SEQ ID NO: 314066 - RNA, 64 nt, Human
uagcaaaauaccuugacugcuugugagaccauuagcauugcaggccaaaccguacuguauuucc

SEQ ID NO: 314067 - RNA, 64 nt, Human
gcaugugugauaacugaucuuguuuuauuuuuuggcauugcaacuguggcauaguuacaauuuc

SEQ ID NO: 314068 - RNA, 64 nt, Human
acauuuuaugguuaauuuaauggaagaugaaagggcauugcaaaguuguucaacaacaguuacc

SEQ ID NO: 314069 - RNA, 64 nt, Human
uccuaguuuguuugcugccauuugaacucauguagggaaugaaagaaagcugcaauuauccgcc

SEQ ID NO: 314070 - RNA, 63 nt, Human
ccccaacagauugggagugacagguugggaugugggaaugacuggggugaggcagggucaagu

SEQ ID NO: 314071 - RNA, 64 nt, Human
auuacugcccggccugccucccaccuggaagucugggaaugaggagauugagauaaacuuuuga

SEQ ID NO: 314072 - RNA, 64 nt, Human
guauuaacccuucaucuguucuugaaacugguuggggaaugaggugauaagcaaggagggugua

SEQ ID NO: 314073 - RNA, 64 nt, Human
ugaccccaugguggggggaggggaggggaggggagggaaugaggcagcucuaggaucuauacug

SEQ ID NO: 314074 - RNA, 64 nt, Human
auguuauaauugcaaaaaaucucaauguccaaaagggaaugagugaaacuaaauuaaugagaag

SEQ ID NO: 314075 - RNA, 64 nt, Human
augguuguccauugaauggagugaggaucaaggugggaaugacugggugguggcugccacuagc

SEQ ID NO: 314076 - RNA, 64 nt, Human
uccuaauaggaaggcgaggagaggagaaggccaggggaaugaauucaagagagauguccacgga

SEQ ID NO: 314077 - RNA, 64 nt, Human
gagaauguuuucucucaaauuuccucugacccaugggaaugaaaauacuuaaauacuguaaagc

SEQ ID NO: 314078 - RNA, 64 nt, Human
gccccaccccuguaaauggaauuuaccagaugaagggaaugaagucccucacugagccucagau

SEQ ID NO: 314079 - RNA, 64 nt, Human
auggcucaaaaauggaaacugaaagcaagucauggggaaugaauacuuugggcaguaucuuccu

SEQ ID NO: 314080 - RNA, 64 nt, Human
uccaggagauuucaauccaggcuaucuguguucagggaaugauuugcaagaaguugguuuauag

SEQ ID NO: 314081 - RNA, 64 nt, Human
gacaguucuguugauuuuuuagggccauacuaaagggaaugagcugaaacagaccuccugauac

SEQ ID NO: 314082 - RNA, 64 nt, Human
aaaagacacuauuguuaguuagcugaaaauccuagggaaugagguugauugggagcgcuuucac

SEQ ID NO: 314083 - RNA, 64 nt, Human
gcgccuucgggacgccggggacucugcggcggcgacccacgagcucgcggcccgcgcccggcuc

SEQ ID NO: 314084 - RNA, 64 nt, Human
ucaucuguuucucguguccgccugguugaggaggacccacgagugcugccgagguguggagggc

SEQ ID NO: 314085 - RNA, 64 nt, Human
ucauguguccagagaucuuggaaaauauuuuuucacccacgauuuauuuuguuauugaugauuu

SEQ ID NO: 314086 - RNA, 53 nt, Human
acuucuacacaucugccuaacuugggaaugaaugugggagaaaaucgcugcug

SEQ ID NO: 314087 - RNA, 64 nt, Human
cccaggcaggugcugccccaggaggacuguccucgggaaugaaccucccgcgggcuuuggacug

SEQ ID NO: 314088 - RNA, 64 nt, Human
agaaggagcaggcacugggccuggaauggaaggcgggaaugaaugggccucugauggugagagg

SEQ ID NO: 314089 - RNA, 64 nt, Human
cuccauuguuguacaggaucuucaguuauucgaggggaaugaggcaggucaagccgaugcuagc

SEQ ID NO: 314090 - RNA, 64 nt, Human
cucaaauacgugggcauucaaauguauuacaguggggaaugaagauacugaaauaaacgucuua

SEQ ID NO: 314091 - RNA, 64 nt, Human
uucuguuccaccguaguugauucucaguagaguugggaaugaggaugcuguuacuuggccauuu

SEQ ID NO: 314092 - RNA, 64 nt, Human
cagaaaaggaagcaggcaugguccuggaaaauuggggaaugacgggccaaucuguguuuccuaa

SEQ ID NO: 314093 - RNA, 64 nt, Human
acagcaaggcuuuccuacauaaguauaauaaugugggaaugauuugguuuuaauuauaaacugg

SEQ ID NO: 314094 - RNA, 64 nt, Human
uaucugaggaagugggucacaugaaauguaaaaagggaaugagguuuuuguuguuuuuuggaag

SEQ ID NO: 314095 - RNA, 64 nt, Human
uuuuguggguacugcaguaaagaacaucccuccugggaaugaagcaaugcuucaucccuuuuac

SEQ ID NO: 314096 - RNA, 64 nt, Human
uugaccucucggugccugcgacgggcugacugcugggaaugaagcaggaucaaugaugggauaa

SEQ ID NO: 314097 - RNA, 64 nt, Human
uugaaaaaaccguuauaaagaaaugugccuuuuggggaaugaauacuuuuguucaugucuagcc

SEQ ID NO: 314098 - RNA, 64 nt, Human
ugcauuacuguccccuugauauaaaaaaucuuuagggaaugagaguuccuucucacuuagaauc

SEQ ID NO: 314099 - RNA, 64 nt, Human
uaaauggagaucauaauuuuauguucacuugauggggaaugacuagaauggggcaauaacaaau

SEQ ID NO: 314100 - RNA, 64 nt, Human
uggaggugcccuaccugcauccugcugcacccccacccacgacacucgagugcaagaucgccuc

SEQ ID NO: 314101 - RNA, 64 nt, Human
cuuugaguacuaccggggcuucacacucuuccagacccacgaaaaccgagagcaccuggugaug

SEQ ID NO: 314102 - RNA, 64 nt, Human
gguuguuucuguuucugaguggaccaacagcagaacccacgaggauuuguuuugaguauggagc

SEQ ID NO: 314103 - RNA, 64 nt, Human
gaaagcaggacgcagagaagaacaaaugaggcucacccacgaggcuggguggccagcagucugg

SEQ ID NO: 314104 - RNA, 64 nt, Human
gggaucaaguaggaaaaugggcagaacugcuuaggggaaugaaauugccauuuuucgggugaaa

SEQ ID NO: 314105 - RNA, 64 nt, Human
cuguaacaaacaagccccguuggaacuuccuagugggaaugaugggagaaguuuggggcagggu

SEQ ID NO: 314106 - RNA, 64 nt, Human
uguguguggaaugucgcagacuccuccacguggcgggaaugagcuguguaaauacuucaauaaa

SEQ ID NO: 314107 - RNA, 64 nt, Human
ugcaauaugugguguaugcuguggugaucuugcugggaaugauuauaagugugugugugguggg

SEQ ID NO: 314108 - RNA, 64 nt, Human
agcuuuuugcaauaugcuggggaaaggggagggagggaaugaaagugccaaagaaaacauguuu

SEQ ID NO: 314109 - RNA, 64 nt, Human
auuuaagaauuagggaaauaauuugguggaaaccgggaaugaguucuauucuuaaacagccuuu

SEQ ID NO: 314110 - RNA, 64 nt, Human
uaacugaggucccaucuucccuacucauuccuaugggaaugaugcuuuggaaauuauuagauau

SEQ ID NO: 314111 - RNA, 64 nt, Human
gaaaaaaaucagguuuuaaacaggaaaaccuauggggaaugauauuuuuugaaagacuuuugua

SEQ ID NO: 314112 - RNA, 64 nt, Human
aauguaauauaauugcagcuagaacccuacaguggggaaugaggaauuuuaaacacacauuuga

SEQ ID NO: 314113 - RNA, 64 nt, Human
gaaaacaguacacuguuguagguuggucaggaaagggaaugauuguggcuuggaccugacuaug

SEQ ID NO: 314114 - RNA, 64 nt, Human
aagaaggaaucauauuccuuuaugaauguguaaugggaaugagaaugaauggcagauguggagc

SEQ ID NO: 314115 - RNA, 64 nt, Human
cgcuuuucuuagguucacaagaaaugcgccgguggggaaugaacuguuucauuaauaaaaccua

SEQ ID NO: 314116 - RNA, 64 nt, Human
aagcaacaaccaacuaguaacagcuccaggaaaggggaaugaaucaacucuugguucuuuccug

SEQ ID NO: 314117 - RNA, 64 nt, Human
cacuaaaaucauuuuggcuccuggggcaagcuuggggaaugaauguggaagaugccuauauucu

SEQ ID NO: 314118 - RNA, 64 nt, Human
cggugcugcaggaguguccugcccaugccccagucggccccaucucucauccuuuuggauaagu

SEQ ID NO: 314119 - RNA, 64 nt, Human
cagccccaucugucccuccguccaggagcucucacggccccaucuguuguaccuucccauguau

SEQ ID NO: 314120 - RNA, 64 nt, Human
ugugugugaguggugggcaggccaguggcagggccggccccagccccugcauggauuccuugug

SEQ ID NO: 314121 - RNA, 64 nt, Human
guguggggaagacccacuccagauuccggggagugggaaugagccacucccaguucuggagagu

SEQ ID NO: 314122 - RNA, 64 nt, Human
auuuaguuuucuggguacugaaguggaugggagggggaaugauuaaagaacaaauuauaaaagu

SEQ ID NO: 314123 - RNA, 64 nt, Human
auuuaauauaucaaagaucaguugacaucuccuagggaaugaugaaaacagcaggcuauuagaa

SEQ ID NO: 314124 - RNA, 64 nt, Human
uuuguuuaagcucuaacucaccccuggaauacaggggaaugaugacaaccagcccagccaggcc

SEQ ID NO: 314125 - RNA, 64 nt, Human
ggcagugcuaaagguggagcugggggauuuuccugggaaugauuugagggcucuugaaagccca

SEQ ID NO: 314126 - RNA, 64 nt, Human
gggcuucggcagucggcugggggaguucuggcuggggaaugacaacauccacgcccugaccgcc

SEQ ID NO: 314127 - RNA, 64 nt, Human
uuuauuaucgcauacagauauucuaagucguugagggaaugacaccaucagacauuauaaguac

SEQ ID NO: 314128 - RNA, 64 nt, Human
ccaaaugauaucagguccucaaucuucagcuacagggaaugaguaacuuugaguggagaagaaa

SEQ ID NO: 314129 - RNA, 64 nt, Human
gccuuggaacgcuucuggcagcagagcugggugugggaaugaggccuagaucgauaucccuggg

SEQ ID NO: 314130 - RNA, 64 nt, Human
gguaccugcuguguaagagagcggacuguggagggggaaugagaacaagccagacuuggugguu

SEQ ID NO: 314131 - RNA, 64 nt, Human
uauuuuguuugaucuauuaaggaagaacaaggaagggaaugaucuuuacucaagaauuucagaa

SEQ ID NO: 314132 - RNA, 64 nt, Human
ucuccaaguuguccucucuccugcugauggaaaugggaaugaaguuaaguggucugaaaaacuu

SEQ ID NO: 314133 - RNA, 64 nt, Human
aauuccauugcuuugaaaaaguuaaugcuuaagagggaaugauaugcauuugacuuguuaaaca

SEQ ID NO: 314134 - RNA, 64 nt, Human
gccuuguacucuuguuaaccuuagagcuagaccugggaaugauucaacuucaagccuuaaccug

SEQ ID NO: 314135 - RNA, 64 nt, Human
ccccacauccccucagaacgcugcgcccagccacacccacgaucaaguuacacagcuuuauugg

SEQ ID NO: 314136 - RNA, 64 nt, Human
aagugccuuccaagcuucccccaagauccacaucacccacgacccugccacuguuuuugcugug

SEQ ID NO: 314137 - RNA, 54 nt, Human; identical to SEQ ID NO: 162181

SEQ ID NO: 314138 - RNA, 64 nt, Human
cuuauccucuccaugcugagcuugacaacacucugggaaugaggaacaagacuuuuucuaaaaa

SEQ ID NO: 314139 - RNA, 64 nt, Human
uuuuuuuugcuuuuauuuucuaaaucauuuuuaagggaaugaaacaggaaugucaucagagauu

SEQ ID NO: 314140 - RNA, 64 nt, Human
cacagcauugguuuuuuucuacuugugugucugggggaaugaacgcacagaucuguuugacuuu

SEQ ID NO: 314141 - RNA, 64 nt, Human
uggcccauaacuguauguuauguggaagaagugugggaaugauggguuuuccaugaaaugugau

SEQ ID NO: 314142 - RNA, 64 nt, Human
uccuugagaaguugaagccgucucaugcagaagagggaaugagcuuccauuaugcugcagagcu

SEQ ID NO: 314143 - RNA, 64 nt, Human
aaaaaagcuaaccuucuauuagaaaaggggacaggggaaugaguaaacuucuuuuauugcggac

SEQ ID NO: 314144 - RNA, 64 nt, Human
aggcucccccugcagguggggggguacccgcaccgggaaugagcaggcucagcaggggggcagc

SEQ ID NO: 314145 - RNA, 64 nt, Human
ucccugccuccugccuccugcggcuguuggauuugggaaugaccuuggugagagucucacugcu

SEQ ID NO: 314146 - RNA, 64 nt, Human
uuaauggaggauauuccucggaaaaacagacuuugggaaugaaggagggacucaggaucauugu

SEQ ID NO: 314147 - RNA, 64 nt, Human
uuuuaauagccaauuauguccuaauuguauuuuggggaaugaacagcagcaaauacuguaaaug

SEQ ID NO: 314148 - RNA, 64 nt, Human
aaugaauuguguuucucuguccugagcuggagaagggaaugagcaggcugacacguugcacagc

SEQ ID NO: 314149 - RNA, 64 nt, Human
cuggucuuacgccuguguagauuucuucuccauugggaaugaaggugucaggcgggacuggaac

SEQ ID NO: 314150 - RNA, 64 nt, Human
gguagcaggggccaguccuccccucuugauugcugggaaugagcagcugagcucuuuggugugg

SEQ ID NO: 314151 - RNA, 64 nt, Human
cuauguggaaguggggcgggcuucauagagacuugggaaugagcugaaggugaaacauuuucuc

SEQ ID NO: 314152 - RNA, 64 nt, Human
ucccugaaagacugaagaaaguguagugcaugggacccacgaaacugcccuggcuccagugaaa

SEQ ID NO: 314153 - RNA, 64 nt, Human
gaggacacaguggagcccacgagcacgagcuggaacccacgaggauggccuggaacccauguca

SEQ ID NO: 314154 - RNA, 64 nt, Human
ggcccggcccggaacuuuucuccccaacccccaaacccacgacucacuuccacaccgucuuccc

SEQ ID NO: 314155 - RNA, 64 nt, Human
uggaugccgcgagggacggacacacguccggggcacccacgaggagggcccccagccugggaga

SEQ ID NO: 314156 - RNA, 59 nt, Human
uggaccccagaauuuuauaacccacaucugggaaugaauuugcagcaccugguagaaga

SEQ ID NO: 314157 - RNA, 64 nt, Human
gugucugcuuuauuccagguuuuguguacagcuugggaaugaaaagguugauuguaaacccaca

SEQ ID NO: 314158 - RNA, 64 nt, Human
auaacccugguggacugcagccuucaucuuuauugggaaugaguuuguuauaaaucagaaaugg

SEQ ID NO: 314159 - RNA, 64 nt, Human
augcagggcuuaaaaggccagcgucuguuugagggggaaugaccucuaacaucuguaaaauuug

SEQ ID NO: 314160 - RNA, 64 nt, Human
cacuaucuucaaauuaccucucuuaaauaggguugggaaugaggacauagaaucauguucuccc

SEQ ID NO: 314161 - RNA, 64 nt, Human
uggggaguguacagaccccugccuuggggguuccgggaaugaugcaacugguuuuacuagugug

SEQ ID NO: 314162 - RNA, 64 nt, Human
aaaagaaacauacauccuucaguauaggagaugagggaaugagagaaaauauuuuuugaagaag

SEQ ID NO: 314163 - RNA, 64 nt, Human
gugguuccuaagggaaagggaagcacaugaucaugggaaugauagcccagaacaaaaagaaauc

SEQ ID NO: 314164 - RNA, 64 nt, Human
aggauccguccucauuuuauuggugaugaugaaugggaaugaaaucagggggcugucuacuaga

SEQ ID NO: 314165 - RNA, 64 nt, Human
aaauugaauaaugguaccagauaaaauuauagaugggaaugaagcuuguguauccauuaucaug

SEQ ID NO: 314166 - RNA, 64 nt, Human
ugcccucguaucauaccaccuguuccuguggagagggaaugaccggcacugaagguaccuuaca

SEQ ID NO: 314167 - RNA, 64 nt, Human
cacgccccuacagaagugcacuuccuugagaggagggaaugaccucauucucuguccagaaugu

SEQ ID NO: 314168 - RNA, 64 nt, Human
uuacuuucuuuuggauugcacugauuguuuuugugggaaugacacuuuaucuggcaaaguaacu

SEQ ID NO: 314169 - RNA, 64 nt, Human
agagcagacaagaaagaagagcccuugaaaacaagggaaugauuuuugagucguuaucaagcua

SEQ ID NO: 314170 - RNA, 64 nt, Human
uggcccauugccccuggcacuccuugcagaggccacccacgaucuucuuugggcuuccauuucc

SEQ ID NO: 314171 - RNA, 64 nt, Human
aguucuccagaaucccaggcgaugacaagucugaacccacgaaaauacccagcgcagcaucuac

SEQ ID NO: 314172 - RNA, 64 nt, Human
cuagguucccggucccgaguacagucuguaucaaacccacgauuuucuccagcucagaacccag

SEQ ID NO: 314173 - RNA, 64 nt, Human
ugggcucagugcugccacccagaucagaucacaugggaaugaggcccuccgaccauuggcagcu

SEQ ID NO: 314174 - RNA, 64 nt, Human
caggagccauccuccuggugguacccaaugucaugggaaugaugugccugucacccccauugga

SEQ ID NO: 314175 - RNA, 64 nt, Human
cuuccagguguugcaguaucucaacaaaauggcugggaaugaauacauggguuucagcaaugcc

SEQ ID NO: 314176 - RNA, 64 nt, Human
gggccucagaacucuugcucuuccugggcugagggggaaugaguguucuugccauuugccagcc

SEQ ID NO: 314177 - RNA, 64 nt, Human
caaaauuacaaaaaguuaugaaaauuuuuauacugggaaugaugcucauauaagaauaccuuuu

SEQ ID NO: 314178 - RNA, 64 nt, Human
auuuguguguggagugggaugugggggguggagggggaaugacagauuucuggaaugcaaugua

SEQ ID NO: 314179 - RNA, 64 nt, Human
cuuuuauuaagcaucugugggaauauacaguugggggaaugauaaucugguuuauuuuuucugu

SEQ ID NO: 314180 - RNA, 64 nt, Human
gaguccuauaaaaagcaaggauaugcaugauucagggaaugaagaaucacaggcuugggcagug

SEQ ID NO: 314181 - RNA, 64 nt, Human
cugauuuauuuucagccaguaaucaaaacagacugggaaugaauaaagcacuuacagaagagua

SEQ ID NO: 314182 - RNA, 64 nt, Human
cuuccccaagcucuccugggucuuggagggaugugggaaugaauuggcauugcaggaaagacag

SEQ ID NO: 314183 - RNA, 64 nt, Human
aaguuugaauuauuuuguucuugugggcagaagugggaaugauggaauauccucacggaaaagg

SEQ ID NO: 314184 - RNA, 64 nt, Human
aaacaagauaaucaguuacugagugaagaaagacgggaaugaugucccauacuucccagcucuc

SEQ ID NO: 314185 - RNA, 64 nt, Human
aggacaaacacuggcuggagaaagccagacugaugggaaugagacuuuggccaaaaaucccaaa

SEQ ID NO: 314186 - RNA, 64 nt, Human
uaaaucagggugaccugugcgccuagccugcgcagggaaugaacuggagacuguggccucaucc

SEQ ID NO: 314187 - RNA, 64 nt, Human
uggggccucgccuggcgggaccccgcagcagccccggccccauccccgcccagagccgggcguc

SEQ ID NO: 314188 - RNA, 64 nt, Human
uugacacguuggagccgagccugaacaugccccucggccccagcacauggaaaacccccuuccu

SEQ ID NO: 314189 - RNA, 64 nt, Human
uuagcuacuucuuuggcuaccucauaauuuguaugggaaugaacaugaauuagggaacuucaaa

SEQ ID NO: 314190 - RNA, 64 nt, Human
uuuucuuuaaaaagacaagaauaaggucugguuagggaaugaaaaauguauacauuucggaaca

SEQ ID NO: 314191 - RNA, 64 nt, Human
uuauugauuuuaaaaguuuuacauguaggagugugggaaugaaggaauucuggagcuuuuugac

SEQ ID NO: 314192 - RNA, 64 nt, Human
auuuagaauaaaaucucacauccauuauuuuaaagggaaugauuggggggaaaaacuggugaaa

SEQ ID NO: 314193 - RNA, 64 nt, Human
ucugggcguuucccaugcagcucucugguagcuggggaaugauuugugagugcuuccucugcuc

SEQ ID NO: 314194 - RNA, 64 nt, Human
ucgagaagcucaagaagcccaggggagaaacaaagggaaugaucuauugagagcccucucuccc

SEQ ID NO: 314195 - RNA, 64 nt, Human
uccagguucugucuggugccccuacuggagucccgggaaugaccgcucucccuuugcgcagccc

SEQ ID NO: 314196 - RNA, 64 nt, Human
uuuucucaauccucucuugaggugcuuuacuaaugggaaugauuucuguauguucccuugguac

SEQ ID NO: 314197 - RNA, 64 nt, Human
cagaacagcaaugcuaguaacaggaugggaacaugggaaugauaauauauauuuuuucuuuuaa

SEQ ID NO: 314198 - RNA, 64 nt, Human
gguuuaaaacagaauugcuuuagauuuccaaagagggaaugauguugccuuccacuuuaaccca

SEQ ID NO: 314199 - RNA, 64 nt, Human
ccauuucacgacgaaaagacaagacucuggggaugggaaugacuuccucgagaccauacagcca

SEQ ID NO: 314200 - RNA, 64 nt, Human
cggcaggcuagaaccuggcaagcuagaaccuggagggaaugaaccuggagggcuagaaccugga

SEQ ID NO: 314201 - RNA, 64 nt, Human
cgccccagggagagagaaaaagcugagacuccuggggaaugacguuggggugauggaguccggg

SEQ ID NO: 314202 - RNA, 64 nt, Human
ggccuccacgaugcccugggcugugugcucuuaugggaaugaggguuggguguccaagaugccc

SEQ ID NO: 314203 - RNA, 64 nt, Human
caagcccuaccucugugcccuguaccagcagaggcggccccacgugggcugugcuacauacagg

SEQ ID NO: 314204 - RNA, 64 nt, Human
aacugaaauguaucccuugaccaacaucacugcccggccccagccccagguaaacaccauucua

SEQ ID NO: 314205 - RNA, 64 nt, Human
cacggcagcuugagccugucacguggucaaggcccggccccaucagaggcugggggaggcggca

SEQ ID NO: 314206 - RNA, 64 nt, Human
ucucuaaauauuuauuuagagaaugauuuuaaaagggaaugauaugcuuguuuaaaugaaagag

SEQ ID NO: 314207 - RNA, 64 nt, Human
auacuaucaagagaagagccuaggagcacagcgagggaaugaaccuuacuugcacuuuauguau

SEQ ID NO: 314208 - RNA, 64 nt, Human
guacaguaauuugccucauaagcauaggagcauugggaaugagagggaacugugcccaguauac

SEQ ID NO: 314209 - RNA, 64 nt, Human
uuucuguuuaguccaguguuaccaagguaagcuggggaaugaaguauaccaacuucuuucagag

SEQ ID NO: 314210 - RNA, 64 nt, Human
uaucuaugaaggguugugcaaaacaggaaggucugggaaugaccagauaucuuguuggcauaaa

SEQ ID NO: 314211 - RNA, 64 nt, Human
cuccuguguuaugugugaacaguugucuuuaugugggaaugacgacuugauugggaguagaguc

SEQ ID NO: 314212 - RNA, 64 nt, Human
uggcuccuaugguaggaaggaugaccaggucccugggaaugagcugccuaccugcugcuccacg

SEQ ID NO: 314213 - RNA, 64 nt, Human
cucagggcaggggaccuugcaacuuaucgcaaaggggaaugaaccugaauccguugcauuuauu

SEQ ID NO: 314214 - RNA, 64 nt, Human
uguguugaccuggauaaaguacaaagguggaagagggaaugaguuaugcuguuaaaaucucagg

SEQ ID NO: 314215 - RNA, 64 nt, Human
cugcucgagggacgccaauaggcaugccgccuccgggaaugagacccccuccaccaggcauuag

SEQ ID NO: 314216 - RNA, 64 nt, Human
ccgucgagugcgugcauccuacuauguggucagugggaaugacccugccaauggcgagccaagc

SEQ ID NO: 314217 - RNA, 64 nt, Human
uggguuuccugguuccacugcuacugacccagaggggaaugagggcugaguuaugaaaagauaa

SEQ ID NO: 314218 - RNA, 64 nt, Human
ccccagggcuuugggggcggcacuugggguuucugggaaugacaucaucucuguuccccauccc

SEQ ID NO: 314219 - RNA, 64 nt, Human
cuucuagcuuuagccgagaaagaaaccagucccagggaaugaaugguggucuccccacucccgg

SEQ ID NO: 314220 - RNA, 64 nt, Human
acuuuguauacaucaucucauuuaaucuucacaacggccccaggagauaaguacuaacuuucuc

SEQ ID NO: 314221 - RNA, 64 nt, Human
aucaaaugaucauggaagcuuggcucugaccccacggccccagcuggagcuggcugagagcagu

SEQ ID NO: 314222 - RNA, 64 nt, Human
guaauuuuccuuuaccuacccaaauccuauaaaacggccccaccccuaucucccuucgcugaca

SEQ ID NO: 314223 - RNA, 64 nt, Human
uguggagaauucuacauugaaacagaaaauaccugggaaugaagauuaaaaauguagcugcugu

SEQ ID NO: 314224 - RNA, 64 nt, Human
augauagcagagauauuuuuacuuagauuacuuugggaaugagagauuguugucuugaacucug

SEQ ID NO: 314225 - RNA, 64 nt, Human
guguacuuuaucauuuuaacaaagcaguaugguugggaaugagacaauucucuauuuuacagug

SEQ ID NO: 314226 - RNA, 64 nt, Human
ggaggagggaguggagagacugacuggccgugaugggaaugacagugagaagguccgccugugc

SEQ ID NO: 314227 - RNA, 64 nt, Human
ugccaggggacuacguuucucagggugguccuaugggaaugaguauggcacagccaaguuacac

SEQ ID NO: 314228 - RNA, 64 nt, Human
uuggcuccaccucuguccucucucuagccugccugggaaugaaugaagcucuguuagaaacacc

SEQ ID NO: 314229 - RNA, 64 nt, Human
cauucagucuaaaauacugaaacuuuggaauauagggaaugaugauaaaaguggauuugguuug

SEQ ID NO: 314230 - RNA, 64 nt, Human
gugucugccccugaggucuuuuaaguugagggcugggaaugaaaccuauagccuuugugcuguu

SEQ ID NO: 314231 - RNA, 64 nt, Human
cuucugcaaagaaaguuguggggcauaagacaccgggaaugagggaggaggaagacaguugugu

SEQ ID NO: 314232 - RNA, 64 nt, Human
cagggacuucuggguuaugggagaaaccagagaugggaaugaggaaaauaugaacuacagcaga

SEQ ID NO: 314233 - RNA, 64 nt, Human
uguuugagaguagaucugccaauuauguugacaagggaaugaucaaaagcuuuguuuuuuuuaa

SEQ ID NO: 314234 - RNA, 64 nt, Human
auugacccguuuggggucucaucucuacuucuaggggaaugaaacacucugaguggccaggccu

SEQ ID NO: 314235 - RNA, 64 nt, Human
agaagccgagccuagaaacuaacacagccaucaagggaaugacuugggcggccuugggaaaucg

SEQ ID NO: 314236 - RNA, 64 nt, Human
caggccugagaauucugugcgcccggcgggcuuugggaaugagggguucccuugaacaugcgua

SEQ ID NO: 314237 - RNA, 64 nt, Human
uaaguagcgggggcugcagccgaccgcccugcuccggccccaguguggugggcgaggguggcgc

SEQ ID NO: 314238 - RNA, 64 nt, Human
ggcagaggacgugaggggcuggcagcaggcagggcggccccaggccucugcccuccucucaggu

SEQ ID NO: 314239 - RNA, 64 nt, Human
gguugauauauugcaaauagacacucugagcccugcauugcaagggcgucuuuugcuuuaaaga

SEQ ID NO: 314240 - RNA, 64 nt, Human
gcuguuuuuggcuguuuucccucugcugcuuuuggggaaugaggggaagccauuuuccagugac

SEQ ID NO: 314241 - RNA, 64 nt, Human
ccagaauauaagcuaucaagaguauuaauuuauugggaaugagcugaggcggauuuccccagag

SEQ ID NO: 314242 - RNA, 64 nt, Human
uguuguacauagagcauuuucacuauugcugaaugggaaugauuaaaaacaagguauuuuucgg

SEQ ID NO: 314243 - RNA, 64 nt, Human
gcugaucaaacucaagcucacaccuguaccugaugggaaugaacauaaugugaagaaacuuauu

SEQ ID NO: 314244 - RNA, 64 nt, Human
guggugcagucagccucgcucucaacgugacccggggaaugaccacccagagggaugagcuagc

SEQ ID NO: 314245 - RNA, 64 nt, Human
aacauuggaauuuuuguuuuaguggucaguauaggggaaugaaagcgucuguuguuacccacgu

SEQ ID NO: 314246 - RNA, 64 nt, Human
caacauugugaucuuucuuccccgccacgugugugggaaugauugaguccuguuugcaagcugg

SEQ ID NO: 314247 - RNA, 64 nt, Human
cuucccugcccaauccucccuggagaagggacaugggaaugaauugaaauggggcgcuggacac

SEQ ID NO: 314248 - RNA, 64 nt, Human
ggaagugaggagugugcacggaugcugaauguuugggaaugagaggaugagugagugaggcuug

SEQ ID NO: 314249 - RNA, 64 nt, Human
gacugaguggggaaaggaguuacacccgugaguggggaaugaggcugguccugcagccucuccc

SEQ ID NO: 314250 - RNA, 64 nt, Human
cucucuucauaguguguugagguucaucauagcagggaaugaauuuugaaacuaagcaacuucg

SEQ ID NO: 314251 - RNA, 64 nt, Human
guaucuucaguuggagguguaguauucaaaaacggggaaugaaggcaggaaggaggcuggaaua

SEQ ID NO: 314252 - RNA, 64 nt, Human
ggucugggggaagcgacggguggaguacaauaaagggaaugaggacaaaccucugccguccgug

SEQ ID NO: 314253 - RNA, 64 nt, Human
cucugggacuuggcggggaugggguggggugggagggaaugaggaagcuacagguagguccacc

SEQ ID NO: 314254 - RNA, 64 nt, Human
ucuuggaacuuuaacuccugccagcccuucuaagacccacgagcggggugagagaagugugcaa

SEQ ID NO: 314255 - RNA, 64 nt, Human
uagguagggacacguguccacgcaccacagacacacccacgacaccugaucucguaucacuagc

SEQ ID NO: 314256 - RNA, 64 nt, Human
ugcuucagccagugcagugagaacagcagccccacggccccaugggaggcggcgcugcucuccc

SEQ ID NO: 314257 - RNA, 64 nt, Human
cauuaguuaaacauuuuuuucuccuuuggaggaagggaaugaaacauuuauggccucaagauac

SEQ ID NO: 314258 - RNA, 64 nt, Human
agcuucgccagugucacugaaucaacagauccaagggaaugaacaagaagacuaccuugagcuc

SEQ ID NO: 314259 - RNA, 64 nt, Human
auguuuagaacucucugauuuugaugaauuauaugggaaugagaaacagaagaagugguauuug

SEQ ID NO: 314260 - RNA, 64 nt, Human
uccuaggggaagagcagaaggaaggaugccacuugggaaugaauuguccuuuucuaggaagcac

SEQ ID NO: 314261 - RNA, 64 nt, Human
ggagggggcuagggauaugcucuggggcuuucaugggaaugaugaagaugauaaugagaaaaau

SEQ ID NO: 314262 - RNA, 64 nt, Human
ugggccuggaacucuaacuccaucgcugaggggugggaaugagaacuaugaaccaggaaggaga

SEQ ID NO: 314263 - RNA, 64 nt, Human
ccaccacgcuucuucgcguaagcaguggcaucuugggaaugaaugcccagccgcucguggguug

SEQ ID NO: 314264 - RNA, 64 nt, Human
aguguggauugcauuguuaggaagaacauuuggugggaaugaacacuccugggcauaccgcuga

SEQ ID NO: 314265 - RNA, 64 nt, Human
ggaauuggaaaugaagaccuaaccagcuauuggugggaaugacggaacuggggauugcgaugau

SEQ ID NO: 314266 - RNA, 64 nt, Human
acugggggcuccugagaugagaguuugagauucagggaaugagaccaccucucauuucuuccag

SEQ ID NO: 314267 - RNA, 64 nt, Human
gccccacgcagguucaccaugaaccucagggucagggaaugagccaggcacgggggcaugggca

SEQ ID NO: 314268 - RNA, 64 nt, Human
gcgguacuggaacaguggagaacccaacaauagcgggaaugaagacugugcggaauuuaguggc

SEQ ID NO: 314269 - RNA, 64 nt, Human
cacccacggggccuuuuuuuggaggugggggcuggggaaugaggggcugaggucccggaaggga

SEQ ID NO: 314270 - RNA, 64 nt, Human
ucagccagauccuuacacguggagcccccagcaugggaaugaggggcucugcaacugagcgaag

SEQ ID NO: 314271 - RNA, 64 nt, Human
agccgcuggcacggcccugcguagcagcaccagccggccccaccccugcucgccccuaucgcuc

SEQ ID NO: 314272 - RNA, 64 nt, Human
cauucaucuccauuuuuuaaaaagguuucucugacggccccacggcccgagccgcggugagcgu

SEQ ID NO: 314273 - RNA, 64 nt, Human
gagugaggcuuccaggcucuuccuggaccugagucggccccacaugggaaccuaguacucucug

SEQ ID NO: 314274 - RNA, 64 nt, Human
auuuaucaguauaaaauuagggaaaccacguguggggaaugaaucaauuuagagcuucgggaau

SEQ ID NO: 314275 - RNA, 64 nt, Human
aacggaguggguggcagcaaauguguguugaaaggggaaugaagccauucacuucacucaguuc

SEQ ID NO: 314276 - RNA, 64 nt, Human
uggggcaggcagugguugguggguggugugcaaagggaaugaagagcguccugggccuaaacac

SEQ ID NO: 314277 - RNA, 64 nt, Human
aaucuucagguccuccguguucuggagcugagaugggaaugagccccuacacagaauggagucc

SEQ ID NO: 314278 - RNA, 64 nt, Human
aacaccaggccugucacacagaugaauguguugagggaaugaauaaguauuuccgucaagaaaa

SEQ ID NO: 314279 - RNA, 64 nt, Human
guuaccaaauucuucauaagaaagaucauauuaugggaaugauaauccuguuuacuguggauua

SEQ ID NO: 314280 - RNA, 64 nt, Human
aauucuguguaugacagugcuauugaaaucacuggggaaugaauggcuuauuuaauaaauggaa

SEQ ID NO: 314281 - RNA, 64 nt, Human
ggauucaaauucugccuugaaauauugugacucugggaaugacaacaccugguuuguucucugu

SEQ ID NO: 314282 - RNA, 64 nt, Human
ggagggucuagaggccugaaauccugguuccuaggggaaugagggggcucaguucuggacugug

SEQ ID NO: 314283 - RNA, 64 nt, Human
gccauagaaauguaagguuugugacaaggcuuucgggaaugauucacacguggcaccccauacu

SEQ ID NO: 314284 - RNA, 64 nt, Human
uaccaguaauucauacuugaggaccaugacuguggggaaugaggcaucuuuuagcaagagcucu

SEQ ID NO: 314285 - RNA, 64 nt, Human
ucuggggucugggccaguggccauagugaagccugggaaugaguguuacugcagcaucugggcu

SEQ ID NO: 314286 - RNA, 64 nt, Human
gcauuuucgucaucugaagcaugagugacaaguugggaaugauguggugauuuagaaugcagua

SEQ ID NO: 314287 - RNA, 64 nt, Human
aaucugcaacccuggggaggaccccaacucaccugggaaugaggcaaauugcauuugcuugcuc

SEQ ID NO: 314288 - RNA, 64 nt, Human
cacucaccuucguguuuuaaagaagccucagagugcauugcagcucugucagggccccauuccc

SEQ ID NO: 314289 - RNA, 64 nt, Human
guguccucagccaccgucuggaaaucggcaacaggcauugcacuccgguuggggguccccaggg

SEQ ID NO: 314290 - RNA, 64 nt, Human
ugagugaaaagaggaaaaagaaaauggcugugcugcauugcaggaaccugcucauuaucauguu

SEQ ID NO: 314291 - RNA, 64 nt, Human
cggucugguaaaagggccuguuuucagggacaaagggaaugaggaugaucuuuggcuguugcug

SEQ ID NO: 314292 - RNA, 64 nt, Human
ucuacccaggauaauagucacaguuuuccagggagggaaugauauaauuuucaugacaauguca

SEQ ID NO: 314293 - RNA, 64 nt, Human
gaaugugugugagcaugugugugugcauguaccggggaaugaaggugaacauacaccucugugu

SEQ ID NO: 314294 - RNA, 64 nt, Human
ccuccuggauggauuccacuguuagacagcuacagggaaugauuggucauggggaagucucugc

SEQ ID NO: 314295 - RNA, 64 nt, Human
ugucccaaggcucacagccaguaggcauaggagcgggaaugaaaaucgagcacugucagaaucu

SEQ ID NO: 314296 - RNA, 64 nt, Human
uagcaggaaacuaaaaugaauggaaauucuuaaagggaaugaugugauucaagcuggaaagagg

SEQ ID NO: 314297 - RNA, 64 nt, Human
uaaugcugcacaccaguuacuguucauggcacccgggaaugacuugggccaaucacugaguuug

SEQ ID NO: 314298 - RNA, 64 nt, Human
augauuuuuauuuuuguugguuuuuauuuuuggggggaaugacauguuugggucuuuuauacau

SEQ ID NO: 314299 - RNA, 64 nt, Human
aaacgguuugaguuaaauggaaaaugaaaguagagggaaugaucuuccccgugguuagcacugu

SEQ ID NO: 314300 - RNA, 64 nt, Human
ugaccagucuguuccggggcccccucagccaggugggaaugacggacacguacuauccaagugu

SEQ ID NO: 314301 - RNA, 64 nt, Human
acaaaauucauucagaccgcacauguuagaggcagggaaugaagaagguacugugggccauggc

SEQ ID NO: 314302 - RNA, 64 nt, Human
aaacgaguuuguacagaagucagaacuuuggguugggaaugagaucuagguuguggcugcuggu

SEQ ID NO: 314303 - RNA, 64 nt, Human
gaaauacagggaugguccauguuuucaagaguaggggaaugauguuuaaacacaaaaauaaauu

SEQ ID NO: 314304 - RNA, 64 nt, Human
uuuuuuucaggauuaaaagaucagaagaugagaggggaaugaauacuucagaugcuuucaggag

SEQ ID NO: 314305 - RNA, 64 nt, Human
cuggcucccccagcucaccguggugcuguccuugacccacgagcuguugagaagggugcagagc

SEQ ID NO: 314306 - RNA, 64 nt, Human
accagugcuuccuucgucagcagcgccuccccagacccacgaggauacucacacugcacgccug

SEQ ID NO: 314307 - RNA, 64 nt, Human
gagggaaagggagggaugaccuucccagggagaaacccacgaccuguccugucuuugaucgccu

SEQ ID NO: 314308 - RNA, 64 nt, Human
augggacuagauucuaaaauuuauuugggaccaugggaaugauaguugggaagaaaacuauuug

SEQ ID NO: 314309 - RNA, 64 nt, Human
cagugcuggugcuucugcuucuuaaguucaucaagggaaugaggaguucuuguccuucuccucc

SEQ ID NO: 314310 - RNA, 64 nt, Human
ugagauuuacacgguuggaguguuaugcggucuagggaaugagacaggaccuaggauaucuucu

SEQ ID NO: 314311 - RNA, 64 nt, Human
gagguguaggauaaggugggggcgggggaaaugggggaaugacacaucccccccaaccuacccc

SEQ ID NO: 314312 - RNA, 64 nt, Human
gauuuuuaggacgguuuugaaaaagaaaaguguugggaaugaagcaagugauugauuggaaaac

SEQ ID NO: 314313 - RNA, 64 nt, Human
ugguaguagaacuaauagcuuuaacaggagaauagggaaugagaaauagaaauccaaggcugaa

SEQ ID NO: 314314 - RNA, 64 nt, Human
uuuaaacagguucaugggacagaguuagaaaacugggaaugaauaagacauccauaacuacuau

SEQ ID NO: 314315 - RNA, 64 nt, Human
auacuuuuggcaauccguuuaaacaagauaagaagggaaugaugauugaugaagcagaugaguu

SEQ ID NO: 314316 - RNA, 64 nt, Human
cagcaucacuguccugguuccaucucugcuauaugggaaugaaaauaaagaaacauauuucuug

SEQ ID NO: 314317 - RNA, 64 nt, Human
gguuuuuuccccucuuuuacuuuccauugaggaagggaaugagcuccuuucuccucuccuucag

SEQ ID NO: 314318 - RNA, 64 nt, Human
aguuagggccucucuuuuguuccugcagugucaggggaaugaccaaguacauccuggugcagga

SEQ ID NO: 314319 - RNA, 64 nt, Human
cauuuaauggucugugcuuuaaaugguaacgcuacggccccaggucacugcgaggcacuuacca

SEQ ID NO: 314320 - RNA, 64 nt, Human
aucagggccagggccuaacaguguuucuuccccucggccccacggcccauacucaccccuucac

SEQ ID NO: 314321 - RNA, 64 nt, Human
caucccuucacaaucccagaguggcaggcgggaccggccccauggucuggcuccugucaccugg

SEQ ID NO: 314322 - RNA, 64 nt, Human
ucccucagccucccaaguagcugggauuacaggcacccacgagcaugcccggcuaauuuuuugu

SEQ ID NO: 314323 - RNA, 64 nt, Human
acuaaaaaggggaggaaggcagaccuccugggagacccacgaaggguuuuuagccagggaaaac

SEQ ID NO: 314324 - RNA, 64 nt, Human
gagaaagcacuuugaaauuuauuacuagcuugcuacccacgaugaaaucaacaaccuguaucug

SEQ ID NO: 314325 - RNA, 64 nt, Human
aaaucacauacauacauuuaaaaaaaaaacaacaacccacgaggagucugaggcugugaauagu

SEQ ID NO: 314326 - RNA, 64 nt, Human
ugucaccuccaaugacuagggugggcaaccacaaacccacgagggcagagugcugcuugcugcu

SEQ ID NO: 314327 - RNA, 64 nt, Human
guauuuuugaauaauuaccaagcagccgaagaccacccacgaaugguuaucuuacgacuguuac

SEQ ID NO: 314328 - RNA, 64 nt, Human
uggguaugaagaugcuucagagcucaugcgcguuacccacgauggcaugacuagcacagagcug

SEQ ID NO: 314329 - RNA, 64 nt, Human
caggccaagguucaauuauuucagcgcagguaucacccacgagaaauuuuuccagaguuucaca

SEQ ID NO: 314330 - RNA, 64 nt, Human
auaucauugucagaccauuuuugcugcuguggucacccacgauuucauuugucuuauacccagg

SEQ ID NO: 314331 - RNA, 64 nt, Human
aaauggugaggcgaggggcuugagaggaacgcccacccacgaaggcccagggcgccagacggcc

SEQ ID NO: 314332 - RNA, 64 nt, Human
uauuaguguggguauggcuaaugaguucugauucacccacgaagguuacauuuaugcugaauac

SEQ ID NO: 314333 - RNA, 64 nt, Human
agcaugggugcccccagaaguaagcagcucuuggacccacgagcagggcugcgucgguuugugg

SEQ ID NO: 314334 - RNA, 64 nt, Human
auggaguucuucaugucugucaagccuugaggacacccacgaauggcaaaucuccacgcuagac

SEQ ID NO: 314335 - RNA, 64 nt, Human
auaaucagaucaaacaccugcuccuuauugccauacccacgaacuguuaaauauaaaaaaauuc

SEQ ID NO: 314336 - RNA, 64 nt, Human
gugacugaaacauucacacagggcucuuugauggacccacgaacgcucuuagcuuucucagggg

SEQ ID NO: 314337 - RNA, 64 nt, Human
guuuuucuggcauuuucuguuccagguuucuuccacccacgagcacuuuauucuccuccgagac

SEQ ID NO: 314338 - RNA, 64 nt, Human
aguuacauuccucuccacaaugaggcuaaaugucacccacgaaagaacuuuauucccuuauauu

SEQ ID NO: 314339 - RNA, 64 nt, Human
agggacaugggaagaccacgggaccucuuucacuacccacgaugaccuccggggguauccuggg

SEQ ID NO: 314340 - RNA, 64 nt, Human
gcccccgugauucaauuaccucccacuuggucccacccacgacacgugggaauugugggagcua

SEQ ID NO: 314341 - RNA, 64 nt, Human
augcccacggccuccuccuguagcuccugccugcacccacgaugcugcacgggcccgcccuggu

SEQ ID NO: 314342 - RNA, 64 nt, Human
acuuucaacagcagugagcccugggcagaugccccggccccagggcuucccccaggaacuccau

SEQ ID NO: 314343 - RNA, 53 nt, Human
gcuggcugcucaaguacuagccccggccccagcacccgccaggauguggagac

SEQ ID NO: 314344 - RNA, 64 nt, Human
ggugguugugaggaggccugucugcaucuccuuccggccccacugggguccaggggugcccaga

SEQ ID NO: 314345 - RNA, 64 nt, Human
gagacccaugugagccuuugcuuuccucuggccccggccccacccugaacacagcucauacaca

SEQ ID NO: 314346 - RNA, 64 nt, Human
ccuguccugcucacucaugggggcuuccagaccccggccccaccagggcuugugucauagggag

SEQ ID NO: 314347 - RNA, 64 nt, Human
uacaaucaguggggaaaagggcagaaccagugcccggccccacacugccucuguggccuggacu

SEQ ID NO: 314348 - RNA, 64 nt, Human
ccucagcagaacucucugacuggggccccuggcccggccccacccagccgacauguuuucuuug

SEQ ID NO: 314349 - RNA, 64 nt, Human
ccugccuagccaggcuggcacugccacucacacucggccccagggcccaggagggacagugccu

SEQ ID NO: 314350 - RNA, 64 nt, Human
ccgugcaagagucgagccggcagagcaaggggcgcggccccagggcccugcgcccacuuugcac

SEQ ID NO: 314351 - RNA, 64 nt, Human
ccaccucucuugucucucccucugaagauggacucggccccacauacacauuuuuguguuacag

SEQ ID NO: 314352 - RNA, 64 nt, Human
ccuccccagcaccugcccucccagucucccaccccggccccaggcuggaagcccucccuccacu

SEQ ID NO: 314353 - RNA, 64 nt, Human
agcacagccuuacgcgcccgacgcgcgccacccgcggccccagcuuuccgccugcacccgcgag

SEQ ID NO: 314354 - RNA, 64 nt, Human
agaacuacugggaucccuaaaaacgccccugguccggccccacucugcgccccucgaucuccca

SEQ ID NO: 314355 - RNA, 64 nt, Human
cacaagaaccugcgucuuggaccauugccccucccggccccaaaccacaggggcucaggucgug

SEQ ID NO: 314356 - RNA, 64 nt, Human
ggagcugcagauuccuccaugucagcucccaucacggccccaaagacagagucacuugguugcu

SEQ ID NO: 314357 - RNA, 64 nt, Human
ccagucacuuggucaucugagccuugaguguguccggccccagccaccagccuguccccacuau

SEQ ID NO: 314358 - RNA, 64 nt, Human
guuccgcguccucugugggggcugccggaagacacggccccaggagucaggccccuguggucag

SEQ ID NO: 314359 - RNA, 64 nt, Human
uagggaagcggcagcaucggaugucagcccccugcggccccagcuggagauggauaugagacua

SEQ ID NO: 314360 - RNA, 64 nt, Human
ccucaugcuagccuagucccuggaggagggaguccggccccaggccagggacuaaggagcaaug

SEQ ID NO: 314361 - RNA, 64 nt, Human
ggcucuuucuccaugggagcuccuggugccgccucggccccagccuguccccagccccucaauc

SEQ ID NO: 314362 - RNA, 64 nt, Human
gggcccagcucccacccagccugacggcgccucccggccccaagcugccuuccucgauguggcc

SEQ ID NO: 314363 - RNA, 64 nt, Human
uuucucuugcaggcuagcucccgcccugccugcccggccccaccgaggccugagcacguucccg

SEQ ID NO: 314364 - RNA, 64 nt, Human
guccugggccucagcuucccuucccacauuccuccggccccaggagcaaccccuugggcuaggu

SEQ ID NO: 314365 - RNA, 64 nt, Human
ugguuugugcgaguucccuugccacgcggggccccggccccaucaagucccucuggggacgucc

SEQ ID NO: 314366 - RNA, 64 nt, Human
ugcggucccggcucugugcgggccgcacccuggacggccccauccggacgcugaagcugccguu

SEQ ID NO: 314367 - RNA, 64 nt, Human
ccucccaccgcucagggcagggaggucugaacugcggccccagagccuuuggccuaagcuggac

SEQ ID NO: 314368 - RNA, 64 nt, Human
uuguuuguggggcuugugggaggggcacauacaucggccccaggauucuaacaucuccuggucu

SEQ ID NO: 314369 - RNA, 64 nt, Human
guuagggguuuugaacuagguggauacuaaaucucggccccacucuucauuggcuuaaccuaaa

SEQ ID NO: 314370 - RNA, 64 nt, Human
cuagccucaggugccacagccugguucggccuggcggccccaggaggcagcagcaaccuugggc

SEQ ID NO: 314371 - RNA, 64 nt, Human
uccuggaggaugugggagggcccuggacauggcccggccccacugcugagugcccgugucccca

SEQ ID NO: 314372 - RNA, 64 nt, Human
aggcuuccagcggugccugccacugaggcaggugcggccccaggaccaucaccaggaaugcgag

SEQ ID NO: 314373 - RNA, 64 nt, Human
acuacagcgccaacgagcagugccgcguggccuucggccccaaggcugucgccugcaccuucgc

SEQ ID NO: 314374 - RNA, 64 nt, Human
caggacagcacuuuuuauacagaggacaccgccucggccccacguccuuagaggccagagcaca

SEQ ID NO: 314375 - RNA, 64 nt, Human
ggccccauccgggauagggcagaggaggugcuggcggccccagggaaggaggguguguacccca

SEQ ID NO: 314376 - RNA, 64 nt, Human
cugagguuuuaugggccuguguauccccuucucccggccccagccugccucccuccugcccgcc

SEQ ID NO: 314377 - RNA, 58 nt, Human
uggaggcgcacacggagugacgggcgcccggccccacucuccggaucuggacgauggg

SEQ ID NO: 314378 - RNA, 64 nt, Human
ccugaacccgauucuggggagcaucuucccgcuccggccccacgaccuccacaggguuacauug

SEQ ID NO: 314379 - RNA, 64 nt, Human
uggggaaagacacugccugggcugaccccgguggcggccccagcaccucagccugcacaguguc

SEQ ID NO: 314380 - RNA, 64 nt, Human
guagggcccccagccagcgcuccagccaaagcggcggccccaggguuaauugcggagaacagga

SEQ ID NO: 314381 - RNA, 64 nt, Human
ccugugcugcugcaccaaccucacugcccucccucggccccacccacccucugguccuucugac

SEQ ID NO: 314382 - RNA, 64 nt, Human
guggauguguggauguggcccgagcaggcucaggcggccccacucacccacagcauccgccgcc

SEQ ID NO: 314383 - RNA, 64 nt, Human
aaaacacacauggccucgccaucguggguaaaaucggccccacagcacgucugcaccagcgggc

SEQ ID NO: 314384 - RNA, 64 nt, Human
ggccucugcagcugggugaccagagccccgggcacggccccagcuccguggggcucucacggug

SEQ ID NO: 314385 - RNA, 64 nt, Human
gggcaaacggaguacagacgucucaagacugaaacggccccauugccuggucuaguagcggauc

SEQ ID NO: 314386 - RNA, 64 nt, Human
ggaacauuguucucuauccuccccugacccccgacggccccaugcuaggugcaccaucuuccuc

SEQ ID NO: 314387 - RNA, 64 nt, Human
cagcacacauucugggaagcaucaaauagacacacggccccagccaccugcaacuuaugugcac

SEQ ID NO: 314388 - RNA, 64 nt, Human
uuauuguuugcuugcuugaaaccuaaucuauagacggccccacagcucgugcacacacugcuuc

SEQ ID NO: 314389 - RNA, 64 nt, Human
uccaaacacugguuccccacugcccugugccuuccggccccagaaggaucuuccuggaugccaa

SEQ ID NO: 314390 - RNA, 64 nt, Human
aaggcugcucuggugaggcagccucuguuuaaaccggccccacaugaagagaacaucccuugag

SEQ ID NO: 314391 - RNA, 64 nt, Human
ccaucaagccaaaccugcugccacagcccucccccggccccagauagcagccccagggaggaug

SEQ ID NO: 314392 - RNA, 64 nt, Human
uggugacaguuaccagcuuuccugaauggauucccggccccaucccucacccccacccucacuu

SEQ ID NO: 314393 - RNA, 64 nt, Human
cgaccuggccugccguugcccugagcugcagccucggccccaggauccugcucacagucaccgc

SEQ ID NO: 314394 - RNA, 64 nt, Human
cugaggcuccaggagggaauaucuguugccccugcggccccagacaccagccagacccaggcug

SEQ ID NO: 314395 - RNA, 64 nt, Human
cgggcgccaccgccacccgcagcgagggcggagccggccccaggugcuccccugacagucccuc

SEQ ID NO: 314396 - RNA, 64 nt, Human
ccccagcccgcggcacuaacgacaggcgaggccgcggccccagaguccccgcaccaggcagagc

SEQ ID NO: 314397 - RNA, 64 nt, Human
gaaaccaaauucaccguuaggaaacagugagcuccggccccaccucgugaacacaaagccucgg

SEQ ID NO: 314398 - RNA, 64 nt, Human
cacccggccagcccuguugucuuucaaagaaccucggccccagugauggcugaucucacuccca

SEQ ID NO: 314399 - RNA, 64 nt, Human
uguuucuauauuguagcuuugcuuaaaauggggucggccccaacugcauccuccucuuuggcgg

SEQ ID NO: 314400 - RNA, 53 nt, Human
acccagcaauugaggugugauggcggccccaccccaacuaccaccucuuuuca

SEQ ID NO: 314401 - RNA, 64 nt, Human
caggaugaacuggcucugagcacccugccgcccgcggccccagcuucaggacaagccccugcuu

SEQ ID NO: 314402 - RNA, 64 nt, Human
acaggucacugccugaccuggacuaagaaccccacggccccacuguccacacacugccucccca

SEQ ID NO: 314403 - RNA, 64 nt, Human
gaaaaaaguaaaacuguacuguugcgugugcaagcggccccacuagagccuuccagccuucugg

SEQ ID NO: 314404 - RNA, 64 nt, Human
ccaaccugauaauucauuuuggauaggccuuucucggccccagacugagguaccauggcucugg

SEQ ID NO: 314405 - RNA, 64 nt, Human
cuguacacgugguguugggacuggaaccauuaugcggccccauaggccucaggagucaucccag

SEQ ID NO: 314406 - RNA, 64 nt, Human
gccgccccuccugccgcccagcuucgugacuccacggccccacgcgccccuugcugccuuccgc

SEQ ID NO: 314407 - RNA, 64 nt, Human
augugggcuggggggcggggcggggagcggcaggcggccccacccugcacugguccaaggucgg

SEQ ID NO: 314408 - RNA, 64 nt, Human
cccaggacgugcugcucccuugugugagugaccacggccccaagcccagggcuggaggcagguc

SEQ ID NO: 314409 - RNA, 64 nt, Human
gcugccugcguccucucggugagcugugcagugccggccccagauccucacacccagggagcag

SEQ ID NO: 314410 - RNA, 64 nt, Human
ugggaaaacacuagagcugcagguaccagccacucggccccaggggguuauggccacagaggga

SEQ ID NO: 314411 - RNA, 64 nt, Human
cgcuggcucgccccuugacuggcuaaguggggcccggccccagcuggaucgaagggcggguugc

SEQ ID NO: 314412 - RNA, 64 nt, Human
gugguccacguccugccucucccugggguuuacacggccccaauaaagccugcucuggccuacg

SEQ ID NO: 314413 - RNA, 64 nt, Human
agcccuugcugccacaccacauugccucaacaaccggccccagagugcccaggcacuccugagg

SEQ ID NO: 314414 - RNA, 64 nt, Human
cgcccacugcuccucagcguccaguccuccugggcggccccagguccuggacaauaagcaacag

SEQ ID NO: 314415 - RNA, 64 nt, Human
ggagugaaaccuuuagggcagcuugccccggccccggccccagccagaguuccugcggagugaa

SEQ ID NO: 314416 - RNA, 64 nt, Human
cucccugggugcccccccucucccuucuccuucccggccccaccaacacucugagauccgagag

SEQ ID NO: 314417 - RNA, 64 nt, Human
gaacacucagcuauuacugcgcuuucccuccccacggccccaacuccagggcaggagcaacugg

SEQ ID NO: 314418 - RNA, 64 nt, Human
ggucuccggcuccuccuugcggcgcugacccggccggccccacacccgcucuuccucuucuuug

SEQ ID NO: 314419 - RNA, 64 nt, Human
ugggcucggcggggccccacucagagcagcuggccggccccaggcagugagggccuuagcaccu

SEQ ID NO: 314420 - RNA, 64 nt, Human
ccuuccugccggggugggaagaguuucucuccaucggccccaugcgggucaccucccuaguccc

SEQ ID NO: 314421 - RNA, 64 nt, Human
uggccccacucacaccauccuaugagcccacgcccggccccacucccaccauccugugaacccc

SEQ ID NO: 314422 - RNA, 64 nt, Human
cggccccauucacuccauccugugagaccacgcccggccccacucacucuauccugugagacca

SEQ ID NO: 314423 - RNA, 64 nt, Human
cggccccacucacaacaucuuguaagacugugcccggccccauucacuccauccugugagacca

SEQ ID NO: 314424 - RNA, 64 nt, Human
agccccacucacaccaaccugugagccccacucccggccccacucacaacaucuuguaagacug

SEQ ID NO: 314425 - RNA, 64 nt, Human
agccccacucccaccauccugugagccccacucccggccccacucacuccauccugugagcccc

SEQ ID NO: 314426 - RNA, 64 nt, Human
ggccccacucacaccaaccugugagccccacucccggccccacucacuccaucuuguaagacua

SEQ ID NO: 314427 - RNA, 64 nt, Human
cagccccacucccaccauccugugagcccaugcccggccccacucacaccaaccugugagcccc

SEQ ID NO: 314428 - RNA, 64 nt, Human
cggccccucucacaccauccugugagaccacgcccggccccacucccaccaucuuguaagacug

SEQ ID NO: 314429 - RNA, 64 nt, Human
uuuccccgaguccucagguacagcgggcugugcccggccccacccccugggcagauguccccca

SEQ ID NO: 314430 - RNA, 64 nt, Human
aucccaaccccauugcuaacaacaugguacauuccggccccaccacucagagccuuccgaagcc

SEQ ID NO: 314431 - RNA, 64 nt, Human
ccaucaucugcacacccgggcagugcucagagcccggccccaggcccccgcgcuccucacuccu

SEQ ID NO: 314432 - RNA, 64 nt, Human
ccaggcugcugcccugcccagcccgacccugccccggccccacuuccaccuugcgcauuuggua

SEQ ID NO: 314433 - RNA, 64 nt, Human
cucucucagccccaucgccccaacuccaaccucucggccccaucgccccaccgcagcuacuccc

SEQ ID NO: 314434 - RNA, 64 nt, Human
uuccuuaccuaaagguuccuugauauguccucuccggccccacuucguucucaguuccacuggu

SEQ ID NO: 314435 - RNA, 64 nt, Human
cccugccucuggggagggggccaucugcugcgcccggccccacugacagaucugaagagcacag

SEQ ID NO: 314436 - RNA, 64 nt, Human
agcagaccauuggggcucccagccaggcccuugucggccccaccagugccucucccugcugcuc

SEQ ID NO: 314437 - RNA, 64 nt, Human
cggguucuugcaacacugugaggggcagccagggcggccccaauaaagcccuugaauacuuuga

SEQ ID NO: 314438 - RNA, 64 nt, Human
cuuugcccccaggaaaggacgcauccaccgguagcggccccagcugacugucgccgugugcugg

SEQ ID NO: 314439 - RNA, 64 nt, Human
gagccgaccccucccgggaccccucccggcugggcggccccacagacccgcuggaacccagcag

SEQ ID NO: 314440 - RNA, 64 nt, Human
gagagcaccacccuccccgacacacagguucaugcggccccaggggccucccuccuguugaaga

SEQ ID NO: 314441 - RNA, 64 nt, Human
uccgggacaaguggucugggacagggaggagcaacggccccagcgcgcaacgcucugcgcguuc

SEQ ID NO: 314442 - RNA, 64 nt, Human
cuucaaguauccucagaaauguauucugcacccccggccccacccaugcugagggaaggggagc

SEQ ID NO: 314443 - RNA, 64 nt, Human
caccgggccgggagagcuucccugacgggagucgcggccccaccgaggcgucggccgcccgaag

SEQ ID NO: 314444 - RNA, 64 nt, Human
acccggacucccuuucugccaccccaggcugguccggccccaggugugggguccgcucucucca

SEQ ID NO: 314445 - RNA, 64 nt, Human
guucuuccuccaccacccuacaccccccuccccccggccccaagccccugugucuccuuguuac

SEQ ID NO: 314446 - RNA, 64 nt, Human
gaaugacuccgaugagcugcucaucgaccuggagcggccccagagcaacagcagcgcugucaca

SEQ ID NO: 314447 - RNA, 64 nt, Human
ugguccucccgagcuccgacagcauuaccucacccggccccaucuguugccccgguccagcccu

SEQ ID NO: 314448 - RNA, 64 nt, Human
gaacgcagacugcaggggccgcgccuggcucaggcggccccacccccgggacguggggucacuu

SEQ ID NO: 314449 - RNA, 64 nt, Human
cucccagcccaucccuccggccccugugccucugcggccccagcccagcucccagggccgucac

SEQ ID NO: 314450 - RNA, 64 nt, Human
ccuagggcgacaggagccagcgggacgccgcacgcggccccagacucagggagcagggccaggc

SEQ ID NO: 314451 - RNA, 64 nt, Human
aaucaaaagcucaagagugacgugaggugggcaccggccccaagugcagagucaaggcagggag

SEQ ID NO: 314452 - RNA, 64 nt, Human
accugccauguuuacagagggccccugggcugcgcggccccagccugggcacccugauuuuuaa

SEQ ID NO: 314453 - RNA, 64 nt, Human
cucccccagcccuggaccccagcagaugaggaaacggccccauuuacugaccccgcccccuuuu

SEQ ID NO: 314454 - RNA, 64 nt, Human
uccccagaauggaggcaacgccagaauccagcaccggccccauuuacccaacucuguacaaagc

SEQ ID NO: 314455 - RNA, 64 nt, Human
acccaccuguguaaugucaaaaaaaaucaauaugcggccccauuuuguaaaggaucauuaaaau

SEQ ID NO: 314456 - RNA, 64 nt, Human
gcugccugcuggagccgccugcagacgcgguccucggccccacgugaaccaggcucggcggcga

SEQ ID NO: 314457 - RNA, 64 nt, Human
gcagagggaggagggggcacagcugugccaagcccggccccacugguguguccucacaauguga

SEQ ID NO: 314458 - RNA, 64 nt, Human
guaguagaauaaaacuagccuaguccugucccuccggccccaguggagacaggcgucuaagaac

SEQ ID NO: 314459 - RNA, 64 nt, Human
ggcggcgaagguggguggggccccucuguaaauacggccccaggguggugagagagucccaugc

SEQ ID NO: 314460 - RNA, 64 nt, Human
acaguagaaggggaaagccuucaucuuggcgaaccggccccaccacccccuccuacccgggccu

SEQ ID NO: 314461 - RNA, 64 nt, Human
ugggagcccucgcaccgcuccccaccccacucagcggccccaucggaacugagaauugcaaaac

SEQ ID NO: 314462 - RNA, 64 nt, Human
cugggacugacagccugcaggguuuccuugggcgcggccccaaaauugccuucaaaacaaaccc

SEQ ID NO: 314463 - RNA, 64 nt, Human
gcuucugaaccccucggccccgcccccguggacccggccccaccccgaauaccccggccacgcu

SEQ ID NO: 314464 - RNA, 64 nt, Human
ggucccgccccgccccgccccgccccggcaggcccggccccaccccgccccgcccccgcugccu

SEQ ID NO: 314465 - RNA, 64 nt, Human
gggagcggccugccucaccccugaauagcuccuucggccccaucuccauccucagcagaugaca

SEQ ID NO: 314466 - RNA, 64 nt, Human
caaggucaggcuccuggggcccuagaagccggggcggccccagcggggaggaggagcaaggaca

SEQ ID NO: 314467 - RNA, 64 nt, Human
gccugguguccacacggugcauuccugucccccucggccccaggcuggcucagcucuccagugc

SEQ ID NO: 314468 - RNA, 64 nt, Human
guggacuuggugagcgccgccccaacgagacucgcggccccaggcccaggccccaccccggcgg

SEQ ID NO: 314469 - RNA, 64 nt, Human
uagucccagacuaccccggacccugucccugccgcggccccagccuugaccuguuugacuugag

SEQ ID NO: 314470 - RNA, 64 nt, Human
cuacucagcgugacccaacuuuucuagugugccacggccccaccaccuccugcaguacccacac

SEQ ID NO: 314471 - RNA, 64 nt, Human
cccuggacagccaugccagagagaggccuuugaccggccccagagcuaaaagcaccagagaaaa

SEQ ID NO: 314472 - RNA, 64 nt, Human
uccugcauucccacccagcgcgcagucuccaccucggccccagcaaagcgcuaagcagccggag

SEQ ID NO: 314473 - RNA, 64 nt, Human
acggaggacugaggucgccgggaccacccugagccggccccaggcucguggacugagugggaag

SEQ ID NO: 314474 - RNA, 64 nt, Human
gcucagggcugcccagcgcccagcgugcacgggacggccccacgacagagggagucagcccggg

SEQ ID NO: 314475 - RNA, 64 nt, Human
gguguccgaggcgacgcaccucgaggguguccgccggccccagcacccaggggacgcgcuggaa

SEQ ID NO: 314476 - RNA, 64 nt, Human
agcgugcugggauuauaggcaugagccaccaggccggccccaggauuuuauauuaagccuucuu

SEQ ID NO: 314477 - RNA, 64 nt, Human
gccugggcauggccugggucgcacccccuccccacggccccacccacagggaccucaacuucug

SEQ ID NO: 314478 - RNA, 64 nt, Human
accagagcggaaggagggacuucccaccggcauccggccccagugccauguuuuaucaucugga

SEQ ID NO: 314479 - RNA, 64 nt, Human
ccacaggugcugggcuuuagagaacaugggaaggcggccccagaccugcgggaacgccuuuccc

SEQ ID NO: 314480 - RNA, 64 nt, Human
guagaaaucagccgggaugccugcaucccacccccggccccagggcccaccacauaaaaucugg

SEQ ID NO: 314481 - RNA, 64 nt, Human
gaacuaaagugcugcacucaaaugaugggaaguccggccccaguacacaggggcuugacuuuuu

SEQ ID NO: 314482 - RNA, 64 nt, Human
uugccuccuguugaauugccccugggccugcccccggccccauuugugccauaaaggguugcuu

SEQ ID NO: 314483 - RNA, 64 nt, Human
cagcaaggcagucccaggccugccgucuccagcacggccccaagguggacacuagccccugcug

SEQ ID NO: 314484 - RNA, 64 nt, Human
cuuguucacauaccaccuucguccccccaggccccggccccacuccuggcucucauuauuuuua

SEQ ID NO: 314485 - RNA, 64 nt, Human
gcugcucucacccugaggguccccagccucucaccggccccagcugaccucguccauucagccc

SEQ ID NO: 314486 - RNA, 64 nt, Human
ucacccucacauucaaggcccuuccugucuuggccggccccacugcccccccauucuaugcccc

SEQ ID NO: 314487 - RNA, 64 nt, Human
agcccauccccuagacacccucuguuuccuuucccggccccaccuggccggcccucugccccug

SEQ ID NO: 314488 - RNA, 64 nt, Human
cgggggcggcgacugccgagcuccgcccuccaggcggccccacccgccugccguccuggggcgc

SEQ ID NO: 314489 - RNA, 64 nt, Human
gaccgacgcggacaacugacccgccaggcgggagcggccccacacguguuugcuuaaagucugc

SEQ ID NO: 314490 - RNA, 64 nt, Human; identical to SEQ ID NO: 313213

SEQ ID NO: 314491 - RNA, 64 nt, Human
cuaggcuguucagggaggcagcucauuuccaccccggccccaggacacccagccugugccccac

SEQ ID NO: 314492 - RNA, 64 nt, Human
ccgcaucuugaucaggcuuucucaagcccuccaucggccccaccagaucuccauucuuugccau

SEQ ID NO: 314493 - RNA, 64 nt, Human
cagucaccuccgcugucaccacauccugagcacucggccccauccccccacaggagggaagcug

SEQ ID NO: 314494 - RNA, 64 nt, Human
aucccauuugcccuccuccucagcuagggccacgcggccccacauugcacuucuggggggugac

SEQ ID NO: 314495 - RNA, 64 nt, Human
ugaggaggaaugggccccucgaagugggccgggccggccccaccugccucugcccagauuugcc

SEQ ID NO: 314496 - RNA, 64 nt, Human
ucuccugccucucccauggcuuacagcuucuacccggccccaaggcuacccaguauuuuaucgu

SEQ ID NO: 314497 - RNA, 64 nt, Human
acaucccccaauccaucagugccaaacuagccaacggccccagcuucucagcucgcuggauggc

SEQ ID NO: 314498 - RNA, 64 nt, Human
uuuuuuuauuuguuguuuguuuuccaugagguuaucggaccaugggcugagcucaggcacuuuc

SEQ ID NO: 314499 - RNA, 64 nt, Human
aguaaugucuuuaaaggcaaagggaaggguaaagucggaccagugucaaggaaaguuuguuuua

SEQ ID NO: 314500 - RNA, 64 nt, Human
ccugacgcucauagaggccauuccuuccugggugucggaccagggcucugugucagggaaaacc

SEQ ID NO: 314501 - RNA, 64 nt, Human
cugauauucaggggcauugcucauugcucccuucucggaccagccuucuuccucccaccauggc

SEQ ID NO: 314502 - RNA, 64 nt, Human
acccacagacaaaaaaauauauauauuccuaaagucggaccagaaaucugacagcugccuuuga

SEQ ID NO: 314503 - RNA, 64 nt, Human
ugcagaggggagccuucuggagaagcugcugggaucggaccagccacuguggcagaugggagcc

SEQ ID NO: 314504 - RNA, 64 nt, Human
agacgcagacaaggccugagcagugcucucggcaucggaccaaagccugggcacacccugccuc

SEQ ID NO: 314505 - RNA, 64 nt, Human
gccuucucccugggggugauucaaggauuuggucucggaccagaccccccuccacagcugcccg

SEQ ID NO: 314506 - RNA, 64 nt, Human
ucacugaacuuugcugagccuguaaaauaaaaggucggaccagcuuuucccaaaagcccauuca

SEQ ID NO: 314507 - RNA, 64 nt, Human
ggccccauacugagccuggacugaaaguauccacucggaccaucuguuaucucucuacacugaa

SEQ ID NO: 314508 - RNA, 64 nt, Human
agcagcugccugggugaagcaucugcuggacaagucggaccacuggccaggggaccuuugauug

SEQ ID NO: 314509 - RNA, 64 nt, Human
uccuucccgcuucccccgacuucacacggcggcuucggaccaacucccucacucccgcccgagg

SEQ ID NO: 314510 - RNA, 64 nt, Human
aguacggcccucagccagucgcuaugcagcacuuucggaccagggacuagacaucaaagcagcg

SEQ ID NO: 314511 - RNA, 64 nt, Human
agccucggcgccugggcagagggcccggaaacccucggaccagaguguguggaggaggcaucug

SEQ ID NO: 314512 - RNA, 64 nt, Human
caucagggcccagggagcccccagaggacuuuauucggaccaagcagagcucacagcuggacag

SEQ ID NO: 314513 - RNA, 64 nt, Human
gugauauggcucuucgcaugcugaguacuggaccucggaccagagccauguaagaaaaggccug

SEQ ID NO: 314514 - RNA, 64 nt, Human
uauuucucauaaugcagcauugugagaagucaguucggaccacugcaccaacacugucguaucc

SEQ ID NO: 314515 - RNA, 64 nt, Human
gacccacaagugccucccgagccuagauccuggcucggaccacugcaagggccgaggcagggcc

SEQ ID NO: 314516 - RNA, 64 nt, Human
cgucuuacucccgcugcuuguucuguccccucccucggaccaaacagugcucaugcuucaggac

SEQ ID NO: 314517 - RNA, 64 nt, Human
acgagggagcuccuggccagcagccgucauccucucggaccagccagcugguccucugggaaca

SEQ ID NO: 314518 - RNA, 50 nt, Human
uuuggcuuccugccacaugaucggaccaucggcucuggggaauccuggug

SEQ ID NO: 314519 - RNA, 64 nt, Human
agcagggcaucgcauggaccgcaggagggcagauucggaccacuaggccugaaaugacauuuca

SEQ ID NO: 314520 - RNA, 64 nt, Human
gggaagagugaucuaugucucuucccccagcagcucggaccacucccagccccccauccccccg

SEQ ID NO: 314521 - RNA, 64 nt, Human
gacaaucaucuggacaacagccacaagggggcgcucggaccaggcagccacuuuccuggugcuc

SEQ ID NO: 314522 - RNA, 64 nt, Human
caacugccugagaggacacaaugggggaggggcuucggaccacagcaggagccccgacugccca

SEQ ID NO: 314523 - RNA, 64 nt, Human
uuuauaugccacggacacuccuuagagcccggauucggaccacuuggggaucccagaaccuccc

SEQ ID NO: 314524 - RNA, 64 nt, Human
uggcaccugggcugcuggagaagucuccucccguucggaccagccucagggcugcacguuaccu

SEQ ID NO: 314525 - RNA, 64 nt, Human
gagacacaagucacaaauccaggcuucugaaacuucggaccaaccagcuucaaucaggguuccc

SEQ ID NO: 314526 - RNA, 64 nt, Human
ugcuccaucgugcaggucuggccuaggcccgggaucggaccaggcucccucaggaccccauccu

SEQ ID NO: 314527 - RNA, 64 nt, Human
agcugaggaggaggcugugugugauggcucuggcucggaccaaccagaugagccuccugaagcc

SEQ ID NO: 314528 - RNA, 64 nt, Human
ggccaguaaaugccagccauuucucaaacccaccucggaccacccagaguuuccucuugguccc

SEQ ID NO: 314529 - RNA, 64 nt, Human
gcccaggauccucagaggaagauggagaggagcuucggaccaagaucaaaccaaacagugggga

SEQ ID NO: 314530 - RNA, 64 nt, Human
ccucucacaggccuuggcuuggaaggcuggagcuucggaccaaggcccagcccugucaccuccu

SEQ ID NO: 314531 - RNA, 64 nt, Human
auggcuagaagggaacccguugugcagcaccuucucggaccagucugccuauguaaggucagug

SEQ ID NO: 314532 - RNA, 64 nt, Human
gcacuaccaaggccgaccacuagaggucagcgucgcgccgcacucuucacccgcauguccagag

SEQ ID NO: 314533 - RNA, 64 nt, Human
aggcuggugccccugcugauguggccugcucugugcgccgcaagaagccaggcccggcccuggc

SEQ ID NO: 314534 - RNA, 64 nt, Human
ucccuggagcucugauccuggaaccccucccucugcgccgcagcuggacgccaccuccgacgga

SEQ ID NO: 314535 - RNA, 64 nt, Human
cugcuuccuccuccacuccuggccgccuucuccagcgccgcacacacagaugcucagucucaga

SEQ ID NO: 314536 - RNA, 64 nt, Human
gccaucaguugcucuugcugaccccucggagcaagcgccgcacaggugguggcugagacagcug

SEQ ID NO: 314537 - RNA, 64 nt, Human
ccgcggugacggggcucuccguggaggaaguggugcgccgcagcgcgggcaugaacacugcucg

SEQ ID NO: 314538 - RNA, 64 nt, Human
agagggcggcuguagagcacccucaggagaaguggcgccgcaggggucacgcaugguccagccc

SEQ ID NO: 314539 - RNA, 64 nt, Human
ucucgccugagacggggcaccuagcccugggcgagcgccgcacccgggcccgcagcggcaccgc

SEQ ID NO: 314540 - RNA, 64 nt, Human
cccuccgcccuccgcuggcuccgagguggugggggcgccgcacgcuccaucccuuucccucgcu

SEQ ID NO: 314541 - RNA, 64 nt, Human
gagaaucacacagagucuucuguagggguauggugcgccgcaugacaugggaggcgauggggac

SEQ ID NO: 314542 - RNA, 64 nt, Human
cccggcggggcccaggacggggcacaagugucaggcgccgcacuuccuuuuaccugcccaagga

SEQ ID NO: 314543 - RNA, 60 nt, Human
acagcauuuacugugauuaggggcuguggggcgccgcacgcugcagcuaacaucugcuuc

SEQ ID NO: 314544 - RNA, 64 nt, Human
cgaugaugccguuggggcggaggcugcccuugcagcgccgcaggaacucggccaggugcugauc

SEQ ID NO: 314545 - RNA, 50 nt, Human
acgacaccucgcucaccugagcgccgcaccgcuucagggacggagacagg

SEQ ID NO: 314546 - RNA, 64 nt, Human
cccgcaggaagagcagccacgccuggaccgcgccgcgccgcagccccacacgccagcucggcug

SEQ ID NO: 314547 - RNA, 64 nt, Human
cggaagacccgagccugccggggggaggccggcggcgccgcaccugcccgccucggcguucgug

SEQ ID NO: 314548 - RNA, 64 nt, Human
ccugccucagcaugcuucgaaaggcagcuucccugcgccgcauccugcgugccuccuccuucuc

SEQ ID NO: 314549 - RNA, 64 nt, Human
cggccccgcccaugaggacuaggagcccagccuugcgccgcauucgcacugggggacaugggag

SEQ ID NO: 314550 - RNA, 64 nt, Human
ucuguacuaaaauacaaacaaguagcugguuguggcgccgcaugccuguagucccagcuacucg

SEQ ID NO: 314551 - RNA, 64 nt, Human
gacggacgggagcuccacugugaaucggcggcacgcgccgcaggaggcugggacugguccaguu

SEQ ID NO: 314552 - RNA, 64 nt, Human
ccuguuuuucuuuuccguugcuggcaguacuguugcgccgcaguuuggagucacuguaguuaag

SEQ ID NO: 314553 - RNA, 64 nt, Human
agcaggcggugggcacccacccugggaccuaggggcgccgcaaaccacacuggacuccggcccu

SEQ ID NO: 314554 - RNA, 53 nt, Human
ccuuugcagaucuguacugaggggcgccgcagcuggccggggccgcccugccc

SEQ ID NO: 314555 - RNA, 64 nt, Human
agcacccgcgggcaccacuuucgugcaguaccaggcgccgcagcugcagccugacaggaugcag

SEQ ID NO: 314556 - RNA, 64 nt, Human
guacggagccaucuugcaggugaggggggugugagcgccgcagcaccaguggcuuuagggccug

SEQ ID NO: 314557 - RNA, 64 nt, Human
caguuccuuugaucucgcuguaagauuugucaaggcugacuacucacuucuccuuuaaauucuu

SEQ ID NO: 314558 - RNA, 64 nt, Human
ucaggaaguucacuguuagaaauaggcuuuguuagcugacuagggucagggaaacuuuucucuu

SEQ ID NO: 314559 - RNA, 64 nt, Human
uuaugagaaagaggcaugaccugacugcacuguugcugacuacuacucugccaaucggcuaccc

SEQ ID NO: 314560 - RNA, 64 nt, Human
gcacuacccaugaggaauucguggaauggcuacugcugacuaacaugaugcacauaaccaaaug

SEQ ID NO: 314561 - RNA, 64 nt, Human
uauguauuuaguguuuuguauaauaccaagaaccgcugacuaaauuuacucaaauuagggcauu

SEQ ID NO: 314562 - RNA, 64 nt, Human
uauuuucaugcuuuucaaacaacaugaauagucagcugacuaaagacuguguguguugugguaa

SEQ ID NO: 314563 - RNA, 64 nt, Human
gagccagcacccucagaugauuucccuccaaacugcugacuaggucauccucugucugguagag

SEQ ID NO: 314564 - RNA, 64 nt, Human
ugggagagccugggcaggaucccaucagaaaggugcugacuaaacugguugcccggacacucaa

SEQ ID NO: 314565 - RNA, 64 nt, Human
acuuggccuuguggaugggccccuuacaguauuugcugacuagucucauuuuuaggugauaaau

SEQ ID NO: 314566 - RNA, 64 nt, Human
uaccuuucacagcuuuuaucaggccaaguuaaaggcugacuacauuuuuucaucaugaggaaag

SEQ ID NO: 314567 - RNA, 64 nt, Human
auauaaauauauuuuuuucuuagacuaaauaugagcugacuaucucuuuugauguguguacaua

SEQ ID NO: 314568 - RNA, 64 nt, Human
cucccaauagggauaaauuuagggugacuguguggcugacuauucugcuuccucaggcaacacu

SEQ ID NO: 314569 - RNA, 64 nt, Human
ugucuacagagaaccuggaguuccugaaccugaugcugacuagugaggaaagauuuuuguuguu

SEQ ID NO: 314570 - RNA, 64 nt, Human
ucucauggguggcacucagucucucuucucuccagcugacuaaacuuuuuuucuguaccaguua

SEQ ID NO: 314571 - RNA, 64 nt, Human
uuuuccccugaauuacccaucaaauugaucugcagcugacuaaaggccacagcugagccuggaa

SEQ ID NO: 314572 - RNA, 64 nt, Human
caucaucaauaaaacaguuggcaugcaucccacugcugacuauaaugccucuccuuaaaugcuu

SEQ ID NO: 314573 - RNA, 64 nt, Human
ugcuacaaaacuugaauauaacacauuuuggaaggcugacuaaccucgauucuguguugugaug

SEQ ID NO: 314574 - RNA, 64 nt, Human
uuaacuguguuaaaguacuugaaauguauugacugcugacuauauuuuaaaaacaaaaugaaau

SEQ ID NO: 314575 - RNA, 64 nt, Human
aauaguucaguauaaauugucguuuuuuucuugugcugacuaacuauaagcaugaucuuguuaa

SEQ ID NO: 314576 - RNA, 64 nt, Human
guaugaugucuuucaaacuuagacauauuugagagcugacuacaaacauuaaaucgcacuuuua

SEQ ID NO: 314577 - RNA, 64 nt, Human
ugaucuguuuuaaaguuggggggugggaaauuuagcugacuagggacaaacauguaaaccuauu

SEQ ID NO: 314578 - RNA, 56 nt, Human
cgcuguccacggaccugugagcugcugcugacuagggcugcaugggagagccaggg

SEQ ID NO: 314579 - RNA, 64 nt, Human
ccugcguaugcacaugcucagaauugucuacuaggcugacuauguaucaccucuucagcuugga

SEQ ID NO: 314580 - RNA, 64 nt, Human
aaguucccuaugaaaaauguguuccauugccauagcugacuacaaauuaaaguugaggagguuu

SEQ ID NO: 314581 - RNA, 64 nt, Human
cacugccaggacccaccacuggaagcaggauggagcugacuacggaacugcacacucagugggc

SEQ ID NO: 314582 - RNA, 64 nt, Human
auuuaaucaugugaaacuuuuccuagaugcaaaugcugacuaauaaagacaaagccacccugaa

SEQ ID NO: 314583 - RNA, 64 nt, Human
gcuaccugauggaauuccugcacuuaaaguucuggcugacuaaacaagauauaucauuuucuuu

SEQ ID NO: 314584 - RNA, 64 nt, Human
gauuuuaaugaaacauggauaguuguggccaccugcugacuauuugugguuuaaaauaaaaggu

SEQ ID NO: 314585 - RNA, 64 nt, Human
ggucuuacaucugugugguauaguagaaaggccagcugacuagaucucuggauucuaauuuugg

SEQ ID NO: 314586 - RNA, 64 nt, Human
aaaagacaagagaauuugguuauaaaagaaaugggcugacuaggcaugauuuuuuuggucuuaa

SEQ ID NO: 314587 - RNA, 64 nt, Human
agggguucuuagucucagcacuaugacauuuugggcugacuacuuauuuguuaggcgggagcuc

SEQ ID NO: 314588 - RNA, 64 nt, Human
cuccacgcccugcccccugcauccccuagagacagcugacuagcagcugcccagcugucaaggu

SEQ ID NO: 314589 - RNA, 64 nt, Human
aaagaaccguuaagugaacuauuauaauauuuuugcugacuacccaguugaagaaaaguuuguu

SEQ ID NO: 314590 - RNA, 64 nt, Human
gcagacauuuccaaguuuguugaaauaauacgaagcugacuagcuuacgugaaugauguugccc

SEQ ID NO: 314591 - RNA, 64 nt, Human
aauucucuguuaucuuuacgagguaaaacugcaagcugacuagcauguucugugaaucugccau

SEQ ID NO: 314592 - RNA, 64 nt, Human
aagauuccagaugagcuguucaugugggccccuugcugacuauauuccagccacuucaggguug

SEQ ID NO: 314593 - RNA, 64 nt, Human
caucugugaauggaacugaagugaacgugaauaugcugacuauauccuggaagcauuuuuauac

SEQ ID NO: 314594 - RNA, 64 nt, Human
ggccacucaacagagaggaccaacauccaguccugcugacuauuugacccccacaacaaugggu

SEQ ID NO: 314595 - RNA, 64 nt, Human
gggacugagagacaggacuagcuggauuuccuaggcugacuaagaaucccuaagccuagcuggg

SEQ ID NO: 314596 - RNA, 64 nt, Human
ucccacccaugagggcugcaggcacuacaaaagagcugacuacugagaauucuggaaaacaagg

SEQ ID NO: 314597 - RNA, 64 nt, Human
ucacagauguguuaauuuuugaagcaaugugggugcugacuacuaguaguaucaaaaauauguu

SEQ ID NO: 314598 - RNA, 64 nt, Human
cugccauguguuuuuuauuuuguuuuuuagcagugcugacuaagccgaaguuuuguaagguaca

SEQ ID NO: 314599 - RNA, 64 nt, Human
gagucuauacaaaggcuugcuaaguguguuuccugcugacuacaacccucuccuguuuacugaa

SEQ ID NO: 314600 - RNA, 64 nt, Human
uugucagaaucuuccuuuggacaaaacaucacuagcugacuauaaaaacaaaagugucaucauu

SEQ ID NO: 314601 - RNA, 64 nt, Human
agugggaucaaugccggcggccucugugaugguugcugacuaauccgggauuucaugagucaga

SEQ ID NO: 314602 - RNA, 64 nt, Human
gcaacgugacucuguuuuuuguguguguuuccaugcugacuaguccccuacuguuaauaucacu

SEQ ID NO: 314603 - RNA, 64 nt, Human
agauggcuacagaccagagauuccacgcucucaggcugacuagaguccgcaucucaucuccaaa

SEQ ID NO: 314604 - RNA, 64 nt, Human
auucauggaccacuguuucuugcuuguaccucuggcugacuaaauuuggggacagauucagucu

SEQ ID NO: 314605 - RNA, 64 nt, Human
gacaugguucccuacuagggauuauacaguauuugcugacuacuuccuaagagccaaaaauaaa

SEQ ID NO: 314606 - RNA, 64 nt, Human
aggaaggccaagccauuacgggagcacagcaugugcugacuacuguacuuccagaccccugccc

SEQ ID NO: 314607 - RNA, 64 nt, Human
ucaagugcuuaaaauuaauguaauuaaaagcuuagcugacuacagaauaggugaggguuucuua

SEQ ID NO: 314608 - RNA, 64 nt, Human
uuguaugucugugugccccuccugccccgaaagugcugacuauggggaaaucuuuuagcugcug

SEQ ID NO: 314609 - RNA, 64 nt, Human
ggugcuggaccaccuggucggggaggagaccauggcugacuaccugcuguacacccucaacaaa

SEQ ID NO: 314610 - RNA, 64 nt, Human
uacaaauugcaguggcuaggaccuccagcagaaugcugacuauaaguagugauaguggguauuc

SEQ ID NO: 314611 - RNA, 58 nt, Human
gaccugaguuugugcuguaagacaaaaugcugacuacuguagaaaaaaaggucaugau

SEQ ID NO: 314612 - RNA, 64 nt, Human
ccugccaggcacaggcagggcaggaccagcccacgcugacuacagggccgccggcaauaaaagc

SEQ ID NO: 314613 - RNA, 64 nt, Human
ugauggggcugcccucaguccucuagaucaagaugcugacuauuagggggcagugauugccauc

SEQ ID NO: 314614 - RNA, 64 nt, Human
ucugauccaagcauauuugcuuggggaacuaagugcugacuaguuuguuuucuaugucaagggg

SEQ ID NO: 314615 - RNA, 64 nt, Human
cuugagcucacuacucaauugugcagcuuaauaugcugacuagggacauuccccuauggauuau

SEQ ID NO: 314616 - RNA, 64 nt, Human
gggacauauaaacauuaagucuguaguagcagcagcugacuaacgagggagauagggagauucu

SEQ ID NO: 314617 - RNA, 64 nt, Human
uuauuuaauauuuucuaaucugaacccauauacagcugacuaauucauucuuagaaauguguua

SEQ ID NO: 314618 - RNA, 64 nt, Human
ugaucauuggcauccugggcguuucuugcccucugcugacuacugauuggauuuuaccuauggc

SEQ ID NO: 314619 - RNA, 64 nt, Human
caaacagaaagcaccgucgagaaauggcuccagcgcugacuagcggccaccucauuuccccccu

SEQ ID NO: 314620 - RNA, 64 nt, Human
agguaggggacuaguggaucuuaucauaguuuuggcugacuaugcagggcuuaaaaggccagcg

SEQ ID NO: 314621 - RNA, 64 nt, Human
cuuuaacuguuagucuuaaauaguugggacaucagcugacuaauagaccucagccucaaaaggc

SEQ ID NO: 314622 - RNA, 64 nt, Human
ugcuaaaucgauaggagucaguuuugucuuaaaugcugacuacagccacugacaugguuggcug

SEQ ID NO: 314623 - RNA, 64 nt, Human
ucggauuaacuggaaaauauaucugaauucaacugcugacuauaaaugguauucuaauaaaauu

SEQ ID NO: 314624 - RNA, 64 nt, Human
cuggcucaggagcucauagauggaggaggugugggcugacuaccucccagaagccccucaugcc

SEQ ID NO: 314625 - RNA, 63 nt, Human
gguguucuaaaugucuuaagaaccuaauuaaauagcugacuacauuuugugucucuuuuuuua

SEQ ID NO: 314626 - RNA, 64 nt, Human
guacucagaggguuaacagacaagcacaaggcaugcugacuacauugguguauccagauugcuu

SEQ ID NO: 314627 - RNA, 64 nt, Human
agcccagcugggauugguguagggagggccgaacgcugacuaguguggccucacugccccaggc

SEQ ID NO: 314628 - RNA, 64 nt, Human
acgcucuugcuuccuaaugcucuauacaaagagggcugacuauauuucuugaagugguguaaaa

SEQ ID NO: 314629 - RNA, 64 nt, Human
gaguuuauccuuuccguaaucucuuuuuaacccugcugacuauuacagggcuuguuuaaucaca

SEQ ID NO: 314630 - RNA, 64 nt, Human
ggccauuuggccggcucugguggccacugagcuggcugacuaagccccgucugaccccagccca

SEQ ID NO: 314631 - RNA, 64 nt, Human
cuuuaauauaauauuauacugcuauauuuaaaaagcugacuacuugauauaauuacuuaaugug

SEQ ID NO: 314632 - RNA, 64 nt, Human
acacaguagauuuuugacaaacaguggcugcucugcugacuaucuuuuaggaauucaggaagca

SEQ ID NO: 314633 - RNA, 64 nt, Human
cuggcccagucccagguuggagucccucugcauagcugacuacucaugcauugcucaaagcugg

SEQ ID NO: 314634 - RNA, 64 nt, Human
gauggggguggcaagggggagacgggugggggucgcugacuauagacuguagcugggaggaggg

SEQ ID NO: 314635 - RNA, 64 nt, Human
cuugagccacauguauuucuguauuuaaagaauugcugacuaacuuucagguaaccagacccau

SEQ ID NO: 314636 - RNA, 64 nt, Human
ugggcgaagcuaacaucggugccuccccgaccuugcugacuaggcacaugggacgcaaaggagg

SEQ ID NO: 314637 - RNA, 64 nt, Human
auaggucccuggcauccugguucauaucuguguugcugacuacagugucugugauguccgcaug

SEQ ID NO: 314638 - RNA, 64 nt, Human
accaggagucacugagccaaugacuuuaccagcugcugacuaaucuucaucaccacuguagauu

SEQ ID NO: 314639 - RNA, 64 nt, Human
gcaccccacccccaccaaccaggggagccacuaagcugacuaacaacuguccccucacccacca

SEQ ID NO: 314640 - RNA, 64 nt, Human
ccccacucuugcccaugggugacucuuacccacagcugacuagggccagcgcaaauacuggaac

SEQ ID NO: 314641 - RNA, 64 nt, Human
auugauggaaguguaggguuuaugaauuauugcagcugacuaccauaccucacacagcguuggu

SEQ ID NO: 314642 - RNA, 64 nt, Human
acugcaggcccacaguuguagaccauucuucugugcugacuauuaggacacauggagugggauu

SEQ ID NO: 314643 - RNA, 64 nt, Human
cuacaggcaguggaccuuggcccggcagcaccacgcugacuauagcaaccagcuggacccggcc

SEQ ID NO: 314644 - RNA, 64 nt, Human
agcugggacaaacugcguuuggagcugugguuaagcugacuaaggaggcgguggcucuuucuua

SEQ ID NO: 314645 - RNA, 64 nt, Human
guuaugaugacucuugauaacuuguuaaucuguugcugacuagcauuagacuguuacacgaaga

SEQ ID NO: 314646 - RNA, 64 nt, Human
cucauuuuucagucuuacagaagauugugugaaggcugacuauacauaaagugacuggaauuuu

SEQ ID NO: 314647 - RNA, 64 nt, Human
aguguuucauuuugaacacauuuuggauuauuaagcugacuaagcaaugaucuaauacacauuu

SEQ ID NO: 314648 - RNA, 64 nt, Human
cagcuuccuggacaagaucgacgugaucaagcaggcugacuaugugccgagcgaucaggugugc

SEQ ID NO: 314649 - RNA, 64 nt, Human
aggaaggagagccugcugcauggggugggguagggcugacuagaagggccaguccugccuggcc

SEQ ID NO: 314650 - RNA, 64 nt, Human
ucccaugggaguggcuuuccauuuugggcagaaugcugacuaguagacuaacauaaaagauaua

SEQ ID NO: 314651 - RNA, 64 nt, Human
caccgcguuucauucuauuggucaauuccauguggcugacuaggucaauuuuuuuucugaacaa

SEQ ID NO: 314652 - RNA, 64 nt, Human
uucaaacuaccugguuaaccaaaauacaaaagcagcugacuaugugugauuucauaauagcaca

SEQ ID NO: 314653 - RNA, 64 nt, Human
ucaauggugcuacuauauaugaucaagauaacaugcugacuaguaaccaugaagauucagaugu

SEQ ID NO: 314654 - RNA, 64 nt, Human
auagcacuuuaccuuuugguuggcuagauaaguggcugacuaccuguuuuucucacuguggugu

SEQ ID NO: 314655 - RNA, 64 nt, Human
ugccauuuucuucccagaaauauguaauccccuggcugacuaggacuguuaaacauagugugga

SEQ ID NO: 314656 - RNA, 64 nt, Human
gagcuagaaggaaaagcuuuuaagucucauguuugcugacuauaaaaauaaaucauaguaauaa

SEQ ID NO: 314657 - RNA, 64 nt, Human
ccacugaggagcagguaaaugggagagguuuccagcugacuagaacccucuuuucuacucgucc

SEQ ID NO: 314658 - RNA, 64 nt, Human
ccuguuuugaaugccaaacccaccauucacuggugcugacuacauagaaugggguugagagaag

SEQ ID NO: 314659 - RNA, 64 nt, Human
ccgagagccacacagauuugacuuucucuagagagcugacuaaugaugaacggaagcaaauaca

SEQ ID NO: 314660 - RNA, 56 nt, Human
cuaaggccgauggucagugagaggaagcugacuagccccuggauucuucuccagac

SEQ ID NO: 314661 - RNA, 64 nt, Human
ggagcuagaaggaaaagcaugaagucucauguuugcugacuauaaaaauaaaucauaguaauaa

SEQ ID NO: 314662 - RNA, 64 nt, Human
ggaaggucuucaaagcacaucgaaauguauuauucgcuaguagcggcuacuuuaaaaugcuucu

SEQ ID NO: 314663 - RNA, 64 nt, Human
cagggcagaccaaugaugccaggcagcugucacacgcuaguauuggcuucauugugaucugagc

SEQ ID NO: 314664 - RNA, 64 nt, Human
gcugcgacucacacgcuucaauucaagaccugaccgcuaguagggagguuuauucagaucgcug

SEQ ID NO: 314665 - RNA, 64 nt, Human
cugcaguucaucucaugggaggggcugaaauacacgcuaguaacuccucugcccuucagccuuc

SEQ ID NO: 314666 - RNA, 64 nt, Human
acuggucugcaucaaguuuauucgguaguuugaccgcuaguauguuggaaguuauuuggauugu

SEQ ID NO: 314667 - RNA, 64 nt, Human
cucugaaacaugaccuuauucuuccaaacaguaucgcuaguaaaauagcaugcuggacuucaga

SEQ ID NO: 314668 - RNA, 64 nt, Human
cauugcaaccagagaggugcccaucccugugcagcgcuaguaaaguugacucuugcaguggaau

SEQ ID NO: 314669 - RNA, 64 nt, Human
caaaaaggcaaaggaaagaaagaaagcuucagaccgcuaguaaggcucaaagaagaagaaaaac

SEQ ID NO: 314670 - RNA, 64 nt, Human
caccgcuucauugaugaggacaggagacuccaagcgcuaguauugcacgcugcacuuaauggac

SEQ ID NO: 314671 - RNA, 64 nt, Human
aacuucuuuuauugcggacaaaugugcacauagccgcuaguaaaacuagccucaaacaggaugc

SEQ ID NO: 314672 - RNA, 64 nt, Human
uaaauuacagagucauuugagcuuucuccccucccgcuaguaucuuuacaggagcagggaagag

SEQ ID NO: 314673 - RNA, 64 nt, Human
gaacccaccagagggcagcaagcuccuuucacuucgcuaguaagaaccccuccguuuuugugug

SEQ ID NO: 314674 - RNA, 64 nt, Human
cgugccccggagucaccgccguccgcggauccggcgcuaguagcggggccugccgaggaagccg

SEQ ID NO: 314675 - RNA, 64 nt, Human
agcgucacccugagauuccccccgagacacagugcgcuaguacggcuguccggaggucagccug

SEQ ID NO: 314676 - RNA, 64 nt, Human
caacaauccuuuuuauaaccucuugaauacaguucgcuaguacaaggggucuucaggaaguuca

SEQ ID NO: 314677 - RNA, 64 nt, Human
cuuuccugugcccccacccccgccuccaguuuuccgcuaguauccggcaagguuucuugcaaca

SEQ ID NO: 314678 - RNA, 64 nt, Human
ucuaucuaguuuaccuagcaaaagcucaaaacugcgcuaguauggacuuuuuggacagacuuag

SEQ ID NO: 314679 - RNA, 64 nt, Human
ugaaagacuucaccuugucauuucuuuaagcagacgcuaguacuuuagaaauauaacuugacuc

SEQ ID NO: 314680 - RNA, 64 nt, Human
ggugaaggggaggaaaguauuaaaaaaucuauaucgcuaguaaauuguaauaaguucuauuaaa

SEQ ID NO: 314681 - RNA, 64 nt, Human; identical to SEQ ID NO: 190304

SEQ ID NO: 314682 - RNA, 64 nt, Human; identical to SEQ ID NO: 190305

SEQ ID NO: 314683 - RNA, 64 nt, Human; identical to SEQ ID NO: 190306

SEQ ID NO: 314684 - RNA, 64 nt, Human; identical to SEQ ID NO: 190307

SEQ ID NO: 314685 - RNA, 64 nt, Human
gaaucuacaaguuuuccugccaagccacucaggugcauugcagggaccagugauaauggcugau

SEQ ID NO: 314686 - RNA, 64 nt, Human
gacugaacagccaaauggaggcuauguggaguuggcauugcauuuaccggcagugcgggaggaa

SEQ ID NO: 314687 - RNA, 64 nt, Human; identical to SEQ ID NO: 190308

SEQ ID NO: 314688 - RNA, 58 nt, Human; identical to SEQ ID NO: 190312

SEQ ID NO: 314689 - RNA, 64 nt, Human; identical to SEQ ID NO: 190313

SEQ ID NO: 314690 - RNA, 64 nt, Human; identical to SEQ ID NO: 190314

SEQ ID NO: 314691 - RNA, 64 nt, Human; identical to SEQ ID NO: 190315

SEQ ID NO: 314692 - RNA, 64 nt, Human; identical to SEQ ID NO: 190316

SEQ ID NO: 314693 - RNA, 64 nt, Human; identical to SEQ ID NO: 190317

SEQ ID NO: 314694 - RNA, 64 nt, Human; identical to SEQ ID NO: 190318

SEQ ID NO: 314695 - RNA, 64 nt, Human; identical to SEQ ID NO: 190319

SEQ ID NO: 314696 - RNA, 64 nt, Human; identical to SEQ ID NO: 190320

SEQ ID NO: 314697 - RNA, 64 nt, Human; identical to SEQ ID NO: 190321

SEQ ID NO: 314698 - RNA, 64 nt, Human; identical to SEQ ID NO: 190322

SEQ ID NO: 314699 - RNA, 64 nt, Human; identical to SEQ ID NO: 190323

SEQ ID NO: 314700 - RNA, 64 nt, Human; identical to SEQ ID NO: 190324

SEQ ID NO: 314701 - RNA, 64 nt, Human; identical to SEQ ID NO: 190325

SEQ ID NO: 314702 - RNA, 64 nt, Human; identical to SEQ ID NO: 190326

SEQ ID NO: 314703 - RNA, 64 nt, Human
auuuuuacuaaggugcuuuauaauguguuuuaaagcauugcauuuacaaaacaaggaaaaugcu

SEQ ID NO: 314704 - RNA, 64 nt, Human
gcgucaucuuaaaaauaccaaauaacagaagaucgcauugcagaugauaucaggaugugguuuc

SEQ ID NO: 314705 - RNA, 64 nt, Human
uaauuuccucaggaauggggauguauuuuuuuaagcauugcagauaucaaaguucuauugugcu

SEQ ID NO: 314706 - RNA, 64 nt, Human; identical to SEQ ID NO: 190330

SEQ ID NO: 314707 - RNA, 64 nt, Human; identical to SEQ ID NO: 190331

SEQ ID NO: 314708 - RNA, 64 nt, Human; identical to SEQ ID NO: 190332

SEQ ID NO: 314709 - RNA, 64 nt, Human; identical to SEQ ID NO: 190333

SEQ ID NO: 314710 - RNA, 64 nt, Human; identical to SEQ ID NO: 190334

SEQ ID NO: 314711 - RNA, 64 nt, Human; identical to SEQ ID NO: 190335

SEQ ID NO: 314712 - RNA, 64 nt, Human; identical to SEQ ID NO: 190336

SEQ ID NO: 314713 - RNA, 64 nt, Human; identical to SEQ ID NO: 190337

SEQ ID NO: 314714 - RNA, 64 nt, Human; identical to SEQ ID NO: 190338

SEQ ID NO: 314715 - RNA, 64 nt, Human; identical to SEQ ID NO: 190339

SEQ ID NO: 314716 - RNA, 64 nt, Human; identical to SEQ ID NO: 190340

SEQ ID NO: 314717 - RNA, 64 nt, Human; identical to SEQ ID NO: 190341

SEQ ID NO: 314718 - RNA, 64 nt, Human; identical to SEQ ID NO: 190342

SEQ ID NO: 314719 - RNA, 64 nt, Human; identical to SEQ ID NO: 190343

SEQ ID NO: 314720 - RNA, 64 nt, Human; identical to SEQ ID NO: 190344

SEQ ID NO: 314721 - RNA, 64 nt, Human; identical to SEQ ID NO: 190348

SEQ ID NO: 314722 - RNA, 64 nt, Human
aagagaacaauauuugggagagaaggauggggaagcauugcaaggaaauugugcuuuauccaac

SEQ ID NO: 314723 - RNA, 64 nt, Human
guacuuaaagguuuuuaauuaucucgaaggccaagcauugcauuuguaaacaguccuggucagu

SEQ ID NO: 314724 - RNA, 64 nt, Human
guacacuugccccaaauugucuuugaagucgugugcauugcacguuggaugagccagggaaauu

SEQ ID NO: 314725 - RNA, 64 nt, Human; identical to SEQ ID NO: 190349

SEQ ID NO: 314726 - RNA, 64 nt, Human; identical to SEQ ID NO: 190350

SEQ ID NO: 314727 - RNA, 64 nt, Human; identical to SEQ ID NO: 190351

SEQ ID NO: 314728 - RNA, 64 nt, Human; identical to SEQ ID NO: 190352

SEQ ID NO: 314729 - RNA, 64 nt, Human; identical to SEQ ID NO: 190353

SEQ ID NO: 314730 - RNA, 64 nt, Human; identical to SEQ ID NO: 190354

SEQ ID NO: 314731 - RNA, 64 nt, Human; identical to SEQ ID NO: 190355

SEQ ID NO: 314732 - RNA, 64 nt, Human; identical to SEQ ID NO: 190356

SEQ ID NO: 314733 - RNA, 64 nt, Human; identical to SEQ ID NO: 190357

SEQ ID NO: 314734 - RNA, 64 nt, Human; identical to SEQ ID NO: 190358

SEQ ID NO: 314735 - RNA, 64 nt, Human; identical to SEQ ID NO: 190359

SEQ ID NO: 314736 - RNA, 64 nt, Human; identical to SEQ ID NO: 190360

SEQ ID NO: 314737 - RNA, 64 nt, Human; identical to SEQ ID NO: 190361

SEQ ID NO: 314738 - RNA, 64 nt, Human; identical to SEQ ID NO: 190362

SEQ ID NO: 314739 - RNA, 64 nt, Human; identical to SEQ ID NO: 190367

SEQ ID NO: 314740 - RNA, 64 nt, Human; identical to SEQ ID NO: 190368

SEQ ID NO: 314741 - RNA, 64 nt, Human
uuuguuucauaauucagcaaguacagaugcaagcgcauugcacacuuuuuccuuucuaaacuua

SEQ ID NO: 314742 - RNA, 64 nt, Human
ugcccccuuccauccccaaccacauuugacuguagcauugcaucuguguccuguugucauuuau

SEQ ID NO: 314743 - RNA, 64 nt, Human
uaaggauuuaguuagugauaagauguucaucccagcauugcaauggagaaaaaugggaagcaau

SEQ ID NO: 314744 - RNA, 64 nt, Human; identical to SEQ ID NO: 190369

SEQ ID NO: 314745 - RNA, 64 nt, Human; identical to SEQ ID NO: 190370

SEQ ID NO: 314746 - RNA, 64 nt, Human; identical to SEQ ID NO: 190371

SEQ ID NO: 314747 - RNA, 64 nt, Human; identical to SEQ ID NO: 190372

SEQ ID NO: 314748 - RNA, 64 nt, Human; identical to SEQ ID NO: 190373

SEQ ID NO: 314749 - RNA, 64 nt, Human; identical to SEQ ID NO: 190374

SEQ ID NO: 314750 - RNA, 64 nt, Human; identical to SEQ ID NO: 190375

SEQ ID NO: 314751 - RNA, 64 nt, Human; identical to SEQ ID NO: 190376

SEQ ID NO: 314752 - RNA, 64 nt, Human; identical to SEQ ID NO: 190377

SEQ ID NO: 314753 - RNA, 64 nt, Human; identical to SEQ ID NO: 190378

SEQ ID NO: 314754 - RNA, 64 nt, Human; identical to SEQ ID NO: 190379

SEQ ID NO: 314755 - RNA, 64 nt, Human; identical to SEQ ID NO: 190380

SEQ ID NO: 314756 - RNA, 64 nt, Human; identical to SEQ ID NO: 190381

SEQ ID NO: 314757 - RNA, 64 nt, Human; identical to SEQ ID NO: 190386

SEQ ID NO: 314758 - RNA, 64 nt, Human; identical to SEQ ID NO: 190387

SEQ ID NO: 314759 - RNA, 64 nt, Human; identical to SEQ ID NO: 190388

SEQ ID NO: 314760 - RNA, 64 nt, Human
ugcacacaaguccacuggccuggcuuggccccaggcauugcaauugacagacauuugcauuuca

SEQ ID NO: 314761 - RNA, 64 nt, Human
ggaacugggccuagcugugggaggucaucgcggggcauugcagggagugcguugugggaauucc

SEQ ID NO: 314762 - RNA, 64 nt, Human
guggaccaggauggagucuccugccuaccucacugcauugcacuggaccugggaugccuaucca

SEQ ID NO: 314763 - RNA, 64 nt, Human; identical to SEQ ID NO: 190389

SEQ ID NO: 314764 - RNA, 64 nt, Human; identical to SEQ ID NO: 190390

SEQ ID NO: 314765 - RNA, 64 nt, Human; identical to SEQ ID NO: 190391

SEQ ID NO: 314766 - RNA, 64 nt, Human; identical to SEQ ID NO: 190392

SEQ ID NO: 314767 - RNA, 64 nt, Human; identical to SEQ ID NO: 190393

SEQ ID NO: 314768 - RNA, 64 nt, Human; identical to SEQ ID NO: 190394

SEQ ID NO: 314769 - RNA, 64 nt, Human; identical to SEQ ID NO: 190395

SEQ ID NO: 314770 - RNA, 64 nt, Human; identical to SEQ ID NO: 190396

SEQ ID NO: 314771 - RNA, 64 nt, Human; identical to SEQ ID NO: 190397

SEQ ID NO: 314772 - RNA, 64 nt, Human; identical to SEQ ID NO: 190398

SEQ ID NO: 314773 - RNA, 64 nt, Human; identical to SEQ ID NO: 190399

SEQ ID NO: 314774 - RNA, 64 nt, Human; identical to SEQ ID NO: 190400

SEQ ID NO: 314775 - RNA, 53 nt, Human; identical to SEQ ID NO: 190404

SEQ ID NO: 314776 - RNA, 64 nt, Human; identical to SEQ ID NO: 190405

SEQ ID NO: 314777 - RNA, 64 nt, Human; identical to SEQ ID NO: 190406

SEQ ID NO: 314778 - RNA, 64 nt, Human; identical to SEQ ID NO: 190407

SEQ ID NO: 314779 - RNA, 64 nt, Human
uaaugauaccuuaaauuacucaggacuuaauguagcauugcacuucuguguacaguaaaacugc

SEQ ID NO: 314780 - RNA, 64 nt, Human
agaaacaaccuuucauguagccccucaacagaaugcauugcaucaucaccaugguaacaguucc

SEQ ID NO: 314781 - RNA, 64 nt, Human
aaucagacaaggaaggauguguaggaucacuacugcauugcaauacccuguuauccucagcaac

SEQ ID NO: 314782 - RNA, 64 nt, Human; identical to SEQ ID NO: 190408

SEQ ID NO: 314783 - RNA, 64 nt, Human; identical to SEQ ID NO: 190409

SEQ ID NO: 314784 - RNA, 64 nt, Human; identical to SEQ ID NO: 190410

SEQ ID NO: 314785 - RNA, 64 nt, Human; identical to SEQ ID NO: 190411

SEQ ID NO: 314786 - RNA, 64 nt, Human; identical to SEQ ID NO: 190412

SEQ ID NO: 314787 - RNA, 64 nt, Human; identical to SEQ ID NO: 190413

SEQ ID NO: 314788 - RNA, 64 nt, Human; identical to SEQ ID NO: 190414

SEQ ID NO: 314789 - RNA, 64 nt, Human; identical to SEQ ID NO: 190415

SEQ ID NO: 314790 - RNA, 64 nt, Human; identical to SEQ ID NO: 190416

SEQ ID NO: 314791 - RNA, 64 nt, Human; identical to SEQ ID NO: 190417

SEQ ID NO: 314792 - RNA, 64 nt, Human; identical to SEQ ID NO: 190418

SEQ ID NO: 314793 - RNA, 64 nt, Human; identical to SEQ ID NO: 190422

SEQ ID NO: 314794 - RNA, 64 nt, Human; identical to SEQ ID NO: 190423

SEQ ID NO: 314795 - RNA, 64 nt, Human; identical to SEQ ID NO: 190424

SEQ ID NO: 314796 - RNA, 64 nt, Human; identical to SEQ ID NO: 190425

SEQ ID NO: 314797 - RNA, 64 nt, Human; identical to SEQ ID NO: 190426

SEQ ID NO: 314798 - RNA, 64 nt, Human
agggaaauuccccggaaauaugagggaaaucucugcauugcaccaccagaggggcauaaauuug

SEQ ID NO: 314799 - RNA, 64 nt, Human
cacaaaaaggaaucuaagcugucuguuuuauucagcauugcaucuucugugccuagcacaagag

SEQ ID NO: 314800 - RNA, 63 nt, Human
agguagucaacccaggagccaagaaaagagaacuacgaggaacaggugcccggaaccuucuug

SEQ ID NO: 314801 - RNA, 64 nt, Human; identical to SEQ ID NO: 190427

SEQ ID NO: 314802 - RNA, 64 nt, Human; identical to SEQ ID NO: 190428

SEQ ID NO: 314803 - RNA, 64 nt, Human; identical to SEQ ID NO: 190429

SEQ ID NO: 314804 - RNA, 64 nt, Human; identical to SEQ ID NO: 190430

SEQ ID NO: 314805 - RNA, 64 nt, Human; identical to SEQ ID NO: 190431

SEQ ID NO: 314806 - RNA, 64 nt, Human; identical to SEQ ID NO: 190432

SEQ ID NO: 314807 - RNA, 64 nt, Human; identical to SEQ ID NO: 190433

SEQ ID NO: 314808 - RNA, 51 nt, Human; identical to SEQ ID NO: 190434

SEQ ID NO: 314809 - RNA, 64 nt, Human; identical to SEQ ID NO: 190435

SEQ ID NO: 314810 - RNA, 64 nt, Human; identical to SEQ ID NO: 190436

SEQ ID NO: 314811 - RNA, 64 nt, Human; identical to SEQ ID NO: 190072

SEQ ID NO: 314812 - RNA, 64 nt, Human; identical to SEQ ID NO: 190073

SEQ ID NO: 314813 - RNA, 64 nt, Human; identical to SEQ ID NO: 190074

SEQ ID NO: 314814 - RNA, 64 nt, Human; identical to SEQ ID NO: 190075

SEQ ID NO: 314815 - RNA, 64 nt, Human; identical to SEQ ID NO: 190076

SEQ ID NO: 314816 - RNA, 64 nt, Human; identical to SEQ ID NO: 190077

SEQ ID NO: 314817 - RNA, 63 nt, Human
guggcacccaccacagaauacaguguguguuauuacgaggagccagcaguugagccuaagguc

SEQ ID NO: 314818 - RNA, 64 nt, Human; identical to SEQ ID NO: 190465

SEQ ID NO: 314819 - RNA, 64 nt, Human; identical to SEQ ID NO: 19566

SEQ ID NO: 314820 - RNA, 64 nt, Human; identical to SEQ ID NO: 19567

SEQ ID NO: 314821 - RNA, 64 nt, Human; identical to SEQ ID NO: 19568

SEQ ID NO: 314822 - RNA, 64 nt, Human; identical to SEQ ID NO: 19569

SEQ ID NO: 314823 - RNA, 64 nt, Human; identical to SEQ ID NO: 19570

SEQ ID NO: 314824 - RNA, 64 nt, Human; identical to SEQ ID NO: 19571

SEQ ID NO: 314825 - RNA, 64 nt, Human; identical to SEQ ID NO: 19572

SEQ ID NO: 314826 - RNA, 64 nt, Human; identical to SEQ ID NO: 19573

SEQ ID NO: 314827 - RNA, 62 nt, Human; identical to SEQ ID NO: 19574

SEQ ID NO: 314828 - RNA, 64 nt, Human; identical to SEQ ID NO: 19575

SEQ ID NO: 314829 - RNA, 64 nt, Human; identical to SEQ ID NO: 19576

SEQ ID NO: 314830 - RNA, 64 nt, Human; identical to SEQ ID NO: 19577

SEQ ID NO: 314831 - RNA, 64 nt, Human; identical to SEQ ID NO: 281603

SEQ ID NO: 314832 - RNA, 64 nt, Human; identical to SEQ ID NO: 281604

SEQ ID NO: 314833 - RNA, 63 nt, Human
uacgauuucacguuaucagugcaguuccguucucgggggaaagguaagcacauagcuaacucc

SEQ ID NO: 314834 - RNA, 63 nt, Human
gaauguguaagcauuguauacauugaucaaguucgggggaauaaagacagaccacaccuaaaa

SEQ ID NO: 314835 - RNA, 63 nt, Human
uaaaucccacgacauaagcugguaucagugguucgggggaaauaguuccauucuaugacucuu

SEQ ID NO: 314836 - RNA, 63 nt, Human
acauagacccugcccuuccucuuugaauucuuccgggggaaggggugacugaacugggagucc

SEQ ID NO: 314837 - RNA, 64 nt, Human; identical to SEQ ID NO: 190466

SEQ ID NO: 314838 - RNA, 64 nt, Human; identical to SEQ ID NO: 190467

SEQ ID NO: 314839 - RNA, 64 nt, Human; identical to SEQ ID NO: 190468

SEQ ID NO: 314840 - RNA, 64 nt, Human; identical to SEQ ID NO: 190469

SEQ ID NO: 314841 - RNA, 64 nt, Human; identical to SEQ ID NO: 190470

SEQ ID NO: 314842 - RNA, 64 nt, Human; identical to SEQ ID NO: 190471

SEQ ID NO: 314843 - RNA, 64 nt, Human; identical to SEQ ID NO: 190472

SEQ ID NO: 314844 - RNA, 64 nt, Human; identical to SEQ ID NO: 190473

SEQ ID NO: 314845 - RNA, 64 nt, Human; identical to SEQ ID NO: 190477

SEQ ID NO: 314846 - RNA, 64 nt, Human; identical to SEQ ID NO: 190478

SEQ ID NO: 314847 - RNA, 64 nt, Human; identical to SEQ ID NO: 190479

SEQ ID NO: 314848 - RNA, 64 nt, Human; identical to SEQ ID NO: 190480

SEQ ID NO: 314849 - RNA, 64 nt, Human; identical to SEQ ID NO: 190481

SEQ ID NO: 314850 - RNA, 64 nt, Human; identical to SEQ ID NO: 190482

SEQ ID NO: 314851 - RNA, 64 nt, Human; identical to SEQ ID NO: 190483

SEQ ID NO: 314852 - RNA, 64 nt, Human; identical to SEQ ID NO: 190484

SEQ ID NO: 314853 - RNA, 63 nt, Human
uguggugaaaaugcacaggagcuugguagacugcgggggaaagagagagcuccuuucgccaug

SEQ ID NO: 314854 - RNA, 63 nt, Human
gagucagacuuccgcugggacgucaauaggaaacgggggaauuacuguguauuugcucucuag

SEQ ID NO: 314855 - RNA, 63 nt, Human
uggguuugucaggauggaauccuacagccuccucgggggaaagcacaccucaugcugagcgcu

SEQ ID NO: 314856 - RNA, 64 nt, Human; identical to SEQ ID NO: 190485

SEQ ID NO: 314857 - RNA, 64 nt, Human; identical to SEQ ID NO: 190486

SEQ ID NO: 314858 - RNA, 64 nt, Human; identical to SEQ ID NO: 190487

SEQ ID NO: 314859 - RNA, 56 nt, Human; identical to SEQ ID NO: 190488

SEQ ID NO: 314860 - RNA, 64 nt, Human; identical to SEQ ID NO: 190489

SEQ ID NO: 314861 - RNA, 64 nt, Human; identical to SEQ ID NO: 190490

SEQ ID NO: 314862 - RNA, 64 nt, Human; identical to SEQ ID NO: 190491

SEQ ID NO: 314863 - RNA, 64 nt, Human; identical to SEQ ID NO: 190495

SEQ ID NO: 314864 - RNA, 64 nt, Human; identical to SEQ ID NO: 190496

SEQ ID NO: 314865 - RNA, 64 nt, Human; identical to SEQ ID NO: 190497

SEQ ID NO: 314866 - RNA, 64 nt, Human; identical to SEQ ID NO: 190498

SEQ ID NO: 314867 - RNA, 64 nt, Human; identical to SEQ ID NO: 190499

SEQ ID NO: 314868 - RNA, 64 nt, Human; identical to SEQ ID NO: 190500

SEQ ID NO: 314869 - RNA, 64 nt, Human; identical to SEQ ID NO: 190501

SEQ ID NO: 314870 - RNA, 64 nt, Human; identical to SEQ ID NO: 190502

SEQ ID NO: 314871 - RNA, 64 nt, Human; identical to SEQ ID NO: 190503

SEQ ID NO: 314872 - RNA, 63 nt, Human
ucacaaaaaaaaaaucaccagcugccauagacacgggggaagcuugcggagcccaggugaaca

SEQ ID NO: 314873 - RNA, 63 nt, Human
aggaagcagaaguucaaggugaucgugccagcccgggggaaaaggcugaguccaccgcugugc

SEQ ID NO: 314874 - RNA, 63 nt, Human
uuucgguucaggggccugcggagcggguuggggcgggggaaacgauaguucugcagucugcgc

SEQ ID NO: 314875 - RNA, 64 nt, Human; identical to SEQ ID NO: 190504

SEQ ID NO: 314876 - RNA, 64 nt, Human; identical to SEQ ID NO: 190505

SEQ ID NO: 314877 - RNA, 64 nt, Human; identical to SEQ ID NO: 190506

SEQ ID NO: 314878 - RNA, 64 nt, Human; identical to SEQ ID NO: 190507

SEQ ID NO: 314879 - RNA, 62 nt, Human; identical to SEQ ID NO: 190508

SEQ ID NO: 314880 - RNA, 64 nt, Human; identical to SEQ ID NO: 190509

SEQ ID NO: 314881 - RNA, 64 nt, Human; identical to SEQ ID NO: 190513

SEQ ID NO: 314882 - RNA, 64 nt, Human; identical to SEQ ID NO: 190514

SEQ ID NO: 314883 - RNA, 64 nt, Human; identical to SEQ ID NO: 190515

SEQ ID NO: 314884 - RNA, 64 nt, Human; identical to SEQ ID NO: 190516

SEQ ID NO: 314885 - RNA, 64 nt, Human; identical to SEQ ID NO: 190517

SEQ ID NO: 314886 - RNA, 64 nt, Human; identical to SEQ ID NO: 190518

SEQ ID NO: 314887 - RNA, 64 nt, Human; identical to SEQ ID NO: 190519

SEQ ID NO: 314888 - RNA, 50 nt, Human; identical to SEQ ID NO: 190520

SEQ ID NO: 314889 - RNA, 64 nt, Human; identical to SEQ ID NO: 190521

SEQ ID NO: 314890 - RNA, 64 nt, Human; identical to SEQ ID NO: 190522

SEQ ID NO: 314891 - RNA, 63 nt, Human
gcggaaucacagccaaggacgugaagagauguacgggggaaagagaagcuggggauuggauga

SEQ ID NO: 314892 - RNA, 63 nt, Human
ccggcuggaccacgucucccuggccccagugaccgggggaagcugagccccucccuccugugu

SEQ ID NO: 314893 - RNA, 63 nt, Human
uccucccaugggagguguaggauaaggugggggcgggggaaaugggggaaugacacauccccc

SEQ ID NO: 314894 - RNA, 64 nt, Human; identical to SEQ ID NO: 190523

SEQ ID NO: 314895 - RNA, 64 nt, Human; identical to SEQ ID NO: 190524

SEQ ID NO: 314896 - RNA, 64 nt, Human; identical to SEQ ID NO: 190525

SEQ ID NO: 314897 - RNA, 64 nt, Human; identical to SEQ ID NO: 190526

SEQ ID NO: 314898 - RNA, 64 nt, Human; identical to SEQ ID NO: 190527

SEQ ID NO: 314899 - RNA, 64 nt, Human; identical to SEQ ID NO: 190532

SEQ ID NO: 314900 - RNA, 64 nt, Human; identical to SEQ ID NO: 190533

SEQ ID NO: 314901 - RNA, 64 nt, Human; identical to SEQ ID NO: 190534

SEQ ID NO: 314902 - RNA, 64 nt, Human; identical to SEQ ID NO: 190535

SEQ ID NO: 314903 - RNA, 64 nt, Human; identical to SEQ ID NO: 190536

SEQ ID NO: 314904 - RNA, 64 nt, Human; identical to SEQ ID NO: 190537

SEQ ID NO: 314905 - RNA, 64 nt, Human; identical to SEQ ID NO: 190538

SEQ ID NO: 314906 - RNA, 64 nt, Human; identical to SEQ ID NO: 190539

SEQ ID NO: 314907 - RNA, 64 nt, Human; identical to SEQ ID NO: 190540

SEQ ID NO: 314908 - RNA, 64 nt, Human; identical to SEQ ID NO: 190541

SEQ ID NO: 314909 - RNA, 64 nt, Human; identical to SEQ ID NO: 190542

SEQ ID NO: 314910 - RNA, 62 nt, Human
augagguagcugggcacaguggcucacaccuacgaucacagcacuucgggaggcugaagcaa

SEQ ID NO: 314911 - RNA, 62 nt, Human
ccgaucacagacgagcggucaccagacucgcccgaucacagacgagcagucaucggaaucac

SEQ ID NO: 314912 - RNA, 64 nt, Human; identical to SEQ ID NO: 190543

SEQ ID NO: 314913 - RNA, 64 nt, Human; identical to SEQ ID NO: 190544

SEQ ID NO: 314914 - RNA, 64 nt, Human; identical to SEQ ID NO: 190545

SEQ ID NO: 314915 - RNA, 64 nt, Human; identical to SEQ ID NO: 190546

SEQ ID NO: 314916 - RNA, 64 nt, Human; identical to SEQ ID NO: 190550

SEQ ID NO: 314917 - RNA, 64 nt, Human; identical to SEQ ID NO: 190551

SEQ ID NO: 314918 - RNA, 64 nt, Human; identical to SEQ ID NO: 190552

SEQ ID NO: 314919 - RNA, 64 nt, Human; identical to SEQ ID NO: 190553

SEQ ID NO: 314920 - RNA, 64 nt, Human; identical to SEQ ID NO: 190554

SEQ ID NO: 314921 - RNA, 64 nt, Human; identical to SEQ ID NO: 190555

SEQ ID NO: 314922 - RNA, 64 nt, Human; identical to SEQ ID NO: 190556

SEQ ID NO: 314923 - RNA, 64 nt, Human; identical to SEQ ID NO: 190557

SEQ ID NO: 314924 - RNA, 64 nt, Human; identical to SEQ ID NO: 190558

SEQ ID NO: 314925 - RNA, 64 nt, Human; identical to SEQ ID NO: 190559

SEQ ID NO: 314926 - RNA, 64 nt, Human; identical to SEQ ID NO: 190560

SEQ ID NO: 314927 - RNA, 64 nt, Human; identical to SEQ ID NO: 190561

SEQ ID NO: 314928 - RNA, 62 nt, Human
ucucuucggaggagcuagcuaugagaugucugcgaucacaucacgguaaagcccaaggagua

SEQ ID NO: 314929 - RNA, 62 nt, Human
aguauugugggaccaugagacaaaauuaaguacgaucacauucuuuauuucucauuuuaaag

SEQ ID NO: 314930 - RNA, 62 nt, Human
ucuaagccagaccagagggacucagacaccaccgaucacaggcuggcccaggugcucccucc

SEQ ID NO: 314931 - RNA, 64 nt, Human; identical to SEQ ID NO: 190562

SEQ ID NO: 314932 - RNA, 64 nt, Human; identical to SEQ ID NO: 190563

SEQ ID NO: 314933 - RNA, 64 nt, Human; identical to SEQ ID NO: 190564

SEQ ID NO: 314934 - RNA, 64 nt, Human; identical to SEQ ID NO: 190568

SEQ ID NO: 314935 - RNA, 64 nt, Human; identical to SEQ ID NO: 190569

SEQ ID NO: 314936 - RNA, 64 nt, Human; identical to SEQ ID NO: 190570

SEQ ID NO: 314937 - RNA, 64 nt, Human; identical to SEQ ID NO: 190571

SEQ ID NO: 314938 - RNA, 64 nt, Human; identical to SEQ ID NO: 190572

SEQ ID NO: 314939 - RNA, 64 nt, Human; identical to SEQ ID NO: 190573

SEQ ID NO: 314940 - RNA, 64 nt, Human; identical to SEQ ID NO: 190574

SEQ ID NO: 314941 - RNA, 64 nt, Human; identical to SEQ ID NO: 190575

SEQ ID NO: 314942 - RNA, 64 nt, Human; identical to SEQ ID NO: 190576

SEQ ID NO: 314943 - RNA, 64 nt, Human; identical to SEQ ID NO: 190577

SEQ ID NO: 314944 - RNA, 64 nt, Human; identical to SEQ ID NO: 190578

SEQ ID NO: 314945 - RNA, 64 nt, Human; identical to SEQ ID NO: 190579

SEQ ID NO: 314946 - RNA, 64 nt, Human; identical to SEQ ID NO: 190580

SEQ ID NO: 314947 - RNA, 62 nt, Human
uggcuagacuagaaaucaaacaacuuggaaaucgaucacaaccaggcauuaaguucacagua

SEQ ID NO: 314948 - RNA, 62 nt, Human
gcacccugcauucugccucauggugcaguuagcgaucacaggccuucagaaguacaacauca

SEQ ID NO: 314949 - RNA, 64 nt, Human; identical to SEQ ID NO: 314552

SEQ ID NO: 314950 - RNA, 64 nt, Human; identical to SEQ ID NO: 190581

SEQ ID NO: 314951 - RNA, 64 nt, Human; identical to SEQ ID NO: 190582

SEQ ID NO: 314952 - RNA, 64 nt, Human; identical to SEQ ID NO: 190586

SEQ ID NO: 314953 - RNA, 64 nt, Human; identical to SEQ ID NO: 190587

SEQ ID NO: 314954 - RNA, 64 nt, Human; identical to SEQ ID NO: 190588

SEQ ID NO: 314955 - RNA, 64 nt, Human; identical to SEQ ID NO: 190589

SEQ ID NO: 314956 - RNA, 59 nt, Human; identical to SEQ ID NO: 190590

SEQ ID NO: 314957 - RNA, 64 nt, Human; identical to SEQ ID NO: 190591

SEQ ID NO: 314958 - RNA, 64 nt, Human; identical to SEQ ID NO: 190592

SEQ ID NO: 314959 - RNA, 64 nt, Human; identical to SEQ ID NO: 190593

SEQ ID NO: 314960 - RNA, 64 nt, Human; identical to SEQ ID NO: 190594

SEQ ID NO: 314961 - RNA, 64 nt, Human; identical to SEQ ID NO: 190595

SEQ ID NO: 314962 - RNA, 64 nt, Human; identical to SEQ ID NO: 190596

SEQ ID NO: 314963 - RNA, 64 nt, Human; identical to SEQ ID NO: 190597

SEQ ID NO: 314964 - RNA, 64 nt, Human; identical to SEQ ID NO: 190598

SEQ ID NO: 314965 - RNA, 64 nt, Human; identical to SEQ ID NO: 190599

SEQ ID NO: 314966 - RNA, 64 nt, Human; identical to SEQ ID NO: 190600

SEQ ID NO: 314967 - RNA, 64 nt, Human; identical to SEQ ID NO: 190604

SEQ ID NO: 314968 - RNA, 64 nt, Human; identical to SEQ ID NO: 190605

SEQ ID NO: 314969 - RNA, 64 nt, Human; identical to SEQ ID NO: 190606

SEQ ID NO: 314970 - RNA, 64 nt, Human; identical to SEQ ID NO: 190607

SEQ ID NO: 314971 - RNA, 64 nt, Human; identical to SEQ ID NO: 190608

SEQ ID NO: 314972 - RNA, 64 nt, Human; identical to SEQ ID NO: 190609

SEQ ID NO: 314973 - RNA, 64 nt, Human; identical to SEQ ID NO: 190610

SEQ ID NO: 314974 - RNA, 64 nt, Human; identical to SEQ ID NO: 190611

SEQ ID NO: 314975 - RNA, 64 nt, Human; identical to SEQ ID NO: 190612

SEQ ID NO: 314976 - RNA, 64 nt, Human; identical to SEQ ID NO: 190613

SEQ ID NO: 314977 - RNA, 64 nt, Human; identical to SEQ ID NO: 190614

SEQ ID NO: 314978 - RNA, 64 nt, Human; identical to SEQ ID NO: 190615

SEQ ID NO: 314979 - RNA, 64 nt, Human; identical to SEQ ID NO: 190616

SEQ ID NO: 314980 - RNA, 64 nt, Human; identical to SEQ ID NO: 190617

SEQ ID NO: 314981 - RNA, 64 nt, Human; identical to SEQ ID NO: 190618

SEQ ID NO: 314982 - RNA, 63 nt, Human
cugcaagaaaggggacccaagaaaccaaagucugccgcccaccucgcuccccucuggaaucuu

SEQ ID NO: 314983 - RNA, 63 nt, Human
ucagcauccuuucuucgcccgccuucgggcugagccgcccaacaaguugugggacuccagucg

SEQ ID NO: 314984 - RNA, 63 nt, Human
gauucccugggcuccaggcucccccgcgcgggcgccgcccaccgccauacuaaacgaucgagg

SEQ ID NO: 314985 - RNA, 64 nt, Human; identical to SEQ ID NO: 190622

SEQ ID NO: 314986 - RNA, 64 nt, Human; identical to SEQ ID NO: 190623

SEQ ID NO: 314987 - RNA, 64 nt, Human; identical to SEQ ID NO: 190624

SEQ ID NO: 314988 - RNA, 64 nt, Human; identical to SEQ ID NO: 190625

SEQ ID NO: 314989 - RNA, 64 nt, Human; identical to SEQ ID NO: 190626

SEQ ID NO: 314990 - RNA, 64 nt, Human; identical to SEQ ID NO: 190627

SEQ ID NO: 314991 - RNA, 64 nt, Human; identical to SEQ ID NO: 190628

SEQ ID NO: 314992 - RNA, 64 nt, Human; identical to SEQ ID NO: 190629

SEQ ID NO: 314993 - RNA, 64 nt, Human; identical to SEQ ID NO: 190630

SEQ ID NO: 314994 - RNA, 64 nt, Human; identical to SEQ ID NO: 190631

SEQ ID NO: 314995 - RNA, 64 nt, Human; identical to SEQ ID NO: 190632

SEQ ID NO: 314996 - RNA, 64 nt, Human; identical to SEQ ID NO: 190633

SEQ ID NO: 314997 - RNA, 64 nt, Human; identical to SEQ ID NO: 190634

SEQ ID NO: 314998 - RNA, 64 nt, Human; identical to SEQ ID NO: 190635

SEQ ID NO: 314999 - RNA, 64 nt, Human; identical to SEQ ID NO: 190636

SEQ ID NO: 315000 - RNA, 64 nt, Human; identical to SEQ ID NO: 190640

SEQ ID NO: 315001 - RNA, 63 nt, Human
uccccucccucauccucgucuguccugucaccugccgcccagccccucuccugccagacagcc

SEQ ID NO: 315002 - RNA, 63 nt, Human
gcucugggaugcagcagccgcucgcauggaagugccgcccagaggcaugcaggcugcugggca

SEQ ID NO: 315003 - RNA, 63 nt, Human
aacagacggcagacacaccugucccccagugaugccgcccaagcugcccauggggcuuccuac

SEQ ID NO: 315004 - RNA, 64 nt, Human; identical to SEQ ID NO: 190641

SEQ ID NO: 315005 - RNA, 64 nt, Human; identical to SEQ ID NO: 190642

SEQ ID NO: 315006 - RNA, 64 nt, Human; identical to SEQ ID NO: 190643

SEQ ID NO: 315007 - RNA, 64 nt, Human; identical to SEQ ID NO: 190644

SEQ ID NO: 315008 - RNA, 64 nt, Human; identical to SEQ ID NO: 190645

SEQ ID NO: 315009 - RNA, 64 nt, Human; identical to SEQ ID NO: 190646

SEQ ID NO: 315010 - RNA, 64 nt, Human; identical to SEQ ID NO: 190647

SEQ ID NO: 315011 - RNA, 64 nt, Human; identical to SEQ ID NO: 190648

SEQ ID NO: 315012 - RNA, 64 nt, Human; identical to SEQ ID NO: 190649

SEQ ID NO: 315013 - RNA, 64 nt, Human; identical to SEQ ID NO: 190650

SEQ ID NO: 315014 - RNA, 55 nt, Human; identical to SEQ ID NO: 190651

SEQ ID NO: 315015 - RNA, 64 nt, Human; identical to SEQ ID NO: 190652

SEQ ID NO: 315016 - RNA, 64 nt, Human; identical to SEQ ID NO: 190653

SEQ ID NO: 315017 - RNA, 64 nt, Human; identical to SEQ ID NO: 190654

SEQ ID NO: 315018 - RNA, 64 nt, Human; identical to SEQ ID NO: 190658

SEQ ID NO: 315019 - RNA, 64 nt, Human; identical to SEQ ID NO: 190659

SEQ ID NO: 315020 - RNA, 61 nt, Human
gcuugcauuucugaaccaaaggcccuuuucagggccgcccaacuaaacaaaagaagagcug

SEQ ID NO: 315021 - RNA, 61 nt, Human
uauuuucauuuucaaccaaaggcccuuuucagggccgcccacuuuuuucauaaaagagcag

SEQ ID NO: 315022 - RNA, 63 nt, Human
ugcucugggaagucggcuccaugcucaccagcagccgcccaggcccgcagccucacccggcuc

SEQ ID NO: 315023 - RNA, 61 nt, Human; identical to SEQ ID NO: 190660

SEQ ID NO: 315024 - RNA, 64 nt, Human; identical to SEQ ID NO: 190661

SEQ ID NO: 315025 - RNA, 64 nt, Human; identical to SEQ ID NO: 190662

SEQ ID NO: 315026 - RNA, 64 nt, Human; identical to SEQ ID NO: 190663

SEQ ID NO: 315027 - RNA, 64 nt, Human; identical to SEQ ID NO: 190664

SEQ ID NO: 315028 - RNA, 64 nt, Human; identical to SEQ ID NO: 190665

SEQ ID NO: 315029 - RNA, 64 nt, Human; identical to SEQ ID NO: 190666

SEQ ID NO: 315030 - RNA, 64 nt, Human; identical to SEQ ID NO: 190667

SEQ ID NO: 315031 - RNA, 64 nt, Human; identical to SEQ ID NO: 190668

SEQ ID NO: 315032 - RNA, 64 nt, Human; identical to SEQ ID NO: 190669

SEQ ID NO: 315033 - RNA, 64 nt, Human; identical to SEQ ID NO: 190670

SEQ ID NO: 315034 - RNA, 64 nt, Human; identical to SEQ ID NO: 190671

SEQ ID NO: 315035 - RNA, 64 nt, Human; identical to SEQ ID NO: 190672

SEQ ID NO: 315036 - RNA, 64 nt, Human; identical to SEQ ID NO: 190677

SEQ ID NO: 315037 - RNA, 64 nt, Human; identical to SEQ ID NO: 190678

SEQ ID NO: 315038 - RNA, 64 nt, Human; identical to SEQ ID NO: 190679

SEQ ID NO: 315039 - RNA, 64 nt, Human
ccuucccccucccagguucuuauugcuaacaauggcauugcagcagugaaaugcaugcggucua

SEQ ID NO: 315040 - RNA, 64 nt, Human
cacuucuaugucucuggaccacaggauggugguggcauugcagguuggcaagugggcugauggg

SEQ ID NO: 315041 - RNA, 64 nt, Human
aaugccacaggccaccuauagcuacauacuccuggcauugcacuuuuuaaccuugcugacaucc

SEQ ID NO: 315042 - RNA, 62 nt, Human; identical to SEQ ID NO: 190680

SEQ ID NO: 315043 - RNA, 64 nt, Human; identical to SEQ ID NO: 190681

SEQ ID NO: 315044 - RNA, 64 nt, Human; identical to SEQ ID NO: 190682

SEQ ID NO: 315045 - RNA, 64 nt, Human; identical to SEQ ID NO: 190683

SEQ ID NO: 315046 - RNA, 58 nt, Human; identical to SEQ ID NO: 190684

SEQ ID NO: 315047 - RNA, 64 nt, Human; identical to SEQ ID NO: 190685

SEQ ID NO: 315048 - RNA, 64 nt, Human; identical to SEQ ID NO: 190686

SEQ ID NO: 315049 - RNA, 64 nt, Human; identical to SEQ ID NO: 190687

SEQ ID NO: 315050 - RNA, 64 nt, Human; identical to SEQ ID NO: 190688

SEQ ID NO: 315051 - RNA, 64 nt, Human; identical to SEQ ID NO: 190689

SEQ ID NO: 315052 - RNA, 64 nt, Human; identical to SEQ ID NO: 190690

SEQ ID NO: 315053 - RNA, 64 nt, Human; identical to SEQ ID NO: 190691

SEQ ID NO: 315054 - RNA, 64 nt, Human; identical to SEQ ID NO: 190696

SEQ ID NO: 315055 - RNA, 64 nt, Human; identical to SEQ ID NO: 190697

SEQ ID NO: 315056 - RNA, 64 nt, Human; identical to SEQ ID NO: 190698

SEQ ID NO: 315057 - RNA, 64 nt, Human; identical to SEQ ID NO: 190699

SEQ ID NO: 315058 - RNA, 56 nt, Human; identical to SEQ ID NO: 40838

SEQ ID NO: 315059 - RNA, 63 nt, Human
cacagccacgggggacugacgccagguuccccagccgcccacaacgacuuuauuuucuuaccc

SEQ ID NO: 315060 - RNA, 63 nt, Human
gacgcucagcucccgcccgacggcagcgccgccgccgcccagaaucccagcccagaaucccga

SEQ ID NO: 315061 - RNA, 64 nt, Human; identical to SEQ ID NO: 190700

SEQ ID NO: 315062 - RNA, 64 nt, Human; identical to SEQ ID NO: 190701

SEQ ID NO: 315063 - RNA, 64 nt, Human; identical to SEQ ID NO: 190702

SEQ ID NO: 315064 - RNA, 64 nt, Human; identical to SEQ ID NO: 190703

SEQ ID NO: 315065 - RNA, 64 nt, Human; identical to SEQ ID NO: 190704

SEQ ID NO: 315066 - RNA, 64 nt, Human; identical to SEQ ID NO: 190705

SEQ ID NO: 315067 - RNA, 64 nt, Human; identical to SEQ ID NO: 190706

SEQ ID NO: 315068 - RNA, 64 nt, Human; identical to SEQ ID NO: 190707

SEQ ID NO: 315069 - RNA, 64 nt, Human; identical to SEQ ID NO: 190708

SEQ ID NO: 315070 - RNA, 64 nt, Human; identical to SEQ ID NO: 190709

SEQ ID NO: 315071 - RNA, 64 nt, Human; identical to SEQ ID NO: 190710

SEQ ID NO: 315072 - RNA, 64 nt, Human; identical to SEQ ID NO: 190714

SEQ ID NO: 315073 - RNA, 64 nt, Human; identical to SEQ ID NO: 190715

SEQ ID NO: 315074 - RNA, 64 nt, Human; identical to SEQ ID NO: 190716

SEQ ID NO: 315075 - RNA, 64 nt, Human; identical to SEQ ID NO: 190717

SEQ ID NO: 315076 - RNA, 64 nt, Human; identical to SEQ ID NO: 190718

SEQ ID NO: 315077 - RNA, 64 nt, Human
agcuugaugcuuucugccuucugucucaggugaugcauugcacauuugggauauuuggaaagga

SEQ ID NO: 315078 - RNA, 64 nt, Human
ccaguccuggccuggcuucuccuuuggaagugaggcauugcacagggagacguacguaucagcg

SEQ ID NO: 315079 - RNA, 64 nt, Human
cauauuugcaagcgcgcucggugcgggcaggcucgcauugcacccagggagcuggaguugagcu

SEQ ID NO: 315080 - RNA, 64 nt, Human; identical to SEQ ID NO: 190719

SEQ ID NO: 315081 - RNA, 64 nt, Human; identical to SEQ ID NO: 190720

SEQ ID NO: 315082 - RNA, 64 nt, Human; identical to SEQ ID NO: 190721

SEQ ID NO: 315083 - RNA, 64 nt, Human; identical to SEQ ID NO: 190722

SEQ ID NO: 315084 - RNA, 64 nt, Human; identical to SEQ ID NO: 190723

SEQ ID NO: 315085 - RNA, 64 nt, Human; identical to SEQ ID NO: 190724

SEQ ID NO: 315086 - RNA, 64 nt, Human; identical to SEQ ID NO: 190725

SEQ ID NO: 315087 - RNA, 64 nt, Human; identical to SEQ ID NO: 190726

SEQ ID NO: 315088 - RNA, 64 nt, Human; identical to SEQ ID NO: 190727

SEQ ID NO: 315089 - RNA, 64 nt, Human; identical to SEQ ID NO: 190728

SEQ ID NO: 315090 - RNA, 64 nt, Human; identical to SEQ ID NO: 190732

SEQ ID NO: 315091 - RNA, 64 nt, Human; identical to SEQ ID NO: 190733

SEQ ID NO: 315092 - RNA, 64 nt, Human; identical to SEQ ID NO: 190734

SEQ ID NO: 315093 - RNA, 64 nt, Human; identical to SEQ ID NO: 190735

SEQ ID NO: 315094 - RNA, 64 nt, Human; identical to SEQ ID NO: 190736

SEQ ID NO: 315095 - RNA, 64 nt, Human; identical to SEQ ID NO: 190737

SEQ ID NO: 315096 - RNA, 64 nt, Human
ucucucgcuauuucugcugcuguuccuagacugagcauugcauuucuugaucaaccagaugauu

SEQ ID NO: 315097 - RNA, 64 nt, Human
ccuccccguuauuuuuuccuuuggaugguuaaaagcauugcaggcacccgggaaggugagcaga

SEQ ID NO: 315098 - RNA, 64 nt, Human
ugccuaugcacauccuaauucacagacauugucagcauugcauuauuccagggcuguuuugagg

SEQ ID NO: 315099 - RNA, 64 nt, Human; identical to SEQ ID NO: 190738

SEQ ID NO: 315100 - RNA, 64 nt, Human; identical to SEQ ID NO: 190739

SEQ ID NO: 315101 - RNA, 64 nt, Human; identical to SEQ ID NO: 190740

SEQ ID NO: 315102 - RNA, 64 nt, Human; identical to SEQ ID NO: 190741

SEQ ID NO: 315103 - RNA, 64 nt, Human; identical to SEQ ID NO: 190742

SEQ ID NO: 315104 - RNA, 64 nt, Human; identical to SEQ ID NO: 190743

SEQ ID NO: 315105 - RNA, 64 nt, Human; identical to SEQ ID NO: 190744

SEQ ID NO: 315106 - RNA, 64 nt, Human; identical to SEQ ID NO: 190745

SEQ ID NO: 315107 - RNA, 64 nt, Human; identical to SEQ ID NO: 190746

SEQ ID NO: 315108 - RNA, 64 nt, Human; identical to SEQ ID NO: 190750

SEQ ID NO: 315109 - RNA, 64 nt, Human; identical to SEQ ID NO: 190751

SEQ ID NO: 315110 - RNA, 64 nt, Human; identical to SEQ ID NO: 190752

SEQ ID NO: 315111 - RNA, 64 nt, Human; identical to SEQ ID NO: 190753

SEQ ID NO: 315112 - RNA, 64 nt, Human; identical to SEQ ID NO: 190754

SEQ ID NO: 315113 - RNA, 64 nt, Human; identical to SEQ ID NO: 190755

SEQ ID NO: 315114 - RNA, 64 nt, Human; identical to SEQ ID NO: 190756

SEQ ID NO: 315115 - RNA, 64 nt, Human
gaacaucugcauaaauuccagguaugugugaacugcauugcaccuuuugcccugcccagggccc

SEQ ID NO: 315116 - RNA, 64 nt, Human
gggaacaugcauuuuaucagacaauuuauccaaagcauugcagaacaugagugcugaugagggc

SEQ ID NO: 315117 - RNA, 64 nt, Human
uuucaugauuagacaauguggaauuacauaacaggcauugcacuaaaagugaugugauuuaugc

SEQ ID NO: 315118 - RNA, 64 nt, Human; identical to SEQ ID NO: 190757

SEQ ID NO: 315119 - RNA, 64 nt, Human; identical to SEQ ID NO: 190758

SEQ ID NO: 315120 - RNA, 64 nt, Human; identical to SEQ ID NO: 190759

SEQ ID NO: 315121 - RNA, 64 nt, Human; identical to SEQ ID NO: 190760

SEQ ID NO: 315122 - RNA, 64 nt, Human; identical to SEQ ID NO: 190761

SEQ ID NO: 315123 - RNA, 64 nt, Human; identical to SEQ ID NO: 190762

SEQ ID NO: 315124 - RNA, 64 nt, Human; identical to SEQ ID NO: 190763

SEQ ID NO: 315125 - RNA, 64 nt, Human; identical to SEQ ID NO: 190764

SEQ ID NO: 315126 - RNA, 64 nt, Human; identical to SEQ ID NO: 190769

SEQ ID NO: 315127 - RNA, 64 nt, Human; identical to SEQ ID NO: 190770

SEQ ID NO: 315128 - RNA, 64 nt, Human; identical to SEQ ID NO: 190771

SEQ ID NO: 315129 - RNA, 64 nt, Human; identical to SEQ ID NO: 190772

SEQ ID NO: 315130 - RNA, 64 nt, Human; identical to SEQ ID NO: 190773

SEQ ID NO: 315131 - RNA, 64 nt, Human; identical to SEQ ID NO: 190774

SEQ ID NO: 315132 - RNA, 64 nt, Human; identical to SEQ ID NO: 190775

SEQ ID NO: 315133 - RNA, 64 nt, Human; identical to SEQ ID NO: 190776

SEQ ID NO: 315134 - RNA, 64 nt, Human
ugccauaauucccaaguucaugucucagacugcugcauugcagcaugaggcagggcaaacacuu

SEQ ID NO: 315135 - RNA, 64 nt, Human
uuaaagugucagaaaaaggugacggcaaggacaugcauugcaauuugcagggggaauugucaag

SEQ ID NO: 315136 - RNA, 63 nt, Human
gagaugcauuauuccuauuacuaaugauguaaguacgaggauaaauccaagaaacuuucaacu

SEQ ID NO: 315137 - RNA, 64 nt, Human; identical to SEQ ID NO: 190777

SEQ ID NO: 315138 - RNA, 64 nt, Human; identical to SEQ ID NO: 190778

SEQ ID NO: 315139 - RNA, 64 nt, Human; identical to SEQ ID NO: 190779

SEQ ID NO: 315140 - RNA, 64 nt, Human; identical to SEQ ID NO: 190780

SEQ ID NO: 315141 - RNA, 64 nt, Human; identical to SEQ ID NO: 190781

SEQ ID NO: 315142 - RNA, 64 nt, Human; identical to SEQ ID NO: 190782

SEQ ID NO: 315143 - RNA, 64 nt, Human; identical to SEQ ID NO: 190783

SEQ ID NO: 315144 - RNA, 64 nt, Human; identical to SEQ ID NO: 190787

SEQ ID NO: 315145 - RNA, 64 nt, Human; identical to SEQ ID NO: 190788

SEQ ID NO: 315146 - RNA, 64 nt, Human; identical to SEQ ID NO: 190789

SEQ ID NO: 315147 - RNA, 64 nt, Human; identical to SEQ ID NO: 190790

SEQ ID NO: 315148 - RNA, 64 nt, Human; identical to SEQ ID NO: 190791

SEQ ID NO: 315149 - RNA, 64 nt, Human; identical to SEQ ID NO: 190792

SEQ ID NO: 315150 - RNA, 64 nt, Human; identical to SEQ ID NO: 190793

SEQ ID NO: 315151 - RNA, 64 nt, Human; identical to SEQ ID NO: 190794

SEQ ID NO: 315152 - RNA, 64 nt, Human; identical to SEQ ID NO: 190795

SEQ ID NO: 315153 - RNA, 64 nt, Human
cucucccauccucaaaaaagggccauuuuaugaugcauugcacacccucuggggaaauugaucu

SEQ ID NO: 315154 - RNA, 64 nt, Human
uguauguccuacauuucaucauugucccgggccugcauugcacuggaaaaaaaaaucgccaccu

SEQ ID NO: 315155 - RNA, 64 nt, Human
gagaaggaaggcagcccaggagucagguaugcaggcauugcauugucagugucugcucucagag

SEQ ID NO: 315156 - RNA, 64 nt, Human; identical to SEQ ID NO: 190796

SEQ ID NO: 315157 - RNA, 64 nt, Human; identical to SEQ ID NO: 190797

SEQ ID NO: 315158 - RNA, 64 nt, Human; identical to SEQ ID NO: 190798

SEQ ID NO: 315159 - RNA, 64 nt, Human; identical to SEQ ID NO: 190799

SEQ ID NO: 315160 - RNA, 64 nt, Human; identical to SEQ ID NO: 190800

SEQ ID NO: 315161 - RNA, 64 nt, Human; identical to SEQ ID NO: 190801

SEQ ID NO: 315162 - RNA, 64 nt, Human; identical to SEQ ID NO: 190805

SEQ ID NO: 315163 - RNA, 64 nt, Human; identical to SEQ ID NO: 190806

SEQ ID NO: 315164 - RNA, 56 nt, Human; identical to SEQ ID NO: 190807

SEQ ID NO: 315165 - RNA, 64 nt, Human; identical to SEQ ID NO: 190808

SEQ ID NO: 315166 - RNA, 64 nt, Human; identical to SEQ ID NO: 190809

SEQ ID NO: 315167 - RNA, 64 nt, Human; identical to SEQ ID NO: 190810

SEQ ID NO: 315168 - RNA, 64 nt, Human; identical to SEQ ID NO: 190811

SEQ ID NO: 315169 - RNA, 64 nt, Human; identical to SEQ ID NO: 190812

SEQ ID NO: 315170 - RNA, 64 nt, Human; identical to SEQ ID NO: 190813

SEQ ID NO: 315171 - RNA, 64 nt, Human; identical to SEQ ID NO: 190814

SEQ ID NO: 315172 - RNA, 64 nt, Human
uagugaauucaugaucaagguuuccuuaaauuuagcauugcauuucaguacugacuguguaagc

SEQ ID NO: 315173 - RNA, 64 nt, Human
cuacaaacacgauuuccgcaaccuggaguuggaggcauugcaggcuguccagccucauccccug

SEQ ID NO: 315174 - RNA, 64 nt, Human
uuugaagaauagagugguauuuagaaaauaaauugcauugcaaagcucuuaucggcucauauga

SEQ ID NO: 315175 - RNA, 64 nt, Human; identical to SEQ ID NO: 190815

SEQ ID NO: 315176 - RNA, 64 nt, Human; identical to SEQ ID NO: 190816

SEQ ID NO: 315177 - RNA, 64 nt, Human; identical to SEQ ID NO: 190817

SEQ ID NO: 315178 - RNA, 64 nt, Human; identical to SEQ ID NO: 190818

SEQ ID NO: 315179 - RNA, 64 nt, Human; identical to SEQ ID NO: 190819

SEQ ID NO: 315180 - RNA, 64 nt, Human; identical to SEQ ID NO: 190823

SEQ ID NO: 315181 - RNA, 64 nt, Human; identical to SEQ ID NO: 190824

SEQ ID NO: 315182 - RNA, 64 nt, Human; identical to SEQ ID NO: 190825

SEQ ID NO: 315183 - RNA, 64 nt, Human; identical to SEQ ID NO: 190826

SEQ ID NO: 315184 - RNA, 64 nt, Human; identical to SEQ ID NO: 190827

SEQ ID NO: 315185 - RNA, 64 nt, Human; identical to SEQ ID NO: 190828

SEQ ID NO: 315186 - RNA, 64 nt, Human; identical to SEQ ID NO: 190829

SEQ ID NO: 315187 - RNA, 64 nt, Human; identical to SEQ ID NO: 190830

SEQ ID NO: 315188 - RNA, 64 nt, Human; identical to SEQ ID NO: 190831

SEQ ID NO: 315189 - RNA, 64 nt, Human; identical to SEQ ID NO: 190832

SEQ ID NO: 315190 - RNA, 64 nt, Human; identical to SEQ ID NO: 190833

SEQ ID NO: 315191 - RNA, 64 nt, Human
cauugaauuauuaauuaaauaaauuuauuaauuggcauugcauugaauuuauagguuaauuuug

SEQ ID NO: 315192 - RNA, 64 nt, Human
cuucuuuccagguucaaaaagcaaaaucugauuggcauugcauugaauuauuaauuaaauaaau

SEQ ID NO: 315193 - RNA, 64 nt, Human
uacaagggagaacucauuugagaucagucuguuggcauugcaaugaagugcuuuguaucaggaa

SEQ ID NO: 315194 - RNA, 64 nt, Human; identical to SEQ ID NO: 190834

SEQ ID NO: 315195 - RNA, 64 nt, Human; identical to SEQ ID NO: 190835

SEQ ID NO: 315196 - RNA, 64 nt, Human; identical to SEQ ID NO: 190836

SEQ ID NO: 315197 - RNA, 64 nt, Human; identical to SEQ ID NO: 190837

SEQ ID NO: 315198 - RNA, 64 nt, Human; identical to SEQ ID NO: 190841

SEQ ID NO: 315199 - RNA, 64 nt, Human; identical to SEQ ID NO: 190842

SEQ ID NO: 315200 - RNA, 64 nt, Human; identical to SEQ ID NO: 190843

SEQ ID NO: 315201 - RNA, 64 nt, Human; identical to SEQ ID NO: 190844

SEQ ID NO: 315202 - RNA, 64 nt, Human; identical to SEQ ID NO: 190845

SEQ ID NO: 315203 - RNA, 64 nt, Human; identical to SEQ ID NO: 190846

SEQ ID NO: 315204 - RNA, 64 nt, Human; identical to SEQ ID NO: 190847

SEQ ID NO: 315205 - RNA, 64 nt, Human; identical to SEQ ID NO: 190848

SEQ ID NO: 315206 - RNA, 58 nt, Human; identical to SEQ ID NO: 190849

SEQ ID NO: 315207 - RNA, 64 nt, Human; identical to SEQ ID NO: 190850

SEQ ID NO: 315208 - RNA, 64 nt, Human; identical to SEQ ID NO: 190851

SEQ ID NO: 315209 - RNA, 64 nt, Human; identical to SEQ ID NO: 190852

SEQ ID NO: 315210 - RNA, 64 nt, Human
ccagagcuagggcugagaaguggcccugccuugggcauugcaccagaacccuggacccccgccu

SEQ ID NO: 315211 - RNA, 64 nt, Human
ucaaaaaaaaaaaaaaauuauauucauauguauugcauugcaauuauaauuacauaugcagauu

SEQ ID NO: 315212 - RNA, 64 nt, Human
gaucgggcacuguaucaagagcaugcaaaacgucgcauugcagagcgggaggccaggagguaau

SEQ ID NO: 315213 - RNA, 64 nt, Human; identical to SEQ ID NO: 190853

SEQ ID NO: 315214 - RNA, 64 nt, Human; identical to SEQ ID NO: 190854

SEQ ID NO: 315215 - RNA, 64 nt, Human; identical to SEQ ID NO: 190855

SEQ ID NO: 315216 - RNA, 64 nt, Human; identical to SEQ ID NO: 190860

SEQ ID NO: 315217 - RNA, 64 nt, Human; identical to SEQ ID NO: 190861

SEQ ID NO: 315218 - RNA, 64 nt, Human; identical to SEQ ID NO: 190862

SEQ ID NO: 315219 - RNA, 64 nt, Human; identical to SEQ ID NO: 190863

SEQ ID NO: 315220 - RNA, 64 nt, Human; identical to SEQ ID NO: 190864

SEQ ID NO: 315221 - RNA, 64 nt, Human; identical to SEQ ID NO: 190865

SEQ ID NO: 315222 - RNA, 64 nt, Human; identical to SEQ ID NO: 190866

SEQ ID NO: 315223 - RNA, 64 nt, Human; identical to SEQ ID NO: 190867

SEQ ID NO: 315224 - RNA, 64 nt, Human; identical to SEQ ID NO: 190868

SEQ ID NO: 315225 - RNA, 64 nt, Human; identical to SEQ ID NO: 190869

SEQ ID NO: 315226 - RNA, 64 nt, Human; identical to SEQ ID NO: 190870

SEQ ID NO: 315227 - RNA, 64 nt, Human; identical to SEQ ID NO: 190871

SEQ ID NO: 315228 - RNA, 64 nt, Human; identical to SEQ ID NO: 190872

SEQ ID NO: 315229 - RNA, 64 nt, Human
gauuucuuugauggacaagccuucccccugcaacgcauugcagggagauggcgccuccuguucu

SEQ ID NO: 315230 - RNA, 64 nt, Human
ccgcuauuagaguauggaggaagggguuuucauugcauugcauuucugaaacauuccuaagacc

SEQ ID NO: 315231 - RNA, 64 nt, Human
uucauucuagccacggggaugaaagggaucuuuugcauugcagagauuuuauauauauuuuguu

SEQ ID NO: 315232 - RNA, 64 nt, Human; identical to SEQ ID NO: 190873

SEQ ID NO: 315233 - RNA, 64 nt, Human; identical to SEQ ID NO: 190874

SEQ ID NO: 315234 - RNA, 64 nt, Human; identical to SEQ ID NO: 190878

SEQ ID NO: 315235 - RNA, 64 nt, Human; identical to SEQ ID NO: 190879

SEQ ID NO: 315236 - RNA, 64 nt, Human; identical to SEQ ID NO: 190880

SEQ ID NO: 315237 - RNA, 64 nt, Human; identical to SEQ ID NO: 190881

SEQ ID NO: 315238 - RNA, 64 nt, Human; identical to SEQ ID NO: 190882

SEQ ID NO: 315239 - RNA, 64 nt, Human; identical to SEQ ID NO: 190883

SEQ ID NO: 315240 - RNA, 64 nt, Human; identical to SEQ ID NO: 190884

SEQ ID NO: 315241 - RNA, 64 nt, Human; identical to SEQ ID NO: 190885

SEQ ID NO: 315242 - RNA, 64 nt, Human; identical to SEQ ID NO: 190886

SEQ ID NO: 315243 - RNA, 64 nt, Human; identical to SEQ ID NO: 190887

SEQ ID NO: 315244 - RNA, 64 nt, Human; identical to SEQ ID NO: 190888

SEQ ID NO: 315245 - RNA, 64 nt, Human; identical to SEQ ID NO: 190889

SEQ ID NO: 315246 - RNA, 64 nt, Human; identical to SEQ ID NO: 190890

SEQ ID NO: 315247 - RNA, 64 nt, Human; identical to SEQ ID NO: 190891

SEQ ID NO: 315248 - RNA, 64 nt, Human
aaguuaaaaugauuuuugucugaauaaaaaaaaagcauugcaaaugcuuuagaaaucucugaua

SEQ ID NO: 315249 - RNA, 64 nt, Human
gaaggugaguuaaagcugguggaaaaggcuuauugcauugcauucagaguaaccugugugcaua

SEQ ID NO: 315250 - RNA, 64 nt, Human
uuugucaccaguggcuuugguauuuccaugucuggcauugcauaaacuucucuggugugaaagg

SEQ ID NO: 315251 - RNA, 64 nt, Human; identical to SEQ ID NO: 190892

SEQ ID NO: 315252 - RNA, 64 nt, Human; identical to SEQ ID NO: 190896

SEQ ID NO: 315253 - RNA, 64 nt, Human; identical to SEQ ID NO: 190897

SEQ ID NO: 315254 - RNA, 53 nt, Human; identical to SEQ ID NO: 190898

SEQ ID NO: 315255 - RNA, 64 nt, Human; identical to SEQ ID NO: 190899

SEQ ID NO: 315256 - RNA, 64 nt, Human; identical to SEQ ID NO: 190900

SEQ ID NO: 315257 - RNA, 64 nt, Human; identical to SEQ ID NO: 190901

SEQ ID NO: 315258 - RNA, 64 nt, Human; identical to SEQ ID NO: 190902

SEQ ID NO: 315259 - RNA, 64 nt, Human; identical to SEQ ID NO: 190903

SEQ ID NO: 315260 - RNA, 64 nt, Human; identical to SEQ ID NO: 190904

SEQ ID NO: 315261 - RNA, 64 nt, Human; identical to SEQ ID NO: 190905

SEQ ID NO: 315262 - RNA, 64 nt, Human; identical to SEQ ID NO: 190906

SEQ ID NO: 315263 - RNA, 64 nt, Human; identical to SEQ ID NO: 190907

SEQ ID NO: 315264 - RNA, 64 nt, Human; identical to SEQ ID NO: 190908

SEQ ID NO: 315265 - RNA, 64 nt, Human; identical to SEQ ID NO: 190909

SEQ ID NO: 315266 - RNA, 64 nt, Human; identical to SEQ ID NO: 190910

SEQ ID NO: 315267 - RNA, 64 nt, Human
ugggagguggagguuucagugagcugagaucguggcauugcacucuagccugggcaaccaagag

SEQ ID NO: 315268 - RNA, 64 nt, Human
cuuuucagucuucccucuccucaaaccuuguguagcauugcacaauauagaucucagucaacau

SEQ ID NO: 315269 - RNA, 64 nt, Human
gaaugcaucaaguauucauuuauugcccgaauaggcauugcauuaaguccucuguaagguguca

SEQ ID NO: 315270 - RNA, 64 nt, Human; identical to SEQ ID NO: 190914

SEQ ID NO: 315271 - RNA, 64 nt, Human; identical to SEQ ID NO: 190915

SEQ ID NO: 315272 - RNA, 64 nt, Human; identical to SEQ ID NO: 190916

SEQ ID NO: 315273 - RNA, 64 nt, Human; identical to SEQ ID NO: 190917

SEQ ID NO: 315274 - RNA, 64 nt, Human; identical to SEQ ID NO: 190918

SEQ ID NO: 315275 - RNA, 64 nt, Human; identical to SEQ ID NO: 190919

SEQ ID NO: 315276 - RNA, 64 nt, Human; identical to SEQ ID NO: 190920

SEQ ID NO: 315277 - RNA, 64 nt, Human; identical to SEQ ID NO: 190921

SEQ ID NO: 315278 - RNA, 64 nt, Human; identical to SEQ ID NO: 190922

SEQ ID NO: 315279 - RNA, 64 nt, Human; identical to SEQ ID NO: 190923

SEQ ID NO: 315280 - RNA, 64 nt, Human; identical to SEQ ID NO: 190924

SEQ ID NO: 315281 - RNA, 64 nt, Human; identical to SEQ ID NO: 190925

SEQ ID NO: 315282 - RNA, 64 nt, Human; identical to SEQ ID NO: 190926

SEQ ID NO: 315283 - RNA, 64 nt, Human; identical to SEQ ID NO: 190927

SEQ ID NO: 315284 - RNA, 64 nt, Human; identical to SEQ ID NO: 190928

SEQ ID NO: 315285 - RNA, 64 nt, Human; identical to SEQ ID NO: 190932

SEQ ID NO: 315286 - RNA, 64 nt, Human
uaaagacuguauauuugagggguuucagaauuuugcauugcagucauagaagagauuuauuucc

SEQ ID NO: 315287 - RNA, 64 nt, Human
uagacuuguauaucccacugggagcacuuuguaggcauugcaugaaccaugggaugaugauucu

SEQ ID NO: 315288 - RNA, 64 nt, Human
cacauaaaaauucaacuuggcuugggagcagaaugcauugcauuguauaaaugacucuggccug

SEQ ID NO: 315289 - RNA, 64 nt, Human; identical to SEQ ID NO: 190933

SEQ ID NO: 315290 - RNA, 64 nt, Human; identical to SEQ ID NO: 190934

SEQ ID NO: 315291 - RNA, 64 nt, Human; identical to SEQ ID NO: 190935

SEQ ID NO: 315292 - RNA, 64 nt, Human; identical to SEQ ID NO: 190936

SEQ ID NO: 315293 - RNA, 64 nt, Human; identical to SEQ ID NO: 190937

SEQ ID NO: 315294 - RNA, 64 nt, Human; identical to SEQ ID NO: 190938

SEQ ID NO: 315295 - RNA, 64 nt, Human; identical to SEQ ID NO: 190939

SEQ ID NO: 315296 - RNA, 64 nt, Human; identical to SEQ ID NO: 190940

SEQ ID NO: 315297 - RNA, 64 nt, Human; identical to SEQ ID NO: 190941

SEQ ID NO: 315298 - RNA, 64 nt, Human; identical to SEQ ID NO: 190942

SEQ ID NO: 315299 - RNA, 64 nt, Human; identical to SEQ ID NO: 190943

SEQ ID NO: 315300 - RNA, 64 nt, Human; identical to SEQ ID NO: 190944

SEQ ID NO: 315301 - RNA, 64 nt, Human; identical to SEQ ID NO: 190945

SEQ ID NO: 315302 - RNA, 64 nt, Human; identical to SEQ ID NO: 190946

SEQ ID NO: 315303 - RNA, 64 nt, Human; identical to SEQ ID NO: 190950

SEQ ID NO: 315304 - RNA, 64 nt, Human; identical to SEQ ID NO: 190951

SEQ ID NO: 315305 - RNA, 64 nt, Human
ggaauucccuggucagggagauggagucaguggggcauugcagcuuggaaucuauuuuauguca

SEQ ID NO: 315306 - RNA, 62 nt, Human
ugguuuauaaaggagaauagcuauugggguuagcauugcacaaagcccaguuucuuucugug

SEQ ID NO: 315307 - RNA, 64 nt, Human
uauuuauuuuguucauuuauuuauuggagaggcagcauugcacagugaaagaauucuggauauc

SEQ ID NO: 315308 - RNA, 64 nt, Human; identical to SEQ ID NO: 190952

SEQ ID NO: 315309 - RNA, 64 nt, Human; identical to SEQ ID NO: 190953

SEQ ID NO: 315310 - RNA, 64 nt, Human; identical to SEQ ID NO: 190954

SEQ ID NO: 315311 - RNA, 64 nt, Human; identical to SEQ ID NO: 190955

SEQ ID NO: 315312 - RNA, 64 nt, Human; identical to SEQ ID NO: 190956

SEQ ID NO: 315313 - RNA, 64 nt, Human; identical to SEQ ID NO: 190957

SEQ ID NO: 315314 - RNA, 64 nt, Human; identical to SEQ ID NO: 190958

SEQ ID NO: 315315 - RNA, 64 nt, Human; identical to SEQ ID NO: 190959

SEQ ID NO: 315316 - RNA, 64 nt, Human; identical to SEQ ID NO: 190960

SEQ ID NO: 315317 - RNA, 64 nt, Human; identical to SEQ ID NO: 190961

SEQ ID NO: 315318 - RNA, 64 nt, Human; identical to SEQ ID NO: 190962

SEQ ID NO: 315319 - RNA, 64 nt, Human; identical to SEQ ID NO: 190963

SEQ ID NO: 315320 - RNA, 64 nt, Human; identical to SEQ ID NO: 190964

SEQ ID NO: 315321 - RNA, 64 nt, Human; identical to SEQ ID NO: 190968

SEQ ID NO: 315322 - RNA, 64 nt, Human; identical to SEQ ID NO: 190969

SEQ ID NO: 315323 - RNA, 64 nt, Human; identical to SEQ ID NO: 190970

SEQ ID NO: 315324 - RNA, 64 nt, Human
acaaccagaugagaggucaucuaaguagcagugagcauugcacggaacagauucagaugagcau

SEQ ID NO: 315325 - RNA, 64 nt, Human
gugacaaagauauucaacagaaaauauugacccugcauugcaaaacacagguucggguucccua

SEQ ID NO: 315326 - RNA, 64 nt, Human
cauccagcaaaguugccugggauucaaaauaaaggcauugcagaccgcacaggugugcugcagg

SEQ ID NO: 315327 - RNA, 64 nt, Human; identical to SEQ ID NO: 190971

SEQ ID NO: 315328 - RNA, 64 nt, Human; identical to SEQ ID NO: 190972

SEQ ID NO: 315329 - RNA, 64 nt, Human; identical to SEQ ID NO: 190973

SEQ ID NO: 315330 - RNA, 64 nt, Human; identical to SEQ ID NO: 190974

SEQ ID NO: 315331 - RNA, 64 nt, Human; identical to SEQ ID NO: 190975

SEQ ID NO: 315332 - RNA, 64 nt, Human; identical to SEQ ID NO: 190976

SEQ ID NO: 315333 - RNA, 64 nt, Human; identical to SEQ ID NO: 190977

SEQ ID NO: 315334 - RNA, 64 nt, Human; identical to SEQ ID NO: 190978

SEQ ID NO: 315335 - RNA, 64 nt, Human; identical to SEQ ID NO: 190979

SEQ ID NO: 315336 - RNA, 64 nt, Human; identical to SEQ ID NO: 190980

SEQ ID NO: 315337 - RNA, 64 nt, Human; identical to SEQ ID NO: 190981

SEQ ID NO: 315338 - RNA, 64 nt, Human; identical to SEQ ID NO: 190982

SEQ ID NO: 315339 - RNA, 64 nt, Human; identical to SEQ ID NO: 190986

SEQ ID NO: 315340 - RNA, 64 nt, Human; identical to SEQ ID NO: 190987

SEQ ID NO: 315341 - RNA, 64 nt, Human; identical to SEQ ID NO: 190988

SEQ ID NO: 315342 - RNA, 64 nt, Human; identical to SEQ ID NO: 190989

SEQ ID NO: 315343 - RNA, 64 nt, Human
cgcuucucuuauucguguuaggugcccccgccaggcauugcaggcuuagucguggcuacuguuc

SEQ ID NO: 315344 - RNA, 64 nt, Human
gguaggguaguggcugggguggagugggaagggagcauugcagccuaagaagaaggccagagag

SEQ ID NO: 315345 - RNA, 63 nt, Human
gcuccuguaccaaccgcccagccacgcuccaucgccgcccaaagggaggugccaaggccagga

SEQ ID NO: 315346 - RNA, 64 nt, Human; identical to SEQ ID NO: 190990

SEQ ID NO: 315347 - RNA, 64 nt, Human; identical to SEQ ID NO: 190991

SEQ ID NO: 315348 - RNA, 64 nt, Human; identical to SEQ ID NO: 190992

SEQ ID NO: 315349 - RNA, 64 nt, Human; identical to SEQ ID NO: 190993

SEQ ID NO: 315350 - RNA, 64 nt, Human; identical to SEQ ID NO: 190994

SEQ ID NO: 315351 - RNA, 64 nt, Human; identical to SEQ ID NO: 190995

SEQ ID NO: 315352 - RNA, 64 nt, Human; identical to SEQ ID NO: 190996

SEQ ID NO: 315353 - RNA, 64 nt, Human; identical to SEQ ID NO: 190997

SEQ ID NO: 315354 - RNA, 63 nt, Human; identical to SEQ ID NO: 190998

SEQ ID NO: 315355 - RNA, 64 nt, Human; identical to SEQ ID NO: 190999

SEQ ID NO: 315356 - RNA, 57 nt, Human
agccuggcgggcggagcuaagggccuccaccagcauccgagcaggaucaagggccgg

SEQ ID NO: 315357 - RNA, 64 nt, Human
gccuuggucauguacagcacugaaaggaaugaagcaccagcaggagguggacagagucucucau

SEQ ID NO: 315358 - RNA, 64 nt, Human
uggaaagaagguuuguguguuuaagacgccaagggcauugcagaaucccucucaguggacagua

SEQ ID NO: 315359 - RNA, 64 nt, Human
acuuauuuuaaaaagcagaggcccagucaaaugagcauugcaucccaugagggaagcacgacag

SEQ ID NO: 315360 - RNA, 64 nt, Human
ggaacagccuuucucgaaucuguuuucagcucuugcauugcauagaugaaccucagcauguaaa

SEQ ID NO: 315361 - RNA, 64 nt, Human
gaguccuuggauccagugcuacgucaguaaauagcaccagcauuuugcaauugcugaucugcug

SEQ ID NO: 315362 - RNA, 64 nt, Human
cuggaggcuggagccaggggccacuucugaacugcaccagcaccaggcccacccucgucucugc

SEQ ID NO: 315363 - RNA, 64 nt, Human
ccuccccauagccagcacagcuaucccgcggggacaccagcacugagcccccucucccuccugc

SEQ ID NO: 315364 - RNA, 64 nt, Human
ucaaucaaacuauuguagcagcuacaaaguaauucaccagcaugacaaaauggucaaaaaauaa

SEQ ID NO: 315365 - RNA, 64 nt, Human
cagcugccugucucuuagaugcacuuucuuuuuccaccagcacauccuucaacacacagaauuu

SEQ ID NO: 315366 - RNA, 64 nt, Human
ggggucucauguccugcuggcuuccagcuucaggcaccagcauccaccuuggcucugccagugg

SEQ ID NO: 315367 - RNA, 64 nt, Human
guuugaugccaucuccauuuugggugaccuguuucaccagcaggccuguuacucuccaugacua

SEQ ID NO: 315368 - RNA, 64 nt, Human
gaucagggcacuauuccuggaggguccagucauucaccagcauuugcaaauguccauagggagc

SEQ ID NO: 315369 - RNA, 64 nt, Human
uaagacaaacacgugcucguccuuuaauggaguucaccagcacacuuguuaaccaguccuguuu

SEQ ID NO: 315370 - RNA, 64 nt, Human
caaaagcauaaccuugaccaaaccaaacaauaggcaccagcaaugcugucauucaguuaugcag

SEQ ID NO: 315371 - RNA, 64 nt, Human
ggacaauugucaaaggagcgggggagggcaaauucaccagcaggggcuaggaauuuagaaaaua

SEQ ID NO: 315372 - RNA, 64 nt, Human
agacuacuucuuccccagauagcuggcuggguggcaccagcagccuggacccuguggaugauaa

SEQ ID NO: 315373 - RNA, 64 nt, Human
ggauuaaugguagcagggaacugccuccucuccccaccagcaccauggcuggcaucgcucaggu

SEQ ID NO: 315374 - RNA, 64 nt, Human
gccugggcagccaucacaccacgaggacaggaagcaccagcacguuucacaccucccccuuccc

SEQ ID NO: 315375 - RNA, 64 nt, Human
acuccagcucuacgucccacauuuuagaauaccccaccagcagaacaaacucagaucucaucag

SEQ ID NO: 315376 - RNA, 64 nt, Human
aagcaauuaaauaugcguaacagugcuacggccacaccagcaccuccuggcugaaggucagccc

SEQ ID NO: 315377 - RNA, 64 nt, Human
cucauuuucucaguuuuuugguauuuaaaccauugcauugcaguagcaucauuuuaaaaaaugc

SEQ ID NO: 315378 - RNA, 64 nt, Human
acugcagcgccuuuaagcauaaaguaacacaacagcauugcacggggccggcacugccgcugcc

SEQ ID NO: 315379 - RNA, 64 nt, Human
cucucuuguuggccagagggccugcuucccaugggcauugcaagugccaccgugcggggccugg

SEQ ID NO: 315380 - RNA, 64 nt, Human
acaguaugugggauaugucagucaaguuggucagcaccagcaucuguccagcuguucaguauau

SEQ ID NO: 315381 - RNA, 64 nt, Human
aaauuacuauaccucuaaguauuuucaugaaauucaccagcaguuugcaagcacaguuuugcaa

SEQ ID NO: 315382 - RNA, 64 nt, Human
ucgcucagacacuuuggcaggaugucuggggccucaccagcaggagcgcgugcaagccgggcag

SEQ ID NO: 315383 - RNA, 64 nt, Human
gcucugacccacagcaauagagcaaguuacccaucaccagcauuuguacagagcagggaauucu

SEQ ID NO: 315384 - RNA, 64 nt, Human
ucaugguggucuccugggcuuggucacugucucucaccagcauguuucuuugugcggucaggaa

SEQ ID NO: 315385 - RNA, 64 nt, Human
agaguacauuugcuuuaaugagugcaccugccuccaccagcaaggggaccccgagaacccugag

SEQ ID NO: 315386 - RNA, 64 nt, Human
gguaaauaauuucugccaggaaacuucccagccccaccagcagccccccuaaaaaaaucacucg

SEQ ID NO: 315387 - RNA, 64 nt, Human
cgcuaccugcggaaauaacagccucagccggggccaccagcacugcugccacuucuuccagccc

SEQ ID NO: 315388 - RNA, 64 nt, Human
aacuaccccagcccaggcucucaccaucuccagucaccagcaucucccucuccucccaaucucc

SEQ ID NO: 315389 - RNA, 64 nt, Human
gagauccgcccagaccccucuccugcccucugcacaccagcagcaggcaugaaccuugggucug

SEQ ID NO: 315390 - RNA, 55 nt, Human
ucagcagccccuguggcuagaggaacaccagcacaaacgacagccucaagucucc

SEQ ID NO: 315391 - RNA, 64 nt, Human
augaugggguggagucagcccugcuuccccuccccaccagcagggggcgcacuggugucugaca

SEQ ID NO: 315392 - RNA, 64 nt, Human
ugcccccuuugaccuuccccaaaggauggucacacaccagcacuuuauacacuucuggcucaca

SEQ ID NO: 315393 - RNA, 64 nt, Human
cauuacuggaacuaaugguuuuaaccuccuuaaccaccagcaucccuccucuccccaaggugaa

SEQ ID NO: 315394 - RNA, 64 nt, Human
gcuaugcuuuaggucucaauuuuggaauuucaaacaccagcaaaaaauuggaaaucgagauagg

SEQ ID NO: 315395 - RNA, 64 nt, Human
auccacuucaggccaaaacaugcuaaagauaacacaccagcacauugacucucucuuugauaac

SEQ ID NO: 315396 - RNA, 64 nt, Human
uguacaugaauuaucagaaaaaaauuuuuggagugcauugcaauuuuuuuuaaagcauaaaaca

SEQ ID NO: 315397 - RNA, 64 nt, Human
cuccugggucuuggagggaugugggaaugaauuggcauugcaggaaagacagguaaagugauug

SEQ ID NO: 315398 - RNA, 64 nt, Human
ucauuuucaucaagacaccuuuuuucuaaaauaggcauugcauacacauaugcacacguaugug

SEQ ID NO: 315399 - RNA, 64 nt, Human
acucuccugguuguguaacugaagauguucugcccaccagcaccagaggucacucuccacaucc

SEQ ID NO: 315400 - RNA, 64 nt, Human
cuuugaggggcugauggcaauaucuaaaaccaggcaccagcaugaacaccaagcugggggugga

SEQ ID NO: 315401 - RNA, 64 nt, Human
auguccagaggggucuggagcuuuguuuccuguucaccagcaaaaaaugucucucccauuuuuc

SEQ ID NO: 315402 - RNA, 64 nt, Human
gugcggaggaaguagcuggacaggcccugccccucaccagcaagaggcaugauuggauggagcu

SEQ ID NO: 315403 - RNA, 64 nt, Human
acagcucacacauguagcacacuuaugcgucaggcaccagcauguacaccuuaauuuauuuaac

SEQ ID NO: 315404 - RNA, 64 nt, Human
aggccucagccccucuuucccaggcccuggaucucaccagcagccaagguugagccagaaccag

SEQ ID NO: 315405 - RNA, 64 nt, Human
aguuggcauggguugcccuacaggcccacagggccaccagcacacccccgcacgcugggcacca

SEQ ID NO: 315406 - RNA, 64 nt, Human
aaccucaccccuggaaagccaccagauuggaggucaccagcaugaugauaauauucaugaccug

SEQ ID NO: 315407 - RNA, 64 nt, Human
gugccgucacaucgcugucucugauuguccccggcaccagcaggcccuuggggggcucaccuga

SEQ ID NO: 315408 - RNA, 64 nt, Human
uuaaagaaaugguagaaaauuugauaaucugaaucaccagcauucaaacaaauauuucggcaau

SEQ ID NO: 315409 - RNA, 64 nt, Human
gccccauauucccagcaucauagacauccaacagcaccagcaggagagugggcuagccugcugg

SEQ ID NO: 315410 - RNA, 64 nt, Human
cacagccucggaacugaauucagagcaggcagagcaccagcaagugcugcuuuacuaacugacg

SEQ ID NO: 315411 - RNA, 64 nt, Human
aauauuaguggcuuacauuuuaaaaaagaaaaaucaccagcaugaacuugcaccuaagucuaua

SEQ ID NO: 315412 - RNA, 64 nt, Human
aaacaaaaaccaguuuaggcuggguaugguggcucaccagcacuuugggaggcugaggcaggug

SEQ ID NO: 315413 - RNA, 64 nt, Human
guuaaaugaaccagugggggcaggucccuccaaccaccagcacugacuccugggcucugaagaa

SEQ ID NO: 315414 - RNA, 64 nt, Human
ucaaaacuucuuuaagcugguaaagugaggggcccaccagcagugaucuccugaugccuuacug

SEQ ID NO: 315415 - RNA, 64 nt, Human
aacucuggcuuccagguaucuccaggauugaagagcauugcauggacaccccuuauccaggacu

SEQ ID NO: 315416 - RNA, 64 nt, Human
gucagaaucaguuuucccauaaaagggugggcuagcauugcagcugcauuugggaccauucaaa

SEQ ID NO: 315417 - RNA, 64 nt, Human
gcagagggaggaagauggcucccaagguuccuaggcauugcaggaccuugggcacaucugcugg

SEQ ID NO: 315418 - RNA, 64 nt, Human
uccaccuguucaggagcugaagcccaugcuuucccaccagcaugucacucccagaccaccuccc

SEQ ID NO: 315419 - RNA, 64 nt, Human
ccucagcaguuguucuccaccccuucuccaccuccaccagcaaggagaagucaaucuacacuuu

SEQ ID NO: 315420 - RNA, 64 nt, Human
uaaauucacuuugaaacaggccucaucccacuuccaccagcaccauagaagaauaauucugggc

SEQ ID NO: 315421 - RNA, 64 nt, Human
acauucaaggcccgugauacagggaugaggucagcaccagcaaacucuggacugguggaagaau

SEQ ID NO: 315422 - RNA, 64 nt, Human
aaagguuuuuagauuuuauaggagcuaauuuguccaccagcauuaauguaacacaguguaguua

SEQ ID NO: 315423 - RNA, 64 nt, Human
gggugucccagggacucugucagugccuucagcccaccagcaggagcuuggaguuuggggagug

SEQ ID NO: 315424 - RNA, 64 nt, Human
ggaaguggcuguggucucacuggauccccacuggcaccagcagugugggugggccucauguaac

SEQ ID NO: 315425 - RNA, 64 nt, Human
gaaaacaucuuuucuagcuucaacagagagguuucaccagcacauuuaccagaagaaucuggga

SEQ ID NO: 315426 - RNA, 64 nt, Human
gaugaguuugggacuucaggaaaaaucaacccagcaccagcagcuaccaaccaccauuccaucu

SEQ ID NO: 315427 - RNA, 64 nt, Human
gaaguaacgaagcuaagaauaugagagugcuugucaccagcacaccuguuuuuuuucuuuuucu

SEQ ID NO: 315428 - RNA, 64 nt, Human
uggaccaugugacuggaagguggguaaccaaguucaccagcaauaaaacccagcgcccagguag

SEQ ID NO: 315429 - RNA, 64 nt, Human
uguuuucuauagcagcuguaccauuuuacauucccaccagcaauguauccagguuucaauuugu

SEQ ID NO: 315430 - RNA, 64 nt, Human
cgccgugccgcagcgugcccacgugcccacgccccaccagcaggcggcugucccggaggccgug

SEQ ID NO: 315431 - RNA, 64 nt, Human
ggcggccguuagucauuacugcugaguccugggucaccagcagacacacugggcauggaccccu

SEQ ID NO: 315432 - RNA, 64 nt, Human
uauauguacagacauguacucucacacacacaggcaccagcauacacacguuuuucuagguaca

SEQ ID NO: 315433 - RNA, 64 nt, Human
gaccugagggcagaaagguucugcccgggaaggucaccagcaccaacaccacgguagugccuga

SEQ ID NO: 315434 - RNA, 64 nt, Human
uuugacuuccuucuguuuuauuuuuuucccuuuagcauugcaugugaauaagaaaauaauguuu

SEQ ID NO: 315435 - RNA, 64 nt, Human
guuaaaaaaaaaaaaaaggaacagaaacaacuuugcauugcauuggcuugacccauaaacuaag

SEQ ID NO: 315436 - RNA, 64 nt, Human
uauacaugauccaggcacauuugaaauuugguaggcauugcaaacacauuugaauauuguguau

SEQ ID NO: 315437 - RNA, 64 nt, Human
gccucaugacuuuaaucagcuugaacugccagugcaccagcaguuuaggugugaugagagaauu

SEQ ID NO: 315438 - RNA, 64 nt, Human
uggcugaggcccugaguguccagccacaugguggcaccagcaccacuccuuuccuuaccacauc

SEQ ID NO: 315439 - RNA, 64 nt, Human
ccaaagccagagacucgaacagccuccccaccaccaccagcauaugucaaggagcacuugcagg

SEQ ID NO: 315440 - RNA, 64 nt, Human
uuuguaaauuuuugaaaugcuaguaauguguuuucaccagcaaguauuuguugcaaacuuaaug

SEQ ID NO: 315441 - RNA, 64 nt, Human
acacuccaaauuuaauguguuuaaauugguggggcaccagcagaaaauauucuagcucagcuuu

SEQ ID NO: 315442 - RNA, 64 nt, Human
cugaaaaugugcuguguuccuaccucggcaagaucaccagcacugaggggcccagcuggagaau

SEQ ID NO: 315443 - RNA, 64 nt, Human
aacaacaaaaaacaaccauuugaaaaauuuuugucaccagcaaaacuuuucacuaauuagugau

SEQ ID NO: 315444 - RNA, 64 nt, Human
uacccaaccuuugccgcugccuguucccacgugucaccagcacgcugcacuccagaugaaaucc

SEQ ID NO: 315445 - RNA, 64 nt, Human
uuugucccagugaaacaggcuaaauaaauuuuggcaccagcaaauuuguuacuuuguuuuuuua

SEQ ID NO: 315446 - RNA, 64 nt, Human
ggccaaguccaacagagaccccaaacccaccacacaccagcagccacaaccucaccaccaacaa

SEQ ID NO: 315447 - RNA, 64 nt, Human
ccugcccuucccacaggugagcagggcuccuguccaccagcacacucaguucucuucccugcag

SEQ ID NO: 315448 - RNA, 64 nt, Human
gagccucgguuuccuuaucuguaaagcaaagcgacaccagcaagccugugagcauuguguauau

SEQ ID NO: 315449 - RNA, 64 nt, Human
ggccagcugagguacaggcaggggcaggcaggaccaccagcagggggcugccucugcacccuac

SEQ ID NO: 315450 - RNA, 64 nt, Human
ccccacaguccaggcccuucagccaagggcucugcaccagcaccuuggaagcaccaauaaagag

SEQ ID NO: 315451 - RNA, 64 nt, Human
ucucagugauaauggagguuucacugugaagcaucaccagcagauccuuguuuugacaaaaaaa

SEQ ID NO: 315452 - RNA, 64 nt, Human
aauauuaaggaugaccugugcaaaauuauacccacaccagcacuagugguaauuauucuaaauu

SEQ ID NO: 315453 - RNA, 64 nt, Human
cccuuugguaggugcaccugagcaccuacauuuggcauugcagccuagccaaaaagggcuggca

SEQ ID NO: 315454 - RNA, 64 nt, Human
guuuuaaaugugaauucuucccagaaauuucaaugcauugcauauuuagccuucggcauauuuu

SEQ ID NO: 315455 - RNA, 64 nt, Human
uuucccuucuguucuguucauguagcacagauaagcauugcacuugguaccaugcuuuaccuca

SEQ ID NO: 315456 - RNA, 64 nt, Human
uuaacggggcacuaaacaaaacaaccaauaaagucaccagcaguauuacuaucacaccaacagc

SEQ ID NO: 315457 - RNA, 64 nt, Human
aaaaaauaauuuccauguaaguuaccagaaagcccaccagcaacauaauuuuaaagccuuucag

SEQ ID NO: 315458 - RNA, 64 nt, Human
caugcacacugaacucugcucagugcuaaacagucaccagcagguuccucaggguuucagcccu

SEQ ID NO: 315459 - RNA, 62 nt, Human
ccucacagcgcagcaagugaggcucccacaggcaccagcaaaacaacggaugaauguagccc

SEQ ID NO: 315460 - RNA, 64 nt, Human
aagccuacaaggggcagaccacgcugauucaguacaccagcaaugcugaggaugccaacuucac

SEQ ID NO: 315461 - RNA, 64 nt, Human
ccucucgccccugugcacccggagaugcccacagcaccagcaccugagcucaccuccgaacccg

SEQ ID NO: 315462 - RNA, 64 nt, Human
gcaucugucuuuucacccacggagggcacagaaccaccagcaaagccggcggcuggacuggcgc

SEQ ID NO: 315463 - RNA, 64 nt, Human
cacuggcugguguggccgccacagagaguguuaccaccagcacccagaccgaacccccaccggc

SEQ ID NO: 315464 - RNA, 64 nt, Human
cagauuacuuaucuuccuucucugcuuugugacucaccagcaguaacacacacaauccacaucu

SEQ ID NO: 315465 - RNA, 64 nt, Human
ucucuguuucccuuggggaaugccauauuuaauucaccagcaguaauccuuuaauaacuggcag

SEQ ID NO: 315466 - RNA, 64 nt, Human
gugccuugugucuugugucaggccuugcccuucccaccagcaugucccucguggcucagggugc

SEQ ID NO: 315467 - RNA, 64 nt, Human
cguuccucccggccuaguccguggaggcccaucacaccagcauccgugacgccagcuucccacu

SEQ ID NO: 315468 - RNA, 64 nt, Human
aaugcagcuaauuuugauagcugcauucauuuaucaccagcauauuguguucugagugaaucca

SEQ ID NO: 315469 - RNA, 64 nt, Human
gccuuuuaaacaacuaggauucccuacuaaccuccaccagcaaccuggacugccucagcauucc

SEQ ID NO: 315470 - RNA, 64 nt, Human
aggugcugcucagauuuucaaguguuguucuuuccaccagcaggaaguagccgcauuugauuuu

SEQ ID NO: 315471 - RNA, 59 nt, Human
gagggagcacaggaggauagccgcaucaccaccagcagcucuugcccagagcugugcag

SEQ ID NO: 315472 - RNA, 64 nt, Human
guauagauuuuucucacugaaaagugagaguuacgcauugcagccaugaagggaugcuaggauc

SEQ ID NO: 315473 - RNA, 64 nt, Human
agaacauuucuguacuagugagaagagggaauaugcauugcaguucagcaaagccggaauucug

SEQ ID NO: 315474 - RNA, 64 nt, Human
uugagcaucuucuacauccuaggcauuguccuaggcauugcauguuuauauccccaauucucac

SEQ ID NO: 315475 - RNA, 64 nt, Human
aaugcgccgucaccaucuccaccugccaccaaaccaccagcagaguagccgccgcugcugugag

SEQ ID NO: 315476 - RNA, 64 nt, Human
acacagaaucaggaccagcaugugcagagcuggccaccagcacaggcuuagggcaguucagaac

SEQ ID NO: 315477 - RNA, 64 nt, Human
acaggugaguacucauaauuggccagcaucucaccaccagcaaguaguagggccaggucaaucc

SEQ ID NO: 315478 - RNA, 64 nt, Human
ucugcauuccccccuccacaccauccuagcgaggcaccagcacaccuaaucacagcaaagccca

SEQ ID NO: 315479 - RNA, 64 nt, Human
aacuccgaagaaaacccuuacuguccaagaccgucaccagcaaccauccgcagucauucaagug

SEQ ID NO: 315480 - RNA, 64 nt, Human
ccagcuauguccucuaggaaaugacagacccaaccaccagcaauaaacauuuccauugucacug

SEQ ID NO: 315481 - RNA, 64 nt, Human
ccucuuuggaaagagaaccaugaaaacaaugccucaccagcagaagaacagaauaucaggaugc

SEQ ID NO: 315482 - RNA, 64 nt, Human
uaaugaagauggagcagaaugagcagaugcagaucaccagcaaagugcacugaugugugagcuc

SEQ ID NO: 315483 - RNA, 64 nt, Human
uuccucugaguugaccagcagcaggucugccgaccaccagcaccauccucuccucccagcagcc

SEQ ID NO: 315484 - RNA, 64 nt, Human
uacaccaagauggucaaauuacuacacaaaucagcaccagcacagucugauagcugcaaauguc

SEQ ID NO: 315485 - RNA, 64 nt, Human
cuguugggugaaugaggcagaugggaaagagccucaccagcagcugcuuuuggagcaggggucc

SEQ ID NO: 315486 - RNA, 64 nt, Human
gggugugacuugaaaguaucgugaccauguggcccaccagcagccuuuccaaaggggaacucca

SEQ ID NO: 315487 - RNA, 64 nt, Human
auacucgagccucuccucucugguugccuccugccaccagcauccauggcucauuugacaccuu

SEQ ID NO: 315488 - RNA, 64 nt, Human
gugacuaugccuccucuucugcacagaaugcuuccaccagcauccugagaagaaaugauuacuu

SEQ ID NO: 315489 - RNA, 64 nt, Human
ccccacccgccucuagcccccagcccgaggcccccaccagcaguuggcgguagcagcuacuccg

SEQ ID NO: 315490 - RNA, 64 nt, Human
auggaaauaauaaagcucuuuauaugagcugucccaccagcaacuuauauauguaaacauacau

SEQ ID NO: 315491 - RNA, 64 nt, Human
uuuuugaauucagauuuaaaaaccaacuuauaaagcauugcaacaagguuaccucuauuuugcc

SEQ ID NO: 315492 - RNA, 64 nt, Human
aaaaaaaaaaaggaaacuuuuuuuguuugcucuugcauugcaaaaauuauaaaguaauuuauua

SEQ ID NO: 315493 - RNA, 64 nt, Human
uuauuucuuuauuuuaauucugcuugguguucuugcauugcauuuaaugaucccuuuucucccc

SEQ ID NO: 315494 - RNA, 64 nt, Human
acgagagguuguacacacauugguaguuauuuugcaccagcagugccuuucucacuggggguac

SEQ ID NO: 315495 - RNA, 64 nt, Human
auggccacccgcccacagccaggccgagagcagacaccagcagcccugucacgccgggcucuac

SEQ ID NO: 315496 - RNA, 64 nt, Human
cuaagaauggagugaagaaaggcaguauggcaggcaccagcaaagaguugagggcuguugcucu

SEQ ID NO: 315497 - RNA, 64 nt, Human
cauguaacaaagaaugcuugcauuugauuaguuucaccagcauuugagagaaggacccuuuagc

SEQ ID NO: 315498 - RNA, 64 nt, Human
acaguuguuucauaaaugagcacuguugugauaacaccagcauucauuuagcuugauugauauc

SEQ ID NO: 315499 - RNA, 64 nt, Human
aagucacacccuccgaaagaugaguagaaaccagcaccagcacagcccagaucuucucuuuccu

SEQ ID NO: 315500 - RNA, 64 nt, Human
augagccagaggcguaggggcccaggagagcccccaccagcagcacaauucugucccugucccu

SEQ ID NO: 315501 - RNA, 64 nt, Human
auuguugagcaaguuuuagcccugcaguuuucaccaccagcaccuacccagcauucugguuuuu

SEQ ID NO: 315502 - RNA, 64 nt, Human
gguggaacgaggagacgggagcgagugggcucuccaccagcacaucacuaugcaucuguuccag

SEQ ID NO: 315503 - RNA, 64 nt, Human
auaugcaaaguggugguggggucaagacagaugacaccagcacuuuaaacucuuugugugggua

SEQ ID NO: 315504 - RNA, 64 nt, Human
caggcggccaggauucaacucccugccuggaucucaccagcacuuucccucuguuuccugaccu

SEQ ID NO: 315505 - RNA, 64 nt, Human
ccuuucuuauucugugagauguuuuguauuauuucaccagcagcauagaacaggaccucugcuu

SEQ ID NO: 315506 - RNA, 64 nt, Human
ucccuuccugcucccagacagucucacaaguaaacaccagcagcucauagauuacaaccaagaa

SEQ ID NO: 315507 - RNA, 64 nt, Human
acccuccccacaucugaaacugccuccccccaaccaccagcagcagcagggcccuccuccccca

SEQ ID NO: 315508 - RNA, 64 nt, Human
gcacgcauuaugaaauguuaaacaaauuacuuuucaccagcaucuuuacuauaauuaccaaaaa

SEQ ID NO: 315509 - RNA, 64 nt, Human
uuugcuaucugacugcugaucugcgugacagaaacaccagcauauuugcaacgccaaggauauu

SEQ ID NO: 315510 - RNA, 64 nt, Human
ggagagaauauuuggagauaggcagcuucaggaugcauugcaaucauccuuuucuuaaauuaug

SEQ ID NO: 315511 - RNA, 64 nt, Human
auaugcgacuauuuugccauggagaaaucugacagcauugcaaacaauaguauuguuugaugua

SEQ ID NO: 315512 - RNA, 64 nt, Human
ccaucccuccuccugccuucauuggggcagacuugcauugcagucugacaguaauuuuuuuucu

SEQ ID NO: 315513 - RNA, 64 nt, Human
accugcaccaauauguucauuacagugcuauucucaccagcaaggacagagaaucaaucuaagu

SEQ ID NO: 315514 - RNA, 64 nt, Human
cuacauccgaaacuucacacaggguguuucugagcaccagcacuuccagcgcuucacuuaacgg

SEQ ID NO: 315515 - RNA, 64 nt, Human
cccugucggaaaagucaccacuuuagucccuggccaccagcacaccccaggagggugaguggcc

SEQ ID NO: 315516 - RNA, 64 nt, Human
uagagaaagcaauaguucaagucccuaccugugccaccagcauguuaacuaugacauugggacu

SEQ ID NO: 315517 - RNA, 64 nt, Human
uguuuuccacagcaguugaaccauuccacauucccaccagcaauguaugagaauuccaauuucu

SEQ ID NO: 315518 - RNA, 64 nt, Human
ggaccagcacaugaggcugaggcugaggggcagucaccagcaccaggaagaaggugguaggagg

SEQ ID NO: 315519 - RNA, 64 nt, Human
gaguuucagccacugaacuccaagguccacuucucaccagcaaggaagagugggguauggaagu

SEQ ID NO: 315520 - RNA, 64 nt, Human
caccacaugugcacacacggguguuggugcaacucaccagcaggugugcaguaggcaagcuuga

SEQ ID NO: 315521 - RNA, 64 nt, Human
ugggccaggcugaugggacagaauuggauacauacaccagcauuccuuuugaacgccccccccc

SEQ ID NO: 315522 - RNA, 64 nt, Human
cucugcaucccaacauucccaggacaugcaugaucaccagcauuuauuuucauuauuugaggau

SEQ ID NO: 315523 - RNA, 64 nt, Human
gccaaagacaugacaucaaauaaguaauagacaucaccagcaaugaauuuugaaaagcaaaaaa

SEQ ID NO: 315524 - RNA, 64 nt, Human
aagcacuugccaagcuuggucaucuaugacaccacaccagcacaguaggaccucagaaaaguac

SEQ ID NO: 315525 - RNA, 64 nt, Human
aagaggaggaggugauguagcacuuccaagauggcaccagcauuugguucuucucaagaguuga

SEQ ID NO: 315526 - RNA, 64 nt, Human
ugagaggauaggcacaguggaccgggcagguguccaccagcagcucagccccugcagucaucuc

SEQ ID NO: 315527 - RNA, 64 nt, Human
acaggcccccucagggcuccuugccuuucccccccaccagcacaccccguacccugccuggaau

SEQ ID NO: 315528 - RNA, 64 nt, Human
agaagauuuagaaguuuccuaguuuuaaguguuucaccagcaaguauuccauaccuacuugaug

SEQ ID NO: 315529 - RNA, 64 nt, Human
aaaaaagccacuucugcuucuguguuuccaaacagcauugcauugauucaguaagauguuauuu

SEQ ID NO: 315530 - RNA, 64 nt, Human
uguuacuaugacaacauuuuuacuguccuuuaaagcauugcaauagcguuuuuggauaugccuc

SEQ ID NO: 315531 - RNA, 64 nt, Human
gcucuauguuucaguagcagauuuucacacaugugcauugcagagacgucaugauucguggaaa

SEQ ID NO: 315532 - RNA, 64 nt, Human
caauaaaggaaaauuacggaaggaaaauaggcaacaccagcaaauuauauguggacagguucua

SEQ ID NO: 315533 - RNA, 64 nt, Human
ccccaggccugcucugggaagucggcuccaugcucaccagcagccgcccaggcccgcagccuca

SEQ ID NO: 315534 - RNA, 64 nt, Human
agcucaguuugccagcauaagugccaaagaccaucaccagcaucuguccuucagggugcucgga

SEQ ID NO: 315535 - RNA, 64 nt, Human
uaacaugcuggucauaacugugccaagaaauccucaccagcaguugcugauuuugaaaacagcc

SEQ ID NO: 315536 - RNA, 64 nt, Human
ggcacuuggcuuucuguuccuagagcccaucccgcaccagcauuuuggaaccugcagagagccu

SEQ ID NO: 315537 - RNA, 64 nt, Human
caguaucagugagugccauacagaauuguguauucaccagcaucaugaaacaguuguggucuuu

SEQ ID NO: 315538 - RNA, 64 nt, Human
ccuaaauaaugaguaggaucuuguuuuguuuuaucaccagcacacagauugcuauaaacuguua

SEQ ID NO: 315539 - RNA, 64 nt, Human
cgcguguugguggcuguggccauggcucugugcccaccagcaucucccuccugagaugccggcc

SEQ ID NO: 315540 - RNA, 64 nt, Human
ggucauauucauaccuucugaugaaguuguacaacaccagcaacauuauaauggcccuguagcu

SEQ ID NO: 315541 - RNA, 64 nt, Human
gauaauaacuaacucugcuuagagguucaaauaucaccagcaaucaguaaaaaauucagcaaua

SEQ ID NO: 315542 - RNA, 64 nt, Human
uugaagccagucuuuaagaaaccuggguuaaagacaccagcacuucugcuugcugggcuggcug

SEQ ID NO: 315543 - RNA, 64 nt, Human
cagauuuuguaggaaggcauacugaauucuuugucaccagcacuuuugauaugaacaguauucg

SEQ ID NO: 315544 - RNA, 64 nt, Human
agccggaagggaagggacaccaaggaucuccggccaccagcagaagccagcagagaggcauggg

SEQ ID NO: 315545 - RNA, 64 nt, Human
uagaaauuugcaagggcuucuuuuccgcaaaugccaccagcagauuauaauuuugucagcaaug

SEQ ID NO: 315546 - RNA, 64 nt, Human
gagggcauuuagaauuuagaaucugagcacaucacaccagcaccagcucccugucucuucuagc

SEQ ID NO: 315547 - RNA, 64 nt, Human
cuguccaugcggccucacugggggccaucagccucaccagcaaagcagagaugagagcguggga

SEQ ID NO: 315548 - RNA, 64 nt, Human
cccuccagcuucccucaugguggcagccuaaccugcauugcagccguucaccggacaccgcacc

SEQ ID NO: 315549 - RNA, 64 nt, Human
guguuauaugcuauguacaugucagaaaccauuagcauugcaugcagguuucauauucuuucua

SEQ ID NO: 315550 - RNA, 64 nt, Human
ccccuccagacuggcaguuucaaggaugcaaauugcauugcaaaaucaaacugacucaugaagc

SEQ ID NO: 315551 - RNA, 64 nt, Human
gucaugaggggccuaugccuuuacuccuuuuaaacaccagcacccgucuuuuccccaaccuaaa

SEQ ID NO: 315552 - RNA, 64 nt, Human
ccagcacccgucuuuuccccaaccuaaaaccaaccaccagcauuucacuacaggaccaaaugga

SEQ ID NO: 315553 - RNA, 64 nt, Human
ucacucagggcaccugcccccuccucuucgugaacaccagcagauaccuccuugugccuccacu

SEQ ID NO: 315554 - RNA, 64 nt, Human
aagaauugagcuaauaauauguuuuaacucuuaacaccagcaagaagucagucauuuauugaag

SEQ ID NO: 315555 - RNA, 64 nt, Human
gagacugaucucuucaauuauugucaucuguagccaccagcacaucacucuuauguaaucccca

SEQ ID NO: 315556 - RNA, 64 nt, Human
ugcccacgagcccugguuuggguggcaagacucacaccagcagcggacugcaggccuuagaggc

SEQ ID NO: 315557 - RNA, 64 nt, Human
uugcuuuuuuuccauuuucccucaugaauagacucaccagcauuuuacccccuuguuauaaaac

SEQ ID NO: 315558 - RNA, 64 nt, Human
acaguggcauagacuccuucacacaucacuguggcaccagcaacuacuucuuuauauuguucuu

SEQ ID NO: 315559 - RNA, 64 nt, Human
aggaaauauuuugugaugguguucuggguccauacaccagcaaugaaggagauagauuugugua

SEQ ID NO: 315560 - RNA, 64 nt, Human
guugggggacaggccgguggcugacccaggauugcaccagcauguccauagagaagagguuuuc

SEQ ID NO: 315561 - RNA, 64 nt, Human
ugugaguggcuaaugagaagagggacagaccgaccaccagcacaguagggcagaucuggacagc

SEQ ID NO: 315562 - RNA, 64 nt, Human
caccgucacccagcaugcgccacgccguggcucccaccagcagugccaccgccaccacacccca

SEQ ID NO: 315563 - RNA, 64 nt, Human
gauugacgucacuaagaggccuuguguagaaguacaccagcaucauuguaguagaguguaaacc

SEQ ID NO: 315564 - RNA, 64 nt, Human
uaguccaacuuggggugggcaaggcagucagcaucaccagcaauaccacaggacccucacccca

SEQ ID NO: 315565 - RNA, 64 nt, Human
ugcuacccucuuuugaagauguucucuagccuuccaccagcagcgaggaauuaacccugugucc

SEQ ID NO: 315566 - RNA, 64 nt, Human
caccgcccacuucuagccccguggaugccgucaccaccagcacacggaacuaccucccaccccc

SEQ ID NO: 315567 - RNA, 64 nt, Human
gcucugacauuguuuuccaaagacacacuaaacugcauugcacaguucaaaauuugauuacuua

SEQ ID NO: 315568 - RNA, 64 nt, Human
gcccugguggaaaagccaguagcacauacgcagggcauugcagggcuucccuauugaugguuca

SEQ ID NO: 315569 - RNA, 64 nt, Human
gaggcaacugacuucauuugugccacacgcaugggcauugcagccuugcgcugucccaggcaug

SEQ ID NO: 315570 - RNA, 64 nt, Human
cagauacugaauguauacguauugugccugagcucaccagcaaacagaagcaucaagcccaggg

SEQ ID NO: 315571 - RNA, 64 nt, Human
gugagucauggaauugucaaaguaagccuucccucaccagcaaauugucuccugaucugaauga

SEQ ID NO: 315572 - RNA, 64 nt, Human
caagcaaagagagaggcuucagaagaaacaaaaucaccagcaccuugaucuuugacuucuaauc

SEQ ID NO: 315573 - RNA, 64 nt, Human
cuuaagcuuccccagucuuggccccaaaugcagucaccagcaaguuuuccauuuuccaagucca

SEQ ID NO: 315574 - RNA, 64 nt, Human
gaaggcguguggugcaggccugugcucacaguggcaccagcaacccugggucucccucucugcu

SEQ ID NO: 315575 - RNA, 64 nt, Human
acuugcugcaggcuggggggcacugggugguucucaccagcaggcugcggggcacuguguucuc

SEQ ID NO: 315576 - RNA, 64 nt, Human
ggauguggaagacaaauccuguccagccggguggcaccagcacucaggcuacugucacaucuug

SEQ ID NO: 315577 - RNA, 64 nt, Human
cccgucuccaucuagcaggaaaagccauaucuugcaccagcagcaugaauggucccuccacacu

SEQ ID NO: 315578 - RNA, 64 nt, Human
ugcacccccaccauuccuacacaucuugccagcccaccagcagccccacucacagcugcugcac

SEQ ID NO: 315579 - RNA, 64 nt, Human
gccugugagggccguagaccuuguauauacccugcaccagcagugaccgggcagagcccaaccc

SEQ ID NO: 315580 - RNA, 64 nt, Human
gaagcacccagugucggcuccccauccaaauccacaccagcaccuuguuacagacaagaaguca

SEQ ID NO: 315581 - RNA, 64 nt, Human
agcucccacacaucacacaggcugguaaucucuucaccagcaccaauuucauuuuacuccaggc

SEQ ID NO: 315582 - RNA, 64 nt, Human
cccacaagaagcaccucccuugcuuggcaaccuucaccagcauuucccaaaaguaugcuccugg

SEQ ID NO: 315583 - RNA, 64 nt, Human
ucauuagcaguggguuuccaggguuggcagcccacaccagcauuaauuucaaugaaggggaccu

SEQ ID NO: 315584 - RNA, 64 nt, Human
ugaaugcuugaauccccucgacaauuuaugaugccaccagcaauguauaagcauuucuguuuac

SEQ ID NO: 315585 - RNA, 64 nt, Human
uggaugggcacaaugacacgggcuuggucuuugccaccagcaugccugaccacaguauucaccu

SEQ ID NO: 315586 - RNA, 64 nt, Human
cuuuuuauuuguuugcaauauuuucagaagaaaggcauugcacagagugaacuuaauggacgaa

SEQ ID NO: 315587 - RNA, 64 nt, Human
ccccaugcugacgucccuccucaagagcuggauggcauugcaaaugaugacagcacuucuggug

SEQ ID NO: 315588 - RNA, 64 nt, Human
cacuaccauaaaauuaugguucagcaucagauuagcauugcacucaguagucuuuaagguuuua

SEQ ID NO: 315589 - RNA, 64 nt, Human
cugaagaguaaagggcugggucugccucagaaggcaccagcaccagggcccagguauuaaggcu

SEQ ID NO: 315590 - RNA, 64 nt, Human
cacagccccagccacccugcacgggggcugcgagcaccagcaacuuugauuuauagaaggaaaa

SEQ ID NO: 315591 - RNA, 64 nt, Human
acacauauauucaguucucagauguugaagcugucaccagcagcuuugcucuuaggagaaaagc

SEQ ID NO: 315592 - RNA, 64 nt, Human
acagcaucgggagcacccagagcacccccugcuccaccagcagcauggcauagccccggccccc

SEQ ID NO: 315593 - RNA, 64 nt, Human
uggccuuugucccuggggcugauggcccccaacucaccagcaucaugaccuugugccaguccug

SEQ ID NO: 315594 - RNA, 64 nt, Human
cucgcuccauagcccucaacugcccaggcgcucccaccagcagaacugagccugccuccuccuc

SEQ ID NO: 315595 - RNA, 64 nt, Human
aaggaggccacgugagcagucagcaccaguucugcaccagcagcgccuccguccuagugggugu

SEQ ID NO: 315596 - RNA, 64 nt, Human
acgcccacccaaccccaagccagcccggccgcuccaccagcaucaccugccuguuaggagaagc

SEQ ID NO: 315597 - RNA, 64 nt, Human
cccucccugcccacccccucccugccguaucgaucaccagcaccaggguggcccgugugcgugg

SEQ ID NO: 315598 - RNA, 64 nt, Human
ggcagcaggggccaagcaggcacucuggggcuggcaccagcaggcacugaagcugcggcccuga

SEQ ID NO: 315599 - RNA, 64 nt, Human
aagaccaucaaucaggggccauaguacaggagcccaccagcaggauuuuugaauaauccuaggg

SEQ ID NO: 315600 - RNA, 64 nt, Human
uaguguaauaauugugcagguacaggaauuguuccaccagcauuaggaacuuuagcaugucaaa

SEQ ID NO: 315601 - RNA, 64 nt, Human
uugggguucccccucccugugugaaauguauuaucaccagcagacacugccgggccucccuccc

SEQ ID NO: 315602 - RNA, 64 nt, Human
gcggguuuccuggguccccucuccagcaagccuccaccagcaagcucggcccagagcuucccuu

SEQ ID NO: 315603 - RNA, 64 nt, Human
uccuuagauucuuggucacuucucuaccacaagccaccagcacuauaaccaguuuugcgugggu

SEQ ID NO: 315604 - RNA, 64 nt, Human
cauugcucccaucugccucugcugcacacacaggcaccagcagggaugccacaggagugcccac

SEQ ID NO: 315605 - RNA, 64 nt, Human
cucaaauuucagaugccaguuuucacuuuuugaagcauugcaucuuuuuaauaaaucuauccug

SEQ ID NO: 315606 - RNA, 64 nt, Human
gcaugaaaaaucaugggccagagccucggcccuagcauugcacuuggccucaugcuggagggag

SEQ ID NO: 315607 - RNA, 64 nt, Human
agggugccuuuuauaugagugcugaggguaguuugcauugcagaguucaugauuacagucuaga

SEQ ID NO: 315608 - RNA, 64 nt, Human
cugguguuaugaagucccucuaugucgucguuuucaccagcaacuggugacugucccuucgaca

SEQ ID NO: 315609 - RNA, 64 nt, Human
accuuggucucaccuauccugcccucacaucuuccaccagcaccuuacugcccaggccuaucug

SEQ ID NO: 315610 - RNA, 64 nt, Human
ucuccaaccacucaggaaaccuccuuggcauaaucaccagcaacacccgggacaauaauacggg

SEQ ID NO: 315611 - RNA, 64 nt, Human
cuucccauauugcuugccugauaaaacagcuaaucaccagcauuuguuccccauagucacaggg

SEQ ID NO: 315612 - RNA, 64 nt, Human
uguccccaugggcagcaggcagacagcucacccccaccagcaugauggccccagcugggggcag

SEQ ID NO: 315613 - RNA, 64 nt, Human
cugccuucagggcauccggagcuuccugaggacacaccagcaggucgccuccagccugaccagc

SEQ ID NO: 315614 - RNA, 64 nt, Human
ucuauaccuaaaggaugaccugcuccagaaacagcaccagcacagcauguauuuucuucucuuc

SEQ ID NO: 315615 - RNA, 64 nt, Human
auuuuggccggacaugguugggguaacccagugacaccagcacugauuggacugcccuacacca

SEQ ID NO: 315616 - RNA, 64 nt, Human
ggacugagggaggaaaugagcgaguucccucugacaccagcagauccccaggggcugcugggca

SEQ ID NO: 315617 - RNA, 64 nt, Human
ugggagcucauuccuggccaacacgcccuggcagcaccagcagcucuugccaccuccagcugcc

SEQ ID NO: 315618 - RNA, 64 nt, Human
gaaguuuuauaaagaucuguauaauugccugaaucaccagcacauucacugacaugauauuauu

SEQ ID NO: 315619 - RNA, 64 nt, Human
gaugcuucgccagccagguccucaccuguguguacaccagcaggacacugauccagucacagcc

SEQ ID NO: 315620 - RNA, 64 nt, Human
ccacucuccuccccucauuaaaccauccaccugacaccagcacaucaggccugguucaccucug

SEQ ID NO: 315621 - RNA, 64 nt, Human
ccagugaaucuugggggccaggcacugugcuaggcaccagcagggguaacacgaagaagacccg

SEQ ID NO: 315622 - RNA, 64 nt, Human
ggaccuacugcucgggaggcagcagacagggagccaccagcaguggcuuccuggcccugugcug

SEQ ID NO: 315623 - RNA, 64 nt, Human
ccaggcagaugcucucuagccuggaucugaggcacaccagcagcaugacaaacucaugaaaugg

SEQ ID NO: 315624 - RNA, 64 nt, Human
aagauauugacgucucuauucugccccagcuggagcauugcagcuccaggaagaugaauacaug

SEQ ID NO: 315625 - RNA, 64 nt, Human
uaaauaaccccuuucaauauaccugguuuuuacagcauugcaaaaucuguaaaaauaacuuuua

SEQ ID NO: 315626 - RNA, 64 nt, Human
agagcaagaggaacugaccaucucaugaccuguggcauugcacggugcaguggacagaagggau

SEQ ID NO: 315627 - RNA, 64 nt, Human
ggaacagcuucaggauacuuccaggagacagagccaccagcagcaaaacaaauauucccaugcc

SEQ ID NO: 315628 - RNA, 64 nt, Human
cagcaccaugugagauggcgagguggcuggacagcaccagcagcgcaucccggcgggaacccag

SEQ ID NO: 315629 - RNA, 64 nt, Human
uccucuagggcaggaccugcacccuguguguuggcaccagcaucgggucuuggacuggggcaga

SEQ ID NO: 315630 - RNA, 64 nt, Human
guccagaggccaccaggagcugagacagugccaccaccagcaccucccacaagcccaccgcugu

SEQ ID NO: 315631 - RNA, 64 nt, Human
ugggggcuucgguguccaggcgcccagguguggccaccagcaccgguuucugccuucgcguugc

SEQ ID NO: 315632 - RNA, 64 nt, Human
ccuggguucuccucagugagggaucccugcccugcaccagcacccugagauggagcugagacuu

SEQ ID NO: 315633 - RNA, 64 nt, Human
uaggcacucucuggcuaaaaacaaacucugaggccaccagcagaucaucuuuaagcuaaguuac

SEQ ID NO: 315634 - RNA, 64 nt, Human
cauuggcuggguucugauugcuagaugucacacccaccagcaucaccaaagugacucugagaua

SEQ ID NO: 315635 - RNA, 64 nt, Human
cccggcaguucucaaacuuuagcaugugaagagucaccagcagauuccugggcucgccuggaga

SEQ ID NO: 315636 - RNA, 64 nt, Human
ugccuaauuugcuuuuucugaccaagccuuguggcaccagcaaucuccaaaguccugugguggg

SEQ ID NO: 315637 - RNA, 64 nt, Human
acuuaggagaauggacuaagcugaagguguacuucaccagcaagagucaacucuagaauucagg

SEQ ID NO: 315638 - RNA, 64 nt, Human
ggcaacacccaggcgggcagagaagggcucagggcaccagcaaccaagccagcccccggcggga

SEQ ID NO: 315639 - RNA, 64 nt, Human
ggaggugcagggaagaggggccggccucagcugucaccagcacuuuugaccaaguccugcuacu

SEQ ID NO: 315640 - RNA, 64 nt, Human
cagcauaaaggacucaaggaccacagccucugcccaccagcauguuccuugaagcccaucgccu

SEQ ID NO: 315641 - RNA, 64 nt, Human
cacgcgcacuuccaucucugccccaucccaacugcaccagcacugccucccccagggauccucu

SEQ ID NO: 315642 - RNA, 64 nt, Human
agcagcauauuaaggguuucuaguaugcuaauaucaccagcaaugaucuuuggcuuuuugauuu

SEQ ID NO: 315643 - RNA, 64 nt, Human
augaagcuauacacagcauauaccgaaagaaccugcauugcacuaggaauucuguguuaguuua

SEQ ID NO: 315644 - RNA, 64 nt, Human
auuuuguuuuuuccuuucuagccacaugacuguggcauugcacaaauacagucucuguagggau

SEQ ID NO: 315645 - RNA, 64 nt, Human
uauuucaccugcaaguuacaaaaaaauaguuugugcauugcaaauaagcaaagacuuggauuga

SEQ ID NO: 315646 - RNA, 64 nt, Human
gacgcaggcaauggggccucgcaggccaggcuugcaccagcaugucuugaguuagaggacuuaa

SEQ ID NO: 315647 - RNA, 64 nt, Human
ggggacuccagggguggcugggagacugggcagccaccagcaaacagacccuguggccccugcc

SEQ ID NO: 315648 - RNA, 64 nt, Human
ucuugagacagacuauacugagacaacaaguugucaccagcagaagauagauaauaugaccuuu

SEQ ID NO: 315649 - RNA, 64 nt, Human
acuugagcaaacuccaagacaccuucuaccccaacaccagcaauuaugccaagggccguuaggc

SEQ ID NO: 315650 - RNA, 64 nt, Human
gauaaagaaaaagacaaacagaaauagacacacacaccagcagagacagaaacagcaauagcca

SEQ ID NO: 315651 - RNA, 64 nt, Human
gcugaaugagggccuucucgugagguacugacaacaccagcaacucgagagcugggaaacucaa

SEQ ID NO: 315652 - RNA, 64 nt, Human
caucugacuuauugaacuuuuacaaacuaacagucaccagcaccaaagaauuaagucaacuaac

SEQ ID NO: 315653 - RNA, 64 nt, Human
cuugacuugacuugacuuuggggguaaagucuuucaccagcacacaagaguuugauuguacaaa

SEQ ID NO: 315654 - RNA, 64 nt, Human
uggucuuuuuauuuacccucugugguagaagagucaccagcagguuccaaauugauguguauga

SEQ ID NO: 315655 - RNA, 64 nt, Human
ggacgcuaugccucaugcccguuuuggguguccucaccagcaaggcugcucgggggccccuggu

SEQ ID NO: 315656 - RNA, 64 nt, Human
uacaaaauggguucucguguuuccuguucaggaucaccagcauuucugagcuuggguuuaugca

SEQ ID NO: 315657 - RNA, 64 nt, Human
ggaaagggcaugggcaaaagguagggauaaaaaccaccagcauauacauggacauacacacaca

SEQ ID NO: 315658 - RNA, 64 nt, Human
ccuucuuccucccuaguccggguuccauucuuuucaccagcacccaucgcccaagggguaccga

SEQ ID NO: 315659 - RNA, 64 nt, Human
uugagucccacgugggggaggaggaggcaggcagcaccagcagggguccaccaagagcccagac

SEQ ID NO: 315660 - RNA, 64 nt, Human
aagagagcacuguaugguauccuuuugcuuuauucaccagcauuuugggggaacauuucuuuua

SEQ ID NO: 315661 - RNA, 64 nt, Human
cuugcucagacgcacucgcauugacacaacguaacaccagcauugugugugcagacuucaggag

SEQ ID NO: 315662 - RNA, 64 nt, Human
caaggacauagauaccuaucaggaugaagaacaggcauugcaaggacccucugaugggacggua

SEQ ID NO: 315663 - RNA, 64 nt, Human
cuuucuagauagauuuuauuuuuaaguguccucagcauugcagaaaauaacauuguaauagcaa

SEQ ID NO: 315664 - RNA, 64 nt, Human
aagagccuccguaccuccccugggcggcggaggggcauugcacuuccgggaaguccaccuagcg

SEQ ID NO: 315665 - RNA, 64 nt, Human
gcuggacaagggccgcguagugcagcagggcacccaccagcagcugcuggcccagggcggccuc

SEQ ID NO: 315666 - RNA, 64 nt, Human
cuuaaguuagccucaucauuuugugcugcuccaacaccagcaggguaucucccaauaaaguguu

SEQ ID NO: 315667 - RNA, 64 nt, Human
gaauacuuugcauuuaaaaacccuguccaccugucaccagcacaagagaauuagagcuucagug

SEQ ID NO: 315668 - RNA, 64 nt, Human
aacaccuuaauucuacugcucuuuuuucuccaaucaccagcaucuguuuuucagggggugauuu

SEQ ID NO: 315669 - RNA, 64 nt, Human
aaguaacuuuuaaaauuugucuuaaaaauuuauacaccagcaauuuagacaaagccuuaagcaa

SEQ ID NO: 315670 - RNA, 64 nt, Human
caguggcaaccccuuuuggccagggccaggggggcaccagcaaggggccacccuuucccuuuuc

SEQ ID NO: 315671 - RNA, 64 nt, Human
agcuuaauuucuugagaaauucaacagucauuuucaccagcauaauuuuaucuuaaggaauaac

SEQ ID NO: 315672 - RNA, 54 nt, Human
uggucauuggacggcuaugauggucaccagcaggagaaagcuuugaugcauguc

SEQ ID NO: 315673 - RNA, 64 nt, Human
gaacuuuucaggagguacugugaggaagagcaggcaccagcagcagaauggggaauggagaggu

SEQ ID NO: 315674 - RNA, 64 nt, Human
ccacuccugggugcaugauugagggugaagcauccaccagcacuucaagggguccauaguauuu

SEQ ID NO: 315675 - RNA, 64 nt, Human
auaaaucaaccaaguuuuggggccucaaaagagacaccagcaacugggccuugagaacuuccau

SEQ ID NO: 315676 - RNA, 64 nt, Human
gagauccagagaggcuggaugacuugcucaaguucaccagcaugguaguggcaaagagaggucc

SEQ ID NO: 315677 - RNA, 64 nt, Human
cuaauuauaaaauuaacaugauaaaagacacucccaccagcaccgugacaguuuacaaaugaca

SEQ ID NO: 315678 - RNA, 64 nt, Human
ucacauagccgguccccacgcccagcggcccacccaccagcagcugcuggaggucguaguggcu

SEQ ID NO: 315679 - RNA, 64 nt, Human
uuuuuacaccauauuguauuacacuuuuaguauucaccagcauaaucacugucugccuaaaaua

SEQ ID NO: 315680 - RNA, 64 nt, Human
ggagaaagaggccgcugcugccgccgccgccgcccaccagcaggcccugcgggaggagagcggu

SEQ ID NO: 315681 - RNA, 64 nt, Human
uuuguuuuccccagggcuuucacugugauuuacugcauugcaggcuguaugauaaaacacacau

SEQ ID NO: 315682 - RNA, 64 nt, Human
aguugagcaauuucuauguaauguacagauacuagcauugcacauauagucugcuuucuguucc

SEQ ID NO: 315683 - RNA, 59 nt, Human
uaauuaaagucauuaucugaacaugaaaugcauugcagguuugguaaauggauaugauu

SEQ ID NO: 315684 - RNA, 64 nt, Human
caguagcugaauccgcccagugauagccugugggcaccagcagcaagggcugccaugggauaca

SEQ ID NO: 315685 - RNA, 64 nt, Human
gcaauguaugauugauccaguuucuucacauccucaccagcauuugguauuacuacuauuuuuu

SEQ ID NO: 315686 - RNA, 64 nt, Human
ucuccuccucuaauuaagcuuguuauuugucaugcaccagcauuggagauaauaaaauuucuug

SEQ ID NO: 315687 - RNA, 64 nt, Human
cuugcagagcgugucuauuacaagaugucauuuccaccagcaguucccuuaggggagcugaaau

SEQ ID NO: 315688 - RNA, 64 nt, Human
ccccugccaucuugccuuaggaacagccuucccccaccagcagccauggcuggcuggggcuuua

SEQ ID NO: 315689 - RNA, 64 nt, Human
uaagugaaauacaaccuaguuuuaucaccauauccaccagcaggcauggauaauuauuuuaaca

SEQ ID NO: 315690 - RNA, 64 nt, Human
ccuuucagagcugugaggagaagucagugaagaacaccagcauccgaguggcugacuuuggcag

SEQ ID NO: 315691 - RNA, 64 nt, Human
gcaccauggccagcagagcggugagcagcacucccaccagcagcccggucagacugaaguguuc

SEQ ID NO: 315692 - RNA, 64 nt, Human
gaaaguucagccaaugcccagagugaccaagcagcaccagcaggccugcccaggaugcugaaag

SEQ ID NO: 315693 - RNA, 64 nt, Human
ugucucuggcuacagcaagaccagcccaggagcccaccagcaccugccucucagcuacuugcug

SEQ ID NO: 315694 - RNA, 64 nt, Human
augcugacagcucuucacaguccuggacuccugccaccagcauccacacugccggcaggaugca

SEQ ID NO: 315695 - RNA, 64 nt, Human
gggguagacugcuccugcagaguuuggaagaagucaccagcaaagccggccuaaccaagaaaag

SEQ ID NO: 315696 - RNA, 64 nt, Human
cucccuucugugcagacuuuuggacccagcucagcaccagcacccgggcguccugagcacuuug

SEQ ID NO: 315697 - RNA, 64 nt, Human
agguuguccagcauaaggagccccagaguucuuucaccagcagacagauucuccauguguuuuc

SEQ ID NO: 315698 - RNA, 64 nt, Human
ccaugcaagcaaagacaugcaguuugcuugcacacaccagcagagcuaagacuggagucuccug

SEQ ID NO: 315699 - RNA, 64 nt, Human
ucaguuuuggagguugggagguccaaggucaaggcaccagcaaauuuggugucuggugaggguc

SEQ ID NO: 315700 - RNA, 64 nt, Human
cugggcccagucagcccugcugcucagagugcaggcauugcacauggugugagaaggucuacac

SEQ ID NO: 315701 - RNA, 64 nt, Human
cugggcccagucagcccugcugcacauggcacaggcauugcacacggugugaggaguguacacc

SEQ ID NO: 315702 - RNA, 64 nt, Human
ucccugggcucaguccuagcugcauggggugcaggcauugcacagagcaugaaugggccuacac

SEQ ID NO: 315703 - RNA, 64 nt, Human
cauugcugucaccuccugagucacuggggucccucaccagcaccucccugacaccugggcuaug

SEQ ID NO: 315704 - RNA, 64 nt, Human
gcaguguuuagcuaacaguaaacagacaucuuuacaccagcaagcaacuaaggagauucaggau

SEQ ID NO: 315705 - RNA, 64 nt, Human
uucaugccgcccccgugcccugcacaaaaaccaccaccagcagcucacauuucacgucucggcu

SEQ ID NO: 315706 - RNA, 64 nt, Human
ugccguuuggucccucuuccgugaggacuggcggcaccagcaccuucgcuuugcaucucgguag

SEQ ID NO: 315707 - RNA, 64 nt, Human
uucuccccgaccagcccagccccaggaugugucgcaccagcagcucugccugguuggccugcag

SEQ ID NO: 315708 - RNA, 64 nt, Human
uuguggagacugucccauggaacaaacccucaggcaccagcacagggcucugggugacucagua

SEQ ID NO: 315709 - RNA, 64 nt, Human
uugucuucacugggagcguggggcccccaggccccaccagcaccguccuccccuaaugaggggc

SEQ ID NO: 315710 - RNA, 58 nt, Human
uugguucagcacuguccugacugcuccccaccagcacgcugaccugugaaccccagcc

SEQ ID NO: 315711 - RNA, 64 nt, Human
guggaagcuggggccuuagacucugcccuggugacaccagcaauuaugacuuugucuacccuuc

SEQ ID NO: 315712 - RNA, 64 nt, Human
gcccaauggggaauggaucuuucaccaaagagcucaccagcauuuuccacagagaugcaaauuc

SEQ ID NO: 315713 - RNA, 64 nt, Human
uggcaacugugucucccugugcuauauuuaauuccaccagcaaagcuggcgaggcagggcccag

SEQ ID NO: 315714 - RNA, 64 nt, Human
cuugguguguagguuccguaucucccuggagaagcaccagcaauucucuuucuuuuacuguuau

SEQ ID NO: 315715 - RNA, 64 nt, Human
uccccagucucauugcuuaguagaauaaauccugcaccagcaacaacacuuguaaauuugugaa

SEQ ID NO: 315716 - RNA, 64 nt, Human
agacgugggcuucagaagcucgcuggccugggcccaccagcauuuucuuuuaugaacaugauac

SEQ ID NO: 315717 - RNA, 64 nt, Human
ccccugaacugcuguugggaaccaccacgcagaccaccagcaucgacauguggugaggagauac

SEQ ID NO: 315718 - RNA, 64 nt, Human
gaggggucccugcaaaacuccaggcaggacuucucaccagcagucguggggaacggaggaggac

SEQ ID NO: 315719 - RNA, 64 nt, Human
gugugugcgcgcgcacgcacgccuugagcagucagcauugcaccugcuauggagaaggguauuc

SEQ ID NO: 315720 - RNA, 64 nt, Human
gaugcugguguuaucaucgaggaacuuucucaacgcauugcauuaacuggaggugcugcacugg

SEQ ID NO: 315721 - RNA, 64 nt, Human
cacgucaccuacaguuuugugauggugcauuuuugcauugcaguauagaucugugcauagauau

SEQ ID NO: 315722 - RNA, 64 nt, Human
cuagccaaaacagcuggcaggacugccggucacacaccagcacgucccaccucgugcucacgga

SEQ ID NO: 315723 - RNA, 64 nt, Human
ccaccaagagagccagggcugcuguuucgcgacucaccagcacagauuugcucagaaacucugc

SEQ ID NO: 315724 - RNA, 64 nt, Human
gacuucagcguccaagacuggggcccacccuucucaccagcacuaaaugcacuaacaaggacuc

SEQ ID NO: 315725 - RNA, 64 nt, Human
uguguguguguguguguacuuguaugcacguaggcaccagcacaaagaucugaaugaugcaccc

SEQ ID NO: 315726 - RNA, 64 nt, Human
aagagacuccaauaauccauauugaaagagucagcaccagcagaggcuacucgacuuaggacgc

SEQ ID NO: 315727 - RNA, 64 nt, Human
ccaagggacagcccacggucuggaggccgaggaccaccagcaggcagguggacugacuguguug

SEQ ID NO: 315728 - RNA, 64 nt, Human
gugaggaaaaccugccauuguggcccuggagagucaccagcagcucuugggaaggacuugcugg

SEQ ID NO: 315729 - RNA, 64 nt, Human
cugugcuguuugucuccucgacagggagccuguccaccagcaggcugcggucccagcgggugcg

SEQ ID NO: 315730 - RNA, 64 nt, Human
gacuucugcuugaggacgucugcagcuccuccuacaccagcacacuggugggaggcuggcggag

SEQ ID NO: 315731 - RNA, 64 nt, Human
agaaaguauccagacccaaccuguuagcuacccucaccagcaccaaaucuucccuucucagaca

SEQ ID NO: 315732 - RNA, 64 nt, Human
gccaggcccugagcucagcuucugcgggcacagacaccagcaugaaaagccuaggccccugagg

SEQ ID NO: 315733 - RNA, 64 nt, Human
auggagggggcaguggggacagggcuugggcagacaccagcaggaauaauuugaaaugugugag

SEQ ID NO: 315734 - RNA, 64 nt, Human
uggggccaaccccaggaccuuuggcucuguccaucaccagcaaccaauccaccaacagaaugug

SEQ ID NO: 315735 - RNA, 64 nt, Human
cccucagaaaccagagccaugagaccuaccauaccaccagcacccugcgggcccggggucuggc

SEQ ID NO: 315736 - RNA, 64 nt, Human
agacaccccucugcccagcucaccacaucuucaucaccagcaaacgccaggacuuggcuccccc

SEQ ID NO: 315737 - RNA, 64 nt, Human
aggggcccgagcugcccccacccccggccucagccaccagcacccccauagggcccccagacac

SEQ ID NO: 315738 - RNA, 64 nt, Human
aaaacuuuuuuuaugucucaaguaaaauggcugagcauugcagagaaaaaaaaaaguccccaca

SEQ ID NO: 315739 - RNA, 64 nt, Human
aaacuguucuuuugcauuuugccgcugagauauggcauugcacugcuuauaugccaagcuaauu

SEQ ID NO: 315740 - RNA, 64 nt, Human
ccugugcucugguccucgguuucugcauguguuagcauugcauugauaacucagaaucuugaua

SEQ ID NO: 315741 - RNA, 64 nt, Human
ggccuccagaaccuuacuggcacuguggcacugccaccagcaaugcccugccuugcugccuuca

SEQ ID NO: 315742 - RNA, 64 nt, Human
ggggaucagagggcuggcgggaacgcgagaagggcaccagcagcauuccacacccagcucuucc

SEQ ID NO: 315743 - RNA, 64 nt, Human
ggugguggucggcuugccucugaggccaccacggcaccagcagaauacguauuucuucuccuug

SEQ ID NO: 315744 - RNA, 64 nt, Human
acuucgugagaccaacacagccgugcccugcaggcaccagcacgugcuuuucagaggcugcgga

SEQ ID NO: 315745 - RNA, 64 nt, Human
ugccugcucgcucugucaccugugccucucagaacaccagcaguuaaccuucaagacauuccac

SEQ ID NO: 315746 - RNA, 64 nt, Human
acccacgcuggcucucuccugccgcgggagaaagcaccagcagguucugagcccuggcugcuug

SEQ ID NO: 315747 - RNA, 64 nt, Human
ggagggcucggguugacgguggcuucccacugagcaccagcauccaggugcacccccgcggcca

SEQ ID NO: 315748 - RNA, 64 nt, Human
cuuuaacaguuaguuuugccaaagccucuccacucaccagcaggcggucucugucuucagggau

SEQ ID NO: 315749 - RNA, 64 nt, Human
aacuuagcccugaguccuaggaggagcaccucugcaccagcacggaccucucgcuccacccagc

SEQ ID NO: 315750 - RNA, 64 nt, Human
ugugcagcucacaccacuccagaaccugacaaggcaccagcaggaccccuugccaggagcaugu

SEQ ID NO: 315751 - RNA, 64 nt, Human
cugccauacaggagauuguggccacugugacucucaccagcagugccugguuccucccccuucc

SEQ ID NO: 315752 - RNA, 64 nt, Human
agucuggccgaccaacugauggcaguaaagagaccaccagcagugacaccugccaaugacagau

SEQ ID NO: 315753 - RNA, 64 nt, Human
uguacuauuacuuaaagguuguguaacauacuuccaccagcaguccaacaauauauguuuaaaa

SEQ ID NO: 315754 - RNA, 64 nt, Human
ugcuuccuucaccugcagaaagccccaagugagccaccagcacucauggggcagucccugucca

SEQ ID NO: 315755 - RNA, 64 nt, Human
cugggacugcccaggcuauggggacaaaggccuucaccagcaagggccacaguuggaacagucc

SEQ ID NO: 315756 - RNA, 64 nt, Human
agagucacucccugcccgucucccagagaugcuucaccagcaccugccucugagaccucgcucu

SEQ ID NO: 315757 - RNA, 64 nt, Human
aaaaugcugauuccaacaggacugaguuuugccagcauugcaaaggaauccaagugccuuucug

SEQ ID NO: 315758 - RNA, 51 nt, Human
ccacugaauuccugaauuaaugcauugcaaaucaauucuugcauacacuuc

SEQ ID NO: 315759 - RNA, 64 nt, Human
uuaacuugugagaaucaggaaaauuccuucaacugcauugcauccucuuggaccagggcuagaa

SEQ ID NO: 315760 - RNA, 64 nt, Human
cccaauucggggccugcuggaguuccggccugggcaccagcauuuggcagcacgcaggcggggc

SEQ ID NO: 315761 - RNA, 64 nt, Human
uuuauagccaucauguuucuaagagacuuggagacaccagcaaacugcuagaacucaaacucuu

SEQ ID NO: 315762 - RNA, 64 nt, Human
agucuccgacuaggccuccagaucagggcuuccucaccagcacuggccuuucuucuacccaccu

SEQ ID NO: 315763 - RNA, 64 nt, Human
auuuauaagggcucuagaaaaaacgaguuauucacaccagcaucaucuuaacuaacauucugaa

SEQ ID NO: 315764 - RNA, 64 nt, Human
gccuccucugggcccucuccuucgucugggaaggcaccagcaugagucccacacacccagccuu

SEQ ID NO: 315765 - RNA, 64 nt, Human
uauccaccacgcuauuauaguuuccguuguccuccaccagcauuucccuuacucugaaguuccg

SEQ ID NO: 315766 - RNA, 64 nt, Human
gcacgcggcccucuccugucagugccggcccacccaccagcaggcccccaacccccaggcagcc

SEQ ID NO: 315767 - RNA, 64 nt, Human
guaaguucuuacaugauaagcagauugaauacaacaccagcagcuugccuuagaaaaggagaaa

SEQ ID NO: 315768 - RNA, 64 nt, Human
ccuuccccagcgccguuugaccucucccaagauacaccagcagccugcuuacuacuaaacgcaa

SEQ ID NO: 315769 - RNA, 64 nt, Human
uaggggccaacaguaaaugggggaggccuccugacaccagcagaggaauuuuguacccaggcga

SEQ ID NO: 315770 - RNA, 64 nt, Human
gaggugucaacagcaagggcucuuaggggucaggcaccagcauggagaccucaugacaaaggaa

SEQ ID NO: 315771 - RNA, 64 nt, Human
cacacacuccaucagcaaaauguauuugagcacacaccagcaauguauguauauuuuuuccauu

SEQ ID NO: 315772 - RNA, 64 nt, Human
aaacugcgcccgucuuaggccugggugucugacccaccagcagugcaaugggcagguuucccca

SEQ ID NO: 315773 - RNA, 64 nt, Human
gagagcccuuggaaggggucucgguggagcugugcaccagcagccaagcagaaagaaacacgcg

SEQ ID NO: 315774 - RNA, 64 nt, Human
cgcccuucuuugagccagacgccaacuugacccucaccagcauuaucaggagcgcgcucagcaa

SEQ ID NO: 315775 - RNA, 64 nt, Human
cggccccucccgggagauccgugcgcccgaccagcaccagcaucgcggaccgcaaaggccgccc

SEQ ID NO: 315776 - RNA, 64 nt, Human
caucucugaaaacaagagacugcuugacaaaggagcauugcagucacuuugacagguuccuuuu

SEQ ID NO: 315777 - RNA, 64 nt, Human
cuucacccugaccgccucccucccuccugccccggcauugcaucuucccuagauagguccccug

SEQ ID NO: 315778 - RNA, 64 nt, Human
acaggcccagaacuuucucacaucugaaauggaggcauugcaaugaaaaggcacccacagcauc

SEQ ID NO: 315779 - RNA, 64 nt, Human
aagggaugccacgaugccaagcacagccaacagccaccagcagccaggagacaggccugggacg

SEQ ID NO: 315780 - RNA, 64 nt, Human
ucuuccuuucucucuuugccuuuaguuugcccgacaccagcagaaaaguggaccuugggggcug

SEQ ID NO: 315781 - RNA, 64 nt, Human
acugaagacaacuaacccuuuccccaacagagcccaccagcagugguggagaugucgguccaug

SEQ ID NO: 315782 - RNA, 64 nt, Human
ccuguuuuuuuaaaaaaagaaguggagguguuuacaccagcaaaauacucauuuuuuaagugua

SEQ ID NO: 315783 - RNA, 64 nt, Human
acgaaggagguggugccgacgugcugcuucccaucaccagcagcugcucgacaaggggcgcagg

SEQ ID NO: 315784 - RNA, 64 nt, Human
ccguccucggccccccacccugaagugccagcaccaccagcaccagauccuccgccgccacacc

SEQ ID NO: 315785 - RNA, 64 nt, Human
gucuugugcuggugggcaagggguuugucuagcacaccagcauauaaugagaugcuugaugaau

SEQ ID NO: 315786 - RNA, 64 nt, Human
ccugcccccgugaagcugguuggggagggcaguucaccagcauccauagaguaauaaagucacu

SEQ ID NO: 315787 - RNA, 64 nt, Human
auuuuuccauaguaccugugccauuuuacauucccaccagcagugcacaaggauugcaaucuau

SEQ ID NO: 315788 - RNA, 64 nt, Human
ucccaccagcccagggcugaucccagcugugugucaccagcagcuuucccagcuucucugugag

SEQ ID NO: 315789 - RNA, 64 nt, Human
ugcugccuccccaggcuggccccagaggagcgagcaccagcacccgacgccuggccugccaggg

SEQ ID NO: 315790 - RNA, 64 nt, Human
gaugcuguggaaaccuggcuuauucuucuaaagccaccagcaaauugugccuaagcgaaauauu

SEQ ID NO: 315791 - RNA, 64 nt, Human
cagaaaaccaaccugcccuccccaaauaugugcucaccagcagcaacaggcuaucugagucuuu

SEQ ID NO: 315792 - RNA, 64 nt, Human
uggguccccccaaaacuugggcuggcccagggcccaccagcagcugauguugccuccucuccug

SEQ ID NO: 315793 - RNA, 64 nt, Human
acacccccguggggggacagccgaugggagccagcaccagcaggauccgagggcgccccggaca

SEQ ID NO: 315794 - RNA, 64 nt, Human
ccagcacuccaugaagauaaacucugggcccgcccaccagcaggaccugucgaccugaggugac

SEQ ID NO: 315795 - RNA, 64 nt, Human
ugauccccccuucuccgagacgcugagagagcaggcauugcaggcgggaagaugccagaaauua

SEQ ID NO: 315796 - RNA, 64 nt, Human
guaaacacaaaugacauucaguucaaugauacgagcauugcagauugcaguaggggucccagcu

SEQ ID NO: 315797 - RNA, 64 nt, Human
ccuauguggaggcggaauugcucucccagcccuugcauugcagaggggcccaugaaagaggaca

SEQ ID NO: 315798 - RNA, 64 nt, Human
cccucacuuuucuccuguguaaagccauccggaacaccagcaccucacugcaucugcagcucuc

SEQ ID NO: 315799 - RNA, 64 nt, Human
caugcagcugcugugggagaaggcaguccaacagcaccagcacggcuaugacagugaugaggag

SEQ ID NO: 315800 - RNA, 64 nt, Human
guggugcuucaguggccaccagccucgucacauacaccagcaucuuucuguaccuccucccuuu

SEQ ID NO: 315801 - RNA, 64 nt, Human
uccggcccaucacuagccagcuuccucgcaucuucaccagcauuggagaggacuacgaugagug

SEQ ID NO: 315802 - RNA, 64 nt, Human
guuccaaagugaagaggucuccauggcaacaggacaccagcaagugugugggagucgcacuggu

SEQ ID NO: 315803 - RNA, 64 nt, Human
aagccccuccccacgucgcccccuccugcacagccaccagcagccagcccccuccgauacaccu

SEQ ID NO: 315804 - RNA, 64 nt, Human
gccugccugagucccagcucccagcuggagaauccaccagcacaagaagaggaggcaggggcag

SEQ ID NO: 315805 - RNA, 64 nt, Human
ucucucucuuucucagccugacaggagcaauggccaccagcaggugaagggcaucgcugcccca

SEQ ID NO: 315806 - RNA, 64 nt, Human
ccuucuuguggugagacugaauuuugggcucagacaccagcaacagccucuugggaugcccuga

SEQ ID NO: 315807 - RNA, 64 nt, Human
cugugcccacauccgaagcacaaggaccucaagucaccagcauaagaacaucaacaggaaugcc

SEQ ID NO: 315808 - RNA, 64 nt, Human
cccucuaauucucuuacccagaauauuuauccuucaccagcaacucugacucuuugacgggagg

SEQ ID NO: 315809 - RNA, 64 nt, Human
cuggcgacagcccggcugagcuucagugaggugccaccagcacccgugccuccgaagaccgcuc

SEQ ID NO: 315810 - RNA, 64 nt, Human
aauggaucgggcugcagaggguuagaagcgagggcaccagcaguuguggguggggagcaaggga

SEQ ID NO: 315811 - RNA, 64 nt, Human
aaaauaaaaacaaccaaaaaaauugaaggaauaucaccagcauguuguacggaaacucucccac

SEQ ID NO: 315812 - RNA, 64 nt, Human
acccugucauggucucagggaacagccugcuucccaccagcagcuugacacccacagugugcuc

SEQ ID NO: 315813 - RNA, 64 nt, Human
cccaagacaggaagggaaaagcaaauuucuaauucaccagcaauaaaaauuggaggaggcuugg

SEQ ID NO: 315814 - RNA, 64 nt, Human
gggucugggagaaccagaugauguacuaggugaagcauugcauugugggaaucacaaagcaaau

SEQ ID NO: 315815 - RNA, 64 nt, Human
guagaguggugauauacagaaugaguuucaguuugcauugcagcugggauugaaaguaaucagu

SEQ ID NO: 315816 - RNA, 64 nt, Human
agccuugggcaagaugccucagcaauauacaauggcauugcaaccagagaggugcccaucccug

SEQ ID NO: 315817 - RNA, 64 nt, Human
ucaagcugaaugaagcccagccuagcaccauugccaccagcaugcgggauucccucauugacag

SEQ ID NO: 315818 - RNA, 64 nt, Human
agaagggcugcccagccagcugguucucccgggacaccagcagauccacacccugggcaccucc

SEQ ID NO: 315819 - RNA, 64 nt, Human
gaaaggagaugccaauucugcuaucacagaacuccaccagcaacuccacccgaccccagcagug

SEQ ID NO: 315820 - RNA, 64 nt, Human
gaccaucugugguuuucagugaacaagcgcugagcaccagcagcagaaaacaacaacaaaaaaa

SEQ ID NO: 315821 - RNA, 64 nt, Human
ugugcaacagguaaacagaaauccuuucauaaagcaccagcaguguuuaaaaaaugagcuucca

SEQ ID NO: 315822 - RNA, 64 nt, Human
gcccagagccacuggucccuacagggcgccgccacaccagcaggaaggaggauggcuguguccg

SEQ ID NO: 315823 - RNA, 64 nt, Human
gaauggacuuuuuguuaaaccgaggugguccaggcaccagcagggaccugagcuuaggacaagc

SEQ ID NO: 315824 - RNA, 64 nt, Human
cuguccccugggcucuagaaagaacauucugugucaccagcacaggcucuugcugggugccugu

SEQ ID NO: 315825 - RNA, 64 nt, Human
cccucagguccugaucagucagaauggaugcuuucaccagcagacccggccauguggcugcucg

SEQ ID NO: 315826 - RNA, 64 nt, Human
cauccuuggcauguauauuaguaggagggcuucacaccagcacugcucacugcgacuccuggaa

SEQ ID NO: 315827 - RNA, 64 nt, Human
ugcugugaggccuugcaccaggugggggccacagcaccagcagcaucuuugcugggcagggccc

SEQ ID NO: 315828 - RNA, 64 nt, Human
auuucuguauauauaauuuaauaacagaagccuccaccagcaacagcauguggaagauacagau

SEQ ID NO: 315829 - RNA, 64 nt, Human
augagcugacggugucccuggagcagugaggggacaccagcaaaaaccuucagcucucagagga

SEQ ID NO: 315830 - RNA, 64 nt, Human
gggcaggacacaggcgagcucaggugaugccggccaccagcaaugccuggccugguagcuccgc

SEQ ID NO: 315831 - RNA, 64 nt, Human
agaccguucaccaccaucuccagcugcucacagacaccagcaaagcaaugugcuccugaucaag

SEQ ID NO: 315832 - RNA, 64 nt, Human
aggcuguucaccaccaucuccagcugaucacagacaccagcaaagcaaugcacuccugaccaag

SEQ ID NO: 315833 - RNA, 64 nt, Human
cucuaucauguggccagagcuaucuuccuaaaaugcauugcauaguugaucaagucacucucug

SEQ ID NO: 315834 - RNA, 64 nt, Human
uuaccucuuugcugauaaauuugcaguaauuacagcauugcaggaaaaacaaucuguuauucca

SEQ ID NO: 315835 - RNA, 64 nt, Human
uccagcccaaauggaaccuguggggugguauuuugcauugcaaggagacgcaaaauuuuauuuu

SEQ ID NO: 315836 - RNA, 64 nt, Human
gagugagugcccggcccaccagggacugcagcugcaccagcaggugccaucacgcuugugaugu

SEQ ID NO: 315837 - RNA, 64 nt, Human
ggccccucugcagauggaaucagcuccaggcugacaccagcagaguccugcauggggcucguga

SEQ ID NO: 315838 - RNA, 64 nt, Human
acauucuaggcccgugauacagggaugaggucagcaccagcaaacucuggacugguggaagaau

SEQ ID NO: 315839 - RNA, 64 nt, Human
aggaagauggcccagcccgugggggcugcugggucaccagcaguggguagggugcaaucuggug

SEQ ID NO: 315840 - RNA, 64 nt, Human
ccuuuuuuauucucucaagccaccagcugccagccaccagcagccagcugccagccuagcuuuu

SEQ ID NO: 315841 - RNA, 64 nt, Human
caacaaagaagagaugugauuugguaccauuucacaccagcaggugucuggacgaaaacaucaa

SEQ ID NO: 315842 - RNA, 64 nt, Human
gguauaugcaaugcuaaaacuguagaagcccaaucaccagcaguuuuuaaaaaggugauaacuu

SEQ ID NO: 315843 - RNA, 64 nt, Human
uucaucccacccugcucagcauuuacauuuuugccaccagcacacuuguucccagaccugcgca

SEQ ID NO: 315844 - RNA, 64 nt, Human
aaaagaaaauuaacaggauuuacacaauuauaaucaccagcagugugaguuuaaaaaacuucgu

SEQ ID NO: 315845 - RNA, 64 nt, Human
cccaaagugcgaggaugacaugugugagcuaccacaccagcaaugucuaugcuucucgauagcu

SEQ ID NO: 315846 - RNA, 64 nt, Human
aaaacuggcuucccccugaagcacccugcuguggcaccagcaggaagcucagguuaauuuuaca

SEQ ID NO: 315847 - RNA, 64 nt, Human
cugaaaacauucauuccauaucuacuuacacauacaccagcaacaguauaaauguaagccuaac

SEQ ID NO: 315848 - RNA, 64 nt, Human
uggucuuuggcauugacgugaaggaagcggaccccaccagcaacaccuacacccuugucaccug

SEQ ID NO: 315849 - RNA, 64 nt, Human
cacccacaagggaggcuagggcaauggagcaggccaccagcagcagcugugcagcauggaacuc

SEQ ID NO: 315850 - RNA, 64 nt, Human
cccgccagccucagugccacuugacauuccuugucaccagcaacaucucgagcccccuggaugu

SEQ ID NO: 315851 - RNA, 64 nt, Human
aaguuuaggcccagcugccagaccucagagaucucaccagcagggugcuucccauguugaugac

SEQ ID NO: 315852 - RNA, 64 nt, Human
ucuucagccaaacaucuagucuuccauagaccaugcauugcaguguacccagaacuguuuagcu

SEQ ID NO: 315853 - RNA, 64 nt, Human
acuccaguuagauuuaaaaaaaucccauuuacaagcauugcaccuuuaagaagaaaacaaauau

SEQ ID NO: 315854 - RNA, 64 nt, Human
agcaguauauaugugcugaaaucucagcaugaaagcauugcaugaguaaagauacuuucccuaa

SEQ ID NO: 315855 - RNA, 64 nt, Human; identical to SEQ ID NO: 203529

SEQ ID NO: 315856 - RNA, 64 nt, Human; identical to SEQ ID NO: 203530

SEQ ID NO: 315857 - RNA, 64 nt, Human; identical to SEQ ID NO: 203531

SEQ ID NO: 315858 - RNA, 64 nt, Human; identical to SEQ ID NO: 203532

SEQ ID NO: 315859 - RNA, 64 nt, Human; identical to SEQ ID NO: 203533

SEQ ID NO: 315860 - RNA, 64 nt, Human; identical to SEQ ID NO: 203534

SEQ ID NO: 315861 - RNA, 64 nt, Human; identical to SEQ ID NO: 203535

SEQ ID NO: 315862 - RNA, 64 nt, Human; identical to SEQ ID NO: 203536

SEQ ID NO: 315863 - RNA, 64 nt, Human; identical to SEQ ID NO: 203537

SEQ ID NO: 315864 - RNA, 64 nt, Human; identical to SEQ ID NO: 203538

SEQ ID NO: 315865 - RNA, 64 nt, Human
cugggcucgaccagcccagcugcgugggguacaggcauugcacacagugugaaugggucuacac

SEQ ID NO: 315866 - RNA, 64 nt, Human
ccaggcccugccagcccugcugcacagggugcaggcauugcacacggugugaagggucuacacc

SEQ ID NO: 315867 - RNA, 64 nt, Human
ugcaggaagcucaaccccucugggcaccaacccugcauugcagguuggcaccuuacuucccugg

SEQ ID NO: 315868 - RNA, 64 nt, Human; identical to SEQ ID NO: 203539

SEQ ID NO: 315869 - RNA, 64 nt, Human; identical to SEQ ID NO: 203540

SEQ ID NO: 315870 - RNA, 64 nt, Human; identical to SEQ ID NO: 203541

SEQ ID NO: 315871 - RNA, 64 nt, Human; identical to SEQ ID NO: 203542

SEQ ID NO: 315872 - RNA, 64 nt, Human; identical to SEQ ID NO: 203543

SEQ ID NO: 315873 - RNA, 64 nt, Human; identical to SEQ ID NO: 203544

SEQ ID NO: 315874 - RNA, 64 nt, Human; identical to SEQ ID NO: 203545

SEQ ID NO: 315875 - RNA, 64 nt, Human; identical to SEQ ID NO: 203546

SEQ ID NO: 315876 - RNA, 64 nt, Human; identical to SEQ ID NO: 203547

SEQ ID NO: 315877 - RNA, 64 nt, Human; identical to SEQ ID NO: 203548

SEQ ID NO: 315878 - RNA, 64 nt, Human; identical to SEQ ID NO: 203549

SEQ ID NO: 315879 - RNA, 64 nt, Human; identical to SEQ ID NO: 203550

SEQ ID NO: 315880 - RNA, 64 nt, Human; identical to SEQ ID NO: 203551

SEQ ID NO: 315881 - RNA, 64 nt, Human; identical to SEQ ID NO: 203552

SEQ ID NO: 315882 - RNA, 64 nt, Human; identical to SEQ ID NO: 203553

SEQ ID NO: 315883 - RNA, 64 nt, Human
cuuugucacauaguuuugaauuucacagccuucugcauugcauacacuugaacuggacaucagg

SEQ ID NO: 315884 - RNA, 64 nt, Human
uuucuaauugauccuguucacauucagugaaauggcauugcauauuuauauguugcuuacagcu

SEQ ID NO: 315885 - RNA, 64 nt, Human
auuaauacgggacugaaaacguuagagacacacugcauugcagauaaaaugcaggcagcacaau

SEQ ID NO: 315886 - RNA, 64 nt, Human; identical to SEQ ID NO: 203554

SEQ ID NO: 315887 - RNA, 64 nt, Human; identical to SEQ ID NO: 203555

SEQ ID NO: 315888 - RNA, 64 nt, Human; identical to SEQ ID NO: 203556

SEQ ID NO: 315889 - RNA, 64 nt, Human; identical to SEQ ID NO: 203557

SEQ ID NO: 315890 - RNA, 64 nt, Human; identical to SEQ ID NO: 203558

SEQ ID NO: 315891 - RNA, 62 nt, Human; identical to SEQ ID NO: 203559

SEQ ID NO: 315892 - RNA, 64 nt, Human; identical to SEQ ID NO: 203560

SEQ ID NO: 315893 - RNA, 64 nt, Human; identical to SEQ ID NO: 203561

SEQ ID NO: 315894 - RNA, 64 nt, Human
ucauuugauugcuugauaaggccucaggaucucagcauugcacaaugccucauggaagccuuug

SEQ ID NO: 315895 - RNA, 64 nt, Human
aagccuucuuaccacacuggcauaucagaugaaagcauugcacuguaccucucguaacacagca

SEQ ID NO: 315896 - RNA, 64 nt, Human
gcauaguuaaaauuaaauguaguuggaauagcuagcauugcagcuacaguagggaacuguaguc

SEQ ID NO: 315897 - RNA, 64 nt, Human
gaccugggcccacagagccuggcuuugguccccagcauugcaguauggugugguguuuguaggc

SEQ ID NO: 315898 - RNA, 64 nt, Human
agcagacacagggauaagaacagaggaggcagcagcauugcacagccccaggcacaguggcagu

SEQ ID NO: 315899 - RNA, 64 nt, Human
aauaggcugauuuuuaaaaguuaaggggcaagcagcauugcauucugggggaacgauccuggcc

SEQ ID NO: 315900 - RNA, 64 nt, Human
acuggaaagugauugccauagggcugggagagaagcauugcacucuugaggcuguagccugugu

SEQ ID NO: 315901 - RNA, 64 nt, Human
caaguucagucugcagccaaaaccauuagggugugcauugcagacuguuuuguugucuuuuuuu

SEQ ID NO: 315902 - RNA, 64 nt, Human
cucaaggaggcccaggauccccaaaauauuauaagcauugcagucagaugauauagcacuagca

SEQ ID NO: 315903 - RNA, 64 nt, Human
uugguuucucuuuguccuuuuggaaaaaugacaagcauugcaucccagucuuguguuccgaagu

SEQ ID NO: 315904 - RNA, 64 nt, Human
auccuguuaggauucauaucuaagauagaguuaugcauugcacauacacaaauaaacuuuuauu

SEQ ID NO: 315905 - RNA, 64 nt, Human
uggaucggaggagugaaccugggcuaagaguuuggcauugcaggagcucccagagagacugccu

SEQ ID NO: 315906 - RNA, 64 nt, Human
uggguuggcucucaauuagaccagguaguuuguugcauugcagguaagucugguuuugucccuu

SEQ ID NO: 315907 - RNA, 58 nt, Human
cauuuucugaugaauauuaacauggagggcauugcaugaggucugccagaaggcccug

SEQ ID NO: 315908 - RNA, 64 nt, Human
uauuuuuuauaucuggaaugagccuguugggaucgcauugcauaccuucgggguacaagucagu

SEQ ID NO: 315909 - RNA, 64 nt, Human
aaauuauuaaacacuccuugagugaaauaauuuugcauugcaaaguguuuuaggaugaacuuug

SEQ ID NO: 315910 - RNA, 64 nt, Human
cuggauaaaaccccugugguggggucugugcugugcauugcaggauggugagcagcgucccucu

SEQ ID NO: 315911 - RNA, 64 nt, Human
ccgguuugaucuuccauugcucaagccagggaaugcauugcagaggcaccugcacaacgacaaa

SEQ ID NO: 315912 - RNA, 58 nt, Human; identical to SEQ ID NO: 315907

SEQ ID NO: 315913 - RNA, 64 nt, Human
ccacaaacugcaauguuuaggaauuguccuuauagcauugcauacacaagaaaaacagagaaaa

SEQ ID NO: 315914 - RNA, 64 nt, Human
gaugcuugcugguuuuauugcaagaauacaaguagcauugcaguagucuacuuuuacaacgcuu

SEQ ID NO: 315915 - RNA, 64 nt, Human
augaggcacaacuauacuacauggacagaguacugcauugcaccaugagcaagaacugcucugc

SEQ ID NO: 315916 - RNA, 64 nt, Human
gcacgcaacccuugcugcugcccgcgcgaagugggcauugcaaagugcgcucauuuuaggccuc

SEQ ID NO: 315917 - RNA, 64 nt, Human
uagaaaaugagaucuuuuaaaugagcaagagauugcauugcaguuuagacaauuccagugggcu

SEQ ID NO: 315918 - RNA, 64 nt, Human; identical to SEQ ID NO: 281605

SEQ ID NO: 315919 - RNA, 64 nt, Human; identical to SEQ ID NO: 281606

SEQ ID NO: 315920 - RNA, 64 nt, Human; identical to SEQ ID NO: 281607

SEQ ID NO: 315921 - RNA, 64 nt, Human; identical to SEQ ID NO: 281610

SEQ ID NO: 315922 - RNA, 64 nt, Human; identical to SEQ ID NO: 281611

SEQ ID NO: 315923 - RNA, 64 nt, Human; identical to SEQ ID NO: 281612

SEQ ID NO: 315924 - RNA, 64 nt, Human; identical to SEQ ID NO: 281613

SEQ ID NO: 315925 - RNA, 64 nt, Human; identical to SEQ ID NO: 281614

SEQ ID NO: 315926 - RNA, 64 nt, Human; identical to SEQ ID NO: 281615

SEQ ID NO: 315927 - RNA, 64 nt, Human; identical to SEQ ID NO: 281616

SEQ ID NO: 315928 - RNA, 64 nt, Human; identical to SEQ ID NO: 281617

SEQ ID NO: 315929 - RNA, 64 nt, Human; identical to SEQ ID NO: 281618

SEQ ID NO: 315930 - RNA, 64 nt, Human; identical to SEQ ID NO: 281619

SEQ ID NO: 315931 - RNA, 64 nt, Human; identical to SEQ ID NO: 281620

SEQ ID NO: 315932 - RNA, 64 nt, Human; identical to SEQ ID NO: 281621

SEQ ID NO: 315933 - RNA, 64 nt, Human; identical to SEQ ID NO: 281622

SEQ ID NO: 315934 - RNA, 63 nt, Human
ggaugaggccaaggcugccuucaauuagaagcagccgcccacagagacaggcacugugugccu

SEQ ID NO: 315935 - RNA, 63 nt, Human
cacugaagccuugacgcugugggcacugccucagccgcccaaguaucugggaccacaggcgug

SEQ ID NO: 315936 - RNA, 63 nt, Human
ccccccugcuuggcucugcugggagagugcucagccgcccaguccugccugcaagcccagggc

SEQ ID NO: 315937 - RNA, 64 nt, Human; identical to SEQ ID NO: 281623

SEQ ID NO: 315938 - RNA, 64 nt, Human; identical to SEQ ID NO: 281624

SEQ ID NO: 315939 - RNA, 64 nt, Human; identical to SEQ ID NO: 281625

SEQ ID NO: 315940 - RNA, 64 nt, Human; identical to SEQ ID NO: 281626

SEQ ID NO: 315941 - RNA, 64 nt, Human; identical to SEQ ID NO: 281627

SEQ ID NO: 315942 - RNA, 64 nt, Human; identical to SEQ ID NO: 281630

SEQ ID NO: 315943 - RNA, 64 nt, Human; identical to SEQ ID NO: 281631

SEQ ID NO: 315944 - RNA, 64 nt, Human; identical to SEQ ID NO: 281632

SEQ ID NO: 315945 - RNA, 64 nt, Human; identical to SEQ ID NO: 281633

SEQ ID NO: 315946 - RNA, 64 nt, Human; identical to SEQ ID NO: 281634

SEQ ID NO: 315947 - RNA, 64 nt, Human; identical to SEQ ID NO: 281635

SEQ ID NO: 315948 - RNA, 64 nt, Human; identical to SEQ ID NO: 281636

SEQ ID NO: 315949 - RNA, 64 nt, Human; identical to SEQ ID NO: 281637

SEQ ID NO: 315950 - RNA, 64 nt, Human; identical to SEQ ID NO: 281638

SEQ ID NO: 315951 - RNA, 64 nt, Human; identical to SEQ ID NO: 281639

SEQ ID NO: 315952 - RNA, 64 nt, Human; identical to SEQ ID NO: 281640

SEQ ID NO: 315953 - RNA, 63 nt, Human
ggaugccaguacuguggugugugagucucagcagccgcccacacgcuccuaacucugcugcau

SEQ ID NO: 315954 - RNA, 63 nt, Human
ccuccgucucuugccucggcgccuggguggcuugccgcccacacuucaggggcccagacuuac

SEQ ID NO: 315955 - RNA, 63 nt, Human
auaugugcuucacauugugaggggagugcacaagccgcccaugcaaagaguagggucagccau

SEQ ID NO: 315956 - RNA, 59 nt, Human; identical to SEQ ID NO: 281641

SEQ ID NO: 315957 - RNA, 64 nt, Human; identical to SEQ ID NO: 281642

SEQ ID NO: 315958 - RNA, 64 nt, Human; identical to SEQ ID NO: 281643

SEQ ID NO: 315959 - RNA, 64 nt, Human; identical to SEQ ID NO: 281644

SEQ ID NO: 315960 - RNA, 64 nt, Human; identical to SEQ ID NO: 281645

SEQ ID NO: 315961 - RNA, 64 nt, Human; identical to SEQ ID NO: 281646

SEQ ID NO: 315962 - RNA, 64 nt, Human; identical to SEQ ID NO: 281647

SEQ ID NO: 315963 - RNA, 64 nt, Human; identical to SEQ ID NO: 281648

SEQ ID NO: 315964 - RNA, 64 nt, Human; identical to SEQ ID NO: 281649

SEQ ID NO: 315965 - RNA, 64 nt, Human; identical to SEQ ID NO: 280506

SEQ ID NO: 315966 - RNA, 64 nt, Human; identical to SEQ ID NO: 280507

SEQ ID NO: 315967 - RNA, 64 nt, Human; identical to SEQ ID NO: 281650

SEQ ID NO: 315968 - RNA, 64 nt, Human; identical to SEQ ID NO: 281651

SEQ ID NO: 315969 - RNA, 64 nt, Human; identical to SEQ ID NO: 281652

SEQ ID NO: 315970 - RNA, 64 nt, Human; identical to SEQ ID NO: 281653

SEQ ID NO: 315971 - RNA, 64 nt, Human; identical to SEQ ID NO: 281654

SEQ ID NO: 315972 - RNA, 63 nt, Human
caucaaccaccuuccccaagcuuagugacagcagccgcccauccuaccuggauggagaagaga

SEQ ID NO: 315973 - RNA, 63 nt, Human
gcuacagcaacagcagcugggcaagccagauaggccgcccaugcucucagccuuucucccucc

SEQ ID NO: 315974 - RNA, 63 nt, Human
gcugccgccccaacugcugccagaccaugugcugccgcccaaccugcucuagugcuucuugcu

SEQ ID NO: 315975 - RNA, 57 nt, Human; identical to SEQ ID NO: 281655

SEQ ID NO: 315976 - RNA, 64 nt, Human; identical to SEQ ID NO: 281656

SEQ ID NO: 315977 - RNA, 64 nt, Human; identical to SEQ ID NO: 281657

SEQ ID NO: 315978 - RNA, 64 nt, Human; identical to SEQ ID NO: 281658

SEQ ID NO: 315979 - RNA, 64 nt, Human; identical to SEQ ID NO: 281659

SEQ ID NO: 315980 - RNA, 64 nt, Human; identical to SEQ ID NO: 281660

SEQ ID NO: 315981 - RNA, 64 nt, Human; identical to SEQ ID NO: 281661

SEQ ID NO: 315982 - RNA, 64 nt, Human; identical to SEQ ID NO: 281662

SEQ ID NO: 315983 - RNA, 64 nt, Human; identical to SEQ ID NO: 281663

SEQ ID NO: 315984 - RNA, 64 nt, Human; identical to SEQ ID NO: 281664

SEQ ID NO: 315985 - RNA, 64 nt, Human; identical to SEQ ID NO: 281665

SEQ ID NO: 315986 - RNA, 64 nt, Human; identical to SEQ ID NO: 281666

SEQ ID NO: 315987 - RNA, 64 nt, Human; identical to SEQ ID NO: 281667

SEQ ID NO: 315988 - RNA, 64 nt, Human; identical to SEQ ID NO: 281670

SEQ ID NO: 315989 - RNA, 64 nt, Human; identical to SEQ ID NO: 281671

SEQ ID NO: 315990 - RNA, 64 nt, Human; identical to SEQ ID NO: 281672

SEQ ID NO: 315991 - RNA, 63 nt, Human
cggcggggacucggagggugccgugcgggcgaggccgcccaaauuuggcaauaaauaaagcuu

SEQ ID NO: 315992 - RNA, 63 nt, Human
acccucaugugagcccggaacgcccgccugcccgccgcccacccccacugacccccgcugccu

SEQ ID NO: 315993 - RNA, 63 nt, Human
cgcccgcguagacgcgcuggacgccgccuccucgccgcccaaugcggcagccugcccgucggc

SEQ ID NO: 315994 - RNA, 64 nt, Human; identical to SEQ ID NO: 281673

SEQ ID NO: 315995 - RNA, 64 nt, Human; identical to SEQ ID NO: 281674

SEQ ID NO: 315996 - RNA, 64 nt, Human; identical to SEQ ID NO: 281675

SEQ ID NO: 315997 - RNA, 64 nt, Human; identical to SEQ ID NO: 281676

SEQ ID NO: 315998 - RNA, 64 nt, Human; identical to SEQ ID NO: 281677

SEQ ID NO: 315999 - RNA, 64 nt, Human; identical to SEQ ID NO: 281678

SEQ ID NO: 316000 - RNA, 64 nt, Human; identical to SEQ ID NO: 281679

SEQ ID NO: 316001 - RNA, 64 nt, Human; identical to SEQ ID NO: 281680

SEQ ID NO: 316002 - RNA, 64 nt, Human; identical to SEQ ID NO: 281681

SEQ ID NO: 316003 - RNA, 64 nt, Human; identical to SEQ ID NO: 281682

SEQ ID NO: 316004 - RNA, 64 nt, Human; identical to SEQ ID NO: 281683

SEQ ID NO: 316005 - RNA, 56 nt, Human; identical to SEQ ID NO: 281684

SEQ ID NO: 316006 - RNA, 64 nt, Human; identical to SEQ ID NO: 281685

SEQ ID NO: 316007 - RNA, 64 nt, Human; identical to SEQ ID NO: 281686

SEQ ID NO: 316008 - RNA, 64 nt, Human; identical to SEQ ID NO: 281687

SEQ ID NO: 316009 - RNA, 64 nt, Human; identical to SEQ ID NO: 281690

SEQ ID NO: 316010 - RNA, 63 nt, Human
ccaggugccggggaagaggggccaggccugggggccgcccagcuccucggaauguguuugacu

SEQ ID NO: 316011 - RNA, 63 nt, Human
uuuuucugucaggaaaacaauguuggccugugggccgcccacaacauauccuucccucacuac

SEQ ID NO: 316012 - RNA, 63 nt, Human
cucucagucauuccccuggggcucaagcgcugggccgcccacuccugccucccucaucugugu

SEQ ID NO: 316013 - RNA, 64 nt, Human; identical to SEQ ID NO: 281691

SEQ ID NO: 316014 - RNA, 64 nt, Human; identical to SEQ ID NO: 281692

SEQ ID NO: 316015 - RNA, 64 nt, Human; identical to SEQ ID NO: 281693

SEQ ID NO: 316016 - RNA, 64 nt, Human
guuguucucauagaaccaacagcaucugagcccucaacaccaacagcaccauccucuguagcag

SEQ ID NO: 316017 - RNA, 64 nt, Human
cggcucccccugccagcaacgcucacucuacccccaacaccaccccuugcccaaccaaugcaca

SEQ ID NO: 316018 - RNA, 64 nt, Human
uuucaggugccccacaccggcaaguaccagccagcaacaccaaccaaaugcuacucucuuuaaa

SEQ ID NO: 316019 - RNA, 64 nt, Human
uauauaucagaaaugcacacaacagaaccauaggcaacaccaacacaggaagaaauagaaguca

SEQ ID NO: 316020 - RNA, 64 nt, Human
cgugagcacugcguacaaacauccaaaaguucaacaacaccagaacugugugucucaugguaug

SEQ ID NO: 316021 - RNA, 64 nt, Human
caaagguuauuuccuggagaaaagacaauuuauucaacaccaacgagggacucaucauaugggc

SEQ ID NO: 316022 - RNA, 64 nt, Human
aguccauugguagcauuguguguaugaggagauucaacaccacagacagcugcaggacucgaua

SEQ ID NO: 316023 - RNA, 63 nt, Human
gccaaggcucccguuccgugggaugccauaaaagccgcccagugggacccacagucacacaga

SEQ ID NO: 316024 - RNA, 64 nt, Human
ucuauaugaucacucccaacgggagguuuaagugcaacaccaggcugugucuuucuaucacgga

SEQ ID NO: 316025 - RNA, 64 nt, Human
cugccucugagccaccaacuggaccccucuccagcaacaccaccgccaccaccucccacauccc

SEQ ID NO: 316026 - RNA, 64 nt, Human
gucuuaaacucaguugcaucccuggugcccaaagcaacaccagaaccaagaaggagcuccauaa

SEQ ID NO: 316027 - RNA, 64 nt, Human
aagcccaggcagacgagaccucugcccugaagaccaacaccagcccgugggcugcccccugccu

SEQ ID NO: 316028 - RNA, 64 nt, Human
gaaaaucccuaccuucagagacucuagcccagcccaacaccaucucuuccuaccucucagccuu

SEQ ID NO: 316029 - RNA, 64 nt, Human
ugccuaguggagccacagugccucccugcagccucaacaccacccugcuguccaguccccagcc

SEQ ID NO: 316030 - RNA, 64 nt, Human
cacuuuuagauaaaaaaaaaaaaaaaacaaaaaacaacaccaaaaaaacagcagugauauauau

SEQ ID NO: 316031 - RNA, 64 nt, Human
gguuugaagacuuccuagcuuguccuauggaccucaacaccaaggauuacaaauugcaaauuua

SEQ ID NO: 316032 - RNA, 64 nt, Human
aaauagauuugcauuugucaggcagacguuuauacaacaccacggugcuuuuauacauugugcu

SEQ ID NO: 316033 - RNA, 64 nt, Human
gagaaaccccuccagaacucccacccugacagcccaacaccaccuuccuccuggcuuccagggg

SEQ ID NO: 316034 - RNA, 64 nt, Human
ggugauuuaaauaaaugaguauugggccuaauugcaacaccagucuguuuuuaacagguucuau

SEQ ID NO: 316035 - RNA, 64 nt, Human
agugagagcucgugcccaucuccgaaaccaccuccaacaccaugagaugugcagccaaauaaca

SEQ ID NO: 316036 - RNA, 64 nt, Human
agcccaucugcgggcagagaaggucuaguuuguccaacaccauuaugauaucaggacugguuac

SEQ ID NO: 316037 - RNA, 64 nt, Human
ugcacuugugauccuuggccccuuuccccauucucaacaccauccaucccucuggacaaaggau

SEQ ID NO: 316038 - RNA, 64 nt, Human
aagguuucuucaucugggucuugcaggaggcaggcaacaccaggagcagaaaugaaagaggcaa

SEQ ID NO: 316039 - RNA, 64 nt, Human
agcuagaugggcuggugugguugggucaaggccccaacaccauggcugccagcuuccaggcugg

SEQ ID NO: 316040 - RNA, 64 nt, Human; identical to SEQ ID NO: 314534

SEQ ID NO: 316041 - RNA, 64 nt, Human; identical to SEQ ID NO: 314537

SEQ ID NO: 316042 - RNA, 64 nt, Human
cugauucuacuccagucuucucucaccauggagacaacaccaguagagcugggagcuggggccu

SEQ ID NO: 316043 - RNA, 64 nt, Human
gugaauuuuccccaguuaugugggaaagguaaagcaacaccaaauaaaagcccacagcagcuuc

SEQ ID NO: 316044 - RNA, 64 nt, Human
uuuuugagaaguucuuuuccuuuauauaggcuuccaacaccaaauaaccuaacugcuggaaaac

SEQ ID NO: 316045 - RNA, 64 nt, Human
cacugcacugcaaggugcauuucugucauuucugcaacaccaugagaccugagcaagaaugugc

SEQ ID NO: 316046 - RNA, 64 nt, Human
uagucagggaccacgggcgcugaaucugcagugccaacaccaaacugacacaucuccaggugua

SEQ ID NO: 316047 - RNA, 64 nt, Human
auggcagcuuuuaaaagauuuuuuuuuuuucucucaacaccaugauuccuuuaacaacauguuu

SEQ ID NO: 316048 - RNA, 64 nt, Human
ucacaaccuaugcagcgccccacuucuuccaccucaacaccaagcuguaggccagcccauggug

SEQ ID NO: 316049 - RNA, 64 nt, Human
aggccgagccggguggaucaugaggucagacguucaacaccagccuggccaagauggugaaacc

SEQ ID NO: 316050 - RNA, 64 nt, Human
agguuuucagggguucacuuaaguguaucacaaucaacaccagacgggauauuuuaacuaucag

SEQ ID NO: 316051 - RNA, 64 nt, Human
uacgcuacaugacaacguuucgacauuucaccggcaacaccaagaggguuuuuaguggcuuggg

SEQ ID NO: 316052 - RNA, 64 nt, Human
ucagaacuggguuuuuguggagguucagagcaggcaacaccauaaguugcucucagauccuugu

SEQ ID NO: 316053 - RNA, 64 nt, Human
agcaauuaaaauauaucaaaucgcacugaauacucaacaccagagcucuaaugugggaaauggu

SEQ ID NO: 316054 - RNA, 64 nt, Human
ucauucugcauauucuuucccuaggguuucuucccaacaccaaaggacuuaccaucugucucuc

SEQ ID NO: 316055 - RNA, 64 nt, Human
agucaaugccacucuccacaacaacaaugaaaaccaacaccaacucaacaacaaagugcaauac

SEQ ID NO: 316056 - RNA, 64 nt, Human
aaaugaagggauauuuaaacuugcuacuguuguucaacaccauuaauggucagugugaaccauu

SEQ ID NO: 316057 - RNA, 64 nt, Human
cugcuucgauuccccacugcccuuguccuggauccaacaccaaauaaaaagaaacaagugaagu

SEQ ID NO: 316058 - RNA, 64 nt, Human; identical to SEQ ID NO: 314542

SEQ ID NO: 316059 - RNA, 50 nt, Human; identical to SEQ ID NO: 314545

SEQ ID NO: 316060 - RNA, 64 nt, Human; identical to SEQ ID NO: 314551

SEQ ID NO: 316061 - RNA, 64 nt, Human; identical to SEQ ID NO: 314555

SEQ ID NO: 316062 - RNA, 64 nt, Human
gcagaaagguucugcccgggaaggucaccagcaccaacaccacgguagugccugaaauuucacc

SEQ ID NO: 316063 - RNA, 64 nt, Human
cccugcuucuccagccuggacccccagcuuugcccaacaccagccccugccccagcccaagucc

SEQ ID NO: 316064 - RNA, 64 nt, Human
agcugcacccauuuucuggagguuuugcugcccacaacaccaguauuucacaacuuccuggucg

SEQ ID NO: 316065 - RNA, 64 nt, Human
aaauauccuacagugagaagacacagcguuuuggcaacaccauggaaagugggcuuaaaaaagg

SEQ ID NO: 316066 - RNA, 64 nt, Human
ccuuucuacugcuguugacaucuucuuauuacagcaacaccauucuaggaguuuccugagcucu

SEQ ID NO: 316067 - RNA, 64 nt, Human
caaaagaagcauugcagcccuuggcuagacuugccaacaccacagaaauggggaauucucuaau

SEQ ID NO: 316068 - RNA, 64 nt, Human
aggcccucugcccacccucucacuaggccucacccaacaccaguggaacuggagccucuggcug

SEQ ID NO: 316069 - RNA, 64 nt, Human
aagccuagcgugucucucaacacuggggcugcugcaacaccagaccagugaucuuuccuaagca

SEQ ID NO: 316070 - RNA, 64 nt, Human
acuugauaaaaagaaaagcuacacccaaacaauacaacaccaaaaugaauuuuggcaccauccu

SEQ ID NO: 316071 - RNA, 64 nt, Human
gauugaagacuagccuauugaagcugcugccaggcaacaccacuuaacaguaacuuaaaggaau

SEQ ID NO: 316072 - RNA, 64 nt, Human
agccaaaaucuaaagaucaaccauuuauccugaacaacaccauuugagaaagagguaaccaucu

SEQ ID NO: 316073 - RNA, 64 nt, Human
aaaugaaagugcucaauagaauuuuuaacguuggcaacaccauaaggauuucuuauguuaaguc

SEQ ID NO: 316074 - RNA, 64 nt, Human
aaugaaucauggaaacacucuuuaugauuuuuuacaacaccagauaugcaggugaauuguggaa

SEQ ID NO: 316075 - RNA, 64 nt, Human
uuaucuaauuugcaauaagagagccucucucuaucaacaccagcuucucucucgggcuguuugc

SEQ ID NO: 316076 - RNA, 64 nt, Human
acucugugcucacaauccagagcaauggauccuccaacaccaccagguggauguggagcaggag

SEQ ID NO: 316077 - RNA, 64 nt, Human
gucccucugugggagcccgggugccaggcccucccaacaccacaccacccuccaggccccccug

SEQ ID NO: 316078 - RNA, 63 nt, Human
gcauuucacgagccacagguggggcucauccaggccgcccagcagcugcugugugaugagcag

SEQ ID NO: 316079 - RNA, 63 nt, Human
ggaggagcagccgugacugcccguggcucugcugccgcccacucccugccuugugaguggccu

SEQ ID NO: 316080 - RNA, 64 nt, Human
ccacgggcgacugacagcucugcaggagagauugcaacaccaucccacacuguccaggccuuaa

SEQ ID NO: 316081 - RNA, 64 nt, Human
uuuaaguauuuuaaauaauuaaaacauuaaauggcaacaccauagaauauagguguucucugga

SEQ ID NO: 316082 - RNA, 64 nt, Human
cuuucuuuagcaccaguggaguuuucagaaggaacaacaccagggaaugccaaaaaaacaaagg

SEQ ID NO: 316083 - RNA, 64 nt, Human
uccuggguccaagugauccucccaccucagcacacaacaccaugcccaauuuuaagugcguuau

SEQ ID NO: 316084 - RNA, 64 nt, Human
ggagcagcacccaggaggggaugccgcgcuccagcaacaccaggucaggccugugcagaccccu

SEQ ID NO: 316085 - RNA, 64 nt, Human
ugaccaucuguaucuuguuaccugcuuucucucucaacaccacaguucucaacccugagccuuc

SEQ ID NO: 316086 - RNA, 64 nt, Human
gcaaauauguucaucacugucaggcugcccacagcaacaccaagcauauuagaagaggaacccc

SEQ ID NO: 316087 - RNA, 64 nt, Human
uggaacucauuuugggcuauucauguuaaauauucaacaccaaugaucuacucuguucgcaguu

SEQ ID NO: 316088 - RNA, 64 nt, Human
agcuuuuucacucuaaaaaucuuggcaauaaugucaacaccagaaagccuccucuggagaaucu

SEQ ID NO: 316089 - RNA, 64 nt, Human
gcugaggcagguggaucacuugaggucaggaguucaacaccagccuggccaacauggugaaacc

SEQ ID NO: 316090 - RNA, 64 nt, Human
cgaggucugaagggcucgccccguguccucucaccaacaccacaccccaacaagccagccuuug

SEQ ID NO: 316091 - RNA, 64 nt, Human
uggcugauuugggaauaaaauauaaucgaauauucaacaccaugaagauaaaucuuauuuugga

SEQ ID NO: 316092 - RNA, 64 nt, Human
guuuuuuauuacuguuccauuuugcaacauccugcaacaccauccugggagacaagagcauuac

SEQ ID NO: 316093 - RNA, 64 nt, Human
uugcucaucucaguccucaaagcuuuuugaaaaccaacaccaucacagcuuguuuuggacuuug

SEQ ID NO: 316094 - RNA, 64 nt, Human
aauucugucuccugcauacacuccggcaugcauccaacaccaauggcuuucuagaugaguggcc

SEQ ID NO: 316095 - RNA, 64 nt, Human
cuauaagaaaugcguuggguguccauaaaauuugcaacaccacaccugauggaaaaauguaauu

SEQ ID NO: 316096 - RNA, 63 nt, Human
ucuccccaggccuccagccucucccggcugccugccgcccaaagagaaaucacaggggcgggg

SEQ ID NO: 316097 - RNA, 63 nt, Human
cgcccggggcgcgccggcucagggaggcucggggccgcccaugcagacuuuuggccuggcgcg

SEQ ID NO: 316098 - RNA, 63 nt, Human
gggacgcugccggguagacucuccacucccccugccgcccacacugcagcagccacauccaua

SEQ ID NO: 316099 - RNA, 63 nt, Human
uacaagagcagaauaguacuuaaaauccaaacugccgcccagaugggcuuguucuucaugccu

SEQ ID NO: 316100 - RNA, 64 nt, Human
aucaaaauaccuucucagaugcuuuagaaacaugcaacaccaacuccuuuucuacccuccucuc

SEQ ID NO: 316101 - RNA, 64 nt, Human
uaacaaugaccagaagccugaagaauuaaaaugccaacaccaaaccuuuccuuaccagcucugg

SEQ ID NO: 316102 - RNA, 64 nt, Human
gaggcagguggaucaccuaaggucaggaguucaacaacaccagccugaccaacauggugaaacc

SEQ ID NO: 316103 - RNA, 64 nt, Human
uaaagugcccuuccaccuauuuuucuuugguuugcaacaccagccuguagacuuccaguuuuuc

SEQ ID NO: 316104 - RNA, 64 nt, Human
gcuauucccaucccacccccaaugcacagggcugcaacaccacgacuucugcccauucucucca

SEQ ID NO: 316105 - RNA, 64 nt, Human
ccccgagcccaagccaggagggauuucccuuaggcaacaccaucccagggagaucugccacaau

SEQ ID NO: 316106 - RNA, 64 nt, Human
gucauugcuggcuuaaagacaaggggccaggagccaacaccagaggccacuccacaaccccagc

SEQ ID NO: 316107 - RNA, 64 nt, Human
aggaaaaccaugaagcaguugcucaaauguuguucaacaccagaaaauuuauauuggagaaaag

SEQ ID NO: 316108 - RNA, 64 nt, Human
gugccuguggcuagccacugugcuccagccugggcaacaccaucguaaaaauaaauaaauaaau

SEQ ID NO: 316109 - RNA, 64 nt, Human
ccagcccugcuuccggcugcgaaugucccugagucaacaccaauagagauugcuuuguguauuu

SEQ ID NO: 316110 - RNA, 64 nt, Human
ggcaggggaacgggauccuucucccgcugcccaccaacaccaacacacacacaccucuaagcug

SEQ ID NO: 316111 - RNA, 64 nt, Human
gagacacaacuuucuggcagacagacaaauuguacaacaccaacaauauccuggaccuugaaau

SEQ ID NO: 316112 - RNA, 64 nt, Human
uauagucacuguaauggugcuauuaacaaacagucaacaccauuguauuuuuuaacuucguguu

SEQ ID NO: 316113 - RNA, 64 nt, Human
gaguaugaaaugagaguuagaccauaugggcugacaacaccauaaauaacaagaaaagggagug

SEQ ID NO: 316114 - RNA, 64 nt, Human
cuuccgcacuggggagaaucuaugcaagccucgucaacaccacuuugcagcauucagcugcuga

SEQ ID NO: 316115 - RNA, 64 nt, Human
uuucaauaaaggaaaauuacggaaggaaaauaggcaacaccagcaaauuauauguggacagguu

SEQ ID NO: 316116 - RNA, 63 nt, Human
ccagcuuccacauccggagcccuggucagcauagccgcccacggucuguucucagauuccuaa

SEQ ID NO: 316117 - RNA, 63 nt, Human
gacugagcucgggcacgcagggccugagaucuggccgcccauuccgcgagccagggccgggcg

SEQ ID NO: 316118 - RNA, 61 nt, Human; identical to SEQ ID NO: 315021

SEQ ID NO: 316119 - RNA, 63 nt, Human; identical to SEQ ID NO: 315022

SEQ ID NO: 316120 - RNA, 64 nt, Human
uuggggaagagaacugaauccaaggaucuguuuucaacaccauuccaagucuguaauuuccuga

SEQ ID NO: 316121 - RNA, 64 nt, Human
ucuggagccugaagggucaagugcugucuaccaucaacaccaaccagaugaacaacacacacgc

SEQ ID NO: 316122 - RNA, 64 nt, Human
agacgcagggagaccccaccaccaccaccaccaccaacaccaccaccaccaccgcgagcuggag

SEQ ID NO: 316123 - RNA, 64 nt, Human
guuuguucaacaucuccaccuguaauccuguggccaacaccaaugccccaaccuucccccacag

SEQ ID NO: 316124 - RNA, 64 nt, Human
gcgggucauauucauaccuucugaugaaguuguacaacaccagcaacauuauaauggcccugua

SEQ ID NO: 316125 - RNA, 64 nt, Human
ugcucagugccuaucaacauuuggacucaagcaucaacaccaaauuauuccucccuucucguau

SEQ ID NO: 316126 - RNA, 64 nt, Human
aguuacaagacccaucucccuagucucagccuuacaacaccacgggacuaaggaagagcacuuc

SEQ ID NO: 316127 - RNA, 64 nt, Human
ucaccagggagaacuggacagaacugaaacacagcaacaccaguucucaaggacaaggugugug

SEQ ID NO: 316128 - RNA, 64 nt, Human
agaaccaccgccaccaccaccaacaccgccacaccaacaccaccacuacaaaaaaaaaagaauu

SEQ ID NO: 316129 - RNA, 64 nt, Human
auuucucagaauuucauucuaggcaaguuccacucaacaccagaucaagcaauucuaucuauuu

SEQ ID NO: 316130 - RNA, 64 nt, Human
aagaccgaagcucagaugaguuaaguggucuccucaacaccaaaaugccaagaagugauggagc

SEQ ID NO: 316131 - RNA, 64 nt, Human
cugcagcccucugcuccucccggccgcugcacagcaacaccacagaacaagcagcaccccacag

SEQ ID NO: 316132 - RNA, 64 nt, Human
gucuccccacuccacgcuccgggcgccccaacuccaacaccacguccugccgcgcagguucuuc

SEQ ID NO: 316133 - RNA, 64 nt, Human
augucuuuggugcuuuggcccuaauagcacuggacaacaccacgaccacauggaaacauauuuu

SEQ ID NO: 316134 - RNA, 64 nt, Human
auggugaggcuuuucaaguaccuauauuuagccccaacaccauuucugggcuccuggggcucag

SEQ ID NO: 316135 - RNA, 64 nt, Human
gguccuuggcgguaaccagagggcagcguagugucaacaccagagaccaggauccaaauugugg

SEQ ID NO: 316136 - RNA, 63 nt, Human
agcuggugagacaaccucugauccugaggaccggccgcccaccaaggguugggcccccggggc

SEQ ID NO: 316137 - RNA, 63 nt, Human
ccagguggcgugagaggcaaugacucguuaccugccgcccaucaccuuggaggccuucccugg

SEQ ID NO: 316138 - RNA, 63 nt, Human
gcgauuugguuucguuuuucuuuuguauuauccgccgcccaguuccuuuuuugucuuucucuc

SEQ ID NO: 316139 - RNA, 63 nt, Human
gaagacccggccaggaccuuggugagauggggugccgcccaccuccugcggauacucuuggag

SEQ ID NO: 316140 - RNA, 64 nt, Human
aucccuuccugucugaacaaaaacuguauggaaucaacaccaccgagcucugugggaaaaaaga

SEQ ID NO: 316141 - RNA, 64 nt, Human
ggcugcugucguuguguucuaccccguacugacccaacaccacaagggcuuucucugguccccu

SEQ ID NO: 316142 - RNA, 64 nt, Human
uuggacacaccauuccggaagaacugcagcuucucaacaccaguacccuugucucuggggaaac

SEQ ID NO: 316143 - RNA, 64 nt, Human
acaauuuuugguaguagguauuucgugagaaguucaacaccaaaacuggaacauaguucuccuu

SEQ ID NO: 316144 - RNA, 64 nt, Human
agguuaauucucuagggcuaguagaacuggaucccaacaccaaacucuuaauuagaccuaggcc

SEQ ID NO: 316145 - RNA, 64 nt, Human
gcucacgccuccucacucucugucugucccucaccaacaccaaggccuccaucucacuguaaau

SEQ ID NO: 316146 - RNA, 64 nt, Human
agaaaagaacacuucuuuauuugagggacuuucccaacaccaggugcuuggggauuucuuagag

SEQ ID NO: 316147 - RNA, 64 nt, Human
gacuguccuuaauugaaauuuugucuuugguuuccaacaccaugaugaagcucuugcuuuuuaa

SEQ ID NO: 316148 - RNA, 64 nt, Human
guaucagagcagugcuaaaauuucuaggacagaacaacaccaguacugguuuacagguguuaag

SEQ ID NO: 316149 - RNA, 64 nt, Human
cuauacagaguaauugaacuuaacauguuuuugucaacaccaauuacauuuucagcuuuuaaaa

SEQ ID NO: 316150 - RNA, 64 nt, Human
ccgaccgcucucagggcccgcugcccugggcuggcaacaccauucuggccuuggccugcagaag

SEQ ID NO: 316151 - RNA, 64 nt, Human
ucuucuuuagccaagaagcaagaucugucacccacaacaccacauaucuugaaaagaugcuuuu

SEQ ID NO: 316152 - RNA, 64 nt, Human
agguaauuaaacaagauaaauuauaccugauuuccaacaccagcuacaaagaguugaagaugau

SEQ ID NO: 316153 - RNA, 64 nt, Human
ggagacgccagaggagccucacggucacguccaacaacaccacugcaccagggaaauggauaua

SEQ ID NO: 316154 - RNA, 64 nt, Human
gaguccuugcugugggaugugccaguguccccaccaacaccaggaauuuagaccuuuucccugc

SEQ ID NO: 316155 - RNA, 64 nt, Human
ugccaucuucauguuuuauaauauaaagcuuacccaacaccaguuaagccaugguuaaccuaaa

SEQ ID NO: 316156 - RNA, 63 nt, Human
agaauacuagaaugguagcacuacccggccggagccgcccaccgucuugggucgcccuacccu

SEQ ID NO: 316157 - RNA, 63 nt, Human; identical to SEQ ID NO: 315345

SEQ ID NO: 316158 - RNA, 63 nt, Human
ccagggaaagagccccaugccgcccccuaaggagccgcccagaccuagggcuggacucaggag

SEQ ID NO: 316159 - RNA, 63 nt, Human
uuauuuauugucggucugcccaugggacugggagccgcccacuuuuguccucaauaaaguuuc

SEQ ID NO: 316160 - RNA, 64 nt, Human
agugacugguggcucacuucugcccaccugccggcaacaccagugccaggaaaaggccaaaaga

SEQ ID NO: 316161 - RNA, 64 nt, Human
cagaccucgggcauccccuuauugccugaugggccaacaccaacaguuacggagugcuugagaa

SEQ ID NO: 316162 - RNA, 64 nt, Human
uagaggcgcuggagcggcacgucauccaggcugucaacaccagccccgagcggggaggcgagga

SEQ ID NO: 316163 - RNA, 64 nt, Human
uugauuggagaauuugcaaacuaccgucgcucagcaacaccaaaaagagaaagucugguuaaaa

SEQ ID NO: 316164 - RNA, 64 nt, Human
uaaaauacuaauauuaaguaaacuucauauuggccaacaccaggguuguauucuauggauguca

SEQ ID NO: 316165 - RNA, 64 nt, Human
aaccuuuccaaaaguuuuauauugagauucauaacaacaccaagaauugauuuuguagccaaca

SEQ ID NO: 316166 - RNA, 64 nt, Human
gacgggucggacacggcugugccccaucuggggccaacaccacuugucuguaacaucccacauc

SEQ ID NO: 316167 - RNA, 64 nt, Human
gccucaggucccgaguaacuuauguucaaugugccaacaccaguggggagcccgcaggccuaug

SEQ ID NO: 316168 - RNA, 64 nt, Human
aaaaagugacacagcagcuucaccagagcauuuccaacaccacagacacacacacgcacgcaca

SEQ ID NO: 316169 - RNA, 52 nt, Human
ccuggagccuucaucccuaagucaacaccaggagagcuucucccaaacuccc

SEQ ID NO: 316170 - RNA, 64 nt, Human
agucuuauuacagcuuugaccaaugguuggaacccaacaccagagcuuugcuaauaauuagugu

SEQ ID NO: 316171 - RNA, 64 nt, Human
cuuugggauacagcguauaggugcagcccugucacaacaccaacagaaguagcagccucugggu

SEQ ID NO: 316172 - RNA, 64 nt, Human
ucaaaucagaauggaaaagacucaaaaccaucaucaacaccaagaucaaaaggacaagaauccu

SEQ ID NO: 316173 - RNA, 64 nt, Human
ugacacacacugucuggggccccaucagcugccacaacaccagccccacuucugggucaugcac

SEQ ID NO: 316174 - RNA, 64 nt, Human
uaaaaacuuuuugcucaaagaagcuuucacauugcaacaccagcuucuaaggauuuuuuaagga

SEQ ID NO: 316175 - RNA, 64 nt, Human
accacuugagcaaacuccaagacaccuucuaccccaacaccagcaauuaugccaagggccguua

SEQ ID NO: 316176 - RNA, 63 nt, Human
agggccaagccuguaucucuucacucugcagaggccgcccaggugcugggaauggcacggagc

SEQ ID NO: 316177 - RNA, 63 nt, Human
cguuccaugcugucuggggagagcagcacacuggccgcccagcacugcugcuaugacgaggac

SEQ ID NO: 316178 - RNA, 63 nt, Human; identical to SEQ ID NO: 40881

SEQ ID NO: 316179 - RNA, 63 nt, Human
cuccaagcccccaaauagcuccaggcgcccucggccgcccaucaugguuaauucuguccaaca

SEQ ID NO: 316180 - RNA, 64 nt, Human
uggggcguuccaggggaugcuguugguucaaggacaacaccagaaugaagagggucucacaaga

SEQ ID NO: 316181 - RNA, 64 nt, Human
uuugcugaaugagggccuucucgugagguacugacaacaccagcaacucgagagcugggaaacu

SEQ ID NO: 316182 - RNA, 64 nt, Human
gguaauuuccacugucuuuucauuuacaaccaagcaacaccaguuaacauaguagccucaucuc

SEQ ID NO: 316183 - RNA, 64 nt, Human
ugaccacaagcuucugccugaagauuccucaggucaacaccaucauuaaaugcgaguuuuguug

SEQ ID NO: 316184 - RNA, 64 nt, Human
ccccagccggcaacuucuaccgagagccauggcucaacaccaaacuggacaguagacaucauga

SEQ ID NO: 316185 - RNA, 64 nt, Human
aaaugcaggaaauucuugaagaguauaaugaaagcaacaccaaaaugaacuugguucucuucga

SEQ ID NO: 316186 - RNA, 64 nt, Human
agaaauaaagcaaaaagcaggccacaaccuuaaccaacaccaaagaaacauccaagcaauaaag

SEQ ID NO: 316187 - RNA, 64 nt, Human
caucagucugguugacaggaagaaaccacaccaucaacaccaacaaguuucuguguuccuuuua

SEQ ID NO: 316188 - RNA, 64 nt, Human
uaguuggaucaagugacuucugcccaccuggacacaacaccaaaaaggcuucuuauucgggugu

SEQ ID NO: 316189 - RNA, 64 nt, Human
uugcuguuaacacuagaaaacacacuuccugcaccaacaccaauacccuuucaaaagaguuguc

SEQ ID NO: 316190 - RNA, 51 nt, Human
ucacauacaggacuuuuuaagcaacaccacaucuugugcuucuuuguagca

SEQ ID NO: 316191 - RNA, 64 nt, Human
cuacuuaaguuagccucaucauuuugugcugcuccaacaccagcaggguaucucccaauaaagu

SEQ ID NO: 316192 - RNA, 64 nt, Human
agaugcccuucaaauauauuuuacguuugcagcacaacaccauugcccggaggcuuccgaaucu

SEQ ID NO: 316193 - RNA, 64 nt, Human
uagucuggaaaacaaacaugaagcaaagaaggcacaacaccauauggaaaagcaagacagaaau

SEQ ID NO: 316194 - RNA, 64 nt, Human
gaugagcagacauccucuguccccguggaggggucaacaccaaggugguguucgugcaccagaa

SEQ ID NO: 316195 - RNA, 64 nt, Human
auauggauuuuuaaaucacaugucauuacuuuugcaacaccaucaccaaaauuuuuugcucuuu

SEQ ID NO: 316196 - RNA, 63 nt, Human
cuguugcuaggagauagcuggggaaggcccaaggccgcccagggcagagagaggagacgaaga

SEQ ID NO: 316197 - RNA, 63 nt, Human; identical to SEQ ID NO: 315972

SEQ ID NO: 316198 - RNA, 63 nt, Human; identical to SEQ ID NO: 315973

SEQ ID NO: 316199 - RNA, 63 nt, Human
uaggcugcuggaguccuggaaccaccugggucggccgcccaaaucuuuccuggcgaaggggag

SEQ ID NO: 316200 - RNA, 64 nt, Human
ugucaucauaacuggcuucugcuugucauccacacaacaccaggacuuaagacaaaugggacug

SEQ ID NO: 316201 - RNA, 64 nt, Human
caaacuaaauuuaagugggaugauuagauauacacaacaccaagugguacaucugcagagauaa

SEQ ID NO: 316202 - RNA, 64 nt, Human
acguugcugugaauauuucuccuacccgauuccccaacaccacuagugccucuggauuuagaga

SEQ ID NO: 316203 - RNA, 64 nt, Human
gggcaggagcucccauccugggcagccaaccaggcaacaccaaggacucuuuguaaacgauagc

SEQ ID NO: 316204 - RNA, 64 nt, Human
aacagcagcagucacguuccucggccgccacaaccaacaccaaagcaggaaaaccauuuucugu

SEQ ID NO: 316205 - RNA, 64 nt, Human
auuugggauugaaguuaaacuacaacagugccgccaacaccaagucuugcaggaaaaaaauaca

SEQ ID NO: 316206 - RNA, 64 nt, Human
cucuuaccuagagggcuuuuacagagaauuagagcaacaccaaaaggauugccucuuuuccuuc

SEQ ID NO: 316207 - RNA, 64 nt, Human
uuaaagaugcuuuggaaaccaaccgugaacacaucaacaccacgacgucuacgauuacuugcua

SEQ ID NO: 316208 - RNA, 64 nt, Human
uaacugagcagcaccgucgucucgacuucggaggcaacaccaagcccgaccgggccaggccugg

SEQ ID NO: 316209 - RNA, 64 nt, Human
cccugacaacccgagagggcauauggggcccugccaacaccacuuccucagcagaaacccguca

SEQ ID NO: 316210 - RNA, 64 nt, Human
gcaacaucagcucugucagcuccuugcugcucuucaacaccaccgagaaccuguauggccagag

SEQ ID NO: 316211 - RNA, 64 nt, Human
ccaacaggucugaucccugaggugaaccccagugcaacaccaaacuucaggggcacaagcgagg

SEQ ID NO: 316212 - RNA, 64 nt, Human
uggaccucuuugguucucuccccuuucaagugagcaacaccacaaugacugucuaaagcaugcc

SEQ ID NO: 316213 - RNA, 64 nt, Human
augcauugcucaaagcuggcuuuucacauuaagucaacaccaaacgugguugccacauuucauc

SEQ ID NO: 316214 - RNA, 64 nt, Human
ugccagccugcccacagcagccuccuagaguuagcaacaccagguguuccucccaacucgucug

SEQ ID NO: 316215 - RNA, 64 nt, Human
gcucuucucagcgccacccucagcagccagauugcaacaccagggagaggcggaugcagagccc

SEQ ID NO: 316216 - RNA, 63 nt, Human
caggcaggacccaguuuccagagagcaggcggggccgcccagugggucaggcacagggagccc

SEQ ID NO: 316217 - RNA, 63 nt, Human
ucuaagaacccgugccgagaggguuccuggacggccgcccagguccuccgugcaggcccguga

SEQ ID NO: 316218 - RNA, 63 nt, Human
gucgagcagagccgguaaccaccacgugccagagccgcccacccggagccgcccgcaugcagc

SEQ ID NO: 316219 - RNA, 63 nt, Human
aggucacagcuaggacuccauccugacgccacagccgcccauggaccagcccccgagagccac

SEQ ID NO: 316220 - RNA, 64 nt, Human
cuguucaacaagcagaacaggauaauucagacaacaacaccaucuuugugcaaggccuggguga

SEQ ID NO: 316221 - RNA, 59 nt, Human
cucacgugacuuguguuaggauuccgaugcaacaccaugcaaaaccccgaaacagcugc

SEQ ID NO: 316222 - RNA, 64 nt, Human
aacacaguuaucuuaguuuaccgguggaguauuucaacaccaaccacauuucccuuccucccuc

SEQ ID NO: 316223 - RNA, 64 nt, Human
gccaaagcaggacgaucacuugagcccaggaguucaacaccagcuugggcaacguaagaagacc

SEQ ID NO: 316224 - RNA, 64 nt, Human
acacggaggaggagccgccccagccugaggucugcaacaccaagaaguggcucaggcaacucug

SEQ ID NO: 316225 - RNA, 64 nt, Human
aaucccgcaggacagcugcacucagggauacgcccaacaccauggccugcaaccccagggucaa

SEQ ID NO: 316226 - RNA, 64 nt, Human
gccucccaggcccauccucaacagcuaccccagccaacaccaaggccacaaggggaccccggcc

SEQ ID NO: 316227 - RNA, 64 nt, Human
gugugcucggcuuccgagaguucuucaagugggccaacaccacccucgugaguaaccuguaugg

SEQ ID NO: 316228 - RNA, 64 nt, Human
auggaggcccucaggaucugacacccucuugucccaacaccagucagcccuauacccuaacuca

SEQ ID NO: 316229 - RNA, 64 nt, Human
ccucccaccacagcaggugucauauauggggggccaacaccagggaugguacuagggggaagug

SEQ ID NO: 316230 - RNA, 64 nt, Human
uggugcuuccaaccuccugccaaccuggaguucacaacaccagagccccacggccucgcacacu

SEQ ID NO: 316231 - RNA, 64 nt, Human
cggccucacucagcucacagggcgugccaggcggcaacaccagaaucuuccagaagcccagcuc

SEQ ID NO: 316232 - RNA, 64 nt, Human
guuugaaaauguugagacagcacagcagccacuccaacaccagcuguagguucaaugaguaguu

SEQ ID NO: 316233 - RNA, 55 nt, Human
uccugccacucagcagcugaaguaucaacaccagcccuugacccuugaguccugg

SEQ ID NO: 316234 - RNA, 64 nt, Human
gauucuaccacaagugaccaucagauuauaucuucaacaccacaccccccaccccaucgugggu

SEQ ID NO: 316235 - RNA, 64 nt, Human
cugcaccccucccuucuccaucucgcuugcugcccaacaccauggcccucacaggcccaacuga

SEQ ID NO: 316236 - RNA, 63 nt, Human
cagcucagcacagaaggagcagccccagccacagccgcccagccccggggucucagaugcuca

SEQ ID NO: 316237 - RNA, 63 nt, Human
aagaggaagagaugagggucgcaggggcccccggccgcccaccgcccgccccgucucaccuuc

SEQ ID NO: 316238 - RNA, 63 nt, Human
gccucccaggggauggggacccagagugcaguggccgcccacauccauggccuaggagcuacu

SEQ ID NO: 316239 - RNA, 63 nt, Human
agagagaggagcgcgcuuccuuuccuccccgcugccgcccacccuggggagagacuuuugcgg

SEQ ID NO: 316240 - RNA, 64 nt, Human
uuguucucacucccgccccaucuuaauguauaaccaacaccaaacacguggaucaacagaaaag

SEQ ID NO: 316241 - RNA, 64 nt, Human
caaccucccugcccccacacacuuaucccagacacaacaccauguggucuggaggucccagccc

SEQ ID NO: 316242 - RNA, 64 nt, Human
auuauuccuccauccugucuggaauacaccaggucaacaccagagaucucagaucagaaucaga

SEQ ID NO: 316243 - RNA, 64 nt, Human
acugaagcccuggcugccucagcgcucugucucccaacaccagcugguguugcagagggagguc

SEQ ID NO: 316244 - RNA, 64 nt, Human
gauguaaguucuuacaugauaagcagauugaauacaacaccagcagcuugccuuagaaaaggag

SEQ ID NO: 316245 - RNA, 64 nt, Human
cuucauuucuuuccagaacaacucuuucccaccccaacaccacugccaccaccccucuuuuuau

SEQ ID NO: 316246 - RNA, 64 nt, Human
ggcaaucugauuagcuucacagacugagucuccacaacaccaaaauauccagauguaaacccca

SEQ ID NO: 316247 - RNA, 64 nt, Human
ccgcggguccaccgaggacgccaaucaaucaacccaacaccacaagcuugguugggugcaagca

SEQ ID NO: 316248 - RNA, 64 nt, Human
aaacacaaaaccccguaaaaucacaaagaaaauccaacaccaaaggcgcagaagccggcuggcc

SEQ ID NO: 316249 - RNA, 64 nt, Human
cucagccuccugaguagcugggaccauaggcucacaacaccacaccuggcaaauuugauuuuuu

SEQ ID NO: 316250 - RNA, 64 nt, Human
gccaaggcggauggaucacuugagcccaggaguucaacaccagccugagcaacaugguaaaacc

SEQ ID NO: 316251 - RNA, 64 nt, Human
agagccaggagacaggauagggguuucuaggguccaacaccagcuuaccuuggaguaugaaucu

SEQ ID NO: 316252 - RNA, 64 nt, Human
agggccauccccaaacccauccccaagccaaacucaacaccauccccuucccuaaucaccucuc

SEQ ID NO: 316253 - RNA, 64 nt, Human
uaacguacuuuccccugaaacagagcaacccagucaacaccacagaaccucagcuuugaacccu

SEQ ID NO: 316254 - RNA, 64 nt, Human
ugugaaauccuuuagccagcguuucaaccucauucaacaccagaaaguucacaguggaaaaaau

SEQ ID NO: 316255 - RNA, 64 nt, Human
ggaaaaagguuucagccaaaggccuaacccuauucaacaccagaaaguuuacacuggagaaagg

SEQ ID NO: 316256 - RNA, 64 nt, Human
uccacaccucacacaccuguugucagcaucgagccaacaccaaccugacaagguucggagugau

SEQ ID NO: 316257 - RNA, 64 nt, Human
gccccggccugggucaucaggcacagaggcaccgcaacaccaccugcggcaacuccagaccucu

SEQ ID NO: 316258 - RNA, 64 nt, Human
ucuugcuuuacuggacugauuuuaacccgcugcacaacaccaacuaaaaguaguaauaccagca

SEQ ID NO: 316259 - RNA, 64 nt, Human
uugaaaaaaaaguuuuccaaaacuacaacuuagacaacaccagaggguucauacugagauauau

SEQ ID NO: 316260 - RNA, 64 nt, Human
cccaacucuuggacaccaggccaacuagaacacccaacaccaaacuguacagacucucccaccc

SEQ ID NO: 316261 - RNA, 64 nt, Human
uacagucuucaucuucuucacuuacccacagcagcaacaccaggccugucacacagaugaaugu

SEQ ID NO: 316262 - RNA, 64 nt, Human
auuagagaaagaauauguugauuuaaaagccuuccaacaccauuuaaacaugguuuaucuucag

SEQ ID NO: 316263 - RNA, 64 nt, Human
gagaugugggccacucagagcuaaccaaaauguucaacaccauaacuagagacacucaaauugc

SEQ ID NO: 316264 - RNA, 64 nt, Human
gaugucugagccacucagaacucaccaaaauguucaacaccauaacaacagcugcucaaacugu

SEQ ID NO: 316265 - RNA, 64 nt, Human
auggggaauucuagcccccacuggggggauguuacaacaccaugcugguuauuuuggcggcugu

SEQ ID NO: 316266 - RNA, 64 nt, Human
agggcauuguguccuggggugacgucccuugugacaacaccaccaagccuggugucuauaccaa

SEQ ID NO: 316267 - RNA, 64 nt, Human
uccagccccuuccccuggagagggacugcucagccaacaccaccagcugccacauccugggcug

SEQ ID NO: 316268 - RNA, 64 nt, Human
ugucuguaaaaugugugaaaccaaacugcagccucaacaccauggacacacgucaucaggaccu

SEQ ID NO: 316269 - RNA, 64 nt, Human
ugcucacauucuuucagccuucugucaccccccucaacaccaaacuuucuuccuugugagcaga

SEQ ID NO: 316270 - RNA, 64 nt, Human
cucaggcugccagcagcucucuggugcaucgucucaacaccaccaaguuuguaggaccugccca

SEQ ID NO: 316271 - RNA, 64 nt, Human
ccuuuugacucuucccuuccaauguaaucucugccaacaccaugaggcuuaaggugcucuaagu

SEQ ID NO: 316272 - RNA, 64 nt, Human
guuucuagaguuguuuucuuccucccccccccccccgcaccauugguuguguaucacuuucacu

SEQ ID NO: 316273 - RNA, 64 nt, Human
gucggcacuuggcuuucuguuccuagagcccaucccgcaccagcauuuuggaaccugcagagag

SEQ ID NO: 316274 - RNA, 64 nt, Human
cugcugucaccuugcucagccaucccgucuucuccaacaccaccucuccagaggccaaggaggc

SEQ ID NO: 316275 - RNA, 64 nt, Human
ccucucgcgagcggcccgggcagggacccugucccaacaccaacaccuccucuccagcccaauc

SEQ ID NO: 316276 - RNA, 64 nt, Human
agcccaaguagcgccugcgcuugcgugguggauccaacaccagcccugcgucgugggacuugcc

SEQ ID NO: 316277 - RNA, 64 nt, Human
gucugugaccuucuccugccccauuucacuugcucaacaccagacuuuaaucugacuguagcuc

SEQ ID NO: 316278 - RNA, 64 nt, Human
ucaucuggaggguucuaagugggagaaggacuaucaacaccacuaggaaucccagaggugggau

SEQ ID NO: 316279 - RNA, 64 nt, Human
gaacauuuuccuuuacccaggaaaucuccggagccaacaccaccacccccagggggucucccca

SEQ ID NO: 316280 - RNA, 64 nt, Human
gcugcauuuuggauauuuaguuuuaucuuuaguucaacaccaucaugguggauucauuuauacc

SEQ ID NO: 316281 - RNA, 64 nt, Human
auuuugcguguuugcauagcauaaaaucaguagacaacaccacugaggucguuacgaucaacga

SEQ ID NO: 316282 - RNA, 64 nt, Human
uuccuucccaucucacagcuuagcuugugcuucucaacaccaagucuuuaagagcaauaaaaac

SEQ ID NO: 316283 - RNA, 64 nt, Human
ggcgcacugugacccccagcuccggccuguccuccaacaccaagcacagcagccuggggcuggc

SEQ ID NO: 316284 - RNA, 64 nt, Human
gcuacagugcccugcugugggcuuggugcaccgucaacaccagagccguguaccugaggcccag

SEQ ID NO: 316285 - RNA, 64 nt, Human
gcuggauggaguggcuggaaggaaugguuccaaacaacaccaccgagaucucccucaggcuggc

SEQ ID NO: 316286 - RNA, 64 nt, Human
gugagcuacugaagccaaggugggaggcagcugacaacaccacccacggcccaugcagaggugg

SEQ ID NO: 316287 - RNA, 64 nt, Human
aggaucagacuaacggcuaaagagacugaugcaucaacaccaggcagagaauaaagcagauuuu

SEQ ID NO: 316288 - RNA, 64 nt, Human
ugccagaucacucagagccuaugaauguggauaucaacaccaggucucuagcaccgcuggauga

SEQ ID NO: 316289 - RNA, 64 nt, Human
ggaugguuuuuaaauuugguaugagauucucugccaacaccaagcucugaguuaacugugcuuu

SEQ ID NO: 316290 - RNA, 64 nt, Human
ccggcgggcccgggccugccgccccccagcccugccgcaccaagcuggcccuccuuccucccuc

SEQ ID NO: 316291 - RNA, 64 nt, Human
uauguguacauucggaguuccuguuuugcucaucccgcaccaccccacccuccacacacuaaca

SEQ ID NO: 316292 - RNA, 64 nt, Human
ucuuuggcugaccuucaauucccucuccaggacuccgcaccacuccccuacacccagagcauuc

SEQ ID NO: 316293 - RNA, 64 nt, Human
aaagugagcccacuacugguugcuuguccauggccaacaccagaaauccccugagcacuaccug

SEQ ID NO: 316294 - RNA, 64 nt, Human
cccccaaccuucaggcugccagaugcuccccugacaacaccaggcuacaggagccagacgccag

SEQ ID NO: 316295 - RNA, 64 nt, Human
ugccuaugugcuccuaccagauggagaggauguucaacaccacucggaucccgggcaaggacac

SEQ ID NO: 316296 - RNA, 64 nt, Human
gcacccuucauauccauccccguucucagcgggacaacaccauggacagccguuuucagagccu

SEQ ID NO: 316297 - RNA, 58 nt, Human
accgacagaacaugggcugaucuucccacaacaccacaggacugcagggugcacaacu

SEQ ID NO: 316298 - RNA, 64 nt, Human
uuaaaacaggaaagugucaauaaaaaaacuugagcaacaccaacauauuuuuucuuaaaauguc

SEQ ID NO: 316299 - RNA, 64 nt, Human
ugcuugaaagugaaaagcaaucaauuauacccaccaacaccacugaaaucauaagcuauucacg

SEQ ID NO: 316300 - RNA, 64 nt, Human
aaagugcaaacaacugagacagcaaaugaaugagcaacaccaugcauauagauugaguacuugg

SEQ ID NO: 316301 - RNA, 64 nt, Human
uacagugccuaaaauaagaauagaacaacauauacaacaccaaaaaauaucuaguaauauauuu

SEQ ID NO: 316302 - RNA, 64 nt, Human
aguaaaauaggugucacgcuguuuuuuuuaaugucaacaccaauaggaauccauuuagauuaau

SEQ ID NO: 316303 - RNA, 64 nt, Human
auggaaugugauuauagauuauaaaguauuaagacaacaccacaggccgcaugcucuaaucggu

SEQ ID NO: 316304 - RNA, 64 nt, Human
aucauggcaguucauuuacucuugugccaaauggcaacaccacgucuaaagcaguuucacagca

SEQ ID NO: 316305 - RNA, 64 nt, Human
gaaaacuuggcuuuaagacuuuuugacuccuuuccaacaccaucuuuuggaauuuucauacaaa

SEQ ID NO: 316306 - RNA, 64 nt, Human
aacucaggggggcagaagcucuggucacccacaccaacaccaaauccaucagcaaauucuacug

SEQ ID NO: 316307 - RNA, 64 nt, Human
ggccgcuucuagagccucgacacccccccaacccccgcaccaagcagacaaagucaauaaaaga

SEQ ID NO: 316308 - RNA, 64 nt, Human
acgcuggccaaguguugagagcugccugcgagccccgcaccaccccgcggagcacguacccagg

SEQ ID NO: 316309 - RNA, 64 nt, Human
uccuuuucuacaugaugcccugcugaccaugcagccgcaccagagagagauucuuccccaauug

SEQ ID NO: 316310 - RNA, 64 nt, Human
ccauggaggguggggaagaagaagaagaacuucuagguccuaaacuagaagaggaagaagaaga

SEQ ID NO: 316311 - RNA, 64 nt, Human
ccauucauucacccaacuuccuucauucagcaggagguccuauuacccucuccagcugccacug

SEQ ID NO: 316312 - RNA, 64 nt, Human
caaugggacaugcagggcgguguggcagguggagagguccuacaggggcugagugaccccacuc

SEQ ID NO: 316313 - RNA, 64 nt, Human
caguauuacuuagcuaucugaauuaugauagaaaagguccuaguuagguuccuauauaaagcau

SEQ ID NO: 316314 - RNA, 64 nt, Human
aaaggccaaaaccugagaagcggugggcuaagauagguccuacugcaaaccaccccuccauauu

SEQ ID NO: 316315 - RNA, 64 nt, Human
gaguacuggacaaggagucaaaaaacuugauuucagguccuagcucuagcacuuacagcugugu

SEQ ID NO: 316316 - RNA, 64 nt, Human
gcugugcccaguggugcuucaacugguaucuaugagguccuagagcuccaggacaaugauaaga

SEQ ID NO: 316317 - RNA, 64 nt, Human
ccauuuguggagagaacaggagggccagauagauagguccuagcagaaggcauugaggugaggg

SEQ ID NO: 316318 - RNA, 64 nt, Human
uccaucaaucagccaccaugucuuaccugccuuuagguccuauugcugaguuugacuucuaagg

SEQ ID NO: 316319 - RNA, 64 nt, Human
cuagcugugcucaccuucauggggcuguuuccagcucguccacaagcucaucgauuuucuuuag

SEQ ID NO: 316320 - RNA, 64 nt, Human
ugguucuuugggguuggcacagaaguccugucugagguccuauccaugccccuuacuggcucag

SEQ ID NO: 316321 - RNA, 64 nt, Human
uagcacauccagggcuaagcaagaaauaauucagagguccuacccucugucuagggaccccccu

SEQ ID NO: 316322 - RNA, 64 nt, Human
uacuaaggucuaugucugcaaacauuacuaaucuagguccuauuacuaaucuaugucugcaaac

SEQ ID NO: 316323 - RNA, 64 nt, Human
guaggcacuuagucauaggaaacauauuaugugcagguccuagccugggggaggaaaguagaua

SEQ ID NO: 316324 - RNA, 64 nt, Human
guguguuugacuucugcauuugaguaucagucucagguccuaguuuacuuucccugguuggaaa

SEQ ID NO: 316325 - RNA, 64 nt, Human
aucuagcaucuuuuuguugcacagggcucuauugagguccuaugucucugauuuuuuuuuuucc

SEQ ID NO: 316326 - RNA, 64 nt, Human
cacacugagucuuaucagccacguucuccuacugagguccuaagugugcucuuugggaagugcc

SEQ ID NO: 316327 - RNA, 64 nt, Human
gugccucuucaucuugacccaggcucuuauagauagguccuaaacauugcuguucacuagauua

SEQ ID NO: 316328 - RNA, 64 nt, Human
uuugugcuuccuggaaugaaaauucuguauaaccagguccuaacagugaucagacauauuacag

SEQ ID NO: 316329 - RNA, 64 nt, Human
auugaucucuuuuuaucgccauuccaggggccucagguccuacuggggaaacuuccuauaccgg

SEQ ID NO: 316330 - RNA, 64 nt, Human
caggagcagcucauaugauccccacagucgauccagguccuacaccuacgauagcuacuauagc

SEQ ID NO: 316331 - RNA, 64 nt, Human
ggauauuuugccacuguuaaaauggauucagaagagguccuagaaaaguaagauuagugacaug

SEQ ID NO: 316332 - RNA, 64 nt, Human
uggcaacuuucuucugauaucugaauguucaugaagguccuagcuuuauauugucccucuuuua

SEQ ID NO: 316333 - RNA, 64 nt, Human
guagaauggacaauuuccaagaaugaugccuuucagguccuagggccucuggccucuagguaac

SEQ ID NO: 316334 - RNA, 64 nt, Human
auuagguaauuagugucacuacauguaucauuaaagguccuaaaaggaauuguuaggcggcagg

SEQ ID NO: 316335 - RNA, 64 nt, Human
caugugaugcugcguguugagggcucaucugcuucucguccaggacgacauuuccagcuucauc

SEQ ID NO: 316336 - RNA, 64 nt, Human
ggugggaggagggcuacagcccacaucccacccccucguccaaucccauaauccaugaugaaag

SEQ ID NO: 316337 - RNA, 64 nt, Human
uccacauccacuucccccgcagcucgugugggcgcucguccacaaacacuccguggcugagagg

SEQ ID NO: 316338 - RNA, 64 nt, Human
ggccauggagucagccucagcccugucuguacugcucguccagcuaaacgagccuggaauaaac

SEQ ID NO: 316339 - RNA, 64 nt, Human
cuucaugcauguuucugagugcaugaaguugugaagguccuacauguaaugcauaugugaugca

SEQ ID NO: 316340 - RNA, 64 nt, Human
gcugacaacgcgagggcgaggggagaaagccaucagguccuagacguggaagaaaggagccuac

SEQ ID NO: 316341 - RNA, 64 nt, Human
uucucaacuggguccagaagagaauuaagcccuaagguccuaaggcaucuaucugugcuagguu

SEQ ID NO: 316342 - RNA, 64 nt, Human
uguggaccuaccaaccaggaacauguugcuucucagguccuaguauauccuccaaagaauauac

SEQ ID NO: 316343 - RNA, 64 nt, Human
aaaggggaggggucaacaaugagagaccaggaguagguccuaucagugccccccagaguagaga

SEQ ID NO: 316344 - RNA, 64 nt, Human
acccagaagacagccaugccuccgaaagagggccagguccuaagcugcugcuugugcgcgacug

SEQ ID NO: 316345 - RNA, 64 nt, Human
aggagauuccacacagggguggaguuucugacgaagguccuaagggaguguuugugucugacuc

SEQ ID NO: 316346 - RNA, 64 nt, Human
accauacaugggcuccagucaacuaugggacugaagguccuaauugcucacccaagggggcugc

SEQ ID NO: 316347 - RNA, 64 nt, Human
uucuuucuaugggguugcagggaugguguacaacagguccuagcauguauagcugcauagauuu

SEQ ID NO: 316348 - RNA, 64 nt, Human
ccuuaauguuauuuugucccagccaacacccucuagguccuaaaagucaagguacuucaguuua

SEQ ID NO: 316349 - RNA, 64 nt, Human
auuuucccuugauaaccauauaaauucugauuuaagguccuaaauucuuaaccuggaacuggag

SEQ ID NO: 316350 - RNA, 64 nt, Human
cccagaaggaaccucaaaagguagaugagguacaagguccuaagugaucucuuuuucugagcag

SEQ ID NO: 316351 - RNA, 64 nt, Human
accagcaggacuccugagaacugugcugguggagagguccuagagccggcgagcguuugagaag

SEQ ID NO: 316352 - RNA, 64 nt, Human
aucaccuugugccggugggggcugggcucccgugagguccuagggcagaaggaggugcuugcag

SEQ ID NO: 316353 - RNA, 64 nt, Human
ugaacucacuucaaagaucuaggccucaucuuacagguccuaaaucacucaucuggccuggaua

SEQ ID NO: 316354 - RNA, 64 nt, Human
accaguuaacguuuccuguacacccucacccucucucguccaucucuguugccucugcacauca

SEQ ID NO: 316355 - RNA, 64 nt, Human
ucaccuuccucuucucauccaccugagaaaaaagcucguccauguccgccauguacuuguccug

SEQ ID NO: 316356 - RNA, 64 nt, Human
gcuacucuguuccuucacguccucccuucucagccucguccaagcaccgggaagaccuccaggc

SEQ ID NO: 316357 - RNA, 64 nt, Human
cugagccccacacggccaucugcccaguccuugacucguccauggagcugagggucggaggaac

SEQ ID NO: 316358 - RNA, 56 nt, Human
cggaggucgggccugacugacagcgcagguccuaaaacugaaggcaacuugguuaa

SEQ ID NO: 316359 - RNA, 64 nt, Human
cugggaauugaccuuguaaucgauuugucugucaagguccuaaaguacuggagugaaauaaauu

SEQ ID NO: 316360 - RNA, 64 nt, Human
cuugucauuuuuuuuccuggaguucuucccauugagguccuaggauuugcacaccacuguccca

SEQ ID NO: 316361 - RNA, 64 nt, Human
uuugaggaaguguauuaaaccuguaugugaaaucagguccuaauacugacaagcaguuugucug

SEQ ID NO: 316362 - RNA, 64 nt, Human
gaaaacaaaugaguuacucucucggacaagcuguagguccuaccuaaauguccagcaggacauu

SEQ ID NO: 316363 - RNA, 64 nt, Human
agaguuucucuuccagaagccaagaggagaacaaagguccuaaugcuguacuauuccacccuuu

SEQ ID NO: 316364 - RNA, 64 nt, Human
uaggacaugucaaagaugacuguugucauucuggagguccuauuagagaauauuauaaaagggu

SEQ ID NO: 316365 - RNA, 64 nt, Human
guugcuguguuagcucuugcuggauuuugagccuagguccuacugucugccaguacucauguga

SEQ ID NO: 316366 - RNA, 64 nt, Human
aauacucucauuuccuuaaaauaauugugauucuagguccuaggaucuagaauuagaucuuugu

SEQ ID NO: 316367 - RNA, 64 nt, Human
ucgguguacuuaucuuuaaaaugggaguaauaguagguccuaaauucauagaguggauauuagg

SEQ ID NO: 316368 - RNA, 64 nt, Human
gggcugaacuguguaucccccaauucauuuguugagguccuaacucccauuucuuuugaaugug

SEQ ID NO: 316369 - RNA, 64 nt, Human
aaccguggaucaaacaaggucagucuaaaguggcagguccuaggugugaccugauaccaccacc

SEQ ID NO: 316370 - RNA, 64 nt, Human
gaaaccucgggaaacuuagaucaucagucaccgaagguccuacagggccacaacugcccccgcc

SEQ ID NO: 316371 - RNA, 64 nt, Human
auauauaauauugcagguuaaauuacuuuaugucagguccuaugaagaaagauacgguuucaga

SEQ ID NO: 316372 - RNA, 64 nt, Human
gcauuuugcugugugaggccgaucgccacuguaaagguccuagaguugccuguuugucucugga

SEQ ID NO: 316373 - RNA, 64 nt, Human
ggcucaggacaauccucuauuuccugaccuuuuccucguccacccugggcuuggggaccccccc

SEQ ID NO: 316374 - RNA, 63 nt, Human
ugccgcugacccacaucugagcaccggccugcgcucguccacccuuguuccccacccccaccc

SEQ ID NO: 316375 - RNA, 64 nt, Human; identical to SEQ ID NO: 76403

SEQ ID NO: 316376 - RNA, 64 nt, Human; identical to SEQ ID NO: 76409

SEQ ID NO: 316377 - RNA, 64 nt, Human
cuguaugaagugucuccccaacacuagcaaaucuagguccuacuaaauacaaaucucugggugg

SEQ ID NO: 316378 - RNA, 64 nt, Human
ggugagggucuugaugaggacagaaguuuagaguagguccuaagacuuuacaguguaacauccu

SEQ ID NO: 316379 - RNA, 64 nt, Human
uauucaacagggcacaugacauauacaugguggcagguccuagagaugagauccacauccuaaa

SEQ ID NO: 316380 - RNA, 64 nt, Human
uauagggagaaaucuugggccugagucaauggauagguccuaggagguggcugggguugagaau

SEQ ID NO: 316381 - RNA, 64 nt, Human
ugguucuucagaugcucuugggguucauaggggcagguccuagucgggcagggccccugacccu

SEQ ID NO: 316382 - RNA, 64 nt, Human
uuuccuccuuuccuucccuuuuccucuucaccugagguccuaaauacucucuguaauuacugug

SEQ ID NO: 316383 - RNA, 64 nt, Human
acuagaaucguguccuauuuaacuuuguguucccagguccuagcucaggaguuggcaaauaaga

SEQ ID NO: 316384 - RNA, 64 nt, Human
gagaaggggccuuacagaacccuaaagggagggaagguccuacaggucuccggccacccacaca

SEQ ID NO: 316385 - RNA, 64 nt, Human
ucagagggccaaagugaaucacaccaguuucugaagguccuaaaaauagcucagauguccuaau

SEQ ID NO: 316386 - RNA, 64 nt, Human
ggaauaaaagcuguaugcaugggcauuaccccucagguccuaagaaauaaguccugaaugcaug

SEQ ID NO: 316387 - RNA, 64 nt, Human
ucauauuuaaagaucuuuuagaagugagagaaaaagguccuacgaaaacggaauaauaaaaagc

SEQ ID NO: 316388 - RNA, 64 nt, Human
guuuuucuguaucuugcguuuuaaauucuuaauaagguccuaaacaaaauuucuuauauuucua

SEQ ID NO: 316389 - RNA, 64 nt, Human
cuguccuacucuguuuucaagaccaucacagaccagguccuaauggguguggaccccaggggag

SEQ ID NO: 316390 - RNA, 64 nt, Human
uccaauucacuauuugcccagaagcuuggggcagagguccuagcaggagaugaugaauucucgu

SEQ ID NO: 316391 - RNA, 64 nt, Human
auucacauuuaaauauuuucaguuauaagcagugagguccuaaaguguuacaagaguacagucu

SEQ ID NO: 316392 - RNA, 64 nt, Human; identical to SEQ ID NO: 76413

SEQ ID NO: 316393 - RNA, 64 nt, Human; identical to SEQ ID NO: 76419

SEQ ID NO: 316394 - RNA, 64 nt, Human; identical to SEQ ID NO: 76425

SEQ ID NO: 316395 - RNA, 64 nt, Human; identical to SEQ ID NO: 76431

SEQ ID NO: 316396 - RNA, 64 nt, Human
caugaacauuucccagacuuucaugaagcuguugagguccuaggcaauuaaugcagcaguugcg

SEQ ID NO: 316397 - RNA, 64 nt, Human
gccacugcagaggcgaaagccagugcuuugguaaagguccuagucuuucuggcuuuaacacaga

SEQ ID NO: 316398 - RNA, 58 nt, Human
ugggaccucuggcacugugacaagucucagguccuagagucagggcaaaaggugaggu

SEQ ID NO: 316399 - RNA, 64 nt, Human
uccacccaugacucacuacaaccuugugcugguaagguccuagcaucuuccccucaccuuccac

SEQ ID NO: 316400 - RNA, 64 nt, Human
ccaggggcugcuguugccuuuggaugccccacugagguccuagagugccuccaggguggucuuc

SEQ ID NO: 316401 - RNA, 64 nt, Human
ugaaacuuuccuaggaccuuaagagaauaguaggagguccuauagcauucccagugucacuaga

SEQ ID NO: 316402 - RNA, 64 nt, Human
aaaaagcaucuuuucuugagaucauggucauaugagguccuaaugaaguacuacaguuuucauu

SEQ ID NO: 316403 - RNA, 64 nt, Human
gagagaacugcugucacuuucaggcaaagcucaaagguccuaggcccacaguucuuuugagcuc

SEQ ID NO: 316404 - RNA, 64 nt, Human
ucggcccaugcuauuccuccugucccaaccugggagguccuagccugggagaucaaggcuacag

SEQ ID NO: 316405 - RNA, 64 nt, Human
acagccuacgcugggguaaggaaauggguauccaagguccuacuuuuuuaauagcucgaauauu

SEQ ID NO: 316406 - RNA, 64 nt, Human
ucggggcaaagcuccaucuccccuuccuuuaaccagguccuagggcugagguuuuaagccaggg

SEQ ID NO: 316407 - RNA, 64 nt, Human
cauuccugacaaaggagagcacacccagguuuggagguccuaggucauuagcccucgucucccg

SEQ ID NO: 316408 - RNA, 64 nt, Human
acuugggagcccccagggaggggcuaguguugguagguccuagacgugguucccuccagccucc

SEQ ID NO: 316409 - RNA, 64 nt, Human
ccuccccaagagaagccuuccuuauuuuggaguaagguccuaagauagcuggaugaaucaggaa

SEQ ID NO: 316410 - RNA, 64 nt, Human
uccagugaaacuuauacaccaaaauauucuuccuagguccuauuugcuaguaacaugagcacug

SEQ ID NO: 316411 - RNA, 64 nt, Human; identical to SEQ ID NO: 76436

SEQ ID NO: 316412 - RNA, 64 nt, Human; identical to SEQ ID NO: 76441

SEQ ID NO: 316413 - RNA, 64 nt, Human; identical to SEQ ID NO: 76447

SEQ ID NO: 316414 - RNA, 64 nt, Human; identical to SEQ ID NO: 76451

SEQ ID NO: 316415 - RNA, 64 nt, Human
gcucuaaagcugggcucaagcaagcccuggccagagguccuaaagaugcugacuggggagucug

SEQ ID NO: 316416 - RNA, 64 nt, Human
ucagccccaagggcaucuccagccucaggccggcagguccuauguccuugacacaaaugcuucu

SEQ ID NO: 316417 - RNA, 64 nt, Human
gacacucccuugccuuuccaccccucucagcuugagguccuaccugguguccuccaugagaauc

SEQ ID NO: 316418 - RNA, 64 nt, Human
ccuuaaaaugaagaaccuccuaacauucaauuuuagguccuacuacauuguuaguuuccauaau

SEQ ID NO: 316419 - RNA, 64 nt, Human
gucccugccgguccaccaggcggaggugggacaaagguccuaacaggagucacuggcucaggac

SEQ ID NO: 316420 - RNA, 64 nt, Human
ggguauccaaauaucuagauucugaucccuuuugagguccuagacccuuugagaaacugaugaa

SEQ ID NO: 316421 - RNA, 64 nt, Human
ugcucccuuugguccucuggggccucagagaggcagguccuaaaggagggggggucuccugggg

SEQ ID NO: 316422 - RNA, 64 nt, Human
cacgucggccaggaguagggugcaggccuccagcagguccuaauccugugugccagggcaggca

SEQ ID NO: 316423 - RNA, 64 nt, Human
gggagaggcuccucccucuccugggacagcucacagguccuagugauucucucaacccuaacac

SEQ ID NO: 316424 - RNA, 64 nt, Human
accccaacaccccugacuuggcccccacagagagagguccuacagcugucauaaauuaaauuua

SEQ ID NO: 316425 - RNA, 64 nt, Human
guaaaaguagcugagccauccugcccauuccuggagguccuacaggugaaacugcaggagcuca

SEQ ID NO: 316426 - RNA, 64 nt, Human
aagucaaccagaugccuagcuccugcugagacccagguccuauggcagcuccucauuagauuaa

SEQ ID NO: 316427 - RNA, 64 nt, Human
guuuuccuauuacugauguggcuguggaaugauaagguccuagaggggcccuggcauuucagga

SEQ ID NO: 316428 - RNA, 64 nt, Human
ccagaggccacgggcgcccuuguucccgccggccagguccuaucaaaggaggcugccggaacuc

SEQ ID NO: 316429 - RNA, 64 nt, Human
cuguuuagggaaagaaaaaacaucuucagaucauagguccuaaaaauacgggcaagcucuuaac

SEQ ID NO: 316430 - RNA, 64 nt, Human; identical to SEQ ID NO: 76457

SEQ ID NO: 316431 - RNA, 64 nt, Human; identical to SEQ ID NO: 76463

SEQ ID NO: 316432 - RNA, 51 nt, Human; identical to SEQ ID NO: 76466

SEQ ID NO: 316433 - RNA, 64 nt, Human; identical to SEQ ID NO: 76471

SEQ ID NO: 316434 - RNA, 64 nt, Human
ccaccgucugucccgaagaggcaggccguccuguagguccuagaggagccacagcccaggggca

SEQ ID NO: 316435 - RNA, 64 nt, Human
cuggauacagagaccaauuuaguuuggagauuacagguccuaucaugccucauucucugcauuc

SEQ ID NO: 316436 - RNA, 64 nt, Human
agugacuccaggacggaccugcgggggcacccagagguccuaagccccaggacugagggucgug

SEQ ID NO: 316437 - RNA, 64 nt, Human
ggggacccccccaccggacucuccacucuccggcagguccuaggggagccaccggaaggaagga

SEQ ID NO: 316438 - RNA, 64 nt, Human
agccugggguugauggggaccacgcggugccugcagguccuagaagugagcugggcaggggcuc

SEQ ID NO: 316439 - RNA, 64 nt, Human
guugucuacucuggagcuugacuuggaccuccccagguccuaggcaguagguugaaaaacacug

SEQ ID NO: 316440 - RNA, 64 nt, Human
uauagauccuuuuguugcugagagaguggaacauagguccuagacagggugaagaguucuggca

SEQ ID NO: 316441 - RNA, 64 nt, Human
ccacugucuucaaagcuucucucacccuagccaaagguccuaagaggagacagcugugaaguug

SEQ ID NO: 316442 - RNA, 64 nt, Human
ucuauagaauuauuuuaucaauauuuguguagugagguccuaaucaagaaacuugaacaggaua

SEQ ID NO: 316443 - RNA, 64 nt, Human
cauguuaguuuucaugaaauugcaacacagagauagguccuaaaaguggaauguauuuaaaacu

SEQ ID NO: 316444 - RNA, 64 nt, Human
ugauauauuaaaauggccaguuaggcucuuuuuguaguugaauugucuucuaaagagauuggau

SEQ ID NO: 316445 - RNA, 64 nt, Human
gguccuaaacuagaagaggaagaagaagaggaaguaguugaaaaugaugaggagauagccuuuu

SEQ ID NO: 316446 - RNA, 64 nt, Human
cgcaggcaagauguauuuugugacugcaguauucuaguugaagggaaggucuucaaagcacauc

SEQ ID NO: 316447 - RNA, 63 nt, Human
ccccuucaauuauuucccaucuccacaaauagucgggggaaaaaauuaaaauuuuccuuuaug

SEQ ID NO: 316448 - RNA, 63 nt, Human
gaggcuggggguagccauugugcagucauggcccgggggaaacuugccaaccuucgugucagg

SEQ ID NO: 316449 - RNA, 64 nt, Human; identical to SEQ ID NO: 76477

SEQ ID NO: 316450 - RNA, 64 nt, Human
caccuacuccagcucccaacuuuuguggacugagcggccgcagagacugggucgccuuggauuc

SEQ ID NO: 316451 - RNA, 64 nt, Human
caaaaugcaaaggagaaguucuauucaaaggcaguaguugaaaucuauuauuuuaguuagccua

SEQ ID NO: 316452 - RNA, 64 nt, Human
agaagcuagcugagguagcuugcagcaucuuuucuaguugaaauggugaacugauaggaaaaca

SEQ ID NO: 316453 - RNA, 64 nt, Human
ugcccagucuucuccccaaagucaagcaagagacuaguugaagggaguucuggggccaggcuca

SEQ ID NO: 316454 - RNA, 64 nt, Human
uucugcacuuuagaagaaaaacaguguuaaucuguaguugaaagaaagcuuaguagaugagaga

SEQ ID NO: 316455 - RNA, 64 nt, Human
gcgucaugaauaugaacagcauugucagaugaauuaguugaagugguuuuuuuuuuguuuuuuu

SEQ ID NO: 316456 - RNA, 64 nt, Human
aauccauuaaugauugcuuugcugacugagaauguaguugaaauuauucuuaaacaucuuuuau

SEQ ID NO: 316457 - RNA, 64 nt, Human
aaaugccaugcauuaggcuuuggaaauuuaauguuaguugaaauguaaaaugugaaaacuuuag

SEQ ID NO: 316458 - RNA, 64 nt, Human
accuguauaaaaccuaagguuuugguaaguaccuuaguugaauaaaagcacaagguuaucaccu

SEQ ID NO: 316459 - RNA, 64 nt, Human
ugcagagaaaaaucccuuagauugcaaaauaaaauaguugaacucucugucuucauguggaagg

SEQ ID NO: 316460 - RNA, 64 nt, Human
cuggaggaagccuccaaguagaggggagaccugguaguugaauaguuguuuaaucaagccaaau

SEQ ID NO: 316461 - RNA, 64 nt, Human
cagaccaauguuugaugggaaaacguggcacucauaguugaauguauacuucuguaccaaaacu

SEQ ID NO: 316462 - RNA, 64 nt, Human
gucccuuaaccccucugagcccgggucucuucauuaguugaaagggauaguaauaccuacuugc

SEQ ID NO: 316463 - RNA, 64 nt, Human
augauauuagaaaauguuuuccuuguuuaagugguaguugaacauagaacuuggguauuauaga

SEQ ID NO: 316464 - RNA, 64 nt, Human
caccauuuuauuucauguaguauggcuaauacuauaguugaaccaaggauaugcauugauucuu

SEQ ID NO: 316465 - RNA, 64 nt, Human
aauaacaugccaaaucacaaacuaguaagagacauaguugaagcuuaaauucaaguuuucuggc

SEQ ID NO: 316466 - RNA, 64 nt, Human
cuugcccgguguccugguccucuugcuuccgucgcggccgcaugugcguguguccaagcagguc

SEQ ID NO: 316467 - RNA, 64 nt, Human
cuggaaaagcagccugggcuucacuggcaggaagcggccgcagccgcgucaguguccagcacgu

SEQ ID NO: 316468 - RNA, 60 nt, Human
uuguauuguugccggcaugacaccgcgggacggccgcaggacgcaggcgagggccgcacg

SEQ ID NO: 316469 - RNA, 64 nt, Human
cgacaggaguccagauaaagguguaggggcugcacggccgcaagucuccuggaaaggcuggagu

SEQ ID NO: 316470 - RNA, 64 nt, Human
uauuugugugauuagaacuuagaaaaauauuuacuaguugaaguuauuaucaguuuuuaauuua

SEQ ID NO: 316471 - RNA, 64 nt, Human
auaguaggcacucaauaaaugcugaaugggugaauaguugaaugauaggugcucaauaaaugaa

SEQ ID NO: 316472 - RNA, 64 nt, Human
aaaugcauucccaccgaggccgcuuuuuuaggccuaguugaaagucaagaaggacagcagcaag

SEQ ID NO: 316473 - RNA, 64 nt, Human
ccagggcuucaauggaauaguauccccuuauguuuaguugaaauguccccuuaacuugauauaa

SEQ ID NO: 316474 - RNA, 64 nt, Human
uauaauuagcccaggcugauguaacuauaaaaauuaguugaaaaaaaaaauauuguuuccuuaa

SEQ ID NO: 316475 - RNA, 64 nt, Human
ugaugacacauaacaaaagaugcuuauguacuaauaguugaaaucugccuuuuucucauucaag

SEQ ID NO: 316476 - RNA, 64 nt, Human
gucucacuccaucauuuaaaaccaguauauucaguaguugaagaaagagcucucccugagucag

SEQ ID NO: 316477 - RNA, 64 nt, Human
gaaauucuguugccaccaguuauacuugacaauuuaguugaagcucagaaaguuauauucaucc

SEQ ID NO: 316478 - RNA, 64 nt, Human
uuuauuaauaugggaauuuaacuuacucaagcaauaguugaagggaaggugcauauuaucacgg

SEQ ID NO: 316479 - RNA, 64 nt, Human
gggaguaaggaauaaaagauauagaauaguaaucuaguugaacuguucugcacaaaacaugcuu

SEQ ID NO: 316480 - RNA, 64 nt, Human
gacagcuuaugggguauuuuaagcauucuuagacuaguugaacaucucacuuugccccaguuac

SEQ ID NO: 316481 - RNA, 64 nt, Human
gcuuaaauugucaaacugucauuacuucuuauuauaguugaaggcauucuccagauucuuuuua

SEQ ID NO: 316482 - RNA, 64 nt, Human
gauguguguaacuuaugucuugaguaucugggaguaguugaagaacagauaauuccuuccaaac

SEQ ID NO: 316483 - RNA, 64 nt, Human
ugacauuuugcuuauacuaaaaguuaucuaucuuuaguugaauauuuucuuuuggagagauugu

SEQ ID NO: 316484 - RNA, 64 nt, Human
uuacacaaaaacgaguaugauuuagcauucauacuaguugaaauuuuuaauagaaucaaggcac

SEQ ID NO: 316485 - RNA, 64 nt, Human
uacaucaccgccacuacugcagcucagugcccagcggccgcaugcacaccucccggccccuccu

SEQ ID NO: 316486 - RNA, 64 nt, Human
caugaucucugacuggaggaagcgaggaggcggccggccgcacugggagcagcgcggauuucuc

SEQ ID NO: 316487 - RNA, 64 nt, Human; identical to SEQ ID NO: 262672

SEQ ID NO: 316488 - RNA, 64 nt, Human
uagaggcacguagacuugguucaagucucguuaguaguugaauagccucaggcaagucacugcc

SEQ ID NO: 316489 - RNA, 64 nt, Human
gugaguuuuguaugaaaaucagccucauuauuuauaguugaauuuuugcacaaaauauauguua

SEQ ID NO: 316490 - RNA, 64 nt, Human
aaaucauaaagucaguugcucaaaaagaaaucaauaguugaauuagugaguauagugggguucc

SEQ ID NO: 316491 - RNA, 64 nt, Human
uuaaacuaugaaaccccugagagauuguaccuucuaguugaaauaaaguauuuauaauagauug

SEQ ID NO: 316492 - RNA, 64 nt, Human
ucaagguuuuuggcaaagcacaucaauguuagacuaguugaaguggaauuguauaauucaauuc

SEQ ID NO: 316493 - RNA, 64 nt, Human
auuuuaagagcuuuauuaucaguuuaacccucccuaguugaauguuauuuucuucuuguuccau

SEQ ID NO: 316494 - RNA, 64 nt, Human
ccauggaaggguuguaccccagcugccacuccucuaguugaaaguguuguguuuacaucugaca

SEQ ID NO: 316495 - RNA, 64 nt, Human
aauaaaaagacaguuuaaaaggcauggauuuugguaguugaaauauaagaguggagaagaaaag

SEQ ID NO: 316496 - RNA, 64 nt, Human
guggacauauuuguuugaagagauaggugaaagauaguugaaaagccuggggguauauucaagg

SEQ ID NO: 316497 - RNA, 64 nt, Human
agcaacguuauuugacgaggggcaugaacauuuauaguugaaacuguagaaagggucagguugg

SEQ ID NO: 316498 - RNA, 64 nt, Human
gauauaacaugcucaugauaaaaaagaauugaaauaguugaaaaggguguucagugaaaaguaa

SEQ ID NO: 316499 - RNA, 64 nt, Human
guuaaugcuuuguuagauagcuucauccagucaauaguugaaaaguuuucacauaauccaguau

SEQ ID NO: 316500 - RNA, 64 nt, Human
ggccuagguaacuuuaauugaaauaauauagauuuaguugaauacuauucaggaaguaauaaau

SEQ ID NO: 316501 - RNA, 64 nt, Human
auacuacuagcuuccagacaaucaugucaaaauuuaguugaacugguuuuucaguuuuuaaaag

SEQ ID NO: 316502 - RNA, 64 nt, Human
ggggccuggccuccuggguucuuugcugaaauuauaguugaauggcuuucucacauuggccaag

SEQ ID NO: 316503 - RNA, 63 nt, Human
gaaaugaugguuagaaucaggagacuugagaacuacgaggaacauggcagccucuagcucaua

SEQ ID NO: 316504 - RNA, 63 nt, Human
ccagauacacaauccucaggcugacauaaaguuuacgaggacugcuacuauaacugagagugc

SEQ ID NO: 316505 - RNA, 63 nt, Human
uugggcggcaggugcgguccccacggccggcucuacgaggaagaguucuggcucuuuugucca

SEQ ID NO: 316506 - RNA, 63 nt, Human
ggcggcgcuccacaucugcggacagaguuuccuuacgaggagacuuggucacugugaaggaga

SEQ ID NO: 316507 - RNA, 64 nt, Human
agcagaugguuuguuacuugaaucuccaaacacuuaguugaauuuuuacagauauuucagauca

SEQ ID NO: 316508 - RNA, 64 nt, Human
cugugaaaaaugugcagcuuuucaguuauaaaacuaguugaacacugguuuacaagauaauccg

SEQ ID NO: 316509 - RNA, 64 nt, Human
auguuuauuuagaaacugguucuguguugaaauauaguugaaaguaaaaaaauaauugagacug

SEQ ID NO: 316510 - RNA, 64 nt, Human
guccuaauugggaaaaaaaaaaaaaaaaaugaaauaguugaaaaacucugggguguaaacaaau

SEQ ID NO: 316511 - RNA, 64 nt, Human
aaagcugcucuggccucgucuucuagcuugugccuaguugaaagucucaccuuuacaggaucau

SEQ ID NO: 316512 - RNA, 64 nt, Human
uugaauauuuagaacuagaguuccuauuuucagcuaguugaaaacagagaaaaccuagugauuc

SEQ ID NO: 316513 - RNA, 64 nt, Human
gcaaacuuuaacagguuuucuucuaaucauaacauaguugaaaaaagaaguuugggcuaacauu

SEQ ID NO: 316514 - RNA, 64 nt, Human
cuuuaaacauaauuaaaagcuuaauguaaauuaguaguugaaauucuaggccggugcgguggcu

SEQ ID NO: 316515 - RNA, 64 nt, Human
ccuaacuuuuuuuuucugcuuuuaaacuguaacauaguugaagauuucuuuuuucuguucucau

SEQ ID NO: 316516 - RNA, 64 nt, Human
uuugagauucauacacuacauuuacaaaaugagauaguugaaaaagcacaucuagaauucagcu

SEQ ID NO: 316517 - RNA, 64 nt, Human
gacauaccuacgcccccguuuuauggguuuggcuuaguugaagaggaaaggguugugcaaggag

SEQ ID NO: 316518 - RNA, 64 nt, Human
auugccgccuucuucccuccucuuuuuuccccccuaguugaaucagcuugucuaacaagcccau

SEQ ID NO: 316519 - RNA, 64 nt, Human
gaucucuccugaacucccacgacgcuaucccuuuuaguugaacuaacauaggugaacguguuca

SEQ ID NO: 316520 - RNA, 64 nt, Human
cuucugccagaucaacucugucaucugugagcaauaguugaaacuuuauguacauagagaaaua

SEQ ID NO: 316521 - RNA, 64 nt, Human
ccuuguaaagugggcaugauuaccaugauuuuuauaguugaagaaccuaagacacagagaccaa

SEQ ID NO: 316522 - RNA, 63 nt, Human
agcagcccacugcaugggacaaucgcaggcagauacgaggaauguauccccugccuauuuucc

SEQ ID NO: 316523 - RNA, 63 nt, Human
acucggagcaaccagacuuacagcauaaguauguacgaggaauuucaaaucaucagauguuug

SEQ ID NO: 316524 - RNA, 64 nt, Human; identical to SEQ ID NO: 262676

SEQ ID NO: 316525 - RNA, 64 nt, Human; identical to SEQ ID NO: 262681

SEQ ID NO: 316526 - RNA, 64 nt, Human
auauaacauaaaaagccaguuggguucuaaauuguaguugaaacacagaaaaugccacuuuucu

SEQ ID NO: 316527 - RNA, 64 nt, Human
uguuuuuauuuuaaaaggcacaaacucuagauauuaguugaauguugaggcuuuaacuuuuucg

SEQ ID NO: 316528 - RNA, 64 nt, Human
acauguauuuuuguaucuuuucuguguguaaacauaguugaaauucaaaaaguuguagcaauuu

SEQ ID NO: 316529 - RNA, 64 nt, Human
cuuacugcccaggugacuugugcauugcuuuauuuaguugaaauaaaaucagcauugaauucag

SEQ ID NO: 316530 - RNA, 64 nt, Human
auuauuuuauaagugccuggcaauagguauucacuaguugaauaguuuaauuugaaaugaauua

SEQ ID NO: 316531 - RNA, 64 nt, Human
ccaugggggcagcuccaucccagagcauuucugauaguugaacuguaauuucuacucuuaagug

SEQ ID NO: 316532 - RNA, 64 nt, Human
augucuuaaugaauguuguugaaagcaauguaaauaguugaaaauauaaauuuauauuacaguu

SEQ ID NO: 316533 - RNA, 64 nt, Human
ucuuuuugcaaguaugaaucacuuaaccugcugauaguugaagaacacuuuaggaguuuuguau

SEQ ID NO: 316534 - RNA, 64 nt, Human
uauuguuauuuucucuacuuucuacuagccccaauaguugaacucuuauaggaaaaucgaaaga

SEQ ID NO: 316535 - RNA, 64 nt, Human
accuggaguuuucuuuguuuuuuuuucuuuuuuuuaguugaaguuuaugagggaaauaccagug

SEQ ID NO: 316536 - RNA, 64 nt, Human
uuuagaauuguuugagaauucugauccaaaacuuuaguugaauucaucuacguuuguuuaauau

SEQ ID NO: 316537 - RNA, 64 nt, Human
acaacugugcuuuugcuauguaugguauccaaguuaguugaaacgcagacacugagaucuguuu

SEQ ID NO: 316538 - RNA, 64 nt, Human
agccaacuuuaauugcuuaaaagacauuuuuauuuaguugaaaaaucuaguuuuuuuuguaaac

SEQ ID NO: 316539 - RNA, 64 nt, Human
gucugaagucagguacucucucucucaacaccuguaguugaauaugauuuggucaguugcucgu

SEQ ID NO: 316540 - RNA, 64 nt, Human
ucugggacuugguuuccccaacuaaaauuugaaguaguugaauggggucucaaaguuugacagg

SEQ ID NO: 316541 - RNA, 64 nt, Human; identical to SEQ ID NO: 262689

SEQ ID NO: 316542 - RNA, 64 nt, Human; identical to SEQ ID NO: 262692

SEQ ID NO: 316543 - RNA, 64 nt, Human; identical to SEQ ID NO: 262697

SEQ ID NO: 316544 - RNA, 64 nt, Human; identical to SEQ ID NO: 262706

SEQ ID NO: 316545 - RNA, 64 nt, Human
uacuuuuauacuaauuguuuccaggguuuuagaguaguugaauguuuauuucacaaggcacccu

SEQ ID NO: 316546 - RNA, 64 nt, Human
ucagugcuggaaaaaauacugagauagacauguuuaguugaaguuauuucauuucagguuauau

SEQ ID NO: 316547 - RNA, 64 nt, Human
uuuuuaauuaaugucacaaagcucuagugcaaucuaguugaaugcagaugccugugcccaaaua

SEQ ID NO: 316548 - RNA, 64 nt, Human
ccuaccuuggcuaccagacauauugggguuuuuguaguugaaugaaugaggaggaugaauuuca

SEQ ID NO: 316549 - RNA, 64 nt, Human
aaauguaaaaggucuuuuuaaaaaucaugaaaaauaguugaauauacauuuuguuucucucaua

SEQ ID NO: 316550 - RNA, 64 nt, Human
ugaaauaggaaugacuauuacugccauauuuauuuaguugaagaaugucuuuguguuaauucau

SEQ ID NO: 316551 - RNA, 64 nt, Human
augauuuugccaagaaugauuauaucaaaaauaguaguugaaaugguaacaucaaaauuauuuu

SEQ ID NO: 316552 - RNA, 64 nt, Human
auacauuaggaugaaguuaaaucuuaaaucuuauuaguugaauuguuguaaggacagugauguc

SEQ ID NO: 316553 - RNA, 64 nt, Human
uaaaacuuuaauuuucuaaacauaguauucaacuuaguugaauaaauauaugauagaaguuaaa

SEQ ID NO: 316554 - RNA, 64 nt, Human
aagcugaauguugagacagugcauccauuuucuuuaguugaauauguuuguauuaauuguaaag

SEQ ID NO: 316555 - RNA, 64 nt, Human
aggauuaaucugguguguuuacauaggauauacauaguugaaaucuagcaugaaagguuaaaaa

SEQ ID NO: 316556 - RNA, 64 nt, Human
aaugcaaauugaugaacguacuauugugauacauuaguugaauggaugaaacuuuuuuaaaguu

SEQ ID NO: 316557 - RNA, 64 nt, Human
gggauuaccauuguuccuggaguacuccuacccuuaguugaauuuccuuauuaaaguuauauuu

SEQ ID NO: 316558 - RNA, 64 nt, Human
uuuuuuuccauagcugggauauaggcugcagcuauaguugaacaagcagucuuuaaaaacugcu

SEQ ID NO: 316559 - RNA, 64 nt, Human
aaauauaacauuacagcuuauuuaaaaccaaauauaguugaacauauuuaaaauacauuuucac

SEQ ID NO: 316560 - RNA, 64 nt, Human; identical to SEQ ID NO: 262710

SEQ ID NO: 316561 - RNA, 64 nt, Human; identical to SEQ ID NO: 262716

SEQ ID NO: 316562 - RNA, 64 nt, Human; identical to SEQ ID NO: 262725

SEQ ID NO: 316563 - RNA, 64 nt, Human; identical to SEQ ID NO: 262729

SEQ ID NO: 316564 - RNA, 64 nt, Human
gguuacugaaucauaagaaaaugccaucucuuuuuaguugaaggaaaacucuggaaguaggugc

SEQ ID NO: 316565 - RNA, 64 nt, Human
ugguacaacaguugagagcagcaccaagugcauuuaguugaaugaagucuucuuggauuucacc

SEQ ID NO: 316566 - RNA, 64 nt, Human
guucacuguggugaugcaugaugaggguaaaugguaguugaaaggagcaggggcccugguguug

SEQ ID NO: 316567 - RNA, 62 nt, Human
ucaaccugaguuuuaaaauaccuuuaauaaauauuaguugaaaaaaugucuacuugaaagca

SEQ ID NO: 316568 - RNA, 64 nt, Human
cauugaacuagggcaagucuuaaauguguacauguaguugaauuucaguccuuacggguaaaca

SEQ ID NO: 316569 - RNA, 64 nt, Human
guguguacagggcaaaaugccaaaaagcacugucuaguugaaaguucccuucuccacccagggg

SEQ ID NO: 316570 - RNA, 64 nt, Human
ugagcucucucagggccuuccccuuucaacaauuuaguugaaugacucccuuccaucuaucagu

SEQ ID NO: 316571 - RNA, 64 nt, Human
uguagcaaagcuaauggaaauaaagcuaaugcucuaguugaaagaaaaggaaaacuccugaaau

SEQ ID NO: 316572 - RNA, 64 nt, Human
ggcauaauaccaagcugggguggcaccacccggcuaguugaaauaaucggaaguagacaagcuc

SEQ ID NO: 316573 - RNA, 64 nt, Human
gagugugaccaaaaguuacauguuugcaccuuucuaguugaaaauaaaguguauauuuuuucua

SEQ ID NO: 316574 - RNA, 64 nt, Human
uuuguagccuugacauucacccaccucccuuauguaguugaaauaucuagcuaacuuggucuuu

SEQ ID NO: 316575 - RNA, 64 nt, Human
agagaaucuggcaugccaaaaacuaacagaaacuuaguugaaggcaaagagagcaaggagaacg

SEQ ID NO: 316576 - RNA, 64 nt, Human
acagaauaaaaucauaguugaggacagcagguuuuaguugaauugaaaauuugacugcucugcc

SEQ ID NO: 316577 - RNA, 64 nt, Human
ccacucuuuaccuuuauugauaucuccaugaugauaguugaauguugcaaugugaaaaaucugc

SEQ ID NO: 316578 - RNA, 64 nt, Human
aggcacucuuggacucucggcaaccacaacauaauaguugaaagaucaagauuggcuccacgaa

SEQ ID NO: 316579 - RNA, 63 nt, Human
acgauggucagccuucagcugggaaucuucaacuacgaggagguccuggacuauagcccagug

SEQ ID NO: 316580 - RNA, 63 nt, Human
ggggccugguggcgagcccaagugguugccuccuacgaggagaccaacgaaguggagauucga

SEQ ID NO: 316581 - RNA, 63 nt, Human
agggagggucagggaagaaacccacucuugcucuacgaggagcaagugccugcccccucccag

SEQ ID NO: 316582 - RNA, 63 nt, Human
augcccggccaauacuacacucuuauucugccuuacgaggauuucuggaagcuucuguaacug

SEQ ID NO: 316583 - RNA, 64 nt, Human
cuucaagaacaccuuuacucuauaacucaaaaauuaguugaaaaauaauuacuucucaaggauu

SEQ ID NO: 316584 - RNA, 64 nt, Human
cauuaggccuugccauugcuuuaauguagacucauaguugaaauuagugcagaaagaacucaga

SEQ ID NO: 316585 - RNA, 64 nt, Human
aaacauuucuguauuuuuuuuaaguaaauaagaguaguugaacugagcaauaccuccuccugug

SEQ ID NO: 316586 - RNA, 64 nt, Human
aauuggaaaguaaaaaaaaguguguaaauauauuuaguugaaucaaauaauaaagaugaaucau

SEQ ID NO: 316587 - RNA, 64 nt, Human
ucagguuugucugggguggaauggaacagucagguaguugaaaguuuuuuuuuagagaugaaaa

SEQ ID NO: 316588 - RNA, 64 nt, Human
aauguguuauuucacauuacaauaauauguguaguaguugaauuguguuaucaaagcaugucca

SEQ ID NO: 316589 - RNA, 64 nt, Human
uucauuuuacacgcccugaagcagucuucuuugcuaguugaauuaugugguguguuuuuccgua

SEQ ID NO: 316590 - RNA, 64 nt, Human
cuauauaacaugaaaagugagcucaaauuuuuuuuaguugaagauuacauauaaaguugugucu

SEQ ID NO: 316591 - RNA, 64 nt, Human
acuuuucauuuagccccaggugacuuacuaaaaauaguugaaaauuauucaccuaagaauagaa

SEQ ID NO: 316592 - RNA, 64 nt, Human
cuagcagaagaacccacuuccugcuuaguugagauaguugaaucuagcauucguuccuauaaaa

SEQ ID NO: 316593 - RNA, 64 nt, Human
cauugugguuuggaaaggagaauucaacaauuaauaguugaaauugugagguuaauguuuaaaa

SEQ ID NO: 316594 - RNA, 64 nt, Human
auauuaguuuuagauuuucacguauuaggcacuuuaguugaaucuuccagcaaaagcugucuac

SEQ ID NO: 316595 - RNA, 64 nt, Human
agucucuuucuuaaagucacaaugacuaaaguauuaguugaauuuuuuuuuuuuuuuuuuugau

SEQ ID NO: 316596 - RNA, 64 nt, Human
uugauucaguauuugaauuucuucuucauaaauguaguugaauuuauccuaguauuuuucuuua

SEQ ID NO: 316597 - RNA, 64 nt, Human
cuugaacuugucaguuuguuuuaaauaaauacaauaguugaaaauuuuucucuguuacaucagu

SEQ ID NO: 316598 - RNA, 63 nt, Human
ugggucugcgauuaugcacagagacuuuggacauacgaggacccucagaccggaggaacaccu

SEQ ID NO: 316599 - RNA, 63 nt, Human
cguuuugcuuuuaaguaucccuauuucuuaaguuacgaggaugaauaccuuucacauuuugau

SEQ ID NO: 316600 - RNA, 64 nt, Human
cuauauaucaccuauacuauauauaucauauauauaguugaauggcaguauucaggcucaacgu

SEQ ID NO: 316601 - RNA, 64 nt, Human
auuacaggugugagccaccacuccuggccaacuguaguugaacucagguauuggaagggcuucc

SEQ ID NO: 316602 - RNA, 64 nt, Human
gguuaugugauucuaccaaaugacuacuuugaaauaguugaaguaccagcauaaaaaaaugaaa

SEQ ID NO: 316603 - RNA, 64 nt, Human
acugguaccaacucaccucuauuuugucaguucauaguugaagauuuuguuuuauuucaaaaac

SEQ ID NO: 316604 - RNA, 64 nt, Human
aguuucuaugaaacagauugcuuaccuaaaucuuuaguugaaugauuaguguucaauauugcuu

SEQ ID NO: 316605 - RNA, 64 nt, Human
cagcaacauaauacucacuuuagguauuacuacauaguugaaggauuuaacugaauguauggau

SEQ ID NO: 316606 - RNA, 64 nt, Human
auugggcgggaaaaacaccagcuuugacccgaaguaguugaagagcuacuucauucuuuucuga

SEQ ID NO: 316607 - RNA, 64 nt, Human
guccccaacacaccugaugucacuuugagccauauaguugaaguacaaauuaauaggccuuaug

SEQ ID NO: 316608 - RNA, 64 nt, Human
ggaaacuuguucacuuuucauuuucaaaggagccuaguugaagugcuauuaugagugugggcua

SEQ ID NO: 316609 - RNA, 64 nt, Human
uuuaaaaaauaacauauucuugcuuucacaaauauaguugaacaagauuucccuaaaaauucca

SEQ ID NO: 316610 - RNA, 55 nt, Human
aagaaugggcaaagaaguaaucauguaguugaagucuguggaugcagcuguuaug

SEQ ID NO: 316611 - RNA, 64 nt, Human
uugcuagaacaagacccuguaguaauaguaauaauaguugaaguuuggccaacucuuaauaaag

SEQ ID NO: 316612 - RNA, 64 nt, Human
gacaggcuguucuaacaugugucuaccugagggcuaguugaaggauccaggaguauuuucuucu

SEQ ID NO: 316613 - RNA, 64 nt, Human
ugccuugaaaaagacauucaggacugcugguuuguaguugaauauuggccaaggaaaggcacau

SEQ ID NO: 316614 - RNA, 64 nt, Human
auuuaaacauuugguucuggauacauguugaacuuaguugaauauaaaaaucuagauuaaaagu

SEQ ID NO: 316615 - RNA, 64 nt, Human
uuaugcacuaagguuuuagguugacuagugguuguaguugaaaauuuuauaaaauaccguuaau

SEQ ID NO: 316616 - RNA, 64 nt, Human; identical to SEQ ID NO: 262735

SEQ ID NO: 316617 - RNA, 64 nt, Human; identical to SEQ ID NO: 262745

SEQ ID NO: 316618 - RNA, 64 nt, Human
ugagcucaccaggcaaagcuaaggaaggauauacuaguugaaaagaauaacccacuccucuucu

SEQ ID NO: 316619 - RNA, 64 nt, Human
ugucuuuuuucuaguggcuacuguuuuaguuuucuaguugaauaucucugacaagcuuucguau

SEQ ID NO: 316620 - RNA, 64 nt, Human
auuacauuuuuugaguuagaugggacucucuggauaguugaaccucuucacuuuauaaaaaagg

SEQ ID NO: 316621 - RNA, 64 nt, Human
auuacuuaaauaauuugggugagcugcaccugauuaguugaaaggccucaagaacaaacacugc

SEQ ID NO: 316622 - RNA, 64 nt, Human
caccccacaauuucuuuaaaaaagaaauuaucuuuaguugaauuccaaguguauuuuaaaauag

SEQ ID NO: 316623 - RNA, 64 nt, Human
gagcucaaggaucugcuucaaaugcacacaggccuaguugaaguuuaaaccccagcaaaacauu

SEQ ID NO: 316624 - RNA, 64 nt, Human; identical to SEQ ID NO: 316614

SEQ ID NO: 316625 - RNA, 64 nt, Human
caucuacugaaaacauuaugugguuuaacguuuauaguugaauugggccaaaauguuucgaauu

SEQ ID NO: 316626 - RNA, 64 nt, Human
aagugugugcucuguucgcccaggucuccaugguuaguugaagccaauuucuggcuugacuuuu

SEQ ID NO: 316627 - RNA, 64 nt, Human
gugugguuuggugcaagucagaauaaauucuggcuaguugaauccacaacuucauuuauauaca

SEQ ID NO: 316628 - RNA, 64 nt, Human
ggauuaagaagcauuaccaauaggaauggaucgauaguugaauaaugauuuuuuauacauagau

SEQ ID NO: 316629 - RNA, 64 nt, Human
ugauucuucuguccucauugugaacauaaccguguaguugaaacagucaaacuuauuuuuguaa

SEQ ID NO: 316630 - RNA, 64 nt, Human
cauuuuaaagaaaugauguugguuuaccuuuuccuaguugaagauaguaauuagguuucuaagc

SEQ ID NO: 316631 - RNA, 64 nt, Human
aaagcaaaguacagugaagaaugaauuuaugguauaguugaacccaguggcagauuguacacug

SEQ ID NO: 316632 - RNA, 64 nt, Human
guuucuauagcaaccacauuugacuaauuuccguuaguugaauaagagguauuaugaucaugga

SEQ ID NO: 316633 - RNA, 64 nt, Human; identical to SEQ ID NO: 262748

SEQ ID NO: 316634 - RNA, 64 nt, Human; identical to SEQ ID NO: 262751

SEQ ID NO: 316635 - RNA, 64 nt, Human; identical to SEQ ID NO: 262754

SEQ ID NO: 316636 - RNA, 64 nt, Human; identical to SEQ ID NO: 262755

SEQ ID NO: 316637 - RNA, 64 nt, Human
uuaccugacguaacuucucaaugccuaaauucuguaguugaagcucugcugcagagaguuggga

SEQ ID NO: 316638 - RNA, 64 nt, Human
cuuucuuuguacuuuaauguucucucuguucuaauaguugaaguaugagauguaacuauuauaa

SEQ ID NO: 316639 - RNA, 64 nt, Human
uuaaacauugugauaaaauuaauuuucaguagaauaguugaauguguuaagauaggauuuuaug

SEQ ID NO: 316640 - RNA, 64 nt, Human
uucugcaucuuggggggcuguacauuuauuuauuuaguugaagauucacugaucccacuuugaa

SEQ ID NO: 316641 - RNA, 64 nt, Human
aaaugguagaagaugaguuuucaaugaguagucauaguugaaauuuuacaaccaaagcucccau

SEQ ID NO: 316642 - RNA, 64 nt, Human
caagccugcuucugggccaggccauugucacuguuaguugaagaaaaagcaguucccaggugcc

SEQ ID NO: 316643 - RNA, 64 nt, Human
aagaugccuuaauccauuccuugaggacagaccuuaguugaaaugauagcagaaugugcuucuc

SEQ ID NO: 316644 - RNA, 64 nt, Human
uuuagaucaacauugaucaaccauuaagacaagauaguugaagacauguauguggacugucaac

SEQ ID NO: 316645 - RNA, 64 nt, Human
ggcacuguaaguuaaaacccaaugggaaaagccuuaguugaacuuuuaaaauacuugauuuaaa

SEQ ID NO: 316646 - RNA, 64 nt, Human
cacugggagcacugcugggcuccuggacugagaauaguugaacaccgggggcuuugugaaggag

SEQ ID NO: 316647 - RNA, 64 nt, Human
agauauuugauucuucauuuuuuguuuuuuucauuaguugaaguggguuuuaguuuuguuuaaa

SEQ ID NO: 316648 - RNA, 64 nt, Human
cgggccugaugauuuuaaagcaaaaaucacccucuaguugaaagagcuuacagcucgagucacc

SEQ ID NO: 316649 - RNA, 64 nt, Human
uaauguuguagagcauuuuguagagugguuuaaauaguugaaaauaaaguucagaacaucaugu

SEQ ID NO: 316650 - RNA, 64 nt, Human
uaggaaccaaagaaugccucuacaagcaaaaagauaguugaaaauaguuaagauccaaagucag

SEQ ID NO: 316651 - RNA, 64 nt, Human
uggaaaagugaucagauuaauaaauguauauugguaguugaauuuagcaaagaaauagagauaa

SEQ ID NO: 316652 - RNA, 64 nt, Human; identical to SEQ ID NO: 262759

SEQ ID NO: 316653 - RNA, 64 nt, Human; identical to SEQ ID NO: 262760

SEQ ID NO: 316654 - RNA, 64 nt, Human; identical to SEQ ID NO: 262761

SEQ ID NO: 316655 - RNA, 64 nt, Human; identical to SEQ ID NO: 262762

SEQ ID NO: 316656 - RNA, 64 nt, Human
uuaaaacaaaaugaccaucucacaaaaacgaguuuaguugaaugcucaauuccuuacaaaaucu

SEQ ID NO: 316657 - RNA, 64 nt, Human
uauaaauucugugacaugcucuugagcuuuacccuaguugaacauacauguguagauuuacaca

SEQ ID NO: 316658 - RNA, 64 nt, Human
acuggaaucccagaccgagucugcuuucugugccuaguugaacggcaagcucggcaucuguugg

SEQ ID NO: 316659 - RNA, 64 nt, Human
ccuuggacaaccaccuaauccuauauucauugaauaguugaacuguauccacccggcguaauac

SEQ ID NO: 316660 - RNA, 64 nt, Human
aaggcaaaguguugaagauacuacggugugguaguaguugaaaauuauugccgucauuauuuac

SEQ ID NO: 316661 - RNA, 64 nt, Human
cauuucaguaauguacugaaaucuuauaagugaauaguugaagcuaguaaaaaugauaccagua

SEQ ID NO: 316662 - RNA, 64 nt, Human
cuacagucccugcaauugggucucuggcaggcaauaguugaaggacuccuguuccguuggggcc

SEQ ID NO: 316663 - RNA, 64 nt, Human
gauaagaaaaauaggucagauaaguaugggaugauaguugaagggaggugaagaggcugcuucu

SEQ ID NO: 316664 - RNA, 64 nt, Human
uggaauaaguuugaccaggucaaguuuuaggauauaguugaauuucuuuaaaaaguuuucuauu

SEQ ID NO: 316665 - RNA, 64 nt, Human
gguggagaagccauugucuucggaaaccuugguguaguugaacugauaguuacuguugugaccu

SEQ ID NO: 316666 - RNA, 64 nt, Human
aaacauuuuuauuugcugcuuuuucccuuugauauaguugaaagaauguauuguaaauuggcau

SEQ ID NO: 316667 - RNA, 64 nt, Human
gcauaaugcaaucaaaaauauguguuuuuaagauuaguugaauauaagaaaaugcuugacaaau

SEQ ID NO: 316668 - RNA, 64 nt, Human
uuuaaacugaucuaugcuguguuugcuuauucuuuaguugaacacacuaugaagaauuccaggu

SEQ ID NO: 316669 - RNA, 64 nt, Human
ugguuacauuuuugcagcccuuuguauuuugugguaguugaaauuguaucacuucuaaacagca

SEQ ID NO: 316670 - RNA, 64 nt, Human
cauuugugauuuuuuuuuuuuuuuuuuggugggguaguugaauaaaauugggcagcuaaauuuu

SEQ ID NO: 316671 - RNA, 64 nt, Human; identical to SEQ ID NO: 121802

SEQ ID NO: 316672 - RNA, 64 nt, Human; identical to SEQ ID NO: 121803

SEQ ID NO: 316673 - RNA, 64 nt, Human; identical to SEQ ID NO: 121804

SEQ ID NO: 316674 - RNA, 64 nt, Human
acagacuuuagaauaaaauaguuaagcauuaauguaguugaacuuuuuaaauuuuugaauugga

SEQ ID NO: 316675 - RNA, 64 nt, Human
aacuagcuauuuuugaccuccugaucaggaacuuuaguugaagcguaaaucuaaagaaacauuu

SEQ ID NO: 316676 - RNA, 64 nt, Human
ugggauuaugggucacaggaaaaaguggguuuuuuaguugaauuuuuuuuaacauuccucauga

SEQ ID NO: 316677 - RNA, 64 nt, Human
aagcuaaguggcaagcgggaagcugaaacucguauaguugaacauucuuggaggcuuaucucuu

SEQ ID NO: 316678 - RNA, 64 nt, Human
agaggugcacugccaauaaguaucucuaauucaauaguugaaagcaaccugcaugcuaaucgug

SEQ ID NO: 316679 - RNA, 64 nt, Human
ugcugaauguugcauuaauugugcuguuugcuuguaguugaauaaaaauagaaaccugaaugaa

SEQ ID NO: 316680 - RNA, 64 nt, Human
caggauuuggggagagaagccaauuuugcauggcuaguugaaaaugguauuagauacuuauuuc

SEQ ID NO: 316681 - RNA, 64 nt, Human
cgucgcuuccugggauuccagcacgaugccuccauaguugaaagacuacacaaaaagccacaau

SEQ ID NO: 316682 - RNA, 64 nt, Human
uuuccagcuaguccuagaguucuauauuucuacauaguugaauuauuuuaucaugcuguugcug

SEQ ID NO: 316683 - RNA, 64 nt, Human
gcuuugaagaaacagaagaaauuaaucuuuuaguuaguugaacauaccaaagcagaggacugga

SEQ ID NO: 316684 - RNA, 64 nt, Human
uuuuugucuuucccaaaucuugguagucuccuuauaguugaagauaaaauguugagugcacuua

SEQ ID NO: 316685 - RNA, 64 nt, Human
ugggggauccaccaggucaucuaggcucuggcccuaguugaaggggcaccccuuccucugugcc

SEQ ID NO: 316686 - RNA, 64 nt, Human
uuucaacuucauguguuauuaacuauacaaauauuaguugaaugaauuguugaauuacaugauu

SEQ ID NO: 316687 - RNA, 64 nt, Human
uacacaucuucugguuuacuauauacaaaaacuguaguugaaaaaagaugacaauuuaaaaguc

SEQ ID NO: 316688 - RNA, 64 nt, Human
ggcgccuggcauauggcauuucagaauauguucauaguugaaacaguaggauagauauuuguca

SEQ ID NO: 316689 - RNA, 64 nt, Human; identical to SEQ ID NO: 121806

SEQ ID NO: 316690 - RNA, 64 nt, Human; identical to SEQ ID NO: 121807

SEQ ID NO: 316691 - RNA, 64 nt, Human
uguucagugccaccguggcuguuacuuuucaaaguaguugaaguauugaaaaugaguaauguug

SEQ ID NO: 316692 - RNA, 64 nt, Human
agauuugcaguaccuacugaaauuuguguuuuuauaguugaaguuaggaaaaugcuauuugauu

SEQ ID NO: 316693 - RNA, 64 nt, Human
ugagucugaguguaauagcccagagauuuauauauaguugaaugucuaaaaugguaaaaugugc

SEQ ID NO: 316694 - RNA, 64 nt, Human
guuucaaauaaaugacuuuuuaauuguaaaagauuaguugaaaaacuguaugaaugugaagauc

SEQ ID NO: 316695 - RNA, 64 nt, Human
cucuucuuuucuugguauuucugguggcagugauuaguugaacagcacauuuaaggcacgauaa

SEQ ID NO: 316696 - RNA, 64 nt, Human
cuaauaacaauuuuaggguuuaacaguaggcuaauaguugaaggaaggauaauaacuacccuug

SEQ ID NO: 316697 - RNA, 64 nt, Human
aaagggacuaaauuuguaaaaaauuaguuuguuauaguugaagauuaacuuuuccuaacauugu

SEQ ID NO: 316698 - RNA, 64 nt, Human
uuggauuuuauagugcuaaaagggcuuuauucuauaguugaaucaccucugaauaaagauauaa

SEQ ID NO: 316699 - RNA, 64 nt, Human
cugcccuggcauggacuggcacagagguguucuguaguugaauaggaagagccugucuaaaaaa

SEQ ID NO: 316700 - RNA, 64 nt, Human
uuacaagcugcugguggauuuuaaaaaauuaagauaguugaaggugguuagguaaaaugccugc

SEQ ID NO: 316701 - RNA, 64 nt, Human
uacccuugaaauaauccaaggacguccaugcaaauaguugaaauuaguaccugcaauauauuug

SEQ ID NO: 316702 - RNA, 64 nt, Human
uaauauaugaauguuucugagaagaaacucuaaauaguugaaaggcuaaccugcucaaaggaua

SEQ ID NO: 316703 - RNA, 64 nt, Human
auaaauauauacauauauuuauauauaaagugauuaguugaacuggcauccugcuuuagccuga

SEQ ID NO: 316704 - RNA, 64 nt, Human
uuuuuuaacaagauuuucuaaucgacuugcagaguaguugaaguggguaagcagcaggguaccu

SEQ ID NO: 316705 - RNA, 64 nt, Human
ucacagauuuuaaaaaauuguuugcacuuaaaaauaguugaaugcugguggaaaguuacuuugc

SEQ ID NO: 316706 - RNA, 64 nt, Human; identical to SEQ ID NO: 121808

SEQ ID NO: 316707 - RNA, 64 nt, Human; identical to SEQ ID NO: 121809

SEQ ID NO: 316708 - RNA, 64 nt, Human; identical to SEQ ID NO: 121810

SEQ ID NO: 316709 - RNA, 64 nt, Human; identical to SEQ ID NO: 121815

SEQ ID NO: 316710 - RNA, 64 nt, Human
uucaggcuccuccaucuucagagccagcuguggguaguugaaucuuuuucccgucaccucauug

SEQ ID NO: 316711 - RNA, 64 nt, Human
aaguuuuauuugcauuacaaauaggauacaaaaauaguugaaucaggauacagaaaucugcugu

SEQ ID NO: 316712 - RNA, 64 nt, Human
uaguuguaagggaucauacagaagauauugaugauaguugaaauauucuuagaaggggugugua

SEQ ID NO: 316713 - RNA, 64 nt, Human
ucuggaaagggaugguuuaaauauuaccaugauguaguugaaauauaaaauaggauuuggaacc

SEQ ID NO: 316714 - RNA, 64 nt, Human
aacauuguuauaaacuaauauaugugagagugcuuaguugaaacaaaaaggaguuuuaguagac

SEQ ID NO: 316715 - RNA, 64 nt, Human
ugcuugcuguuuuaacuugacagaugaaggacuuuaguugaacuucauauuguaagaacuguua

SEQ ID NO: 316716 - RNA, 64 nt, Human
auuuauaagaaaguaauccaaauaagaaacacgauaguugaaaauaauuuuuauaguaaauaau

SEQ ID NO: 316717 - RNA, 64 nt, Human; identical to SEQ ID NO: 316714

SEQ ID NO: 316718 - RNA, 64 nt, Human
aacauuauuauaaacuaauauaugugagaguacuuaguugaaacaaaaaggaauuuuaguagac

SEQ ID NO: 316719 - RNA, 64 nt, Human
augaccugacaaaaacugacucaugucuuuaaaguaguugaagccacuuuuagaauguuacucu

SEQ ID NO: 316720 - RNA, 64 nt, Human
augaaguuuuuugccucccacguugggaagucauuaguugaacuauuuucacauuggcccccca

SEQ ID NO: 316721 - RNA, 64 nt, Human
aauguacacuuuuuuagacaugaaagaauugccuuaguugaacaguucucagauuguaguuugc

SEQ ID NO: 316722 - RNA, 64 nt, Human
agaauggcuguagguggccgcugacaagugccuuuaguugaagagcacauuucuuucaucucuc

SEQ ID NO: 316723 - RNA, 64 nt, Human
agcaaaguauguguauuuuucccuugucaaaaauuaguugaaauuguucauuaaugugaauaca

SEQ ID NO: 316724 - RNA, 64 nt, Human
guccuuggaacaucuuucgcguauucacgguuuguaguugaaaaguuuacuguaaaaaaaucaa

SEQ ID NO: 316725 - RNA, 62 nt, Human
gacuggcggcaccagcaccuucgcuuugcaucucgguagaggagaaacggcagcacagccca

SEQ ID NO: 316726 - RNA, 62 nt, Human
ggggaagggcugcucagcucaagguguccuguucgguagagcaaguguccucugacagccgu

SEQ ID NO: 316727 - RNA, 64 nt, Human
gaaagugauacgauugaaaugaaaucacauaguucgugcucagaaauucuauuuugguauguuu

SEQ ID NO: 316728 - RNA, 64 nt, Human
ccugcagccuggagaagaggguggcuguggugggcgugcucauccccugcuaaggagcaggagc

SEQ ID NO: 316729 - RNA, 64 nt, Human
uucuuuuuuuuuuuuuuuuucuauccuguacauuuaguugaacugugcggaauugugguguugg

SEQ ID NO: 316730 - RNA, 64 nt, Human
guccccuccaaacuugcuuccguggucugccuccuaguugaaucucagcccugaguguccagau

SEQ ID NO: 316731 - RNA, 64 nt, Human
cauucuuaacuucuugguagcuagaaauuuagaguaguugaaaucuuuaggaaugaacuucuga

SEQ ID NO: 316732 - RNA, 64 nt, Human
uacuccaaguccuugaguuuuguuauaucugaacuaguugaacugugacugacagguaauccua

SEQ ID NO: 316733 - RNA, 64 nt, Human
uaauauuacauaauggaauggcuguucacuugauuaguugaaacacaaauucuggcuugaaaaa

SEQ ID NO: 316734 - RNA, 64 nt, Human
gacaggcuuuuaguagaauuuuuuaguuuuauuuuaguugaauuuuauuucuaugcaaugcaga

SEQ ID NO: 316735 - RNA, 64 nt, Human
aaugcucuuauuuuuccaacagcuaaacuacucuuaguugaacagugugcccuagcuuuucuug

SEQ ID NO: 316736 - RNA, 64 nt, Human
ucguucugguggcuuuguguaaauauguuugcccuaguugaauuaagaaacucuaaagguuaua

SEQ ID NO: 316737 - RNA, 64 nt, Human
ccauaauaggcucagaggcuucagcccagcugcauaguugaagauuuauggacagaaggaaagu

SEQ ID NO: 316738 - RNA, 64 nt, Human
aacaaacaaacaaacaucagucuuagucucuugcuaguugaaaucaaauaaaagaaaauauaua

SEQ ID NO: 316739 - RNA, 64 nt, Human
uauuuaauggauggacucuucaaaacuuaccaaauaguugaagaaaccaggugccuucucauga

SEQ ID NO: 316740 - RNA, 64 nt, Human
uugcaagccucuccauccagcaucuucucuaucuuaguugaaugccuucuuucugaacauuugu

SEQ ID NO: 316741 - RNA, 64 nt, Human
gagugugucuguaguucauuugcaaauaaacauuuaguugaaaaauaauucuccaaauacucuc

SEQ ID NO: 316742 - RNA, 64 nt, Human
caccuggaguucugcugguuaaguuuguuaaacuuaguugaaacugggaaccuguuggcuaacc

SEQ ID NO: 316743 - RNA, 64 nt, Human
ucuaucaaacaaaacucuggaccagacagauuuauaguugaagccuacgagauguauaaagaaa

SEQ ID NO: 316744 - RNA, 64 nt, Human
cugaagcugucccgcagguccccacccuccaacacgugcucaccugucccccuccucgcagcag

SEQ ID NO: 316745 - RNA, 64 nt, Human
cccccaugcagccucuuccccaccccccccaccacgugcucaaucaugaguaccucaaaggauu

SEQ ID NO: 316746 - RNA, 64 nt, Human
aaaaugagaccaugauauuaagcaucuaggaucacgugcucauugaaucagaaaaaaaguggaa

SEQ ID NO: 316747 - RNA, 64 nt, Human
uggugcugagcgccuagucacagcagguggaccucgugcucaucagagcaugccaauccuaagc

SEQ ID NO: 316748 - RNA, 64 nt, Human
gacagaaauucacccucauacaucugcauaucacuaguugaaagauucacuacaagguccaagu

SEQ ID NO: 316749 - RNA, 64 nt, Human
ucacacuguuugucuggucguauagcccaaaccuuaguugaaaucagacagaaagaaugucuuu

SEQ ID NO: 316750 - RNA, 64 nt, Human
cugcuucccccacauugggcugaccgugucucucuaguugaacccugggaacaauuuccaaaac

SEQ ID NO: 316751 - RNA, 64 nt, Human
aacccugugacuuaacuacuuuaucuccauuuuguaguugaagaaauaaguucagagagaaaga

SEQ ID NO: 316752 - RNA, 64 nt, Human
auagcaccaaaaaauggagggauuauucuuccaguaguugaacacugucauccguuucagcuga

SEQ ID NO: 316753 - RNA, 64 nt, Human
uaaucuacugcauuuagggaguauucuaauaagcuaguugaauacuugaaccauaaaaugucca

SEQ ID NO: 316754 - RNA, 64 nt, Human
caaaucauccugucaaguguaaccacuguccacguaguugaacuucugggaucaagaaagucua

SEQ ID NO: 316755 - RNA, 64 nt, Human
gaaaagcgauuuuuuuucauguauucauucugaauaguugaaauguauauuuguacagucuuuu

SEQ ID NO: 316756 - RNA, 64 nt, Human
aaagaugaaaaucccgcucuguuucagggucuuuuaguugaagcacucaggaaauauacuaaug

SEQ ID NO: 316757 - RNA, 64 nt, Human
guugaccgaaacauuguuauuggacacauaacuauaguugaaagaauaagcaaaaagucuaucu

SEQ ID NO: 316758 - RNA, 64 nt, Human
aaaaaaaaaaaacaggugugguggcaugcaccuguaguugaagcuacuuggaaggaugaagugg

SEQ ID NO: 316759 - RNA, 64 nt, Human
uggagcauaucugccuaauuaagauguugccuuuuaguugaaugccacugaagagcugugauag

SEQ ID NO: 316760 - RNA, 64 nt, Human
cacuuugcuaaaauuacagccugaauccuuucuuuaguugaagaaaggguaugugugugcaagu

SEQ ID NO: 316761 - RNA, 64 nt, Human
agguuaguugagggagagcagugguucuuuguucuaguugaaggauaggcacacauucauucua

SEQ ID NO: 316762 - RNA, 64 nt, Human
gagguaaagaugauagaggguuguggggggucucuaguugaauguuuuggcccaugacuuugga

SEQ ID NO: 316763 - RNA, 64 nt, Human; identical to SEQ ID NO: 262763

SEQ ID NO: 316764 - RNA, 64 nt, Human; identical to SEQ ID NO: 262764

SEQ ID NO: 316765 - RNA, 64 nt, Human; identical to SEQ ID NO: 262765

SEQ ID NO: 316766 - RNA, 64 nt, Human; identical to SEQ ID NO: 262766

SEQ ID NO: 316767 - RNA, 64 nt, Human
auugaaaaaccuguacaagaggcucauucuacucuaguugaaacucuguacagauacagaucug

SEQ ID NO: 316768 - RNA, 64 nt, Human
ccuaagggaaucccaggaguaaccaaggaggggguaguugaaaaaucccagcuuccucugugcc

SEQ ID NO: 316769 - RNA, 64 nt, Human
uuuaacagacacccuaaaagucuucuuuucuacauaguugaagacagcaacaucuucacugaau

SEQ ID NO: 316770 - RNA, 64 nt, Human
aagacuuguuaaguuuuaaaauaacaaaaauggcuaguugaauaguauuuuauguguaauucuu

SEQ ID NO: 316771 - RNA, 64 nt, Human
acauuaagcaucacaaaugauauuaaaaauuggcuaguugaaucuauugggauuuucuacaagu

SEQ ID NO: 316772 - RNA, 64 nt, Human
aguugaaaccaugacagggagcucucauagauacuaguugaaaaaagucucugaacaauucucu

SEQ ID NO: 316773 - RNA, 64 nt, Human
uaauuuuuauaaaauauuggguuuucccuuaagauaguugaaguauuuuucuugccaugccuau

SEQ ID NO: 316774 - RNA, 64 nt, Human
gaggaaaagguucuuguuaaauuauuugauuguguaguugaaguaauuauaauuuauaucaaaa

SEQ ID NO: 316775 - RNA, 64 nt, Human
guagaacauugguauucgcuugagaaaaaaagaauaguugaaccuauuucucuuucuuuacaag

SEQ ID NO: 316776 - RNA, 64 nt, Human
cguagaaucuccacuaggaagucuuuauuugaaauaguugaaucagugaucuaguauuuuccuu

SEQ ID NO: 316777 - RNA, 64 nt, Human
auagcaccucaguaccaaggggagggauuuugacuaguugaauuauuaagccaccacaauaaag

SEQ ID NO: 316778 - RNA, 64 nt, Human
caucaacauggauaugacauuucacaacagugacuaguugaaucccuuguaacguaguaguugu

SEQ ID NO: 316779 - RNA, 64 nt, Human
gaaagaucacagauacguaauaauuuaaagucuguaguugaauuuccuaacuuaaagaauagac

SEQ ID NO: 316780 - RNA, 64 nt, Human
uaaucugaaaauuaaugauucucuguaagcacuguaguugaaaagagaguagcaauuaggauga

SEQ ID NO: 316781 - RNA, 64 nt, Human
uaucuguguuuucaccauucaaagugcuguuuaguaguugaaacuuaaacuauuuaaugucauu

SEQ ID NO: 316782 - RNA, 64 nt, Human; identical to SEQ ID NO: 262767

SEQ ID NO: 316783 - RNA, 64 nt, Human; identical to SEQ ID NO: 262768

SEQ ID NO: 316784 - RNA, 64 nt, Human; identical to SEQ ID NO: 262769

SEQ ID NO: 316785 - RNA, 64 nt, Human; identical to SEQ ID NO: 262770

SEQ ID NO: 316786 - RNA, 64 nt, Human
ccacuauguuuggaaacaggggguaucgacuauauaguugaaagggucagaaauaccauucaca

SEQ ID NO: 316787 - RNA, 64 nt, Human
guuuuugcagaauauuagaaaaaugucaugaaaauaguugaagagaaaugcucacugcacaagg

SEQ ID NO: 316788 - RNA, 64 nt, Human
uacaauugauauuugaaauugacuguagagcauuuaguugaagaguuaagcauucaguuccauu

SEQ ID NO: 316789 - RNA, 64 nt, Human
uaauugauuauauaguguaagaauaguugaagacuaguugaagaccuuuugugauuucauuauc

SEQ ID NO: 316790 - RNA, 64 nt, Human
aaaaauuucccuaauugauuauauaguguaagaauaguugaagacuaguugaagaccuuuugug

SEQ ID NO: 316791 - RNA, 64 nt, Human
uauaccgugacugaaaacuagaguccuacuuacauaguugaaauaucaaggaggucagaagaaa

SEQ ID NO: 316792 - RNA, 64 nt, Human
gcuuuaauaacucauuuuucuuagagaacuaaaguaguugaaacaauauagaaacauuuuuuaa

SEQ ID NO: 316793 - RNA, 63 nt, Human
ggugcucuggcuggagaggaaaagccaguucccuacgaggaguguucccaaugcuuuguccau

SEQ ID NO: 316794 - RNA, 63 nt, Human
uguaaucuacuguccagcugaaagcacucauguuacgaggaagaaacuacaagugauguucaa

SEQ ID NO: 316795 - RNA, 63 nt, Human
agcccacugcucauccacguggucugccaugccuacgaggaaggccagcgcaugcaggacugg

SEQ ID NO: 316796 - RNA, 63 nt, Human
gaggggaguuaggaguugcuggacuggaugcauuacgaggacuggggacaggguagagggaca

SEQ ID NO: 316797 - RNA, 63 nt, Human
uucacggaaagugccugcaaaaacagagguggauacgaggacagguuggagcugcagggacug

SEQ ID NO: 316798 - RNA, 63 nt, Human
uuaaguauuaaugaggggaaaggaaaugagcucuacgaggauuucacccugcaugggagagag

SEQ ID NO: 316799 - RNA, 63 nt, Human
aauaaaggcagagagaagagacagaacuaaaaauacgaggaaaggagagugaggauuuucauu

SEQ ID NO: 316800 - RNA, 63 nt, Human
guguugacugggggaggugaaucacaaaaaaguuacgaggaguuuaagaguuaaauauuauuu

SEQ ID NO: 316801 - RNA, 63 nt, Human
aucgugccgguggagcccgagcggacagcggaauacgaggacuacggcgcagacgagccugca

SEQ ID NO: 316802 - RNA, 63 nt, Human
ccgucaaaucuuucagaaaauauaagccuuuaauacgaggaagaguauucuuaagaugaacau

SEQ ID NO: 316803 - RNA, 63 nt, Human
uagugcgccguguccugagagaggugcccucccuacgaggagggaagaacaggcccuggggug

SEQ ID NO: 316804 - RNA, 63 nt, Human
gccuccugcucaucccuccuucuuuaguaucuuuacgaggagucucacugggcugguugugcu

SEQ ID NO: 316805 - RNA, 64 nt, Human
cggcccagggugggccagaccagcagcccaggaagcagcacacgcggccguggggaggcaggca

SEQ ID NO: 316806 - RNA, 64 nt, Human
gacggacguguagcccuggcgaggccagccggcggcagcacagccugucuccaaucagcaagug

SEQ ID NO: 316807 - RNA, 64 nt, Human
ggagguugcccacgggccucggcaccuggcccuggcagcacagcucucaggcccagcccugggc

SEQ ID NO: 316808 - RNA, 64 nt, Human
gcacccacagccucagcuccugugcaguuccugggcagcacaguggaagugggagccugguccu

SEQ ID NO: 316809 - RNA, 64 nt, Human
gagaggugagaagugcucccaagcagacacaacagcagcacagaggucuggaggccacacaaaa

SEQ ID NO: 316810 - RNA, 64 nt, Human
uaacccuuuuaaugccuuuaccucaaguugcuuggcagcacaacuaucuuugcaaaaaaaagua

SEQ ID NO: 316811 - RNA, 64 nt, Human
accaacauggacugagggacuucucagaggcagggcagcacacggccagccccgcggccuggcg

SEQ ID NO: 316812 - RNA, 64 nt, Human
ucugcuccugagcacggugcgugcaaagcauauagcagcacauaggcucaggcuucuguaggcu

SEQ ID NO: 316813 - RNA, 64 nt, Human
guuacucuguauuuaaggguaagccccacagcgggcagcacaaacagccugggagccacugugc

SEQ ID NO: 316814 - RNA, 64 nt, Human
uuccacaggacgauggaccgccggacucuuuucugcagcacacgccugugugcugugagccccc

SEQ ID NO: 316815 - RNA, 64 nt, Human
ucauugcugcagugcucccaucccccaccagguggcagcacagccccacugugucuuccgcagu

SEQ ID NO: 316816 - RNA, 64 nt, Human
gucuccucccaauucauccuuaauuccaagugaagcagcacagugcugagaaacaguucaucca

SEQ ID NO: 316817 - RNA, 64 nt, Human
aguccucuuaaagagggacgagggccagacugaagcagcacaaggccggggacacccaugccaa

SEQ ID NO: 316818 - RNA, 64 nt, Human
gggcggcccaagcacagcccugacuaggaugacagcagcacaaaagaccaccuuucuccccuga

SEQ ID NO: 316819 - RNA, 64 nt, Human
cucaugcauaacccuguggcuugcuucccccagggcagcacaggcuaagucaggaacaucggau

SEQ ID NO: 316820 - RNA, 64 nt, Human; identical to SEQ ID NO: 262771

SEQ ID NO: 316821 - RNA, 64 nt, Human; identical to SEQ ID NO: 262772

SEQ ID NO: 316822 - RNA, 64 nt, Human; identical to SEQ ID NO: 262773

SEQ ID NO: 316823 - RNA, 64 nt, Human
gccaaagcaagagcagauucccuaggcaagagcagcagcacaacuaggaaaccccaaagcccau

SEQ ID NO: 316824 - RNA, 64 nt, Human
cagcauuaccuuccacugccuuucucccugggaagcagcacagcugagacugggcaccaggcca

SEQ ID NO: 316825 - RNA, 64 nt, Human
caguacucaguuaggcagugcaguacucaggaaugcagcacaguacucaggcagugcaauacuc

SEQ ID NO: 316826 - RNA, 64 nt, Human
ucacuugugucugcuccuagccugugcucugccagcagcacagacaucugcuccaucagaccuc

SEQ ID NO: 316827 - RNA, 64 nt, Human
agacagcuccguguggagagcuuagccccuggaggcagcacaaggaggaugugauauguggggg

SEQ ID NO: 316828 - RNA, 64 nt, Human
uaaucuuugaagcauuuugggcuuaagauugccagcagcacacaucagaugcagucauuguugc

SEQ ID NO: 316829 - RNA, 64 nt, Human
cugcccccgccagcucuggcuguuuagcuugagggcagcacagaggccccugggacaccuacag

SEQ ID NO: 316830 - RNA, 64 nt, Human
uuuucuuugaaccuuaaagguucuauuauuaaaagcagcacagauuccacauuuuuauacauga

SEQ ID NO: 316831 - RNA, 64 nt, Human
ucgccuguccacaggcuuccuuguaagcaagucagcagcacagcuacucacgcugccaucugga

SEQ ID NO: 316832 - RNA, 64 nt, Human
ucccaggccugugagaaaagcaaaaauucacauugcagcacaugaugccagaaauagcacugaa

SEQ ID NO: 316833 - RNA, 63 nt, Human
aagcauuuuuggcaaccaauggcagauaucuauggcagcacacaaaaaaaguauagaaagauc

SEQ ID NO: 316834 - RNA, 64 nt, Human
uugaauaucuuugaacuugcuguuuucaauaugggcagcacaaaggugagagauacauauuaau

SEQ ID NO: 316835 - RNA, 64 nt, Human
acccacguuaggugugacacguucacauaacugugcagcacaugccgggagugaucagucggac

SEQ ID NO: 316836 - RNA, 64 nt, Human
ccugggaggggcaauccucaaaugcggggugggggcagcacaggagggcggccuccuucugagc

SEQ ID NO: 316837 - RNA, 64 nt, Human
acuugauuuuaaaaaccagucaagagcaaucaaagcagcacaugguguuguauacuucauuagc

SEQ ID NO: 316838 - RNA, 64 nt, Human; identical to SEQ ID NO: 262777

SEQ ID NO: 316839 - RNA, 64 nt, Human; identical to SEQ ID NO: 262778

SEQ ID NO: 316840 - RNA, 64 nt, Human; identical to SEQ ID NO: 262779

SEQ ID NO: 316841 - RNA, 64 nt, Human
uccuguuuuuugagccuucuggaccaacaaaauggcagcacauccugcuuccugacagggaagg

SEQ ID NO: 316842 - RNA, 64 nt, Human
uuugaauacuauuucacugacguuacuaagcauugcagcacaauguagaaauuggcuugggaug

SEQ ID NO: 316843 - RNA, 64 nt, Human
gaagucuggaagacgucugcagaggacccuuuuggcagcacaacuguuacucuagggaguuggu

SEQ ID NO: 316844 - RNA, 64 nt, Human
ugauauucaguucauucaccugauuacuuugguugcagcacaacuguauauauuguauaaccga

SEQ ID NO: 316845 - RNA, 64 nt, Human
ccucaugcaguuggcauccaggcagcccucugcagcagcacacccugcaggcggaguuuucaga

SEQ ID NO: 316846 - RNA, 64 nt, Human
ugcugggcaaggaauuccagugccuccuacgggggcagcacacuuagauauuccuggacaucca

SEQ ID NO: 316847 - RNA, 64 nt, Human
ucaggcaugaccacguccagugaagacauuugaggcagcacaucucaggacccaggcaauagac

SEQ ID NO: 316848 - RNA, 64 nt, Human
gugagcaguuucacuuggagguucacaugggguggcagcacacuuaacaucuaacacaccaggu

SEQ ID NO: 316849 - RNA, 64 nt, Human
ccccgccagggagguuucaugagcucaugucuaugcagcacauaaggguucuucagugaaaagc

SEQ ID NO: 316850 - RNA, 64 nt, Human
cuaugaacuucaaaacaaaaacaaaacuuugagagcagcacaugcauccagguauuuauagauu

SEQ ID NO: 316851 - RNA, 64 nt, Human
gaggauggguuugagaaggaccccuucccaaauagcagcacagcugccaagucauuugaggauc

SEQ ID NO: 316852 - RNA, 64 nt, Human
cucugccagccgcuggugcccaccagcuggcucugcagcacauugcccugaggggccugccacu

SEQ ID NO: 316853 - RNA, 64 nt, Human
aucaucugugccuggaagaguucacugucauugagcagcacagccugagugcuggccucuguca

SEQ ID NO: 316854 - RNA, 64 nt, Human
gcuucucgugguuggcgugcugcagcgacaggcggcagcacagcaccugcacgaacacccgccg

SEQ ID NO: 316855 - RNA, 64 nt, Human
acccaagcuggcccauaaucagcaguggggcccagcagcacaggaggggcggacgguuagcuuu

SEQ ID NO: 316856 - RNA, 64 nt, Human; identical to SEQ ID NO: 262780

SEQ ID NO: 316857 - RNA, 64 nt, Human; identical to SEQ ID NO: 262781

SEQ ID NO: 316858 - RNA, 64 nt, Human; identical to SEQ ID NO: 262782

SEQ ID NO: 316859 - RNA, 64 nt, Human
ggacagagaggaaggaaggauuggaaaaguccccgcagcacagcgacggugggaagaugccuua

SEQ ID NO: 316860 - RNA, 64 nt, Human
uucugaaccuuccugcccgggagucuguaacacagcagcacaggaccgcgcuuccuuuagcagu

SEQ ID NO: 316861 - RNA, 64 nt, Human
guggccauuaccaucucuaaggagagcucugauugcagcacagagcaguggccaggccacccaa

SEQ ID NO: 316862 - RNA, 64 nt, Human
auguuuugacucauuugguaaccauugccuguaagcagcacagaauuggugccauggauuaucu

SEQ ID NO: 316863 - RNA, 64 nt, Human
uacuaaaauguaaaaaauuaaugugcucaccucggcagcacauauacuaaaaauuaauaagacc

SEQ ID NO: 316864 - RNA, 64 nt, Human
uuuggaucaaaaggagaaaugauaagugacaaaagcagcacaaggaauuucccuguguggaugc

SEQ ID NO: 316865 - RNA, 64 nt, Human
uccuagcaccuggcuaguuucuaacauguuuugugcagcacaguuuuuaauaaaugcuuguuac

SEQ ID NO: 316866 - RNA, 64 nt, Human
gucuaggggaauccugccugccccauggaguugcgcagcacaacccuggcuccaauugccagaa

SEQ ID NO: 316867 - RNA, 64 nt, Human
ugggauggcuggauugagcaaugagcagagccaagcagcacagaguccccuggggcuagaggug

SEQ ID NO: 316868 - RNA, 64 nt, Human
caacgcugcaccaaagaaaaggucagaauaaaaggcagcacagcuggugaccuuauuuucuaga

SEQ ID NO: 316869 - RNA, 64 nt, Human
gggaucuuuuagggcccugagcccugccuggagagcagcacagcucaucaguccccaaagcccc

SEQ ID NO: 316870 - RNA, 64 nt, Human
acuaucugcaguaccagugagccaagccugaugggcagcacagacacagacacacaccgcaggg

SEQ ID NO: 316871 - RNA, 64 nt, Human
uacuguuugauaagaaaaguagguccagccuuaagcagcacagaugcgcugguagaugcauagu

SEQ ID NO: 316872 - RNA, 64 nt, Human
agccagucuuugaaaaaauacaacuauggcaucugcagcacaaauauuuaaggacaucagaagc

SEQ ID NO: 316873 - RNA, 64 nt, Human
ggcagucccugggcaagggaggauuuucccggccgcagcacagccuuccauucaugugcacgug

SEQ ID NO: 316874 - RNA, 64 nt, Human; identical to SEQ ID NO: 262733

SEQ ID NO: 316875 - RNA, 64 nt, Human; identical to SEQ ID NO: 262734

SEQ ID NO: 316876 - RNA, 64 nt, Human; identical to SEQ ID NO: 262747

SEQ ID NO: 316877 - RNA, 64 nt, Human
guuagcaccccacucucccaagccaccccugcaagcagcacagcagggcauauaccagucagga

SEQ ID NO: 316878 - RNA, 64 nt, Human
aauuagaaaacaagugggacauauuuuccugagagcagcacaggaaucuucuucuuggcagcug

SEQ ID NO: 316879 - RNA, 64 nt, Human
acuuuaugggcagggcccuagaagagcgagcccagcagcacagagaagcucugauagcacagau

SEQ ID NO: 316880 - RNA, 64 nt, Human
auggcccagagcuacccugggagugucagugcuagcagcacagcuaccucugguggcaggagaa

SEQ ID NO: 316881 - RNA, 64 nt, Human
uguauguaaccaacccuuaucuggcaacauaauugcagcacaauaaugauuugcaugauaccuu

SEQ ID NO: 316882 - RNA, 64 nt, Human
caaaugaagugagucaugugugauuuaaguucaggcagcacaucaauuucuaaauacuuuuugu

SEQ ID NO: 316883 - RNA, 64 nt, Human
guuagagacacacugcauugcagauaaaaugcaggcagcacaauauggccuaaacugccauagu

SEQ ID NO: 316884 - RNA, 64 nt, Human
uuuugaguaauguaggaauacaaaagguaaauuagcagcacauauaauuuuuuuuuaauuuaug

SEQ ID NO: 316885 - RNA, 64 nt, Human
ugaagaucugacuguacuaaauaugaaaaauaaagcagcacauacuuucucuacuguuuuccug

SEQ ID NO: 316886 - RNA, 64 nt, Human
ugaucaguaucacuuuaaguccugcauuuaauuggcagcacaagauccugcagagccucuuucc

SEQ ID NO: 316887 - RNA, 64 nt, Human
ggugaaaugcguguguguacagacaguccacugggcagcacagguauccucauguucuuuauuu

SEQ ID NO: 316888 - RNA, 64 nt, Human
agacuuuguccuuuugccaggccuaaccaugacugcagcacaaaauuaucgacucuggcgagau

SEQ ID NO: 316889 - RNA, 64 nt, Human
uucaguaucguaugacccuggccucucgugaagagcagcacaacauggaaagagccaaaauguc

SEQ ID NO: 316890 - RNA, 64 nt, Human
uguuagcccaagucugaauuuacauuugacuaaagcagcacauaagauaauuugcuaaaaugcu

SEQ ID NO: 316891 - RNA, 64 nt, Human
uuuggaaacuuauuuuuucuccccaaaagaaucagcagcacaggggaacuaugucacaguuuac

SEQ ID NO: 316892 - RNA, 64 nt, Human; identical to SEQ ID NO: 262698

SEQ ID NO: 316893 - RNA, 64 nt, Human; identical to SEQ ID NO: 262699

SEQ ID NO: 316894 - RNA, 64 nt, Human; identical to SEQ ID NO: 262700

SEQ ID NO: 316895 - RNA, 64 nt, Human
ugcauuaagauaaucacguuaaaauuguuacuaugcagcacagaacuucauucuuauaguauuc

SEQ ID NO: 316896 - RNA, 64 nt, Human
gcagggcuggcuuucuuagcguguaacuuguguagcagcacagggcccacacuuagaaggaccc

SEQ ID NO: 316897 - RNA, 52 nt, Human
ugaaaaucuuggaccuuugauagcagcacauguauuguaaaugucccaggau

SEQ ID NO: 316898 - RNA, 64 nt, Human
cagcaaaguggcauaaaaaucaccugguaaguaugcagcacauugcuuauauccuggguaugca

SEQ ID NO: 316899 - RNA, 64 nt, Human
cuuuuccuugcuuuguuaaccaucacgagagucugcagcacaacuuuuaacaaagcuagaacag

SEQ ID NO: 316900 - RNA, 64 nt, Human
uuccuccccaucuggaauucacagcuguucccuggcagcacacaggaggguauuaaggaccuuu

SEQ ID NO: 316901 - RNA, 64 nt, Human
uucuugaauauuuuuaacacuguguaaucccugagcagcacaaaacuuuuauuccgaugaccag

SEQ ID NO: 316902 - RNA, 64 nt, Human
ugauucaggaagauaguaucucagaaugaccagagcagcacagaaacaagcuacucugacauua

SEQ ID NO: 316903 - RNA, 64 nt, Human
ggugaugauagauuucaaaaaacaaaagguggcagcagcacaauguucauggugaauuaucuca

SEQ ID NO: 316904 - RNA, 64 nt, Human
caaugugaaagauuauuuaaaugcuuuuaaaucugcagcacauugauaagaugguuuccgugag

SEQ ID NO: 316905 - RNA, 64 nt, Human
caugccuaugcagccacacagugguaacuugaaggcagcacagaggugagggauuaaaaggaaa

SEQ ID NO: 316906 - RNA, 64 nt, Human
cugugcugucccaggaagugucuggcgggcgugggcagcacagcucuacacuguacgauucacu

SEQ ID NO: 316907 - RNA, 64 nt, Human
ggacuggcugggcccccagggcugcuccccacuugcagcacaaugccuucuccaccugcccucc

SEQ ID NO: 316908 - RNA, 64 nt, Human
ccagaggcguaggggcccaggagagcccccaccagcagcacaauucugucccugucccugcccc

SEQ ID NO: 316909 - RNA, 64 nt, Human
ggcaauaacucuguggcacgugggcaucacguaagcagcacacuaggaggcccaggcgcaggca

SEQ ID NO: 316910 - RNA, 64 nt, Human; identical to SEQ ID NO: 262704

SEQ ID NO: 316911 - RNA, 64 nt, Human; identical to SEQ ID NO: 262705

SEQ ID NO: 316912 - RNA, 64 nt, Human; identical to SEQ ID NO: 262707

SEQ ID NO: 316913 - RNA, 64 nt, Human
aaaguuuccagauagguauuguaucauugagaaugcagcacagauagugugggcuucacacuau

SEQ ID NO: 316914 - RNA, 64 nt, Human
gaggccacccacugacccaacugauccugcuccagcagcacaccucagccccacugacacccag

SEQ ID NO: 316915 - RNA, 64 nt, Human
gcagggaucuggcacggaccagauguggcgaauggcagcacagcgcgguggcugggucugcaca

SEQ ID NO: 316916 - RNA, 64 nt, Human
acuaaagcuugagguggauguuggcuucacuccugcagcacaaugcuggcccuagaaagcgagc

SEQ ID NO: 316917 - RNA, 64 nt, Human
gucccagaguagcugaagggaagccaaccccccugcagcacaaauaggccccccagucccagcc

SEQ ID NO: 316918 - RNA, 64 nt, Human
caucaugagccucaacugccuacaucuggggcaagcagcacaccggcugcagaugggacagcca

SEQ ID NO: 316919 - RNA, 64 nt, Human
ugccaugcauauguaaauuauugcuuuaauuagagcagcacauugcuaaaauaaaaaauacacc

SEQ ID NO: 316920 - RNA, 64 nt, Human
gggcauuuaguuuacuagaaauucuuuaccuuaagcagcacacacauuuacuacacacacagug

SEQ ID NO: 316921 - RNA, 64 nt, Human
guagcgcacucuucauggugacacucgaggucgggcagcacaaguguaaugaauaccuuagugc

SEQ ID NO: 316922 - RNA, 64 nt, Human
cucgaguggugcuguacuuguuaugagugaggcagcagcacaguguguggcauuuacaugguac

SEQ ID NO: 316923 - RNA, 64 nt, Human
auuuuacucuugccugugaaccucaugcaugaaagcagcacauuaaauuguaaaaauacaaaca

SEQ ID NO: 316924 - RNA, 64 nt, Human
aauagugcauuagucuaucucagccuaguguucugcagcacacaugggcaggcaguuuacucac

SEQ ID NO: 316925 - RNA, 64 nt, Human
gauaccuguguauagcuucccaccuuccaugagugcagcacacagguagugcuggaaaaacgca

SEQ ID NO: 316926 - RNA, 64 nt, Human
ugcccagcuguucuuacugcuuaguagccuugaagcagcacaucuccacugucccuggcaggau

SEQ ID NO: 316927 - RNA, 64 nt, Human
ucugccgaggcucugugagccugaugccucccuggcagcacaggaaaagaauuuuuuuuuuuaa

SEQ ID NO: 316928 - RNA, 64 nt, Human; identical to SEQ ID NO: 262708

SEQ ID NO: 316929 - RNA, 64 nt, Human; identical to SEQ ID NO: 262709

SEQ ID NO: 316930 - RNA, 64 nt, Human; identical to SEQ ID NO: 262783

SEQ ID NO: 316931 - RNA, 64 nt, Human
acauucucuccccuauuuaggaaacuugguuagagcagcacacgucggagaacaggaggcucac

SEQ ID NO: 316932 - RNA, 64 nt, Human
cacacguccugcaauauucacugaggaaugcacagcagcacauaugugccucauguguccugcu

SEQ ID NO: 316933 - RNA, 64 nt, Human
ccuuuguucuggguccuuucgggagggcugaugggcagcacaggaggcccguccucggggggcu

SEQ ID NO: 316934 - RNA, 64 nt, Human
ucuccccugugcucuggugacccgaggaggucgugcagcacagcgcagaagccccugcccacgg

SEQ ID NO: 316935 - RNA, 64 nt, Human
agcauugggcuggcuguccgcugcugacuggauggcagcacaaagacaauaugagcagagggag

SEQ ID NO: 316936 - RNA, 64 nt, Human
aggugcucgaugggccccccagggcuucuccagggcagcacagggaccccggaugaagacucug

SEQ ID NO: 316937 - RNA, 64 nt, Human
uucuguccuuuuucuccugcuccuuguuuucccagcagcacaugggguuccucggaggagcaga

SEQ ID NO: 316938 - RNA, 64 nt, Human
agcccccaggccaggugagguccaccggccccuggcagcacagcccagggccugcaugggggca

SEQ ID NO: 316939 - RNA, 53 nt, Human
uaucaaacagcaagcacugacaagcagcacauucucaagagcacacagguaag

SEQ ID NO: 316940 - RNA, 64 nt, Human
gucuuuuguguuugauuuuguuugauuucccucugcagcacagcgucucuguaaagguuuuuau

SEQ ID NO: 316941 - RNA, 64 nt, Human
uacacuuucaacauuuuauuacgauuauuauucagcagcacauucugaggggggaacaauucac

SEQ ID NO: 316942 - RNA, 64 nt, Human
ugaugaaagcaugcuuucuacgccauucaggaaggcagcacaaauuuaucucagaaagguuccu

SEQ ID NO: 316943 - RNA, 64 nt, Human
gcugccaaccugagauugaaggcagugccucagagcagcacagagaguuggggcccccugagcc

SEQ ID NO: 316944 - RNA, 64 nt, Human
aacaugaacaacugaauacagaaaguaacugaaagcagcacagagacugugucgucccuacaga

SEQ ID NO: 316945 - RNA, 64 nt, Human
aucuuccugcaagucaucugcucacacacaguuggcagcacauagcguuuccuucuuucagaaa

SEQ ID NO: 316946 - RNA, 64 nt, Human; identical to SEQ ID NO: 262711

SEQ ID NO: 316947 - RNA, 64 nt, Human; identical to SEQ ID NO: 262712

SEQ ID NO: 316948 - RNA, 64 nt, Human; identical to SEQ ID NO: 262713

SEQ ID NO: 316949 - RNA, 64 nt, Human
caggcucagcccuucccacccugccccaugcccagcagcacaacacggagugagacaggaugcc

SEQ ID NO: 316950 - RNA, 64 nt, Human
uggcugugaccauggcagacaucaccaaucaagugcagcacaugggugaugucagaauucuucc

SEQ ID NO: 316951 - RNA, 64 nt, Human
ggcaucgcuucugauggccccgaauccccauugagcagcacaaagcccguuugggguaggagug

SEQ ID NO: 316952 - RNA, 64 nt, Human
ggccaggagcagcaggucaugugcacaugccguugcagcacaagcuuaugcuucccguagccgu

SEQ ID NO: 316953 - RNA, 64 nt, Human
cauggaugucccaggaggcagcucuccccacacagcagcacagccaucacaggauuccuugugu

SEQ ID NO: 316954 - RNA, 64 nt, Human
gagagagagagagaaugugauuuuuggccuuguggcagcacauccucacacccaaagaaguuug

SEQ ID NO: 316955 - RNA, 64 nt, Human
auguugggagagagcuggggcagagcggggagcugcagcacagcaacagugauggcgaggacuu

SEQ ID NO: 316956 - RNA, 64 nt, Human
acuccguaggcuucuuaaucuuccaggcauuacagcagcacaguguucuacuuuuuacaucauu

SEQ ID NO: 316957 - RNA, 64 nt, Human
ugaaccauccaaaaaucauugcuuuuaacuguuugcagcacaauauaacuuuacauucuuugcc

SEQ ID NO: 316958 - RNA, 64 nt, Human
auagcuacugcuagaagucuuaaaaaaaccaacagcagcacaggauguauuaagaauuauauga

SEQ ID NO: 316959 - RNA, 64 nt, Human
acccagggugcauuaacuuaaaagauucacuaaagcagcacauagcacugggaacucuggcucc

SEQ ID NO: 316960 - RNA, 64 nt, Human
acccauuauguuuucagguaacaggaggaaaaaugcagcacaauuuuuuuucucuugaaaggca

SEQ ID NO: 316961 - RNA, 64 nt, Human
caguucuuggguuccccgcucuaguuugaccugugcagcacauuccagaagguuccagggaggu

SEQ ID NO: 316962 - RNA, 64 nt, Human
accugcugggggcacugaccaugcugagugaaacgcagcacaagcugcuggcggaggcgcugga

SEQ ID NO: 316963 - RNA, 64 nt, Human
aagagcaauugcagcagacccagcagcagcagcagcagcacaaacauugcugccuuugucccca

SEQ ID NO: 316964 - RNA, 64 nt, Human; identical to SEQ ID NO: 262717

SEQ ID NO: 316965 - RNA, 64 nt, Human; identical to SEQ ID NO: 262718

SEQ ID NO: 316966 - RNA, 64 nt, Human; identical to SEQ ID NO: 262722

SEQ ID NO: 316967 - RNA, 64 nt, Human
cagagacaccaaacugccaaaaacaagacgcguagcagcacacacuucacaaagccaagccuag

SEQ ID NO: 316968 - RNA, 64 nt, Human
gaugcacgcagacccaucucccuugucaugcugggcagcacaccggcuaagcaggggagcagag

SEQ ID NO: 316969 - RNA, 64 nt, Human
caggggucaggugucaggcccgucggagcugccugcagcacaugcgggcucgcccauacccgug

SEQ ID NO: 316970 - RNA, 64 nt, Human
cccuggggccaccucggcugcugcagccugcccagcagcacauuccagucacugcccccgcacu

SEQ ID NO: 316971 - RNA, 64 nt, Human
gauaccugggcaaccuuguaacuguauucuccaggcagcacaugcgguggcucugggacauugg

SEQ ID NO: 316972 - RNA, 64 nt, Human
cagccucugcaauacacaguuaccagaugggaaugcagcacaguggcacagagagguaacuacg

SEQ ID NO: 316973 - RNA, 64 nt, Human
uucacauucaacaagguagcacacaggaccaagagcagcacaugcaaucaacuggaauaauaua

SEQ ID NO: 316974 - RNA, 64 nt, Human
ugauggaggggcuggaugcguucgaugaccugaugcagcacacgcacauccagcccugguaccu

SEQ ID NO: 316975 - RNA, 64 nt, Human
gggagcccuugguguucugagcagcagggcccaggcagcacaugagcagugcccaggggcuccc

SEQ ID NO: 316976 - RNA, 64 nt, Human
cuuugcugcugugaaucccaccugccaccagccugcagcacaccccacagccaaguagaggcga

SEQ ID NO: 316977 - RNA, 64 nt, Human
ggauggaaugugcugggccacuguuggguggagagcagcacauucuuacagaggagauggagcg

SEQ ID NO: 316978 - RNA, 64 nt, Human
aggucagcugcccuggccuugcaccccucugcaugcagcacagaagggugugaccaugcccuca

SEQ ID NO: 316979 - RNA, 64 nt, Human
cucauggggaggaaagagcuuccagggggcgaacgcagcacagaggaagaggccugcuccacuu

SEQ ID NO: 316980 - RNA, 64 nt, Human
gugcugaacauuucucagcccuggcuaaaagggagcagcacagggagagaaacaggauaggaaa

SEQ ID NO: 316981 - RNA, 64 nt, Human
gucugcaucauccuuuucaaauguuccuuuaaaugcagcacacugaguuuguacaauuguguua

SEQ ID NO: 316982 - RNA, 64 nt, Human; identical to SEQ ID NO: 262714

SEQ ID NO: 316983 - RNA, 64 nt, Human; identical to SEQ ID NO: 262715

SEQ ID NO: 316984 - RNA, 64 nt, Human; identical to SEQ ID NO: 262726

SEQ ID NO: 316985 - RNA, 64 nt, Human
uaagucgggggccagagggagcucccucaacuaggcagcacagcccuacugaucagcgcaugug

SEQ ID NO: 316986 - RNA, 64 nt, Human
cugcugagacuucagggacccaucagaacuuggugcagcacagccccgcccguggagggucccu

SEQ ID NO: 316987 - RNA, 64 nt, Human
uguaucagguacuuaauugcauagaguuaguuuugcagcacaaugguguugcuuuaauggaaaa

SEQ ID NO: 316988 - RNA, 64 nt, Human
gcauccuuacuggauaucuuaguugcuuguuugggcagcacacuaauauuacuuaaaacacugu

SEQ ID NO: 316989 - RNA, 64 nt, Human
ucaguagcauuuugaaugcaagggaugauggaaagcagcacaugcguuucuguggcagcugugg

SEQ ID NO: 316990 - RNA, 64 nt, Human
ggagagagaaucugggaagagaaauggagaauaagcagcacaguguuauucauuucuguaaauu

SEQ ID NO: 316991 - RNA, 64 nt, Human
auguuaaauaugugaaugguggaaauggugacuagcagcacacauucugggaagcaucaaauag

SEQ ID NO: 316992 - RNA, 64 nt, Human
agagaggacggcguggcgaaagucagcguccacugcagcacaggaucagauggccgugugcugu

SEQ ID NO: 316993 - RNA, 64 nt, Human
uuuuuuuuguaauuuaaguggcauuucuaugcaggcagcacagcagacuaguuaaucuauugcu

SEQ ID NO: 316994 - RNA, 64 nt, Human
ggcugugcacggcccucgucacaaggugacccuugcagcacaggccgcgggugccccaggcucg

SEQ ID NO: 316995 - RNA, 64 nt, Human
ugcugagccggcugcccugggcacccgguuccaggcagcacagacguggggcauccccagaaag

SEQ ID NO: 316996 - RNA, 64 nt, Human
ggcucagaccgacccccacuccauccccagaccugcagcacaagugcgcgggccuguccuccca

SEQ ID NO: 316997 - RNA, 64 nt, Human
caucugcccaggacggggccggccaggugggcgggcagcacagcaaggaggcuggcuggggccu

SEQ ID NO: 316998 - RNA, 64 nt, Human
agcagcaggguuaagacucagcacagggccagcagcagcacaaccuugaccagagcuugggucc

SEQ ID NO: 316999 - RNA, 64 nt, Human
aacugguuuuucuuggguggcugaugacauggaugcagcacagacucagccuuggccuggagca

SEQ ID NO: 317000 - RNA, 64 nt, Human; identical to SEQ ID NO: 262730

SEQ ID NO: 317001 - RNA, 64 nt, Human; identical to SEQ ID NO: 262731

SEQ ID NO: 317002 - RNA, 64 nt, Human; identical to SEQ ID NO: 262732

SEQ ID NO: 317003 - RNA, 64 nt, Human
ugcuaauuuauuguauuguuccuuugugcucuaagcagcacacuugccuucuauuuauuuaagu

SEQ ID NO: 317004 - RNA, 64 nt, Human
auuauaggcaugagcugccgugccuggacuaucagcagcacauguuuugcuguuacgguguacu

SEQ ID NO: 317005 - RNA, 64 nt, Human
uggaaaaccaccucuguuuuccuugcucuauacagcagcacauauuaucauacagacagaaaau

SEQ ID NO: 317006 - RNA, 64 nt, Human
uugggugauggguucguuagaaguccaaaccucagcagcacacaauauacucauguaacaagcc

SEQ ID NO: 317007 - RNA, 64 nt, Human
aaaggcaccuauaaaacaggucaauacaguacaggcagcacagagacccccggaacaagccuaa

SEQ ID NO: 317008 - RNA, 64 nt, Human
ggcugcaugagcugcaagugugugcucuccugacgcagcacaagcucaggacauggaggugccg

SEQ ID NO: 317009 - RNA, 64 nt, Human
aggaugccuucuacacguuggugcgugagauccggcagcacaagcugcggaagcugaacccucc

SEQ ID NO: 317010 - RNA, 64 nt, Human
cuccaggccugugggcggggccucgguccuugccgcagcacaaucccguggacagagcuuacuc

SEQ ID NO: 317011 - RNA, 64 nt, Human
aggggucucccucggggaccguucagugucccaggcagcacagugugugaacugcuuucaaguc

SEQ ID NO: 317012 - RNA, 64 nt, Human
gaaacugaaguguguucucauggcacacuucauggcagcacagauauaccucauuuuaaccaau

SEQ ID NO: 317013 - RNA, 64 nt, Human
agagcccucgugcauugacuugacagccucuccggcagcacaggccuagcugguucuggguugg

SEQ ID NO: 317014 - RNA, 64 nt, Human
cuaccuucucaugcucugagguacuacugccucugcagcacaaauuucuauuucugucaauaaa

SEQ ID NO: 317015 - RNA, 64 nt, Human
gugcucaaggauuggagaggagacaaaaccaggagcagcacaguggggacaucucccgucucaa

SEQ ID NO: 317016 - RNA, 64 nt, Human
guagaggggagugguauguguuuucucaguggaagcagcacaugagugggugacaggauguuag

SEQ ID NO: 317017 - RNA, 64 nt, Human
aaacagaaucagugacccgggugcuuuguggccagcagcacagaaucaaacccgcaucccagca

SEQ ID NO: 317018 - RNA, 64 nt, Human
uuccaaaguucucaguuaucaagaccucauccagcucguccaaaggcuucagggauggaaacaa

SEQ ID NO: 317019 - RNA, 64 nt, Human
caugccaacaugcugagcaugcucacaaagaaggcucguccauuccuccuguguuuuaguauuu

SEQ ID NO: 317020 - RNA, 64 nt, Human
cucaagucucccacccuugacugguugggauuugcucguccagccucuagacacuucccaaagc

SEQ ID NO: 317021 - RNA, 64 nt, Human
gagagggaaagacauucagacccacagaaaggaggcagcacacagagaaagaugcacagaucaa

SEQ ID NO: 317022 - RNA, 64 nt, Human
gggcuguguauuaaaugguuuuauuuucaguuuugcagcacagaacacuguugaaauauccaua

SEQ ID NO: 317023 - RNA, 64 nt, Human
acauuugguagacaugugcuuugacauagcgugagcagcacauuacuaaagcaauuacaugcau

SEQ ID NO: 317024 - RNA, 64 nt, Human
gugugcaaaagcagugggcuccuggcagaagggagcagcacacgcguuauaguaacucccauca

SEQ ID NO: 317025 - RNA, 64 nt, Human
ucuccuaggguuauguccaguugggguuuuuaaggcagcacagacugccaaguacuguuuuuuu

SEQ ID NO: 317026 - RNA, 64 nt, Human
aauagaaugcagcuggaggcuacgcauggccucugcagcacacgcagcuggagagggcuucugu

SEQ ID NO: 317027 - RNA, 64 nt, Human
gagauauacuaacguaaaugacgaguuaaugggugcagcacaccaacauggcacauguauacau

SEQ ID NO: 317028 - RNA, 64 nt, Human
uccaaagauauaagaaauuuugauaugucugcaugcagcacagaacuuugaaccuaggaggcag

SEQ ID NO: 317029 - RNA, 64 nt, Human
aaaacaacugacccagagaagcuaaaagccacuggcagcacaggcugacaaaauggaagcaaag

SEQ ID NO: 317030 - RNA, 64 nt, Human
agacgugccacugccccaccaccagcugaaaacagcagcacaucgcuggcuuuuccccuugugu

SEQ ID NO: 317031 - RNA, 64 nt, Human
uguccuaggcuucugaugaucauuguugccagaugcagcacauauacuaaauaugagacagggu

SEQ ID NO: 317032 - RNA, 64 nt, Human
uccccagugacagaaguagagaagagaauggaaagcagcacacuccguccccucuagucuggag

SEQ ID NO: 317033 - RNA, 64 nt, Human
aucaaagcaguagccacauggugcuggcuccuuugcagcacaaaccuggucauuuugaugacug

SEQ ID NO: 317034 - RNA, 64 nt, Human
gccauagagaggaggagaagaaacuaaccaacaugcagcacaagaaggggagcugucagucgug

SEQ ID NO: 317035 - RNA, 64 nt, Human
uccauguggagagagcacugugugcgcagcggcagcagcacagacguccaugaggaaaacuccc

SEQ ID NO: 317036 - RNA, 64 nt, Human
gucucuguuugcugcccaaggcagcaguucaugucucguccauguccauguucguguuagcacu

SEQ ID NO: 317037 - RNA, 64 nt, Human
guggggaaggguuucuccuccaugaucgacccuccucguccaccuacaaaucaggaacagaaag

SEQ ID NO: 317038 - RNA, 64 nt, Human
ggcauggucccuggagccgagccuucaccacgcacucguccaaguucggaugcgggaaccuggu

SEQ ID NO: 317039 - RNA, 64 nt, Human
guuagcagaugcccuucaaauauauuuuacguuugcagcacaacaccauugcccggaggcuucc

SEQ ID NO: 317040 - RNA, 64 nt, Human
aguaggacucacuucucugauuaauaagcaauuugcagcacacagcguuccacugcgggguuuc

SEQ ID NO: 317041 - RNA, 64 nt, Human
auuugaaauauggucuuuugguuaugaauacuuugcagcacagcugagaggcugucuguuguau

SEQ ID NO: 317042 - RNA, 64 nt, Human
uaauuccucugaaaacaugaguauuuugaguucugcagcacaaugacuguaggacuaagcuaag

SEQ ID NO: 317043 - RNA, 64 nt, Human
cugccacuccagcaggcgucgguucaaggccugagcagcacagggacauggacccagccacgcu

SEQ ID NO: 317044 - RNA, 64 nt, Human
guuuuccuuguuuucagcccccccacuccagcccgcagcacauuuccgcuguccgucaguaauu

SEQ ID NO: 317045 - RNA, 64 nt, Human
aucguauauuuggccauuguugaccaaaaguuaugcagcacaucauuauaauuuugauguguca

SEQ ID NO: 317046 - RNA, 64 nt, Human
aaucagacuaacaguugaaucauugcuguuggaggcagcacaaauuuauguguuacaacaguag

SEQ ID NO: 317047 - RNA, 64 nt, Human
gaaaggggcuugccugaggucacguagauaaucagcagcacauugaacgcugcacuccugggcu

SEQ ID NO: 317048 - RNA, 64 nt, Human
aauccaaagcauuuugguuuauccaggacccagggcagcacagcugucaccaagcaggagaguu

SEQ ID NO: 317049 - RNA, 64 nt, Human
aaugucaugcucccuggggcaggaccuugagccugcagcacacacuaggccaccugcagucuca

SEQ ID NO: 317050 - RNA, 64 nt, Human
guuugugguauaaaaaggaaguggggacagauucgcagcacagagucgcuggcauguuucacuc

SEQ ID NO: 317051 - RNA, 64 nt, Human
cgcuucugccugcguuccaugcugucuggggagagcagcacacuggccgcccagcacugcugcu

SEQ ID NO: 317052 - RNA, 64 nt, Human
ggaacccuaaagcaguaaaauaaaaaaccugguugcagcacauucacacuguuguccuuaaaau

SEQ ID NO: 317053 - RNA, 64 nt, Human
uguagaagaauauauucaaaguuaaaauucaguggcagcacagauuauuuuuaucagagcugua

SEQ ID NO: 317054 - RNA, 64 nt, Human
cucuugcguauuucuggaucuccuucccuccuuucucguccaaaucaugaaauguuuggccuua

SEQ ID NO: 317055 - RNA, 64 nt, Human
caggguccuuacccccagccaccaccugccccgccucguccacgccugcgcccacuaucauccc

SEQ ID NO: 317056 - RNA, 61 nt, Human
agcgcaucaguguucucugagguccugugcccucguccagcugcugcccuccacagcgguu

SEQ ID NO: 317057 - RNA, 64 nt, Human
gcuucuagacuguuggcaagaguagcaagaugcugcagcacauugacuauagaaugagauguau

SEQ ID NO: 317058 - RNA, 64 nt, Human
ccugcuucuacucagcccugccaugcuauggggugcagcacaaacccaggacccaggccuagcc

SEQ ID NO: 317059 - RNA, 64 nt, Human
gcucgcuacuuugaugaacucuuucugagagacugcagcacaccuagagggcccuuuccugcuu

SEQ ID NO: 317060 - RNA, 64 nt, Human
aaacuagaaugagagggaagagauagcauggcaugcagcacacacggcugcuccaguucauggc

SEQ ID NO: 317061 - RNA, 64 nt, Human
aaaacacaaaugacagauauggaagaaaauauuugcagcacauaaaaaaaucaacgaguacaau

SEQ ID NO: 317062 - RNA, 64 nt, Human
gcacguuuucuucauugauaaguggaggagaaaugcagcacagcuuucaagauacuauuuuaaa

SEQ ID NO: 317063 - RNA, 64 nt, Human
caaaagacugagaggcaaaacuuggcuuuuagcugcagcacauagcccuguuauauuugauuua

SEQ ID NO: 317064 - RNA, 64 nt, Human
uuguaaaaugagaaccgauuuucaguuuaguguagcagcacacuuguucagguuugcaugguau

SEQ ID NO: 317065 - RNA, 64 nt, Human
uauguacauuuuccccuuuguuaaacaauuaacagcagcacacucugggaccaccagcuauuuu

SEQ ID NO: 317066 - RNA, 64 nt, Human
ccugggugugccucgcugcuggggcucugcaggggcagcacagcuggggugcaggccaggcugc

SEQ ID NO: 317067 - RNA, 64 nt, Human
caccuucgcuuugcaucucgguagaggagaaacggcagcacagcccaaggaccaaaggaggggg

SEQ ID NO: 317068 - RNA, 64 nt, Human
ucccuuugaugcuuugguggccuugccccgcucugcagcacagacaggccagaugcauuugucc

SEQ ID NO: 317069 - RNA, 64 nt, Human
cuguggcaggacuggcccagggaggaggaagccagcagcacaccuggggaauggggucccggcc

SEQ ID NO: 317070 - RNA, 64 nt, Human
caccaccuugggccccacggugccacgggcucaggcagcacaguagggcgccgggccuuuggga

SEQ ID NO: 317071 - RNA, 64 nt, Human
ggaccaagcaguuaccgagcgaggcacucacugggcagcacauccagccagacccgaccagcuc

SEQ ID NO: 317072 - RNA, 64 nt, Human
ucgccccccaccuccacaggugccuuaaagggcccucguccacccaagguggggggcaggggcc

SEQ ID NO: 317073 - RNA, 64 nt, Human
agccugggcucagccuucugcaucaggacauggccucguccacugagggcacgauuuaaacauu

SEQ ID NO: 317074 - RNA, 64 nt, Human
cucccaaagugcugggauuacaggcaugagccaccgugcucagccgcaaaauucuuuaugaauu

SEQ ID NO: 317075 - RNA, 64 nt, Human
uaccuuuagauaaaaacaaagaagaguaauauaugcagcacagugacguuaggauucugguaau

SEQ ID NO: 317076 - RNA, 64 nt, Human
ugagucaggagcaaggaacguccagggagugggagcagcacaugcgcgugcuguggcaggagga

SEQ ID NO: 317077 - RNA, 64 nt, Human
ucggugagccaugugcaccuauggcccagccacugcagcacaggaggcuccgugagcccuuggu

SEQ ID NO: 317078 - RNA, 64 nt, Human
uggccacuuuaaucuagggugaccuagcaauccugcagcacagggcagagaguacugucuuagg

SEQ ID NO: 317079 - RNA, 64 nt, Human
gugucuagaaaacagacuggggaaccuuaugugagcagcacaucccaccagugaaacaggguau

SEQ ID NO: 317080 - RNA, 64 nt, Human
cugcccaucgggacgcccggccagccgcucgggcgcagcacaagggacaggggaccaaggucag

SEQ ID NO: 317081 - RNA, 53 nt, Human
gucaaagugacaugcucugagaggcagcacacacagaauaacccugcauccaa

SEQ ID NO: 317082 - RNA, 64 nt, Human
accgaugcaggaggaagcaagcgugucuuccccugcagcacacagcgacuugcguugacaaagg

SEQ ID NO: 317083 - RNA, 64 nt, Human
aagcagcuaccauuccauggacuugccucccagagcagcacaaugcccgucugagccccacgug

SEQ ID NO: 317084 - RNA, 64 nt, Human
auccaaguugagcacgcgccuuccccagcuugcagcagcacaccccaagcgcugcuuuucaccu

SEQ ID NO: 317085 - RNA, 64 nt, Human
ugguuuugaccccaccugauccuccuuuccucaugcagcacaagugcucaccggggccagagcc

SEQ ID NO: 317086 - RNA, 64 nt, Human
ccucuaagaucuugccucuuuccuccucaugaaagcagcacacauuguguuaacuuaugucucu

SEQ ID NO: 317087 - RNA, 64 nt, Human
uuucauaaaacuaaccgaaguuuuguuuacugaugcagcacaagagauguaaaaaaaaaaaaaa

SEQ ID NO: 317088 - RNA, 64 nt, Human
cccaaacaaaccaaaauuuaaaugaucagaauuggcagcacaaagaaaacgcccucuccugacu

SEQ ID NO: 317089 - RNA, 64 nt, Human
cacagaaaacuccugcugauggucucagcuuccagcagcacaaaagcagaugauguacuggaaa

SEQ ID NO: 317090 - RNA, 64 nt, Human
auugcugcagggccaagcccuuuuuagugcugugcucguccagcucaccaccacagccccucuc

SEQ ID NO: 317091 - RNA, 64 nt, Human
gcugcuccgcccuugccuuggggccgagggagcccucguccaccccugcacagcagcugggcac

SEQ ID NO: 317092 - RNA, 64 nt, Human
gaggguccccagccucucaccggccccagcugaccucguccauucagccccugccaggccaagc

SEQ ID NO: 317093 - RNA, 64 nt, Human
ucaaccaggucaaugccgggcaccuguucgugcagcagcacacacacccuaccuuccacgcgcu

SEQ ID NO: 317094 - RNA, 64 nt, Human
uuccaaaaaagacacuuguacacgcauguuuauagcagcacaauuugcgauugaaaacauaggg

SEQ ID NO: 317095 - RNA, 64 nt, Human
gggcccaaaccuauuuguaaccaaagagcugggagcagcacaaggacccagccuuuguucugca

SEQ ID NO: 317096 - RNA, 64 nt, Human
uucacccugcagugagggaagaggccaccagguggcagcacagccacacccguucccacgucag

SEQ ID NO: 317097 - RNA, 64 nt, Human
auccugagccccugcaugcacccagggccacccggcagcacacucaucccgcgccuccagaggc

SEQ ID NO: 317098 - RNA, 64 nt, Human
ggcaggcgccccuguacgucugcucaugcaccaggcagcacagccgcaguuccucaguuguugu

SEQ ID NO: 317099 - RNA, 64 nt, Human
agacacgggaugacgggaagcaggaagcggggcagcagcacagcgugggguccuggcacugcag

SEQ ID NO: 317100 - RNA, 64 nt, Human
uuguacagagaugguggcugaugucaaucucccugcagcacagcuccaggugagucucccugau

SEQ ID NO: 317101 - RNA, 64 nt, Human
gaagccaguccuguuccucuaaccagcaacgugggcagcacagugaaggguggacaaaacucga

SEQ ID NO: 317102 - RNA, 64 nt, Human
ucuguggugagaguccuguaggaucccugcucaagcagcacagaggaaggggcaagacguggcc

SEQ ID NO: 317103 - RNA, 64 nt, Human
uacaaguggucuggguuagaggcgagccuggcaggcagcacagacugaacucagagguagacag

SEQ ID NO: 317104 - RNA, 64 nt, Human
cccuccaauucagacucagcugacuguugagagagcagcacaucauuuuaucauuuuaucuucu

SEQ ID NO: 317105 - RNA, 64 nt, Human
cacaauagacaucaucguuuggcccucucuguuagcagcacauucaaccauuuguuuucaguca

SEQ ID NO: 317106 - RNA, 64 nt, Human
gacuuccggguaaggggagucaauugauuacccagcagcacaguauuugcuuuuuauaauuccc

SEQ ID NO: 317107 - RNA, 64 nt, Human
gccccaagguugccccgggccagcagcccagccagcagcacagucucuauggugcugaggaaga

SEQ ID NO: 317108 - RNA, 64 nt, Human
cacagcuccucucuggggcacccuaucugcuugucucguccaggaagcguuagggcugaugggu

SEQ ID NO: 317109 - RNA, 64 nt, Human
uuuaauucuuacuguacuuggcaugcgcaauaaagcagcacauguaaaaaaaaaauacacagug

SEQ ID NO: 317110 - RNA, 64 nt, Human
ucaaaaaaucauuacauuucuauuucuugguggagcagcacauuguggagugugauucuuaauu

SEQ ID NO: 317111 - RNA, 64 nt, Human
uaacgucccuggguaaccuaauggccacuggcuagcagcacacaaucucgccagggaaaaucug

SEQ ID NO: 317112 - RNA, 64 nt, Human
uuuaauuuauuuacaugcugucuguuaucuucaagcagcacaaaauaugcauauaaaagugaug

SEQ ID NO: 317113 - RNA, 64 nt, Human
ugcgggcugggcagcuguuagaguccaacguggggcagcacagagagggggccaccuccccagg

SEQ ID NO: 317114 - RNA, 64 nt, Human
cgccccuucuccaucgucccaggaaucccagggggcagcacagccggcccccggcccacguuuu

SEQ ID NO: 317115 - RNA, 64 nt, Human
aaauccucaauaaaauacuggcaaaccgaauccagcagcacaucaaaaagcuuauccaccauga

SEQ ID NO: 317116 - RNA, 64 nt, Human
uggggccgaugagguggacucagccaaagacucagcagcacauggggcagguguccuggcaggg

SEQ ID NO: 317117 - RNA, 64 nt, Human
gaguuggccagauuguggggugcagcuggguggggcagcacaccucuggggggauaaugucccc

SEQ ID NO: 317118 - RNA, 64 nt, Human
cagggcguuccguucauucuuucaguaaauguuugcagcacauguguuacaugucaggcaguga

SEQ ID NO: 317119 - RNA, 64 nt, Human
ccccucccccuaauguaaaugacgaguuaauggugcagcacaccaacauggcacauguauacau

SEQ ID NO: 317120 - RNA, 64 nt, Human
gggcuggucccagaacaggcagucucacaagcacgcagcacacuggaguggacgccugugccca

SEQ ID NO: 317121 - RNA, 64 nt, Human
cgcgcccagucucuccccacguucuugaacucgggcagcacauccucacagaaaucuaggaacu

SEQ ID NO: 317122 - RNA, 64 nt, Human
cccugcagaugcagcagauguacgacaugaucaugcagcacaagcgggccaugcaggacaugca

SEQ ID NO: 317123 - RNA, 64 nt, Human
ucuguauuuauuauguguauccccagcuauguaugcagcacagcccaucuccuuuuucuguguu

SEQ ID NO: 317124 - RNA, 64 nt, Human; identical to SEQ ID NO: 262736

SEQ ID NO: 317125 - RNA, 64 nt, Human; identical to SEQ ID NO: 262741

SEQ ID NO: 317126 - RNA, 64 nt, Human; identical to SEQ ID NO: 262742

SEQ ID NO: 317127 - RNA, 64 nt, Human
cucauccuccuccuccuccacuugcagcgagacggcagcacagaccccuggagguccagggggg

SEQ ID NO: 317128 - RNA, 64 nt, Human
agccgcuccugguaucagagcugcuuuccagagggcagcacagccagggccgggugucuuuagg

SEQ ID NO: 317129 - RNA, 64 nt, Human
ugugaaagcuaaccaugcuaaccaccaaggcaaagcagcacagugugaauagaacagagcggga

SEQ ID NO: 317130 - RNA, 64 nt, Human
cggggauucuggacuggcucccuccccuccuguugcagcacaaggccggggucucuggggggcu

SEQ ID NO: 317131 - RNA, 64 nt, Human
gcaggcccaggccagccagggcuucgucaggccugcagcacaauuugacuuccuaugcccaggc

SEQ ID NO: 317132 - RNA, 64 nt, Human
aacauugaaagugagcggaggacuugggggcagagcagcacaaagaaacagccuuacacugggc

SEQ ID NO: 317133 - RNA, 64 nt, Human
gccgguggguccacuccaacucccccugaguguagcagcacacuuuccauacaccagguucuuu

SEQ ID NO: 317134 - RNA, 64 nt, Human
cgagacagacccucugccgcugcuuccaggcugggcagcacaaggccuugccuggccugaugau

SEQ ID NO: 317135 - RNA, 64 nt, Human
uucuccugcagcacuccaaaacccacucugcacugcagcacagugaaugauaugcacucaccau

SEQ ID NO: 317136 - RNA, 64 nt, Human
ccggggcucugcguggcuugcugggaggugggcugcagcacagaggccugugacugcguuccag

SEQ ID NO: 317137 - RNA, 64 nt, Human
gagacaggagaucaccauaagcgucccugauauagcagcacacauuuucacguuuccacuuaaa

SEQ ID NO: 317138 - RNA, 64 nt, Human
augcaaaccuuugugacuuccuuuggaggacuuggcagcacagcaugcccccgugaccugccug

SEQ ID NO: 317139 - RNA, 64 nt, Human
cuuugggggacaggcuucuccugugagcagcagagcagcacaauaaaugaggccacugugccag

SEQ ID NO: 317140 - RNA, 64 nt, Human
ccuucuugggcacugcacugcugccucaccaguggcagcacaaggugcacuucauggucucacu

SEQ ID NO: 317141 - RNA, 60 nt, Human
aguccuccuccgaggccuaggccgcccccagcagcacagaccccgccgccuccuacggcc

SEQ ID NO: 317142 - RNA, 64 nt, Human
gagacgcccagccccaucccuguccucaugaccccucguccaccccccacacacacuauaaggc

SEQ ID NO: 317143 - RNA, 64 nt, Human
agagguuuccagcugacuagaacccucuuuucuacucguccaaaccacucccgucaccugccuu

SEQ ID NO: 317144 - RNA, 64 nt, Human; identical to SEQ ID NO: 262680

SEQ ID NO: 317145 - RNA, 52 nt, Human
augucgccuacaacaugugagcgcagcacaccggcccaggugccggagauga

SEQ ID NO: 317146 - RNA, 64 nt, Human
gcugcccccaggacaugcaggauuucugcagggggcagcacagguucugggauugugaggcugu

SEQ ID NO: 317147 - RNA, 64 nt, Human
ugugguucccauguucucuaacagggccagcugagcagcacaggccaggaggccacaguguaag

SEQ ID NO: 317148 - RNA, 64 nt, Human
aacgcuccuucugaagaaauggggcccuguagcugcagcacaggggaagggcccggcacccuuu

SEQ ID NO: 317149 - RNA, 64 nt, Human
cuugaaauggauuucuaggucacuggggacuccggcagcacauucggcuucagaauaaagggcg

SEQ ID NO: 317150 - RNA, 64 nt, Human
cucugggggacuggcuuccccugugagcagcagagcagcacaauaaaugaggccacugugccag

SEQ ID NO: 317151 - RNA, 64 nt, Human
cucugggggaccggcuuccccugugagcagcagagcagcacaauaaaugaggccacugugccag

SEQ ID NO: 317152 - RNA, 64 nt, Human
gcuugcuuuagggcugagcccuggacucccagcagcagcacaguucagcauuguguggcugguu

SEQ ID NO: 317153 - RNA, 64 nt, Human
cacuaaauaucuagugcuaaaccuaucuguauuggcagcacagcuacucagaucugcacuccug

SEQ ID NO: 317154 - RNA, 64 nt, Human
ggaaggaaggaacuacaagagagucggagaugaugcagcacacacacaauuccccagcccagug

SEQ ID NO: 317155 - RNA, 64 nt, Human
uacagcaugugacuacugaauacuauaggcaauugcagcacaaugggaaauauuuguguaucua

SEQ ID NO: 317156 - RNA, 64 nt, Human
uuguuggcagccagacaaggguggggcuccacaggcagcacaggcgccccaccaccacccaguu

SEQ ID NO: 317157 - RNA, 64 nt, Human
aguuacuaacuucuccaaggagcaugucacuccagcagcacaggggacgcaaugggaggcaggg

SEQ ID NO: 317158 - RNA, 64 nt, Human
gcugggagguccggaucguuccugcagggaagcggcagcacacggagaccacuugguugaauuc

SEQ ID NO: 317159 - RNA, 64 nt, Human
cuucugcccgccccaucgaggaggccccucgggggcagcacaucuuccuccucgcaggagggac

SEQ ID NO: 317160 - RNA, 64 nt, Human; identical to SEQ ID NO: 262723

SEQ ID NO: 317161 - RNA, 64 nt, Human; identical to SEQ ID NO: 262724

SEQ ID NO: 317162 - RNA, 64 nt, Human; identical to SEQ ID NO: 262746

SEQ ID NO: 317163 - RNA, 64 nt, Human
gcacgauuucauguuccuaaacccaugucuuagggcagcacagagccaggucaugucaugcccc

SEQ ID NO: 317164 - RNA, 64 nt, Human
ggugggugguuuggccuugaggacgcuagggcaggcagcacaccuggauguggacuuggacucg

SEQ ID NO: 317165 - RNA, 64 nt, Human
guucuugauuaguuuggcacuccauuacguggaggcagcacagugcagacagaccuaauggcuc

SEQ ID NO: 317166 - RNA, 64 nt, Human
ugugugcuuuuggagagaauguugauuggcaaaagcagcacaguauuaauauuuagaguaggau

SEQ ID NO: 317167 - RNA, 64 nt, Human
uugggugggggguggggggugguugaggggggaggcagcacagugcagcaaauguuucuuggga

SEQ ID NO: 317168 - RNA, 64 nt, Human
aauuuuccuuuacaaugcaaacaugccacugguggcagcacaugguaauuuguggauuuuuuuu

SEQ ID NO: 317169 - RNA, 64 nt, Human
ucuggugacugaguguaaaauaugugccaagucugcagcacagugaccaaaucugacaaucgag

SEQ ID NO: 317170 - RNA, 64 nt, Human
cccacccccugcccaccucuccaggcucugcucugcagcacacccgugggugaccccucacccc

SEQ ID NO: 317171 - RNA, 64 nt, Human
uucuccucaccuaaacccaucuccuacuuugggcgcagcacacauauuuucuugucaacuuuuc

SEQ ID NO: 317172 - RNA, 64 nt, Human
uaggcuuggccuugacaugcuucuucgaggguuggcagcacaccgggaggggaugcuuggacaa

SEQ ID NO: 317173 - RNA, 64 nt, Human
acucuccauuauagcuuucacacgguuuggaugugcagcacauccaaggcaaccacagcugugg

SEQ ID NO: 317174 - RNA, 64 nt, Human
uuucaaggaacuguguguuuccaacaucaugguagcagcacacacuuccaaagcucagccaggg

SEQ ID NO: 317175 - RNA, 64 nt, Human
gccuuucacggcugcugacuucucagggcugcaagcagcacagaauguuauccuuacguccuga

SEQ ID NO: 317176 - RNA, 64 nt, Human
guggguaucacacugagugugaguuguguccacacgugcucaagcagaaggacuuuugugucca

SEQ ID NO: 317177 - RNA, 64 nt, Human
acaagucuuagugcuugggagggaggccccgcugcgugcucagacucacagccaaccuggaagg

SEQ ID NO: 317178 - RNA, 53 nt, Human
gcgaggccagaguccaauaaacucgugcucaucugcagccuccucugugacuc

SEQ ID NO: 317179 - RNA, 64 nt, Human
uccccuacccagggaacuggaccuggcagggcaccgugcucauguggcuccaaggacaagcaug

SEQ ID NO: 317180 - RNA, 64 nt, Human
gccauuuuacagaugggagaacagucucagcacaauugagcagcuugcccagcuaggagcagca

SEQ ID NO: 317181 - RNA, 64 nt, Human
gacccgggcuuggggcuggccaauggggagcuggauugagcagaacccagacccugaguccuug

SEQ ID NO: 317182 - RNA, 64 nt, Human
accauuuauuguugugauguuuaaguuauaacuuauugagcacuuuuaguagugauaacuguuu

SEQ ID NO: 317183 - RNA, 64 nt, Human
gaauuauuuguauguaugagguaugauuguaaagauugagcauuggaagggguaucagagacca

SEQ ID NO: 317184 - RNA, 64 nt, Human
ugacgacacccacaacauacaugagaguaaugggauugagcauuuauggcagcaacagaggagc

SEQ ID NO: 317185 - RNA, 64 nt, Human
uuaaacuuuucauuacacuaaagugcauuauuuuauugagcaaguauccuucauugugagguuu

SEQ ID NO: 317186 - RNA, 64 nt, Human
ccaucagguugcugggaguggagauggagggauuauugagcagaaaaugaguuggauggagaua

SEQ ID NO: 317187 - RNA, 64 nt, Human
aaacuguuuuguaaugaaagaucuucauugggggauugagcagcauuuaauaaagucuauguuu

SEQ ID NO: 317188 - RNA, 64 nt, Human
uaguuauagaugauuacuugugaugugaaacugaauugagcaugacaaccagacauuuccaguu

SEQ ID NO: 317189 - RNA, 64 nt, Human
uggaguaccuacuauaauacaguagcuaacauguauugagcacagauuuuuuuugguaaaacug

SEQ ID NO: 317190 - RNA, 64 nt, Human
ccuggccgguuaacaucuuuuaauuguuuccaggauugagcagguucucagcugggcucugaua

SEQ ID NO: 317191 - RNA, 64 nt, Human
uauuaaaaaaaaagaagguaacugauaaaccaaaauugagcauaguaauuacccacagaaggag

SEQ ID NO: 317192 - RNA, 64 nt, Human
ucaagcuggagaaaugaguccugauagacugaaaauugagcaaauggaagaagauacaguauug

SEQ ID NO: 317193 - RNA, 64 nt, Human
ugucuguuugcugauggucuggucuauguuccgaauugagcacaaaaccuguccuaugaaugcu

SEQ ID NO: 317194 - RNA, 64 nt, Human
gugugguggugacucauuuccauaccauuguggaauugagcagagaaccugcucucggaggaug

SEQ ID NO: 317195 - RNA, 64 nt, Human
aaguccagucugaauccauggggcugaaggguaaauugagcaguucaugacccaggauaucuga

SEQ ID NO: 317196 - RNA, 64 nt, Human
cuggcuuuuuucuuuccucccuuaccccaaauucauugagcacuuaaaggagcagagaugcagc

SEQ ID NO: 317197 - RNA, 64 nt, Human
gauguugauucuuaacugcuacagauaaccuguaauugagcagauuuaaaauucaggcauacuu

SEQ ID NO: 317198 - RNA, 64 nt, Human
gguuccaggaaucucauucauucauucaguauuuauugagcaucuaguauaagucugggcacug

SEQ ID NO: 317199 - RNA, 64 nt, Human
auguaccuaucuuggugaugggugggggccaagaauugagcaugacaucuuccccagcagccac

SEQ ID NO: 317200 - RNA, 64 nt, Human
uaggaaguuuuuuugcagagagugcugguaaagaauugagcaaguuugcuauuguauuguaaug

SEQ ID NO: 317201 - RNA, 64 nt, Human
ugaaccuggcaaguguagguugcagugagcugagauugagcaacuguacuccagcuuggcgaca

SEQ ID NO: 317202 - RNA, 64 nt, Human
aaagaaaaguagcugucaacaaggggaaagugaaauugagcaauucacuguuucaggauacuug

SEQ ID NO: 317203 - RNA, 64 nt, Human
ugugacacuauuggaugugauucuaaaagcuuuuauugagcauugucaaauuuguaagcuucau

SEQ ID NO: 317204 - RNA, 64 nt, Human
aggcaaaagaaaaaauacauguuuuuaagaaaacauugagcagagaacugcagccaggaugcgc

SEQ ID NO: 317205 - RNA, 64 nt, Human
ggcuccaaaagccaacgugaacaauuaaaaauguauugagcaucuacucuguagcagguccugu

SEQ ID NO: 317206 - RNA, 64 nt, Human
uuagggaaaaggugaaaaagaaaaaaugguaguaauugagcagaaaaaaauuaauuuauauaug

SEQ ID NO: 317207 - RNA, 64 nt, Human
cagauucuaccaucaggugcuauaaguguuugggauugagcaucauacuggaaagcaaacaccu

SEQ ID NO: 317208 - RNA, 64 nt, Human
cauaucuuuaaacuuucuugcaucaguauucuaaauugagcaaacugaaagauuuucaucagga

SEQ ID NO: 317209 - RNA, 64 nt, Human
auucuaaguaucuuuagcccaaauaccaugacauauugagcaucuuuaaauaaccagacuguau

SEQ ID NO: 317210 - RNA, 64 nt, Human
aguuuuuggaaaugguccuguuacuccagagaaaauugagcagcucagguaagaacacaauaaa

SEQ ID NO: 317211 - RNA, 64 nt, Human
aacaaacaaacgaaaaacauuucaaaagguauuuauugagcaccugcaggcgugaccugacagc

SEQ ID NO: 317212 - RNA, 64 nt, Human
ugggaguuuguaaaaugaggugauacaguucugaauugagcauuccuuuaugauauucacucug

SEQ ID NO: 317213 - RNA, 64 nt, Human
ggccugaccuaggcuugggagucaaacugcucauauugagcauauuguuaaguggguaaagcca

SEQ ID NO: 317214 - RNA, 64 nt, Human
aagggcagguugaaucaaggugaaucaaucugaaauugagcacaccugccugccaucgcuguuc

SEQ ID NO: 317215 - RNA, 64 nt, Human
guaauguucaugucauaacuuuuaguuaauugccauugagcaccuguucugaggaggugagaug

SEQ ID NO: 317216 - RNA, 64 nt, Human
uaccuuucuuugugaggcaauggaguggucuaggauugagcaaaaagcaauuuuuguuacaucu

SEQ ID NO: 317217 - RNA, 64 nt, Human
uuuuuuaacuuuugugucaaauaggaguugaggaauugagcaggauucuacccuaguccgauug

SEQ ID NO: 317218 - RNA, 64 nt, Human
cccucaucaucugugccuggaagaguucacugucauugagcagcacagccugagugcuggccuc

SEQ ID NO: 317219 - RNA, 64 nt, Human
uccuuuuagugauaaacaguagcagccugcguuaauugagcaccuacugugugucugagcauuu

SEQ ID NO: 317220 - RNA, 64 nt, Human
aagacccucaucucugggcuacacggugauucagauugagcaccaacuuguuuccuccccucaa

SEQ ID NO: 317221 - RNA, 64 nt, Human
aaaggcccauuacuuuuaagguaugugcuguccuauugagcaaauaacuuuuuuucaauugcca

SEQ ID NO: 317222 - RNA, 64 nt, Human
uuucgaaacuucaagaaacuucaauaagggaugcauugagcagucugacagugagaauaaagaa

SEQ ID NO: 317223 - RNA, 64 nt, Human
aacgaauccaaaguguucucacacgucacauacgauugagcaucuccaucuggucgugaagcau

SEQ ID NO: 317224 - RNA, 64 nt, Human
guaccaauguauuuauuaacacuuguauuuuauuauugagcauaucaauaaaaauauuaaaaaa

SEQ ID NO: 317225 - RNA, 64 nt, Human
uauauuuagaacccuuccuguuuuaugucuguaccucguccaccccucagguaauaccugccuc

SEQ ID NO: 317226 - RNA, 64 nt, Human
uaguuacucauucagggauagcacugagcaaagcauugagcaaaggggucccauagaggugagg

SEQ ID NO: 317227 - RNA, 64 nt, Human
cagacacaguauuuuagggugcauccaguauaccauugagcauuguaaccucaggaaacaguuu

SEQ ID NO: 317228 - RNA, 64 nt, Human
uuccccagguaaguuuaagauucaaacaccaucuauugagcaccuacauugugugccagguagu

SEQ ID NO: 317229 - RNA, 64 nt, Human
gcuuccaccugaucccugacccugggauggcuggauugagcaaugagcagagccaagcagcaca

SEQ ID NO: 317230 - RNA, 64 nt, Human
cguuuuaauuacuauaguguuauguagagauuugauugagcagcuaauguuucugaacuuuacu

SEQ ID NO: 317231 - RNA, 64 nt, Human
uucauucauuccaugugugccacuaaauaaagagauugagcaagugccacuguguggaacauuu

SEQ ID NO: 317232 - RNA, 64 nt, Human
ggcggggagugacugaauaaacucugccuuuuaaauugagcaucugggccgggcaugguggcuc

SEQ ID NO: 317233 - RNA, 64 nt, Human
guguuucauuaacuguuggagauuaucacauuaaauugagcagauuuggaucuuuuacauuuga

SEQ ID NO: 317234 - RNA, 64 nt, Human
uuaaucccacuguggagacuucugggaacuauuuauugagcaggccugugccuccacaucaucu

SEQ ID NO: 317235 - RNA, 64 nt, Human
uauggacuugaggcccaccucuguguccaaguggauugagcauauaugccuaggaggagauaga

SEQ ID NO: 317236 - RNA, 64 nt, Human
ggagugggagacaccugaccuuucucaagcugagauugagcagaagaucaaggaguacaaugcc

SEQ ID NO: 317237 - RNA, 64 nt, Human
cuaauuauggcuuucaucauucauucauguauuuauugagcaccuacuuauuauggugcucaac

SEQ ID NO: 317238 - RNA, 64 nt, Human
caaauuggaggauuccuuugaggaaauguucucaauugagcaauucagucccucuccccaaaga

SEQ ID NO: 317239 - RNA, 64 nt, Human
uggaauauucuguucuugauccagaugaaaucugauugagcaguguacuuacaaguuguacugu

SEQ ID NO: 317240 - RNA, 64 nt, Human
aaugcaauuucauguuagagcuagaauaaaaguaauugagcagucauuugcaaaugcuucauua

SEQ ID NO: 317241 - RNA, 64 nt, Human
cauaacauuuauaccaaugaggcaaaaauaaagaauugagcaccaauaugaagucuccacuguu

SEQ ID NO: 317242 - RNA, 64 nt, Human; identical to SEQ ID NO: 121816

SEQ ID NO: 317243 - RNA, 64 nt, Human
uacagaagagguuucuuucugcaccaggaggaggcgugcucaaguaucgguacgagaucuagcc

SEQ ID NO: 317244 - RNA, 64 nt, Human
uuuuuuuuguuuguuuucuuaaaaguaccucugcauugagcauauuuucuuacuuuuauuauuu

SEQ ID NO: 317245 - RNA, 64 nt, Human
cuaggccugcaucccccauuuuauugcaucaaaaauugagcauugggaacaaaguuggggucaa

SEQ ID NO: 317246 - RNA, 64 nt, Human
caaggaaggaugggcauuuuguggcuuuuaauuuauugagcacuuggacauguagaucauuuua

SEQ ID NO: 317247 - RNA, 64 nt, Human
cuuuaacuuuuaaauaauaaugauaacuaucuuuauugagcaucuucuacauccuaggcauugu

SEQ ID NO: 317248 - RNA, 64 nt, Human
uguaaaauguacauuuaucaguugauaaguaccuauugagcaccaguuguauuuccaacuuuga

SEQ ID NO: 317249 - RNA, 64 nt, Human
aagagucauucauuccuucauuuagcaaguauuuauugagcaacugcuauguggcagauauguu

SEQ ID NO: 317250 - RNA, 64 nt, Human
auacgccucugacaugaguccagggagaggcaagauugagcaauagucaguggcaccauuuccu

SEQ ID NO: 317251 - RNA, 64 nt, Human
uuagaauugauuucuuugagugguauuucucuugauugagcagcuagacaaaauaaucugcaaa

SEQ ID NO: 317252 - RNA, 64 nt, Human
aauagcaaugcaagcagccuagcacagacuaagcauugagcauaauaggcccacauaauuuccu

SEQ ID NO: 317253 - RNA, 64 nt, Human
cuaaucuuccucuggaguuuuagugaaaggauuuauugagcagcuucuggaauauaaugugcau

SEQ ID NO: 317254 - RNA, 64 nt, Human
acaaaagguguuuaaggaugaacuaaauauuuuaauugagcauuuauauggauaaucauacauu

SEQ ID NO: 317255 - RNA, 64 nt, Human
aauuacuuaaggcagucuuucauggaauguuuugauugagcaaugaaauaaacaguccuccauu

SEQ ID NO: 317256 - RNA, 64 nt, Human
augacacuugcagggcaggcugaaaaguuuugagauugagcagcuugggaguuuguggccacug

SEQ ID NO: 317257 - RNA, 64 nt, Human
ugcuucuuuugagcacacuguaccuaccaucugcauugagcagaaagacuuuuguuuuacugaa

SEQ ID NO: 317258 - RNA, 64 nt, Human
uaaaaacuaagcuaaaaagaaccuagaaccuucaauugagcaguugugaaaauugcuaauggug

SEQ ID NO: 317259 - RNA, 64 nt, Human
aaauaauuaaaaaaauauauauauaauuuugagaauugagcauuuaauaaacugacuuuuguua

SEQ ID NO: 317260 - RNA, 64 nt, Human
ucggcaaagucuccgccccaacuugcuccaucuacggccgcagagcggcuggcaguuucuucga

SEQ ID NO: 317261 - RNA, 64 nt, Human
gaccccaggcuccaucccuggcuuccccagccugcggccgcaagcaaaaccaagcgcgagaugc

SEQ ID NO: 317262 - RNA, 56 nt, Human; identical to SEQ ID NO: 262749

SEQ ID NO: 317263 - RNA, 62 nt, Human
ggguccaagugagauucugagagucugcugggauugagcaaucaucuccugcccaaguuucc

SEQ ID NO: 317264 - RNA, 64 nt, Human
uuugagaaaaaguagggcuugggugcaaguaaagauugagcaggaaauaaaggaaaaucaagua

SEQ ID NO: 317265 - RNA, 64 nt, Human
uuuaaaaaaauuuuguggcagaauuaaauuucuaauugagcagauuagauugaauuaaauagaa

SEQ ID NO: 317266 - RNA, 64 nt, Human
gagaucuuaaacauucagucagucaucaaacauuauugagcaccuaacuauaugacaggcacuu

SEQ ID NO: 317267 - RNA, 64 nt, Human
uaaguguaaauguuaacagcaggagaaguuaagaauugagcaguucuguugcaugauuucccaa

SEQ ID NO: 317268 - RNA, 64 nt, Human
uugaaauguguaagaaccuaggagggaaaggaagauugagcaacauaggaaaaggggaagagag

SEQ ID NO: 317269 - RNA, 64 nt, Human
caugugacuugcagccuaccuguaauuucuauccauugagcaugcauggauauacccaauagua

SEQ ID NO: 317270 - RNA, 64 nt, Human
cuucauguaucaccuucacugacuccauugagucauugagcaucuguacauauccuucaccacc

SEQ ID NO: 317271 - RNA, 64 nt, Human
guucugagucuccaaauaauaauagccgacguuuauugagcacuuacuaugugcccaacccugu

SEQ ID NO: 317272 - RNA, 64 nt, Human
uagcugugcuaugagguuucuuugacuucaauguauugagcaugugaugggcuguuuaaagugu

SEQ ID NO: 317273 - RNA, 64 nt, Human
auuaugcugucuuugacuuagucagucaacacuuauugagcaccuacuaagugccaaacacucu

SEQ ID NO: 317274 - RNA, 64 nt, Human
ucuugcaaaaaaagaaauggguuucugcuaaugaauugagcagacaucuaauauuuuauaugcc

SEQ ID NO: 317275 - RNA, 64 nt, Human
ccuaugguguuuuuggaaguauuuggcauugcuaauugagcaguccauauaguacuacuuuuag

SEQ ID NO: 317276 - RNA, 64 nt, Human
uuaaaauauuuuauauagaaaagcuacaaaguaaauugagcaaugcuuuuaaaguuaucuuugu

SEQ ID NO: 317277 - RNA, 64 nt, Human
gagaaaaagcuuaaacauuucaccagaaaucuuaauugagcagcagucauaucgccacagcuuu

SEQ ID NO: 317278 - RNA, 64 nt, Human
auguaguugaauuucaguccuuacggguaaacagauugagcauggcucucuauucccucagccu

SEQ ID NO: 317279 - RNA, 64 nt, Human
agcgagguggaccccgaaacggacggcccggagcccgcaccagccccgcgccuacccgggccgc

SEQ ID NO: 317280 - RNA, 64 nt, Human
aagcccugugcuccggccauggccgcuguguccgccgcaccagccaccccaaagcccuccuccu

SEQ ID NO: 317281 - RNA, 64 nt, Human
ugccauguacaggcuugggguggcuccaggaagccucguccagugauauauuucucauagcauu

SEQ ID NO: 317282 - RNA, 64 nt, Human
aaaauucuaaaaaugaaauaaauauuguuauuuuauugagcaugaaaccccugugcauauuucu

SEQ ID NO: 317283 - RNA, 64 nt, Human
uaagauuccuagaaggaaucuuugguuaauucagauugagcaguuaaaguuuuugcuauuuacc

SEQ ID NO: 317284 - RNA, 64 nt, Human
uaauuuaaauugggcccugcugguuuguugaugaauugagcaacugagaacguggcgggcacua

SEQ ID NO: 317285 - RNA, 64 nt, Human
uauuucuauuuggaccacauauucuccauuuugcauugagcaguagaguacaguggaaagggaa

SEQ ID NO: 317286 - RNA, 64 nt, Human
gaaaggagaguacuuugguuucugagcaccgaauauugagcaauaugucagucacuaaaaggaa

SEQ ID NO: 317287 - RNA, 64 nt, Human
uaccucaacaagaagaauuugaagacuucaaaauauugagcagaauucauucauacuuaaaaau

SEQ ID NO: 317288 - RNA, 64 nt, Human
auguguguaugucuugucuaagguacugauuuguauugagcauuucaauauuauugaaugguuu

SEQ ID NO: 317289 - RNA, 64 nt, Human
ucuuugucuacacauguaaaacuuaccuuuuguuauugagcaggccuaucucuuucagauaguu

SEQ ID NO: 317290 - RNA, 64 nt, Human
cuuaaaagauaaagacauaaaugggacaauuguuauugagcaaaaaaccaaauuaucccacccu

SEQ ID NO: 317291 - RNA, 64 nt, Human
uuucuugggaagcuaauuuuguugaauguuuagaauugagcaaagauguaaauuuuugaagggc

SEQ ID NO: 317292 - RNA, 64 nt, Human
gcagaauauucacaaguuucuguugaccuuguugauugagcaugacuacuaaauauuauguaau

SEQ ID NO: 317293 - RNA, 64 nt, Human
aaauuaaagggugucuggaugccauguuaauuuuauugagcaugagaaaguauuugaagaaacu

SEQ ID NO: 317294 - RNA, 64 nt, Human
uugagaaaacauugcauuaaaucuuguagauuacauugagcaguauagacaucuucccaauauu

SEQ ID NO: 317295 - RNA, 64 nt, Human
cagggagugccuauacauccuguccagccacgacauugagcagcacgcccccuaucgccaccug

SEQ ID NO: 317296 - RNA, 64 nt, Human
uguagagcaaaacucuucucucaagguggaagccauugagcaucuccucuucuugaaggccaac

SEQ ID NO: 317297 - RNA, 64 nt, Human
ugcaugauguauugcuucuucacguuuuguuuuuauugagcacggaguagaauuccagggcugc

SEQ ID NO: 317298 - RNA, 64 nt, Human
gccgcggcaucgcuucugauggccccgaauccccauugagcagcacaaagcccguuugggguag

SEQ ID NO: 317299 - RNA, 64 nt, Human
uugcauccauaacaucuuaagcgggcagagguggauugagcacuauggagagauugucaucaag

SEQ ID NO: 317300 - RNA, 64 nt, Human
uuauguugauagcauguaggagugagaaaaagucauugagcauaaggaaugaguguuccugugc

SEQ ID NO: 317301 - RNA, 64 nt, Human
aucaugaaugugagucauuauguagcugucguacauugagcaaauaaacuuacagaucugacgc

SEQ ID NO: 317302 - RNA, 64 nt, Human
uuguagaaggagagaaaccaugcucucuagcaacauugagcaaaaaucauaaccacucaucuaa

SEQ ID NO: 317303 - RNA, 64 nt, Human
gagauaaccacaaccaggaagaacaaaucugggcauugagcaagcuaugaggguccccgggagc

SEQ ID NO: 317304 - RNA, 64 nt, Human
cuuauuuuugugagcaguuugccauucagaaaccauugagcaaaauaagucuauagaugggacu

SEQ ID NO: 317305 - RNA, 64 nt, Human
acuauuuaguuuauuaucgaaauuggaaggauucauugagcagcauagaaguuuguuuacaugu

SEQ ID NO: 317306 - RNA, 64 nt, Human
ugguauucuuucgagguauucuuuccaggccgagauugagcaccucauguaccuacgccacaga

SEQ ID NO: 317307 - RNA, 64 nt, Human
uauaugugaaaucuugcccagucacagagguagaauugagcacucacagaugcuccaguaagaa

SEQ ID NO: 317308 - RNA, 64 nt, Human
gauuuugguuugcauuucccugauggcgaaugauauugagcaucuuuucaugagcuuauuggcc

SEQ ID NO: 317309 - RNA, 64 nt, Human
cccacuuauuuuucaagguuuuaaaacagucuacauugagcauuugaaaggugugcuagaacaa

SEQ ID NO: 317310 - RNA, 64 nt, Human
gaauuguguaaacuagaucuuuagagaaguugccauugagcaaaguuauuuaaaugaguuaguu

SEQ ID NO: 317311 - RNA, 64 nt, Human
aguaauaauaaaacuauuucagauguauuauaugauugagcaaaugagaaaacauguugauguu

SEQ ID NO: 317312 - RNA, 64 nt, Human
aaauuuuuacuuucuuguauacaacaaugcuaaaauugagcagauugauaacugccagcaaacc

SEQ ID NO: 317313 - RNA, 64 nt, Human
uuggccuuuuaaaguuacuguuauguuuaucuauauugagcacagauaauggcauuauucuuau

SEQ ID NO: 317314 - RNA, 64 nt, Human
gcucuuuaaacacagagaccugccaagacgcccucucguccaacuaugcccaggcugaaguccu

SEQ ID NO: 317315 - RNA, 64 nt, Human
cuugccagacgugguuccagacggggagacgcaccucguccagaacgggauucagcugcucaac

SEQ ID NO: 317316 - RNA, 64 nt, Human
cucagggcuggagugcgcucuuggucccuggucccucguccacaggggcaggccugggacccag

SEQ ID NO: 317317 - RNA, 64 nt, Human
aucuggccccuggaauaaaaccauaguuccuaaaauugagcaucccuaagaguagcugcuuggu

SEQ ID NO: 317318 - RNA, 64 nt, Human
caugaauaucauaaaauuauguucuuugcauuauauugagcaagcagguucaaauacaguaacu

SEQ ID NO: 317319 - RNA, 64 nt, Human
uuuuuauugugguguuuuaaauauggggagggguauugagcauuuuuuagggagaaaaauaaau

SEQ ID NO: 317320 - RNA, 64 nt, Human
ucaggaaacuaaaaauauuaacaucuauuaaaaaauugagcauuuuucuacgcucgugugucuu

SEQ ID NO: 317321 - RNA, 64 nt, Human
cuuauggauguuucuucccuaaacuauguauggaauugagcaucauccagaauaaauagcguug

SEQ ID NO: 317322 - RNA, 64 nt, Human
auuuucuuguauuacccucuacaauauacuuuuuauugagcacuuugcugcugaaaugcugccu

SEQ ID NO: 317323 - RNA, 64 nt, Human
uaauuaauugugcuauauguugcuuuaacaacccauugagcagucagggaaugugaguaagcuu

SEQ ID NO: 317324 - RNA, 64 nt, Human
ucauuccuguguacaguagcuuaaaauugcagugauugagcauaaccuacuuguuuguauaaau

SEQ ID NO: 317325 - RNA, 64 nt, Human
guaaaaucuagguuuuuuucaacauuagcaguaaauugagcacuguuuacuguuucauuguacc

SEQ ID NO: 317326 - RNA, 64 nt, Human
acaucucuggauuuugugaugaaauauuaaaaauauugagcaaguuguugaaaaugcauuacua

SEQ ID NO: 317327 - RNA, 64 nt, Human
gauugauuucuuuccuaaagucccuagugacaugauugagcaguaaagaacggccaaaucacac

SEQ ID NO: 317328 - RNA, 64 nt, Human
aaaucuuaaaauaauuccaagcugagucuucuagauugagcagaaauggugaaaggaguauuga

SEQ ID NO: 317329 - RNA, 64 nt, Human
uguggucccuccaccuucaaaccagcaauggugcauugagcaaauuguggucaaauauacauca

SEQ ID NO: 317330 - RNA, 64 nt, Human
aguuaggggaacuucucuguaaagaacccuggguauugagcaaaaaccuuauuaucguuaauga

SEQ ID NO: 317331 - RNA, 64 nt, Human
augcucaguucuguaggcucucuauccuagaggaauugagcaaaacagaagaaucaugaagucu

SEQ ID NO: 317332 - RNA, 64 nt, Human
ccucaacugucaccacugcuaagggacucuauccauugagcacauuuuccuaaggcccugcugu

SEQ ID NO: 317333 - RNA, 63 nt, Human
gugcucaugaagcgcuccaucacggcaccgcuggccgcccacaucuccuuggugaacaaggcc

SEQ ID NO: 317334 - RNA, 63 nt, Human
gcgguacccggacaguuacgaguccauguccgagccgcccauugcucaucuuuugcgccccgu

SEQ ID NO: 317335 - RNA, 64 nt, Human
gccaggauuggcacaagcucccuggugagggagccucguccaaggcaguucuguguccucgcac

SEQ ID NO: 317336 - RNA, 64 nt, Human
agacauuggcacuuguguaaaacugucccugcagauugagcaggaaguaaaaacaaauggaaau

SEQ ID NO: 317337 - RNA, 64 nt, Human
cuucuuaacaggcuuaugauagguaucaaucaggauugagcacugaauuccaagcuccacuggc

SEQ ID NO: 317338 - RNA, 64 nt, Human
aggcaacccuaaagcauuccaagcaauauugcagauugagcaggcccuccagcugcuggccaca

SEQ ID NO: 317339 - RNA, 64 nt, Human
uuuugaacaauauugugaaaaugauugcauucucauugagcaugaaagucaaaacuggaauuuu

SEQ ID NO: 317340 - RNA, 64 nt, Human
ugugcucuugcauucucucauucccuuuuccucuauugagcagagccuggaguuugagacuaug

SEQ ID NO: 317341 - RNA, 64 nt, Human
gaggugaccacagcugcaguuagggaagggagccauugagcacagacuuuggaaggaaccuuuu

SEQ ID NO: 317342 - RNA, 64 nt, Human
uugacuuaccugacggaccccagagaccuauugcauugagcaguggggacuuaauauauuuuac

SEQ ID NO: 317343 - RNA, 64 nt, Human
cagaaaagucauaugguugaauaaauaauuauaaauugagcacugauggaaucccucuacaggu

SEQ ID NO: 317344 - RNA, 64 nt, Human
uucagcuuaauuugcuucaauucagcaaccauuuauugagcaucuauuaugugccaggcacugu

SEQ ID NO: 317345 - RNA, 64 nt, Human
uugcaguguaggaauucuauugaguggcagugucauugagcaguauauauauaaagcacagauu

SEQ ID NO: 317346 - RNA, 64 nt, Human
cugauccccaguuccuauacccuaccccugaccuauugagcagccucugaagagccauagggcc

SEQ ID NO: 317347 - RNA, 64 nt, Human
uugacugauucacuuuuucauaaagugagcauuuauugagcauuuuuucaugugccagagccug

SEQ ID NO: 317348 - RNA, 64 nt, Human
uaaauaccuguucucuuucaauggacuguugccuauugagcauuguggaugauguguuuucaga

SEQ ID NO: 317349 - RNA, 64 nt, Human
uauugacuauagguuugccuuuccuggagaauuaauugagcaauugaggagugucucaggauag

SEQ ID NO: 317350 - RNA, 64 nt, Human
ucacauauuuuugccucugugaguucaucugaugauugagcaguagcauuugccuuuuggguuu

SEQ ID NO: 317351 - RNA, 64 nt, Human
guuucauccaguggccacguggaagcuuuguagcauugagcagauaguaaaauaucuuagaauu

SEQ ID NO: 317352 - RNA, 64 nt, Human
ggggaggaggaucauguacgcccggaaguaggaccucguccagucgugcuuggguuuggccgca

SEQ ID NO: 317353 - RNA, 64 nt, Human
agacugcugaaugucugagagaaccagaguuguucucguccaagguagaaagguacgaagauac

SEQ ID NO: 317354 - RNA, 64 nt, Human
guggcguggggcagcagcugccucugagcccucgcucguccacggucuucugcaucacugguau

SEQ ID NO: 317355 - RNA, 64 nt, Human
gaccuaaagucaaaggaccuguguagcauuucagauugagcacuucacuaucaaaaauacuaac

SEQ ID NO: 317356 - RNA, 64 nt, Human
uaacuguaauccuuuuuaccagcauacgauuguuauugagcaauaugaaagggaaauguucuuu

SEQ ID NO: 317357 - RNA, 64 nt, Human
aaaaaauaaaaagaguaugagucuucuguaauucauugagcaguuagcucauuugagauaaagu

SEQ ID NO: 317358 - RNA, 64 nt, Human
caaguauuuuaacucucaguccaacauuauuugaauugagcaccucaagcaugcuuagcaaugu

SEQ ID NO: 317359 - RNA, 64 nt, Human
cguguuugggcaacaucaagacuguaaguguagaauugagcaacugucuucuaucaauaaaggc

SEQ ID NO: 317360 - RNA, 64 nt, Human
uuuggcaauggaauuuuuaauguaauaaaucuuuauugagcacugcugguggccaggagugcgg

SEQ ID NO: 317361 - RNA, 64 nt, Human
gagagacucaguucagcaacuguuuauucuguuuauugagcacuuacuuggaccaagcacugug

SEQ ID NO: 317362 - RNA, 64 nt, Human
guuaaucuacagagaacugcagcccuuauucagaauugagcagugauugucaguugauaucucu

SEQ ID NO: 317363 - RNA, 64 nt, Human
aaccauucuaaagaaaguagugaucuuguauuaaauugagcagaauucucacagauuuuaccau

SEQ ID NO: 317364 - RNA, 64 nt, Human
ugugaaaagaauagaagcuaagguuuagauaaauauugagcagaucuauaggaagauugaaccu

SEQ ID NO: 317365 - RNA, 64 nt, Human
ucagccacagcugcaaagguuguaaaugcuuaugauugagcauuuuuaggguuucuccaucccu

SEQ ID NO: 317366 - RNA, 64 nt, Human
cuuuuaacaaacuuguucauuuccuuuucuuuccauugagcaccucugaacaaugugauucuuu

SEQ ID NO: 317367 - RNA, 64 nt, Human
aaaucauuaacacuuaaaugacuucauugggaauauugagcagagggacugugcuucuaugcac

SEQ ID NO: 317368 - RNA, 64 nt, Human
aggucugugccaaagaagaauccaauaagcacauauugagcacuugcuguauaugcaguauuga

SEQ ID NO: 317369 - RNA, 64 nt, Human
uaagcacauauugagcacuugcuguauaugcaguauugagcacuguaggcaagagggaagaaag

SEQ ID NO: 317370 - RNA, 64 nt, Human
guaagcacagaucgcacugccucaauaacuugguauugagcacguauuuugcaaaagcuacuuu

SEQ ID NO: 317371 - RNA, 64 nt, Human
guguguggagugauccugccgcccccucccugggcucguccagagaucucaaacuccgaugccc

SEQ ID NO: 317372 - RNA, 64 nt, Human
gcuuuugaaaaacaacugcauaaccuuuacacuccucguccauuuuauuaggauuacccaaaua

SEQ ID NO: 317373 - RNA, 64 nt, Human
aaccauuuuaaaggaaagaaaauauguaaauucuauugagcaaaauucuguccuguugaaacuu

SEQ ID NO: 317374 - RNA, 64 nt, Human
aauauagauuccugauaaauuucacuguuugcaaauugagcagugcugcaacauguacuguaug

SEQ ID NO: 317375 - RNA, 64 nt, Human
aaucuuccauguuuucucuaaguaacacuucuuuauugagcauuuaauguggacauacuauaaa

SEQ ID NO: 317376 - RNA, 64 nt, Human
gaaagugcuuugaaauauugauguggggagguuuauugagcacaagauguauuucagcccaugc

SEQ ID NO: 317377 - RNA, 64 nt, Human
uuguuggauauguucauuuauucaauagucauuuauugagcaccuacuacguaccuugguacug

SEQ ID NO: 317378 - RNA, 64 nt, Human
cuugaaagcugggggaugugugggcaagagguggauugagcaggaucucaggguuaugucgagg

SEQ ID NO: 317379 - RNA, 64 nt, Human
gauuuuccuauuuauuuaguccuccagcucuuuuauugagcauccacgugcuggacgauacuua

SEQ ID NO: 317380 - RNA, 64 nt, Human
gcucuucauuagcucaauaugugguuugcccucaauugagcacuguuuauuacuuuguaauaug

SEQ ID NO: 317381 - RNA, 64 nt, Human
ccccucauccccagaaauuauuuuucuacaccaaauugagcaauuugaccaagauuucuaguag

SEQ ID NO: 317382 - RNA, 64 nt, Human
uaaaacauuauucuuuaaugggauaauacaauucauugagcagcuaccacuuaaaaaacuugca

SEQ ID NO: 317383 - RNA, 64 nt, Human
gaaagugggauccuggccccacucugccuuuccuauugagcaaccagcucugggcucaguuucc

SEQ ID NO: 317384 - RNA, 64 nt, Human
ggcaaaggaaagaaauaauauauauuuuuaugucauugagcaauauuuuuuaauguguaccugu

SEQ ID NO: 317385 - RNA, 64 nt, Human
gagcuuuuuggucuuguucugauuuggaaggugaauugagcaggucugcugcuguuggccucug

SEQ ID NO: 317386 - RNA, 64 nt, Human
ucucacauggaugcucccaaggguuagggacugcauugagcaggcccaccugcuucccagaacc

SEQ ID NO: 317387 - RNA, 64 nt, Human
uauaugcaaauucuguaccauuuuguaucagggaauugagcaucuucagauguugguaucugca

SEQ ID NO: 317388 - RNA, 64 nt, Human
cugaaguacuggcucuuuccugcucuggacaagaauugagcaacuugucugaugacugggaaag

SEQ ID NO: 317389 - RNA, 64 nt, Human
ugccguuuucuuuccuguucuccucugcuucauucucguccagccauugcuccccucucccugc

SEQ ID NO: 317390 - RNA, 64 nt, Human
caauuuauuuugcuuaccauacaccccuuuucuccucguccacauuuuccaaucuguauggugg

SEQ ID NO: 317391 - RNA, 64 nt, Human
auuuaauaccccugacuggacaccacagcuuagccucguccacccuaaauguacucagaacacu

SEQ ID NO: 317392 - RNA, 64 nt, Human
uggcagugugcggagcugauaacauuuucccaauauugagcaguucccaaggacagucagcauu

SEQ ID NO: 317393 - RNA, 64 nt, Human
gucuguauuacuguagguucucuucaaauaauuaauugagcagacaaguuuguuuuauuuugga

SEQ ID NO: 317394 - RNA, 64 nt, Human
ucacauuuugcuuuuaagugaacacuuuuuccccauugagcaucuugaacauacuuuuuuucca

SEQ ID NO: 317395 - RNA, 64 nt, Human
cucauccuuacucacucauucccucaaaauauuuauugagcaccaacaaugucacaagcacugu

SEQ ID NO: 317396 - RNA, 64 nt, Human
aacguucgcucuguucauggguugucuaucuaacauugagcagcauuggagaggccacagcuga

SEQ ID NO: 317397 - RNA, 64 nt, Human
accgugaccagagaaguaaauauggagccguuuuauugagcaguuuccuccagggaugacggcu

SEQ ID NO: 317398 - RNA, 64 nt, Human
cagccauggcuggugacaacagaggaucguugagauugagcagcgcuuggugaucucucagcaa

SEQ ID NO: 317399 - RNA, 64 nt, Human
ggagggcccacuuguauccucugguucuucauuuauugagcaccuacuacaugcaaggcacugu

SEQ ID NO: 317400 - RNA, 64 nt, Human
aguggaccacaagaaacgcaaaauccgggaggagauugagcauuuuggaaucaagaucuaucaa

SEQ ID NO: 317401 - RNA, 64 nt, Human
uuucucucugaguccuguaacuguccccgaggggauugagcagaagcucggguaugagcccuga

SEQ ID NO: 317402 - RNA, 64 nt, Human
gcaucucagcaaagccccucccaggguuugaucgauugagcaggacagcccugcuccuggacag

SEQ ID NO: 317403 - RNA, 64 nt, Human
cagugaaccuacugguggacucccaauugacaagauugagcaauagaaaaaaauuccuuuccuu

SEQ ID NO: 317404 - RNA, 64 nt, Human
aaagccuuagacaaauuaaauuuggcagaguuuaauugagcaaaggacaauucacaaaucaggu

SEQ ID NO: 317405 - RNA, 64 nt, Human
ucauuggcuuuccuauuuuucuguucauuuuuuaauugagcaaaugucuauugaacacuuaaaa

SEQ ID NO: 317406 - RNA, 64 nt, Human
gccuuauuuaaccagaccaucagggcaucauagaauugagcauugaauuugcuacuguaggagu

SEQ ID NO: 317407 - RNA, 64 nt, Human
uaugaaauugggacucaacucuuugaaaacaccuauugagcaguuauaccuguugagcaguuua

SEQ ID NO: 317408 - RNA, 64 nt, Human
cuguugaccuacccuggaccgaguggaccacgaccucguccauuuaaacccggcugacucagug

SEQ ID NO: 317409 - RNA, 64 nt, Human
ucccugucguggagcuggggugcgugaucuggugcucguccacgcaggugugugguguaaacau

SEQ ID NO: 317410 - RNA, 64 nt, Human
agaaccugguagaaggaagcugugcagcaugcuccucguccaugugugucggcagugcuggugu

SEQ ID NO: 317411 - RNA, 64 nt, Human
ugaagucauccacuccugcaucugguuggucuuuauugagcaccuacuauaugcagaaggggag

SEQ ID NO: 317412 - RNA, 64 nt, Human
uuaauucauuguacuuauuugcuuauuuguguguauugagcaucuguaaugugccagcauugug

SEQ ID NO: 317413 - RNA, 64 nt, Human
ucgguuccuucacuucuucaugccacaaguguuuauugagcaccugugugccaggccucacaga

SEQ ID NO: 317414 - RNA, 64 nt, Human
ugaggaaggucauuuggguuuuugugagauuuguauugagcaccugcugucuacagagaaugug

SEQ ID NO: 317415 - RNA, 64 nt, Human
aucuacaacuaauauuaagacuccugugguauugauugagcagagcagaagagauuucaaaaaa

SEQ ID NO: 317416 - RNA, 64 nt, Human
ggcauccauccauccgucauucauucaaauauuuauugagcaccuacuaugugcccagcccugu

SEQ ID NO: 317417 - RNA, 64 nt, Human
gggagauggcagccccaggguacagccagcaggcauugagcagccuuagcauugucccccuacu

SEQ ID NO: 317418 - RNA, 64 nt, Human
uaccuauuuauguauuuauuuauugaagugugaaauugagcaauaggcaggcaccaccgucccc

SEQ ID NO: 317419 - RNA, 64 nt, Human
cugcuuaucuccgaaauggugugaucgucuccucauugagcagcggcugccaccgcgcuguggg

SEQ ID NO: 317420 - RNA, 64 nt, Human
cacuagcaaccuguugagcacuugaaauugaguuauugagcacugaaauguggcuaguccaaau

SEQ ID NO: 317421 - RNA, 64 nt, Human
guguugaaucuaaaucacauucgguuauauaaucauugagcaauacuaauuuuuccaaucagua

SEQ ID NO: 317422 - RNA, 64 nt, Human
cccugagauguuacaguugaagagcuugguuuucauugagcauuucucuauuuuuccaguuauc

SEQ ID NO: 317423 - RNA, 64 nt, Human
ccaguuuuguuucguuucuccuuuuauucucuguauugagcaagucuuagacaucauacguuuc

SEQ ID NO: 317424 - RNA, 64 nt, Human
cuguugcgucaggcaaggucaccugcauuuauuuauugagcagcagugcugugucaggcccagg

SEQ ID NO: 317425 - RNA, 64 nt, Human
auaugauauucaggaauauauucauucaauauuuauugagcaccuaugcaugccaaaacuguuc

SEQ ID NO: 317426 - RNA, 64 nt, Human
gagugcagaggucaucccagguguugcugaguuuauugagcacaccuagccugcuugcuuacug

SEQ ID NO: 317427 - RNA, 63 nt, Human
agggaaaugucaggggcggggagggugacaguggccgcccaaggcccacgagcuuguucuuug

SEQ ID NO: 317428 - RNA, 63 nt, Human; identical to SEQ ID NO: 315974

SEQ ID NO: 317429 - RNA, 63 nt, Human
cuugggggucccagaaggccccggccugaggaggccgcccaccugcgggacccuccuccucgc

SEQ ID NO: 317430 - RNA, 64 nt, Human
cucuuaucaauuagcacucacuaauguacuacuaauugagcaaccuacgcacucaguugacuac

SEQ ID NO: 317431 - RNA, 64 nt, Human
aucuuauguuuugaaauaccugugaauuguuggcauugagcagcugaagcuaacucaugacucu

SEQ ID NO: 317432 - RNA, 64 nt, Human
guaacacuccugauacaacucugguuauaagugaauugagcauuaauguuucuuuuguauaaau

SEQ ID NO: 317433 - RNA, 64 nt, Human
ugaaggcuccuuuugaaugugucuugagacccaaauugagcauguugcuguuauuccugcccug

SEQ ID NO: 317434 - RNA, 64 nt, Human
augagauaucuauaucccuacaaccuaauuguauauugagcagaaacugaauuaauaugcuucc

SEQ ID NO: 317435 - RNA, 64 nt, Human
aaauuaauaaaucauuaauaguuaaaauguuuacauugagcacuagaacauguuuggccuuuuu

SEQ ID NO: 317436 - RNA, 64 nt, Human
acucccuccugcauuccucauuuaaggaguguuuauugagcacccuuugugugcagacauggcu

SEQ ID NO: 317437 - RNA, 64 nt, Human
ccugugcuaaauucuucagugauaugaaaaaaucauugagcauucauuauugcgaaugaagugg

SEQ ID NO: 317438 - RNA, 64 nt, Human
ccugaaaugcugcauccuaaaauuccaaaauuauauugagcaaucgccaaggccuaaagccaac

SEQ ID NO: 317439 - RNA, 64 nt, Human
augaaauucuuggaaacuuccauuaaguguguagauugagcagguaguaauugcaugcaguuug

SEQ ID NO: 317440 - RNA, 64 nt, Human
uuagauaccaggauauuguuggccauguggcaucauugagcagcaggaggcugaaggaggggag

SEQ ID NO: 317441 - RNA, 64 nt, Human
gugcugcugaggauagacugacuuuggccauuggauugagcaaaggcagaaaugggggcuagug

SEQ ID NO: 317442 - RNA, 64 nt, Human
uuauuuaauuuugugauuuguucuuccauaugacauugagcaaauagaucuguuucaaaauaug

SEQ ID NO: 317443 - RNA, 64 nt, Human
aaaacuucuugcuucaaaugaaaaaaucccaacuauugagcauguuuaaaucuuugcagagauu

SEQ ID NO: 317444 - RNA, 64 nt, Human
uauauuuuauaaagaaaauucuaucuuaugguugauugagcauugagacuuaugaaggcauuag

SEQ ID NO: 317445 - RNA, 64 nt, Human
aaggggucagggcaagugugacccaccaggcaaaauugagcagcauuuucauagggaccgacuu

SEQ ID NO: 317446 - RNA, 63 nt, Human
ugggacauuagggcccccggccucgggagaggugccgcccagcuucccaugccagcccggagc

SEQ ID NO: 317447 - RNA, 63 nt, Human
uggacugccccgguucuguguugugugccgagugccgcccaguguucugugaccacccgugua

SEQ ID NO: 317448 - RNA, 64 nt, Human
aucaugcauucauucauuaauucaaccaguauuuauugagcaccuaauaugugccaggcacugc

SEQ ID NO: 317449 - RNA, 64 nt, Human; identical to SEQ ID NO: 317180

SEQ ID NO: 317450 - RNA, 64 nt, Human; identical to SEQ ID NO: 317181

SEQ ID NO: 317451 - RNA, 64 nt, Human; identical to SEQ ID NO: 317182

SEQ ID NO: 317452 - RNA, 64 nt, Human; identical to SEQ ID NO: 317183

SEQ ID NO: 317453 - RNA, 64 nt, Human; identical to SEQ ID NO: 317184

SEQ ID NO: 317454 - RNA, 64 nt, Human; identical to SEQ ID NO: 317185

SEQ ID NO: 317455 - RNA, 64 nt, Human; identical to SEQ ID NO: 317186

SEQ ID NO: 317456 - RNA, 64 nt, Human; identical to SEQ ID NO: 317187

SEQ ID NO: 317457 - RNA, 64 nt, Human; identical to SEQ ID NO: 317188

SEQ ID NO: 317458 - RNA, 64 nt, Human; identical to SEQ ID NO: 317189

SEQ ID NO: 317459 - RNA, 64 nt, Human; identical to SEQ ID NO: 317190

SEQ ID NO: 317460 - RNA, 64 nt, Human; identical to SEQ ID NO: 317191

SEQ ID NO: 317461 - RNA, 64 nt, Human; identical to SEQ ID NO: 317192

SEQ ID NO: 317462 - RNA, 64 nt, Human; identical to SEQ ID NO: 317193

SEQ ID NO: 317463 - RNA, 63 nt, Human; identical to SEQ ID NO: 315991

SEQ ID NO: 317464 - RNA, 63 nt, Human
guggggcccuccccugccaacuccccuucccuggccgcccacucaacccacaccucuuucacg

SEQ ID NO: 317465 - RNA, 63 nt, Human
ggcagugacgcccgccaccaccacgcagccgccgccgcccacgccggccucugcugcccccuu

SEQ ID NO: 317466 - RNA, 64 nt, Human; identical to SEQ ID NO: 317194

SEQ ID NO: 317467 - RNA, 64 nt, Human; identical to SEQ ID NO: 317195

SEQ ID NO: 317468 - RNA, 64 nt, Human; identical to SEQ ID NO: 317196

SEQ ID NO: 317469 - RNA, 64 nt, Human; identical to SEQ ID NO: 317197

SEQ ID NO: 317470 - RNA, 64 nt, Human; identical to SEQ ID NO: 317198

SEQ ID NO: 317471 - RNA, 64 nt, Human; identical to SEQ ID NO: 317199

SEQ ID NO: 317472 - RNA, 64 nt, Human; identical to SEQ ID NO: 317200

SEQ ID NO: 317473 - RNA, 64 nt, Human; identical to SEQ ID NO: 317201

SEQ ID NO: 317474 - RNA, 64 nt, Human; identical to SEQ ID NO: 317202

SEQ ID NO: 317475 - RNA, 64 nt, Human; identical to SEQ ID NO: 317203

SEQ ID NO: 317476 - RNA, 64 nt, Human; identical to SEQ ID NO: 317204

SEQ ID NO: 317477 - RNA, 64 nt, Human; identical to SEQ ID NO: 317205

SEQ ID NO: 317478 - RNA, 64 nt, Human; identical to SEQ ID NO: 317206

SEQ ID NO: 317479 - RNA, 64 nt, Human; identical to SEQ ID NO: 317207

SEQ ID NO: 317480 - RNA, 64 nt, Human; identical to SEQ ID NO: 317208

SEQ ID NO: 317481 - RNA, 63 nt, Human
cacggccccgggccugagcccuggcacccgcuggccgcccacccgcgcccgccacucggggcc

SEQ ID NO: 317482 - RNA, 63 nt, Human
acacuguaaauagaacccccuccaccaccccccgccgcccagcauccuaccuggacugcggug

SEQ ID NO: 317483 - RNA, 63 nt, Human; identical to SEQ ID NO: 315992

SEQ ID NO: 317484 - RNA, 64 nt, Human; identical to SEQ ID NO: 317209

SEQ ID NO: 317485 - RNA, 64 nt, Human; identical to SEQ ID NO: 317210

SEQ ID NO: 317486 - RNA, 64 nt, Human; identical to SEQ ID NO: 317211

SEQ ID NO: 317487 - RNA, 64 nt, Human; identical to SEQ ID NO: 317212

SEQ ID NO: 317488 - RNA, 64 nt, Human; identical to SEQ ID NO: 317213

SEQ ID NO: 317489 - RNA, 64 nt, Human; identical to SEQ ID NO: 317214

SEQ ID NO: 317490 - RNA, 64 nt, Human; identical to SEQ ID NO: 317215

SEQ ID NO: 317491 - RNA, 64 nt, Human; identical to SEQ ID NO: 317216

SEQ ID NO: 317492 - RNA, 64 nt, Human; identical to SEQ ID NO: 317217

SEQ ID NO: 317493 - RNA, 64 nt, Human; identical to SEQ ID NO: 317218

SEQ ID NO: 317494 - RNA, 64 nt, Human; identical to SEQ ID NO: 317219

SEQ ID NO: 317495 - RNA, 64 nt, Human; identical to SEQ ID NO: 317220

SEQ ID NO: 317496 - RNA, 64 nt, Human; identical to SEQ ID NO: 317221

SEQ ID NO: 317497 - RNA, 64 nt, Human; identical to SEQ ID NO: 317222

SEQ ID NO: 317498 - RNA, 64 nt, Human; identical to SEQ ID NO: 317223

SEQ ID NO: 317499 - RNA, 63 nt, Human
gguuccccucugcugcuugugcgcaugcgugcggccgcccagcaagcugugccuuuugcgccu

SEQ ID NO: 317500 - RNA, 63 nt, Human; identical to SEQ ID NO: 315993

SEQ ID NO: 317501 - RNA, 63 nt, Human
cugacccucuugcacucucccugccccccggacgccgcccagcuugcuuguguauaaguugua

SEQ ID NO: 317502 - RNA, 64 nt, Human; identical to SEQ ID NO: 317224

SEQ ID NO: 317503 - RNA, 64 nt, Human; identical to SEQ ID NO: 317226

SEQ ID NO: 317504 - RNA, 64 nt, Human; identical to SEQ ID NO: 317227

SEQ ID NO: 317505 - RNA, 64 nt, Human; identical to SEQ ID NO: 317228

SEQ ID NO: 317506 - RNA, 64 nt, Human; identical to SEQ ID NO: 317229

SEQ ID NO: 317507 - RNA, 64 nt, Human; identical to SEQ ID NO: 317230

SEQ ID NO: 317508 - RNA, 64 nt, Human; identical to SEQ ID NO: 317231

SEQ ID NO: 317509 - RNA, 64 nt, Human; identical to SEQ ID NO: 317232

SEQ ID NO: 317510 - RNA, 64 nt, Human; identical to SEQ ID NO: 317233

SEQ ID NO: 317511 - RNA, 64 nt, Human; identical to SEQ ID NO: 317234

SEQ ID NO: 317512 - RNA, 64 nt, Human; identical to SEQ ID NO: 317235

SEQ ID NO: 317513 - RNA, 64 nt, Human; identical to SEQ ID NO: 317236

SEQ ID NO: 317514 - RNA, 64 nt, Human; identical to SEQ ID NO: 317237

SEQ ID NO: 317515 - RNA, 64 nt, Human; identical to SEQ ID NO: 317238

SEQ ID NO: 317516 - RNA, 64 nt, Human; identical to SEQ ID NO: 317239

SEQ ID NO: 317517 - RNA, 63 nt, Human; identical to SEQ ID NO: 316010

SEQ ID NO: 317518 - RNA, 63 nt, Human
gaacuccuggccucaagugauccacccaccucagccgcccaaaguguugggauuacaggcaug

SEQ ID NO: 317519 - RNA, 63 nt, Human
aagacaggccaaucccuucccucccagaagcuggccgcccagcaggagggacugaggccagac

SEQ ID NO: 317520 - RNA, 64 nt, Human; identical to SEQ ID NO: 317240

SEQ ID NO: 317521 - RNA, 64 nt, Human; identical to SEQ ID NO: 317241

SEQ ID NO: 317522 - RNA, 64 nt, Human; identical to SEQ ID NO: 317244

SEQ ID NO: 317523 - RNA, 64 nt, Human; identical to SEQ ID NO: 317245

SEQ ID NO: 317524 - RNA, 64 nt, Human; identical to SEQ ID NO: 317246

SEQ ID NO: 317525 - RNA, 64 nt, Human; identical to SEQ ID NO: 317247

SEQ ID NO: 317526 - RNA, 64 nt, Human; identical to SEQ ID NO: 317248

SEQ ID NO: 317527 - RNA, 64 nt, Human; identical to SEQ ID NO: 317249

SEQ ID NO: 317528 - RNA, 64 nt, Human; identical to SEQ ID NO: 317250

SEQ ID NO: 317529 - RNA, 64 nt, Human; identical to SEQ ID NO: 317251

SEQ ID NO: 317530 - RNA, 64 nt, Human; identical to SEQ ID NO: 317252

SEQ ID NO: 317531 - RNA, 64 nt, Human; identical to SEQ ID NO: 317253

SEQ ID NO: 317532 - RNA, 64 nt, Human; identical to SEQ ID NO: 317254

SEQ ID NO: 317533 - RNA, 64 nt, Human; identical to SEQ ID NO: 317255

SEQ ID NO: 317534 - RNA, 64 nt, Human; identical to SEQ ID NO: 317256

SEQ ID NO: 317535 - RNA, 63 nt, Human
cuggucaguggcggcuguccccuccccagcccagccgcccagccacaugugucugccugaccc

SEQ ID NO: 317536 - RNA, 63 nt, Human
aggccccacggccgagccucuggccggagaucggccgcccacggggggccacagcagcggccg

SEQ ID NO: 317537 - RNA, 64 nt, Human
cagcacccccucucaggggagaccaugguggccccggccgcacccccccacccuggugccacca

SEQ ID NO: 317538 - RNA, 64 nt, Human; identical to SEQ ID NO: 317257

SEQ ID NO: 317539 - RNA, 64 nt, Human; identical to SEQ ID NO: 317258

SEQ ID NO: 317540 - RNA, 64 nt, Human; identical to SEQ ID NO: 317259

SEQ ID NO: 317541 - RNA, 62 nt, Human; identical to SEQ ID NO: 317263

SEQ ID NO: 317542 - RNA, 64 nt, Human; identical to SEQ ID NO: 317264

SEQ ID NO: 317543 - RNA, 64 nt, Human; identical to SEQ ID NO: 317265

SEQ ID NO: 317544 - RNA, 64 nt, Human; identical to SEQ ID NO: 317266

SEQ ID NO: 317545 - RNA, 64 nt, Human; identical to SEQ ID NO: 317267

SEQ ID NO: 317546 - RNA, 64 nt, Human; identical to SEQ ID NO: 317268

SEQ ID NO: 317547 - RNA, 64 nt, Human; identical to SEQ ID NO: 317269

SEQ ID NO: 317548 - RNA, 64 nt, Human; identical to SEQ ID NO: 317270

SEQ ID NO: 317549 - RNA, 64 nt, Human; identical to SEQ ID NO: 317271

SEQ ID NO: 317550 - RNA, 64 nt, Human; identical to SEQ ID NO: 317272

SEQ ID NO: 317551 - RNA, 64 nt, Human; identical to SEQ ID NO: 317273

SEQ ID NO: 317552 - RNA, 64 nt, Human; identical to SEQ ID NO: 317274

SEQ ID NO: 317553 - RNA, 63 nt, Human; identical to SEQ ID NO: 316011

SEQ ID NO: 317554 - RNA, 63 nt, Human
uguuuaccguucaucaccacucgggggcaccgggccgcccacccacucccaaaauccgucagu

SEQ ID NO: 317555 - RNA, 63 nt, Human
cguagccaggccuggaggccccccaggcaggaggccgcccaaaggcggggccggcgucucgca

SEQ ID NO: 317556 - RNA, 64 nt, Human; identical to SEQ ID NO: 317275

SEQ ID NO: 317557 - RNA, 64 nt, Human; identical to SEQ ID NO: 317276

SEQ ID NO: 317558 - RNA, 64 nt, Human; identical to SEQ ID NO: 317277

SEQ ID NO: 317559 - RNA, 64 nt, Human; identical to SEQ ID NO: 317278

SEQ ID NO: 317560 - RNA, 64 nt, Human; identical to SEQ ID NO: 317282

SEQ ID NO: 317561 - RNA, 64 nt, Human; identical to SEQ ID NO: 317283

SEQ ID NO: 317562 - RNA, 64 nt, Human; identical to SEQ ID NO: 317284

SEQ ID NO: 317563 - RNA, 64 nt, Human; identical to SEQ ID NO: 317285

SEQ ID NO: 317564 - RNA, 64 nt, Human; identical to SEQ ID NO: 317286

SEQ ID NO: 317565 - RNA, 64 nt, Human; identical to SEQ ID NO: 317287

SEQ ID NO: 317566 - RNA, 64 nt, Human; identical to SEQ ID NO: 317288

SEQ ID NO: 317567 - RNA, 64 nt, Human; identical to SEQ ID NO: 317289

SEQ ID NO: 317568 - RNA, 64 nt, Human; identical to SEQ ID NO: 317290

SEQ ID NO: 317569 - RNA, 64 nt, Human; identical to SEQ ID NO: 317291

SEQ ID NO: 317570 - RNA, 64 nt, Human; identical to SEQ ID NO: 317292

SEQ ID NO: 317571 - RNA, 63 nt, Human; identical to SEQ ID NO: 315954

SEQ ID NO: 317572 - RNA, 63 nt, Human
gccacaggccacugcaaacccugcugccugccggccgcccagacaccacagacgccaccuggc

SEQ ID NO: 317573 - RNA, 63 nt, Human
accuuugggcugcccuggcccccacucucccgggccgcccaccacaggcucuuaauggggccg

SEQ ID NO: 317574 - RNA, 64 nt, Human; identical to SEQ ID NO: 317293

SEQ ID NO: 317575 - RNA, 64 nt, Human; identical to SEQ ID NO: 317294

SEQ ID NO: 317576 - RNA, 64 nt, Human; identical to SEQ ID NO: 317295

SEQ ID NO: 317577 - RNA, 64 nt, Human; identical to SEQ ID NO: 317296

SEQ ID NO: 317578 - RNA, 64 nt, Human; identical to SEQ ID NO: 317297

SEQ ID NO: 317579 - RNA, 64 nt, Human; identical to SEQ ID NO: 317298

SEQ ID NO: 317580 - RNA, 64 nt, Human; identical to SEQ ID NO: 317299

SEQ ID NO: 317581 - RNA, 64 nt, Human; identical to SEQ ID NO: 317300

SEQ ID NO: 317582 - RNA, 64 nt, Human; identical to SEQ ID NO: 317301

SEQ ID NO: 317583 - RNA, 64 nt, Human; identical to SEQ ID NO: 317302

SEQ ID NO: 317584 - RNA, 64 nt, Human; identical to SEQ ID NO: 317303

SEQ ID NO: 317585 - RNA, 64 nt, Human; identical to SEQ ID NO: 317304

SEQ ID NO: 317586 - RNA, 64 nt, Human; identical to SEQ ID NO: 317305

SEQ ID NO: 317587 - RNA, 64 nt, Human; identical to SEQ ID NO: 317306

SEQ ID NO: 317588 - RNA, 64 nt, Human; identical to SEQ ID NO: 317307

SEQ ID NO: 317589 - RNA, 63 nt, Human
ggaggaagcucagaucucuagagcugucuugucgccgcccaggauugaccuguguguaagucc

SEQ ID NO: 317590 - RNA, 63 nt, Human
aagucccugaaggcccucaggcaguauauaggggccgcccaccuucagcugcccugggauggg

SEQ ID NO: 317591 - RNA, 63 nt, Human; identical to SEQ ID NO: 316012

SEQ ID NO: 317592 - RNA, 64 nt, Human; identical to SEQ ID NO: 317308

SEQ ID NO: 317593 - RNA, 64 nt, Human; identical to SEQ ID NO: 317309

SEQ ID NO: 317594 - RNA, 64 nt, Human; identical to SEQ ID NO: 317310

SEQ ID NO: 317595 - RNA, 64 nt, Human; identical to SEQ ID NO: 317311

SEQ ID NO: 317596 - RNA, 64 nt, Human; identical to SEQ ID NO: 317312

SEQ ID NO: 317597 - RNA, 64 nt, Human; identical to SEQ ID NO: 317313

SEQ ID NO: 317598 - RNA, 64 nt, Human; identical to SEQ ID NO: 317317

SEQ ID NO: 317599 - RNA, 64 nt, Human; identical to SEQ ID NO: 317318

SEQ ID NO: 317600 - RNA, 64 nt, Human; identical to SEQ ID NO: 317319

SEQ ID NO: 317601 - RNA, 64 nt, Human; identical to SEQ ID NO: 317320

SEQ ID NO: 317602 - RNA, 64 nt, Human; identical to SEQ ID NO: 317321

SEQ ID NO: 317603 - RNA, 64 nt, Human; identical to SEQ ID NO: 317322

SEQ ID NO: 317604 - RNA, 64 nt, Human; identical to SEQ ID NO: 317323

SEQ ID NO: 317605 - RNA, 64 nt, Human; identical to SEQ ID NO: 317324

SEQ ID NO: 317606 - RNA, 64 nt, Human; identical to SEQ ID NO: 317325

SEQ ID NO: 317607 - RNA, 63 nt, Human
gagacgccccuccaacuggcgggugugaaggaagccgcccagggguccgggcuguccuuggcc

SEQ ID NO: 317608 - RNA, 63 nt, Human
uccgggugacaccagccccgucuccagccuugagccgcccaugcugaugcgaccucggcugac

SEQ ID NO: 317609 - RNA, 63 nt, Human; identical to SEQ ID NO: 316023

SEQ ID NO: 317610 - RNA, 64 nt, Human; identical to SEQ ID NO: 317326

SEQ ID NO: 317611 - RNA, 64 nt, Human; identical to SEQ ID NO: 317327

SEQ ID NO: 317612 - RNA, 64 nt, Human; identical to SEQ ID NO: 317328

SEQ ID NO: 317613 - RNA, 64 nt, Human; identical to SEQ ID NO: 317329

SEQ ID NO: 317614 - RNA, 64 nt, Human; identical to SEQ ID NO: 317330

SEQ ID NO: 317615 - RNA, 64 nt, Human; identical to SEQ ID NO: 317331

SEQ ID NO: 317616 - RNA, 64 nt, Human; identical to SEQ ID NO: 317332

SEQ ID NO: 317617 - RNA, 64 nt, Human; identical to SEQ ID NO: 317336

SEQ ID NO: 317618 - RNA, 64 nt, Human; identical to SEQ ID NO: 317337

SEQ ID NO: 317619 - RNA, 64 nt, Human; identical to SEQ ID NO: 317338

SEQ ID NO: 317620 - RNA, 64 nt, Human; identical to SEQ ID NO: 317339

SEQ ID NO: 317621 - RNA, 64 nt, Human; identical to SEQ ID NO: 317340

SEQ ID NO: 317622 - RNA, 64 nt, Human; identical to SEQ ID NO: 317341

SEQ ID NO: 317623 - RNA, 64 nt, Human; identical to SEQ ID NO: 317342

SEQ ID NO: 317624 - RNA, 64 nt, Human; identical to SEQ ID NO: 317343

SEQ ID NO: 317625 - RNA, 63 nt, Human
uugggggguggggggcggaggagggugaggggugccgcccaugggccacaaaucucuacaagu

SEQ ID NO: 317626 - RNA, 63 nt, Human
accgaggggguggggacugagccgcccgccucugccgcccaccaccaucucaggaaaggcugu

SEQ ID NO: 317627 - RNA, 64 nt, Human; identical to SEQ ID NO: 317344

SEQ ID NO: 317628 - RNA, 64 nt, Human; identical to SEQ ID NO: 317345

SEQ ID NO: 317629 - RNA, 64 nt, Human; identical to SEQ ID NO: 317346

SEQ ID NO: 317630 - RNA, 64 nt, Human; identical to SEQ ID NO: 317347

SEQ ID NO: 317631 - RNA, 64 nt, Human; identical to SEQ ID NO: 317348

SEQ ID NO: 317632 - RNA, 64 nt, Human; identical to SEQ ID NO: 317349

SEQ ID NO: 317633 - RNA, 64 nt, Human; identical to SEQ ID NO: 317350

SEQ ID NO: 317634 - RNA, 64 nt, Human; identical to SEQ ID NO: 317351

SEQ ID NO: 317635 - RNA, 64 nt, Human; identical to SEQ ID NO: 317355

SEQ ID NO: 317636 - RNA, 64 nt, Human; identical to SEQ ID NO: 317356

SEQ ID NO: 317637 - RNA, 64 nt, Human; identical to SEQ ID NO: 317357

SEQ ID NO: 317638 - RNA, 64 nt, Human; identical to SEQ ID NO: 317358

SEQ ID NO: 317639 - RNA, 64 nt, Human; identical to SEQ ID NO: 317359

SEQ ID NO: 317640 - RNA, 64 nt, Human; identical to SEQ ID NO: 317360

SEQ ID NO: 317641 - RNA, 64 nt, Human; identical to SEQ ID NO: 317361

SEQ ID NO: 317642 - RNA, 64 nt, Human
ccagaagagccccacgggcuuccugcaucuuccaccgcaccauaccuggagcccuccgaggggu

SEQ ID NO: 317643 - RNA, 64 nt, Human; identical to SEQ ID NO: 317362

SEQ ID NO: 317644 - RNA, 64 nt, Human; identical to SEQ ID NO: 317363

SEQ ID NO: 317645 - RNA, 64 nt, Human; identical to SEQ ID NO: 317364

SEQ ID NO: 317646 - RNA, 64 nt, Human; identical to SEQ ID NO: 317365

SEQ ID NO: 317647 - RNA, 64 nt, Human; identical to SEQ ID NO: 317366

SEQ ID NO: 317648 - RNA, 64 nt, Human; identical to SEQ ID NO: 317367

SEQ ID NO: 317649 - RNA, 64 nt, Human; identical to SEQ ID NO: 317368

SEQ ID NO: 317650 - RNA, 64 nt, Human; identical to SEQ ID NO: 317369

SEQ ID NO: 317651 - RNA, 64 nt, Human; identical to SEQ ID NO: 317370

SEQ ID NO: 317652 - RNA, 64 nt, Human; identical to SEQ ID NO: 317373

SEQ ID NO: 317653 - RNA, 64 nt, Human; identical to SEQ ID NO: 317374

SEQ ID NO: 317654 - RNA, 64 nt, Human; identical to SEQ ID NO: 317375

SEQ ID NO: 317655 - RNA, 64 nt, Human; identical to SEQ ID NO: 317376

SEQ ID NO: 317656 - RNA, 64 nt, Human; identical to SEQ ID NO: 317377

SEQ ID NO: 317657 - RNA, 64 nt, Human; identical to SEQ ID NO: 317378

SEQ ID NO: 317658 - RNA, 63 nt, Human
uccagcguuugccuggucuggaaguccuggccggccgcccacaucgggcucaccuuaaagguc

SEQ ID NO: 317659 - RNA, 63 nt, Human
ucccaucuaggaagugaggagcgucucugcccggccgcccaucgucugagauguggggagcgc

SEQ ID NO: 317660 - RNA, 63 nt, Human
cagcaucgcacucuggcagcaccgccucuucccgccgcccagcccaccccauggccggcuuuc

SEQ ID NO: 317661 - RNA, 64 nt, Human; identical to SEQ ID NO: 317379

SEQ ID NO: 317662 - RNA, 64 nt, Human; identical to SEQ ID NO: 317380

SEQ ID NO: 317663 - RNA, 64 nt, Human; identical to SEQ ID NO: 317381

SEQ ID NO: 317664 - RNA, 64 nt, Human; identical to SEQ ID NO: 317382

SEQ ID NO: 317665 - RNA, 64 nt, Human; identical to SEQ ID NO: 317383

SEQ ID NO: 317666 - RNA, 64 nt, Human; identical to SEQ ID NO: 317384

SEQ ID NO: 317667 - RNA, 64 nt, Human; identical to SEQ ID NO: 317385

SEQ ID NO: 317668 - RNA, 64 nt, Human; identical to SEQ ID NO: 317386

SEQ ID NO: 317669 - RNA, 64 nt, Human; identical to SEQ ID NO: 317387

SEQ ID NO: 317670 - RNA, 64 nt, Human; identical to SEQ ID NO: 317388

SEQ ID NO: 317671 - RNA, 64 nt, Human; identical to SEQ ID NO: 317392

SEQ ID NO: 317672 - RNA, 64 nt, Human; identical to SEQ ID NO: 317393

SEQ ID NO: 317673 - RNA, 64 nt, Human; identical to SEQ ID NO: 317394

SEQ ID NO: 317674 - RNA, 64 nt, Human; identical to SEQ ID NO: 317395

SEQ ID NO: 317675 - RNA, 64 nt, Human; identical to SEQ ID NO: 317396

SEQ ID NO: 317676 - RNA, 52 nt, Human; identical to SEQ ID NO: 40857

SEQ ID NO: 317677 - RNA, 50 nt, Human; identical to SEQ ID NO: 40858

SEQ ID NO: 317678 - RNA, 60 nt, Human; identical to SEQ ID NO: 40859

SEQ ID NO: 317679 - RNA, 64 nt, Human; identical to SEQ ID NO: 317397

SEQ ID NO: 317680 - RNA, 64 nt, Human; identical to SEQ ID NO: 317398

SEQ ID NO: 317681 - RNA, 64 nt, Human; identical to SEQ ID NO: 317399

SEQ ID NO: 317682 - RNA, 64 nt, Human; identical to SEQ ID NO: 317400

SEQ ID NO: 317683 - RNA, 64 nt, Human; identical to SEQ ID NO: 317401

SEQ ID NO: 317684 - RNA, 64 nt, Human; identical to SEQ ID NO: 317402

SEQ ID NO: 317685 - RNA, 64 nt, Human; identical to SEQ ID NO: 317403

SEQ ID NO: 317686 - RNA, 64 nt, Human; identical to SEQ ID NO: 317404

SEQ ID NO: 317687 - RNA, 64 nt, Human; identical to SEQ ID NO: 317405

SEQ ID NO: 317688 - RNA, 64 nt, Human; identical to SEQ ID NO: 317406

SEQ ID NO: 317689 - RNA, 64 nt, Human; identical to SEQ ID NO: 317407

SEQ ID NO: 317690 - RNA, 64 nt, Human; identical to SEQ ID NO: 317411

SEQ ID NO: 317691 - RNA, 64 nt, Human; identical to SEQ ID NO: 317412

SEQ ID NO: 317692 - RNA, 64 nt, Human; identical to SEQ ID NO: 317413

SEQ ID NO: 317693 - RNA, 64 nt, Human; identical to SEQ ID NO: 317414

SEQ ID NO: 317694 - RNA, 63 nt, Human; identical to SEQ ID NO: 315934

SEQ ID NO: 317695 - RNA, 63 nt, Human
aaguauaacgucaggcccaaguguggacacacugccgcccaucccaucaggucaugaggaagg

SEQ ID NO: 317696 - RNA, 63 nt, Human
aacuccccucaccaggagaggcaccugcuuggugccgcccagggaaggggcucaggccugacg

SEQ ID NO: 317697 - RNA, 64 nt, Human; identical to SEQ ID NO: 317415

SEQ ID NO: 317698 - RNA, 64 nt, Human; identical to SEQ ID NO: 317416

SEQ ID NO: 317699 - RNA, 64 nt, Human; identical to SEQ ID NO: 317417

SEQ ID NO: 317700 - RNA, 64 nt, Human; identical to SEQ ID NO: 317418

SEQ ID NO: 317701 - RNA, 64 nt, Human; identical to SEQ ID NO: 317419

SEQ ID NO: 317702 - RNA, 64 nt, Human; identical to SEQ ID NO: 317420

SEQ ID NO: 317703 - RNA, 64 nt, Human; identical to SEQ ID NO: 317421

SEQ ID NO: 317704 - RNA, 64 nt, Human; identical to SEQ ID NO: 317422

SEQ ID NO: 317705 - RNA, 64 nt, Human; identical to SEQ ID NO: 317423

SEQ ID NO: 317706 - RNA, 64 nt, Human; identical to SEQ ID NO: 317424

SEQ ID NO: 317707 - RNA, 64 nt, Human; identical to SEQ ID NO: 317425

SEQ ID NO: 317708 - RNA, 64 nt, Human; identical to SEQ ID NO: 317426

SEQ ID NO: 317709 - RNA, 64 nt, Human; identical to SEQ ID NO: 317430

SEQ ID NO: 317710 - RNA, 64 nt, Human; identical to SEQ ID NO: 317431

SEQ ID NO: 317711 - RNA, 64 nt, Human; identical to SEQ ID NO: 317432

SEQ ID NO: 317712 - RNA, 63 nt, Human
ccugggcucuuccagccucagugugccucucuggccgcccacuggaugagcggugagacgaac

SEQ ID NO: 317713 - RNA, 63 nt, Human
ccuugagcuccgcuuuuugcugagaucacagcagccgcccacagacaguucacuuuuauuucu

SEQ ID NO: 317714 - RNA, 53 nt, Human; identical to SEQ ID NO: 40860

SEQ ID NO: 317715 - RNA, 64 nt, Human; identical to SEQ ID NO: 317433

SEQ ID NO: 317716 - RNA, 64 nt, Human; identical to SEQ ID NO: 317434

SEQ ID NO: 317717 - RNA, 64 nt, Human; identical to SEQ ID NO: 317435

SEQ ID NO: 317718 - RNA, 64 nt, Human; identical to SEQ ID NO: 317436

SEQ ID NO: 317719 - RNA, 64 nt, Human; identical to SEQ ID NO: 317437

SEQ ID NO: 317720 - RNA, 64 nt, Human; identical to SEQ ID NO: 317438

SEQ ID NO: 317721 - RNA, 64 nt, Human; identical to SEQ ID NO: 317439

SEQ ID NO: 317722 - RNA, 64 nt, Human; identical to SEQ ID NO: 317440

SEQ ID NO: 317723 - RNA, 64 nt, Human; identical to SEQ ID NO: 317441

SEQ ID NO: 317724 - RNA, 64 nt, Human; identical to SEQ ID NO: 317442

SEQ ID NO: 317725 - RNA, 64 nt, Human; identical to SEQ ID NO: 317443

SEQ ID NO: 317726 - RNA, 64 nt, Human; identical to SEQ ID NO: 317444

SEQ ID NO: 317727 - RNA, 64 nt, Human; identical to SEQ ID NO: 317445

SEQ ID NO: 317728 - RNA, 64 nt, Human; identical to SEQ ID NO: 317448

SEQ ID NO: 317729 - RNA, 63 nt, Human; identical to SEQ ID NO: 315060

SEQ ID NO: 317730 - RNA, 63 nt, Human
ggcaagaagcugcgcugaaggcccgggcucccggccgcccagggucgccgccgccccucgcac

SEQ ID NO: 317731 - RNA, 63 nt, Human
aguuuuucuaacauggaaaaagauucucagccugccgcccagcaugcagguggccucgcuuug

SEQ ID NO: 317732 - RNA, 64 nt, Human; identical to SEQ ID NO: 317180

SEQ ID NO: 317733 - RNA, 64 nt, Human; identical to SEQ ID NO: 317181

SEQ ID NO: 317734 - RNA, 64 nt, Human; identical to SEQ ID NO: 317182

SEQ ID NO: 317735 - RNA, 64 nt, Human; identical to SEQ ID NO: 317183

SEQ ID NO: 317736 - RNA, 64 nt, Human; identical to SEQ ID NO: 317184

SEQ ID NO: 317737 - RNA, 64 nt, Human; identical to SEQ ID NO: 317185

SEQ ID NO: 317738 - RNA, 64 nt, Human; identical to SEQ ID NO: 317186

SEQ ID NO: 317739 - RNA, 64 nt, Human; identical to SEQ ID NO: 317187

SEQ ID NO: 317740 - RNA, 64 nt, Human; identical to SEQ ID NO: 317188

SEQ ID NO: 317741 - RNA, 64 nt, Human; identical to SEQ ID NO: 317189

SEQ ID NO: 317742 - RNA, 64 nt, Human; identical to SEQ ID NO: 317190

SEQ ID NO: 317743 - RNA, 64 nt, Human; identical to SEQ ID NO: 317191

SEQ ID NO: 317744 - RNA, 64 nt, Human; identical to SEQ ID NO: 317192

SEQ ID NO: 317745 - RNA, 64 nt, Human; identical to SEQ ID NO: 317193

SEQ ID NO: 317746 - RNA, 64 nt, Human; identical to SEQ ID NO: 317194

SEQ ID NO: 317747 - RNA, 63 nt, Human; identical to SEQ ID NO: 315935

SEQ ID NO: 317748 - RNA, 63 nt, Human
aagauugaaggaugugcagggcuuccucucagagccgcccaaacugccguugauguguggagg

SEQ ID NO: 317749 - RNA, 63 nt, Human
ugugccccgcgggagcuccaggccgccccuccugccgcccagcuucgugacuccacggcccca

SEQ ID NO: 317750 - RNA, 64 nt, Human; identical to SEQ ID NO: 317195

SEQ ID NO: 317751 - RNA, 64 nt, Human; identical to SEQ ID NO: 317196

SEQ ID NO: 317752 - RNA, 64 nt, Human; identical to SEQ ID NO: 317197

SEQ ID NO: 317753 - RNA, 64 nt, Human; identical to SEQ ID NO: 317198

SEQ ID NO: 317754 - RNA, 64 nt, Human; identical to SEQ ID NO: 317199

SEQ ID NO: 317755 - RNA, 64 nt, Human; identical to SEQ ID NO: 317200

SEQ ID NO: 317756 - RNA, 64 nt, Human; identical to SEQ ID NO: 317201

SEQ ID NO: 317757 - RNA, 64 nt, Human; identical to SEQ ID NO: 317202

SEQ ID NO: 317758 - RNA, 64 nt, Human; identical to SEQ ID NO: 317203

SEQ ID NO: 317759 - RNA, 64 nt, Human; identical to SEQ ID NO: 317204

SEQ ID NO: 317760 - RNA, 64 nt, Human; identical to SEQ ID NO: 317205

SEQ ID NO: 317761 - RNA, 64 nt, Human; identical to SEQ ID NO: 317206

SEQ ID NO: 317762 - RNA, 64 nt, Human; identical to SEQ ID NO: 317207

SEQ ID NO: 317763 - RNA, 64 nt, Human; identical to SEQ ID NO: 317208

SEQ ID NO: 317764 - RNA, 64 nt, Human; identical to SEQ ID NO: 317209

SEQ ID NO: 317765 - RNA, 63 nt, Human
uagccucuguagcuggugguggcagcguggggugccgcccagcgugcuggguccuggcagugc

SEQ ID NO: 317766 - RNA, 63 nt, Human
ugggcagaggccagaguagaauggaggaugauugccgcccaggggacgagcucagcccugcgc

SEQ ID NO: 317767 - RNA, 64 nt, Human; identical to SEQ ID NO: 317210

SEQ ID NO: 317768 - RNA, 64 nt, Human; identical to SEQ ID NO: 317211

SEQ ID NO: 317769 - RNA, 64 nt, Human; identical to SEQ ID NO: 317212

SEQ ID NO: 317770 - RNA, 64 nt, Human; identical to SEQ ID NO: 317213

SEQ ID NO: 317771 - RNA, 64 nt, Human; identical to SEQ ID NO: 317214

SEQ ID NO: 317772 - RNA, 64 nt, Human; identical to SEQ ID NO: 317215

SEQ ID NO: 317773 - RNA, 64 nt, Human; identical to SEQ ID NO: 317216

SEQ ID NO: 317774 - RNA, 64 nt, Human; identical to SEQ ID NO: 317217

SEQ ID NO: 317775 - RNA, 64 nt, Human; identical to SEQ ID NO: 317218

SEQ ID NO: 317776 - RNA, 64 nt, Human; identical to SEQ ID NO: 317219

SEQ ID NO: 317777 - RNA, 64 nt, Human; identical to SEQ ID NO: 317220

SEQ ID NO: 317778 - RNA, 64 nt, Human; identical to SEQ ID NO: 317221

SEQ ID NO: 317779 - RNA, 64 nt, Human; identical to SEQ ID NO: 317222

SEQ ID NO: 317780 - RNA, 64 nt, Human; identical to SEQ ID NO: 317223

SEQ ID NO: 317781 - RNA, 64 nt, Human; identical to SEQ ID NO: 317224

SEQ ID NO: 317782 - RNA, 63 nt, Human
ugggggucagaccacccccuagaggagccacgugccgcccagccaccuucaaugccugccacc

SEQ ID NO: 317783 - RNA, 63 nt, Human
acgcacuggaucacccaggucccagcagacauggccgcccaaagucagcaagccuccuuugug

SEQ ID NO: 317784 - RNA, 63 nt, Human; identical to SEQ ID NO: 315936

SEQ ID NO: 317785 - RNA, 64 nt, Human; identical to SEQ ID NO: 317226

SEQ ID NO: 317786 - RNA, 64 nt, Human; identical to SEQ ID NO: 317227

SEQ ID NO: 317787 - RNA, 64 nt, Human; identical to SEQ ID NO: 317228

SEQ ID NO: 317788 - RNA, 64 nt, Human; identical to SEQ ID NO: 317229

SEQ ID NO: 317789 - RNA, 64 nt, Human; identical to SEQ ID NO: 317230

SEQ ID NO: 317790 - RNA, 64 nt, Human; identical to SEQ ID NO: 317231

SEQ ID NO: 317791 - RNA, 64 nt, Human; identical to SEQ ID NO: 317232

SEQ ID NO: 317792 - RNA, 64 nt, Human; identical to SEQ ID NO: 317233

SEQ ID NO: 317793 - RNA, 64 nt, Human; identical to SEQ ID NO: 317234

SEQ ID NO: 317794 - RNA, 64 nt, Human; identical to SEQ ID NO: 317235

SEQ ID NO: 317795 - RNA, 64 nt, Human; identical to SEQ ID NO: 317236

SEQ ID NO: 317796 - RNA, 64 nt, Human; identical to SEQ ID NO: 317237

SEQ ID NO: 317797 - RNA, 64 nt, Human; identical to SEQ ID NO: 317238

SEQ ID NO: 317798 - RNA, 64 nt, Human; identical to SEQ ID NO: 317239

SEQ ID NO: 317799 - RNA, 64 nt, Human; identical to SEQ ID NO: 317240

SEQ ID NO: 317800 - RNA, 63 nt, Human
gccaccgcaugaggagauggagggcgggacugggccgcccagccccuugacuccagccucgac

SEQ ID NO: 317801 - RNA, 63 nt, Human; identical to SEQ ID NO: 315953

SEQ ID NO: 317802 - RNA, 63 nt, Human
acccagcaggaggaagcccaggagcuggguccugccgcccaggagcugggcccugccacccag

SEQ ID NO: 317803 - RNA, 64 nt, Human; identical to SEQ ID NO: 317241

SEQ ID NO: 317804 - RNA, 64 nt, Human; identical to SEQ ID NO: 317244

SEQ ID NO: 317805 - RNA, 64 nt, Human; identical to SEQ ID NO: 317245

SEQ ID NO: 317806 - RNA, 64 nt, Human; identical to SEQ ID NO: 317246

SEQ ID NO: 317807 - RNA, 64 nt, Human; identical to SEQ ID NO: 317247

SEQ ID NO: 317808 - RNA, 64 nt, Human; identical to SEQ ID NO: 317248

SEQ ID NO: 317809 - RNA, 64 nt, Human; identical to SEQ ID NO: 317249

SEQ ID NO: 317810 - RNA, 64 nt, Human; identical to SEQ ID NO: 317250

SEQ ID NO: 317811 - RNA, 64 nt, Human; identical to SEQ ID NO: 317251

SEQ ID NO: 317812 - RNA, 64 nt, Human; identical to SEQ ID NO: 317252

SEQ ID NO: 317813 - RNA, 64 nt, Human; identical to SEQ ID NO: 317253

SEQ ID NO: 317814 - RNA, 64 nt, Human; identical to SEQ ID NO: 317254

SEQ ID NO: 317815 - RNA, 64 nt, Human; identical to SEQ ID NO: 317255

SEQ ID NO: 317816 - RNA, 64 nt, Human; identical to SEQ ID NO: 317256

SEQ ID NO: 317817 - RNA, 64 nt, Human; identical to SEQ ID NO: 317257

SEQ ID NO: 317818 - RNA, 63 nt, Human
ccaagggcagccauggugcucuguacugcucgggccgcccaggucacagagccugagcuucgu

SEQ ID NO: 317819 - RNA, 63 nt, Human
aggcugcacaggccagggcucgggcaugugguggccgcccaccaggggccuucacgucugccc

SEQ ID NO: 317820 - RNA, 63 nt, Human
gcccuggagcucaacaagcggaaggcuguagaagccgcccagcuggccgaggaccugaaggug

SEQ ID NO: 317821 - RNA, 64 nt, Human; identical to SEQ ID NO: 317258

SEQ ID NO: 317822 - RNA, 64 nt, Human; identical to SEQ ID NO: 317259

SEQ ID NO: 317823 - RNA, 62 nt, Human; identical to SEQ ID NO: 317263

SEQ ID NO: 317824 - RNA, 64 nt, Human; identical to SEQ ID NO: 317264

SEQ ID NO: 317825 - RNA, 64 nt, Human; identical to SEQ ID NO: 317265

SEQ ID NO: 317826 - RNA, 64 nt, Human; identical to SEQ ID NO: 317266

SEQ ID NO: 317827 - RNA, 64 nt, Human; identical to SEQ ID NO: 317267

SEQ ID NO: 317828 - RNA, 64 nt, Human; identical to SEQ ID NO: 317268

SEQ ID NO: 317829 - RNA, 64 nt, Human; identical to SEQ ID NO: 317269

SEQ ID NO: 317830 - RNA, 64 nt, Human; identical to SEQ ID NO: 317270

SEQ ID NO: 317831 - RNA, 64 nt, Human; identical to SEQ ID NO: 317271

SEQ ID NO: 317832 - RNA, 64 nt, Human; identical to SEQ ID NO: 317272

SEQ ID NO: 317833 - RNA, 64 nt, Human; identical to SEQ ID NO: 317273

SEQ ID NO: 317834 - RNA, 64 nt, Human; identical to SEQ ID NO: 317274

SEQ ID NO: 317835 - RNA, 64 nt, Human; identical to SEQ ID NO: 317275

SEQ ID NO: 317836 - RNA, 63 nt, Human
cagcugugagagaggagcagguccucagcccaugccgcccacuaggccucagaccacagggga

SEQ ID NO: 317837 - RNA, 63 nt, Human
ggccagcuuggcagggauccccaggaggccugggccgcccagaggcuccucucaggcugggcc

SEQ ID NO: 317838 - RNA, 63 nt, Human
cccuacacgauccgcaacccaugcccuggaccagccgcccagaucaugccgccgcagcugguu

SEQ ID NO: 317839 - RNA, 64 nt, Human; identical to SEQ ID NO: 317276

SEQ ID NO: 317840 - RNA, 64 nt, Human; identical to SEQ ID NO: 317277

SEQ ID NO: 317841 - RNA, 64 nt, Human; identical to SEQ ID NO: 317278

SEQ ID NO: 317842 - RNA, 64 nt, Human; identical to SEQ ID NO: 317282

SEQ ID NO: 317843 - RNA, 64 nt, Human; identical to SEQ ID NO: 317283

SEQ ID NO: 317844 - RNA, 64 nt, Human; identical to SEQ ID NO: 317284

SEQ ID NO: 317845 - RNA, 64 nt, Human; identical to SEQ ID NO: 317285

SEQ ID NO: 317846 - RNA, 64 nt, Human; identical to SEQ ID NO: 317286

SEQ ID NO: 317847 - RNA, 64 nt, Human; identical to SEQ ID NO: 317287

SEQ ID NO: 317848 - RNA, 64 nt, Human; identical to SEQ ID NO: 317288

SEQ ID NO: 317849 - RNA, 64 nt, Human; identical to SEQ ID NO: 317289

SEQ ID NO: 317850 - RNA, 64 nt, Human; identical to SEQ ID NO: 317290

SEQ ID NO: 317851 - RNA, 64 nt, Human; identical to SEQ ID NO: 317291

SEQ ID NO: 317852 - RNA, 64 nt, Human; identical to SEQ ID NO: 317292

SEQ ID NO: 317853 - RNA, 64 nt, Human; identical to SEQ ID NO: 317293

SEQ ID NO: 317854 - RNA, 63 nt, Human
aucauuuagucuaacaacugcccaguuuccagucgggggaacugaggcagagcaagguaguga

SEQ ID NO: 317855 - RNA, 63 nt, Human
aggaauggcauggacaucuccgccuccgcgacacgggggaacuguuuucuugaugaugcugug

SEQ ID NO: 317856 - RNA, 64 nt, Human; identical to SEQ ID NO: 317294

SEQ ID NO: 317857 - RNA, 64 nt, Human; identical to SEQ ID NO: 317295

SEQ ID NO: 317858 - RNA, 64 nt, Human; identical to SEQ ID NO: 317296

SEQ ID NO: 317859 - RNA, 64 nt, Human; identical to SEQ ID NO: 317297

SEQ ID NO: 317860 - RNA, 64 nt, Human; identical to SEQ ID NO: 317298

SEQ ID NO: 317861 - RNA, 64 nt, Human; identical to SEQ ID NO: 317299

SEQ ID NO: 317862 - RNA, 64 nt, Human; identical to SEQ ID NO: 317300

SEQ ID NO: 317863 - RNA, 64 nt, Human; identical to SEQ ID NO: 317301

SEQ ID NO: 317864 - RNA, 64 nt, Human; identical to SEQ ID NO: 317302

SEQ ID NO: 317865 - RNA, 64 nt, Human; identical to SEQ ID NO: 317303

SEQ ID NO: 317866 - RNA, 64 nt, Human; identical to SEQ ID NO: 317304

SEQ ID NO: 317867 - RNA, 64 nt, Human; identical to SEQ ID NO: 317305

SEQ ID NO: 317868 - RNA, 64 nt, Human; identical to SEQ ID NO: 317306

SEQ ID NO: 317869 - RNA, 64 nt, Human; identical to SEQ ID NO: 317307

SEQ ID NO: 317870 - RNA, 64 nt, Human; identical to SEQ ID NO: 317308

SEQ ID NO: 317871 - RNA, 63 nt, Human
gaggagccagcggccaccugcggggagaccaccgccgcccagacuacugacggcaggggcugc

SEQ ID NO: 317872 - RNA, 63 nt, Human
gagucacccugagggccccgggcaguugcccuggccgcccagugacgcccaccggcucccucc

SEQ ID NO: 317873 - RNA, 64 nt, Human
uaaacacuuaacuggauuuuggaauaauaaaacucucguccaauuuggcuuuuaaaaagcaggc

SEQ ID NO: 317874 - RNA, 64 nt, Human; identical to SEQ ID NO: 317309

SEQ ID NO: 317875 - RNA, 64 nt, Human; identical to SEQ ID NO: 317310

SEQ ID NO: 317876 - RNA, 64 nt, Human; identical to SEQ ID NO: 317311

SEQ ID NO: 317877 - RNA, 64 nt, Human; identical to SEQ ID NO: 317312

SEQ ID NO: 317878 - RNA, 64 nt, Human; identical to SEQ ID NO: 317313

SEQ ID NO: 317879 - RNA, 64 nt, Human; identical to SEQ ID NO: 317317

SEQ ID NO: 317880 - RNA, 64 nt, Human; identical to SEQ ID NO: 317318

SEQ ID NO: 317881 - RNA, 64 nt, Human; identical to SEQ ID NO: 317319

SEQ ID NO: 317882 - RNA, 64 nt, Human; identical to SEQ ID NO: 317320

SEQ ID NO: 317883 - RNA, 64 nt, Human; identical to SEQ ID NO: 317321

SEQ ID NO: 317884 - RNA, 64 nt, Human; identical to SEQ ID NO: 317322

SEQ ID NO: 317885 - RNA, 64 nt, Human; identical to SEQ ID NO: 317323

SEQ ID NO: 317886 - RNA, 64 nt, Human; identical to SEQ ID NO: 317324

SEQ ID NO: 317887 - RNA, 64 nt, Human; identical to SEQ ID NO: 317325

SEQ ID NO: 317888 - RNA, 64 nt, Human; identical to SEQ ID NO: 317326

SEQ ID NO: 317889 - RNA, 63 nt, Human
uuuuuuuuuuuuuuugagagagagucuuacucugccgcccaaacuggagugcaguggcacaau

SEQ ID NO: 317890 - RNA, 63 nt, Human
auguugcuucccucuccugucuuucccacuggagccgcccaagcuuguagguggguggugugc

SEQ ID NO: 317891 - RNA, 63 nt, Human
cugaaggagaaagaggccgcugcugccgccgccgccgcccaccagcaggcccugcgggaggag

SEQ ID NO: 317892 - RNA, 64 nt, Human; identical to SEQ ID NO: 317327

SEQ ID NO: 317893 - RNA, 64 nt, Human; identical to SEQ ID NO: 317328

SEQ ID NO: 317894 - RNA, 64 nt, Human; identical to SEQ ID NO: 317329

SEQ ID NO: 317895 - RNA, 64 nt, Human; identical to SEQ ID NO: 317330

SEQ ID NO: 317896 - RNA, 64 nt, Human; identical to SEQ ID NO: 317331

SEQ ID NO: 317897 - RNA, 64 nt, Human; identical to SEQ ID NO: 317332

SEQ ID NO: 317898 - RNA, 64 nt, Human; identical to SEQ ID NO: 317336

SEQ ID NO: 317899 - RNA, 64 nt, Human; identical to SEQ ID NO: 317337

SEQ ID NO: 317900 - RNA, 64 nt, Human; identical to SEQ ID NO: 317338

SEQ ID NO: 317901 - RNA, 64 nt, Human; identical to SEQ ID NO: 317339

SEQ ID NO: 317902 - RNA, 64 nt, Human; identical to SEQ ID NO: 317340

SEQ ID NO: 317903 - RNA, 64 nt, Human; identical to SEQ ID NO: 317341

SEQ ID NO: 317904 - RNA, 64 nt, Human; identical to SEQ ID NO: 317342

SEQ ID NO: 317905 - RNA, 64 nt, Human; identical to SEQ ID NO: 317343

SEQ ID NO: 317906 - RNA, 64 nt, Human; identical to SEQ ID NO: 317344

SEQ ID NO: 317907 - RNA, 62 nt, Human
ugagcccaggaguuggaggcugcagugcgcuacgaucacaccacugcacaccagccugggga

SEQ ID NO: 317908 - RNA, 62 nt, Human
uuuggaugcagugcucgcuguugcugaauaggcgaucacaacgugcauugugcuucuuucuu

SEQ ID NO: 317909 - RNA, 63 nt, Human
uaccccaagacucccaugagggagaugccaugagccgcccaaggccuuccccuggcacuggca

SEQ ID NO: 317910 - RNA, 64 nt, Human; identical to SEQ ID NO: 317345

SEQ ID NO: 317911 - RNA, 64 nt, Human; identical to SEQ ID NO: 317346

SEQ ID NO: 317912 - RNA, 64 nt, Human; identical to SEQ ID NO: 317347

SEQ ID NO: 317913 - RNA, 64 nt, Human; identical to SEQ ID NO: 317348

SEQ ID NO: 317914 - RNA, 64 nt, Human; identical to SEQ ID NO: 317349

SEQ ID NO: 317915 - RNA, 64 nt, Human; identical to SEQ ID NO: 317350

SEQ ID NO: 317916 - RNA, 64 nt, Human; identical to SEQ ID NO: 317351

SEQ ID NO: 317917 - RNA, 64 nt, Human; identical to SEQ ID NO: 317355

SEQ ID NO: 317918 - RNA, 64 nt, Human; identical to SEQ ID NO: 317356

SEQ ID NO: 317919 - RNA, 64 nt, Human; identical to SEQ ID NO: 317357

SEQ ID NO: 317920 - RNA, 64 nt, Human; identical to SEQ ID NO: 317358

SEQ ID NO: 317921 - RNA, 64 nt, Human; identical to SEQ ID NO: 317359

SEQ ID NO: 317922 - RNA, 64 nt, Human; identical to SEQ ID NO: 317360

SEQ ID NO: 317923 - RNA, 64 nt, Human; identical to SEQ ID NO: 317361

SEQ ID NO: 317924 - RNA, 64 nt, Human; identical to SEQ ID NO: 317362

SEQ ID NO: 317925 - RNA, 63 nt, Human
acccagcgugcaacagccacgggaagccuuucugccgcccaggcccacaggucucgagacgca

SEQ ID NO: 317926 - RNA, 63 nt, Human; identical to SEQ ID NO: 315001

SEQ ID NO: 317927 - RNA, 63 nt, Human
gguugcuguuugguucugcaggcugguggggaggccgcccaucgugguggggcaucuguccag

SEQ ID NO: 317928 - RNA, 64 nt, Human; identical to SEQ ID NO: 317363

SEQ ID NO: 317929 - RNA, 64 nt, Human; identical to SEQ ID NO: 317364

SEQ ID NO: 317930 - RNA, 64 nt, Human; identical to SEQ ID NO: 317365

SEQ ID NO: 317931 - RNA, 64 nt, Human; identical to SEQ ID NO: 317366

SEQ ID NO: 317932 - RNA, 64 nt, Human; identical to SEQ ID NO: 317367

SEQ ID NO: 317933 - RNA, 64 nt, Human; identical to SEQ ID NO: 317368

SEQ ID NO: 317934 - RNA, 64 nt, Human; identical to SEQ ID NO: 317369

SEQ ID NO: 317935 - RNA, 64 nt, Human; identical to SEQ ID NO: 317370

SEQ ID NO: 317936 - RNA, 64 nt, Human; identical to SEQ ID NO: 317373

SEQ ID NO: 317937 - RNA, 64 nt, Human; identical to SEQ ID NO: 317374

SEQ ID NO: 317938 - RNA, 64 nt, Human; identical to SEQ ID NO: 317375

SEQ ID NO: 317939 - RNA, 64 nt, Human; identical to SEQ ID NO: 317376

SEQ ID NO: 317940 - RNA, 64 nt, Human; identical to SEQ ID NO: 317377

SEQ ID NO: 317941 - RNA, 64 nt, Human; identical to SEQ ID NO: 317378

SEQ ID NO: 317942 - RNA, 64 nt, Human; identical to SEQ ID NO: 317379

SEQ ID NO: 317943 - RNA, 63 nt, Human
gcccacaggccuggagccagcuagcgaccuugugccgcccagcuguccauggcccgugcagag

SEQ ID NO: 317944 - RNA, 63 nt, Human
acccaugaaaugcccugccuccccauucgcauggccgcccaagaggcuggcucccagcauguc

SEQ ID NO: 317945 - RNA, 63 nt, Human
aacgugucauuugcucgacccuggcccacccuugccgcccagcuguugugcugggcacagucu

SEQ ID NO: 317946 - RNA, 64 nt, Human; identical to SEQ ID NO: 317380

SEQ ID NO: 317947 - RNA, 64 nt, Human; identical to SEQ ID NO: 317381

SEQ ID NO: 317948 - RNA, 64 nt, Human; identical to SEQ ID NO: 317382

SEQ ID NO: 317949 - RNA, 64 nt, Human; identical to SEQ ID NO: 317383

SEQ ID NO: 317950 - RNA, 64 nt, Human; identical to SEQ ID NO: 317384

SEQ ID NO: 317951 - RNA, 64 nt, Human; identical to SEQ ID NO: 317385

SEQ ID NO: 317952 - RNA, 64 nt, Human; identical to SEQ ID NO: 317386

SEQ ID NO: 317953 - RNA, 64 nt, Human; identical to SEQ ID NO: 317387

SEQ ID NO: 317954 - RNA, 64 nt, Human; identical to SEQ ID NO: 317388

SEQ ID NO: 317955 - RNA, 64 nt, Human; identical to SEQ ID NO: 317392

SEQ ID NO: 317956 - RNA, 64 nt, Human; identical to SEQ ID NO: 317393

SEQ ID NO: 317957 - RNA, 64 nt, Human; identical to SEQ ID NO: 317394

SEQ ID NO: 317958 - RNA, 64 nt, Human; identical to SEQ ID NO: 317395

SEQ ID NO: 317959 - RNA, 64 nt, Human; identical to SEQ ID NO: 317396

SEQ ID NO: 317960 - RNA, 64 nt, Human; identical to SEQ ID NO: 317397

SEQ ID NO: 317961 - RNA, 63 nt, Human; identical to SEQ ID NO: 315955

SEQ ID NO: 317962 - RNA, 63 nt, Human
agcuugcuguggggcagugcagggaguccugcggccgcccaggugucaggagagguccccgcc

SEQ ID NO: 317963 - RNA, 63 nt, Human
gccagcugggucuccggggacccugggcccugggccgcccauuccuggcccucccgcugcauc

SEQ ID NO: 317964 - RNA, 64 nt, Human; identical to SEQ ID NO: 317398

SEQ ID NO: 317965 - RNA, 64 nt, Human; identical to SEQ ID NO: 317399

SEQ ID NO: 317966 - RNA, 64 nt, Human; identical to SEQ ID NO: 317400

SEQ ID NO: 317967 - RNA, 64 nt, Human; identical to SEQ ID NO: 317401

SEQ ID NO: 317968 - RNA, 64 nt, Human; identical to SEQ ID NO: 317402

SEQ ID NO: 317969 - RNA, 64 nt, Human; identical to SEQ ID NO: 317403

SEQ ID NO: 317970 - RNA, 64 nt, Human; identical to SEQ ID NO: 317404

SEQ ID NO: 317971 - RNA, 64 nt, Human; identical to SEQ ID NO: 317405

SEQ ID NO: 317972 - RNA, 64 nt, Human; identical to SEQ ID NO: 317406

SEQ ID NO: 317973 - RNA, 64 nt, Human; identical to SEQ ID NO: 317407

SEQ ID NO: 317974 - RNA, 64 nt, Human; identical to SEQ ID NO: 317411

SEQ ID NO: 317975 - RNA, 64 nt, Human; identical to SEQ ID NO: 317412

SEQ ID NO: 317976 - RNA, 64 nt, Human; identical to SEQ ID NO: 317413

SEQ ID NO: 317977 - RNA, 64 nt, Human; identical to SEQ ID NO: 317414

SEQ ID NO: 317978 - RNA, 64 nt, Human; identical to SEQ ID NO: 317415

SEQ ID NO: 317979 - RNA, 63 nt, Human; identical to SEQ ID NO: 315002

SEQ ID NO: 317980 - RNA, 63 nt, Human
uguaaggggcucugggacgcccagacccugcccgccgcccaccugguggugacaagcuccagc

SEQ ID NO: 317981 - RNA, 63 nt, Human
auaugugugaauguguggcaucauuucacuucagccgcccaauuccaucucuccucugcagcc

SEQ ID NO: 317982 - RNA, 64 nt, Human; identical to SEQ ID NO: 317416

SEQ ID NO: 317983 - RNA, 64 nt, Human; identical to SEQ ID NO: 317417

SEQ ID NO: 317984 - RNA, 64 nt, Human; identical to SEQ ID NO: 317418

SEQ ID NO: 317985 - RNA, 64 nt, Human; identical to SEQ ID NO: 317419

SEQ ID NO: 317986 - RNA, 64 nt, Human; identical to SEQ ID NO: 317420

SEQ ID NO: 317987 - RNA, 64 nt, Human; identical to SEQ ID NO: 317421

SEQ ID NO: 317988 - RNA, 64 nt, Human; identical to SEQ ID NO: 317422

SEQ ID NO: 317989 - RNA, 64 nt, Human; identical to SEQ ID NO: 317423

SEQ ID NO: 317990 - RNA, 64 nt, Human; identical to SEQ ID NO: 317424

SEQ ID NO: 317991 - RNA, 64 nt, Human; identical to SEQ ID NO: 317425

SEQ ID NO: 317992 - RNA, 64 nt, Human; identical to SEQ ID NO: 317426

SEQ ID NO: 317993 - RNA, 64 nt, Human; identical to SEQ ID NO: 317430

SEQ ID NO: 317994 - RNA, 64 nt, Human; identical to SEQ ID NO: 317431

SEQ ID NO: 317995 - RNA, 64 nt, Human; identical to SEQ ID NO: 317432

SEQ ID NO: 317996 - RNA, 64 nt, Human; identical to SEQ ID NO: 317433

SEQ ID NO: 317997 - RNA, 63 nt, Human
cgguggcgccagcccuaggcuacccuugccaaggccgcccaccugcaucagccucuggccaga

SEQ ID NO: 317998 - RNA, 61 nt, Human; identical to SEQ ID NO: 315020

SEQ ID NO: 317999 - RNA, 61 nt, Human
ucucgacuucccaaaucaaaggcccuuuucagggccgcccacaguuuuccgcaaaagagcu

SEQ ID NO: 318000 - RNA, 64 nt, Human; identical to SEQ ID NO: 317434

SEQ ID NO: 318001 - RNA, 64 nt, Human; identical to SEQ ID NO: 317435

SEQ ID NO: 318002 - RNA, 64 nt, Human; identical to SEQ ID NO: 317436

SEQ ID NO: 318003 - RNA, 64 nt, Human; identical to SEQ ID NO: 317437

SEQ ID NO: 318004 - RNA, 64 nt, Human; identical to SEQ ID NO: 317438

SEQ ID NO: 318005 - RNA, 64 nt, Human; identical to SEQ ID NO: 317439

SEQ ID NO: 318006 - RNA, 64 nt, Human; identical to SEQ ID NO: 317440

SEQ ID NO: 318007 - RNA, 64 nt, Human; identical to SEQ ID NO: 317441

SEQ ID NO: 318008 - RNA, 64 nt, Human; identical to SEQ ID NO: 317442

SEQ ID NO: 318009 - RNA, 64 nt, Human; identical to SEQ ID NO: 317443

SEQ ID NO: 318010 - RNA, 64 nt, Human; identical to SEQ ID NO: 317444

SEQ ID NO: 318011 - RNA, 64 nt, Human; identical to SEQ ID NO: 317445

SEQ ID NO: 318012 - RNA, 64 nt, Human; identical to SEQ ID NO: 317448

SEQ ID NO: 318013 - RNA, 64 nt, Human
aauugauugguagguuuucauaagcauuguuucuuuaaggcauggaaagggaagaaugcucaag

SEQ ID NO: 318014 - RNA, 64 nt, Human
uuuuuuuuuuuuuuuguaauauacagcuuuuuuuuuaaggcaucauuuucgagggucuaaaauu

SEQ ID NO: 318015 - RNA, 63 nt, Human
gguggggccuggcuuuggggcaagacugagccacgggggaagggggaaucccguaccugcugc

SEQ ID NO: 318016 - RNA, 63 nt, Human
uucgggugagcguccuggccugggcccuaugcccgggggaagggugaaauugggguucaggcc

SEQ ID NO: 318017 - RNA, 63 nt, Human
cccugccggccacaagggagcagcguccgcgccgccgcccaccggcccucccgccagcuccuc

SEQ ID NO: 318018 - RNA, 64 nt, Human
gguggcucaugccuguaaucccaccacuuuuuuuuuaaggcaggcggaucaccugaggucagga

SEQ ID NO: 318019 - RNA, 64 nt, Human
uccucccugacagacauccagccccuaguaauacuuaaggcacuauggcacuuagcuuugaagu

SEQ ID NO: 318020 - RNA, 64 nt, Human
auauugcuuugauagcugcuaucaugaccccuuuuuaaggcaauucuaaucuuucauaacuaca

SEQ ID NO: 318021 - RNA, 64 nt, Human
caaugagccuuugcaaaauuuucaagcggaaauuuuaaggcaccucauuaucuuucauaacugu

SEQ ID NO: 318022 - RNA, 64 nt, Human
uguagcauuucuuaauaacaucguugugauguucuuaaggcagaucuuucuucauaaaaaggaa

SEQ ID NO: 318023 - RNA, 64 nt, Human
gcaucaguuugcaguucacugcaaaucuuuuacauuaaggcaaagauugaaaacaugcuuaacc

SEQ ID NO: 318024 - RNA, 64 nt, Human
aaauaaaggacaucugaccuccuuuuuugguacauuaaggcacuuuauaaauggacuuuuauug

SEQ ID NO: 318025 - RNA, 64 nt, Human
agaaugauguaaauaguuaaccuucaguagucuauuaaggcauuaauacuucucuggacaugcg

SEQ ID NO: 318026 - RNA, 64 nt, Human
uucauacugaugcugcaguucagggcuggaguuguuaaggcauugaccuccacccaccugcccc

SEQ ID NO: 318027 - RNA, 64 nt, Human
acagcagaucggucagcaccagaagucaacugaguuaaggcaggaaaagaaauaagcccaacca

SEQ ID NO: 318028 - RNA, 64 nt, Human
aagccaaagaaacaagcugugcaggcauggucccuuaaggcacagugggagcugagcuggaagg

SEQ ID NO: 318029 - RNA, 64 nt, Human
aggaagaggggaaugcacaucuuuugcgccacuauuaaggcaccugucaccuuacaucucaauc

SEQ ID NO: 318030 - RNA, 63 nt, Human
ugccuugggagguguguggaauaaauuauuuuuguuaaggcaagcauugguguguucuuuaac

SEQ ID NO: 318031 - RNA, 64 nt, Human
cauauacauagccacauuuacaguuuuaaccauuuuaaggcauguaauucagugggguuaggua

SEQ ID NO: 318032 - RNA, 63 nt, Human
ucuaguccuggcggaacacacugggggugggggcgggggaagaugcgguaaugaaaccgguua

SEQ ID NO: 318033 - RNA, 63 nt, Human
cauuuggguaagccgguggcuggucucgucugccgggggaaggguggggaggugcaaugggau

SEQ ID NO: 318034 - RNA, 63 nt, Human
ucuggcucccgagcucagacacagcccccaggagccgcccaccacggcugugggaacuuccag

SEQ ID NO: 318035 - RNA, 63 nt, Human
ugugcaguggacugugggucucccauaugcggugccgcccaaagguggcuuugccucaagcaa

SEQ ID NO: 318036 - RNA, 64 nt, Human
accaaguaauuggcaugacaucugagcacagaaauuaaggcaaaaaaccaaagcaaaacaaaua

SEQ ID NO: 318037 - RNA, 64 nt, Human
uauauugugagaaaacagccccaucaggcuuguguuaaggcaauggacugaaugagugcgugcu

SEQ ID NO: 318038 - RNA, 64 nt, Human
agaggccaccggagcuagggcacuagccugacuuuuaaggcagugugucuuucugagcacugua

SEQ ID NO: 318039 - RNA, 64 nt, Human
gggacagaaauugugcauucaaggagcuuggauuuuaaggcagcagcuugcugaugccaccagc

SEQ ID NO: 318040 - RNA, 64 nt, Human
ggugcugcccucagggacugcacccugacaaguguuaaggcaacauuccuuucuugugcccugg

SEQ ID NO: 318041 - RNA, 64 nt, Human
gugugagggagcgguaugcucuacccuuguguauuuaaggcaggacagagaaauugaggaugcc

SEQ ID NO: 318042 - RNA, 64 nt, Human
uagaucuccagacccugccuggccacaauucaaauuaaggcaacaaacauauaccuuccaugaa

SEQ ID NO: 318043 - RNA, 64 nt, Human
cuuccagaaccaacugcauugguuuuccaugaccuuaaggcaguaguucucaacuggggggcaa

SEQ ID NO: 318044 - RNA, 64 nt, Human
uuugggagcuuugcuuuccaaguuuuuuuuuguuuuaaggcaaacuuaaaauuuuaauggaaac

SEQ ID NO: 318045 - RNA, 64 nt, Human
guaaagauaguagucuuugcauacauuuaaguaauuaaggcauuuauugcugggagaauaggag

SEQ ID NO: 318046 - RNA, 64 nt, Human
cagccuugccuucucaaguagauucuaagcuccuuuaaggcaguaauugcauuuuaucugucuc

SEQ ID NO: 318047 - RNA, 64 nt, Human
gucuuagcccuugggagcugacagcccaugggcauuaaggcaaaguaguuccagugauuuaaaa

SEQ ID NO: 318048 - RNA, 64 nt, Human
guaugguuuuuguuuucucuuggaaugucaggucuuaaggcauuuaauugagggacaaaaaaaa

SEQ ID NO: 318049 - RNA, 64 nt, Human
gcuuaaauuauucuaggaccaacucuucucuuauuuaaggcacuguauuuaauuggauuuccug

SEQ ID NO: 318050 - RNA, 63 nt, Human; identical to SEQ ID NO: 315003

SEQ ID NO: 318051 - RNA, 63 nt, Human
uacgggcaccuggaguugauucggcugcagcuggccgcccaguuugagaauugguguaagaca

SEQ ID NO: 318052 - RNA, 63 nt, Human
guacucagccucaggagagcuugcugcacccaggccgcccaggucuucacagcacaacugccu

SEQ ID NO: 318053 - RNA, 63 nt, Human
aucucacggaccugaccucagaggugcaccagugccgcccagguagauaagagcugcagcauu

SEQ ID NO: 318054 - RNA, 64 nt, Human
ccaacuuuaugaguaaugcuuggaauaaaaacucuuaaggcaacucacugauuuacuucuagca

SEQ ID NO: 318055 - RNA, 64 nt, Human
cccuuuauguaaaaauuagugaauaucuuaugaauuaaggcauuccucuuucccuaaccccgau

SEQ ID NO: 318056 - RNA, 64 nt, Human
uguaagggagcaguucaauaauccaugaaagaacuuaaggcauuuguugguuuaucagacucgg

SEQ ID NO: 318057 - RNA, 64 nt, Human
cuuucaugaauggaauggaaaaaagaugacucaguuaaggcaccagccauauguguauucuuga

SEQ ID NO: 318058 - RNA, 64 nt, Human
uuuauuuauauucugccuuguuccagaaaaguguuuaaggcaacaaugcuuguuuuuugguguu

SEQ ID NO: 318059 - RNA, 64 nt, Human
uuaggauaaguuuagaacuugaauauuugcaugcuuaaggcacuguuuuagaagcuuacuuagu

SEQ ID NO: 318060 - RNA, 64 nt, Human
caagcggccuuauguacauuucccaacaaucuuuuuaaggcaaaauugugaccauauguguaua

SEQ ID NO: 318061 - RNA, 64 nt, Human
aaaugcuacaguuuuauagauugcacaucauucuuuaaggcauacuuuuaccucaggaaacuua

SEQ ID NO: 318062 - RNA, 64 nt, Human
ggucaucuuuauuuaguuugcaugaaguugaaaauuaaggcauuuuuaaaaauuuuacuucaug

SEQ ID NO: 318063 - RNA, 64 nt, Human
aguuggagugaauuauuugcuaaguauuaaaugauuaaggcaugugccgauugucaaauuaucc

SEQ ID NO: 318064 - RNA, 64 nt, Human
caaaaagacucuacccauauuacagaugggcaaauuaaggcauaagaaaacuaagaaauaugca

SEQ ID NO: 318065 - RNA, 64 nt, Human
gguuuucaauuuauuuuuuaaugauuaauucguauuaaggcaacaagacaguacaacaaauaau

SEQ ID NO: 318066 - RNA, 64 nt, Human
aagaccuggagcaauaaaagacaaaugcaacauuuuaaggcaaugguuucacaugguuacauau

SEQ ID NO: 318067 - RNA, 64 nt, Human
auuuauuuuacuaccugaaguacaauuuaacuuuuuaaggcagauuuuuauuuccuuugaaaua

SEQ ID NO: 318068 - RNA, 62 nt, Human
ccggucacagacgagcagucaucggacucacccgaucacagacgagcggucaccggaaucgc

SEQ ID NO: 318069 - RNA, 62 nt, Human
aaacaacucugaaugugcgguucggaaucacccgaucacagacgagcggucaccggaaucgc

SEQ ID NO: 318070 - RNA, 63 nt, Human
accucugacccucuccuagcccuucccauacaggccgcccaacacucccccuacguugcgcug

SEQ ID NO: 318071 - RNA, 63 nt, Human
ucccaucuaggaagugaggagcuucucugccuggccgcccaucgucugagauguggggagcac

SEQ ID NO: 318072 - RNA, 64 nt, Human
uaucuuaaugaaaauagauauggucacaaguacauuaaggcacguagaagguaggaguaagaaa

SEQ ID NO: 318073 - RNA, 64 nt, Human
guucuucugcagaauggcugcaaauuuaauugcauuaaggcaagaaggaagcucuaaugugugc

SEQ ID NO: 318074 - RNA, 64 nt, Human
uuggauuugauucauagguaggagggcuuagauuuuaaggcacuucugaaagucaaucccugga

SEQ ID NO: 318075 - RNA, 64 nt, Human
uuaucagcacccugggucauaguguaggcuagaguuaaggcacuggcagacuuagggaugcugg

SEQ ID NO: 318076 - RNA, 64 nt, Human
guauugaauguaaaucagagcucucuagucuucauuaaggcagcaaguccuggguugugaaaaa

SEQ ID NO: 318077 - RNA, 64 nt, Human
uagauguuuuccuagguguuggaaaacagguugauuaaggcaacagcagaagggcagggcaagg

SEQ ID NO: 318078 - RNA, 64 nt, Human
ggaaaugccugccaacuaaucuuggauagauucuuuaaggcauuccacuuagcuugccaguuga

SEQ ID NO: 318079 - RNA, 64 nt, Human
aaaaaaacacugcauuaaaaaaguaucuguugcauuaaggcacauagugggauuacaucauaaa

SEQ ID NO: 318080 - RNA, 64 nt, Human
uuauugccuuggauaaauaaauuauugaucuuuuuuaaggcagcaguuauuaaauugguaauag

SEQ ID NO: 318081 - RNA, 64 nt, Human
aucagauuuaagggcucuguccuguuauacauauuuaaggcagaaaaaaaguuacaugucgauu

SEQ ID NO: 318082 - RNA, 64 nt, Human
ugggucacccaggccacaaggccaugguuaauucuuaaggcaaggcaaauccauggaugagaag

SEQ ID NO: 318083 - RNA, 64 nt, Human
gcagaagggggggaauagccacaggggacaaaccuuaaggcauuauaagugaccuuauuucugc

SEQ ID NO: 318084 - RNA, 64 nt, Human
ggaaggauuaaacuugaacuacuuauccuauucuuuaaggcacuccauugccuggccccaauuu

SEQ ID NO: 318085 - RNA, 64 nt, Human
uucugccucauugaacucaacauccuucagacuuuuaaggcauuccaaaucccagucuucaugu

SEQ ID NO: 318086 - RNA, 63 nt, Human
agcuguucagaggucuccugggggagcuuaaaacgggggaaacacugguuuucacagaugcuc

SEQ ID NO: 318087 - RNA, 63 nt, Human
gaacuaagagaugagggaggcacaaacucugcacgggggaacugugugugcaaaggugagcug

SEQ ID NO: 318088 - RNA, 63 nt, Human
cagccgggcgccccggaccccccaggcgggcugcgggggaaccggcgccgagaggggaagggg

SEQ ID NO: 318089 - RNA, 64 nt, Human
auuccaauugcaauuucauaaaacguaaaguauuuuaaggcaaagaaaggcuguuaauucccuc

SEQ ID NO: 318090 - RNA, 64 nt, Human
cuguggggaccuucccacucuugacagagccccauuaaggcaucuggguggguuuuaaacagaa

SEQ ID NO: 318091 - RNA, 64 nt, Human
aauuuuauuauaguaaugugacuuggauucaauuuuaaggcauauuuaacaaaauuugaauagc

SEQ ID NO: 318092 - RNA, 64 nt, Human
caucuugccauggcucuucuaggccucuuuaggguuaaggcauauuuccuucugagaauuucug

SEQ ID NO: 318093 - RNA, 64 nt, Human
caucagucccuauguauuugcaguucaccugcacuuaaggcacucuguuauuuagacucaucuu

SEQ ID NO: 318094 - RNA, 64 nt, Human
ugcaaagagcuucaaacaccaaaaauauaccauuuuaaggcauguggugacaaugcuauuugcc

SEQ ID NO: 318095 - RNA, 64 nt, Human
uuuuauauauguaaugucuuaauugagauuucuguuaaggcagaaauaauuaggcuagggcucu

SEQ ID NO: 318096 - RNA, 60 nt, Human
accugccuuccucaaccuagagaaggguuguuaaggcagaccgcccuguuccccagaguu

SEQ ID NO: 318097 - RNA, 64 nt, Human
aauccuauuaaaauaugcaaaaauaagucagauuuuaaggcaaauaaagugacauaaggugcuu

SEQ ID NO: 318098 - RNA, 64 nt, Human
uaagacuucucuguccucugcuuugcuguuauccuuaaggcauauacuuugucuuucugcagaa

SEQ ID NO: 318099 - RNA, 64 nt, Human
cuuccauaggaaauaguggauaauuuucagcuauuuaaggcaaaagcuaaaauaguucacuccu

SEQ ID NO: 318100 - RNA, 64 nt, Human
cucuguaaaaaauguaauuuaaaauaagcaauaauuaaggcacaguugauuuuguagaguauug

SEQ ID NO: 318101 - RNA, 64 nt, Human
gaaaaggaguuacuauguauauuaugcuuagcuuuuaaggcauuuuaaauaaccaugaauguug

SEQ ID NO: 318102 - RNA, 64 nt, Human
auuguauuuguuaacagugucuuuuuuuaaaaaguuaaggcacucugaaacaaauggaaagucc

SEQ ID NO: 318103 - RNA, 63 nt, Human
ccaauuauauguucauuuuguauauuuuuuggucgggggaaaaauugaccugcaguaaaaaaa

SEQ ID NO: 318104 - RNA, 63 nt, Human
ucaggugaugugauaucauaagcuuucuuggaacgggggaaagaaaaugaaacuuuuuggugu

SEQ ID NO: 318105 - RNA, 63 nt, Human
ugaauuuaacaaaugcuuagucucagcagccuccgggggaaaaaagcuuagccuagcagucag

SEQ ID NO: 318106 - RNA, 63 nt, Human
uuuuacauauggucuauuuaagucugauguuuacgggggaaaguguaguuacuaaaaauguuu

SEQ ID NO: 318107 - RNA, 64 nt, Human
uaacagaggagaaaggugaaacacacacacauucuuaaggcaauaaaacuaggggguguauauu

SEQ ID NO: 318108 - RNA, 64 nt, Human
gugauuaagacuuuuugccuauuucuuguauaaguuaaggcagccauaaaugaaaauacaaaac

SEQ ID NO: 318109 - RNA, 64 nt, Human
cccccauauguaucagugaagccuuugaaauuacuuaaggcagucuuucauggaauguuuugau

SEQ ID NO: 318110 - RNA, 64 nt, Human
gccagggcuggagucugagaccuuugguuguucuuuaaggcaccuccugccacuuucucccuca

SEQ ID NO: 318111 - RNA, 64 nt, Human
gcaugagccaccaugccuggcuguugaauuguucuuaaggcaucauaucuagaagcaaagaaaa

SEQ ID NO: 318112 - RNA, 64 nt, Human
aguaguuuuuaguaggaaagugccauuccuguccuuaaggcacagucucaucagaagucuaaua

SEQ ID NO: 318113 - RNA, 64 nt, Human
uaucaguggauuucauuuuguagcugcugagauguuaaggcaagccucagcaucugccccugcu

SEQ ID NO: 318114 - RNA, 64 nt, Human
uuuaugucaaaagcaacauuucacaaauguacuuuuaaggcauaauaaggguuaacauucuagg

SEQ ID NO: 318115 - RNA, 64 nt, Human
ccucagguugccuauguauuuuaccuuuucauauuuaaggcaaaaguacuugaaaauuuuaagu

SEQ ID NO: 318116 - RNA, 64 nt, Human
cacuucugaguuucauccuauccgagggaugagauuaaggcagaggcaaaaguuucacacaaag

SEQ ID NO: 318117 - RNA, 64 nt, Human
auaugaaaauaauaguguuucacaguauuucuauuuaaggcagcuauaaauauaggagaaaaau

SEQ ID NO: 318118 - RNA, 64 nt, Human
aagaaaaauauaccuuuuauccggaaauauugguuuaaggcaaauaaauaaaacugugcuugcu

SEQ ID NO: 318119 - RNA, 64 nt, Human
gguaagggggauaguaucuuagaaaaccuguugguuaaggcagcugcaugugauaaaaguggua

SEQ ID NO: 318120 - RNA, 64 nt, Human
aacaagauuaaauauccagccaguacaguauuuuuuaaggcaaauaaagaugauuagcucaccu

SEQ ID NO: 318121 - RNA, 63 nt, Human
auuauggcuucagagguggaagauaaacagugacgggggaacaaacagacaacaagaagguuu

SEQ ID NO: 318122 - RNA, 63 nt, Human
aauccuaggcccugcauuccugucauccucauccgggggaaacaccaucaucccaguagcugc

SEQ ID NO: 318123 - RNA, 63 nt, Human
gagggugucggccugcagccaaguucacugucacgggggaaggagccaccagccaguccucag

SEQ ID NO: 318124 - RNA, 64 nt, Human
uuauacuaaaauuucaacugugugaagauacauuuuaaggcauuacuuugcuaauaaucuacac

SEQ ID NO: 318125 - RNA, 64 nt, Human
gucauugugaaggucaguuugaggcaucacaaauuuaaggcacccagacauaagggucaacagg

SEQ ID NO: 318126 - RNA, 64 nt, Human
gaauucuaaaauucaaaacaggcauuucauuuucuuaaggcacacuuccuacacacagcuauca

SEQ ID NO: 318127 - RNA, 64 nt, Human
aguaucaugaugauuggaaaaaccugugaaguuguuaaggcacucucauuugcccucuuuuucu

SEQ ID NO: 318128 - RNA, 64 nt, Human
caaagaugaucauuuuuaugugauuuuagaaauguuaaggcaauacuacuaauuauuguagguu

SEQ ID NO: 318129 - RNA, 64 nt, Human
aucugugggucugggagucacacaguguuggagguuaaggcauacgagagcagaggucucccaa

SEQ ID NO: 318130 - RNA, 64 nt, Human
auauaacaugacaggcacuaggacgucugccuuuuuaaggcaguuccguuaaggguuuuuguuu

SEQ ID NO: 318131 - RNA, 64 nt, Human
uuucuuacaguucuggaggcuggaaacuccaagauuaaggcagauuucaugccuauugagggcc

SEQ ID NO: 318132 - RNA, 64 nt, Human
acagccucauuucggacuaaacucauuagaguucuuaaggcaguuuguccaauuaaagcuucag

SEQ ID NO: 318133 - RNA, 64 nt, Human
uuuggagaaaacuugauacaauagaagcugacuuuuaaggcauuggcuuuuaaauuaauacaua

SEQ ID NO: 318134 - RNA, 64 nt, Human
aagaaucuuuccaaaguugucucauucagcaauguuaaggcaucuguaucaaauuauuuuggau

SEQ ID NO: 318135 - RNA, 64 nt, Human
gugaacagaguugugucugaggaaugugccuaauuuaaggcaggguuuguuccaaugcauccgu

SEQ ID NO: 318136 - RNA, 64 nt, Human
cacuaauauacuaacaacagaaucuaaucuucauuuaaggcacuguagugaauuaucugagcua

SEQ ID NO: 318137 - RNA, 64 nt, Human
aucaagcuuacuuacacacauucuacagaguuauuuaaggcauacauuauaaucucccagcccc

SEQ ID NO: 318138 - RNA, 63 nt, Human
cugaaaguagaagucuguccgucuaugaacaugcgggggaaggauccggaaccaggacccaga

SEQ ID NO: 318139 - RNA, 63 nt, Human
uuuacucuuagguuuugagcuaaugauucaaaacgggggaauauaaaagguuuuuuuucugua

SEQ ID NO: 318140 - RNA, 63 nt, Human
gaggggcuccagcaggaggccgugggugccauucgggggaaagugggggaacgacacacacuu

SEQ ID NO: 318141 - RNA, 64 nt, Human
gcuuucucucuuugcacuuccuuccuaaucuugguuaaggcauguuuuaugccaugaagaauac

SEQ ID NO: 318142 - RNA, 64 nt, Human
aauaaauagcaaaucacugaauucagaaucucacuuaaggcagaaauuaaaaucauaauauaaa

SEQ ID NO: 318143 - RNA, 64 nt, Human
cccugcauuugagaaauauuuuauuauuuuuauuuuaaggcaaaacaguguuuacugugauggg

SEQ ID NO: 318144 - RNA, 64 nt, Human
guugugguuuuuagugcacuuaauauuagcuugcuuaaggcauacuuuuaaucaaguagaacaa

SEQ ID NO: 318145 - RNA, 63 nt, Human
uacuaauguauuacugagacuaguaaauaaauuuuuaaggcaaaauagagcauucaaagccag

SEQ ID NO: 318146 - RNA, 64 nt, Human
gggaaaguuacgcuuuucuaagaauaauggacucuuaaggcauugagggcucuaaacaggauuc

SEQ ID NO: 318147 - RNA, 64 nt, Human
uccuuuuucauaauuaauuuuauccaagauuguauuaaggcaaaaucugauucuacauuccacc

SEQ ID NO: 318148 - RNA, 64 nt, Human
ucaagugaaauguauucauuuguaauacuuugguuuaaggcauacuuuaauuuuuacgaguuuc

SEQ ID NO: 318149 - RNA, 64 nt, Human
uuucacuuuaccaaguagauagaugguauagagcuuaaggcauuuucaugcucauaaaucugau

SEQ ID NO: 318150 - RNA, 64 nt, Human
uuuauauuuuguauaccuuuuaauagguauccacuuaaggcauuugcaguacaaauauuaauug

SEQ ID NO: 318151 - RNA, 64 nt, Human
uuucaacuguaaacuccuuuaguaccauugaaacuuaaggcaaaaaagaucccugggauuacuu

SEQ ID NO: 318152 - RNA, 64 nt, Human
uuuuuucacucuccuuagaauuggaacuaugcaguuaaggcagauaaaauguacagauguuuca

SEQ ID NO: 318153 - RNA, 64 nt, Human
ugccuuucagccccuggugucugcagugggggauuuaaggcacccgcuuccacuucuuucuugu

SEQ ID NO: 318154 - RNA, 64 nt, Human
cauuuuuaucuggaaagacuuuucuagcugcaauuuaaggcagcaauccaagagacuugaauaa

SEQ ID NO: 318155 - RNA, 63 nt, Human
ggccgcccgcgcccgccgcggccccgaucggggcgggggaauccccggagaccagccuccuua

SEQ ID NO: 318156 - RNA, 63 nt, Human
cuggcucuucuuugcagcuccagauccuguuugcgggggaagccacacaucgcacguuuuacu

SEQ ID NO: 318157 - RNA, 63 nt, Human
ugugaugcagccucgggacagggcugaggccugcgggggaagaccuauaccccacgccugggc

SEQ ID NO: 318158 - RNA, 64 nt, Human
gcagcuacugacaaguagaacacugcuacuuuuuuuaaggcaguuucuuguuuuuuuagacgga

SEQ ID NO: 318159 - RNA, 64 nt, Human
caaaucuaagaaucauuccuguacuacagaaggguuaaggcaaagguagccuuuugggcuuuuu

SEQ ID NO: 318160 - RNA, 64 nt, Human
uugaaauucuguuuacuucaguccauuguauccuuuaaggcaccugugcuagccuagauuuugu

SEQ ID NO: 318161 - RNA, 64 nt, Human
uuugaauauaaaauuggugaaaguguugguuuuuuuaaggcaguaauuuuuuuguuuguuuuuu

SEQ ID NO: 318162 - RNA, 64 nt, Human
ugaaaugucagucuuuucaguaaugaggauaccuuuaaggcacucuuggacucucggcaaccac

SEQ ID NO: 318163 - RNA, 64 nt, Human
gaauucagaggccucagguaaugacgacaucauuuuaaggcauggagcugagaagucugggagu

SEQ ID NO: 318164 - RNA, 64 nt, Human
gaugguucugaagcuggcccauugaaagagccucuuaaggcagcugggacagaggccugguggc

SEQ ID NO: 318165 - RNA, 64 nt, Human
ccuuuccccaccuuccuuaccuccucuucccccauuaaggcagcucauccaagcuuguauuuaa

SEQ ID NO: 318166 - RNA, 64 nt, Human
acaauguauaauuguguuuuuccaccccacauuuuuaaggcaauuaaauauagauauuuccacu

SEQ ID NO: 318167 - RNA, 64 nt, Human
uauaaccuucaugaugaauuacuucuucaggguguuaaggcagugacuuuagaaacaaauuuuu

SEQ ID NO: 318168 - RNA, 64 nt, Human
gugcaaauccauagcacaagauaaauugagcuaguuaaggcaaaucagguaaaauagucaugau

SEQ ID NO: 318169 - RNA, 64 nt, Human
gugauggaggauucuuugguaucuuacuguuugguuaaggcacuaauuuuacuuaccuauuaga

SEQ ID NO: 318170 - RNA, 64 nt, Human
uugcuuuugguuuuuuucucuauuuagcauucuguuaaggcacaaaaacuauguacuguauggg

SEQ ID NO: 318171 - RNA, 64 nt, Human
augguaucauauuaacauauucuaaauaagggcuuuaaggcacaggcuguugaagcauuuucuc

SEQ ID NO: 318172 - RNA, 63 nt, Human
cugagaggcgcccgcggucugcggccaguggcccgggggaaagcuggggcugggaagcccggg

SEQ ID NO: 318173 - RNA, 63 nt, Human
agaaacagcaauagccaggacuccuggcuaaaacgggggaagugagaggaaagaggcgggggc

SEQ ID NO: 318174 - RNA, 63 nt, Human
aacucagugcacucaagacgcaucuccaguuuucgggggaagcugguauuugacauagugugu

SEQ ID NO: 318175 - RNA, 50 nt, Human
aacgagacgacgaagauuaauuaaggcagccucauagucaaucccaguug

SEQ ID NO: 318176 - RNA, 64 nt, Human
gaguuugccucuuucagaauacuaccuccuuuuguuaaggcauauucuuucgaaaauauagauu

SEQ ID NO: 318177 - RNA, 64 nt, Human
uaucugcccaaggcagcaacaagcucuuuuguguuuaaggcauaaaagaagaauucugcauaga

SEQ ID NO: 318178 - RNA, 64 nt, Human
cuaucgucaggccuguugccuggagaucucuaaguuaaggcaacaagacuuaaagaauuuucua

SEQ ID NO: 318179 - RNA, 64 nt, Human
uucuuuaacauuaguuuauuugaacuaagggaauuuaaggcauaagaaccauuaucccaauaaa

SEQ ID NO: 318180 - RNA, 64 nt, Human
uuguuuuuaccauaggauugccuacagcgcuccuuuaaggcacagguuuucuccugcccugcuu

SEQ ID NO: 318181 - RNA, 64 nt, Human
aauagaauauaaaccgaaaggaagaacugaacaauuaaggcaauucuaaauaauuaccauuuca

SEQ ID NO: 318182 - RNA, 64 nt, Human
ccagcagcccacuggaggcauucuucaggcuccuuuaaggcaggugcauugauaguuccauuag

SEQ ID NO: 318183 - RNA, 64 nt, Human
acccuugauggauuuucaaggucaugcuggccaauuaaggcaucaucaguccuaccugagcaac

SEQ ID NO: 318184 - RNA, 64 nt, Human
auaguacaugagaaauucagaguauuagacaguuuuaaggcauucaacugagaaaacuuuauuu

SEQ ID NO: 318185 - RNA, 64 nt, Human
auucucugugaucaguuuguuauuuuuuuucuccuuaaggcacaaaauaauugguuugagguau

SEQ ID NO: 318186 - RNA, 64 nt, Human
augccguuauuuuaugguucauuugcagugacuuuuaaggcaguacuguuuagcacuuugauau

SEQ ID NO: 318187 - RNA, 64 nt, Human
uuuuaggaguauuaaucaacauuguauucagcucuuaaggcacuagucccuuacagaggaccau

SEQ ID NO: 318188 - RNA, 64 nt, Human
gagauaguauuuggaaugaauggaagaauauggguuaaggcaaaaaccauccagcagacuuuaa

SEQ ID NO: 318189 - RNA, 63 nt, Human
ccagugauuucuacccuguggaggcugaggggucgggggaagaaaacagaugaccucagccua

SEQ ID NO: 318190 - RNA, 63 nt, Human
guguggucaugucccacagcaagcuuuugggaucgggggaauaagaggguaugggggaaaggu

SEQ ID NO: 318191 - RNA, 63 nt, Human
gaacauucaucuguacugaaguguuacuugaaccgggggaaucucggaccugggggagccggg

SEQ ID NO: 318192 - RNA, 63 nt, Human
ggagagagcagugaaaacaugcagggcuguggacgggggaaggguuguggcggguguucugag

SEQ ID NO: 318193 - RNA, 64 nt, Human
cauuugaucugacccagugccagacacaggggauuuaaggcauguucacacuugcugggcaggg

SEQ ID NO: 318194 - RNA, 64 nt, Human
aaugcuaaaugggcgacugaugaggucacgguucuuaaggcacauccgggacgaucgauauagc

SEQ ID NO: 318195 - RNA, 64 nt, Human
cuacagguagauuuuaaaaacacguuaaagggccuuaaggcauuuuguuauucuguuaaaaacc

SEQ ID NO: 318196 - RNA, 64 nt, Human
uccauuuuuuuaaggcuccucuuuaucuccuuucuuaaggcacuguugcuauggcacuuuucua

SEQ ID NO: 318197 - RNA, 64 nt, Human
cacacuaggaaagaggaggagggugcagccaaacuuaaggcaccggcaaguguugucagcacug

SEQ ID NO: 318198 - RNA, 64 nt, Human
ccaaaauauuuggaaugaaggacuuuggcccuauuuaaggcagauuuuacagagcgcaccucaa

SEQ ID NO: 318199 - RNA, 64 nt, Human
uauuacuauuuuccuuuuuguuguucacauagucuuaaggcaccuauacuuuuaaauugacuuu

SEQ ID NO: 318200 - RNA, 64 nt, Human
gcauaaaaauuaaauagaggugaacacaauuauuuuaaggcaguuaaauuaucucuguauugug

SEQ ID NO: 318201 - RNA, 64 nt, Human
ccauguguaacaaagagaaaugugcaaauauuuuuuaaggcaguauuaagugcaagaggaguaa

SEQ ID NO: 318202 - RNA, 64 nt, Human
cccuggcuuucauuuucucucaggugaaaggaaauuaaggcaacaaaagaagcccggcuccugg

SEQ ID NO: 318203 - RNA, 64 nt, Human
uuuaaacagugagguaguuuugaauggcauuucauuaaggcaucuaugggcauuaugagcuaaa

SEQ ID NO: 318204 - RNA, 64 nt, Human
gcccugcugguuugggcuugccucgaagauuuuauuaaggcacgaagaagugaaaaacuaaggg

SEQ ID NO: 318205 - RNA, 64 nt, Human
cagcccaguccccuuucgggggccuugggagaguuuaaggcaccugcugguuccaggaccucgc

SEQ ID NO: 318206 - RNA, 64 nt, Human
uguguuuuuaaucacuguaaccggaugcauuuuuuuaaggcaaaauuucucccuuaucuacuau

SEQ ID NO: 318207 - RNA, 63 nt, Human
uggaaggggcaggaccuccggccuuguccauuucgggggaaacuugggcccugccaaggggca

SEQ ID NO: 318208 - RNA, 63 nt, Human
aagucuugucaauaacuugcuguguggaagcagcgggggaagaccuagaacccuuuccccagc

SEQ ID NO: 318209 - RNA, 63 nt, Human
ugcuauguggcuucaaccagccucacagccacacgggggaagcagagagucaagaaugcaaag

SEQ ID NO: 318210 - RNA, 64 nt, Human
uguuucagauguuuagucaauugugaaauuuuucuuaaggcaauuuucuuuucuaucaguuugu

SEQ ID NO: 318211 - RNA, 64 nt, Human
gaauaauaauggcuaacuuuuauuaucuucuauauuaaggcaguaugccaagggucuuuaugua

SEQ ID NO: 318212 - RNA, 64 nt, Human
agaugauagucacucuucccauauuuauaggcuauuaaggcaagggauaucuuaaacaucauau

SEQ ID NO: 318213 - RNA, 64 nt, Human
caagauuuagguacuuaucaaagauaauggggaauuaaggcaucaauaaaaugaugccaaagac

SEQ ID NO: 318214 - RNA, 64 nt, Human
uucuaucacuggcacuacagaauccuucucuuucuuaaggcacuuugcauuguagaauguuccu

SEQ ID NO: 318215 - RNA, 64 nt, Human
ugugaugugauguaauuggaauagagcuguugauuuaaggcacacacaaucccucacacugugg

SEQ ID NO: 318216 - RNA, 64 nt, Human
aauaucgaucagaugacuagaaagugaauaaaaauuaaggcaacugaacaaaaaaaugcucaca

SEQ ID NO: 318217 - RNA, 64 nt, Human
aggcccgccaggugggcauggucccccauuuucuuuaaggcagcaccuggaguggagagaggcc

SEQ ID NO: 318218 - RNA, 64 nt, Human
ugccauucagggcuguuccagagauucgauccucuuaaggcauuaucagugagcaaaugugaag

SEQ ID NO: 318219 - RNA, 64 nt, Human
cuuuucucagcugacauacagagcacuaaauauuuuaaggcaaguccauaggucugaaucucuu

SEQ ID NO: 318220 - RNA, 64 nt, Human
gcuaaaagacaaauuuaaggggagcucuucaacauuaaggcaguaugauaucaugcuugguuuu

SEQ ID NO: 318221 - RNA, 64 nt, Human
uucuauuacuuaaaacguuuuuauugugcaacauuuaaggcauacaaaaacauauaaagaauac

SEQ ID NO: 318222 - RNA, 64 nt, Human
agaaaagcaucagccuuccagaguuacugucugcuuaaggcagaaacagcaguaaauaaugagg

SEQ ID NO: 318223 - RNA, 64 nt, Human
caucauaccaucauuuuuuaacugagugaaauuauuaaggcauguaauacauuaaugaacauaa

SEQ ID NO: 318224 - RNA, 63 nt, Human
ggguggcggcgguaagcggggaggaaacauggcgccgcccaaaugcgcccggaggccguuagg

SEQ ID NO: 318225 - RNA, 63 nt, Human
cgaaggcccuuagacaaccauggcugcuguacugccgcccaggguggguggccagugaggacu

SEQ ID NO: 318226 - RNA, 63 nt, Human
cugcagggguguccuuguccacucgcaccccucgccgcccaccagggccaugcucugugacuu

SEQ ID NO: 318227 - RNA, 63 nt, Human
cugucuccuagaggccccggaggagcugggccagccgcccacccccacccccagugcagggcu

SEQ ID NO: 318228 - RNA, 64 nt, Human
acauuaaguagcacuuuugugguagaacugauucuuaaggcaggccugaaaggccauuacuaau

SEQ ID NO: 318229 - RNA, 64 nt, Human
ucuauuccugauauaauuacuguaguacucuugcuuaaggcaagaguuucagauuuacuguuga

SEQ ID NO: 318230 - RNA, 64 nt, Human
gauuuucuccuaggguuauguccaguugggguuuuuaaggcagcacagacugccaaguacuguu

SEQ ID NO: 318231 - RNA, 64 nt, Human
gaagaaaaagcuauuguuuacaauuauaucaccauuaaggcaacugcuacacccugcuuuguau

SEQ ID NO: 318232 - RNA, 64 nt, Human
caguacuguggcccaccaguguaaucucccuggauuaaggcauucuuaaaaacuuaggcuuggc

SEQ ID NO: 318233 - RNA, 64 nt, Human
aauggcuucucuggcugacugcaaggcugucuccuuaaggcacugagugggcgggggaggcugg

SEQ ID NO: 318234 - RNA, 64 nt, Human
ucaagacuuaguuauugucacacuaauugaucguuuaaggcauaagauggucuagcauuaggaa

SEQ ID NO: 318235 - RNA, 64 nt, Human
aaauuacuauaaagacuccuaauagcuuuuccuguuaaggcagacccaguaugaaauggggauu

SEQ ID NO: 318236 - RNA, 64 nt, Human
guguaauuauguaaauacaauuuguacuuuuuucuuaaggcauacuaguacaagugguaauuuu

SEQ ID NO: 318237 - RNA, 64 nt, Human
auaauaaauguguguucagaacuuuuuguguuuuuuaaggcauuaauaaagccuucgauaauau

SEQ ID NO: 318238 - RNA, 64 nt, Human
caaccacagggagugccaguuaacacuggaaggauuaaggcaaggucccuucucuugagacucc

SEQ ID NO: 318239 - RNA, 64 nt, Human
ucaugggcccacauuagguugugcugugaauuacuuaaggcagugauacugauguaguauaguu

SEQ ID NO: 318240 - RNA, 64 nt, Human
guaguacuguuuaccuaacuaccucauggauguguuaaggcauauugaguuaaaucucauauaa

SEQ ID NO: 318241 - RNA, 64 nt, Human
ucuaauuuuuuucuaaucaaaaagaaaauugagcuuaaggcaaaaggccugguuuuagagauau

SEQ ID NO: 318242 - RNA, 63 nt, Human
guuccaacuuggagugugaagggcuugagcauacgggggaagagagucugcagaaguuggggg

SEQ ID NO: 318243 - RNA, 63 nt, Human
caaaaauaaaauaaaaauaaaaauaaauauuggcgggggaacccucuggaaucaauaaaggcu

SEQ ID NO: 318244 - RNA, 63 nt, Human
aaauugauuucuauuuuuaauuucaguuaguaucgggggaaaaaaauccagacugaacaguuu

SEQ ID NO: 318245 - RNA, 64 nt, Human
uuacuuuuuaaaccaucaacauuacuuuucuuucuuaaggcaaggcaugcauaagagucauuug

SEQ ID NO: 318246 - RNA, 64 nt, Human
ucauuguaaucugcaaaauguagaaauaaauuacuuaaggcaguauccuuuauacaguuguaua

SEQ ID NO: 318247 - RNA, 64 nt, Human
auucuccauacucuuuuuugcaucaaaggacaaauuaaggcaucuuuccucuugccccaaaggc

SEQ ID NO: 318248 - RNA, 64 nt, Human
cuacuuccugauuggauugguuuugccgcugauguuaaggcagccagcuucuuaguucaaaaag

SEQ ID NO: 318249 - RNA, 57 nt, Human
guuaugauugccuucuguaaagaauucuuaaggcauaaauacgugucuaaauggacc

SEQ ID NO: 318250 - RNA, 64 nt, Human
auuuguccucagucuccuuuaugcaucugcaacuuuaaggcauaguccaucgaucuacagggug

SEQ ID NO: 318251 - RNA, 64 nt, Human
aauaccucacgccacaauccagcauauugauguuuuaaggcaaaacaaccaacuuugucuguag

SEQ ID NO: 318252 - RNA, 64 nt, Human
auuucugguggcagugauuaguugaacagcacauuuaaggcacgauaauuugcuacacuuuuuc

SEQ ID NO: 318253 - RNA, 64 nt, Human
ucugucagagaaccuaauaagugcuacuuugccauuaaggcagacuaggguucaugucuuuuua

SEQ ID NO: 318254 - RNA, 64 nt, Human
auaagaacuagcugaagagacaaccaaagaagcauuaaggcagguugaugcugauaggaccaca

SEQ ID NO: 318255 - RNA, 64 nt, Human
aaauccaaauucgaacauucuuaggagguuuuuguuaaggcaugacagaugauuuaaacaaaua

SEQ ID NO: 318256 - RNA, 64 nt, Human
gagaagccugcuugauaacuugucuuaaguucuauuaaggcaguuagacugagauuucuaauga

SEQ ID NO: 318257 - RNA, 64 nt, Human
cccuugccacgaccuacuuaggcuacaauuuccuuuaaggcagccccuagcucugggaaggaau

SEQ ID NO: 318258 - RNA, 64 nt, Human
cuacacacuuccagugauaguggcucauugucuguuaaggcaaacuguuccacuguugggcaua

SEQ ID NO: 318259 - RNA, 63 nt, Human
gaagugaccugguccuaagcugugcagggcgugcgggggaacugcccuguggaugcagccacc

SEQ ID NO: 318260 - RNA, 63 nt, Human
ggaaucuggagggggcgcuggaggagugcgaaacgggggaagggagccggcagaauagagggc

SEQ ID NO: 318261 - RNA, 63 nt, Human
uuuuuuccaacaaguggauaaaagucugugacucgggggaaaguggaaggagaaaugcagccg

SEQ ID NO: 318262 - RNA, 64 nt, Human
uacagaguuuuuuugugugugguuuuuaaaacuguuaaggcaagaagugucaaaugcuuuagag

SEQ ID NO: 318263 - RNA, 64 nt, Human
uuccucuucauucuaaagguuuacuccauugaauuuaaggcauuuguucauuccaguguugaga

SEQ ID NO: 318264 - RNA, 64 nt, Human
cacuuauguauacacuuuuucuguacuuacuagguuaaggcagauuuauuuuuaugauuuguuu

SEQ ID NO: 318265 - RNA, 64 nt, Human
caaauuuuaccucuguuacuuaaagccaacaauuuuaaggcaguaguuuuacuggccauuuaag

SEQ ID NO: 318266 - RNA, 64 nt, Human
agggugucaccagacccacacagagcaagggagauuaaggcaguucuugcugccccuucucugg

SEQ ID NO: 318267 - RNA, 64 nt, Human
ugucugcgaaguccuauggaaacccgaggguugauuaaggcaguacaaauuguggagccuuuua

SEQ ID NO: 318268 - RNA, 64 nt, Human
uguaccuuguguucacucgaacuaagaacaaugguuaaggcagaauaaugacuaaaauauguuc

SEQ ID NO: 318269 - RNA, 64 nt, Human
agcaauaauuacaguaaauuaaauaaagauuccuuuaaggcagacaagggcuaagauuuccuua

SEQ ID NO: 318270 - RNA, 64 nt, Human
accaguacuugucaguccaucuuaauacuguucauuaaggcacucucugucucuaauccuuagg

SEQ ID NO: 318271 - RNA, 64 nt, Human
uuuaaaaggagaauaugguucaagcaaguccuuguuaaggcaaacuauugauauuucauuaauu

SEQ ID NO: 318272 - RNA, 64 nt, Human
uggcuuaacagagaacaagcuuuuacagacguccuuaaggcaacagugcagagauguaauccuu

SEQ ID NO: 318273 - RNA, 64 nt, Human
gugccuuccaucaugauuuccacaugaaagcacuuuaaggcacugauuuuaagauaauguuuuu

SEQ ID NO: 318274 - RNA, 64 nt, Human
ggcaugcgguauggaaauucuaagagagaaaguuuuaaggcaaugaaucacagauuuaaguuca

SEQ ID NO: 318275 - RNA, 64 nt, Human
gcagaugaaguggaugcccagcggaaggaggcaauuaaggcaaaggugggugagaguccccaug

SEQ ID NO: 318276 - RNA, 63 nt, Human
uugaagccagaggucaguggccgugcuguguugcgggggaagcuguguggaaggagaagcugg

SEQ ID NO: 318277 - RNA, 63 nt, Human
gcugcccugagcccuggaaggguggggguggggcgggggaaggcaggcagagcccccucuccg

SEQ ID NO: 318278 - RNA, 63 nt, Human
guucagcagcagaacaagccagggccauggggacgggggaaguuuucacuuggagauggacac

SEQ ID NO: 318279 - RNA, 64 nt, Human
agagccccgugccgggagcugacagcuuucacgcuuaaggcacgugugaccuggguagucagac

SEQ ID NO: 318280 - RNA, 64 nt, Human
acccuuucuaguuugcauuuccuggugcacacauuuaaggcauaacagcacauucaucccuuug

SEQ ID NO: 318281 - RNA, 64 nt, Human
guccugccuuuggcuccacauugccacaugacccuuaaggcaagcagguagcguguccauagua

SEQ ID NO: 318282 - RNA, 64 nt, Human
uuguagcugauuguuguguuuuauaaaucuucuguuaaggcagaagggugauuaugagugguuc

SEQ ID NO: 318283 - RNA, 64 nt, Human
uauacuccugggcacugguugacaguacugaggcuuaaggcagcuggacucucuugcuggugac

SEQ ID NO: 318284 - RNA, 64 nt, Human
aauguuacgcuagaauaaacaccaaggcagucaguuaaggcagcuaugguuuggaaaggcauac

SEQ ID NO: 318285 - RNA, 64 nt, Human
cgcgcggauucaggauugcggggacgcagaaagguuaaggcacuuuuaaaaacuauagcaaggc

SEQ ID NO: 318286 - RNA, 64 nt, Human
ucaguuauacuuucaaugaccuuuugugcaucuguuaaggcaaaacagagaaacucacaaccua

SEQ ID NO: 318287 - RNA, 64 nt, Human
uuuuuuuuucaaaguaggcaauucuuuguauauuuuaaggcaaauaaucacuucaccucuggug

SEQ ID NO: 318288 - RNA, 64 nt, Human
gaggaggaugaaggaaggcagccucagacaggaauuaaggcaaugcccaggcgggccugggcac

SEQ ID NO: 318289 - RNA, 64 nt, Human
cuuuguuuuaaauggccaaaagaauccagaaacauuaaggcagggacagcagucagaaucgaca

SEQ ID NO: 318290 - RNA, 64 nt, Human
cgggucuaaucuaauauuagaauauauuaaccgcuuaaggcauugaagccauaugggaugggga

SEQ ID NO: 318291 - RNA, 64 nt, Human
ugcuggaaaaacaucaagaaugacagucuuauauuuaaggcaccagucauuguuuccauuuuuu

SEQ ID NO: 318292 - RNA, 64 nt, Human
ucuggccucaguguuacagcuaaauaaucuuuaauuaaggcaagucacuuucuucuucuuaaag

SEQ ID NO: 318293 - RNA, 63 nt, Human
accgcugcuaugggaucgucaccugguucgggacgggggaagggcagagacaagggauuucuu

SEQ ID NO: 318294 - RNA, 63 nt, Human
cauuuugccuguguggggcugacaaccaagccucgggggaaaugguaaguggcaggaguugga

SEQ ID NO: 318295 - RNA, 62 nt, Human
ggccagcagccccaggagucccagacccgugccgaucacacuggugcuguugagaucuccca

SEQ ID NO: 318296 - RNA, 62 nt, Human
ugguuuguuuugccuuaggcuauuccaccucucgaucacaagagcugcugcuauaacuucca

SEQ ID NO: 318297 - RNA, 64 nt, Human
augaaucuaugacagagcaaugcuuuuaaugaauuuaaggcaaaaaagguggagagggagaugu

SEQ ID NO: 318298 - RNA, 64 nt, Human
aaucucugaucuugaacaaugggaaaaguauaccuuaaggcauuucuggacuaaaauauuuuca

SEQ ID NO: 318299 - RNA, 64 nt, Human
agaaagcaagaucacgaaggugugcaaaugauucuuaaggcauggacgaggauuuuucaauuua

SEQ ID NO: 318300 - RNA, 64 nt, Human
gggacacuauuuugucuuuuaguuuuaaacuuuuuuaaggcaaagcaagcuccccaaucccugu

SEQ ID NO: 318301 - RNA, 64 nt, Human
gugaguuaaucuuguaugagguugcauugauuuuuuaaggcaauauauaauugaaacuacuguc

SEQ ID NO: 318302 - RNA, 64 nt, Human
uguggaaacguauggaacauuguacucacuggacuuaaggcagugcuugguuagcuauuuuuaa

SEQ ID NO: 318303 - RNA, 64 nt, Human
ugaacuuaaacucuaauuaauuccaacuguacuuuuaaggcaguggcuguuuuuagacuuucuu

SEQ ID NO: 318304 - RNA, 64 nt, Human
uggcacaugccuauagucccagcuacucaggagguuaaggcaagagagucgcuugaaugcagga

SEQ ID NO: 318305 - RNA, 64 nt, Human
accaacugaccaugaaauagaguaugcuguaaucuuaaggcauagguuauuagugggaagagag

SEQ ID NO: 318306 - RNA, 64 nt, Human
gcucuggcuuguuaucugcaacaggaacauguccuuaaggcacaaaucacucaugguauuguuu

SEQ ID NO: 318307 - RNA, 64 nt, Human
gcucuggcuuguuaucugcaacaggaauauguccuuaaggcacaaaucacucaugcuauuguuu

SEQ ID NO: 318308 - RNA, 64 nt, Human
cauuccuuaaccuagaauucagaugauccuggaauuaaggcaggucagaggacuguaaugauag

SEQ ID NO: 318309 - RNA, 64 nt, Human
uuacauaauugauuuucuacuccugcccugugaauuaaggcagaguuuuacuguaauauuugca

SEQ ID NO: 318310 - RNA, 64 nt, Human
ugcugguuaggaaccgcucaccccaacaugugucuuaaggcaggacgacuuggaaaaaaaggcg

SEQ ID NO: 318311 - RNA, 63 nt, Human
ccaaugggccugcccccaccccaggaguuuggccgggggaacccauucaugcuguuccucugc

SEQ ID NO: 318312 - RNA, 63 nt, Human
ucccuuccgcuccaagcaccaguuccggugguacgggggaauaccagugaaauaguuugguuc

SEQ ID NO: 318313 - RNA, 64 nt, Human
auauguggcauuccuuucuuuaaacuauagguaauuaaggcagcugaaaaguaaauugccuucu

SEQ ID NO: 318314 - RNA, 64 nt, Human
gcagccacgcagcaggcucuggguggggcugccguuaaggcacguucuuuccuuacuggugcug

SEQ ID NO: 318315 - RNA, 62 nt, Human
uaaucaauuaauaauauuaauaaauuucuuauauuuaaggcauuguuaucuccuccacuuug

SEQ ID NO: 318316 - RNA, 64 nt, Human
ugucucaagcucuuccuuacucccaggcacugucuuaaggcaucugacaugcaucaucucauuu

SEQ ID NO: 318317 - RNA, 64 nt, Human
ugaaagccagagaagaccuuccucuuacaucacauuaaggcacccacucacuaccuuggcgucg

SEQ ID NO: 318318 - RNA, 64 nt, Human
gacuugugaagacugaaguuugaugaagucugguuuaaggcacagguaaacugaguguggaugc

SEQ ID NO: 318319 - RNA, 64 nt, Human
auuuagauaugaguuaagagcugccagauuuauuuuaaggcauguagagaaucucauaaucuau

SEQ ID NO: 318320 - RNA, 64 nt, Human
cuauuuugaaucuguaaauauuuuaaauguuuuauuaaggcauguaauaaacuauucuuugaaa

SEQ ID NO: 318321 - RNA, 64 nt, Human
gcaagucucgguggcccuguguucauccuguuguuuaaggcauagcccugauccuucuggaagg

SEQ ID NO: 318322 - RNA, 64 nt, Human
caccaucucuucuuugaguuguuuauggccucccuuaaggcauuuuacaaacccauaagccuac

SEQ ID NO: 318323 - RNA, 64 nt, Human
ccuguugcuuuccgaggugccacaaugcaaaugcuuaaggcacggagugugaaugugaagacac

SEQ ID NO: 318324 - RNA, 64 nt, Human
cacuucuuuuuccccacuaagauuccugugccuuuuaaggcagagggagaucccuauggcguua

SEQ ID NO: 318325 - RNA, 64 nt, Human
cacagcagagaaugccaugcggccuguguaagaauuaaggcagauuuauaugcacugaugagga

SEQ ID NO: 318326 - RNA, 64 nt, Human
ccccaaggcuccccuccuguggggaggccaccuuuuaaggcaccacuagcagucaggauauggu

SEQ ID NO: 318327 - RNA, 63 nt, Human
ccgcccgcagacucuggcuccuccgacuacacccgggggaaccuaguccgccuggggcuggcc

SEQ ID NO: 318328 - RNA, 63 nt, Human
ccuucccccgugugaacacgagugacagggcuccgggggaagucucagagaagccauagcccc

SEQ ID NO: 318329 - RNA, 63 nt, Human
ugagccuccucaugcucucagagcagggaacagcgggggaaaauguuuacacuccaugcacaa

SEQ ID NO: 318330 - RNA, 64 nt, Human
uucucuguuuuucuauugauaccucuauauauuuuuaaggcaaugucacuuuguuuuguuuaca

SEQ ID NO: 318331 - RNA, 64 nt, Human
aaaagauacauuggucuuuaaacccaaacccccuuuaaggcauguuggucucaaggggauuugg

SEQ ID NO: 318332 - RNA, 64 nt, Human
uuccuuuguccaggagaaaccucacaaaccuucuuuaaggcauaguuuuguuguuuguuugcuu

SEQ ID NO: 318333 - RNA, 64 nt, Human
agucaguuuaagaggcugauagaucuuggcccuguuaaggcauccacuucacaguucugaaggc

SEQ ID NO: 318334 - RNA, 64 nt, Human
ggcugucacuuggagccaacaguaacuugccaccuuaaggcagggucauccccgggccaggagg

SEQ ID NO: 318335 - RNA, 64 nt, Human
cuuccuugugauugaagaugaaaggaguaagaaauuaaggcauuuguuuaauuuauacugguaa

SEQ ID NO: 318336 - RNA, 64 nt, Human
uggcaugcaucuguagucccaccuauucaggagauuaaggcaggaggaucacuugagcccagga

SEQ ID NO: 318337 - RNA, 64 nt, Human
agaaaacugagaccaaucagauggaaauggaguuuuaaggcaagaggccauauauagggcuaca

SEQ ID NO: 318338 - RNA, 64 nt, Human
uggacugucagacaaaauggcaguauccuaagaguuaaggcacaucaaacacaggagucgagag

SEQ ID NO: 318339 - RNA, 64 nt, Human
gagaggaauaagcuuagcguuaauauugacaauauuaaggcaauauucuuguaggaauacuaug

SEQ ID NO: 318340 - RNA, 64 nt, Human
uguaauaguccuuuuuugguuuuuguuuuguuuuuuaaggcaggucugucauuuuugaauacug

SEQ ID NO: 318341 - RNA, 64 nt, Human
ucgaccagccagggaaagacuggcaagaaaagaguuaaggcaaaaaaggaugcaacaauucucc

SEQ ID NO: 318342 - RNA, 64 nt, Human
aauuggauucuuugggaacaugaagcauucaggcuuaaggcaagaaagaucucaaaaagcaacu

SEQ ID NO: 318343 - RNA, 64 nt, Human
aaaaauuaaaauguugccuuuguccaaguauagauuaaggcaacaaacauauuuggguguguaa

SEQ ID NO: 318344 - RNA, 63 nt, Human
uagauccaggacagagaggaaacaagcuucccacgggggaacaaggccuggaugaggauguug

SEQ ID NO: 318345 - RNA, 63 nt, Human
cuggacaaacucuggaagcagcgugugaaacagcgggggaagggaagagcggcgugagcggag

SEQ ID NO: 318346 - RNA, 63 nt, Human
gagaacagugcaacaaaugccagcauugccauucgggggaaaaaaaaaaaaaaaaaaaaaaga

SEQ ID NO: 318347 - RNA, 64 nt, Human
caauucauccauaaauauaaaaagggaaaaaaacuuaaggcaguagucugcauuaggacuguuu

SEQ ID NO: 318348 - RNA, 63 nt, Human
uuggcgagacacagcuugagaacagaagggcgucgggggaaccugccgcaaggagcagagaca

SEQ ID NO: 318349 - RNA, 63 nt, Human
auuggccugcccuucaacaauggccucaugggccgggggaacaucccuacccuuggcagugug

SEQ ID NO: 318350 - RNA, 63 nt, Human
gaacgaagacuuccgccgcgaagcccgauagaucgggggaaaauggggccuucgaccccagcg

SEQ ID NO: 318351 - RNA, 63 nt, Human
auauuucaguguugugacaaauguguaaacuagcgggggaagacaguauuguaucauaaauga

SEQ ID NO: 318352 - RNA, 63 nt, Human
uagggaggaggguucacaguguuuuugugggggcgggggaaggaagaggcagccccgcccccg

SEQ ID NO: 318353 - RNA, 63 nt, Human
ucuuuauacuauauaauaugguaacuuggguaccgggggaacuuuaaaauuucaucucaaaaa

SEQ ID NO: 318354 - RNA, 63 nt, Human
gguugggggugggugagggaauggggugggagucgggggaagugcaguccuuggagauguacu

SEQ ID NO: 318355 - RNA, 63 nt, Human
uguaaaaaauaaaaauaaauaauaacaauaauacgggggaaaggaacgaaaggaaaauaaucc

SEQ ID NO: 318356 - RNA, 63 nt, Human
ccagacucuggucuucuuuggguaaacgugugacgggggaaagccaaggucuggagaagcucc

SEQ ID NO: 318357 - RNA, 63 nt, Human
gacccaggcuacgagcgggagggaggcgggagucgggggaagacgcggcaggccggccgaggg

SEQ ID NO: 318358 - RNA, 63 nt, Human
ucccuuacucaguugccgggacauccccagucucgggggaagaagaugccaugggcuuauacc

SEQ ID NO: 318359 - RNA, 63 nt, Human
augggaccuaagguguugguauuuuccaggugucgggggaaaugaacuggugaagggguuuug

SEQ ID NO: 318360 - RNA, 50 nt, Human
ucaagagcagugaccagugacgggggaaacacaggguuaauaaaugccau

SEQ ID NO: 318361 - RNA, 63 nt, Human
uugggccaguaggcaucuuagcuuggcaggugucgggggaaugggccagauggaccugcuaga

SEQ ID NO: 318362 - RNA, 63 nt, Human
ucacucccggggccaccaaacgggccccucucucgggggaaccggacagcagcuuggcaaagg

SEQ ID NO: 318363 - RNA, 63 nt, Human
cuugaaguucaucuauuugauauaagacaccuucgggggaaauaauuccugugaauauucuuu

SEQ ID NO: 318364 - RNA, 63 nt, Human
cagcauggcuggagugggaagaggcuugggccccgggggaaugguuagggggacugaaccccu

SEQ ID NO: 318365 - RNA, 63 nt, Human
cugccagccaagggaaaggcccagagcccugugcgggggaauguggcacugucuauccauccg

SEQ ID NO: 318366 - RNA, 63 nt, Human
cggagaggacaguacuuaguccaaaggugcuaacgggggaacugggggcauugugacacccaa

SEQ ID NO: 318367 - RNA, 63 nt, Human
uguacagagaaaaccuggggaggguggggagggcgggggaauggaccuuguauagaucuggag

SEQ ID NO: 318368 - RNA, 64 nt, Human
uggaccccaaggcagaaaccaagaacugucugcaggcaaauaagcacccagcacccauccuggc

SEQ ID NO: 318369 - RNA, 64 nt, Human
cacucuccugccccaaucuaucuaguacuucccaggcaaauaggccccuuugaggcuccugagu

SEQ ID NO: 318370 - RNA, 64 nt, Human
gcacuuacaucauuugguacacagggucaaauagggcaaauaauuuugucuuuguauaauagau

SEQ ID NO: 318371 - RNA, 64 nt, Human
agccgauacgaacgucuugccaacaaaaauguguggcaaauagaaguauaucaagcaauaaucu

SEQ ID NO: 318372 - RNA, 64 nt, Human
uuuauugucagaauuuagacugaaacuacacauuggcaaauagcgugggauagauuuguuucuu

SEQ ID NO: 318373 - RNA, 64 nt, Human
uagagauuguuugaaugaugcauguuauugacaaggcaaauauauauauauacacagucuguuu

SEQ ID NO: 318374 - RNA, 64 nt, Human
uggguuuuaauccuacuuuagcuguagaaccuugggcaaauaacuucaucuuuuuggguccuaa

SEQ ID NO: 318375 - RNA, 64 nt, Human
uacuauuugccucuacuuuguauuguucagaaauggcaaauacaauauaaaagugauauauggu

SEQ ID NO: 318376 - RNA, 64 nt, Human
aucccucaaaaaacauuguuugccaaauccugguggcaaauacuugcacucaguauuucacaca

SEQ ID NO: 318377 - RNA, 64 nt, Human
cgaagaaaaaagaaaaaagagugguauuauuaugggcaaauaaucauauucccacuuaaaugau

SEQ ID NO: 318378 - RNA, 64 nt, Human
uuugcuuugcuagugcugcuuuguguguauguguggcaaauaauuugggggugauuugcaauga

SEQ ID NO: 318379 - RNA, 64 nt, Human
ugggcccaggccaguccuuguugcuggccuccaaggcaaauagugcuucacccugaccucucac

SEQ ID NO: 318380 - RNA, 64 nt, Human
caaauuuguagaaauuauuuacuagaagcuuccuggcaaauagucccuuuagcuacuucuccag

SEQ ID NO: 318381 - RNA, 64 nt, Human
uucuggauauuagaucuuuguuggaugcauaguuggcaaauauuuucuaccauucuguagguug

SEQ ID NO: 318382 - RNA, 64 nt, Human
agggauguccgcuauauccaaaauuacagcuauuggcaaauaaacgagauggauaaaggugugu

SEQ ID NO: 318383 - RNA, 56 nt, Human; identical to SEQ ID NO: 40838

SEQ ID NO: 318384 - RNA, 63 nt, Human
uuccagcagcaaucggcucucagaagaaguuuagccgcccacuucugccugccacuacaacaa

SEQ ID NO: 318385 - RNA, 63 nt, Human
ccugguucaaacgggugccuggucagaaggccagccgcccacuucccguuuccucuuuaacug

SEQ ID NO: 318386 - RNA, 64 nt, Human
caacaaaucugucugcuuccucacauuagucauuggcaaauaagcauucugucucuuuggcugc

SEQ ID NO: 318387 - RNA, 64 nt, Human
acauuuuuuuguuuuucacuuuagguaucucuuaggcaaauagagauauaaauuguaauaggaa

SEQ ID NO: 318388 - RNA, 64 nt, Human
guagucaucaacaauuugaccagggccuuuauuuggcaaauaacugagccaaccagaauaaaau

SEQ ID NO: 318389 - RNA, 64 nt, Human
caaaugcuggagccucaguuaaagugccucaaggggcaaauauuucaccauugccagagaagau

SEQ ID NO: 318390 - RNA, 64 nt, Human
gggcgggaaugaggaaaggggagggcaugauccuggcaaauagucuuuccuuuuccguaauuac

SEQ ID NO: 318391 - RNA, 64 nt, Human
auucuugguaguugagcagcucugggggaauaagggcaaauaugcuuguuaugaacuacacuga

SEQ ID NO: 318392 - RNA, 64 nt, Human
aaaaagcaaaaucauggaaaauuuuuguuguccaggcaaauaaaaggucauuuuaauuuagcug

SEQ ID NO: 318393 - RNA, 64 nt, Human
aacugcauugaauuuaaaacuucuaaaaauaacaggcaaauauuguagcuauauuacaguggga

SEQ ID NO: 318394 - RNA, 64 nt, Human
uuguuuuguuuuuguuuguuuucacuagaauaauggcaaauacuucuaauuuuuuucccuaaac

SEQ ID NO: 318395 - RNA, 64 nt, Human
acucauaucauggccuuuuaaauauuguaauaaaggcaaauagauauuugcccuuaguuuacug

SEQ ID NO: 318396 - RNA, 64 nt, Human
cuugaaauauuuaaaacauauuuguaaccagugaggcaaauacagaaguugaugucggcaguaa

SEQ ID NO: 318397 - RNA, 64 nt, Human
gagggaaggaaacugacaacgugugaaaguuagaggcaaauacauagguguagcuuggagugcu

SEQ ID NO: 318398 - RNA, 64 nt, Human
agauaggccuaaaucuuucagauucuuucuacaaggcaaauaaccccucucuuguuaauuauga

SEQ ID NO: 318399 - RNA, 64 nt, Human
gccaaaccacauaccuuaaugauuugggaaguuaggcaaauaugagauauguagacauaucuau

SEQ ID NO: 318400 - RNA, 64 nt, Human
augacagagcuggagaguuuuuugaaauggcaguggcaaauaaauaaauacuuuuuuuuaaaug

SEQ ID NO: 318401 - RNA, 63 nt, Human
cagaccuaaggcaucucuacucccuccagaggagccgcccagauuccugcaguggagaggagg

SEQ ID NO: 318402 - RNA, 63 nt, Human
gccaccacucacucuccuuauuacacaagcacagccgcccagugugcacaucaugugcagaca

SEQ ID NO: 318403 - RNA, 63 nt, Human
agacagccaugcugcuggcacuacagagggugagccgcccaugucuggggccuccucccauuc

SEQ ID NO: 318404 - RNA, 64 nt, Human
uucauucuuaguaguauaguuugcaauucuuaauggcaaauaauaaguuucaguagaaaacaaa

SEQ ID NO: 318405 - RNA, 64 nt, Human
ugggauucuucacucugccccucacuuccuuuagggcaaauaacacagcagaaccacgugggua

SEQ ID NO: 318406 - RNA, 64 nt, Human
aguuuauguggugaugguguggcuuuccgaaaugggcaaauauucagaagaucuuuugcauuuu

SEQ ID NO: 318407 - RNA, 64 nt, Human
gggcaaagcagacauuuuaguauacagagugauuggcaaauauuuucaagauuuaauaugagca

SEQ ID NO: 318408 - RNA, 64 nt, Human
uuuuaucuacuguguguugugguggccuguuggaggcaaauagaucagauuuuuuuuguaccua

SEQ ID NO: 318409 - RNA, 64 nt, Human
guaaauaguuauuuuauccuguggugcauguuugggcaaauauauauauagccugauaaacaac

SEQ ID NO: 318410 - RNA, 64 nt, Human
agaaaacaaaagccagacaaacccaaguuguccaggcaaauaaacucaaaucuuugucacgucu

SEQ ID NO: 318411 - RNA, 64 nt, Human
uaaaauuagaauuauacaaugacuuauuuuugguggcaaauacuuuaggagcaauaaugccuua

SEQ ID NO: 318412 - RNA, 64 nt, Human
ggaacuagcuucccaccucugacagggauaccauggcaaauaccacucuuugccuaggauuaua

SEQ ID NO: 318413 - RNA, 64 nt, Human
aacugugaauguauguagcaauccugcgugugaaggcaaauaaacucuuuaacaggcaauuaua

SEQ ID NO: 318414 - RNA, 64 nt, Human
caucauuaccugugaacugcaguggggcagucauggcaaauagaauugggcugggguuucuccu

SEQ ID NO: 318415 - RNA, 64 nt, Human
auaaaguacugaaucaccacuuuauauccacaaaggcaaauaacuaauguaugauaauagaaua

SEQ ID NO: 318416 - RNA, 64 nt, Human
aacacuagucuccauucacuugaaauacucucauggcaaauauuuauccucucauuaagugcuu

SEQ ID NO: 318417 - RNA, 64 nt, Human
uuuccaugcguuaacuuuucccaauagcagaggaggcaaauaugagcauacaaucccuuuguuc

SEQ ID NO: 318418 - RNA, 64 nt, Human
accuguggaucauauauauucaaagugagacaaaggcaaauaaaaagcagcuauuuucaugaau

SEQ ID NO: 318419 - RNA, 64 nt, Human; identical to SEQ ID NO: 314551

SEQ ID NO: 318420 - RNA, 64 nt, Human
gaugcaaauaauguaaaauguuuuaaagacaaauggcaaauaagauauggaccaaagucacuaa

SEQ ID NO: 318421 - RNA, 64 nt, Human
ucugcucauaaaaggaggaacacuuuagauagagggcaaauauaucugaaaaccuaauuucuuu

SEQ ID NO: 318422 - RNA, 64 nt, Human
uccugaagguguuuuucauucacuuuaauagaagggcaaauauuuauaagcuauuucuguacca

SEQ ID NO: 318423 - RNA, 64 nt, Human
gcaaaucuccauccacaucagggagcuuuccccaggcaaauacaaaccgccccguggccugcag

SEQ ID NO: 318424 - RNA, 64 nt, Human
aauccucucucaccucacagauacccccucccauggcaaauaauauaauaaccagugaauuuuc

SEQ ID NO: 318425 - RNA, 64 nt, Human
uuuaauccuaauauaaagugaauuugauugaaaaggcaaauagcuauuagggaagcaguuugcc

SEQ ID NO: 318426 - RNA, 64 nt, Human
aggucgguggguuaacugugugccuacugaaccuggcaaauaaacaucacccugcaaagccucu

SEQ ID NO: 318427 - RNA, 64 nt, Human
cugugaccacagcucaaguaaaaaaacaaaaacaggcaaauaaauaaacaugcuuaacaugucu

SEQ ID NO: 318428 - RNA, 64 nt, Human
ucauauuuuucaggacagauaguuuuuacuguggggcaaauagguuaaaauuacacuauguuag

SEQ ID NO: 318429 - RNA, 64 nt, Human
augcugcaagauaauguauuuaacaauauuugguggcaaauauucaauaaauaguuuacaucug

SEQ ID NO: 318430 - RNA, 64 nt, Human
aucuaaaauauuuuuaaauguauguauuuuaauuggcaaauaauacuuguauauauuguuuaca

SEQ ID NO: 318431 - RNA, 64 nt, Human
ucuccaguauuuucuguauuaucuuaauguuuauggcaaauaaaauguaaaggaacaugcaaca

SEQ ID NO: 318432 - RNA, 64 nt, Human
aguaacugcaggacaugauuauugaggcuugauuggcaaauacgacuucuacauccauauucuc

SEQ ID NO: 318433 - RNA, 64 nt, Human
aggaaacauggcacugcuuuuuucucuaagcaaaggcaaauauccucauaauucuaagcuaauu

SEQ ID NO: 318434 - RNA, 64 nt, Human
auuggauagcucagagggcccuugauucuggcaaggcaaauaaagccagaaugagaaauuacca

SEQ ID NO: 318435 - RNA, 62 nt, Human
ugaacccaggaauucaaggcugcaguaagcuacgaucacaccacugcacucuggccugcaug

SEQ ID NO: 318436 - RNA, 62 nt, Human
ccgaucacagacgagcagucaucggaaucacccgaucacagacgaguggccaccggaaucac

SEQ ID NO: 318437 - RNA, 62 nt, Human
ccgaucacagacgagcggucaccagaaucgcccgaucacagacgagcagucaucggaaucac

SEQ ID NO: 318438 - RNA, 64 nt, Human
uucuucacaauaaggcaaugguuuugagaggccaggcaaauaaucuuucucaccguagaacaaa

SEQ ID NO: 318439 - RNA, 64 nt, Human
agaugcuagguaguacgacccucuggauuuggaaggcaaauaaaacucuuacagugauuauuua

SEQ ID NO: 318440 - RNA, 64 nt, Human
cagugaaagaaucugaagccgauaauacaaagaaggcaaauaacucucaggagccuucuccgca

SEQ ID NO: 318441 - RNA, 64 nt, Human
uguguuccaaagcuuuuucaaacuagaauaaggaggcaaauagaagaaugagauacugaugucc

SEQ ID NO: 318442 - RNA, 64 nt, Human
uaacuugaaucacuaacugacugaaaauugaaugggcaaauaagugcuuuugucuccagaguau

SEQ ID NO: 318443 - RNA, 64 nt, Human
cuauuaaaauaugcaaaaauaagucagauuuuaaggcaaauaaagugacauaaggugcuuuaua

SEQ ID NO: 318444 - RNA, 64 nt, Human
caagaaucuguuuaaaguucagacuucaaauaguggcaaauaaaaagugcuauuugugaugguu

SEQ ID NO: 318445 - RNA, 64 nt, Human
uuuuagaucugacauugguagauagauggauuuaggcaaauaugaugcguuuguggggaaucca

SEQ ID NO: 318446 - RNA, 64 nt, Human
gaauguuuuauugucauuaugugaaaccaauauuggcaaauaguacuuuaaugaugaaguaaau

SEQ ID NO: 318447 - RNA, 64 nt, Human
accagaagugagagauuguuauauuuaggauauaggcaaauacaguaaaaguuaaaaaaaaaaa

SEQ ID NO: 318448 - RNA, 64 nt, Human
aaauuauguaaacuugauccugaaguuuuagaauggcaaauaaauguacaauuguuuacauaac

SEQ ID NO: 318449 - RNA, 64 nt, Human
auagccaccgagauccuuaucgaaacucauuuuaggcaaauaugaguuuuauuguccguuuacu

SEQ ID NO: 318450 - RNA, 64 nt, Human
agcuugcaccucauuuuaccaugcgugagggaauggcaaauaagaauguuugagcacacugccc

SEQ ID NO: 318451 - RNA, 64 nt, Human
agcuaauaaugccaccucugcaguuuugggaacaggcaaauaaaguaucaguauacauggugau

SEQ ID NO: 318452 - RNA, 64 nt, Human
auucaauucuugggagcuuuccuguuuaauauguggcaaauaugugaucuuaaauuuauaagga

SEQ ID NO: 318453 - RNA, 62 nt, Human
ccgaucacagacgagcagucaucggacucacccgaucacagacgagcggucaccagacucgc

SEQ ID NO: 318454 - RNA, 62 nt, Human
ccaaucacagacaagcagucaucggaaucacccgaucacagacgagcagucaucggacucac

SEQ ID NO: 318455 - RNA, 62 nt, Human
ccgaucacagacgagcggucaccggaaucgcccgaucacagacgagcggccaccggaaucgc

SEQ ID NO: 318456 - RNA, 64 nt, Human
acaacauuuuacuacugagggaaauagccaaaaaggcaaauaauggaaaaauaguaaacauuaa

SEQ ID NO: 318457 - RNA, 64 nt, Human
caucagagaugguaaucuacagcucaccucugaaggcaaauauaagcugggaaaaaaguuuuga

SEQ ID NO: 318458 - RNA, 64 nt, Human
uagccaaggaaggucagugugaaaagcuugcuauggcaaauauagcgaaaucucuccacugccu

SEQ ID NO: 318459 - RNA, 64 nt, Human
accaggggucuggccccaucgggucacaggugauggcaaauagaaaagaagcaaauggaggaaa

SEQ ID NO: 318460 - RNA, 64 nt, Human
ucuauuuuaagaaucauauuuuaggauuauuuuuggcaaauacagugagcacuuauguaaccag

SEQ ID NO: 318461 - RNA, 64 nt, Human
aaaauauaccuuuuauccggaaauauugguuuaaggcaaauaaauaaaacugugcuugcucuaa

SEQ ID NO: 318462 - RNA, 64 nt, Human
agauuaaauauccagccaguacaguauuuuuuaaggcaaauaaagaugauuagcucaccuugag

SEQ ID NO: 318463 - RNA, 64 nt, Human
aauaaugaggugucauuuuuugauaaucuugaauggcaaauaacccaauagccugcguaccaga

SEQ ID NO: 318464 - RNA, 64 nt, Human
uggguaguaugauggguguuuuuagcagguaggaggcaaauaucuugaaagggguugugaagag

SEQ ID NO: 318465 - RNA, 64 nt, Human
uuauacaagcuucuggugucuaggacaaauuuauggcaaauaaaauuagcaaaacugaacuggg

SEQ ID NO: 318466 - RNA, 64 nt, Human
gggaacuggccuuuagugaagcuauccagagcagggcaaauagccacugguaaagggaggaaau

SEQ ID NO: 318467 - RNA, 64 nt, Human
augguggggaaguggauucaggaaucuggggaauggcaaauauauuaagaagaguauugaaagu

SEQ ID NO: 318468 - RNA, 64 nt, Human
ggcagaucugcuuggggaagcuaguuaugugaaaggcaaauagagucauacaguagcucaaaag

SEQ ID NO: 318469 - RNA, 64 nt, Human
uaacaauaaaaaaaguaucaauaaaauaauuauuggcaaauaaauuggugaguugaagcagccu

SEQ ID NO: 318470 - RNA, 64 nt, Human
auuuugcagcuaucaugauccuaguucaaugcuaggcaaauaauggcacuuguuaauuauuuac

SEQ ID NO: 318471 - RNA, 62 nt, Human
gaaagugccuuugcagcucagaaccacagcaacgaucacaaaugacuuuauuauuuauuuuu

SEQ ID NO: 318472 - RNA, 62 nt, Human
ggcucugucgccuaagcuggagugugguggcacgaucacagcucacugcagccuccaucucc

SEQ ID NO: 318473 - RNA, 63 nt, Human; identical to SEQ ID NO: 315059

SEQ ID NO: 318474 - RNA, 64 nt, Human
ugucuaauguauuucaaaaucacccaaaacuuuuggcaaauaaaagcauuuaaaaagaccuuuc

SEQ ID NO: 318475 - RNA, 64 nt, Human
gauauucuuauucacguuuuuuuuaaccauaaguggcaaauauuuuaaaauauuugaaaaacac

SEQ ID NO: 318476 - RNA, 64 nt, Human
gcugauuuuuauuucuuugggggcuuuuuuucuuggcaaauacuaaaaaucucgucaauguaau

SEQ ID NO: 318477 - RNA, 64 nt, Human
aacuccacugcuuaccuacuuucuucagguaaagggcaaauaaugaucgaaaaaauaauuauuu

SEQ ID NO: 318478 - RNA, 64 nt, Human
uccauaaugacaugggcauauaccguaacauucuggcaaauaacaauuagaaaagauagguuua

SEQ ID NO: 318479 - RNA, 64 nt, Human
gagaacuuaucauguugguguguuagguaaaucgggcaaauaugauagugucuuacauugggcc

SEQ ID NO: 318480 - RNA, 64 nt, Human
cuaaggaaauuucuguaccuggagagagaguuuaggcaaauaacaaucagcaaggaaaccuuca

SEQ ID NO: 318481 - RNA, 64 nt, Human
cgggaacauaucuugcauggacuuuagcagcaauggcaaauaccuggcuaccugugcagaugau

SEQ ID NO: 318482 - RNA, 64 nt, Human
acacgcccuucaaaaccuguugaauaauuugauuggcaaauacuaucugucaccaagucccuuu

SEQ ID NO: 318483 - RNA, 64 nt, Human
ugaccaaauacaaacauccuaaaguagagcuuagggcaaauauuugauugagagggcacaauuu

SEQ ID NO: 318484 - RNA, 64 nt, Human
cagguuguuagaugauaacucaaaauuuucaguaggcaaauagguaauguggaaaucugaagaa

SEQ ID NO: 318485 - RNA, 64 nt, Human
gcaaacccuggaaguaaagacuuugucucacuuaggcaaauaaauguucuuccucuuuucagaa

SEQ ID NO: 318486 - RNA, 64 nt, Human
uguuaccugguuaagcuuguuuucucuugcuuuaggcaaauaaaaguuuaaaaaucaccuuguu

SEQ ID NO: 318487 - RNA, 64 nt, Human
gcuuuggcucuauugauuuguccauuauguguuaggcaaauauaacuuaaguggagggggaagu

SEQ ID NO: 318488 - RNA, 64 nt, Human
aaaucuauggccacacugagaagccuuugaaaauggcaaauacuuuucaucaccaauugcccaa

SEQ ID NO: 318489 - RNA, 62 nt, Human
auagucacucauucuucggucugaauuuuagacgaucacagaaacggucuuuaugaauuauu

SEQ ID NO: 318490 - RNA, 62 nt, Human
gagaguggacucaaaccuuuuaaaucugaaugcgaucacacuguagugauauaguagaagca

SEQ ID NO: 318491 - RNA, 62 nt, Human
aauuuuuuuucucccuaaccccagaugcaaugcgaucacagggucauuaccaucucuuuauu

SEQ ID NO: 318492 - RNA, 64 nt, Human
uaaaauugaggucacauauuuucuuuuguauccuggcaaauacuccugcaggccaggaaguaua

SEQ ID NO: 318493 - RNA, 64 nt, Human
auucugaaacaagaauuagaaugacuugagaacgggcaaauaacaaagcaaaccaauauaauua

SEQ ID NO: 318494 - RNA, 64 nt, Human
uucuuuuaccaaccugagaaaauuaggaugaccuggcaaauaagaucuugaauaggccaaaagc

SEQ ID NO: 318495 - RNA, 64 nt, Human
ugggaauauccgugccaggaaaagaaaaauuucuggcaaauauuuugucacugcuguaaagcaa

SEQ ID NO: 318496 - RNA, 64 nt, Human
uuuuucuauuguuuuuagaaaaaauaaaauaacuggcaaauauaucauugagccaaaucuuaag

SEQ ID NO: 318497 - RNA, 64 nt, Human
uguuguucccugcuguccuccguauuacgugaccggcaaauaaaucucauagcaguuaauauaa

SEQ ID NO: 318498 - RNA, 64 nt, Human
ggccaaggcucucucugucccuguaaaagagaggggcaaauagagagucuccaagagaacgccc

SEQ ID NO: 318499 - RNA, 64 nt, Human
accaaauugggagaauuguugcaaaguagugaauggcaaauaaauguuuuaaaaucuaucgcuc

SEQ ID NO: 318500 - RNA, 64 nt, Human
acacacaaacauacauaaagagagcaauugauaaggcaaauaagguaacauuuaacaauaaucu

SEQ ID NO: 318501 - RNA, 64 nt, Human
guuuuaaagguguuuauacugauuugauugugcuggcaaauauacuguauuguuaauauugaac

SEQ ID NO: 318502 - RNA, 64 nt, Human
ccuccauuuagacuauucaaaaauuuagaagaguggcaaauacuauuuuaaaagaagaaccaag

SEQ ID NO: 318503 - RNA, 64 nt, Human
ugucugauuaugcaugguucuaaaugguuucaguggcaaauacauaacauuguacuacugauua

SEQ ID NO: 318504 - RNA, 64 nt, Human
gcacaaugucuuugguugcaagucauaagccugaggcaaauaaaauuccaguaauuucgaagaa

SEQ ID NO: 318505 - RNA, 64 nt, Human
gauuuagugauaaagcaaauucuccuuggccucaggcaaauaguuucuaaagauucugugaaua

SEQ ID NO: 318506 - RNA, 64 nt, Human
ugaacagauauuucuccaaagaagauauacaaauggcaaauacauacguugaaagauccuuaau

SEQ ID NO: 318507 - RNA, 62 nt, Human
ccgaucacagacgagcagucaucggacucacccgaucacagacgagcggucaccagaaucgc

SEQ ID NO: 318508 - RNA, 62 nt, Human
ccgaucacagacgagcagucaucggaaucacccgaucacagacgagcagucaucggacucac

SEQ ID NO: 318509 - RNA, 62 nt, Human
auuucuaaagcucaaagaauucuguguuuaaacgaucacaauaggccgcugcuaucagauuu

SEQ ID NO: 318510 - RNA, 64 nt, Human
cuccagaaacauucuauagugugccagagcaaaaggcaaauacacaaaauauuauuuaaaucag

SEQ ID NO: 318511 - RNA, 64 nt, Human
aaauuauuuuaacaaagauuaaaauauacugcagggcaaauaauauucucuaaaacacaggaac

SEQ ID NO: 318512 - RNA, 64 nt, Human
ccuugggcaagacauugggcucuaggaugcaauuggcaaauacguccccguuacucaaauccuu

SEQ ID NO: 318513 - RNA, 64 nt, Human
aaguugcagauccacaaaacuaacaggauaauugggcaaauaaauuacauauaaacacacacaa

SEQ ID NO: 318514 - RNA, 64 nt, Human
auguuauuauguaauuaggacacauuuaaaauuuggcaaauaaugcauauaaugaaaucaauau

SEQ ID NO: 318515 - RNA, 64 nt, Human
aaggaaucucuugcugaguccaggccaccaaucaggcaaauagcccauacauuugaucguugua

SEQ ID NO: 318516 - RNA, 64 nt, Human
augucacugacauaaaguugaaaaaauaaaugcaggcaaauaacuagagacuucuuuuaagggg

SEQ ID NO: 318517 - RNA, 64 nt, Human
ucauuaugacaccuauugcaaauuagcaucccauggcaaauauauuuugaaaaaauaaagaacu

SEQ ID NO: 318518 - RNA, 64 nt, Human
caucaggauagcacagggaaacuguaguuuaaguggcaaauaaaaacauuugcaucaagagcug

SEQ ID NO: 318519 - RNA, 64 nt, Human
ucugaggcuggccgucuuucgggguguuccuuuuggcaaauauacacuguaaucuugagucuaa

SEQ ID NO: 318520 - RNA, 64 nt, Human
ugccauccgcuguggcugcagcuuggaccgcaagggcaaauacacccugaccccacgguagggc

SEQ ID NO: 318521 - RNA, 64 nt, Human
uauucugaaaaaaugaggaaaaaauaacaacaguggcaaauaaaaucauauuugguacuaaaau

SEQ ID NO: 318522 - RNA, 64 nt, Human
ucaucauaagaacuuuauauaaaggcauuacauuggcaaauaagguuuggaagcagaagagcaa

SEQ ID NO: 318523 - RNA, 64 nt, Human
ccagucucaauugccugauggcugaugccggcccggcaaauaggcaccgcacuuuacucuuggg

SEQ ID NO: 318524 - RNA, 64 nt, Human
uaacuuuguguucccagguccuagcucaggaguuggcaaauaagaauuaaaugucugcuacacc

SEQ ID NO: 318525 - RNA, 62 nt, Human
ugagcgagggaggucgaggcugcagugagccacgaucacaccacugcacuccagccuaggug

SEQ ID NO: 318526 - RNA, 62 nt, Human
gcugagacggacgguagacuuccaccauguaccgaucacaucccagcucugcauggccccug

SEQ ID NO: 318527 - RNA, 60 nt, Human; identical to SEQ ID NO: 314543

SEQ ID NO: 318528 - RNA, 64 nt, Human
cuuaacuguuuuuuguaacaagcaaagagaauauggcaaauauuuguauauucccaaggggccg

SEQ ID NO: 318529 - RNA, 64 nt, Human
agcccuguucuuuuuccuccagccugaagucuucggcaaauagcucagagggacacggucuugc

SEQ ID NO: 318530 - RNA, 64 nt, Human
uaacugagaauguaagaaaauugaugcuguacaaggcaaauaaagcuguuuauuaaccuugaug

SEQ ID NO: 318531 - RNA, 64 nt, Human
uuuuuguaauguuggcauacuuggggaauuuaguggcaaauacauuccccagcaggccuuuugu

SEQ ID NO: 318532 - RNA, 64 nt, Human
cuucccagagggauugcugugaaauuuuuuugguggcaaauaaagauaaauuucauucuguuca

SEQ ID NO: 318533 - RNA, 64 nt, Human
guaaaacuauguauaauaguauauagccaugcauggcaaauauuuuaauauuucuguuuucauu

SEQ ID NO: 318534 - RNA, 64 nt, Human
uaaguuuauacuauauaauuucuuaaugaacauuggcaaauagaguagcuaagagauugacaag

SEQ ID NO: 318535 - RNA, 64 nt, Human
ucuuguuuuccaaaguuucggcaggugccuggagggcaaauaaaaaagcagcagucagucagua

SEQ ID NO: 318536 - RNA, 64 nt, Human
aggguugagcacucaagggaaagauggaguagagggcaaauagcaaaaguuguugcacuccuga

SEQ ID NO: 318537 - RNA, 64 nt, Human
ggagagaggccuuuuuaugcauuaaauuguacauggcaaauaaaucccagaaggaucuguagau

SEQ ID NO: 318538 - RNA, 64 nt, Human
uaucaaucaucaauuguaaauaaauaauugccaaggcaaauaaauuuauauauauuaaauauuu

SEQ ID NO: 318539 - RNA, 64 nt, Human
cauguacccauaaaaauuuaaaaagaaauggaauggcaaauaauggaacauaaacuuuaaacag

SEQ ID NO: 318540 - RNA, 64 nt, Human
auugaacuauuuuuauaucugcugucuuucagaaggcaaauaggaaacuauauauuugcuuaaa

SEQ ID NO: 318541 - RNA, 64 nt, Human
uagauagcuguaaaauggaauauuuuuaaaugaaggcaaauaaguacuuaaaagugagcugagc

SEQ ID NO: 318542 - RNA, 64 nt, Human
ccuauauauuuauauaacuuuguaauauaacaugggcaaauaucugacuucuguauuuuuaaaa

SEQ ID NO: 318543 - RNA, 62 nt, Human
ugcucugucacccaggcuugagugcaguggugcgaucacagcccagugcagccucgaccacc

SEQ ID NO: 318544 - RNA, 62 nt, Human
ucugauugaaaaaaaacgacagucuggggaagcgaucacaucuggugaccaggcugcuucau

SEQ ID NO: 318545 - RNA, 62 nt, Human
gcagucccuccucaccagcucuccagccaggacgaucacacagagaugaauggcaucugagu

SEQ ID NO: 318546 - RNA, 64 nt, Human
auacaaaacuauuaaguaugucaacagccauuuaggcaaauaagcacuccuuuaaagccgcugc

SEQ ID NO: 318547 - RNA, 64 nt, Human
aucuaagaccaguauaguaaacuuagcccacaguggcaaauaaugaguaauauuguaauauguu

SEQ ID NO: 318548 - RNA, 64 nt, Human
auacuugaauugguuuuuucguauuuugccuacuggcaaauauuuugccuauuuucagucguuc

SEQ ID NO: 318549 - RNA, 64 nt, Human
cuagugcaguuacccccucucaguaauuauguuuggcaaauaugaaauacaaggaucuggcaag

SEQ ID NO: 318550 - RNA, 64 nt, Human
gauauggaaaaccagauaaaacaauguuacaaaaggcaaauauaaagaguauguuuucuuuuua

SEQ ID NO: 318551 - RNA, 64 nt, Human
uagaaugguuuucaucaguugggaucagcuauauggcaaauagguaucaucaaugaguuaacca

SEQ ID NO: 318552 - RNA, 64 nt, Human
cugccagguaguucccacugauggaaauguuuauggcaaauaauuuugccuucuaggcuguugc

SEQ ID NO: 318553 - RNA, 64 nt, Human
acuggacuagugaaaaaucuaguauuuguauccuggcaaauaauacuaauuuauaauccacagu

SEQ ID NO: 318554 - RNA, 64 nt, Human
cacacuuuaaugauaauauuccacauagucuaugggcaaauauuuucaacauuuccaauuuuua

SEQ ID NO: 318555 - RNA, 61 nt, Human
uaccaaagcugcugauuugaagaaccucuuuggcaaauauggaaagguacauucuuuuuac

SEQ ID NO: 318556 - RNA, 64 nt, Human
gugcaaggacucccggagccugugcagccuugguggcaaauaucucaucugccggcccccagga

SEQ ID NO: 318557 - RNA, 64 nt, Human
uuuguuuuaacuauuuugaagguuaggugagaugggcaaauaggcuuaacuauuuugaagguug

SEQ ID NO: 318558 - RNA, 64 nt, Human
gguaaauacugugaaauaccuuuucucacaaaaaggcaaauauugaaguuguuuaucaacuucg

SEQ ID NO: 318559 - RNA, 64 nt, Human
uuuuucaaaguaggcaauucuuuguauauuuuaaggcaaauaaucacuucaccucuggugccuu

SEQ ID NO: 318560 - RNA, 64 nt, Human
aagauucuguuccccucuucgcagaagugaggaaggcaaauacucaggguuugaagggagaccu

SEQ ID NO: 318561 - RNA, 62 nt, Human
agaaaacaaaacgaacucugguugggguacuacgaucacagacacagacauacuuuuccuaa

SEQ ID NO: 318562 - RNA, 62 nt, Human
gucacaucccaaggcagcaagagcauggauaccgaucacagggcugcugcggagucgugggg

SEQ ID NO: 318563 - RNA, 64 nt, Human; identical to SEQ ID NO: 314544

SEQ ID NO: 318564 - RNA, 64 nt, Human
aucugcuggcucuggggucccagugaauucugguggcaaauauauauuuucacuaacuaacucu

SEQ ID NO: 318565 - RNA, 64 nt, Human
uuccaguugcuguggaccaaugcaucucuuuaaaggcaaauauuauccagcaagcagucuaccc

SEQ ID NO: 318566 - RNA, 64 nt, Human
gccuucgcaccuccuccccuaaagcagcgcggggggcaaauaagaccccaccccucccugcagc

SEQ ID NO: 318567 - RNA, 64 nt, Human
gaaaaaaaguaugcuucauuaguaauuaaagaaaggcaaauagagcuggaagcauuuuucccuu

SEQ ID NO: 318568 - RNA, 64 nt, Human
cucucucuuccucuuucuucauucagaucuauauggcaaauagccacaauuauauaaaucauuu

SEQ ID NO: 318569 - RNA, 64 nt, Human
uuggguugauuuggaauaauuuuaugcucuuucuggcaaauaagauucuaaaagcacuuauauc

SEQ ID NO: 318570 - RNA, 64 nt, Human
ugcugccucaaagagcguguguucuuaguuaacuggcaaauagagcuguacucaguggccuugc

SEQ ID NO: 318571 - RNA, 64 nt, Human
ggcacacagcagcaggcagggaggaggcggagguggcaaauaaaccugggcaauuuuguuuaua

SEQ ID NO: 318572 - RNA, 64 nt, Human
ugauaauaauacaaaugauuguuguccauggaaaggcaaauaaauuuucuacagugaagaugca

SEQ ID NO: 318573 - RNA, 64 nt, Human
uguaauaaauaucuggaaaaaacauuaaacaauaggcaaauauauguuaugugcauuucuagaa

SEQ ID NO: 318574 - RNA, 64 nt, Human
ggacucagcaaugcacuuuaggacugagcuaggaggcaaauaucugaagcuugcuaugcuguuc

SEQ ID NO: 318575 - RNA, 64 nt, Human
cugggccccugucgucaggaccuccugaggcuuuggcaaauaaaccuccuaaaaugauacaaac

SEQ ID NO: 318576 - RNA, 64 nt, Human
gagcagaagcccaggcgggcccggggccuuggcuggcaaauaaagcguuagcccgcagcgcgac

SEQ ID NO: 318577 - RNA, 64 nt, Human
ggggcuugauugaucaguucccacucugacaacuggcaaauaccaggcguuaucauccuguaug

SEQ ID NO: 318578 - RNA, 64 nt, Human
cagacaccacaggagcugucaccuccugcggaugggcaaauaaauugguggaggacggagagaa

SEQ ID NO: 318579 - RNA, 62 nt, Human
guggacguguaugaugaggaggagaucaacaccgaucacaaugaaagcagugaagugagcca

SEQ ID NO: 318580 - RNA, 62 nt, Human
aacuggcuuacuuccuagucuacuugaggcugcgaucacacugaggaacucacaauuccaaa

SEQ ID NO: 318581 - RNA, 62 nt, Human
cacccuaacucaaaauaaauguuaaauaagugcgaucacacagcaccgacucuaccugacug

SEQ ID NO: 318582 - RNA, 64 nt, Human
ggugaugauauaggaguuaaggagaaaucauuuaggcaaauagcaaggguaggaaguccucagu

SEQ ID NO: 318583 - RNA, 64 nt, Human
aaugccaagauaauucacucuacucagccggcguggcaaauauaaaacuuacagagcguggcug

SEQ ID NO: 318584 - RNA, 64 nt, Human
uugccagaggcuuuucauuaguuuuguuuugauuggcaaauacuauuguggaaagaacauauau

SEQ ID NO: 318585 - RNA, 64 nt, Human
gggugagccugaagauggucccuuugguuucuggggcaaauagagcaccagcuuugugcauaau

SEQ ID NO: 318586 - RNA, 64 nt, Human
uacccacccugccuccaggccagggggcuggggaggcaaauagagccccccuauuuuagucuuu

SEQ ID NO: 318587 - RNA, 64 nt, Human
guguauuauuuacgucucugguccagucuuuucuggcaaauaacaguaaagaugguuuagcagg

SEQ ID NO: 318588 - RNA, 64 nt, Human
ggaucugcaagaugaacuguaagcucccccuugaggcaaauauuaaaguaauuuuuauaugucu

SEQ ID NO: 318589 - RNA, 64 nt, Human
aagaaggcccugcauguguaugaguccuauucugggcaaauagauucuuaaaguggcuuucaac

SEQ ID NO: 318590 - RNA, 64 nt, Human
gugggggaaggcucacuaagagggcaccaaguggggcaaauaccccugguaacccauuuaugga

SEQ ID NO: 318591 - RNA, 64 nt, Human
ugggcuugcccucccuuggcguccgucacccuuuggcaaauauagaauauuucacauucucaga

SEQ ID NO: 318592 - RNA, 64 nt, Human
uguaauugugugugaugugaagccaauucagacaggcaaauaaaagugaccuuuuacacugacu

SEQ ID NO: 318593 - RNA, 64 nt, Human
cuuauuuuuguuauccgagaccuuugcaaacauuggcaaauagcaucaauuaccuacuguauuu

SEQ ID NO: 318594 - RNA, 64 nt, Human
auaauuccuaaggucagccucccuuuuuguaaguggcaaauaucugauuaaaucauuucucagu

SEQ ID NO: 318595 - RNA, 64 nt, Human
uaaaguuuuuuaagaauguuuaucucagccaguaggcaaauacuugguguaaaacaaguugguc

SEQ ID NO: 318596 - RNA, 64 nt, Human
ccuuucguaaugaaauggaagccuccccuugucuggcaaauaauaaacucagugucuacuuuug

SEQ ID NO: 318597 - RNA, 62 nt, Human
aaagccugaacugugcuguuggaaaaugagagcgaucacauggagcaguaauggagcaaaga

SEQ ID NO: 318598 - RNA, 62 nt, Human
cugacuccacugaggaacugccucagaagcugcgaucacaacuuuggcugaagccccugccu

SEQ ID NO: 318599 - RNA, 62 nt, Human
ggcuggcccgggguggugaaguagcuggagcccgaucacagucccgcgguuugucagggggc

SEQ ID NO: 318600 - RNA, 64 nt, Human
ucugaugacugcggaugcugugacggacccaaggggcaaauagggucccaggguccagggaggg

SEQ ID NO: 318601 - RNA, 64 nt, Human
ggccagucagagaaagggggccauggacugcuguggcaaauagggagacaaggagacagacccu

SEQ ID NO: 318602 - RNA, 64 nt, Human
ucuucauguucaauuauuucccccauuuuucccaggcaaauaaaauucccuaaagccaaaauuu

SEQ ID NO: 318603 - RNA, 64 nt, Human
ugcagagucucuccugcccucccuccuuccugcaggcaaauauacaagcuagacccuguucccu

SEQ ID NO: 318604 - RNA, 64 nt, Human
gcaugcuuuaaaaaacacagucacgcaccaagcaggcaaauagcuuuaguccuucucaccucac

SEQ ID NO: 318605 - RNA, 64 nt, Human
cugaaaauucuauuacguuuauuuagauuucaaaggcaaauauugauuccuaugcucugugguu

SEQ ID NO: 318606 - RNA, 64 nt, Human
aucagcccuuuaaguaccuuucuguugcagcccaggcaaauaucacuuggccauucagaugggg

SEQ ID NO: 318607 - RNA, 64 nt, Human
gagaagggaggcaggggaggggcagcagaaccaaggcaaauauuucagcugggcuauaccccuc

SEQ ID NO: 318608 - RNA, 64 nt, Human
aggauuuucgucuuuauaauuucuguuuggccauggcaaauaccauaguugaguauuugcuuca

SEQ ID NO: 318609 - RNA, 64 nt, Human
ccuagugaaaacuuggguaauauauguaagaaauggcaaauaaauaccuuaguuaaugacuuuu

SEQ ID NO: 318610 - RNA, 64 nt, Human
cauuaaccccuaauucacucuucuuaaauagcuuggcaaauaagacuuuaccuuuaaaugaauu

SEQ ID NO: 318611 - RNA, 64 nt, Human
uaaaaaucaggccaaaaaucaggccaaaugacuuggcaaauaauugacaaagugguuuucacgu

SEQ ID NO: 318612 - RNA, 64 nt, Human
gcgugcuggaggcccuccugccugggccuuguggggcaaauauuggguccccaggcuggaaaga

SEQ ID NO: 318613 - RNA, 62 nt, Human
ggcaacacugaauaggaguuaagggaauggcacgaucacagugagagagcugcacucaccug

SEQ ID NO: 318614 - RNA, 62 nt, Human
gaaagaaagaaagaaagaaauccuacuacgagcgaucacaccaucuggccugaaaccacuuc

SEQ ID NO: 318615 - RNA, 62 nt, Human
uguguggucucugccccagccuguccuugucacgaucacaggccuugcuuuuguaacaauga

SEQ ID NO: 318616 - RNA, 62 nt, Human
caggaugagguauuuggguuuuuuuuuuagaucgaucacaucuacagaaaauggcuaaacca

SEQ ID NO: 318617 - RNA, 64 nt, Human; identical to SEQ ID NO: 73703

SEQ ID NO: 318618 - RNA, 64 nt, Human; identical to SEQ ID NO: 73704

SEQ ID NO: 318619 - RNA, 64 nt, Human; identical to SEQ ID NO: 73705

SEQ ID NO: 318620 - RNA, 64 nt, Human; identical to SEQ ID NO: 73706

SEQ ID NO: 318621 - RNA, 64 nt, Human; identical to SEQ ID NO: 73707

SEQ ID NO: 318622 - RNA, 64 nt, Human; identical to SEQ ID NO: 73708

SEQ ID NO: 318623 - RNA, 64 nt, Human; identical to SEQ ID NO: 73709

SEQ ID NO: 318624 - RNA, 64 nt, Human; identical to SEQ ID NO: 73710

SEQ ID NO: 318625 - RNA, 64 nt, Human; identical to SEQ ID NO: 73711

SEQ ID NO: 318626 - RNA, 64 nt, Human; identical to SEQ ID NO: 73712

SEQ ID NO: 318627 - RNA, 64 nt, Human; identical to SEQ ID NO: 73713

SEQ ID NO: 318628 - RNA, 64 nt, Human; identical to SEQ ID NO: 73714

SEQ ID NO: 318629 - RNA, 64 nt, Human; identical to SEQ ID NO: 73715

SEQ ID NO: 318630 - RNA, 64 nt, Human; identical to SEQ ID NO: 73716

SEQ ID NO: 318631 - RNA, 64 nt, Human; identical to SEQ ID NO: 73717

SEQ ID NO: 318632 - RNA, 64 nt, Human; identical to SEQ ID NO: 314546

SEQ ID NO: 318633 - RNA, 64 nt, Human; identical to SEQ ID NO: 314547

SEQ ID NO: 318634 - RNA, 64 nt, Human; identical to SEQ ID NO: 314548

SEQ ID NO: 318635 - RNA, 64 nt, Human; identical to SEQ ID NO: 73718

SEQ ID NO: 318636 - RNA, 64 nt, Human; identical to SEQ ID NO: 73719

SEQ ID NO: 318637 - RNA, 64 nt, Human; identical to SEQ ID NO: 73720

SEQ ID NO: 318638 - RNA, 64 nt, Human; identical to SEQ ID NO: 73721

SEQ ID NO: 318639 - RNA, 64 nt, Human; identical to SEQ ID NO: 73722

SEQ ID NO: 318640 - RNA, 64 nt, Human; identical to SEQ ID NO: 73723

SEQ ID NO: 318641 - RNA, 64 nt, Human; identical to SEQ ID NO: 73724

SEQ ID NO: 318642 - RNA, 64 nt, Human; identical to SEQ ID NO: 73725

SEQ ID NO: 318643 - RNA, 64 nt, Human; identical to SEQ ID NO: 73726

SEQ ID NO: 318644 - RNA, 64 nt, Human; identical to SEQ ID NO: 73727

SEQ ID NO: 318645 - RNA, 64 nt, Human; identical to SEQ ID NO: 73728

SEQ ID NO: 318646 - RNA, 64 nt, Human; identical to SEQ ID NO: 73729

SEQ ID NO: 318647 - RNA, 64 nt, Human; identical to SEQ ID NO: 73730

SEQ ID NO: 318648 - RNA, 64 nt, Human; identical to SEQ ID NO: 73731

SEQ ID NO: 318649 - RNA, 64 nt, Human; identical to SEQ ID NO: 73732

SEQ ID NO: 318650 - RNA, 64 nt, Human; identical to SEQ ID NO: 314549

SEQ ID NO: 318651 - RNA, 64 nt, Human; identical to SEQ ID NO: 314550

SEQ ID NO: 318652 - RNA, 64 nt, Human; identical to SEQ ID NO: 314552

SEQ ID NO: 318653 - RNA, 64 nt, Human; identical to SEQ ID NO: 73733

SEQ ID NO: 318654 - RNA, 64 nt, Human; identical to SEQ ID NO: 73734

SEQ ID NO: 318655 - RNA, 64 nt, Human; identical to SEQ ID NO: 73735

SEQ ID NO: 318656 - RNA, 64 nt, Human; identical to SEQ ID NO: 73736

SEQ ID NO: 318657 - RNA, 64 nt, Human; identical to SEQ ID NO: 73737

SEQ ID NO: 318658 - RNA, 64 nt, Human; identical to SEQ ID NO: 73738

SEQ ID NO: 318659 - RNA, 64 nt, Human; identical to SEQ ID NO: 73739

SEQ ID NO: 318660 - RNA, 64 nt, Human; identical to SEQ ID NO: 73740

SEQ ID NO: 318661 - RNA, 64 nt, Human; identical to SEQ ID NO: 73741

SEQ ID NO: 318662 - RNA, 64 nt, Human; identical to SEQ ID NO: 73742

SEQ ID NO: 318663 - RNA, 64 nt, Human; identical to SEQ ID NO: 73743

SEQ ID NO: 318664 - RNA, 64 nt, Human; identical to SEQ ID NO: 73744

SEQ ID NO: 318665 - RNA, 64 nt, Human; identical to SEQ ID NO: 73745

SEQ ID NO: 318666 - RNA, 64 nt, Human; identical to SEQ ID NO: 73746

SEQ ID NO: 318667 - RNA, 64 nt, Human; identical to SEQ ID NO: 73747

SEQ ID NO: 318668 - RNA, 64 nt, Human; identical to SEQ ID NO: 314556

SEQ ID NO: 318669 - RNA, 64 nt, Human; identical to SEQ ID NO: 73748

SEQ ID NO: 318670 - RNA, 64 nt, Human; identical to SEQ ID NO: 73749

SEQ ID NO: 318671 - RNA, 64 nt, Human; identical to SEQ ID NO: 73750

SEQ ID NO: 318672 - RNA, 64 nt, Human; identical to SEQ ID NO: 73751

SEQ ID NO: 318673 - RNA, 64 nt, Human; identical to SEQ ID NO: 73752

SEQ ID NO: 318674 - RNA, 64 nt, Human; identical to SEQ ID NO: 73753

SEQ ID NO: 318675 - RNA, 64 nt, Human; identical to SEQ ID NO: 73754

SEQ ID NO: 318676 - RNA, 64 nt, Human; identical to SEQ ID NO: 73755

SEQ ID NO: 318677 - RNA, 64 nt, Human; identical to SEQ ID NO: 73756

SEQ ID NO: 318678 - RNA, 64 nt, Human; identical to SEQ ID NO: 73757

SEQ ID NO: 318679 - RNA, 64 nt, Human; identical to SEQ ID NO: 73758

SEQ ID NO: 318680 - RNA, 64 nt, Human; identical to SEQ ID NO: 73759

SEQ ID NO: 318681 - RNA, 64 nt, Human; identical to SEQ ID NO: 73760

SEQ ID NO: 318682 - RNA, 64 nt, Human; identical to SEQ ID NO: 73761

SEQ ID NO: 318683 - RNA, 64 nt, Human; identical to SEQ ID NO: 73762

SEQ ID NO: 318684 - RNA, 63 nt, Human
guagaagugcugggagcagcagcuggggaagcugccgcccacgggcucugccccuuccagcug

SEQ ID NO: 318685 - RNA, 61 nt, Human
uucgucaguuuucuuccaauggcccuuuucagggccgcccacucccucucagaaagagcug

SEQ ID NO: 318686 - RNA, 63 nt, Human
gacgucagacuuggcucagcucggggagccuuagccgcccaugcacuggggacgcuccgcugc

SEQ ID NO: 318687 - RNA, 64 nt, Human; identical to SEQ ID NO: 73763

SEQ ID NO: 318688 - RNA, 64 nt, Human; identical to SEQ ID NO: 73764

SEQ ID NO: 318689 - RNA, 53 nt, Human; identical to SEQ ID NO: 73765

SEQ ID NO: 318690 - RNA, 64 nt, Human; identical to SEQ ID NO: 73766

SEQ ID NO: 318691 - RNA, 64 nt, Human; identical to SEQ ID NO: 73767

SEQ ID NO: 318692 - RNA, 64 nt, Human; identical to SEQ ID NO: 73768

SEQ ID NO: 318693 - RNA, 64 nt, Human; identical to SEQ ID NO: 73769

SEQ ID NO: 318694 - RNA, 64 nt, Human; identical to SEQ ID NO: 73770

SEQ ID NO: 318695 - RNA, 64 nt, Human; identical to SEQ ID NO: 73771

SEQ ID NO: 318696 - RNA, 64 nt, Human; identical to SEQ ID NO: 73772

SEQ ID NO: 318697 - RNA, 64 nt, Human; identical to SEQ ID NO: 73773

SEQ ID NO: 318698 - RNA, 64 nt, Human; identical to SEQ ID NO: 73774

SEQ ID NO: 318699 - RNA, 64 nt, Human; identical to SEQ ID NO: 73775

SEQ ID NO: 318700 - RNA, 64 nt, Human; identical to SEQ ID NO: 73776

SEQ ID NO: 318701 - RNA, 64 nt, Human; identical to SEQ ID NO: 73777

SEQ ID NO: 318702 - RNA, 64 nt, Human; identical to SEQ ID NO: 314536

SEQ ID NO: 318703 - RNA, 64 nt, Human; identical to SEQ ID NO: 73778

SEQ ID NO: 318704 - RNA, 64 nt, Human; identical to SEQ ID NO: 73779

SEQ ID NO: 318705 - RNA, 64 nt, Human; identical to SEQ ID NO: 73780

SEQ ID NO: 318706 - RNA, 64 nt, Human; identical to SEQ ID NO: 73781

SEQ ID NO: 318707 - RNA, 64 nt, Human; identical to SEQ ID NO: 73782

SEQ ID NO: 318708 - RNA, 64 nt, Human; identical to SEQ ID NO: 73783

SEQ ID NO: 318709 - RNA, 64 nt, Human; identical to SEQ ID NO: 73784

SEQ ID NO: 318710 - RNA, 64 nt, Human; identical to SEQ ID NO: 73785

SEQ ID NO: 318711 - RNA, 64 nt, Human; identical to SEQ ID NO: 73786

SEQ ID NO: 318712 - RNA, 64 nt, Human; identical to SEQ ID NO: 73787

SEQ ID NO: 318713 - RNA, 64 nt, Human; identical to SEQ ID NO: 73788

SEQ ID NO: 318714 - RNA, 64 nt, Human; identical to SEQ ID NO: 73789

SEQ ID NO: 318715 - RNA, 64 nt, Human; identical to SEQ ID NO: 73790

SEQ ID NO: 318716 - RNA, 64 nt, Human; identical to SEQ ID NO: 73791

SEQ ID NO: 318717 - RNA, 64 nt, Human; identical to SEQ ID NO: 73792

SEQ ID NO: 318718 - RNA, 61 nt, Human; identical to SEQ ID NO: 73793

SEQ ID NO: 318719 - RNA, 64 nt, Human; identical to SEQ ID NO: 73794

SEQ ID NO: 318720 - RNA, 64 nt, Human; identical to SEQ ID NO: 73795

SEQ ID NO: 318721 - RNA, 64 nt, Human; identical to SEQ ID NO: 73796

SEQ ID NO: 318722 - RNA, 64 nt, Human; identical to SEQ ID NO: 73797

SEQ ID NO: 318723 - RNA, 64 nt, Human; identical to SEQ ID NO: 73798

SEQ ID NO: 318724 - RNA, 64 nt, Human; identical to SEQ ID NO: 73799

SEQ ID NO: 318725 - RNA, 64 nt, Human; identical to SEQ ID NO: 73800

SEQ ID NO: 318726 - RNA, 64 nt, Human; identical to SEQ ID NO: 73801

SEQ ID NO: 318727 - RNA, 64 nt, Human; identical to SEQ ID NO: 73802

SEQ ID NO: 318728 - RNA, 64 nt, Human; identical to SEQ ID NO: 73803

SEQ ID NO: 318729 - RNA, 64 nt, Human; identical to SEQ ID NO: 73804

SEQ ID NO: 318730 - RNA, 64 nt, Human; identical to SEQ ID NO: 73805

SEQ ID NO: 318731 - RNA, 64 nt, Human; identical to SEQ ID NO: 73806

SEQ ID NO: 318732 - RNA, 64 nt, Human; identical to SEQ ID NO: 73807

SEQ ID NO: 318733 - RNA, 64 nt, Human; identical to SEQ ID NO: 314553

SEQ ID NO: 318734 - RNA, 53 nt, Human; identical to SEQ ID NO: 314554

SEQ ID NO: 318735 - RNA, 63 nt, Human
cagcucaacacagaaggagcagccccagccacagccgcccagccccggggucucagaugcuca

SEQ ID NO: 318736 - RNA, 64 nt, Human; identical to SEQ ID NO: 73808

SEQ ID NO: 318737 - RNA, 64 nt, Human; identical to SEQ ID NO: 73809

SEQ ID NO: 318738 - RNA, 64 nt, Human; identical to SEQ ID NO: 73810

SEQ ID NO: 318739 - RNA, 64 nt, Human; identical to SEQ ID NO: 73811

SEQ ID NO: 318740 - RNA, 64 nt, Human; identical to SEQ ID NO: 73812

SEQ ID NO: 318741 - RNA, 64 nt, Human; identical to SEQ ID NO: 73813

SEQ ID NO: 318742 - RNA, 64 nt, Human; identical to SEQ ID NO: 73814

SEQ ID NO: 318743 - RNA, 64 nt, Human; identical to SEQ ID NO: 73815

SEQ ID NO: 318744 - RNA, 64 nt, Human; identical to SEQ ID NO: 73816

SEQ ID NO: 318745 - RNA, 64 nt, Human; identical to SEQ ID NO: 73817

SEQ ID NO: 318746 - RNA, 64 nt, Human; identical to SEQ ID NO: 73818

SEQ ID NO: 318747 - RNA, 64 nt, Human; identical to SEQ ID NO: 73819

SEQ ID NO: 318748 - RNA, 64 nt, Human; identical to SEQ ID NO: 73820

SEQ ID NO: 318749 - RNA, 64 nt, Human; identical to SEQ ID NO: 73821

SEQ ID NO: 318750 - RNA, 64 nt, Human; identical to SEQ ID NO: 73822

SEQ ID NO: 318751 - RNA, 64 nt, Human; identical to SEQ ID NO: 73823

SEQ ID NO: 318752 - RNA, 64 nt, Human; identical to SEQ ID NO: 73824

SEQ ID NO: 318753 - RNA, 64 nt, Human; identical to SEQ ID NO: 73825

SEQ ID NO: 318754 - RNA, 64 nt, Human; identical to SEQ ID NO: 73826

SEQ ID NO: 318755 - RNA, 64 nt, Human; identical to SEQ ID NO: 73827

SEQ ID NO: 318756 - RNA, 64 nt, Human; identical to SEQ ID NO: 73828

SEQ ID NO: 318757 - RNA, 64 nt, Human; identical to SEQ ID NO: 73829

SEQ ID NO: 318758 - RNA, 64 nt, Human; identical to SEQ ID NO: 73830

SEQ ID NO: 318759 - RNA, 64 nt, Human; identical to SEQ ID NO: 73831

SEQ ID NO: 318760 - RNA, 64 nt, Human; identical to SEQ ID NO: 73832

SEQ ID NO: 318761 - RNA, 64 nt, Human; identical to SEQ ID NO: 73833

SEQ ID NO: 318762 - RNA, 64 nt, Human; identical to SEQ ID NO: 73834

SEQ ID NO: 318763 - RNA, 64 nt, Human; identical to SEQ ID NO: 73835

SEQ ID NO: 318764 - RNA, 64 nt, Human; identical to SEQ ID NO: 73836

SEQ ID NO: 318765 - RNA, 64 nt, Human; identical to SEQ ID NO: 73837

SEQ ID NO: 318766 - RNA, 64 nt, Human; identical to SEQ ID NO: 314532

SEQ ID NO: 318767 - RNA, 64 nt, Human; identical to SEQ ID NO: 314533

SEQ ID NO: 318768 - RNA, 64 nt, Human; identical to SEQ ID NO: 73838

SEQ ID NO: 318769 - RNA, 64 nt, Human; identical to SEQ ID NO: 73839

SEQ ID NO: 318770 - RNA, 64 nt, Human; identical to SEQ ID NO: 73840

SEQ ID NO: 318771 - RNA, 64 nt, Human; identical to SEQ ID NO: 73841

SEQ ID NO: 318772 - RNA, 64 nt, Human; identical to SEQ ID NO: 73842

SEQ ID NO: 318773 - RNA, 64 nt, Human; identical to SEQ ID NO: 73843

SEQ ID NO: 318774 - RNA, 64 nt, Human; identical to SEQ ID NO: 73844

SEQ ID NO: 318775 - RNA, 64 nt, Human; identical to SEQ ID NO: 73845

SEQ ID NO: 318776 - RNA, 64 nt, Human; identical to SEQ ID NO: 73846

SEQ ID NO: 318777 - RNA, 64 nt, Human; identical to SEQ ID NO: 73847

SEQ ID NO: 318778 - RNA, 64 nt, Human; identical to SEQ ID NO: 73848

SEQ ID NO: 318779 - RNA, 64 nt, Human; identical to SEQ ID NO: 73849

SEQ ID NO: 318780 - RNA, 64 nt, Human; identical to SEQ ID NO: 73850

SEQ ID NO: 318781 - RNA, 64 nt, Human; identical to SEQ ID NO: 73851

SEQ ID NO: 318782 - RNA, 64 nt, Human; identical to SEQ ID NO: 73852

SEQ ID NO: 318783 - RNA, 63 nt, Human
gguauuuucugccuaagugcuacgugauccucugccgcccagaccucaacagcacagagcacu

SEQ ID NO: 318784 - RNA, 58 nt, Human; identical to SEQ ID NO: 40789

SEQ ID NO: 318785 - RNA, 63 nt, Human
uugccugaaccaagaggccaggagcccccaugggccgcccaguaccaugcacacuccuguccc

SEQ ID NO: 318786 - RNA, 64 nt, Human; identical to SEQ ID NO: 73853

SEQ ID NO: 318787 - RNA, 64 nt, Human; identical to SEQ ID NO: 73854

SEQ ID NO: 318788 - RNA, 64 nt, Human; identical to SEQ ID NO: 73855

SEQ ID NO: 318789 - RNA, 64 nt, Human; identical to SEQ ID NO: 73856

SEQ ID NO: 318790 - RNA, 64 nt, Human; identical to SEQ ID NO: 73857

SEQ ID NO: 318791 - RNA, 64 nt, Human; identical to SEQ ID NO: 73858

SEQ ID NO: 318792 - RNA, 64 nt, Human; identical to SEQ ID NO: 73859

SEQ ID NO: 318793 - RNA, 64 nt, Human; identical to SEQ ID NO: 73860

SEQ ID NO: 318794 - RNA, 64 nt, Human; identical to SEQ ID NO: 73861

SEQ ID NO: 318795 - RNA, 64 nt, Human; identical to SEQ ID NO: 73862

SEQ ID NO: 318796 - RNA, 64 nt, Human; identical to SEQ ID NO: 73863

SEQ ID NO: 318797 - RNA, 64 nt, Human; identical to SEQ ID NO: 73864

SEQ ID NO: 318798 - RNA, 64 nt, Human; identical to SEQ ID NO: 73865

SEQ ID NO: 318799 - RNA, 64 nt, Human; identical to SEQ ID NO: 73866

SEQ ID NO: 318800 - RNA, 64 nt, Human; identical to SEQ ID NO: 73867

SEQ ID NO: 318801 - RNA, 63 nt, Human
gauuuuggugagcuuagcuucuguauuccuacugccgcccagaaaaggggcagggcucugcag

SEQ ID NO: 318802 - RNA, 63 nt, Human; identical to SEQ ID NO: 314982

SEQ ID NO: 318803 - RNA, 63 nt, Human
agagugguccucagcccauuucagacugcagaugccgcccacucccaccccacuccuaggcug

SEQ ID NO: 318804 - RNA, 64 nt, Human; identical to SEQ ID NO: 73868

SEQ ID NO: 318805 - RNA, 64 nt, Human; identical to SEQ ID NO: 73869

SEQ ID NO: 318806 - RNA, 64 nt, Human; identical to SEQ ID NO: 73870

SEQ ID NO: 318807 - RNA, 64 nt, Human; identical to SEQ ID NO: 73871

SEQ ID NO: 318808 - RNA, 64 nt, Human; identical to SEQ ID NO: 73872

SEQ ID NO: 318809 - RNA, 64 nt, Human; identical to SEQ ID NO: 73873

SEQ ID NO: 318810 - RNA, 64 nt, Human; identical to SEQ ID NO: 73874

SEQ ID NO: 318811 - RNA, 64 nt, Human; identical to SEQ ID NO: 73875

SEQ ID NO: 318812 - RNA, 64 nt, Human; identical to SEQ ID NO: 73876

SEQ ID NO: 318813 - RNA, 64 nt, Human; identical to SEQ ID NO: 73877

SEQ ID NO: 318814 - RNA, 64 nt, Human; identical to SEQ ID NO: 73878

SEQ ID NO: 318815 - RNA, 64 nt, Human; identical to SEQ ID NO: 73879

SEQ ID NO: 318816 - RNA, 64 nt, Human; identical to SEQ ID NO: 73880

SEQ ID NO: 318817 - RNA, 64 nt, Human; identical to SEQ ID NO: 73881

SEQ ID NO: 318818 - RNA, 64 nt, Human; identical to SEQ ID NO: 73882

SEQ ID NO: 318819 - RNA, 63 nt, Human; identical to SEQ ID NO: 317518

SEQ ID NO: 318820 - RNA, 63 nt, Human; identical to SEQ ID NO: 317519

SEQ ID NO: 318821 - RNA, 63 nt, Human; identical to SEQ ID NO: 318735

SEQ ID NO: 318822 - RNA, 64 nt, Human; identical to SEQ ID NO: 73883

SEQ ID NO: 318823 - RNA, 64 nt, Human; identical to SEQ ID NO: 73884

SEQ ID NO: 318824 - RNA, 64 nt, Human; identical to SEQ ID NO: 73885

SEQ ID NO: 318825 - RNA, 64 nt, Human; identical to SEQ ID NO: 73886

SEQ ID NO: 318826 - RNA, 64 nt, Human; identical to SEQ ID NO: 73887

SEQ ID NO: 318827 - RNA, 64 nt, Human; identical to SEQ ID NO: 73888

SEQ ID NO: 318828 - RNA, 64 nt, Human; identical to SEQ ID NO: 73889

SEQ ID NO: 318829 - RNA, 64 nt, Human; identical to SEQ ID NO: 73890

SEQ ID NO: 318830 - RNA, 64 nt, Human; identical to SEQ ID NO: 73891

SEQ ID NO: 318831 - RNA, 52 nt, Human; identical to SEQ ID NO: 73892

SEQ ID NO: 318832 - RNA, 64 nt, Human; identical to SEQ ID NO: 73893

SEQ ID NO: 318833 - RNA, 64 nt, Human; identical to SEQ ID NO: 73894

SEQ ID NO: 318834 - RNA, 64 nt, Human; identical to SEQ ID NO: 73895

SEQ ID NO: 318835 - RNA, 64 nt, Human; identical to SEQ ID NO: 73896

SEQ ID NO: 318836 - RNA, 64 nt, Human; identical to SEQ ID NO: 73897

SEQ ID NO: 318837 - RNA, 63 nt, Human; identical to SEQ ID NO: 317554

SEQ ID NO: 318838 - RNA, 63 nt, Human; identical to SEQ ID NO: 317555

SEQ ID NO: 318839 - RNA, 63 nt, Human; identical to SEQ ID NO: 317589

SEQ ID NO: 318840 - RNA, 54 nt, Human; identical to SEQ ID NO: 73898

SEQ ID NO: 318841 - RNA, 64 nt, Human; identical to SEQ ID NO: 73899

SEQ ID NO: 318842 - RNA, 64 nt, Human; identical to SEQ ID NO: 73900

SEQ ID NO: 318843 - RNA, 64 nt, Human; identical to SEQ ID NO: 73901

SEQ ID NO: 318844 - RNA, 64 nt, Human; identical to SEQ ID NO: 73902

SEQ ID NO: 318845 - RNA, 64 nt, Human; identical to SEQ ID NO: 73903

SEQ ID NO: 318846 - RNA, 64 nt, Human; identical to SEQ ID NO: 73904

SEQ ID NO: 318847 - RNA, 64 nt, Human; identical to SEQ ID NO: 73905

SEQ ID NO: 318848 - RNA, 64 nt, Human; identical to SEQ ID NO: 73906

SEQ ID NO: 318849 - RNA, 64 nt, Human; identical to SEQ ID NO: 73907

SEQ ID NO: 318850 - RNA, 64 nt, Human; identical to SEQ ID NO: 73908

SEQ ID NO: 318851 - RNA, 64 nt, Human; identical to SEQ ID NO: 73909

SEQ ID NO: 318852 - RNA, 63 nt, Human; identical to SEQ ID NO: 73910

SEQ ID NO: 318853 - RNA, 64 nt, Human; identical to SEQ ID NO: 73911

SEQ ID NO: 318854 - RNA, 64 nt, Human; identical to SEQ ID NO: 73912

SEQ ID NO: 318855 - RNA, 63 nt, Human; identical to SEQ ID NO: 317590

SEQ ID NO: 318856 - RNA, 63 nt, Human; identical to SEQ ID NO: 316237

SEQ ID NO: 318857 - RNA, 63 nt, Human; identical to SEQ ID NO: 317333

SEQ ID NO: 318858 - RNA, 64 nt, Human; identical to SEQ ID NO: 73913

SEQ ID NO: 318859 - RNA, 64 nt, Human; identical to SEQ ID NO: 73914

SEQ ID NO: 318860 - RNA, 64 nt, Human; identical to SEQ ID NO: 73915

SEQ ID NO: 318861 - RNA, 64 nt, Human; identical to SEQ ID NO: 73916

SEQ ID NO: 318862 - RNA, 64 nt, Human; identical to SEQ ID NO: 73917

SEQ ID NO: 318863 - RNA, 64 nt, Human; identical to SEQ ID NO: 73918

SEQ ID NO: 318864 - RNA, 64 nt, Human; identical to SEQ ID NO: 73919

SEQ ID NO: 318865 - RNA, 64 nt, Human; identical to SEQ ID NO: 73920

SEQ ID NO: 318866 - RNA, 64 nt, Human; identical to SEQ ID NO: 73921

SEQ ID NO: 318867 - RNA, 64 nt, Human; identical to SEQ ID NO: 73922

SEQ ID NO: 318868 - RNA, 64 nt, Human; identical to SEQ ID NO: 73923

SEQ ID NO: 318869 - RNA, 64 nt, Human; identical to SEQ ID NO: 73924

SEQ ID NO: 318870 - RNA, 64 nt, Human; identical to SEQ ID NO: 73925

SEQ ID NO: 318871 - RNA, 64 nt, Human; identical to SEQ ID NO: 73926

SEQ ID NO: 318872 - RNA, 64 nt, Human; identical to SEQ ID NO: 73927

SEQ ID NO: 318873 - RNA, 63 nt, Human
gauccauggggcaguccaggcaucucccuaccagccgcccacauuggcuucgcugcagcgcuu

SEQ ID NO: 318874 - RNA, 64 nt, Human; identical to SEQ ID NO: 73928

SEQ ID NO: 318875 - RNA, 64 nt, Human; identical to SEQ ID NO: 73929

SEQ ID NO: 318876 - RNA, 64 nt, Human; identical to SEQ ID NO: 73930

SEQ ID NO: 318877 - RNA, 64 nt, Human; identical to SEQ ID NO: 73931

SEQ ID NO: 318878 - RNA, 64 nt, Human; identical to SEQ ID NO: 73932

SEQ ID NO: 318879 - RNA, 64 nt, Human; identical to SEQ ID NO: 73933

SEQ ID NO: 318880 - RNA, 64 nt, Human; identical to SEQ ID NO: 73934

SEQ ID NO: 318881 - RNA, 64 nt, Human; identical to SEQ ID NO: 73935

SEQ ID NO: 318882 - RNA, 64 nt, Human; identical to SEQ ID NO: 73936

SEQ ID NO: 318883 - RNA, 64 nt, Human; identical to SEQ ID NO: 73937

SEQ ID NO: 318884 - RNA, 64 nt, Human; identical to SEQ ID NO: 73938

SEQ ID NO: 318885 - RNA, 64 nt, Human; identical to SEQ ID NO: 73939

SEQ ID NO: 318886 - RNA, 64 nt, Human; identical to SEQ ID NO: 73940

SEQ ID NO: 318887 - RNA, 64 nt, Human; identical to SEQ ID NO: 73941

SEQ ID NO: 318888 - RNA, 64 nt, Human; identical to SEQ ID NO: 73942

SEQ ID NO: 318889 - RNA, 63 nt, Human; identical to SEQ ID NO: 317660

SEQ ID NO: 318890 - RNA, 63 nt, Human; identical to SEQ ID NO: 316239

SEQ ID NO: 318891 - RNA, 64 nt, Human; identical to SEQ ID NO: 73943

SEQ ID NO: 318892 - RNA, 64 nt, Human; identical to SEQ ID NO: 73944

SEQ ID NO: 318893 - RNA, 64 nt, Human; identical to SEQ ID NO: 73945

SEQ ID NO: 318894 - RNA, 58 nt, Human; identical to SEQ ID NO: 73946

SEQ ID NO: 318895 - RNA, 64 nt, Human; identical to SEQ ID NO: 73947

SEQ ID NO: 318896 - RNA, 64 nt, Human; identical to SEQ ID NO: 73948

SEQ ID NO: 318897 - RNA, 64 nt, Human; identical to SEQ ID NO: 73949

SEQ ID NO: 318898 - RNA, 64 nt, Human; identical to SEQ ID NO: 73950

SEQ ID NO: 318899 - RNA, 64 nt, Human; identical to SEQ ID NO: 73951

SEQ ID NO: 318900 - RNA, 64 nt, Human; identical to SEQ ID NO: 73952

SEQ ID NO: 318901 - RNA, 64 nt, Human; identical to SEQ ID NO: 73953

SEQ ID NO: 318902 - RNA, 64 nt, Human; identical to SEQ ID NO: 73954

SEQ ID NO: 318903 - RNA, 64 nt, Human; identical to SEQ ID NO: 73955

SEQ ID NO: 318904 - RNA, 64 nt, Human; identical to SEQ ID NO: 73956

SEQ ID NO: 318905 - RNA, 64 nt, Human; identical to SEQ ID NO: 73957

SEQ ID NO: 318906 - RNA, 63 nt, Human; identical to SEQ ID NO: 317334

SEQ ID NO: 318907 - RNA, 63 nt, Human; identical to SEQ ID NO: 316238

SEQ ID NO: 318908 - RNA, 64 nt, Human; identical to SEQ ID NO: 73958

SEQ ID NO: 318909 - RNA, 64 nt, Human; identical to SEQ ID NO: 73959

SEQ ID NO: 318910 - RNA, 64 nt, Human; identical to SEQ ID NO: 73960

SEQ ID NO: 318911 - RNA, 64 nt, Human; identical to SEQ ID NO: 73961

SEQ ID NO: 318912 - RNA, 64 nt, Human; identical to SEQ ID NO: 73962

SEQ ID NO: 318913 - RNA, 64 nt, Human; identical to SEQ ID NO: 73963

SEQ ID NO: 318914 - RNA, 64 nt, Human; identical to SEQ ID NO: 73964

SEQ ID NO: 318915 - RNA, 64 nt, Human; identical to SEQ ID NO: 73965

SEQ ID NO: 318916 - RNA, 64 nt, Human; identical to SEQ ID NO: 73966

SEQ ID NO: 318917 - RNA, 64 nt, Human; identical to SEQ ID NO: 73967

SEQ ID NO: 318918 - RNA, 58 nt, Human; identical to SEQ ID NO: 73946

SEQ ID NO: 318919 - RNA, 64 nt, Human; identical to SEQ ID NO: 73969

SEQ ID NO: 318920 - RNA, 64 nt, Human; identical to SEQ ID NO: 73970

SEQ ID NO: 318921 - RNA, 64 nt, Human; identical to SEQ ID NO: 73971

SEQ ID NO: 318922 - RNA, 64 nt, Human; identical to SEQ ID NO: 73972

SEQ ID NO: 318923 - RNA, 64 nt, Human; identical to SEQ ID NO: 73973

SEQ ID NO: 318924 - RNA, 64 nt, Human; identical to SEQ ID NO: 73974

SEQ ID NO: 318925 - RNA, 64 nt, Human; identical to SEQ ID NO: 73975

SEQ ID NO: 318926 - RNA, 64 nt, Human; identical to SEQ ID NO: 73976

SEQ ID NO: 318927 - RNA, 64 nt, Human; identical to SEQ ID NO: 73977

SEQ ID NO: 318928 - RNA, 64 nt, Human; identical to SEQ ID NO: 73978

SEQ ID NO: 318929 - RNA, 64 nt, Human; identical to SEQ ID NO: 73979

SEQ ID NO: 318930 - RNA, 64 nt, Human; identical to SEQ ID NO: 73980

SEQ ID NO: 318931 - RNA, 64 nt, Human; identical to SEQ ID NO: 73981

SEQ ID NO: 318932 - RNA, 64 nt, Human; identical to SEQ ID NO: 73982

SEQ ID NO: 318933 - RNA, 64 nt, Human; identical to SEQ ID NO: 73983

SEQ ID NO: 318934 - RNA, 64 nt, Human; identical to SEQ ID NO: 73984

SEQ ID NO: 318935 - RNA, 64 nt, Human; identical to SEQ ID NO: 73985

SEQ ID NO: 318936 - RNA, 64 nt, Human; identical to SEQ ID NO: 73986

SEQ ID NO: 318937 - RNA, 64 nt, Human; identical to SEQ ID NO: 73987

SEQ ID NO: 318938 - RNA, 63 nt, Human; identical to SEQ ID NO: 314983

SEQ ID NO: 318939 - RNA, 63 nt, Human
cuucagauacugugggacucaugcuggagaggagccgcccacuuccaggaccugugaauaagg

SEQ ID NO: 318940 - RNA, 63 nt, Human
guccgugcaggcacacucagcgcuaagccaaaggccgcccaugcugagcucaucuggccccau

SEQ ID NO: 318941 - RNA, 64 nt, Human; identical to SEQ ID NO: 73988

SEQ ID NO: 318942 - RNA, 64 nt, Human; identical to SEQ ID NO: 73989

SEQ ID NO: 318943 - RNA, 64 nt, Human; identical to SEQ ID NO: 73990

SEQ ID NO: 318944 - RNA, 64 nt, Human; identical to SEQ ID NO: 73991

SEQ ID NO: 318945 - RNA, 64 nt, Human; identical to SEQ ID NO: 73992

SEQ ID NO: 318946 - RNA, 64 nt, Human; identical to SEQ ID NO: 73993

SEQ ID NO: 318947 - RNA, 64 nt, Human; identical to SEQ ID NO: 73994

SEQ ID NO: 318948 - RNA, 64 nt, Human; identical to SEQ ID NO: 73995

SEQ ID NO: 318949 - RNA, 64 nt, Human; identical to SEQ ID NO: 73996

SEQ ID NO: 318950 - RNA, 64 nt, Human; identical to SEQ ID NO: 73997

SEQ ID NO: 318951 - RNA, 64 nt, Human; identical to SEQ ID NO: 73998

SEQ ID NO: 318952 - RNA, 64 nt, Human; identical to SEQ ID NO: 73999

SEQ ID NO: 318953 - RNA, 64 nt, Human; identical to SEQ ID NO: 74000

SEQ ID NO: 318954 - RNA, 64 nt, Human; identical to SEQ ID NO: 74001

SEQ ID NO: 318955 - RNA, 64 nt, Human; identical to SEQ ID NO: 74002

SEQ ID NO: 318956 - RNA, 64 nt, Human; identical to SEQ ID NO: 74003

SEQ ID NO: 318957 - RNA, 64 nt, Human; identical to SEQ ID NO: 74004

SEQ ID NO: 318958 - RNA, 64 nt, Human; identical to SEQ ID NO: 74005

SEQ ID NO: 318959 - RNA, 64 nt, Human; identical to SEQ ID NO: 74006

SEQ ID NO: 318960 - RNA, 64 nt, Human; identical to SEQ ID NO: 74007

SEQ ID NO: 318961 - RNA, 64 nt, Human; identical to SEQ ID NO: 74008

SEQ ID NO: 318962 - RNA, 64 nt, Human; identical to SEQ ID NO: 74009

SEQ ID NO: 318963 - RNA, 64 nt, Human; identical to SEQ ID NO: 74010

SEQ ID NO: 318964 - RNA, 64 nt, Human; identical to SEQ ID NO: 74011

SEQ ID NO: 318965 - RNA, 64 nt, Human; identical to SEQ ID NO: 74012

SEQ ID NO: 318966 - RNA, 64 nt, Human; identical to SEQ ID NO: 74013

SEQ ID NO: 318967 - RNA, 64 nt, Human; identical to SEQ ID NO: 74014

SEQ ID NO: 318968 - RNA, 64 nt, Human; identical to SEQ ID NO: 74015

SEQ ID NO: 318969 - RNA, 64 nt, Human; identical to SEQ ID NO: 74016

SEQ ID NO: 318970 - RNA, 64 nt, Human; identical to SEQ ID NO: 74017

SEQ ID NO: 318971 - RNA, 64 nt, Human; identical to SEQ ID NO: 74018

SEQ ID NO: 318972 - RNA, 64 nt, Human; identical to SEQ ID NO: 74019

SEQ ID NO: 318973 - RNA, 64 nt, Human; identical to SEQ ID NO: 74020

SEQ ID NO: 318974 - RNA, 64 nt, Human; identical to SEQ ID NO: 74021

SEQ ID NO: 318975 - RNA, 64 nt, Human; identical to SEQ ID NO: 74022

SEQ ID NO: 318976 - RNA, 64 nt, Human; identical to SEQ ID NO: 74023

SEQ ID NO: 318977 - RNA, 64 nt, Human; identical to SEQ ID NO: 74024

SEQ ID NO: 318978 - RNA, 64 nt, Human; identical to SEQ ID NO: 74025

SEQ ID NO: 318979 - RNA, 64 nt, Human
gaaaggauguuacuagaaguacacaaauugggcccggcgcgauggcucacgccuguaaucccag

SEQ ID NO: 318980 - RNA, 64 nt, Human
aguaauacgaaggugaggucugggaugcugcgugcggcgcgacgacaggagguaugaccugggu

SEQ ID NO: 318981 - RNA, 64 nt, Human
acacacccgucacaagacgcggacaugcaggucucggcgcgagcucugccccguccaagagccu

SEQ ID NO: 318982 - RNA, 64 nt, Human
cugaccuauaccucaggaugggcgcgucugggcgcggcgcgagcggccgggcagggcccugcag

SEQ ID NO: 318983 - RNA, 57 nt, Human; identical to SEQ ID NO: 307757

SEQ ID NO: 318984 - RNA, 63 nt, Human; identical to SEQ ID NO: 317626

SEQ ID NO: 318985 - RNA, 63 nt, Human; identical to SEQ ID NO: 316219

SEQ ID NO: 318986 - RNA, 63 nt, Human; identical to SEQ ID NO: 316236

SEQ ID NO: 318987 - RNA, 64 nt, Human
cgacccgcgccugugccacccccuggcccggccgcggcgcgacgccgaacccguguugggcggc

SEQ ID NO: 318988 - RNA, 64 nt, Human
cgcagaaggcgggcaagugaagcgcgggcgcccgcggcgcgacccuccccggcggugccgcgcu

SEQ ID NO: 318989 - RNA, 64 nt, Human
ggaaagaacccuggggacccuaauguuggacucucggcgcgacacucaaccaccauggccgcuc

SEQ ID NO: 318990 - RNA, 64 nt, Human; identical to SEQ ID NO: 115711

SEQ ID NO: 318991 - RNA, 64 nt, Human; identical to SEQ ID NO: 115712

SEQ ID NO: 318992 - RNA, 64 nt, Human; identical to SEQ ID NO: 115713

SEQ ID NO: 318993 - RNA, 64 nt, Human; identical to SEQ ID NO: 115714

SEQ ID NO: 318994 - RNA, 63 nt, Human; identical to SEQ ID NO: 316199

SEQ ID NO: 318995 - RNA, 63 nt, Human; identical to SEQ ID NO: 317427

SEQ ID NO: 318996 - RNA, 64 nt, Human; identical to SEQ ID NO: 115715

SEQ ID NO: 318997 - RNA, 64 nt, Human; identical to SEQ ID NO: 115716

SEQ ID NO: 318998 - RNA, 64 nt, Human; identical to SEQ ID NO: 115717

SEQ ID NO: 318999 - RNA, 63 nt, Human; identical to SEQ ID NO: 115718

SEQ ID NO: 319000 - RNA, 64 nt, Human; identical to SEQ ID NO: 115719

SEQ ID NO: 319001 - RNA, 64 nt, Human; identical to SEQ ID NO: 115720

SEQ ID NO: 319002 - RNA, 64 nt, Human; identical to SEQ ID NO: 115721

SEQ ID NO: 319003 - RNA, 64 nt, Human; identical to SEQ ID NO: 115722

SEQ ID NO: 319004 - RNA, 64 nt, Human; identical to SEQ ID NO: 115723

SEQ ID NO: 319005 - RNA, 64 nt, Human; identical to SEQ ID NO: 115724

SEQ ID NO: 319006 - RNA, 64 nt, Human; identical to SEQ ID NO: 115725

SEQ ID NO: 319007 - RNA, 64 nt, Human; identical to SEQ ID NO: 115726

SEQ ID NO: 319008 - RNA, 64 nt, Human; identical to SEQ ID NO: 115727

SEQ ID NO: 319009 - RNA, 64 nt, Human; identical to SEQ ID NO: 115728

SEQ ID NO: 319010 - RNA, 64 nt, Human; identical to SEQ ID NO: 115729

SEQ ID NO: 319011 - RNA, 64 nt, Human; identical to SEQ ID NO: 115730

SEQ ID NO: 319012 - RNA, 64 nt, Human; identical to SEQ ID NO: 115731

SEQ ID NO: 319013 - RNA, 63 nt, Human; identical to SEQ ID NO: 316218

SEQ ID NO: 319014 - RNA, 63 nt, Human; identical to SEQ ID NO: 317499

SEQ ID NO: 319015 - RNA, 64 nt, Human; identical to SEQ ID NO: 314535

SEQ ID NO: 319016 - RNA, 64 nt, Human; identical to SEQ ID NO: 115732

SEQ ID NO: 319017 - RNA, 64 nt, Human; identical to SEQ ID NO: 115733

SEQ ID NO: 319018 - RNA, 64 nt, Human; identical to SEQ ID NO: 115734

SEQ ID NO: 319019 - RNA, 64 nt, Human; identical to SEQ ID NO: 115735

SEQ ID NO: 319020 - RNA, 64 nt, Human; identical to SEQ ID NO: 115736

SEQ ID NO: 319021 - RNA, 64 nt, Human; identical to SEQ ID NO: 115737

SEQ ID NO: 319022 - RNA, 64 nt, Human; identical to SEQ ID NO: 115738

SEQ ID NO: 319023 - RNA, 64 nt, Human; identical to SEQ ID NO: 115739

SEQ ID NO: 319024 - RNA, 64 nt, Human; identical to SEQ ID NO: 115740

SEQ ID NO: 319025 - RNA, 64 nt, Human; identical to SEQ ID NO: 115741

SEQ ID NO: 319026 - RNA, 64 nt, Human; identical to SEQ ID NO: 115742

SEQ ID NO: 319027 - RNA, 64 nt, Human; identical to SEQ ID NO: 115743

SEQ ID NO: 319028 - RNA, 64 nt, Human; identical to SEQ ID NO: 115744

SEQ ID NO: 319029 - RNA, 64 nt, Human; identical to SEQ ID NO: 115745

SEQ ID NO: 319030 - RNA, 64 nt, Human; identical to SEQ ID NO: 115746

SEQ ID NO: 319031 - RNA, 64 nt, Human; identical to SEQ ID NO: 115747

SEQ ID NO: 319032 - RNA, 64 nt, Human; identical to SEQ ID NO: 115748

SEQ ID NO: 319033 - RNA, 63 nt, Human; identical to SEQ ID NO: 317802

SEQ ID NO: 319034 - RNA, 63 nt, Human; identical to SEQ ID NO: 317818

SEQ ID NO: 319035 - RNA, 63 nt, Human; identical to SEQ ID NO: 317819

SEQ ID NO: 319036 - RNA, 64 nt, Human; identical to SEQ ID NO: 115749

SEQ ID NO: 319037 - RNA, 64 nt, Human; identical to SEQ ID NO: 115750

SEQ ID NO: 319038 - RNA, 64 nt, Human; identical to SEQ ID NO: 115751

SEQ ID NO: 319039 - RNA, 64 nt, Human; identical to SEQ ID NO: 115752

SEQ ID NO: 319040 - RNA, 64 nt, Human; identical to SEQ ID NO: 115753

SEQ ID NO: 319041 - RNA, 64 nt, Human; identical to SEQ ID NO: 115754

SEQ ID NO: 319042 - RNA, 64 nt, Human; identical to SEQ ID NO: 115755

SEQ ID NO: 319043 - RNA, 64 nt, Human; identical to SEQ ID NO: 115756

SEQ ID NO: 319044 - RNA, 64 nt, Human; identical to SEQ ID NO: 115757

SEQ ID NO: 319045 - RNA, 64 nt, Human; identical to SEQ ID NO: 115758

SEQ ID NO: 319046 - RNA, 64 nt, Human; identical to SEQ ID NO: 115759

SEQ ID NO: 319047 - RNA, 64 nt, Human; identical to SEQ ID NO: 115760

SEQ ID NO: 319048 - RNA, 64 nt, Human; identical to SEQ ID NO: 115761

SEQ ID NO: 319049 - RNA, 64 nt, Human; identical to SEQ ID NO: 115762

SEQ ID NO: 319050 - RNA, 64 nt, Human; identical to SEQ ID NO: 115763

SEQ ID NO: 319051 - RNA, 64 nt, Human; identical to SEQ ID NO: 115764

SEQ ID NO: 319052 - RNA, 64 nt, Human; identical to SEQ ID NO: 115765

SEQ ID NO: 319053 - RNA, 64 nt, Human; identical to SEQ ID NO: 115766

SEQ ID NO: 319054 - RNA, 63 nt, Human; identical to SEQ ID NO: 40881

SEQ ID NO: 319055 - RNA, 63 nt, Human; identical to SEQ ID NO: 317820

SEQ ID NO: 319056 - RNA, 64 nt, Human; identical to SEQ ID NO: 115767

SEQ ID NO: 319057 - RNA, 64 nt, Human; identical to SEQ ID NO: 115768

SEQ ID NO: 319058 - RNA, 64 nt, Human; identical to SEQ ID NO: 115769

SEQ ID NO: 319059 - RNA, 64 nt, Human; identical to SEQ ID NO: 115770

SEQ ID NO: 319060 - RNA, 64 nt, Human; identical to SEQ ID NO: 115771

SEQ ID NO: 319061 - RNA, 64 nt, Human; identical to SEQ ID NO: 115772

SEQ ID NO: 319062 - RNA, 64 nt, Human; identical to SEQ ID NO: 115773

SEQ ID NO: 319063 - RNA, 64 nt, Human; identical to SEQ ID NO: 115774

SEQ ID NO: 319064 - RNA, 64 nt, Human; identical to SEQ ID NO: 115775

SEQ ID NO: 319065 - RNA, 64 nt, Human; identical to SEQ ID NO: 115776

SEQ ID NO: 319066 - RNA, 64 nt, Human; identical to SEQ ID NO: 115777

SEQ ID NO: 319067 - RNA, 64 nt, Human; identical to SEQ ID NO: 115778

SEQ ID NO: 319068 - RNA, 64 nt, Human; identical to SEQ ID NO: 115779

SEQ ID NO: 319069 - RNA, 64 nt, Human; identical to SEQ ID NO: 115780

SEQ ID NO: 319070 - RNA, 64 nt, Human; identical to SEQ ID NO: 115781

SEQ ID NO: 319071 - RNA, 64 nt, Human; identical to SEQ ID NO: 115782

SEQ ID NO: 319072 - RNA, 64 nt, Human; identical to SEQ ID NO: 115783

SEQ ID NO: 319073 - RNA, 63 nt, Human; identical to SEQ ID NO: 317572

SEQ ID NO: 319074 - RNA, 63 nt, Human; identical to SEQ ID NO: 316179

SEQ ID NO: 319075 - RNA, 63 nt, Human; identical to SEQ ID NO: 317836

SEQ ID NO: 319076 - RNA, 64 nt, Human; identical to SEQ ID NO: 115784

SEQ ID NO: 319077 - RNA, 64 nt, Human; identical to SEQ ID NO: 115785

SEQ ID NO: 319078 - RNA, 64 nt, Human; identical to SEQ ID NO: 115786

SEQ ID NO: 319079 - RNA, 64 nt, Human; identical to SEQ ID NO: 115787

SEQ ID NO: 319080 - RNA, 64 nt, Human; identical to SEQ ID NO: 115788

SEQ ID NO: 319081 - RNA, 64 nt, Human; identical to SEQ ID NO: 115789

SEQ ID NO: 319082 - RNA, 64 nt, Human; identical to SEQ ID NO: 115790

SEQ ID NO: 319083 - RNA, 64 nt, Human; identical to SEQ ID NO: 115791

SEQ ID NO: 319084 - RNA, 64 nt, Human; identical to SEQ ID NO: 115792

SEQ ID NO: 319085 - RNA, 64 nt, Human; identical to SEQ ID NO: 115793

SEQ ID NO: 319086 - RNA, 64 nt, Human; identical to SEQ ID NO: 115794

SEQ ID NO: 319087 - RNA, 64 nt, Human; identical to SEQ ID NO: 115795

SEQ ID NO: 319088 - RNA, 64 nt, Human; identical to SEQ ID NO: 115796

SEQ ID NO: 319089 - RNA, 64 nt, Human; identical to SEQ ID NO: 115797

SEQ ID NO: 319090 - RNA, 64 nt, Human; identical to SEQ ID NO: 115798

SEQ ID NO: 319091 - RNA, 64 nt, Human; identical to SEQ ID NO: 115799

SEQ ID NO: 319092 - RNA, 64 nt, Human; identical to SEQ ID NO: 115800

SEQ ID NO: 319093 - RNA, 64 nt, Human; identical to SEQ ID NO: 115801

SEQ ID NO: 319094 - RNA, 63 nt, Human; identical to SEQ ID NO: 317837

SEQ ID NO: 319095 - RNA, 63 nt, Human; identical to SEQ ID NO: 317838

SEQ ID NO: 319096 - RNA, 64 nt, Human; identical to SEQ ID NO: 115802

SEQ ID NO: 319097 - RNA, 64 nt, Human; identical to SEQ ID NO: 115803

SEQ ID NO: 319098 - RNA, 64 nt, Human; identical to SEQ ID NO: 115804

SEQ ID NO: 319099 - RNA, 64 nt, Human; identical to SEQ ID NO: 115805

SEQ ID NO: 319100 - RNA, 64 nt, Human; identical to SEQ ID NO: 115806

SEQ ID NO: 319101 - RNA, 64 nt, Human; identical to SEQ ID NO: 115807

SEQ ID NO: 319102 - RNA, 64 nt, Human; identical to SEQ ID NO: 115808

SEQ ID NO: 319103 - RNA, 64 nt, Human; identical to SEQ ID NO: 115809

SEQ ID NO: 319104 - RNA, 64 nt, Human; identical to SEQ ID NO: 115810

SEQ ID NO: 319105 - RNA, 64 nt, Human; identical to SEQ ID NO: 115811

SEQ ID NO: 319106 - RNA, 64 nt, Human; identical to SEQ ID NO: 115812

SEQ ID NO: 319107 - RNA, 64 nt, Human; identical to SEQ ID NO: 115813

SEQ ID NO: 319108 - RNA, 64 nt, Human; identical to SEQ ID NO: 115814

SEQ ID NO: 319109 - RNA, 64 nt, Human; identical to SEQ ID NO: 115815

SEQ ID NO: 319110 - RNA, 64 nt, Human; identical to SEQ ID NO: 115816

SEQ ID NO: 319111 - RNA, 64 nt, Human; identical to SEQ ID NO: 115817

SEQ ID NO: 319112 - RNA, 50 nt, Human; identical to SEQ ID NO: 115818

SEQ ID NO: 319113 - RNA, 63 nt, Human; identical to SEQ ID NO: 317962

SEQ ID NO: 319114 - RNA, 63 nt, Human; identical to SEQ ID NO: 316196

SEQ ID NO: 319115 - RNA, 63 nt, Human; identical to SEQ ID NO: 317909

SEQ ID NO: 319116 - RNA, 64 nt, Human; identical to SEQ ID NO: 115819

SEQ ID NO: 319117 - RNA, 64 nt, Human; identical to SEQ ID NO: 115820

SEQ ID NO: 319118 - RNA, 64 nt, Human; identical to SEQ ID NO: 115821

SEQ ID NO: 319119 - RNA, 64 nt, Human; identical to SEQ ID NO: 115822

SEQ ID NO: 319120 - RNA, 64 nt, Human; identical to SEQ ID NO: 115823

SEQ ID NO: 319121 - RNA, 64 nt, Human; identical to SEQ ID NO: 115824

SEQ ID NO: 319122 - RNA, 64 nt, Human; identical to SEQ ID NO: 115825

SEQ ID NO: 319123 - RNA, 64 nt, Human; identical to SEQ ID NO: 115826

SEQ ID NO: 319124 - RNA, 64 nt, Human; identical to SEQ ID NO: 115827

SEQ ID NO: 319125 - RNA, 64 nt, Human; identical to SEQ ID NO: 115828

SEQ ID NO: 319126 - RNA, 64 nt, Human; identical to SEQ ID NO: 115829

SEQ ID NO: 319127 - RNA, 64 nt, Human; identical to SEQ ID NO: 115830

SEQ ID NO: 319128 - RNA, 64 nt, Human; identical to SEQ ID NO: 115831

SEQ ID NO: 319129 - RNA, 64 nt, Human; identical to SEQ ID NO: 115832

SEQ ID NO: 319130 - RNA, 64 nt, Human; identical to SEQ ID NO: 115833

SEQ ID NO: 319131 - RNA, 64 nt, Human; identical to SEQ ID NO: 115834

SEQ ID NO: 319132 - RNA, 64 nt, Human; identical to SEQ ID NO: 115835

SEQ ID NO: 319133 - RNA, 63 nt, Human; identical to SEQ ID NO: 317658

SEQ ID NO: 319134 - RNA, 63 nt, Human; identical to SEQ ID NO: 317659

SEQ ID NO: 319135 - RNA, 63 nt, Human; identical to SEQ ID NO: 314984

SEQ ID NO: 319136 - RNA, 64 nt, Human; identical to SEQ ID NO: 115836

SEQ ID NO: 319137 - RNA, 64 nt, Human; identical to SEQ ID NO: 115837

SEQ ID NO: 319138 - RNA, 64 nt, Human; identical to SEQ ID NO: 115838

SEQ ID NO: 319139 - RNA, 64 nt, Human; identical to SEQ ID NO: 115839

SEQ ID NO: 319140 - RNA, 64 nt, Human; identical to SEQ ID NO: 115840

SEQ ID NO: 319141 - RNA, 64 nt, Human; identical to SEQ ID NO: 115841

SEQ ID NO: 319142 - RNA, 64 nt, Human; identical to SEQ ID NO: 115842

SEQ ID NO: 319143 - RNA, 64 nt, Human; identical to SEQ ID NO: 115843

SEQ ID NO: 319144 - RNA, 64 nt, Human; identical to SEQ ID NO: 115844

SEQ ID NO: 319145 - RNA, 64 nt, Human; identical to SEQ ID NO: 115845

SEQ ID NO: 319146 - RNA, 64 nt, Human; identical to SEQ ID NO: 115846

SEQ ID NO: 319147 - RNA, 64 nt, Human; identical to SEQ ID NO: 115847

SEQ ID NO: 319148 - RNA, 64 nt, Human; identical to SEQ ID NO: 115848

SEQ ID NO: 319149 - RNA, 64 nt, Human; identical to SEQ ID NO: 115849

SEQ ID NO: 319150 - RNA, 64 nt, Human; identical to SEQ ID NO: 115850

SEQ ID NO: 319151 - RNA, 64 nt, Human; identical to SEQ ID NO: 115851

SEQ ID NO: 319152 - RNA, 64 nt, Human; identical to SEQ ID NO: 115852

SEQ ID NO: 319153 - RNA, 53 nt, Human; identical to SEQ ID NO: 40860

SEQ ID NO: 319154 - RNA, 63 nt, Human; identical to SEQ ID NO: 316158

SEQ ID NO: 319155 - RNA, 63 nt, Human; identical to SEQ ID NO: 317963

SEQ ID NO: 319156 - RNA, 64 nt, Human; identical to SEQ ID NO: 115853

SEQ ID NO: 319157 - RNA, 64 nt, Human; identical to SEQ ID NO: 115854

SEQ ID NO: 319158 - RNA, 64 nt, Human; identical to SEQ ID NO: 115855

SEQ ID NO: 319159 - RNA, 64 nt, Human; identical to SEQ ID NO: 115856

SEQ ID NO: 319160 - RNA, 64 nt, Human; identical to SEQ ID NO: 115857

SEQ ID NO: 319161 - RNA, 64 nt, Human; identical to SEQ ID NO: 115858

SEQ ID NO: 319162 - RNA, 64 nt, Human; identical to SEQ ID NO: 115859

SEQ ID NO: 319163 - RNA, 64 nt, Human; identical to SEQ ID NO: 115860

SEQ ID NO: 319164 - RNA, 64 nt, Human; identical to SEQ ID NO: 115861

SEQ ID NO: 319165 - RNA, 64 nt, Human; identical to SEQ ID NO: 115862

SEQ ID NO: 319166 - RNA, 64 nt, Human; identical to SEQ ID NO: 115863

SEQ ID NO: 319167 - RNA, 64 nt, Human; identical to SEQ ID NO: 115864

SEQ ID NO: 319168 - RNA, 64 nt, Human; identical to SEQ ID NO: 115865

SEQ ID NO: 319169 - RNA, 64 nt, Human; identical to SEQ ID NO: 115866

SEQ ID NO: 319170 - RNA, 64 nt, Human; identical to SEQ ID NO: 115867

SEQ ID NO: 319171 - RNA, 64 nt, Human; identical to SEQ ID NO: 115868

SEQ ID NO: 319172 - RNA, 64 nt, Human; identical to SEQ ID NO: 115869

SEQ ID NO: 319173 - RNA, 63 nt, Human; identical to SEQ ID NO: 318052

SEQ ID NO: 319174 - RNA, 63 nt, Human; identical to SEQ ID NO: 318053

SEQ ID NO: 319175 - RNA, 63 nt, Human; identical to SEQ ID NO: 317573

SEQ ID NO: 319176 - RNA, 64 nt, Human; identical to SEQ ID NO: 115870

SEQ ID NO: 319177 - RNA, 64 nt, Human; identical to SEQ ID NO: 115871

SEQ ID NO: 319178 - RNA, 64 nt, Human; identical to SEQ ID NO: 115872

SEQ ID NO: 319179 - RNA, 64 nt, Human; identical to SEQ ID NO: 115873

SEQ ID NO: 319180 - RNA, 64 nt, Human; identical to SEQ ID NO: 115874

SEQ ID NO: 319181 - RNA, 64 nt, Human; identical to SEQ ID NO: 115875

SEQ ID NO: 319182 - RNA, 64 nt, Human; identical to SEQ ID NO: 115876

SEQ ID NO: 319183 - RNA, 64 nt, Human; identical to SEQ ID NO: 115877

SEQ ID NO: 319184 - RNA, 64 nt, Human; identical to SEQ ID NO: 115878

SEQ ID NO: 319185 - RNA, 64 nt, Human; identical to SEQ ID NO: 115879

SEQ ID NO: 319186 - RNA, 64 nt, Human; identical to SEQ ID NO: 115880

SEQ ID NO: 319187 - RNA, 64 nt, Human; identical to SEQ ID NO: 115881

SEQ ID NO: 319188 - RNA, 64 nt, Human; identical to SEQ ID NO: 115882

SEQ ID NO: 319189 - RNA, 64 nt, Human; identical to SEQ ID NO: 115883

SEQ ID NO: 319190 - RNA, 64 nt, Human; identical to SEQ ID NO: 115884

SEQ ID NO: 319191 - RNA, 64 nt, Human; identical to SEQ ID NO: 115885

SEQ ID NO: 319192 - RNA, 64 nt, Human; identical to SEQ ID NO: 115886

SEQ ID NO: 319193 - RNA, 63 nt, Human; identical to SEQ ID NO: 317429

SEQ ID NO: 319194 - RNA, 63 nt, Human; identical to SEQ ID NO: 317446

SEQ ID NO: 319195 - RNA, 63 nt, Human; identical to SEQ ID NO: 317447

SEQ ID NO: 319196 - RNA, 64 nt, Human; identical to SEQ ID NO: 115887

SEQ ID NO: 319197 - RNA, 64 nt, Human; identical to SEQ ID NO: 115888

SEQ ID NO: 319198 - RNA, 64 nt, Human; identical to SEQ ID NO: 115889

SEQ ID NO: 319199 - RNA, 64 nt, Human; identical to SEQ ID NO: 115890

SEQ ID NO: 319200 - RNA, 64 nt, Human; identical to SEQ ID NO: 115891

SEQ ID NO: 319201 - RNA, 64 nt, Human; identical to SEQ ID NO: 115892

SEQ ID NO: 319202 - RNA, 64 nt, Human; identical to SEQ ID NO: 115893

SEQ ID NO: 319203 - RNA, 64 nt, Human; identical to SEQ ID NO: 115894

SEQ ID NO: 319204 - RNA, 64 nt, Human; identical to SEQ ID NO: 115895

SEQ ID NO: 319205 - RNA, 64 nt, Human; identical to SEQ ID NO: 115896

SEQ ID NO: 319206 - RNA, 64 nt, Human; identical to SEQ ID NO: 115897

SEQ ID NO: 319207 - RNA, 64 nt, Human; identical to SEQ ID NO: 115898

SEQ ID NO: 319208 - RNA, 64 nt, Human; identical to SEQ ID NO: 115899

SEQ ID NO: 319209 - RNA, 64 nt, Human; identical to SEQ ID NO: 115900

SEQ ID NO: 319210 - RNA, 64 nt, Human; identical to SEQ ID NO: 115901

SEQ ID NO: 319211 - RNA, 64 nt, Human; identical to SEQ ID NO: 115902

SEQ ID NO: 319212 - RNA, 64 nt, Human; identical to SEQ ID NO: 115903

SEQ ID NO: 319213 - RNA, 64 nt, Human; identical to SEQ ID NO: 314538

SEQ ID NO: 319214 - RNA, 64 nt, Human; identical to SEQ ID NO: 314539

SEQ ID NO: 319215 - RNA, 64 nt, Human; identical to SEQ ID NO: 314540

SEQ ID NO: 319216 - RNA, 64 nt, Human; identical to SEQ ID NO: 115904

SEQ ID NO: 319217 - RNA, 64 nt, Human; identical to SEQ ID NO: 115905

SEQ ID NO: 319218 - RNA, 64 nt, Human; identical to SEQ ID NO: 115906

SEQ ID NO: 319219 - RNA, 64 nt, Human; identical to SEQ ID NO: 115907

SEQ ID NO: 319220 - RNA, 64 nt, Human; identical to SEQ ID NO: 115908

SEQ ID NO: 319221 - RNA, 64 nt, Human; identical to SEQ ID NO: 115909

SEQ ID NO: 319222 - RNA, 64 nt, Human; identical to SEQ ID NO: 115910

SEQ ID NO: 319223 - RNA, 64 nt, Human; identical to SEQ ID NO: 115911

SEQ ID NO: 319224 - RNA, 64 nt, Human; identical to SEQ ID NO: 115912

SEQ ID NO: 319225 - RNA, 64 nt, Human; identical to SEQ ID NO: 115913

SEQ ID NO: 319226 - RNA, 64 nt, Human; identical to SEQ ID NO: 115914

SEQ ID NO: 319227 - RNA, 64 nt, Human; identical to SEQ ID NO: 115915

SEQ ID NO: 319228 - RNA, 63 nt, Human; identical to SEQ ID NO: 317464

SEQ ID NO: 319229 - RNA, 63 nt, Human; identical to SEQ ID NO: 317465

SEQ ID NO: 319230 - RNA, 63 nt, Human; identical to SEQ ID NO: 317481

SEQ ID NO: 319231 - RNA, 64 nt, Human; identical to SEQ ID NO: 205597

SEQ ID NO: 319232 - RNA, 64 nt, Human; identical to SEQ ID NO: 205598

SEQ ID NO: 319233 - RNA, 64 nt, Human; identical to SEQ ID NO: 205599

SEQ ID NO: 319234 - RNA, 64 nt, Human; identical to SEQ ID NO: 205600

SEQ ID NO: 319235 - RNA, 64 nt, Human; identical to SEQ ID NO: 205601

SEQ ID NO: 319236 - RNA, 64 nt, Human; identical to SEQ ID NO: 205602

SEQ ID NO: 319237 - RNA, 64 nt, Human; identical to SEQ ID NO: 205603

SEQ ID NO: 319238 - RNA, 64 nt, Human; identical to SEQ ID NO: 205604

SEQ ID NO: 319239 - RNA, 64 nt, Human; identical to SEQ ID NO: 205605

SEQ ID NO: 319240 - RNA, 64 nt, Human; identical to SEQ ID NO: 205606

SEQ ID NO: 319241 - RNA, 64 nt, Human; identical to SEQ ID NO: 205607

SEQ ID NO: 319242 - RNA, 64 nt, Human; identical to SEQ ID NO: 205608

SEQ ID NO: 319243 - RNA, 64 nt, Human; identical to SEQ ID NO: 205609

SEQ ID NO: 319244 - RNA, 64 nt, Human; identical to SEQ ID NO: 205610

SEQ ID NO: 319245 - RNA, 64 nt, Human; identical to SEQ ID NO: 205611

SEQ ID NO: 319246 - RNA, 64 nt, Human; identical to SEQ ID NO: 205612

SEQ ID NO: 319247 - RNA, 63 nt, Human; identical to SEQ ID NO: 317482

SEQ ID NO: 319248 - RNA, 63 nt, Human; identical to SEQ ID NO: 316217

SEQ ID NO: 319249 - RNA, 63 nt, Human; identical to SEQ ID NO: 317535

SEQ ID NO: 319250 - RNA, 63 nt, Human; identical to SEQ ID NO: 317536

SEQ ID NO: 319251 - RNA, 64 nt, Human; identical to SEQ ID NO: 205613

SEQ ID NO: 319252 - RNA, 64 nt, Human; identical to SEQ ID NO: 205614

SEQ ID NO: 319253 - RNA, 64 nt, Human; identical to SEQ ID NO: 205349

SEQ ID NO: 319254 - RNA, 64 nt, Human; identical to SEQ ID NO: 204010

SEQ ID NO: 319255 - RNA, 64 nt, Human; identical to SEQ ID NO: 205550

SEQ ID NO: 319256 - RNA, 64 nt, Human; identical to SEQ ID NO: 205551

SEQ ID NO: 319257 - RNA, 64 nt, Human; identical to SEQ ID NO: 205329

SEQ ID NO: 319258 - RNA, 64 nt, Human; identical to SEQ ID NO: 204083

SEQ ID NO: 319259 - RNA, 64 nt, Human; identical to SEQ ID NO: 205594

SEQ ID NO: 319260 - RNA, 64 nt, Human; identical to SEQ ID NO: 205595

SEQ ID NO: 319261 - RNA, 64 nt, Human; identical to SEQ ID NO: 205596

SEQ ID NO: 319262 - RNA, 64 nt, Human; identical to SEQ ID NO: 205309

SEQ ID NO: 319263 - RNA, 64 nt, Human; identical to SEQ ID NO: 204084

SEQ ID NO: 319264 - RNA, 64 nt, Human; identical to SEQ ID NO: 205129

SEQ ID NO: 319265 - RNA, 64 nt, Human; identical to SEQ ID NO: 205130

SEQ ID NO: 319266 - RNA, 64 nt, Human; identical to SEQ ID NO: 205131

SEQ ID NO: 319267 - RNA, 63 nt, Human; identical to SEQ ID NO: 318034

SEQ ID NO: 319268 - RNA, 63 nt, Human; identical to SEQ ID NO: 318035

SEQ ID NO: 319269 - RNA, 63 nt, Human; identical to SEQ ID NO: 318403

SEQ ID NO: 319270 - RNA, 63 nt, Human; identical to SEQ ID NO: 316136

SEQ ID NO: 319271 - RNA, 64 nt, Human; identical to SEQ ID NO: 205310

SEQ ID NO: 319272 - RNA, 64 nt, Human; identical to SEQ ID NO: 204158

SEQ ID NO: 319273 - RNA, 64 nt, Human; identical to SEQ ID NO: 205169

SEQ ID NO: 319274 - RNA, 64 nt, Human; identical to SEQ ID NO: 205170

SEQ ID NO: 319275 - RNA, 64 nt, Human; identical to SEQ ID NO: 205171

SEQ ID NO: 319276 - RNA, 64 nt, Human; identical to SEQ ID NO: 205350

SEQ ID NO: 319277 - RNA, 64 nt, Human; identical to SEQ ID NO: 204159

SEQ ID NO: 319278 - RNA, 64 nt, Human; identical to SEQ ID NO: 205189

SEQ ID NO: 319279 - RNA, 64 nt, Human; identical to SEQ ID NO: 205190

SEQ ID NO: 319280 - RNA, 64 nt, Human; identical to SEQ ID NO: 205191

SEQ ID NO: 319281 - RNA, 64 nt, Human; identical to SEQ ID NO: 205529

SEQ ID NO: 319282 - RNA, 64 nt, Human; identical to SEQ ID NO: 204160

SEQ ID NO: 319283 - RNA, 52 nt, Human; identical to SEQ ID NO: 205209

SEQ ID NO: 319284 - RNA, 64 nt, Human; identical to SEQ ID NO: 205210

SEQ ID NO: 319285 - RNA, 64 nt, Human; identical to SEQ ID NO: 205211

SEQ ID NO: 319286 - RNA, 64 nt, Human; identical to SEQ ID NO: 205108

SEQ ID NO: 319287 - RNA, 63 nt, Human; identical to SEQ ID NO: 317607

SEQ ID NO: 319288 - RNA, 63 nt, Human; identical to SEQ ID NO: 317608

SEQ ID NO: 319289 - RNA, 63 nt, Human; identical to SEQ ID NO: 317501

SEQ ID NO: 319290 - RNA, 63 nt, Human; identical to SEQ ID NO: 317625

SEQ ID NO: 319291 - RNA, 64 nt, Human; identical to SEQ ID NO: 205615

SEQ ID NO: 319292 - RNA, 64 nt, Human; identical to SEQ ID NO: 205616

SEQ ID NO: 319293 - RNA, 64 nt, Human; identical to SEQ ID NO: 205617

SEQ ID NO: 319294 - RNA, 64 nt, Human; identical to SEQ ID NO: 205618

SEQ ID NO: 319295 - RNA, 64 nt, Human; identical to SEQ ID NO: 205619

SEQ ID NO: 319296 - RNA, 64 nt, Human; identical to SEQ ID NO: 205620

SEQ ID NO: 319297 - RNA, 64 nt, Human; identical to SEQ ID NO: 205621

SEQ ID NO: 319298 - RNA, 64 nt, Human; identical to SEQ ID NO: 205622

SEQ ID NO: 319299 - RNA, 53 nt, Human; identical to SEQ ID NO: 205623

SEQ ID NO: 319300 - RNA, 64 nt, Human; identical to SEQ ID NO: 205624

SEQ ID NO: 319301 - RNA, 64 nt, Human; identical to SEQ ID NO: 205625

SEQ ID NO: 319302 - RNA, 64 nt, Human; identical to SEQ ID NO: 205626

SEQ ID NO: 319303 - RNA, 64 nt, Human; identical to SEQ ID NO: 205627

SEQ ID NO: 319304 - RNA, 64 nt, Human; identical to SEQ ID NO: 205628

SEQ ID NO: 319305 - RNA, 64 nt, Human; identical to SEQ ID NO: 205629

SEQ ID NO: 319306 - RNA, 64 nt, Human; identical to SEQ ID NO: 205630

SEQ ID NO: 319307 - RNA, 63 nt, Human; identical to SEQ ID NO: 318384

SEQ ID NO: 319308 - RNA, 63 nt, Human; identical to SEQ ID NO: 316137

SEQ ID NO: 319309 - RNA, 63 nt, Human; identical to SEQ ID NO: 318385

SEQ ID NO: 319310 - RNA, 63 nt, Human; identical to SEQ ID NO: 317871

SEQ ID NO: 319311 - RNA, 64 nt, Human; identical to SEQ ID NO: 205631

SEQ ID NO: 319312 - RNA, 64 nt, Human; identical to SEQ ID NO: 205632

SEQ ID NO: 319313 - RNA, 64 nt, Human; identical to SEQ ID NO: 205633

SEQ ID NO: 319314 - RNA, 64 nt, Human; identical to SEQ ID NO: 205634

SEQ ID NO: 319315 - RNA, 64 nt, Human; identical to SEQ ID NO: 204848

SEQ ID NO: 319316 - RNA, 64 nt, Human; identical to SEQ ID NO: 205249

SEQ ID NO: 319317 - RNA, 64 nt, Human; identical to SEQ ID NO: 205250

SEQ ID NO: 319318 - RNA, 64 nt, Human; identical to SEQ ID NO: 205251

SEQ ID NO: 319319 - RNA, 64 nt, Human; identical to SEQ ID NO: 205330

SEQ ID NO: 319320 - RNA, 64 nt, Human; identical to SEQ ID NO: 204867

SEQ ID NO: 319321 - RNA, 64 nt, Human; identical to SEQ ID NO: 205311

SEQ ID NO: 319322 - RNA, 64 nt, Human; identical to SEQ ID NO: 205072

SEQ ID NO: 319323 - RNA, 64 nt, Human; identical to SEQ ID NO: 204884

SEQ ID NO: 319324 - RNA, 64 nt, Human; identical to SEQ ID NO: 205351

SEQ ID NO: 319325 - RNA, 64 nt, Human; identical to SEQ ID NO: 205530

SEQ ID NO: 319326 - RNA, 64 nt, Human; identical to SEQ ID NO: 204885

SEQ ID NO: 319327 - RNA, 63 nt, Human; identical to SEQ ID NO: 317889

SEQ ID NO: 319328 - RNA, 63 nt, Human; identical to SEQ ID NO: 317890

SEQ ID NO: 319329 - RNA, 63 nt, Human; identical to SEQ ID NO: 318226

SEQ ID NO: 319330 - RNA, 63 nt, Human; identical to SEQ ID NO: 318227

SEQ ID NO: 319331 - RNA, 64 nt, Human; identical to SEQ ID NO: 205389

SEQ ID NO: 319332 - RNA, 64 nt, Human; identical to SEQ ID NO: 205390

SEQ ID NO: 319333 - RNA, 64 nt, Human; identical to SEQ ID NO: 205391

SEQ ID NO: 319334 - RNA, 64 nt, Human; identical to SEQ ID NO: 205271

SEQ ID NO: 319335 - RNA, 64 nt, Human; identical to SEQ ID NO: 204886

SEQ ID NO: 319336 - RNA, 64 nt, Human; identical to SEQ ID NO: 205531

SEQ ID NO: 319337 - RNA, 64 nt, Human; identical to SEQ ID NO: 205570

SEQ ID NO: 319338 - RNA, 64 nt, Human; identical to SEQ ID NO: 204903

SEQ ID NO: 319339 - RNA, 64 nt, Human; identical to SEQ ID NO: 204904

SEQ ID NO: 319340 - RNA, 64 nt, Human; identical to SEQ ID NO: 204905

SEQ ID NO: 319341 - RNA, 64 nt, Human; identical to SEQ ID NO: 205571

SEQ ID NO: 319342 - RNA, 64 nt, Human; identical to SEQ ID NO: 205149

SEQ ID NO: 319343 - RNA, 64 nt, Human; identical to SEQ ID NO: 205150

SEQ ID NO: 319344 - RNA, 64 nt, Human; identical to SEQ ID NO: 205151

SEQ ID NO: 319345 - RNA, 64 nt, Human; identical to SEQ ID NO: 205229

SEQ ID NO: 319346 - RNA, 64 nt, Human; identical to SEQ ID NO: 205230

SEQ ID NO: 319347 - RNA, 63 nt, Human; identical to SEQ ID NO: 318684

SEQ ID NO: 319348 - RNA, 61 nt, Human; identical to SEQ ID NO: 318685

SEQ ID NO: 319349 - RNA, 63 nt, Human; identical to SEQ ID NO: 317872

SEQ ID NO: 319350 - RNA, 63 nt, Human; identical to SEQ ID NO: 316138

SEQ ID NO: 319351 - RNA, 64 nt, Human; identical to SEQ ID NO: 205231

SEQ ID NO: 319352 - RNA, 64 nt, Human; identical to SEQ ID NO: 205331

SEQ ID NO: 319353 - RNA, 64 nt, Human
gacuccugaagccccgcugcugagaugggcgcucccgacacagcgcagacccaccaggaggaaa

SEQ ID NO: 319354 - RNA, 64 nt, Human
aaagagaacaaggagcuugccaggcuucauguagccgacacacgucucaggauuuuaaguccac

SEQ ID NO: 319355 - RNA, 64 nt, Human
cgggcuggccuaacagcucaggugcuccuaaacuccgacacagaguuccugcuuuggguggaug

SEQ ID NO: 319356 - RNA, 64 nt, Human
ugaauuucaugaaggggaacuauaguuauuucuaccgacacaaauauuauaauuagcaauuuga

SEQ ID NO: 319357 - RNA, 64 nt, Human
ggcuaaacaaccugacaaacuguggccaggggaaccgacacaacccucaagcauuucuauguau

SEQ ID NO: 319358 - RNA, 64 nt, Human
acauuaacacuguaccaagcuuugcagaucuuuuccgacacacaugucugaagacuuauuuuca

SEQ ID NO: 319359 - RNA, 64 nt, Human
aggaaacuauaugggaugaacacuuuuaaacuuuccgacacaacuuccauuacuaacuuucuaa

SEQ ID NO: 319360 - RNA, 64 nt, Human
uugaguccaaggcagauccucucucccagggaauccgacacaggaggaaccccuucucugguug

SEQ ID NO: 319361 - RNA, 64 nt, Human
uggacuugggggccacagugacugaguuugauucccgacacagccuccuccuugcuguguaguu

SEQ ID NO: 319362 - RNA, 64 nt, Human
cuucauaccuagaccuguuccgcacaccacggcuccgacacaucucacugugcugcgugguggu

SEQ ID NO: 319363 - RNA, 63 nt, Human; identical to SEQ ID NO: 317782

SEQ ID NO: 319364 - RNA, 63 nt, Human; identical to SEQ ID NO: 317783

SEQ ID NO: 319365 - RNA, 63 nt, Human; identical to SEQ ID NO: 316139

SEQ ID NO: 319366 - RNA, 64 nt, Human
agggcggagagccauacccuggccccagcgcgccccgacacacaugcuuuucuccaugacacga

SEQ ID NO: 319367 - RNA, 64 nt, Human
acuaccuaaccuuucugagccuccuauaccucauccgacacaaauggggaugauaccuaccucc

SEQ ID NO: 319368 - RNA, 64 nt, Human
uauggucuugauccuccaaugucuaauuuucuuuccgacacauuuaccaaauugcuugagccug

SEQ ID NO: 319369 - RNA, 64 nt, Human
cccuuucccagcugcacucgcccuguggacagccccgacacaccacuuuccugaggcugucgcu

SEQ ID NO: 319370 - RNA, 64 nt, Human
gucuuccuccagcaguuacuugaugcccccucccccgacacagacucucaaucugccgguggua

SEQ ID NO: 319371 - RNA, 64 nt, Human
uuuuuucuagugaaguuaaacaaacauugggauaccgacacagacaacuugagacaguuuuuuu

SEQ ID NO: 319372 - RNA, 64 nt, Human
ugugcucacugaaagggcugucaaccccagaaggccgacacaaaaaaaaugguaugugaagaug

SEQ ID NO: 319373 - RNA, 64 nt, Human
cuggcccggucagcggcucuggccauacagccuuccgacacacucccuccuccuuaucugcggg

SEQ ID NO: 319374 - RNA, 64 nt, Human
ccaacccuuggcccaggacggcuuugaauauggcccgacacaaauucguaaacuuuuuaaaaaa

SEQ ID NO: 319375 - RNA, 64 nt, Human
gcucucccaggggccagguggagagcagugccccccgacacauguauucucaucugugguccag

SEQ ID NO: 319376 - RNA, 64 nt, Human
ucugagacagagcaaacacccaccccagaacaagccgacacacagggagacgggggccuggagc

SEQ ID NO: 319377 - RNA, 64 nt, Human
agcagcuccacuaauggaggagaggcaguagccuccgacacagaacgcauggaccuccuacuac

SEQ ID NO: 319378 - RNA, 64 nt, Human
cagucacccaccuaugugccagagucaggccuggccgacacaaggaucuaugcuuuuucugugg

SEQ ID NO: 319379 - RNA, 64 nt, Human
guggcggcugcacaacagcccugccugagaagccccgacacacggggcucgggccuuuaaaacg

SEQ ID NO: 319380 - RNA, 63 nt, Human; identical to SEQ ID NO: 316117

SEQ ID NO: 319381 - RNA, 63 nt, Human; identical to SEQ ID NO: 317997

SEQ ID NO: 319382 - RNA, 63 nt, Human; identical to SEQ ID NO: 318686

SEQ ID NO: 319383 - RNA, 64 nt, Human
cauuuguucacuuuuuaaacuaaaauaggaacauccgacacacaccguuugcaucgucuucucc

SEQ ID NO: 319384 - RNA, 64 nt, Human
cugggaagaccgugaacuuaaggagucugauucuccgacacaggcugguggaccaccuacccca

SEQ ID NO: 319385 - RNA, 64 nt, Human
cuugaucagcgucccaguuucacagccaggcaaaccgacacagggcuuggaagggauuugccaa

SEQ ID NO: 319386 - RNA, 64 nt, Human
cagagccagccagcuuugaagacgcggcccugccccgacacaggcagccuggagaagcugggca

SEQ ID NO: 319387 - RNA, 64 nt, Human
ccaugggcuuuacccuucccugcgggcucucuccccgacacauuuguuaaaaucaaaccugaau

SEQ ID NO: 319388 - RNA, 64 nt, Human
cacacaaacacacacacacuggacaguagaugggccgacacacacuuggcccgaguuccuccau

SEQ ID NO: 319389 - RNA, 64 nt, Human
cuagccuaggugagacacugcagccaggcaaccaccgacacacgccccuucucaaagccagagg

SEQ ID NO: 319390 - RNA, 64 nt, Human
agcucagcggcucucuccgagagcaccacccuccccgacacacagguucaugcggccccagggg

SEQ ID NO: 319391 - RNA, 64 nt, Human
guugcuggagaacccugagggcagggcccgagccccgacacaucccuucccccaaaaagcaaca

SEQ ID NO: 319392 - RNA, 64 nt, Human
gaaagcgggcagcaggccccgauaccgggaagagccgacacagccacgaaccagacaagcagac

SEQ ID NO: 319393 - RNA, 64 nt, Human
uccucgaauucucagacgacaccuggagacugucccgacacagcgacgcuccccugagagguuu

SEQ ID NO: 319394 - RNA, 64 nt, Human
guuugcggaggaugcagggauaugcucacagcgcccgacacaacccccucccgccgcccccaac

SEQ ID NO: 319395 - RNA, 64 nt, Human
ccuggaacaacccugccccugcacccagcaugcuccgacacagcagggaagcuccuccuguggc

SEQ ID NO: 319396 - RNA, 64 nt, Human
cuggucccuacucaacaaaauaugaugauggcucccgacacaagcgccagggccagggcuuagc

SEQ ID NO: 319397 - RNA, 63 nt, Human; identical to SEQ ID NO: 317730

SEQ ID NO: 319398 - RNA, 63 nt, Human; identical to SEQ ID NO: 316156

SEQ ID NO: 319399 - RNA, 63 nt, Human; identical to SEQ ID NO: 318873

SEQ ID NO: 319400 - RNA, 64 nt, Human
gaacagggcacgcggugggcuggugguuucauagccgacacacagcgccuaccaugugcagcug

SEQ ID NO: 319401 - RNA, 64 nt, Human
accaaagaaccaaagugacuccacaauugggaugccgacacaccuugcuaggaacugacaacaa

SEQ ID NO: 319402 - RNA, 64 nt, Human
augcucaugccaguuaaugccaggaaaaaaaucaccgacacacuacuaguacuuuguuccuguu

SEQ ID NO: 319403 - RNA, 64 nt, Human
gacaucuuggaacucaaucuucuguuggaucacgggaaaucaagacacccaggaggaauugaaa

SEQ ID NO: 319404 - RNA, 64 nt, Human
aguagaaaaaugucacguuuccauaucuccugcuggaaaucagaaaauauaauaaaauugcaca

SEQ ID NO: 319405 - RNA, 64 nt, Human
ucaaaauuuaugaaaaacaaaaugcuguaugaauggaaaucauuuugcaauugagugacacuuc

SEQ ID NO: 319406 - RNA, 64 nt, Human
gcuuguggguauauuggauagcucagaaaaucugggaaaucaaaguggcucaauagcugugagg

SEQ ID NO: 319407 - RNA, 64 nt, Human
ucuggagccucugggcagaacccuccaucagaguggaaaucagacgggacccccugcagcuucc

SEQ ID NO: 319408 - RNA, 64 nt, Human
ccccucaggcccccaugggggcagggaucggcuuggaaaucaacgugguuguccccgccaggcc

SEQ ID NO: 319409 - RNA, 64 nt, Human
uugcuucccagcuagaccugugugagaggugucuggaaaucaugcaugguguauuugggacuau

SEQ ID NO: 319410 - RNA, 64 nt, Human
aucagaaauaauaaccuguuagggauguauucuaggaaaucagaaguaguucucuuuucuugcu

SEQ ID NO: 319411 - RNA, 64 nt, Human
uccagucuucuggaaugucuucacugcagcugcuggaaaucacugcuuucauucccacaaaacc

SEQ ID NO: 319412 - RNA, 64 nt, Human
aggcacacgaugcucugggacauaacuggugccuggaaaucaccaugguccucauaucucccau

SEQ ID NO: 319413 - RNA, 64 nt, Human
uuuuuuccuuacaaugugaacucaucgugaucuuggaaaucaauaaagucaaauaucaacuaaa

SEQ ID NO: 319414 - RNA, 64 nt, Human
gaguaauaaguuuuauauccuucauucugggagaggaaaucaacauaagguguugacuaauuga

SEQ ID NO: 319415 - RNA, 63 nt, Human; identical to SEQ ID NO: 317712

SEQ ID NO: 319416 - RNA, 63 nt, Human; identical to SEQ ID NO: 317713

SEQ ID NO: 319417 - RNA, 63 nt, Human; identical to SEQ ID NO: 316177

SEQ ID NO: 319418 - RNA, 63 nt, Human; identical to SEQ ID NO: 317800

SEQ ID NO: 319419 - RNA, 64 nt, Human
gccucugaucaguuucacaaaguuuguucccuaaggaaaucaaaucccauugucaccuaacucu

SEQ ID NO: 319420 - RNA, 64 nt, Human
uuaauccugugcaaaggaaaagaggugcuuugugggaaaucacuaaugagaaggcuaaccugca

SEQ ID NO: 319421 - RNA, 64 nt, Human
ucauugaccauuuaaaaagucuccugcuaaguauggaaaucagacaguaagagaaagccaaaaa

SEQ ID NO: 319422 - RNA, 64 nt, Human
uaaaaguugggcacuaaucuggauuaacauucgaggaaaucaguugagcugaauuuaaguuguu

SEQ ID NO: 319423 - RNA, 64 nt, Human
uuguaucucugcaguguggauugaacagaaaauuggaaaucauagucaaagggcuucccuuggu

SEQ ID NO: 319424 - RNA, 64 nt, Human
guguccccagggacuucuaaagcuuggggcuccaggaaaucauccaguagaguuggagauucag

SEQ ID NO: 319425 - RNA, 64 nt, Human
auugugaugguuagaaacuucguggauaguuuguggaaaucauccaauuaaacauacugcuuaa

SEQ ID NO: 319426 - RNA, 64 nt, Human
cucagaaccccauggguuccagaccaagaguacaggaaaucaaauuguuguccugucugucuau

SEQ ID NO: 319427 - RNA, 64 nt, Human
ugcugccuaggaaacuauaaacccuugguuaaggggaaaucauggcuuguucucuuuguacagu

SEQ ID NO: 319428 - RNA, 64 nt, Human
acguaaucuaccauuuccuacacuauuugagcauggaaaucauaguccccacucugugaaaacu

SEQ ID NO: 319429 - RNA, 64 nt, Human
aauucagggaagggcaaggagccuuccucauucaggaaaucaaaucagucuuccggucugcagc

SEQ ID NO: 319430 - RNA, 64 nt, Human
acagcacagcucauggagggugagaucauguuagggaaaucaauuuuuaucuagucauuuguuc

SEQ ID NO: 319431 - RNA, 64 nt, Human
auuuccagugacaaugcaagguaaguauaucaaaggaaaucaacaguugugcuugggggcuuuu

SEQ ID NO: 319432 - RNA, 64 nt, Human
ucuuuaguuguagcuaaauguuagauccaccgugggaaaucauucccuuuaaaaugacagcaca

SEQ ID NO: 319433 - RNA, 64 nt, Human
aguggugcucaaugcaaauaguagacauuuguguggaaaucauaccaguuguucauugauggga

SEQ ID NO: 319434 - RNA, 64 nt, Human
gagucugauuuuuaggaaggaauaggaggagcagggaaaucagaaaaacuguuggucucacucu

SEQ ID NO: 319435 - RNA, 52 nt, Human; identical to SEQ ID NO: 40857

SEQ ID NO: 319436 - RNA, 50 nt, Human; identical to SEQ ID NO: 40858

SEQ ID NO: 319437 - RNA, 60 nt, Human; identical to SEQ ID NO: 40859

SEQ ID NO: 319438 - RNA, 64 nt, Human
ucuuccuagaacauuagccguaguggaauuaacaggaaaucaugagggugacguagaauugagu

SEQ ID NO: 319439 - RNA, 64 nt, Human
aggaggcucaguuagaccucagaagggaacuccuggaaaucaccggcuuuccccuccacuugcu

SEQ ID NO: 319440 - RNA, 64 nt, Human
cacauauuuaagcaaacaucacauuuggagaagaggaaaucauaaaaucauccuagaagacuau

SEQ ID NO: 319441 - RNA, 64 nt, Human
ugucuaguaaauaggaucauuuauugggcaguugggaaaucagcucucuguccuguugaguguu

SEQ ID NO: 319442 - RNA, 64 nt, Human
auucagcauaugggaaguaacauugcacuaauauggaaaucacugccagagacagucuauuuuc

SEQ ID NO: 319443 - RNA, 64 nt, Human
cacaugaggauguauaaguacagauuuuaaaaaaggaaaucaacuuacacuuccuggcucuugu

SEQ ID NO: 319444 - RNA, 64 nt, Human
gcaacgcugccuuucaccuccgcuggcucaccugggaaaucacgcagacccaguacauccugga

SEQ ID NO: 319445 - RNA, 64 nt, Human
uuacuguuucuuaccuuaaaaaguaauuguagauggaaaucaguuguguuuggcaggagaauca

SEQ ID NO: 319446 - RNA, 64 nt, Human
ucacuagagacagcccaaagacaaauauugggcaggaaaucaguucucacugagcccgguuucc

SEQ ID NO: 319447 - RNA, 64 nt, Human
gguuugcaguugggaaagaggucaacugagauuuggaaaucaucuuuguaauauuugcaaauua

SEQ ID NO: 319448 - RNA, 64 nt, Human
uuugauagagcagagauaaaauauuuugauggaaggaaaucaauuuucuguaacugaugaugug

SEQ ID NO: 319449 - RNA, 64 nt, Human
aagcugaguaaacaggcccuuccuagaguguccuggaaaucacagcaacccauugaaaacugcc

SEQ ID NO: 319450 - RNA, 64 nt, Human
aaacgugaagaauuaugaucucuggagaaggacaggaaaucaccccauuugaaaaacaguuuuu

SEQ ID NO: 319451 - RNA, 64 nt, Human
gaggauauucacugaagcucauaguuauaaacaaggaaaucacuguuaagaaugggaauuuguc

SEQ ID NO: 319452 - RNA, 64 nt, Human
agagaagccauggagaacagacuugaaaaguuuaggaaaucauaauguggcagaggugguggga

SEQ ID NO: 319453 - RNA, 64 nt, Human
auccacagacauuuuaguugcagaagaaaggcuaggaaaucauuccuuuugguuaaaugggugu

SEQ ID NO: 319454 - RNA, 63 nt, Human; identical to SEQ ID NO: 316116

SEQ ID NO: 319455 - RNA, 63 nt, Human; identical to SEQ ID NO: 317981

SEQ ID NO: 319456 - RNA, 64 nt, Human; identical to SEQ ID NO: 314541

SEQ ID NO: 319457 - RNA, 64 nt, Human
ccggcuggcaggagggggcucugacgugcagguuggaaaucagaagucugugagagcgcgggag

SEQ ID NO: 319458 - RNA, 64 nt, Human
accuggcuucucaguucuuugguuggaaggagcaggaaaucagcuccuauucuccaguggagag

SEQ ID NO: 319459 - RNA, 64 nt, Human
uuuaguaucuguuuaauuuuucaguccaaagagaggaaaucagucgcugaguauuauuugacuc

SEQ ID NO: 319460 - RNA, 64 nt, Human
uaggaagaguagcacuuuccgccuaagcacuuuaggaaaucaccuuucuaagcccuggggcgcc

SEQ ID NO: 319461 - RNA, 64 nt, Human
agccacccacuugccauuugcuccuguccuuccaggaaaucacaauuuucaucagagcccaaga

SEQ ID NO: 319462 - RNA, 64 nt, Human
ggugcccucagaaccucagccagaaaggcaaggaggaaaucagagcaggagccucauacucuug

SEQ ID NO: 319463 - RNA, 64 nt, Human
ggaagauuuucauaaagucauauuucaugucaaaggaaaucagcagugauagaugaaggguucg

SEQ ID NO: 319464 - RNA, 64 nt, Human
uuuguuuucguuuuucaucuuuugaagagcaaagggaaaucaagaggagacccccaggcagagg

SEQ ID NO: 319465 - RNA, 64 nt, Human
uguguuacaauaucaguuuccagaauaaagugagggaaaucaggucuuuauugauaaaguuagg

SEQ ID NO: 319466 - RNA, 64 nt, Human
caguuuucugagaaagacuauucaaacagucucaggaaaucaaauaugcaaagcacugacuucu

SEQ ID NO: 319467 - RNA, 64 nt, Human
caacaguuuuagauacucauuagugacuucaaagggaaaucaaggaaagaccaguuuccauuua

SEQ ID NO: 319468 - RNA, 64 nt, Human
ccuuuuaucucucuucuccaauauuaaaaaaaauggaaaucaaauuauuaugcugaagggaaaa

SEQ ID NO: 319469 - RNA, 64 nt, Human
agcacuauuggaauuauuucccgcuguugccaauggaaaucaaagaaaauggaugugacgucug

SEQ ID NO: 319470 - RNA, 64 nt, Human
ugcaggaacugaugugugcauauuuagcaucccuggaaaucauaauaaaguuuccauuagaaca

SEQ ID NO: 319471 - RNA, 64 nt, Human
agcucugucucccuaacucaacugcuuugcaaggggaaaucaagcugggagaaucuuuuucugg

SEQ ID NO: 319472 - RNA, 64 nt, Human
ugcccaauuucacagaguacaaaauaguuguaggggaaaucaaggugaaggaucuguccgacag

SEQ ID NO: 319473 - RNA, 63 nt, Human; identical to SEQ ID NO: 317695

SEQ ID NO: 319474 - RNA, 63 nt, Human; identical to SEQ ID NO: 317696

SEQ ID NO: 319475 - RNA, 63 nt, Human; identical to SEQ ID NO: 317731

SEQ ID NO: 319476 - RNA, 64 nt, Human
aauaauauucuuuucuuauuucuaagccuuucugggaaaucauuucaguccacaccaaccauau

SEQ ID NO: 319477 - RNA, 64 nt, Human
ccauggauggagcccuugggcucucugggaaaugggaaaucagccaaaggacugagaaggaguu

SEQ ID NO: 319478 - RNA, 64 nt, Human
aauaguacaaguuauuaucaaggauguuuuacagggaaaucaaaagaauauuaucauacuuuau

SEQ ID NO: 319479 - RNA, 64 nt, Human
aauuaggcuuuauuaucuuccuaaaucaaggaaaggaaaucauccccagaccauuuaugcugag

SEQ ID NO: 319480 - RNA, 64 nt, Human
cagggccuuauuuggaagagcgggcaaagaggauggaaaucauaaaauauuucaugggaaucga

SEQ ID NO: 319481 - RNA, 64 nt, Human
acaaauacuucacugccugaugauaauggugcuuggaaaucaagcaaacagcgcacaucaacuu

SEQ ID NO: 319482 - RNA, 64 nt, Human
ucacacuggacucagauaccuucuucaguguguuggaaaucacuggcuucacacaggcccaacu

SEQ ID NO: 319483 - RNA, 64 nt, Human
gagccuagagacagaaaugacagaucucugcuuuggaaaucacacgucuggcuucacagaugug

SEQ ID NO: 319484 - RNA, 64 nt, Human
cauugggaaauaauuaauagauauuuuucuggggggaaaucacaagucacugagguguuuguuu

SEQ ID NO: 319485 - RNA, 64 nt, Human
cuugauuugagauuuuuaugccugugacuuccuuggaaaucaaauguaaaguuuaauugaaaga

SEQ ID NO: 319486 - RNA, 64 nt, Human
auagcacagacuugaaggaguuuaaaaggaggcuggaaaucaauacugcacacugcacauuugc

SEQ ID NO: 319487 - RNA, 64 nt, Human
uuuacuuuuauauuuuugcuugaaucuuaacucuggaaaucaccugauguagaagaagacugug

SEQ ID NO: 319488 - RNA, 64 nt, Human
cuacaaaaggagacaguugagacuuuugcuuguuggaaaucaaacuucuuauuugucuaaauug

SEQ ID NO: 319489 - RNA, 64 nt, Human
uucagacacucucugcccagacucauuuuuaacuggaaaucaucacagcagugggauaucagag

SEQ ID NO: 319490 - RNA, 64 nt, Human
gcaagaccauggggacuucaagagccuguggucaggaaaucagguccagccuucccuguagcca

SEQ ID NO: 319491 - RNA, 64 nt, Human
uccuuuauauucguacugcacuuuguuuuuccaaggaaaucagugucuuuuacguuguuaugau

SEQ ID NO: 319492 - RNA, 63 nt, Human; identical to SEQ ID NO: 318785

SEQ ID NO: 319493 - RNA, 63 nt, Human; identical to SEQ ID NO: 318801

SEQ ID NO: 319494 - RNA, 63 nt, Human; identical to SEQ ID NO: 317925

SEQ ID NO: 319495 - RNA, 64 nt, Human
aguccagcccugauguggagacacaugggauuuuggaaaucagcuucuggaggaaugcauguca

SEQ ID NO: 319496 - RNA, 64 nt, Human
ggggaaggacaaaagcagggaacagauaagugauggaaaucagaagggaauauagaaagaacuc

SEQ ID NO: 319497 - RNA, 64 nt, Human
uggaauaauaccuaacaggcaggcucuggaaguuggaaaucacauacacacacacacacacaca

SEQ ID NO: 319498 - RNA, 64 nt, Human
uaucugguuuaauguuguauuuauaauuuaaaguggaaaucagaaacuguuucaagaaccugua

SEQ ID NO: 319499 - RNA, 64 nt, Human
ccuaaagacacugucaugaacuguguugaaugguggaaaucaguauuucuguuugugguguugu

SEQ ID NO: 319500 - RNA, 64 nt, Human
ccuuaagauacuagugcagcuagauuucauuuagggaaaucaccaguaacuugacugaccaauu

SEQ ID NO: 319501 - RNA, 64 nt, Human
uugaugcaugggagguuggcaauauagacaaaguggaaaucauuaguaugugagggccuugauu

SEQ ID NO: 319502 - RNA, 64 nt, Human
uguauuuccuauaaugaugucugauauuuaaauaggaaaucagacaaacaauauucagaaaguu

SEQ ID NO: 319503 - RNA, 64 nt, Human
uucuauuuauugaugagacuuccguagauaauguggaaaucaaauuuaaccaagaaaaaaagau

SEQ ID NO: 319504 - RNA, 64 nt, Human
aaaaaagaaaaaaaaaucaaaauguauaaauauuggaaaucaaguuuuucagcuguuuuguugg

SEQ ID NO: 319505 - RNA, 64 nt, Human
aacccacaucugcgagaucagcguuaugcuaagaggaaaucacugaggccauaucuuuuuacaa

SEQ ID NO: 319506 - RNA, 64 nt, Human
aacuuauuuauaaaucaaagauuuguuaauuuuuggaaaucaugcuuuucaaagcauccuaacu

SEQ ID NO: 319507 - RNA, 64 nt, Human
aaaaugugcauguuuagaaacaaaauuucuucauggaaaucauauacauuagaaaaucacaguc

SEQ ID NO: 319508 - RNA, 64 nt, Human
aaugauuauuguacuacaguauuuucagaauaugggaaaucaauuaaaaauguaaucuaaucua

SEQ ID NO: 319509 - RNA, 64 nt, Human
uuuaaaaauuuagcuucuagauuccauuugguaaggaaaucaauauuggaaguauugcuaaaau

SEQ ID NO: 319510 - RNA, 64 nt, Human
gugauuaaagugaucaaaaugccaaaauacuaaaggaaaucaauuguucacagguaacuacaau

SEQ ID NO: 319511 - RNA, 64 nt, Human
uuuguuuucuuuuuaucauuguaucaaacuauauggaaaucauaugguuagaugugauuauuug

SEQ ID NO: 319512 - RNA, 64 nt, Human
agcuuguuagccugcagauuccuuuucauuuggaggaaaucacaaguggccgaaaaaaaaaauu

SEQ ID NO: 319513 - RNA, 64 nt, Human
uaaaccuuaacaagacuacaaguauauuccagaaggaaaucauuuuaguuaugaacuaaauaau

SEQ ID NO: 319514 - RNA, 64 nt, Human
gcgcauauuuucgauauuuuugugaauuccaaaaggaaaucacagggcuguucgaaauauuggg

SEQ ID NO: 319515 - RNA, 64 nt, Human
aaucuucauauucucuguagccuuugucaagugaggaaaucagugguuaaagaauuccacuaua

SEQ ID NO: 319516 - RNA, 64 nt, Human
accaugagaauuuuacuuccauuauacaucaauuggaaaucaauccuguuaagagauaauucuu

SEQ ID NO: 319517 - RNA, 64 nt, Human
guucacuaagcacccacccugugaaaaguauuauggaaaucacugcugcacaggaaaaguaauu

SEQ ID NO: 319518 - RNA, 64 nt, Human
gauuucuccuuugagaaauuuuaguaugguuugaggaaaucaagugauaaaggaguaugcugaa

SEQ ID NO: 319519 - RNA, 64 nt, Human
gucaauauauauuuaaaauaauaauggaaacauaggaaaucagcuauuuaaaccagaucacccu

SEQ ID NO: 319520 - RNA, 64 nt, Human
aagaagcagaagcaaguuucgaagucacagucaaggaaaucaauaccuaccaauuuaaccuaaa

SEQ ID NO: 319521 - RNA, 64 nt, Human
ugccuaguuaaguggaaauguguuuggagauaggggaaaucacauaacugguacaaguaugggg

SEQ ID NO: 319522 - RNA, 64 nt, Human
cuguaaccaaccugccacccacugauucagaaauggaaaucacauuccacaaucuauggcuucc

SEQ ID NO: 319523 - RNA, 64 nt, Human
gucccaugugcaucuuauuuaaaauuucccccauggaaaucacucuccuguugacuauuuccag

SEQ ID NO: 319524 - RNA, 64 nt, Human
auuuuagaaagcuaaaugaaucgcaaguuaacuuggaaaucaguagaaagcuaaagugauccua

SEQ ID NO: 319525 - RNA, 64 nt, Human
caaauacaaucuaacuuuuacccaaucuacagcaggaaaucaaaggaguggguggaaugagaga

SEQ ID NO: 319526 - RNA, 64 nt, Human
cucugugcugaaacggauggaauucauggcuuauggaaaucaaaucccuuuugaaggacucaga

SEQ ID NO: 319527 - RNA, 64 nt, Human
aaaaucuuggauuaugaagugacucucacaagauggaaaucacauuuacaaaauuacacaguua

SEQ ID NO: 319528 - RNA, 64 nt, Human
aguggccccuauugagaaguuuuccgguagaguuggaaaucaguugugaauacauucuuugcua

SEQ ID NO: 319529 - RNA, 64 nt, Human
auuccagcagucugaaaccuaaauauguuauauuggaaaucaugacugugagacuuuauugucc

SEQ ID NO: 319530 - RNA, 64 nt, Human
auugacauaucuaaaaccaaacugaaaucgcuuuggaaaucagauuuuuuaauguuaggaagau

SEQ ID NO: 319531 - RNA, 64 nt, Human
gagccaacaagacuuacugcaucuugggggauggggaaaucacucacuuuauuuuggaaauuuu

SEQ ID NO: 319532 - RNA, 64 nt, Human
caauacaagcuugugauuuaugcuuacucuaaguggaaaucaggauuguuaugaagacuuaagg

SEQ ID NO: 319533 - RNA, 64 nt, Human
aaaugcuugcuuggacuugcccaucuagcacuuuggaaaucaguauuuaaaugccaaauaaucu

SEQ ID NO: 319534 - RNA, 64 nt, Human
cagguaugggaaacagcucucagauuuauaaauuggaaaucaccagguuacuugccaauauaua

SEQ ID NO: 319535 - RNA, 64 nt, Human
ugguguuagggggaugagcaugcuguuuaugaacggaaaucaugauuucccuuguagaaaguga

SEQ ID NO: 319536 - RNA, 64 nt, Human
accuuucucuaugucaaguuuugugucagacaugggaaaucauguauuuguucaauugacuacu

SEQ ID NO: 319537 - RNA, 64 nt, Human
gaagggugggggugggccugguugccccauguuaggaaaucacuaccagucagguggggcuggg

SEQ ID NO: 319538 - RNA, 64 nt, Human
ccagaagggaaaagggcacccuggauuacucuuuggaaaucacuccuuggugggcagcauccug

SEQ ID NO: 319539 - RNA, 64 nt, Human
uuguuaguaaaucauuagguaacaucuugugguaggaaaucauuagguaacaucaauccuaacu

SEQ ID NO: 319540 - RNA, 64 nt, Human
agcccucuuacaucuaaaagaucucugguuggauggaaaucaacugucagaauuaccucaggua

SEQ ID NO: 319541 - RNA, 64 nt, Human
aacauuaaugaaagcccuauaaaauagaaagauuggaaaucaccauuguuuccuauuauccaca

SEQ ID NO: 319542 - RNA, 64 nt, Human
cuauagucauugauggaguagaucaugauggaggggaaaucacuggagaucaaauauguaaaau

SEQ ID NO: 319543 - RNA, 63 nt, Human; identical to SEQ ID NO: 316078

SEQ ID NO: 319544 - RNA, 63 nt, Human; identical to SEQ ID NO: 318783

SEQ ID NO: 319545 - RNA, 58 nt, Human; identical to SEQ ID NO: 40789

SEQ ID NO: 319546 - RNA, 64 nt, Human
uaaaauugcugggcacugaaaaggggugggaguuggaaaucagaaagaaagagaaauauuucau

SEQ ID NO: 319547 - RNA, 64 nt, Human
agaaugccaaaccacauuuuuaucacacuucuuuggaaaucaaugccuuugcauagaaaaucaa

SEQ ID NO: 319548 - RNA, 64 nt, Human
agguaugggugaaauuggaaauuacuaaucuauuggaaaucaguuccugacauaguaaaguuug

SEQ ID NO: 319549 - RNA, 64 nt, Human
uuuuguuucuuucuugucuugucuuuuauugaaaggaaaucaaaaauaggcuaaacagaauuuu

SEQ ID NO: 319550 - RNA, 64 nt, Human
guuuuggggaauaagaaucguccacauucccacaggaaaucauugcuauggucuccccuaggaa

SEQ ID NO: 319551 - RNA, 64 nt, Human
uccagccuuggcaaaaucaccuucccuuuaccagggaaaucacuuccuuuaggacugaaagcua

SEQ ID NO: 319552 - RNA, 64 nt, Human
uuucugauaugagggcagcaccugccucugaaugggaaaucaugcaacuacucagaaugugucc

SEQ ID NO: 319553 - RNA, 64 nt, Human
aaugccugcaaacuauaugcaaaaaugaguaugaggaaaucaaauguaaaucauaugcaaauau

SEQ ID NO: 319554 - RNA, 64 nt, Human
gcacuuggugagaaugggaagcauccauucauugggaaaucacggggacagaggaggaauucac

SEQ ID NO: 319555 - RNA, 64 nt, Human
caaaguguagacaucuguaggaacuaaauaucaaggaaaucaagacauuuauuuucaaagcgag

SEQ ID NO: 319556 - RNA, 64 nt, Human
ugaagauugaaauauccaaagguuuaaacaagauggaaaucaaugaaaaagaggccuuguuuau

SEQ ID NO: 319557 - RNA, 64 nt, Human
ggaauuauguggucagugcauuguuuuuuaaacuggaaaucauuuuguuuuaaaaguuaauaau

SEQ ID NO: 319558 - RNA, 64 nt, Human
gcuuuugugcuuaggcaagugcaaaauacucuauggaaaucauaauugucaucuucuucauggu

SEQ ID NO: 319559 - RNA, 64 nt, Human
aguaacagcucuaagauggucaugcagugagauaggaaaucaagauggaagcagagaaucuggc

SEQ ID NO: 319560 - RNA, 64 nt, Human
aauucaaagagccaucucugaugggagagggugaggaaaucagcugaaugguuggccugcauau

SEQ ID NO: 319561 - RNA, 64 nt, Human
agaaaggaaaaauacauuucuaugcuugaauucuggaaaucaucagaaauauugacacuugagg

SEQ ID NO: 319562 - RNA, 63 nt, Human; identical to SEQ ID NO: 317748

SEQ ID NO: 319563 - RNA, 63 nt, Human; identical to SEQ ID NO: 317749

SEQ ID NO: 319564 - RNA, 63 nt, Human; identical to SEQ ID NO: 317765

SEQ ID NO: 319565 - RNA, 64 nt, Human
agugagcagucaggaaagagaacuuccagauccuggaaaucaggguuaguauuguccaggucua

SEQ ID NO: 319566 - RNA, 64 nt, Human
gccaccagggagucccgaagcccuucugagaucaggaaaucaggucccaagguuaggagacgcc

SEQ ID NO: 319567 - RNA, 64 nt, Human
ugucaccauggauuggaacuguuuugcauaucagggaaaucauagccaaggggaaaucuaucag

SEQ ID NO: 319568 - RNA, 64 nt, Human
auaauucagagcauacgucauuggaagacuuccuggaaaucaguguaaaucuugcaacauagcu

SEQ ID NO: 319569 - RNA, 64 nt, Human
caauaggcuuuaggaaaaaaagacugcaaccaacggaaaucaauaggaguugaagagauuaaac

SEQ ID NO: 319570 - RNA, 64 nt, Human
uguuguauuucauauuuauuuauauaauacaaauggaaaucaaaacugaaauagccucccuuua

SEQ ID NO: 319571 - RNA, 64 nt, Human
ucagugaauauuaccuuauguaaauuaaaaauuaggaaaucaaaagaaaagcauacauauaaaa

SEQ ID NO: 319572 - RNA, 64 nt, Human
uucaucuuauuuagcacuggagcaaauagccaagggaaaucaaaucaguaacuggucaugguca

SEQ ID NO: 319573 - RNA, 64 nt, Human
gaagaaaauguuuucucuccugcguauguuaagaggaaaucaguuuaaaaugccugcuaaucaa

SEQ ID NO: 319574 - RNA, 64 nt, Human
agcacauaguaaaaagggaacaucagggucaaauggaaaucaccugagacaggaaacagggagu

SEQ ID NO: 319575 - RNA, 64 nt, Human
gguugcauuuucaucacugaaagucagaggccaaggaaaucauuucuacuucuuuaaaaacucc

SEQ ID NO: 319576 - RNA, 64 nt, Human
aucgguggcauauacugcacauacugaaauagagggaaaucacugaauguaaagagguuucauc

SEQ ID NO: 319577 - RNA, 64 nt, Human
aacuuccugcacacacuggcagagaggggcgcugggaaaucaccccacaggguggaggucuccu

SEQ ID NO: 319578 - RNA, 64 nt, Human
agcgcaaguuaggaaaaugagcuuuuguuuucauggaaaucauucugauuacagugcugauguu

SEQ ID NO: 319579 - RNA, 64 nt, Human
uaaauguauaauuauuuuuauaaauuuuauuguuggaaaucaaaaauuaguagauuuuuuacca

SEQ ID NO: 319580 - RNA, 64 nt, Human
agacagaagacaugaggaaaaacaaaagguuugaggaaaucaggcauaugacuuuauacuuaac

SEQ ID NO: 319581 - RNA, 63 nt, Human; identical to SEQ ID NO: 316079

SEQ ID NO: 319582 - RNA, 63 nt, Human; identical to SEQ ID NO: 318803

SEQ ID NO: 319583 - RNA, 63 nt, Human; identical to SEQ ID NO: 318401

SEQ ID NO: 319584 - RNA, 64 nt, Human
acacucuaggaugacaugauguuauaauuuuaggggaaaucacauuuuuaccuuaugcuguuac

SEQ ID NO: 319585 - RNA, 64 nt, Human
guccccaaacuuauggacacugccuuagccucuuggaaaucagguagaccauauucuaaguuag

SEQ ID NO: 319586 - RNA, 64 nt, Human
aaucuuucuugugcauuuucaauacuuguaaacuggaaaucagaaaauauuuacuaugaacagg

SEQ ID NO: 319587 - RNA, 64 nt, Human
ucuuucgauaaaggaagacacacgaugcuaauccggaaaucagcaaacuuugcauuacucccua

SEQ ID NO: 319588 - RNA, 64 nt, Human
ucuucauugaaguggcuuuuuaucauuuaaugauggaaaucaauugcuuccauugacaaaacug

SEQ ID NO: 319589 - RNA, 64 nt, Human
aguaaauguauacuuaguguuuucuuacaaucguggaaaucagaaauguuuauacaggugucag

SEQ ID NO: 319590 - RNA, 64 nt, Human
ggguuuugggauuugggugugggguaaguugaagggaaaucaauuuaaaggaaaguucuauuau

SEQ ID NO: 319591 - RNA, 64 nt, Human
acccaugugucugucacaccaugaauguaccuggggaaaucaacugaccucccugaacauuuca

SEQ ID NO: 319592 - RNA, 64 nt, Human
cgggaggcugaggcaggacgauuacuugagcuugggaaaucaagguugcagugagcuaugauug

SEQ ID NO: 319593 - RNA, 64 nt, Human
aguauuuuccaaaagauauuugaaauccuaaugaggaaaucagaaaaagcuauggaaaaauaga

SEQ ID NO: 319594 - RNA, 64 nt, Human
aauugccuaauugcugcaaaguauaacccagauaggaaaucauauguuuuuuuccaagagucau

SEQ ID NO: 319595 - RNA, 64 nt, Human
gagcucucucagugugaacaugccuucugugggcggaaaucaggaagccaccagcuguuaaugg

SEQ ID NO: 319596 - RNA, 64 nt, Human
gugcuuaauuuacucuguuguaaagggauaaaguggaaaucauuuuuuuccguggaguggugau

SEQ ID NO: 319597 - RNA, 64 nt, Human
auaaaugugaaccuaagaaaacuccaccucugaaggaaaucauuugaauuuuguuuuuguacgu

SEQ ID NO: 319598 - RNA, 64 nt, Human
uuuuuuuuaaacgagaacaagaauaugaagaacuggaaaucauuaagaaaggguuucccuuccu

SEQ ID NO: 319599 - RNA, 64 nt, Human
guauuguuacgaacauggauaugacaaccaaacuggaaaucagaacacuaggguaaaguggaua

SEQ ID NO: 319600 - RNA, 63 nt, Human; identical to SEQ ID NO: 318939

SEQ ID NO: 319601 - RNA, 63 nt, Human; identical to SEQ ID NO: 318940

SEQ ID NO: 319602 - RNA, 63 nt, Human; identical to SEQ ID NO: 318224

SEQ ID NO: 319603 - RNA, 64 nt, Human
agggaauggggagaagaaagacccccauugguuuggaaaucaaggagagggcggugacauauug

SEQ ID NO: 319604 - RNA, 64 nt, Human
accuucacccauuucaugaaaauaaaaucaaaagggaaaucaaaaauaaagaaaacgcuaaaga

SEQ ID NO: 319605 - RNA, 64 nt, Human
ugugcauucuaugcuuugcucaacaggaaagagaggaaaucaaauacaaauuauuuauaugcau

SEQ ID NO: 319606 - RNA, 64 nt, Human
uuuuuaagaaauauaauaaagcacuuagggcaggggaaaucaucucgguaaucauggaaccuaa

SEQ ID NO: 319607 - RNA, 64 nt, Human
cuuaugaaauauaugguuuucaucuguaauugaaggaaaucauagaaaguuugcugaaagcaaa

SEQ ID NO: 319608 - RNA, 64 nt, Human
cuugcuuggacaguuccucugugucacugacacaggaaaucauuucuaggacacagugaucagg

SEQ ID NO: 319609 - RNA, 64 nt, Human
aggaaagggaaguuuuauuuggaaccuucuaagaggaaaucaaccaggaccaaagagccuuaaa

SEQ ID NO: 319610 - RNA, 64 nt, Human
ccaauggcagggcaccucaguuguguauauguggggaaaucaaaugcuaccugacucacaucug

SEQ ID NO: 319611 - RNA, 64 nt, Human
augggaaaaauaaggauaacucagaauuucaaaaggaaaucacaaauucagcuaauaauagcau

SEQ ID NO: 319612 - RNA, 64 nt, Human
auuuuaauuuagcaugagccaauuuacagagcauggaaaucacuuucauuuccggauuggcgcg

SEQ ID NO: 319613 - RNA, 64 nt, Human
cuaaggaaacaaguacacuccacacaugcauaaaggaaaucaaauguuauuuuuaagaaaaugg

SEQ ID NO: 319614 - RNA, 64 nt, Human
caaccuaccuguugagcaucacagaaugugauaaggaaaucaacuugcuuaucaacuuccuaaa

SEQ ID NO: 319615 - RNA, 64 nt, Human
agaguugauaaauuagauugaaaccauuccaguaggaaaucaggcaguucccuguugaaaguug

SEQ ID NO: 319616 - RNA, 64 nt, Human
gcaacccagagauaguggaaacugaaauuaggaaggaaaucaucaauaacucagugggcugacc

SEQ ID NO: 319617 - RNA, 64 nt, Human
guuuauuuugcuauugugaaaaacuaaauguaaaggaaaucaccuacuuucaugcagguguaua

SEQ ID NO: 319618 - RNA, 64 nt, Human
augguagaaauuaagacguuucuuugcaaaacaaggaaaucacacauaugcacacauacauauu

SEQ ID NO: 319619 - RNA, 63 nt, Human; identical to SEQ ID NO: 318070

SEQ ID NO: 319620 - RNA, 63 nt, Human; identical to SEQ ID NO: 318071

SEQ ID NO: 319621 - RNA, 63 nt, Human; identical to SEQ ID NO: 316098

SEQ ID NO: 319622 - RNA, 64 nt, Human
uacaggcuuuauuuaaaucugaacaauccuacagggaaaucagaauuaggaaaaaaaucuggag

SEQ ID NO: 319623 - RNA, 64 nt, Human
caguauguguuuuagauugauuucccuguuucagggaaaucacggacaguaguuucaguucuga

SEQ ID NO: 319624 - RNA, 64 nt, Human
ugguggagcuggaguugcaccgcggcagcuccauggaaaucaaucugggggagaaggacacugc

SEQ ID NO: 319625 - RNA, 64 nt, Human
aggccaaggccaaaauugggcuaguccuggccagggaaaucagaagcucuucuugggugagauu

SEQ ID NO: 319626 - RNA, 64 nt, Human
ugagguuuauacuauuucugguuuuuaaccaaaaggaaaucaucuggaagcaggaggcaaaaag

SEQ ID NO: 319627 - RNA, 64 nt, Human
gaucucagaaucaggccuauuuguguaggcccauggaaaucacuacuugugaaguagagaugcc

SEQ ID NO: 319628 - RNA, 64 nt, Human
auacucaagacuuuguaucugugcagcauuuuauggaaaucacuggugaccuauaggauauuac

SEQ ID NO: 319629 - RNA, 64 nt, Human
agagaaagaagaaagaccuagaagguuguagaugggaaaucaggaaugauuugaacugauaaag

SEQ ID NO: 319630 - RNA, 64 nt, Human
agucuccuuucgaaugugaagaaguaaauuuagaggaaaucaaacaagcaucacuuuccucagu

SEQ ID NO: 319631 - RNA, 64 nt, Human
acauauugcuacaaggcaaaucaagaagacaucaggaaaucagaugcacaggaaauaaaggaaa

SEQ ID NO: 319632 - RNA, 64 nt, Human
auacagucaagauacauaguaaaugguaucauuuggaaaucagcaucgugggcacugcugagga

SEQ ID NO: 319633 - RNA, 64 nt, Human
ccucauucaacacagggcuggagguucuacaacaggaaaucaggccuacagcauccuguguauc

SEQ ID NO: 319634 - RNA, 64 nt, Human
acagccaccaguaggcuuggcagugggcugcaguggaaaucaacucaagauguacacgaagguu

SEQ ID NO: 319635 - RNA, 64 nt, Human
guuucuuucaugcuccuuacccugccccagcuggggaaaucaaaagggccaaagaaccaaagaa

SEQ ID NO: 319636 - RNA, 64 nt, Human
acauguagguagagaagaaagauaauuuuaaaaaggaaaucaggucuuuugcaacugugccucc

SEQ ID NO: 319637 - RNA, 64 nt, Human
ucccuuacccuccuccagaccauucaggacacagggaaaucaggguuacaaaucuucuugaucc

SEQ ID NO: 319638 - RNA, 63 nt, Human; identical to SEQ ID NO: 318402

SEQ ID NO: 319639 - RNA, 63 nt, Human; identical to SEQ ID NO: 316096

SEQ ID NO: 319640 - RNA, 63 nt, Human; identical to SEQ ID NO: 316159

SEQ ID NO: 319641 - RNA, 64 nt, Human
cauuuaaccuauaugacucuaauuuuuuuucugaggaaaucauuugguuuuugaguuguuuuuu

SEQ ID NO: 319642 - RNA, 64 nt, Human
auccuauuauuaauucguaugcuuagucaaccuaggaaaucaaaauaauguuuugaaguucuua

SEQ ID NO: 319643 - RNA, 64 nt, Human
uuuaucuagauaaguuuguuuacuuaugcccuccggaaaucaugcaagacugcucccugcaaag

SEQ ID NO: 319644 - RNA, 64 nt, Human
uuacagucuuguauuuacaagcuaaauauauauaggaaaucacaaauaaaucccuuuuaaguuu

SEQ ID NO: 319645 - RNA, 64 nt, Human
uauucaugaugacucuauuuggaaugauauucagggaaaucacaauaauauagcaguaguuaua

SEQ ID NO: 319646 - RNA, 64 nt, Human
ccuuuuguuuucauaauauaaugcaguuuguucaggaaaucagcacaaagccugauaguacuuu

SEQ ID NO: 319647 - RNA, 64 nt, Human
acuggacagaugggguguugucaaacaucuucagggaaaucaacaagccaacagacaagaagga

SEQ ID NO: 319648 - RNA, 64 nt, Human
ugaggcugagccccuaccccaacccaagcucugcggaaaucaacagccccagagccacuuggag

SEQ ID NO: 319649 - RNA, 64 nt, Human
gucauuagagauacucugaagcauaguuaguuuaggaaaucacuucauauugauuguauuagaa

SEQ ID NO: 319650 - RNA, 64 nt, Human
cuggaauuguacauggauaucuuuaucccuagggggaaaucaaggagcugggcaccccuaauuc

SEQ ID NO: 319651 - RNA, 64 nt, Human
uucaaacaauaauuuuugaaacaaaaaagaggaaggaaaucaguggcagaaauaauccugcugu

SEQ ID NO: 319652 - RNA, 64 nt, Human
uauaagagaacucgacuggcuaucaggaagagauggaaaucagaaaaucccaucacuccagcag

SEQ ID NO: 319653 - RNA, 64 nt, Human
uaugaaaaucuaacacucaagauaguuucuaaaaggaaaucaguaguuaaggauaccugauuuc

SEQ ID NO: 319654 - RNA, 64 nt, Human
ucaaaugaugugcaaaaccuuuuacugguugcauggaaaucagccaaguuuuauaauccuuaaa

SEQ ID NO: 319655 - RNA, 64 nt, Human
uugauuaacuucuuuaaguacaugugauaacuauggaaaucaagauuaugugacugaaaaacau

SEQ ID NO: 319656 - RNA, 64 nt, Human
caaagauguaaaauaugccagaugugugugaguuggaaaucaaaaaaagaaaaauaaaauaugc

SEQ ID NO: 319657 - RNA, 63 nt, Human; identical to SEQ ID NO: 317766

SEQ ID NO: 319658 - RNA, 63 nt, Human; identical to SEQ ID NO: 316176

SEQ ID NO: 319659 - RNA, 63 nt, Human; identical to SEQ ID NO: 317891

SEQ ID NO: 319660 - RNA, 61 nt, Human
cagcaaaguggauuccauaacucuggcacaaggaaaucaagaugaaaagcacucauuaagg

SEQ ID NO: 319661 - RNA, 64 nt, Human
uucaggaugugaaaugaacagugauuuauaaaauggaaaucaaauuguacauuagcagaguucu

SEQ ID NO: 319662 - RNA, 64 nt, Human
cuauugguauaacccgcccaccugaaggggaaagggaaaucaaauuaauuuuucucguuagaca

SEQ ID NO: 319663 - RNA, 64 nt, Human
uguagaaaauaaugaauuaaugagauuggugaaaggaaaucaugcaaaacauuugaaugcaaag

SEQ ID NO: 319664 - RNA, 64 nt, Human
uaaauuucaccucccgacuucagcauagaucacaggaaaucacauggcacacgguuaaacacgu

SEQ ID NO: 319665 - RNA, 64 nt, Human
aacaucccaagaagaggauaaggaugcuuaaaauggaaaucauucuccaacgauauacaaauug

SEQ ID NO: 319666 - RNA, 64 nt, Human
aaauggaccuauaucaagaggcagacugaagcuuggaaaucauuaugaauauuuguaaauuaca

SEQ ID NO: 319667 - RNA, 64 nt, Human
cacuagugcuaguagauauuacuacccuccugagggaaaucagaaaugauuuaaccccggugga

SEQ ID NO: 319668 - RNA, 64 nt, Human
uuuaccacauguaacagauuccuuuauauguaguggaaaucacuauuuguagaaacugucaggu

SEQ ID NO: 319669 - RNA, 64 nt, Human
ccuuuaauauaagggagaaauacaugguuuuuguggaaaucauuauauguuugcuuuagauuuu

SEQ ID NO: 319670 - RNA, 64 nt, Human
guacaguugggaaccauacacuucuggcauguuuggaaaucaaaaugucacauucucgggggag

SEQ ID NO: 319671 - RNA, 64 nt, Human
aaaaguuuguguuuuacugucuuagaucguucuuggaaaucacuaaaaaaaaaaaaaguuaauu

SEQ ID NO: 319672 - RNA, 64 nt, Human
uacaaauccccagcucaugaacgugaagcugauaggaaaucaccccagggaacccgaaaaagaa

SEQ ID NO: 319673 - RNA, 64 nt, Human
cuuguacagauauuaguguuaccagcauucauguggaaaucaagagcaaagacaaaauaauguu

SEQ ID NO: 319674 - RNA, 64 nt, Human
gccugccuugaagaaaagaagaccagggccaaagggaaaucagucaagggagccuguuuugucu

SEQ ID NO: 319675 - RNA, 64 nt, Human
acuaaguugaguuauacuucuugguucacauuuuggaaaucagagauuacagauuacauggcca

SEQ ID NO: 319676 - RNA, 63 nt, Human; identical to SEQ ID NO: 317927

SEQ ID NO: 319677 - RNA, 63 nt, Human; identical to SEQ ID NO: 317943

SEQ ID NO: 319678 - RNA, 63 nt, Human; identical to SEQ ID NO: 317944

SEQ ID NO: 319679 - RNA, 64 nt, Human
uggugaaggcuaucuggggcaggcacaaauugguggaaaucacaucuuaaugucaagcucauua

SEQ ID NO: 319680 - RNA, 64 nt, Human
aaaauucuucauuugugcaaaauuugaacaaagaggaaaucaucuucauaguaaugaaacuuug

SEQ ID NO: 319681 - RNA, 64 nt, Human
gccuuuuggauaugcugaacgcagaagaaaggguggaaaucaacccucuccugucugcccucug

SEQ ID NO: 319682 - RNA, 64 nt, Human
auuucuugaccuuuacccacuuacgcaaggagaaggaaaucauaaugaugucaugugaucaaag

SEQ ID NO: 319683 - RNA, 64 nt, Human
uuuuaaauuagagcucuguuuaauuauaccacugggaaaucaugguuacgcuucaggcauauuc

SEQ ID NO: 319684 - RNA, 64 nt, Human
acucagggcaguguguuggaaauuccacugagggggaaaucaggugcugcggccgccugggccc

SEQ ID NO: 319685 - RNA, 64 nt, Human
guucucagaagagucacaguuuggggugagaucuggaaaucaagaaauggguguccacucuuuu

SEQ ID NO: 319686 - RNA, 64 nt, Human
gauaaauugcacaccuuggaauucgcuuucuaaaggaaaucaaaugaauggaggaacuuuccaa

SEQ ID NO: 319687 - RNA, 64 nt, Human
ccaacauuaauacucaggaccccaagauacagaaggaaaucaugcgugugaucggaacucaggu

SEQ ID NO: 319688 - RNA, 64 nt, Human
gagacccaccugcauguuguuuuggcucauauuuggaaaucaagaaacagauggacaaguugga

SEQ ID NO: 319689 - RNA, 64 nt, Human
uuggaggaugccuguggccuugugauaaaaugugggaaaucacagaaaacaccagaaacaacaa

SEQ ID NO: 319690 - RNA, 64 nt, Human
cccugagaccaaagaagaggggccaaguacccugggaaaucagcugaaggucaacaaaagacug

SEQ ID NO: 319691 - RNA, 64 nt, Human
gacuuguagucacugggcuuuuguuuugcuuuauggaaaucauugaaggucuggaucccuuucu

SEQ ID NO: 319692 - RNA, 64 nt, Human
gucagcuucauaccauuuuuaaagucaauacgauggaaaucaauaaaucugaauuccgaacaug

SEQ ID NO: 319693 - RNA, 64 nt, Human
auuaaaauaaauuugccaacuaguaaugcauacuggaaaucaaaagauacugaaagaaugguga

SEQ ID NO: 319694 - RNA, 64 nt, Human
ucaugccuguauucuccaggaaacuuguccuucuggaaaucauauugaaugauauuucuauauc

SEQ ID NO: 319695 - RNA, 63 nt, Human; identical to SEQ ID NO: 316099

SEQ ID NO: 319696 - RNA, 63 nt, Human; identical to SEQ ID NO: 317945

SEQ ID NO: 319697 - RNA, 63 nt, Human; identical to SEQ ID NO: 317980

SEQ ID NO: 319698 - RNA, 64 nt, Human
ggaggcacggugcggagagcgucgcauaugcgcgggaaaucaagaacuaugauauuuuucuguu

SEQ ID NO: 319699 - RNA, 64 nt, Human
agagcagucuagggacaccacugcccugucuuuaggaaaucacaacacagagaagcaaaaaggg

SEQ ID NO: 319700 - RNA, 64 nt, Human
ugucuugaagaaguuggcuuucuuuacaugggaaggaaaucaugccaaaaaaauccaaaacaaa

SEQ ID NO: 319701 - RNA, 64 nt, Human
cauggcagucgugcuuuagccaccaaagacaugaggaaaucacaggguaagucugggaaaaugg

SEQ ID NO: 319702 - RNA, 64 nt, Human
uuuuugguuuucugauggaaauaauagaauuaggggaaaucaaaucugguugguaggugucuac

SEQ ID NO: 319703 - RNA, 64 nt, Human
auauugggugaugucaaagguauaugauacuugaggaaaucaggccaaguguagcugagcaauu

SEQ ID NO: 319704 - RNA, 64 nt, Human
cagaccacagaggauggagccugggaagcagcgaggaaaucacagcccccucgccccugccucc

SEQ ID NO: 319705 - RNA, 64 nt, Human
gcagucauccucccccuuccccgugcagggagcaggaaaucagugcuggggguggugggcggac

SEQ ID NO: 319706 - RNA, 64 nt, Human
aagucaaucugugugcugguuuuguugguuauguggaaaucacaaacuccagaggagcaaaggg

SEQ ID NO: 319707 - RNA, 64 nt, Human
ggccaaccuagccaaggcugcagcauauagaccaggaaaucagguagcccagacuggugaugga

SEQ ID NO: 319708 - RNA, 64 nt, Human
gucacuaauacuguggugagugauuuuacucaaaggaaaucacacuauuaagcagcuugguuuu

SEQ ID NO: 319709 - RNA, 64 nt, Human
gggccugaggcuuaggagagcugccuucgcugcaggaaaucagggauuaucccuuaacagaagu

SEQ ID NO: 319710 - RNA, 64 nt, Human
uccagugccgcuccugcuuccccucccuacccucggaaaucagugcgauguggacgucacgcuc

SEQ ID NO: 319711 - RNA, 64 nt, Human
gaaaguauacagagaaacuauaagcaauuaugugggaaaucauuuaauaauauuaaaucuuaga

SEQ ID NO: 319712 - RNA, 64 nt, Human
gauuacuguugauagaauauucauuuuauggcaaggaaaucaucuaaacccauaaccauaguuu

SEQ ID NO: 319713 - RNA, 55 nt, Human
cugaaagugaugaauuuuaacuucuggaaaucagacuuuuacaacuggaugugug

SEQ ID NO: 319714 - RNA, 64 nt, Human; identical to SEQ ID NO: 314556

SEQ ID NO: 319715 - RNA, 63 nt, Human; identical to SEQ ID NO: 318051

SEQ ID NO: 319716 - RNA, 64 nt, Human
cucaguuggucaguaaagaccaauccuuacuguaggaaaucauuguuguaucaucacaaacauc

SEQ ID NO: 319717 - RNA, 64 nt, Human
cugggccaucuugguuuuugcaagaaaaaagcgaggaaaucagagaaacucuuugggcugugug

SEQ ID NO: 319718 - RNA, 64 nt, Human
uuuggaaguaagccuuuauuuauuacuuuuuggaggaaaucagagaagugucaauggaccguca

SEQ ID NO: 319719 - RNA, 64 nt, Human
cuugugaaaauuuauccauuuaucuucagguuggggaaaucaauuuuucuuuaaauccaaagau

SEQ ID NO: 319720 - RNA, 64 nt, Human
auuuucuuucuuucuauauuggauugcaagcuugggaaaucaagcuaccuuuuuguuguuguug

SEQ ID NO: 319721 - RNA, 64 nt, Human
accaccacuucugccuuagauaauaugauuauaaggaaaucaaauaaauguugccuuaacuuca

SEQ ID NO: 319722 - RNA, 64 nt, Human
ggcauccagagucauugcuguggcugagcuggaaggaaaucaccaggugccaccgucaauauuu

SEQ ID NO: 319723 - RNA, 64 nt, Human
aaacccuuccuagucucacuugauuccucaugacggaaaucacacuaaagagagaaaucaguga

SEQ ID NO: 319724 - RNA, 64 nt, Human
aagaggugaagaaggaauugcagaaagugaaagaggaaaucauugaaggugaggugguuugcuu

SEQ ID NO: 319725 - RNA, 64 nt, Human
agcauuaaucaacaucagugaguccauacuaaguggaaaucauauaaaugaaauguaugugaca

SEQ ID NO: 319726 - RNA, 64 nt, Human
augcuuuuaauaagaaggguaggacuggauguugggaaaucaugugaacaucuaucuccaaauc

SEQ ID NO: 319727 - RNA, 64 nt, Human
aggcuucagugacagucaucccuuaagacgcacuggaaaucacacaauggaacaacacucagaa

SEQ ID NO: 319728 - RNA, 64 nt, Human
acaggauugagagauuaaaguaaagacaggcauaggaaaucacaaggguauugacuggggaagu

SEQ ID NO: 319729 - RNA, 64 nt, Human
guacaucucacauguugggaaacgcuggccacugggaaaucauuagaaaggaggcuguagaaua

SEQ ID NO: 319730 - RNA, 64 nt, Human
ggugcuuuacugucucuggcuuguuuccaucacuggaaaucacuuagagaauuguaguguuuuu

SEQ ID NO: 319731 - RNA, 64 nt, Human
uuuugacaacaccucaaauuuuucuaaauauaaaggaaaucauacuggugaaaaauucuagaaa

SEQ ID NO: 319732 - RNA, 63 nt, Human; identical to SEQ ID NO: 316216

SEQ ID NO: 319733 - RNA, 64 nt, Human
gguaauugauagaggcgguaucccagauugguggggaaaucauggauuacuuaaaaauuaauug

SEQ ID NO: 319734 - RNA, 64 nt, Human
aucugccuuagccuugggaggucugggaagggcuggaaaucacuggggacaggaaaccacuucc

SEQ ID NO: 319735 - RNA, 64 nt, Human
auuguuacaauacuguuaacuacagaauuuauuuggaaaucaccaguuuuaacaugcaugcauu

SEQ ID NO: 319736 - RNA, 64 nt, Human
uagaaaugugaagcaugugacaaaguuuccauuuggaaaucacaccuuaaagacauaggagaau

SEQ ID NO: 319737 - RNA, 64 nt, Human
uauauaacuguguuaaguccuucagacaaguucaggaaaucaaaaaguuuaaaaagggaauucu

SEQ ID NO: 319738 - RNA, 64 nt, Human
uuuaaaccaguuuagauuucaagaaaaaauaaauggaaaucaucgaaaauucauuucacauuaa

SEQ ID NO: 319739 - RNA, 64 nt, Human
ccauucacugauuggaagagugaccuggcaucuuggaaaucauugugugucuucaggagaaugu

SEQ ID NO: 319740 - RNA, 64 nt, Human
aaggaagaacuucucuucgaugauaaugucgaguggaaaucaugcuuaaucugaagauuaaagu

SEQ ID NO: 319741 - RNA, 64 nt, Human
agcugcuuagcuggugcuggccugaggcagggcaggaaaucagaauagcauuugcuucucuggg

SEQ ID NO: 319742 - RNA, 64 nt, Human
uagcuuguggaguuuaugggccaccaggguuuggggaaaucaccaucccgcggaugcugugacc

SEQ ID NO: 319743 - RNA, 64 nt, Human
ccgaagccagggccaugccagcaggccccaccauggaaaucaaaacaccgcaccagccagcaga

SEQ ID NO: 319744 - RNA, 64 nt, Human
uuuuucuaaugggcuaaacccagaugguuuccuaggaaaucacaggcuucugagcacagcugca

SEQ ID NO: 319745 - RNA, 64 nt, Human
cuucuacccacccgccucccaccagaucccaucuggaaaucauaauaaagacauaugccacuuu

SEQ ID NO: 319746 - RNA, 64 nt, Human
uuccuauuuaauguuauugacuauagcagauuuuggaaaucaguguuuuccaugugacccucuu

SEQ ID NO: 319747 - RNA, 64 nt, Human
auuugccauagaguacacugccugccuuaagugaggaaaucaaagugcuauuacgaaguucaag

SEQ ID NO: 319748 - RNA, 64 nt, Human
uauucucaggugagcaaaauaccgaauacugaauggaaaucaacuguaaguauuaggacuucau

SEQ ID NO: 319749 - RNA, 63 nt, Human; identical to SEQ ID NO: 318225

SEQ ID NO: 319750 - RNA, 63 nt, Human; identical to SEQ ID NO: 316097

SEQ ID NO: 319751 - RNA, 61 nt, Human; identical to SEQ ID NO: 317999

SEQ ID NO: 319752 - RNA, 64 nt, Human
gugacuuaggugcugucaacauuagcaagauaauggaaaucacgacgccagugggugcuuaccu

SEQ ID NO: 319753 - RNA, 64 nt, Human
ugggaccauuaguccauuuccauuuuacagacaaggaaaucaagacccagcuugggggaaaagc

SEQ ID NO: 319754 - RNA, 64 nt, Human
cuggggccauucuaggcucuuucaagugacuuuuggaaaucaaccuuuuuuauuugggggggag

SEQ ID NO: 319755 - RNA, 64 nt, Human
ugacccccacugccgccuccuucuuaacucugcaggaaaucagagcuggcagccuccaguggga

SEQ ID NO: 319756 - RNA, 64 nt, Human
uaaauuaaaaaaaaaaaagagcacgacaaaccuuggaaaucaagaaaguucuggaaugaugaag

SEQ ID NO: 319757 - RNA, 64 nt, Human
acugaauaaauagaacucaacuauugcuuuucagggaaaucauggauaggguugaagaagguua

SEQ ID NO: 319758 - RNA, 64 nt, Human
gcagaaacugaauuaauaugcuuccuugcaaaugggaaaucacauagcaguuaccccauggcau

SEQ ID NO: 319759 - RNA, 64 nt, Human
acucuggagcaacuuagucaaauaccguuacuugggaaaucaucuuuacggaauguggugcuga

SEQ ID NO: 319760 - RNA, 64 nt, Human
gagcuagcuggugugguugcagugaccuuguagaggaaaucaguucauuacuuugacaucauuc

SEQ ID NO: 319761 - RNA, 64 nt, Human
cacacaagaggcaagaaagaaaacagggugggugggaaaucagccuauuugugaauuuaaaagg

SEQ ID NO: 319762 - RNA, 64 nt, Human
ggccugcuagucacuggaaauugagguccaugggggaaaucaaggaugcucaguuuaagguaca

SEQ ID NO: 319763 - RNA, 64 nt, Human
caccuuccuuuagucucguccugugguguugaagggaaaucagccaguuguaaauuuugcccag

SEQ ID NO: 319764 - RNA, 64 nt, Human
cagcuguuuucgugucauguauaguaguagaaauggaaaucauuguacuguaaaagccuaguga

SEQ ID NO: 319765 - RNA, 64 nt, Human
ucacucgacauuggucucuuguguugauagggaaggaaaucaggcauuccuauuucuuuaaaua

SEQ ID NO: 319766 - RNA, 64 nt, Human
augcagcccaccuagaugagucucuucaagaaugggaaaucaaggggugacagggaguaaaagg

SEQ ID NO: 319767 - RNA, 64 nt, Human
ccugcccucccucuggacccccagccaggggcuuggaaaucaaauucagcucuucacuccagca

SEQ ID NO: 319768 - RNA, 63 nt, Human; identical to SEQ ID NO: 318017

SEQ ID NO: 319769 - RNA, 64 nt, Human
ccaucugggggaaaucuugggaugcuuuuuccuaggaaaucauaugguugugauauguuuuggc

SEQ ID NO: 319770 - RNA, 64 nt, Human
cucaaaauaauugagaucacauuucaggacauuuggaaaucaggucgauuugugguaacuguag

SEQ ID NO: 319771 - RNA, 64 nt, Human
uaguugaaacucuguacagauacagaucugaccuggaaaucauauuuaaugccauugacacuga

SEQ ID NO: 319772 - RNA, 64 nt, Human
augauaauuaucagcgaucugagguacucagcauggaaaucaacauccugaacguccucaaaug

SEQ ID NO: 319773 - RNA, 64 nt, Human
gccacgggaaguuuagagagcuaagauuaucuggggaaaucaaaacaaaaacaagcaaacaaaa

SEQ ID NO: 319774 - RNA, 64 nt, Human
uacagguuuauccauuugcaaauauuuucaaaauggaaaucacuguuuauauugauuauaaaca

SEQ ID NO: 319775 - RNA, 52 nt, Human
cugcaaucagucagcugugaagggaaaucauuuacaacccuaaggcaucaga

SEQ ID NO: 319776 - RNA, 64 nt, Human
cucucaugguccacacugcugggggaaagggaaaggaaaucagcaacucuucaaucccaaccug

SEQ ID NO: 319777 - RNA, 64 nt, Human
caaugccacgauuuagauuuaaugaugcuucaguggaaaucaaucagaagguauucugaccuug

SEQ ID NO: 319778 - RNA, 64 nt, Human
uguauuauucaauccuuuggaauguuauauuuuuggaaaucauagcuuuuuauuuccaaggccc

SEQ ID NO: 319779 - RNA, 64 nt, Human
gcuauaaagccagugacugagaaagucuucaccuggaaaucacaacuggguaugcaucagguau

SEQ ID NO: 319780 - RNA, 64 nt, Human
acaguaucuuaaguuuaacugggcacuucccucuggaaaucacaguguugugcaccaggaacac

SEQ ID NO: 319781 - RNA, 64 nt, Human
ucugccucccaugaggcuuacagaguucaauguuggaaaucauuguaaucuucaaaauaaguca

SEQ ID NO: 319782 - RNA, 64 nt, Human
auaacuuaaagaauaauacuuagaaggguuaauuggaaaucagaguuugaaauaaaacuuggac

SEQ ID NO: 319783 - RNA, 64 nt, Human
aacuuuuaguuuuguuugcccaaggauuaauugaggaaaucagcuaagaaaauggacuuuagac

SEQ ID NO: 319784 - RNA, 64 nt, Human
ggcuuacaaacagcaaaucaaagaagauaauauuggaaaucagcugcugagaaagauggguugg

SEQ ID NO: 319785 - RNA, 64 nt, Human; identical to SEQ ID NO: 314553

SEQ ID NO: 319786 - RNA, 53 nt, Human; identical to SEQ ID NO: 314554

SEQ ID NO: 319787 - RNA, 64 nt, Human; identical to SEQ ID NO: 314555

SEQ ID NO: 319788 - RNA, 64 nt, Human
aaaguacacagggcuauucuguaauauuguucagggaaaucagcaugauagaugcugugccucc

SEQ ID NO: 319789 - RNA, 64 nt, Human; identical to SEQ ID NO: 314532

SEQ ID NO: 319790 - RNA, 64 nt, Human; identical to SEQ ID NO: 314533

SEQ ID NO: 319791 - RNA, 64 nt, Human; identical to SEQ ID NO: 314534

SEQ ID NO: 319792 - RNA, 64 nt, Human; identical to SEQ ID NO: 314535

SEQ ID NO: 319793 - RNA, 64 nt, Human; identical to SEQ ID NO: 314536

SEQ ID NO: 319794 - RNA, 64 nt, Human; identical to SEQ ID NO: 314537

SEQ ID NO: 319795 - RNA, 64 nt, Human; identical to SEQ ID NO: 314538

SEQ ID NO: 319796 - RNA, 64 nt, Human; identical to SEQ ID NO: 314539

SEQ ID NO: 319797 - RNA, 64 nt, Human; identical to SEQ ID NO: 314540

SEQ ID NO: 319798 - RNA, 64 nt, Human; identical to SEQ ID NO: 314541

SEQ ID NO: 319799 - RNA, 64 nt, Human; identical to SEQ ID NO: 314542

SEQ ID NO: 319800 - RNA, 60 nt, Human; identical to SEQ ID NO: 314543

SEQ ID NO: 319801 - RNA, 64 nt, Human; identical to SEQ ID NO: 314544

SEQ ID NO: 319802 - RNA, 50 nt, Human; identical to SEQ ID NO: 314545

SEQ ID NO: 319803 - RNA, 64 nt, Human; identical to SEQ ID NO: 314546

SEQ ID NO: 319804 - RNA, 64 nt, Human; identical to SEQ ID NO: 314547

SEQ ID NO: 319805 - RNA, 64 nt, Human; identical to SEQ ID NO: 314548

SEQ ID NO: 319806 - RNA, 64 nt, Human; identical to SEQ ID NO: 314549

SEQ ID NO: 319807 - RNA, 64 nt, Human; identical to SEQ ID NO: 314550

SEQ ID NO: 319808 - RNA, 64 nt, Human
augaagcccacucacuugccauuccagggccaaaggaccggagguuugcauauccgccccuugu

SEQ ID NO: 319809 - RNA, 64 nt, Human
agaagcccguccuccuaugcugguggaaggcggaggaccggagucccugcagaaggccccgugc

SEQ ID NO: 319810 - RNA, 64 nt, Human
cauccggcaacagucugaaaguacguggaggacgggaccggaagacgagagagggcuggacauc

SEQ ID NO: 319811 - RNA, 64 nt, Human
cacccagggaugagcaguguccagugcaguaccuggaccggagcccccuccacagacacccgcg

SEQ ID NO: 319812 - RNA, 64 nt, Human
acagagauaguccuggaagacacguggcgccuguggaccggaagcaccaaaugcuggugcugcu

SEQ ID NO: 319813 - RNA, 64 nt, Human
ggccgggaacuguccgaggugcugagcuggggcgggaccggaauccucccgguaggguaccagg

SEQ ID NO: 319814 - RNA, 64 nt, Human
ggcguuguggucuuugcauugggggaggggggagggaccggaugggcggggggagggggagggg

SEQ ID NO: 319815 - RNA, 64 nt, Human
auaccaagaacauggaggccaagaaacucuccaaggaccggaugaagaaguacauggcaagaag

SEQ ID NO: 319816 - RNA, 64 nt, Human
uuuuuuuuuaaaugaucauaagauggcccauuuuggaccggaacugucauugccagacagaauu

SEQ ID NO: 319817 - RNA, 64 nt, Human
gguuaauuuuucacuccagugcguccuguugcagggaccggagcugaugggagcugcuucuccc

SEQ ID NO: 319818 - RNA, 64 nt, Human
gcugcugcguggagcacuuaaaguccagccuccaggaccggaugccccuccugucucccgcucc

SEQ ID NO: 319819 - RNA, 64 nt, Human
augcagggcccccacaggagcguguccuauccccggaccggacgcaugcagggcccccacagga

SEQ ID NO: 319820 - RNA, 64 nt, Human
ugaacgaggccauugguacccucaccgccaggggggaccggaaugccuggguccccaccaugcu

SEQ ID NO: 319821 - RNA, 64 nt, Human
cacuccuuuuuuucccauuguucuaucaucucuaggaccggaacuaccuucucuucugucauga

SEQ ID NO: 319822 - RNA, 64 nt, Human
cagacaccgcucaucccgaucucuuccugucagaggaccggagaagugugagaaggugccccuu

SEQ ID NO: 319823 - RNA, 64 nt, Human
uccggaugcaggcgaggccgcggccccagaguccccgcaccaggcagagccguaccugucaccc

SEQ ID NO: 319824 - RNA, 64 nt, Human
guagaacgguggcuacugugaguggggagcagaaccgcaccacuguuauacugggauaacaauu

SEQ ID NO: 319825 - RNA, 64 nt, Human
auccacccucuggcacaacucugaggccaccaaccucguccacacccggggggcccccgggugc

SEQ ID NO: 319826 - RNA, 64 nt, Human
cucagcacagccuggggagggggucauuguucuccucguccaucagggaucucagaggcucaga

SEQ ID NO: 319827 - RNA, 64 nt, Human
ggggucaggccagauggggcaggaaggcuccgcaggaccggaccccuagaccacccugccccac

SEQ ID NO: 319828 - RNA, 64 nt, Human
caucgaguugaacaggacuuaaacgaaucaucagggaccggauauuucuuauuucucauuugga

SEQ ID NO: 319829 - RNA, 64 nt, Human
uggcucuuccucccagagcagccggcagcuaccuggaccggaaauguccucauccccucccugg

SEQ ID NO: 319830 - RNA, 64 nt, Human
ccacccuggacugaaguucugcaaaguccuccgaggaccggaacacguuucugcgacccggggc

SEQ ID NO: 319831 - RNA, 64 nt, Human
cgugacauccagcacuuggucagacccuagccagggaccggacaccugccccgcccaggcuggg

SEQ ID NO: 319832 - RNA, 64 nt, Human
ugccuggcgggcagccccugcuggaccaaggugcggaccggagcggcugaggacggggcagagc

SEQ ID NO: 319833 - RNA, 64 nt, Human
ugggcuccuagcgcucgaaagcccaacgccucccggaccggaccgccgaggggagcugggaccu

SEQ ID NO: 319834 - RNA, 64 nt, Human
aagggggaagccggccagggagcgagcccagaacggaccggacgccugugcacccccagcccug

SEQ ID NO: 319835 - RNA, 64 nt, Human
cuuucuuucagacccugccuaccugcaggcagauggaccggaggguuuucugcuuccuuucaac

SEQ ID NO: 319836 - RNA, 64 nt, Human
aggagccccgccccuccugccgggggaggcccagggaccggagcauuucugcaaggcccuugug

SEQ ID NO: 319837 - RNA, 64 nt, Human
gcguggaccgaggaggucuuugugcccugagcagggaccggauaacaccagaaagagggaugcu

SEQ ID NO: 319838 - RNA, 64 nt, Human
uccugguggcccugaugcagaagaaccggcggaaggaccggaagcuaggggccagucucuucac

SEQ ID NO: 319839 - RNA, 64 nt, Human
ucaaguuuggagccguuuccgugguuguagcagaggaccggagguuggguuccugauuaaacuu

SEQ ID NO: 319840 - RNA, 64 nt, Human
uauggacuuggucugaugcugaaugggccacuugggaccggaagugacuugcuccagacaagag

SEQ ID NO: 319841 - RNA, 64 nt, Human
caaacaggcaugggaaaauggaaggguugaggauggaccggagaauuggaacuucagaauaggu

SEQ ID NO: 319842 - RNA, 64 nt, Human
uccgcacccgcagcacgccgaugacgucgccggccucguccagcuccaugucgcccuccgucgc

SEQ ID NO: 319843 - RNA, 64 nt, Human
uuuccucugguuuccuuguccuacuguucuuugccucguccaggucucuaucucccaaagaccu

SEQ ID NO: 319844 - RNA, 64 nt, Human
ggugcccccagcccggcacccagcgcuuucgccccucguccacccaccccuggcuggcagccuc

SEQ ID NO: 319845 - RNA, 64 nt, Human
aacgucgcaggacaguugugaaaauaacaugacgcucguccaaggccacuuccugagggcaagu

SEQ ID NO: 319846 - RNA, 64 nt, Human
ccacuucugcacuugcgguuccggcauggacaauggaccggagaguggggguggggggucccaa

SEQ ID NO: 319847 - RNA, 64 nt, Human
uugucaauagccucuuccucacugaucuguaccgggaccggaaacuucuuggugcugaagguaa

SEQ ID NO: 319848 - RNA, 64 nt, Human
ggcgcuccagggagcggagcaaggacaaggaccgggaccggaagcggcgaagcagccggagucg

SEQ ID NO: 319849 - RNA, 64 nt, Human
uaggaacacgaagcacgaucaguccaucccagagggaccggaguuaugacaagcuuuccaaaua

SEQ ID NO: 319850 - RNA, 64 nt, Human
uguuucuccuucaggauccgagcuaaaaucccagggaccggagcccuggccucugcagcagccg

SEQ ID NO: 319851 - RNA, 64 nt, Human
ugacccacacuacccucccuugaccagcugucugggaccggaaaccagcuuugucuccagguag

SEQ ID NO: 319852 - RNA, 64 nt, Human
uaucuacugagggccuggaggggccuggggcccgggaccggaggcugacgaggcuggacuuccu

SEQ ID NO: 319853 - RNA, 64 nt, Human
guaaugccuaaucuauuuaucaaaacugacuacuggaccggagcccagaaaccaugggucaagu

SEQ ID NO: 319854 - RNA, 64 nt, Human
ggguggacccacuggccugucagucucaauaaagggaccggaguccaguccugaacagcuuacu

SEQ ID NO: 319855 - RNA, 64 nt, Human
agacguggugugagagggacggcucacagggcuuggaccggagagagauggcucaugaggcuug

SEQ ID NO: 319856 - RNA, 64 nt, Human
cugagggagcucagggcaaaggccaggcuagcgcggaccggaaggggccgaggcugcacgggcc

SEQ ID NO: 319857 - RNA, 64 nt, Human
uuuucucuagguugguaccugcuuaguggcauauggaccggaaaggguuaauuuaaaggggggg

SEQ ID NO: 319858 - RNA, 64 nt, Human
ggggaggggacggggaaggaagaaagaauuuaaaggaccggaaugcgagaguccagguggccuu

SEQ ID NO: 319859 - RNA, 64 nt, Human
gcacggccucaggcccccgagggacagucggccuggaccggaccucuccuuucgcccccacacc

SEQ ID NO: 319860 - RNA, 64 nt, Human; identical to SEQ ID NO: 319808

SEQ ID NO: 319861 - RNA, 64 nt, Human
ucuggccccagucgaacugggggcuagccaccuccucguccagcccccaaaccuccccuuccuu

SEQ ID NO: 319862 - RNA, 64 nt, Human
caccuauggaugcgucccagccagccccgucgcucucguccauccucagagacaaagaagaggg

SEQ ID NO: 319863 - RNA, 64 nt, Human
ccauuugcugggaugaccgugcaggccggugacacggccgcaccugccccaaagcgggccgccc

SEQ ID NO: 319864 - RNA, 64 nt, Human; identical to SEQ ID NO: 319809

SEQ ID NO: 319865 - RNA, 64 nt, Human; identical to SEQ ID NO: 319810

SEQ ID NO: 319866 - RNA, 64 nt, Human; identical to SEQ ID NO: 319811

SEQ ID NO: 319867 - RNA, 64 nt, Human; identical to SEQ ID NO: 319812

SEQ ID NO: 319868 - RNA, 64 nt, Human; identical to SEQ ID NO: 319813

SEQ ID NO: 319869 - RNA, 64 nt, Human; identical to SEQ ID NO: 319814

SEQ ID NO: 319870 - RNA, 64 nt, Human; identical to SEQ ID NO: 319815

SEQ ID NO: 319871 - RNA, 64 nt, Human; identical to SEQ ID NO: 319816

SEQ ID NO: 319872 - RNA, 64 nt, Human; identical to SEQ ID NO: 319817

SEQ ID NO: 319873 - RNA, 64 nt, Human; identical to SEQ ID NO: 319818

SEQ ID NO: 319874 - RNA, 64 nt, Human; identical to SEQ ID NO: 319819

SEQ ID NO: 319875 - RNA, 64 nt, Human; identical to SEQ ID NO: 319820

SEQ ID NO: 319876 - RNA, 64 nt, Human; identical to SEQ ID NO: 319821

SEQ ID NO: 319877 - RNA, 64 nt, Human; identical to SEQ ID NO: 319822

SEQ ID NO: 319878 - RNA, 64 nt, Human; identical to SEQ ID NO: 319827

SEQ ID NO: 319879 - RNA, 64 nt, Human
ucaaaaccaaguaucacacuuuaauguacaugggccgcaccauaaugagaugugagccuugugc

SEQ ID NO: 319880 - RNA, 58 nt, Human; identical to SEQ ID NO: 295701

SEQ ID NO: 319881 - RNA, 64 nt, Human
cagccuaaccugcauugcagccguucaccggacaccgcaccagacccucaaaacccauccaaga

SEQ ID NO: 319882 - RNA, 64 nt, Human
ggacccagccugagauggucccaucugcagggccccgcaccaguuggagcagaugccuccccac

SEQ ID NO: 319883 - RNA, 64 nt, Human; identical to SEQ ID NO: 319828

SEQ ID NO: 319884 - RNA, 64 nt, Human; identical to SEQ ID NO: 319829

SEQ ID NO: 319885 - RNA, 64 nt, Human; identical to SEQ ID NO: 319830

SEQ ID NO: 319886 - RNA, 64 nt, Human; identical to SEQ ID NO: 319831

SEQ ID NO: 319887 - RNA, 64 nt, Human; identical to SEQ ID NO: 319832

SEQ ID NO: 319888 - RNA, 64 nt, Human; identical to SEQ ID NO: 319833

SEQ ID NO: 319889 - RNA, 64 nt, Human; identical to SEQ ID NO: 319834

SEQ ID NO: 319890 - RNA, 64 nt, Human; identical to SEQ ID NO: 319835

SEQ ID NO: 319891 - RNA, 64 nt, Human; identical to SEQ ID NO: 319836

SEQ ID NO: 319892 - RNA, 64 nt, Human; identical to SEQ ID NO: 319837

SEQ ID NO: 319893 - RNA, 64 nt, Human; identical to SEQ ID NO: 319838

SEQ ID NO: 319894 - RNA, 64 nt, Human; identical to SEQ ID NO: 319839

SEQ ID NO: 319895 - RNA, 64 nt, Human; identical to SEQ ID NO: 319840

SEQ ID NO: 319896 - RNA, 64 nt, Human; identical to SEQ ID NO: 319841

SEQ ID NO: 319897 - RNA, 64 nt, Human; identical to SEQ ID NO: 319846

SEQ ID NO: 319898 - RNA, 64 nt, Human
agacgugcacuuggugcugcgcccagggaggaagccgcaccaccagccagcgcaggcccuggug

SEQ ID NO: 319899 - RNA, 64 nt, Human
gagacgugagcacaguuauggcagagaaguuucuccgcaccagaauuauccacagcaacuuggc

SEQ ID NO: 319900 - RNA, 64 nt, Human
aguuggacacuccgagagugcagcuguucuccccccgcaccauccguguccugcauucugcgag

SEQ ID NO: 319901 - RNA, 64 nt, Human; identical to SEQ ID NO: 319847

SEQ ID NO: 319902 - RNA, 64 nt, Human; identical to SEQ ID NO: 319848

SEQ ID NO: 319903 - RNA, 64 nt, Human; identical to SEQ ID NO: 319849

SEQ ID NO: 319904 - RNA, 64 nt, Human; identical to SEQ ID NO: 319850

SEQ ID NO: 319905 - RNA, 64 nt, Human; identical to SEQ ID NO: 319851

SEQ ID NO: 319906 - RNA, 64 nt, Human; identical to SEQ ID NO: 319852

SEQ ID NO: 319907 - RNA, 64 nt, Human; identical to SEQ ID NO: 319853

SEQ ID NO: 319908 - RNA, 64 nt, Human; identical to SEQ ID NO: 319854

SEQ ID NO: 319909 - RNA, 64 nt, Human; identical to SEQ ID NO: 319855

SEQ ID NO: 319910 - RNA, 64 nt, Human; identical to SEQ ID NO: 319856

SEQ ID NO: 319911 - RNA, 64 nt, Human; identical to SEQ ID NO: 319857

SEQ ID NO: 319912 - RNA, 64 nt, Human; identical to SEQ ID NO: 319858

SEQ ID NO: 319913 - RNA, 64 nt, Human; identical to SEQ ID NO: 319859

SEQ ID NO: 319914 - RNA, 64 nt, Human; identical to SEQ ID NO: 302318

SEQ ID NO: 319915 - RNA, 64 nt, Human; identical to SEQ ID NO: 302319

SEQ ID NO: 319916 - RNA, 64 nt, Human
aacaaaucucaccuuuggggcugcguuucaucaccucguccacaauagucaauccuaauugugg

SEQ ID NO: 319917 - RNA, 64 nt, Human
auccugaccuucuuagggacgugccuggaaccaccucguccacguccacguccaccugggggcc

SEQ ID NO: 319918 - RNA, 64 nt, Human
gcccugcagcucugggccaccugcugguguccaccucguccaacagagucguggugcuggaugc

SEQ ID NO: 319919 - RNA, 64 nt, Human
uguggcgcuccagguucugcuuggccuccaucuccucguccagcuggucuugcaggcuguuccg

SEQ ID NO: 319920 - RNA, 64 nt, Human; identical to SEQ ID NO: 302320

SEQ ID NO: 319921 - RNA, 64 nt, Human; identical to SEQ ID NO: 302324

SEQ ID NO: 319922 - RNA, 64 nt, Human; identical to SEQ ID NO: 302325

SEQ ID NO: 319923 - RNA, 53 nt, Human; identical to SEQ ID NO: 302227

SEQ ID NO: 319924 - RNA, 64 nt, Human; identical to SEQ ID NO: 302327

SEQ ID NO: 319925 - RNA, 64 nt, Human; identical to SEQ ID NO: 302328

SEQ ID NO: 319926 - RNA, 64 nt, Human; identical to SEQ ID NO: 302329

SEQ ID NO: 319927 - RNA, 55 nt, Human; identical to SEQ ID NO: 302231

SEQ ID NO: 319928 - RNA, 64 nt, Human; identical to SEQ ID NO: 302331

SEQ ID NO: 319929 - RNA, 64 nt, Human; identical to SEQ ID NO: 302332

SEQ ID NO: 319930 - RNA, 64 nt, Human; identical to SEQ ID NO: 302333

SEQ ID NO: 319931 - RNA, 64 nt, Human; identical to SEQ ID NO: 302334

SEQ ID NO: 319932 - RNA, 64 nt, Human; identical to SEQ ID NO: 302335

SEQ ID NO: 319933 - RNA, 57 nt, Human; identical to SEQ ID NO: 302237

SEQ ID NO: 319934 - RNA, 64 nt, Human
uuuuccaccugggagccugugcccucagaccgccccgcaccagagccacgggcuguggggcggg

SEQ ID NO: 319935 - RNA, 64 nt, Human
acuucccaggcuuggugcacuucaucuauguggaccgcaccacugggcagaugguggcgccuuc

SEQ ID NO: 319936 - RNA, 64 nt, Human
caugggaaacagugcagugacucacccccugcccccgcaccaaccacccauauucaggagaaga

SEQ ID NO: 319937 - RNA, 64 nt, Human
uucugaacucaagcugcguuuauuaaugccucucccgcaccaggccgggcuugggcccugcaca

SEQ ID NO: 319938 - RNA, 64 nt, Human; identical to SEQ ID NO: 302337

SEQ ID NO: 319939 - RNA, 64 nt, Human; identical to SEQ ID NO: 302338

SEQ ID NO: 319940 - RNA, 50 nt, Human; identical to SEQ ID NO: 302240

SEQ ID NO: 319941 - RNA, 64 nt, Human; identical to SEQ ID NO: 302343

SEQ ID NO: 319942 - RNA, 64 nt, Human; identical to SEQ ID NO: 302344

SEQ ID NO: 319943 - RNA, 64 nt, Human; identical to SEQ ID NO: 302345

SEQ ID NO: 319944 - RNA, 64 nt, Human; identical to SEQ ID NO: 302346

SEQ ID NO: 319945 - RNA, 64 nt, Human; identical to SEQ ID NO: 302347

SEQ ID NO: 319946 - RNA, 57 nt, Human; identical to SEQ ID NO: 302246

SEQ ID NO: 319947 - RNA, 64 nt, Human; identical to SEQ ID NO: 302349

SEQ ID NO: 319948 - RNA, 64 nt, Human; identical to SEQ ID NO: 302350

SEQ ID NO: 319949 - RNA, 64 nt, Human; identical to SEQ ID NO: 302351

SEQ ID NO: 319950 - RNA, 64 nt, Human; identical to SEQ ID NO: 302352

SEQ ID NO: 319951 - RNA, 64 nt, Human; identical to SEQ ID NO: 302353

SEQ ID NO: 319952 - RNA, 64 nt, Human
aggaaguugagagucuuuagaccugugcacagccccgcaccaaggggugcuguaugcucuaggc

SEQ ID NO: 319953 - RNA, 64 nt, Human
ugguuuuaccgccugcaaccucacugugcccgccccgcaccaugcccuagccccaggucuagcc

SEQ ID NO: 319954 - RNA, 64 nt, Human
ucacuuggaucaaaagcaaaacagucucuccgccccgcaccagaucaaguaguuuggacaucac

SEQ ID NO: 319955 - RNA, 64 nt, Human
ugggaaucaggccgccgagggcugagcuccagagccgcaccaucugccacaaacagaauucgag

SEQ ID NO: 319956 - RNA, 64 nt, Human; identical to SEQ ID NO: 302354

SEQ ID NO: 319957 - RNA, 64 nt, Human; identical to SEQ ID NO: 302355

SEQ ID NO: 319958 - RNA, 64 nt, Human; identical to SEQ ID NO: 302356

SEQ ID NO: 319959 - RNA, 64 nt, Human; identical to SEQ ID NO: 302357

SEQ ID NO: 319960 - RNA, 64 nt, Human; identical to SEQ ID NO: 302362

SEQ ID NO: 319961 - RNA, 64 nt, Human; identical to SEQ ID NO: 302363

SEQ ID NO: 319962 - RNA, 64 nt, Human; identical to SEQ ID NO: 302364

SEQ ID NO: 319963 - RNA, 64 nt, Human; identical to SEQ ID NO: 302365

SEQ ID NO: 319964 - RNA, 64 nt, Human; identical to SEQ ID NO: 302366

SEQ ID NO: 319965 - RNA, 64 nt, Human; identical to SEQ ID NO: 302367

SEQ ID NO: 319966 - RNA, 64 nt, Human; identical to SEQ ID NO: 302368

SEQ ID NO: 319967 - RNA, 64 nt, Human; identical to SEQ ID NO: 302369

SEQ ID NO: 319968 - RNA, 64 nt, Human; identical to SEQ ID NO: 302370

SEQ ID NO: 319969 - RNA, 64 nt, Human; identical to SEQ ID NO: 302371

SEQ ID NO: 319970 - RNA, 64 nt, Human
guucacugacugugcacugugcuuagagacccugccgcaccacagugccaaugcuugucagaca

SEQ ID NO: 319971 - RNA, 64 nt, Human
ucgggcgggugaacgcagacccugacuaccugccccgcaccauggacuuuggccucaacgugcg

SEQ ID NO: 319972 - RNA, 54 nt, Human; identical to SEQ ID NO: 295727

SEQ ID NO: 319973 - RNA, 64 nt, Human
gcccagacugagggucugggauggggugaaccuuccgcaccagagggacacuccacagaagcca

SEQ ID NO: 319974 - RNA, 64 nt, Human; identical to SEQ ID NO: 302372

SEQ ID NO: 319975 - RNA, 64 nt, Human; identical to SEQ ID NO: 302373

SEQ ID NO: 319976 - RNA, 64 nt, Human; identical to SEQ ID NO: 302374

SEQ ID NO: 319977 - RNA, 64 nt, Human; identical to SEQ ID NO: 302375

SEQ ID NO: 319978 - RNA, 64 nt, Human; identical to SEQ ID NO: 302376

SEQ ID NO: 319979 - RNA, 53 nt, Human; identical to SEQ ID NO: 302271

SEQ ID NO: 319980 - RNA, 64 nt, Human; identical to SEQ ID NO: 302382

SEQ ID NO: 319981 - RNA, 64 nt, Human; identical to SEQ ID NO: 302383

SEQ ID NO: 319982 - RNA, 64 nt, Human; identical to SEQ ID NO: 302384

SEQ ID NO: 319983 - RNA, 64 nt, Human; identical to SEQ ID NO: 302385

SEQ ID NO: 319984 - RNA, 64 nt, Human; identical to SEQ ID NO: 302386

SEQ ID NO: 319985 - RNA, 64 nt, Human; identical to SEQ ID NO: 302387

SEQ ID NO: 319986 - RNA, 64 nt, Human; identical to SEQ ID NO: 302388

SEQ ID NO: 319987 - RNA, 64 nt, Human; identical to SEQ ID NO: 302389

SEQ ID NO: 319988 - RNA, 64 nt, Human; identical to SEQ ID NO: 302390

SEQ ID NO: 319989 - RNA, 64 nt, Human; identical to SEQ ID NO: 302391

SEQ ID NO: 319990 - RNA, 64 nt, Human; identical to SEQ ID NO: 302392

SEQ ID NO: 319991 - RNA, 64 nt, Human; identical to SEQ ID NO: 302393

SEQ ID NO: 319992 - RNA, 64 nt, Human; identical to SEQ ID NO: 302394

SEQ ID NO: 319993 - RNA, 64 nt, Human; identical to SEQ ID NO: 302395

SEQ ID NO: 319994 - RNA, 64 nt, Human; identical to SEQ ID NO: 302400

SEQ ID NO: 319995 - RNA, 64 nt, Human; identical to SEQ ID NO: 302401

SEQ ID NO: 319996 - RNA, 64 nt, Human; identical to SEQ ID NO: 302402

SEQ ID NO: 319997 - RNA, 64 nt, Human; identical to SEQ ID NO: 302403

SEQ ID NO: 319998 - RNA, 64 nt, Human; identical to SEQ ID NO: 302404

SEQ ID NO: 319999 - RNA, 64 nt, Human; identical to SEQ ID NO: 302405

SEQ ID NO: 320000 - RNA, 64 nt, Human; identical to SEQ ID NO: 302406

SEQ ID NO: 320001 - RNA, 64 nt, Human; identical to SEQ ID NO: 302407

SEQ ID NO: 320002 - RNA, 64 nt, Human
ggagauugucccagggccuuguggaggacacgggccgcaccacacagugcucccugcccugccu

SEQ ID NO: 320003 - RNA, 64 nt, Human
cgagggccaauucaaccccauucuuuccagcgccccgcaccauagcaccugcccaccugagaac

SEQ ID NO: 320004 - RNA, 64 nt, Human; identical to SEQ ID NO: 302408

SEQ ID NO: 320005 - RNA, 64 nt, Human; identical to SEQ ID NO: 302409

SEQ ID NO: 320006 - RNA, 64 nt, Human; identical to SEQ ID NO: 302410

SEQ ID NO: 320007 - RNA, 64 nt, Human; identical to SEQ ID NO: 302411

SEQ ID NO: 320008 - RNA, 64 nt, Human; identical to SEQ ID NO: 302412

SEQ ID NO: 320009 - RNA, 64 nt, Human; identical to SEQ ID NO: 302413

SEQ ID NO: 320010 - RNA, 64 nt, Human; identical to SEQ ID NO: 302414

SEQ ID NO: 320011 - RNA, 64 nt, Human; identical to SEQ ID NO: 302419

SEQ ID NO: 320012 - RNA, 64 nt, Human; identical to SEQ ID NO: 302420

SEQ ID NO: 320013 - RNA, 64 nt, Human; identical to SEQ ID NO: 302421

SEQ ID NO: 320014 - RNA, 64 nt, Human; identical to SEQ ID NO: 302422

SEQ ID NO: 320015 - RNA, 64 nt, Human; identical to SEQ ID NO: 302423

SEQ ID NO: 320016 - RNA, 64 nt, Human; identical to SEQ ID NO: 302424

SEQ ID NO: 320017 - RNA, 64 nt, Human; identical to SEQ ID NO: 302425

SEQ ID NO: 320018 - RNA, 64 nt, Human
cugcccuguugccaaacaacucccugaggccucuccgcaccaccucagcgggcaggagguccca

SEQ ID NO: 320019 - RNA, 64 nt, Human
ggcuuuucucugccuuucuaccgaccaugugaccccgcaccagcccugcccccaccugcccucc

SEQ ID NO: 320020 - RNA, 64 nt, Human
cccuaaguaggcccuccccucccuaaaucugcuuccgcaccaccuggucuuagccccaaagaug

SEQ ID NO: 320021 - RNA, 64 nt, Human; identical to SEQ ID NO: 302426

SEQ ID NO: 320022 - RNA, 64 nt, Human; identical to SEQ ID NO: 302427

SEQ ID NO: 320023 - RNA, 64 nt, Human; identical to SEQ ID NO: 302428

SEQ ID NO: 320024 - RNA, 64 nt, Human; identical to SEQ ID NO: 302429

SEQ ID NO: 320025 - RNA, 64 nt, Human; identical to SEQ ID NO: 302430

SEQ ID NO: 320026 - RNA, 58 nt, Human; identical to SEQ ID NO: 302313

SEQ ID NO: 320027 - RNA, 64 nt, Human; identical to SEQ ID NO: 302432

SEQ ID NO: 320028 - RNA, 64 nt, Human; identical to SEQ ID NO: 302433

SEQ ID NO: 320029 - RNA, 64 nt, Human; identical to SEQ ID NO: 302438

SEQ ID NO: 320030 - RNA, 64 nt, Human; identical to SEQ ID NO: 302439

SEQ ID NO: 320031 - RNA, 64 nt, Human
caucugcuccucugcugcaggacggccggcugccccgcaccaucccucuccccagcugcaaacu

SEQ ID NO: 320032 - RNA, 64 nt, Human
ucauauccaccucuguccagggugccgccagcugccgcaccagcccgaacaccauugagggagc

SEQ ID NO: 320033 - RNA, 64 nt, Human
gaacccgggagguggagguugcagggagccgaggccgcaccacugcacuccagccugggugaca

SEQ ID NO: 320034 - RNA, 64 nt, Human
aaaguuggcgggggcuuggcugugcccucagauuccgcaccaauaaagccuucaaacucccuaa

SEQ ID NO: 320035 - RNA, 64 nt, Human
cagccccaggccccucuguaccauccccuccccuccgcaccacugaccucuugucuccuguugu

SEQ ID NO: 320036 - RNA, 64 nt, Human
ggacauggccuauguaccuaacguggccuucuucccgcaccacccuugccugcgcuggcccagu

SEQ ID NO: 320037 - RNA, 64 nt, Human
cugaggguggccaccacagccuuggcuccaugguggcggguagacaagggaugccugggcugac

SEQ ID NO: 320038 - RNA, 64 nt, Human
cucuacaaaaaauacaaaaauuagccuggcauauggcggguaccguaauccuagcuacucggga

SEQ ID NO: 320039 - RNA, 64 nt, Human
auuucuagaaaaagcugacuccauuuuugucccuggcggguaaauuaggaaucugcacuauuuu

SEQ ID NO: 320040 - RNA, 64 nt, Human
gagagagagaauggaauugcugaccccuggaacuggcggguauucuggucauugaggagacacc

SEQ ID NO: 320041 - RNA, 50 nt, Human
gccucaucaccaaggccuagggcggguaugaaguguggggcgggggucua

SEQ ID NO: 320042 - RNA, 64 nt, Human
uaaagguguaaguuauauaggcuugaaaaaaauuggcggguaaaaaucacaaaaugcagucgaa

SEQ ID NO: 320043 - RNA, 64 nt, Human
ucaugccuguaaucugagcacuuugggagaccaaggcggguagaucccuugugcccaggaguuc

SEQ ID NO: 320044 - RNA, 64 nt, Human
uaagacaauuucuuuuuucuuuugguuuaauaggggcggguauagggaccaacugggaccgagu

SEQ ID NO: 320045 - RNA, 64 nt, Human
agcuccgugaaaaugucaguuacuuuuacuaaguggcggguagugaauuaucugugccuagacc

SEQ ID NO: 320046 - RNA, 64 nt, Human
gcauugcacuuggccucaugcuggagggaggcugggcggguacagcgcggaggaggagggaggc

SEQ ID NO: 320047 - RNA, 64 nt, Human
gccuggcacaggccgaggcaggaggagcccggacggcggguaggacggagaugaagaacaucug

SEQ ID NO: 320048 - RNA, 64 nt, Human
auuugauuugccgagugguuuggagaucuuuaggggcggguaggggaagaggguggcuggacuu

SEQ ID NO: 320049 - RNA, 64 nt, Human
caugccagcaggccccaccauggaaaucaaaacaccgcaccagccagcagaauggacauucuga

SEQ ID NO: 320050 - RNA, 64 nt, Human
ugagugcagaagggugcgccucuucccucuacccccgcaccaccugcugugugccagccugaga

SEQ ID NO: 320051 - RNA, 64 nt, Human
aggaugaaaaguagaggcugcugggaggcaagagccgcaccaugcaggauggggaggagggcga

SEQ ID NO: 320052 - RNA, 64 nt, Human
uccucuuuccuucuccaggacggccgagaguuauccgcaccagugauuguugacauugacagcu

SEQ ID NO: 320053 - RNA, 64 nt, Human
gcccgcugcacguucugccaagguggugguggcgggcggguaggggugugggggccgucuuccu

SEQ ID NO: 320054 - RNA, 64 nt, Human
gaggugggcaggguggauggcuucgggcagggaaggcggguagaggcugcaugugggggccccu

SEQ ID NO: 320055 - RNA, 64 nt, Human
acaccucacaugucccaggagcugccuucauucaggcggguagcugcacugggcaugggguggu

SEQ ID NO: 320056 - RNA, 64 nt, Human
ucacgccuguaauccuagcacuuugggaggcugaggcggguagaucacaaggucaggagaucag

SEQ ID NO: 320057 - RNA, 64 nt, Human
gugaagguuuuguaaacuuuccaguauuaauuugggcggguauuccccgcuuguggcuuguuuc

SEQ ID NO: 320058 - RNA, 64 nt, Human
cugcggugggaucugaguauaucuagggcgggugggcggguagcagugcugggccugugucuug

SEQ ID NO: 320059 - RNA, 64 nt, Human
ccaggacaagcacgaggccucaggucggcccuguggcggguaggcaggaaggacugucccagac

SEQ ID NO: 320060 - RNA, 64 nt, Human
aggcauaaggagugaaaagcuccuugaaaauccaggcggguauggaaaggugcugcuacccaua

SEQ ID NO: 320061 - RNA, 64 nt, Human
gagguccauccugaccaaggagcggcggccggagggcggguacaaggcugucugguuuggcgag

SEQ ID NO: 320062 - RNA, 64 nt, Human
cucucccucuugccagcucugugagucuggccagggcggguagggagcguggagggcaucuguc

SEQ ID NO: 320063 - RNA, 64 nt, Human
ucuacgaaaaauacaaaaauuagcugggcauaguggcggguaccuauaaucccagcuacucggg

SEQ ID NO: 320064 - RNA, 64 nt, Human
uugaagauccuuccuugccuguggcuugaugcggggcggguaaaggguauuuuaacuuaggggu

SEQ ID NO: 320065 - RNA, 64 nt, Human
cuaaaaauacaaaaaaaaauuagccgggggugguggcggguaccuguaguccuagcuacuuggg

SEQ ID NO: 320066 - RNA, 64 nt, Human
aacaaggagcaguauguugaguagaaagggugugggcggguauagauuggccugggaguguuac

SEQ ID NO: 320067 - RNA, 64 nt, Human
cugucugggggagcgggccucuagcuucagccagggcggguacacacccugggcacaggguccu

SEQ ID NO: 320068 - RNA, 64 nt, Human
gggaaggcaggcugauggggcacacccuuggccucucguccacgaggggagaaaccuaaacccu

SEQ ID NO: 320069 - RNA, 64 nt, Human
auaggaccugcauccuuccuggggacgaauuccacucguccaagggacagcccacggucuggag

SEQ ID NO: 320070 - RNA, 64 nt, Human
uggaugggguggugccuuggucucucuugacuaccucguccaaagagagcacugcccuuagaca

SEQ ID NO: 320071 - RNA, 64 nt, Human
auggccgcucaccaggcaauuugcuaggcucgggggcggguaguauccauacacuaugcacuac

SEQ ID NO: 320072 - RNA, 64 nt, Human
gggagggguccgggaagaaggggaaggggugccuggcggguacuuuucuaucuuuuauuuccag

SEQ ID NO: 320073 - RNA, 64 nt, Human
ggaaaggcggggucagggcgggguucgcggaagaggcggguauaagaauggggggaagaugcgg

SEQ ID NO: 320074 - RNA, 64 nt, Human
cgagugagagccaguguuugcugcccuugcugggggcggguaggaaacccugagcuuccugaug

SEQ ID NO: 320075 - RNA, 64 nt, Human
agcuaaguggaauaauacaacguaacuaaaacauggcggguaccgaaaggagggcaauucaugg

SEQ ID NO: 320076 - RNA, 64 nt, Human
gcaguguuaaacagaggcauugagaaaggggaaaggcggguauuuuuaaaagccaaagauugac

SEQ ID NO: 320077 - RNA, 64 nt, Human
aguucccucccucccagccccccaauuuccugcgggcggguacaaaggacccuuucaauguccc

SEQ ID NO: 320078 - RNA, 64 nt, Human
cuuucugaccaucaagccugcuucuuggggggugggcggguagggggguggccaucccugcuac

SEQ ID NO: 320079 - RNA, 58 nt, Human
ucucagucaccaccgugugagcugcccgggcggguacacggcccaggcccagggaacc

SEQ ID NO: 320080 - RNA, 64 nt, Human
agcuuuguggaaggcugaucaguggcugcuggguggcggguacccuugcucagaugccuggcag

SEQ ID NO: 320081 - RNA, 64 nt, Human
auuugcuuuacucuuucuuuaugauugcaucugaccgcaccaaggugggccaugcguuguuugg

SEQ ID NO: 320082 - RNA, 64 nt, Human
caguguggagaggggugcacccacucaccaggguccgcaccagcugcucugccccuugggcauc

SEQ ID NO: 320083 - RNA, 64 nt, Human
ggcagcgggagccucccugccucaggccucugugccgcaccauugaacuguaccaugugcuaca

SEQ ID NO: 320084 - RNA, 64 nt, Human
guccugcauaugcaccuggggaguccccacacacccgcaccaaaggggaaacauucaaaggaga

SEQ ID NO: 320085 - RNA, 64 nt, Human
agagaaaauguaaaggagggagaucuuucccaggccgcaccauuucugucacucacauggaccc

SEQ ID NO: 320086 - RNA, 64 nt, Human
uccacaccugcccaccucaccucacugcaccgcaccgcaccagagccagagcagcugcuugucu

SEQ ID NO: 320087 - RNA, 64 nt, Human
aucgcguuccaggguuuugauguggugggaugauccgcaccaucuucacugaugugcuucccuu

SEQ ID NO: 320088 - RNA, 64 nt, Human
cuugggaggggucccaguggggcaggccccucugucuggccaccccucuguccuggccccggaa

SEQ ID NO: 320089 - RNA, 55 nt, Human
ccgaggacugugacacauagcccauucuggccaccagagcccacuuggccccacc

SEQ ID NO: 320090 - RNA, 64 nt, Human
auuugccaccuaaacgaucaguguggugcugcguucuggccaguaaauuccauguuuuuggcua

SEQ ID NO: 320091 - RNA, 64 nt, Human
cagcugcccugagcuucaggcagcaguguuuaucucuggccaguugucugguuuccauguauuc

SEQ ID NO: 320092 - RNA, 64 nt, Human
gggacaguugacauuucugguccuacaggcccuuucuggccagggaggcauugcugcaggugag

SEQ ID NO: 320093 - RNA, 64 nt, Human
gcccacagugggggcugcaaaugcugccacugccucuggccauuuaaagugagaggggcaccaa

SEQ ID NO: 320094 - RNA, 64 nt, Human
ggucuuggccauggggacgcccucagucuagggaucuggccacagacucccuccugugaaccaa

SEQ ID NO: 320095 - RNA, 64 nt, Human
uugguuguggugcgaggcggcugcccuggugggcucuggccauggcgcucugugccugcggccg

SEQ ID NO: 320096 - RNA, 64 nt, Human
aacucagcauccaggacaacaauguggaccugauucuggccacaccccccuucagccgccugga

SEQ ID NO: 320097 - RNA, 64 nt, Human
acauaauuuguuuaggcucccacauaaaugugaaucuggccaacaacuuugguucauccuuuag

SEQ ID NO: 320098 - RNA, 64 nt, Human
gcuuucucaucaucacucuauaccaauacuuauuucuggccaaaugaaucugcuucucugcccc

SEQ ID NO: 320099 - RNA, 64 nt, Human
accuagcaauaggcauagcuacguggcacuauauucuggccagacucgauguguacucuaacuu

SEQ ID NO: 320100 - RNA, 64 nt, Human
acucacauuggaaaaacccucugagcugaauaauucuggccauuccugcugucaacaauacugc

SEQ ID NO: 320101 - RNA, 64 nt, Human
caaccccaggaauaagaacuccauuucaaacaguucuggccauucugagccugcuuuugugauu

SEQ ID NO: 320102 - RNA, 64 nt, Human
ucccaaccccagcuacucugaucccucugggggcucuggccaagggccagacagaccuucacag

SEQ ID NO: 320103 - RNA, 64 nt, Human
gccuaucaggaagccucuaaaaugggguguaggaucuggccagaaacacuguaggaguaguaag

SEQ ID NO: 320104 - RNA, 64 nt, Human
cugauauugaagaaccuggagaggauccuucaguucuggccauuccagggacccuccagaaaca

SEQ ID NO: 320105 - RNA, 64 nt, Human
uuaacuccuagcccagccuagcgugcccugccccucuggccacugcugcagacaccugccuuaa

SEQ ID NO: 320106 - RNA, 64 nt, Human
gggcggaucacuugaggucaggaguucaagaccaucuggccaacauggugaaacccugucucua

SEQ ID NO: 320107 - RNA, 64 nt, Human
ucaaggccugucagaaggcucugguaggccuuccucuggccaggagacuccagcagggaaugcc

SEQ ID NO: 320108 - RNA, 64 nt, Human
uugcugauuaaaucagugcuguuuuuacaccacuucuggccaacucagaauaauuuagauuguu

SEQ ID NO: 320109 - RNA, 64 nt, Human
gggugcagggucagggcucccgcaggggccugcaucuggccagcaggacacagggaugcgcagg

SEQ ID NO: 320110 - RNA, 64 nt, Human
uccaaacuuggccuagcaucccuccuggccccccucuggccacgacuuggccugugccugguuc

SEQ ID NO: 320111 - RNA, 64 nt, Human
ugacagccagccuggaagaccgcuuggcagcccuucuggccacggcuguuucuucuuugugcuu

SEQ ID NO: 320112 - RNA, 64 nt, Human
uggaacugcaucagugacugaauucugccuugguucuggccaccccagagugggagaggcuggg

SEQ ID NO: 320113 - RNA, 64 nt, Human
agagcaaguggagcagggcuuagcaggagcaguuucuggccagaagcaccagccugcugccagc

SEQ ID NO: 320114 - RNA, 64 nt, Human
aaagccucucauaggcacuggggacccugcacagucuggccaugugacccucuccccaggcaag

SEQ ID NO: 320115 - RNA, 64 nt, Human
cugugaacuuguggccugaagagccagagcuagcucuggccaccagcugggcgacgucacccug

SEQ ID NO: 320116 - RNA, 64 nt, Human
guuucacaaucuguugucuccagcucugcauaugucuggccagggggcuucuaggaaguagguu

SEQ ID NO: 320117 - RNA, 64 nt, Human
aaagaagggagagccggggaggauagggcaggagucuggccaggagcccaaggucaagucuggc

SEQ ID NO: 320118 - RNA, 64 nt, Human; identical to SEQ ID NO: 262673

SEQ ID NO: 320119 - RNA, 64 nt, Human
cuuuuuguuuaauaccuuccccaagaggggacagucuggccaacuugcuccaguaaugcaauaa

SEQ ID NO: 320120 - RNA, 64 nt, Human
ggccuggauagacugccugcguccuuaccacugaucuggccaagaaugaggcccucccaacacu

SEQ ID NO: 320121 - RNA, 64 nt, Human
cuugauuuugcacaguguaacagcgcaguugcauucuggccacuuugaccuuauagcucccaaa

SEQ ID NO: 320122 - RNA, 64 nt, Human
uguguaauauuuaaacuguucuguaaaauaagugucuggccauuugguaugauuucugugugug

SEQ ID NO: 320123 - RNA, 64 nt, Human
uagguaaaagucuugggaaauauuugggcauuggucuggccaagucuacaaugucccaauauca

SEQ ID NO: 320124 - RNA, 64 nt, Human
ccaaaguacugggauuuaggcaugagccaccacaucuggccaauaguuucuuuugaugugcaga

SEQ ID NO: 320125 - RNA, 64 nt, Human
ccgugacaacggugcccucagcagccugguguccucuggccauuugcugucauggcuacaaagu

SEQ ID NO: 320126 - RNA, 64 nt, Human
aagauguucuuauacccuugcuuucccauauuuuucuggccaagcaugccaucuccuuuacucu

SEQ ID NO: 320127 - RNA, 64 nt, Human
cuagucaucagucuuauuucaguaaaaccaucuuucuggccaaaucucuaacacguuuuuuacu

SEQ ID NO: 320128 - RNA, 64 nt, Human
cacaaggcuugggggcuggacucccucuacucccucuggccauagccccuccuggagauggggu

SEQ ID NO: 320129 - RNA, 64 nt, Human
gguccaucuugggcauuagguucuccagcagagcucuggccagcugccucuucuuuaacuggga

SEQ ID NO: 320130 - RNA, 64 nt, Human
uuuauccugcuuucuuugggauugcuaggcaaggucuggccaggccccccuuuuuucccccaag

SEQ ID NO: 320131 - RNA, 64 nt, Human
cagccuuaguuuuuggagucaaguguuaaagguuucuggccagaggaauuggggucuugccauc

SEQ ID NO: 320132 - RNA, 64 nt, Human
ggcggaucaccugaggucaggaguucgagauuagucuggccaacauggugaaaccccaucucua

SEQ ID NO: 320133 - RNA, 64 nt, Human
gagugcuacuucagaagccuuauaggauuuucuuucuggccaagauuuccuucuguaucacucc

SEQ ID NO: 320134 - RNA, 64 nt, Human; identical to SEQ ID NO: 262743

SEQ ID NO: 320135 - RNA, 64 nt, Human; identical to SEQ ID NO: 262744

SEQ ID NO: 320136 - RNA, 64 nt, Human; identical to SEQ ID NO: 262750

SEQ ID NO: 320137 - RNA, 64 nt, Human
aaaaaacuuucucccugcaucucauaccuuuaccucuggccaguuggccaccagggggaguggg

SEQ ID NO: 320138 - RNA, 64 nt, Human
aaagcauaacuucuaaaggaagcagaauagcuccucuggccagcaucgaauauaaguaagaugc

SEQ ID NO: 320139 - RNA, 64 nt, Human
ucccuggggccugcucccagccacugaggcccgcucuggccaggggagaaggagcugccgugcg

SEQ ID NO: 320140 - RNA, 64 nt, Human
gaccuccgagaaaugaccccguccugccccugacucuggccaucagaagaggccucuccauuaa

SEQ ID NO: 320141 - RNA, 64 nt, Human
ugaccagccaccccaucccuccccuacccaucugucuggccagaccuguucuccagagcucaau

SEQ ID NO: 320142 - RNA, 64 nt, Human
auaaauaagugauauaaaacauguaaagcuuaguucuggccacaguguagcuacucaauaaaug

SEQ ID NO: 320143 - RNA, 64 nt, Human
gccaagcugaagcugaagcugaagauucuucccaucuggccagccuugugugaaaaugccuucu

SEQ ID NO: 320144 - RNA, 64 nt, Human
gaggcagugcuugcauugcuuuguucgccuaucaucuggccacaugaggcugucaagcaaaaga

SEQ ID NO: 320145 - RNA, 64 nt, Human
gaggagggccggccagcauuugguggcccaucagucuggccaucugucacgucacagaagcaaa

SEQ ID NO: 320146 - RNA, 64 nt, Human
aagacugccuuccuuuuagaaaaaaaugcaauuuucuggccacaagggcauagugcaguucacu

SEQ ID NO: 320147 - RNA, 64 nt, Human
acagagcugguggauuaauuaauagucuucgauaucuggccauggguaaccucauuguaacuau

SEQ ID NO: 320148 - RNA, 64 nt, Human
gcuggccaggccccugcgugggcccaagcuggacucuggccacucccuggccaggcuuugggga

SEQ ID NO: 320149 - RNA, 64 nt, Human
ccucacaggugggugugaggcccccucuggaguuucuggccauucacuuacccacucucuucuc

SEQ ID NO: 320150 - RNA, 64 nt, Human
uggucaugggcuggucuggucgguuucccauuugucuggccagucucuaugugucuuaaucccu

SEQ ID NO: 320151 - RNA, 64 nt, Human
ccacccucaggugggcuggcuggcugacagaccuucuggccagacagacuccuaaccaaccaga

SEQ ID NO: 320152 - RNA, 64 nt, Human; identical to SEQ ID NO: 262677

SEQ ID NO: 320153 - RNA, 64 nt, Human; identical to SEQ ID NO: 262678

SEQ ID NO: 320154 - RNA, 64 nt, Human; identical to SEQ ID NO: 262679

SEQ ID NO: 320155 - RNA, 64 nt, Human
acaguauuccugccgaggcugacuuccuacuuggucuggccacugucccaggcuauguauccuu

SEQ ID NO: 320156 - RNA, 64 nt, Human
uuuccuagauccuagaagacaguaugauauuuucucuggccaguugcauaauaacugcaaaaug

SEQ ID NO: 320157 - RNA, 63 nt, Human
uguacagacggucugucugauaagagcucucacucuggccaaggagcucugaauugugagucu

SEQ ID NO: 320158 - RNA, 64 nt, Human
gagaccuccaacauacuugucugaagguggugauucuggccauggccccucugccaagccugug

SEQ ID NO: 320159 - RNA, 64 nt, Human
uagcaucacugugugucuuagcaggcaggcagugucuggccauuauugcguucuacagccagag

SEQ ID NO: 320160 - RNA, 64 nt, Human
cugugggccaggccugccaugacugcgucucggcucuggccaugagcucugcccaggcccacaa

SEQ ID NO: 320161 - RNA, 64 nt, Human
cuugugaacacuucaaacaucgcuaagcauuugaucuggccauguauaugguagcuguguuuua

SEQ ID NO: 320162 - RNA, 64 nt, Human
uacacagaguuugguaugauauuuaaauacaucaucuggccaggcaugguggcuuacgccugua

SEQ ID NO: 320163 - RNA, 64 nt, Human
cugccaucauuucucuccucuagagucccuggcuucuggccacugccuccucccucuucuaagc

SEQ ID NO: 320164 - RNA, 64 nt, Human
uacauauuggaaugaagucccuaugagagccauuucuggccauguucuauaccucaaagugagg

SEQ ID NO: 320165 - RNA, 64 nt, Human
gggcuguuccccuccccuaaaguuaaucucuuggucuggccaaguugcugcucccucaaccuuc

SEQ ID NO: 320166 - RNA, 64 nt, Human
cuggggcccuggacuccucaccucgcgcucugccucuggccagaguuccaggguggaggaagga

SEQ ID NO: 320167 - RNA, 64 nt, Human
ucaguggcucuucaggggacaggaaaugccugugucuggccagugugguucuggagcuuugggg

SEQ ID NO: 320168 - RNA, 64 nt, Human
ccugguuguggggaccaggucugugggccucaggucuggccagccagggcuggugcuguccccg

SEQ ID NO: 320169 - RNA, 64 nt, Human
cuaaauucucaauuaaaaagaaguguauccuuaaucuggccaacugaaagugaacuuguucauu

SEQ ID NO: 320170 - RNA, 64 nt, Human; identical to SEQ ID NO: 262727

SEQ ID NO: 320171 - RNA, 64 nt, Human; identical to SEQ ID NO: 262728

SEQ ID NO: 320172 - RNA, 64 nt, Human; identical to SEQ ID NO: 262752

SEQ ID NO: 320173 - RNA, 64 nt, Human
gaauuaagaagaacauaaauuuugagcuaguaacucuggccaaauaaauacacucaaguuuuua

SEQ ID NO: 320174 - RNA, 64 nt, Human
ugaggcccacgagucuuuccagcucuuccuccauucuggccagucccugcauccucccuggggu

SEQ ID NO: 320175 - RNA, 64 nt, Human
uuugcaaggggaaaucaagcugggagaaucuuuuucuggccaccugugggguagguugucaaac

SEQ ID NO: 320176 - RNA, 64 nt, Human
ugggggccagggauucccuuucccacucugaggcucuggccagagggagagaggacucuggacc

SEQ ID NO: 320177 - RNA, 64 nt, Human
ggcagaucauuugaggccaggaguucaagaccagucuggccaauauggagaaaccuugucucua

SEQ ID NO: 320178 - RNA, 64 nt, Human
ggacuaggaaaaguguguggucuguggggcggacucuggccaucauguugacagccuugcacuu

SEQ ID NO: 320179 - RNA, 64 nt, Human
aaccauauguguuuucugcaguuauuucucuuguucuggccaaacaacccuaaaaauccuuacc

SEQ ID NO: 320180 - RNA, 64 nt, Human
uguggacugcagcccacuaugauguuauuacuucucuggccaggccuccaguggaagugcacag

SEQ ID NO: 320181 - RNA, 64 nt, Human
uggauauuauucagaccuuaguacagcaagacacucuggccaccauaaaaaacgcagaaaagaa

SEQ ID NO: 320182 - RNA, 64 nt, Human
ugcucacagagcaccccaguuccucaccagcuacucuggccauauaucccacaccagaaggaac

SEQ ID NO: 320183 - RNA, 64 nt, Human
acugggggacacuguggcagcaggagggacucugucuggccagggaggagccccaguggugaga

SEQ ID NO: 320184 - RNA, 64 nt, Human
augcuccccaucgccugcuugcucuccagccgagucuggccaauuugccauggggaggcugcag

SEQ ID NO: 320185 - RNA, 64 nt, Human
uugcuuccuuuuuugaccagcaggaaacagcaggucuggccagauucucacuugcccaucaauc

SEQ ID NO: 320186 - RNA, 64 nt, Human
ugguuugugguccgagauccuguacuaaggagggucuggccagaggaacagaccagcuuuugca

SEQ ID NO: 320187 - RNA, 64 nt, Human
ccggcuguccuucuguccugcugcagacuaaaggucuggccaaugucuugccccaccccgccag

SEQ ID NO: 320188 - RNA, 64 nt, Human; identical to SEQ ID NO: 262682

SEQ ID NO: 320189 - RNA, 64 nt, Human; identical to SEQ ID NO: 262686

SEQ ID NO: 320190 - RNA, 64 nt, Human; identical to SEQ ID NO: 262687

SEQ ID NO: 320191 - RNA, 64 nt, Human
gagcaagggcugagggaagccaucaccuaacaccucuggccacccaggaccaggucuguguggg

SEQ ID NO: 320192 - RNA, 64 nt, Human
gcucuaaaguacugacuuuucagcaaauuuccuuucuggccaagcccucugaguuugaaauucu

SEQ ID NO: 320193 - RNA, 54 nt, Human
ucguccccgacaucuucugagcccucuggccagcacgccuguccucccccgggg

SEQ ID NO: 320194 - RNA, 64 nt, Human
gcaagcaacacagaggaauuuauaccucaaacuaucuggccauauuuacuaccuuaucacugca

SEQ ID NO: 320195 - RNA, 64 nt, Human
cuggauguggaguuuaauaaauuaccuacuaucaucuggccacuuagauuauuaucacaccacu

SEQ ID NO: 320196 - RNA, 64 nt, Human
ucuucacaaacuagccagugacaugugggacagcucuggccagggcucugggacugcaguguac

SEQ ID NO: 320197 - RNA, 64 nt, Human
gcuuuccagguugccagucccugcacucuuccuuucuggccaaggaugaugucaguucugcugc

SEQ ID NO: 320198 - RNA, 64 nt, Human
uuuaagguugccauugguugaaaacauaagugucucuggccaucaaagugaucuuguuuacagc

SEQ ID NO: 320199 - RNA, 64 nt, Human
ugcugccagcuaauaagaagugccaaguggacagucuggccacugucaaggcagggaaggggcc

SEQ ID NO: 320200 - RNA, 64 nt, Human
cuggaagccuuccuggauuucacgcaucccauccucuggccagaaauggccuccgaacugugca

SEQ ID NO: 320201 - RNA, 64 nt, Human
cucuaacacuuaaaaaaaaacccagaucagaagaucuggccaugcuggggcucacauucucacc

SEQ ID NO: 320202 - RNA, 64 nt, Human
ugagugcuuggcuuuccaaggauacugcggagacucuggccaagcugaugaccuucugaagugu

SEQ ID NO: 320203 - RNA, 64 nt, Human
agagccagggacaugaugcaggcgaagcuugggaucuggccaaguuggacuuugauccuuuggg

SEQ ID NO: 320204 - RNA, 64 nt, Human
aguugcacauauugagaaccuaaugcacucugggucuggccagggcuuccucaaauacaugcac

SEQ ID NO: 320205 - RNA, 64 nt, Human
augcugccaggauaauuucugcuugccaugggcaucuggccaccaaggaauuucgcacccugac

SEQ ID NO: 320206 - RNA, 64 nt, Human; identical to SEQ ID NO: 262674

SEQ ID NO: 320207 - RNA, 64 nt, Human; identical to SEQ ID NO: 262675

SEQ ID NO: 320208 - RNA, 50 nt, Human; identical to SEQ ID NO: 262688

SEQ ID NO: 320209 - RNA, 64 nt, Human
gcuguuugguaacguaacguuuccaaacauuuugucuggccaauggguucuauagaaaaguccg

SEQ ID NO: 320210 - RNA, 64 nt, Human
gagaaguaggauuaguuaggggcagaucuugaauucuggccaagaaacugauauuuaacccaua

SEQ ID NO: 320211 - RNA, 64 nt, Human
agacgggcaccaggaucaagcucaucgacuuuggucuggccaggaggcuggguaaggcucaucu

SEQ ID NO: 320212 - RNA, 64 nt, Human
cucugaagagaacucucucuucccacuaagugagucuggccaaaauguaaaccccacccucccu

SEQ ID NO: 320213 - RNA, 64 nt, Human
auugagaugaaaguuaacauagugugaaugaaagucuggccaacagagcaguagaugauauaac

SEQ ID NO: 320214 - RNA, 64 nt, Human
cauuuugaaaaagaaaaaaaguacacauucagaaucuggccaauuuaaguuuguauuuuaaaaa

SEQ ID NO: 320215 - RNA, 64 nt, Human
uaucugaggaagucuagguaguuuuccuuuuggaucuggccauuggugcguguuucauucagau

SEQ ID NO: 320216 - RNA, 64 nt, Human
cccuuuuaaauuuuuaauuaauuucaaagcuuccucuggccagguagacuuuuguauacagacc

SEQ ID NO: 320217 - RNA, 64 nt, Human
gcauccuggggcccagagccaggugauaggucccucuggccaacuggacaguugaggccugugg

SEQ ID NO: 320218 - RNA, 64 nt, Human
aaaauuaaaauaccaugguaauauuugcaaaaggucuggccauaccagaaaaguacaguugaga

SEQ ID NO: 320219 - RNA, 64 nt, Human
cucucucccacuucuucuccccucccccaccgcaucuggccagauggacuguccuacagcaauc

SEQ ID NO: 320220 - RNA, 64 nt, Human
gagcuccuguuuuacaccacuguguaucucuauuucuggccaucacuuuuuuaauacacaugac

SEQ ID NO: 320221 - RNA, 64 nt, Human
ucagccucugauuggccaugggccagaccugcacucuggccaaugauugguucauuccaggaca

SEQ ID NO: 320222 - RNA, 64 nt, Human
uccuuuggggcuugggcagggccgugacacagguucuggccaaugauuugcaagaggaauugau

SEQ ID NO: 320223 - RNA, 64 nt, Human
uagcaaaccacgcugucuuacagugguacuuucuucuggccacugcacuguagauaauucauug

SEQ ID NO: 320224 - RNA, 64 nt, Human; identical to SEQ ID NO: 76461

SEQ ID NO: 320225 - RNA, 64 nt, Human; identical to SEQ ID NO: 76462

SEQ ID NO: 320226 - RNA, 64 nt, Human
aaaaugcaaccacagugcauguugcagauaccggcggccgcaggaggggcagcauccaguagag

SEQ ID NO: 320227 - RNA, 64 nt, Human
cccggugcccacccugcugguaggagccagcggcucuggccaagugcacgagggucucuguguu

SEQ ID NO: 320228 - RNA, 64 nt, Human
cugcgucuggacaagccucauggggacuggggauucuggccaguguaauuucugucaaccacgg

SEQ ID NO: 320229 - RNA, 64 nt, Human
guguguaaaagcacaaagugcauguguacucacuucuggccauauaacauuuacacagggaaau

SEQ ID NO: 320230 - RNA, 64 nt, Human
aaaaagacacggcgcuggcaagugauaggaacauucuggccagagguuaaagagcaggcugaca

SEQ ID NO: 320231 - RNA, 57 nt, Human
augugguugacuguaugugauuugaguucuggccaccaacaauuuagucauaucuga

SEQ ID NO: 320232 - RNA, 64 nt, Human
caugaucuuuuuucugucuaguacuuguuuucauucuggccagcaguucuacauuaaaucaccu

SEQ ID NO: 320233 - RNA, 64 nt, Human
gacugucgugacucacgcuacuugggaaacucacucuggccacuccuccucugguggcaugagc

SEQ ID NO: 320234 - RNA, 64 nt, Human
cuuucaaagaugauuuuuacuuaaagauauuaggucuggccaggcgaagugacucacaccugca

SEQ ID NO: 320235 - RNA, 64 nt, Human
ggaggaucaccugaggucaggaguuugagaccagucuggccaaaauaguggaaccccgucgcua

SEQ ID NO: 320236 - RNA, 64 nt, Human
ugucccgggaaggcccaggcugagaggcccuggcucuggccaggcugggaucugggugggaggc

SEQ ID NO: 320237 - RNA, 64 nt, Human
uccagagccuguuagcccguggcuacggucaggcucuggccagggcagagggcugcccagggcc

SEQ ID NO: 320238 - RNA, 64 nt, Human
auauaguuugaauuauauauaaauuaccccuucuucuggccaccccugcucccaucuuaguauu

SEQ ID NO: 320239 - RNA, 64 nt, Human
aaaaacacugaacauauaaccaucagacuauaauucuggccauguuuuucaucauuugaucugg

SEQ ID NO: 320240 - RNA, 64 nt, Human
uuugcucuauuugcugacaugcuuccuguuguggucuggccaaugccaaauguacucgaaugau

SEQ ID NO: 320241 - RNA, 64 nt, Human
aauguccagaaauaaccagugagaggggcaguucucuggccacacccacuuauguacuuuaacu

SEQ ID NO: 320242 - RNA, 64 nt, Human
gcaaccccuacuggauggcaccugagaugaucaacggccgcagcuaugaugagaagguggaugu

SEQ ID NO: 320243 - RNA, 64 nt, Human
ucacuagcgccugaggcugagguggugcucccugcggccgcacuaaaaccucuuuccaaacggu

SEQ ID NO: 320244 - RNA, 56 nt, Human; identical to SEQ ID NO: 262753

SEQ ID NO: 320245 - RNA, 64 nt, Human
uaaugaguuuuauccaagaccuuacaaccacauuucuggccauuuaacuagcacuuuauaagcc

SEQ ID NO: 320246 - RNA, 64 nt, Human
cuacccuugccaaggccgcccaccugcaucagccucuggccagacggcccgccgugccugcauu

SEQ ID NO: 320247 - RNA, 64 nt, Human
gggucucacuggccccaagucucccacccagaacucuggccaaaaauggcucucuaggugggcu

SEQ ID NO: 320248 - RNA, 64 nt, Human
ucaggaggccagccugccaugagagcacauguccucuggccaggaguaguggcugagcucugug

SEQ ID NO: 320249 - RNA, 64 nt, Human
uugcugugccugacggaugggcuguagaauggggucuggccaccuggccugcugggaaacagca

SEQ ID NO: 320250 - RNA, 64 nt, Human
cagggagcagcccugugucgggggcuggaauaguucuggccagaccccguuccccuuccucuau

SEQ ID NO: 320251 - RNA, 64 nt, Human
uaaucuuuaagucagaaccuaauuguacaguggcucuggccaucuuuuccucauguggaagaau

SEQ ID NO: 320252 - RNA, 64 nt, Human
cuuccagaguuagcuuuuggacaguuaccuucuuucuggccaucuugacuucugccccacaucu

SEQ ID NO: 320253 - RNA, 64 nt, Human
uuuucaauuuagcagccuuucaaauguauaugguucuggccacauuaaaguugcaaauaacacu

SEQ ID NO: 320254 - RNA, 64 nt, Human
ccaugggggagcucacccaccccacaauuccuccucuggccacaucuccuguggucucugacca

SEQ ID NO: 320255 - RNA, 64 nt, Human
acaucuggaaucuggagaccagggagccuuugguucuggccagaaugcugcaggacuugagaag

SEQ ID NO: 320256 - RNA, 64 nt, Human
uaaaagaaagauauuuuucuauuuauuuucuacaucuggccaguggcucuggugcuagaugcca

SEQ ID NO: 320257 - RNA, 64 nt, Human
cagggcccccuggcaccuggcucuggccguguuuucuggccagaggcccccacuuuccuaacuc

SEQ ID NO: 320258 - RNA, 64 nt, Human
uuuucauuugccucuaauuuugcuugcucauauuucuggccaauguacagccucauauuuuuca

SEQ ID NO: 320259 - RNA, 64 nt, Human
gaaacucagagcaacaguucagagguggcguaaaucuggccaccuggagagcucgagugccacc

SEQ ID NO: 320260 - RNA, 64 nt, Human; identical to SEQ ID NO: 76437

SEQ ID NO: 320261 - RNA, 64 nt, Human; identical to SEQ ID NO: 76438

SEQ ID NO: 320262 - RNA, 64 nt, Human; identical to SEQ ID NO: 76439

SEQ ID NO: 320263 - RNA, 64 nt, Human
aaauauuuuuguuuuaccaagaaacugaaauaauucuggccaggaauaaauacuuccugaacau

SEQ ID NO: 320264 - RNA, 64 nt, Human
gguggaucacucaaggucacaaguuugagaccagucuggccaacauggugaaaccccaucucua

SEQ ID NO: 320265 - RNA, 64 nt, Human
accccaacuugacuuucaagaacacauuucaagcucuggccagagucccguuccucaaauucau

SEQ ID NO: 320266 - RNA, 64 nt, Human
ugggcagaucacaaguucaagagaucgagaccauucuggccaacauggugaaaccccgucucua

SEQ ID NO: 320267 - RNA, 64 nt, Human
ugugagcacggucuugaucaaacucgcccuucugucuggccagcugcccacgaccuacggugua

SEQ ID NO: 320268 - RNA, 64 nt, Human
aaagacucccuauucgaaaauuagugcuggaauaucuggccaaccauaugcagaagaaugaaac

SEQ ID NO: 320269 - RNA, 64 nt, Human
ucaaauuuuuauuuuaaaaauuauaaugcaaacaucuggccaucaccuuaaccaagugacaaag

SEQ ID NO: 320270 - RNA, 64 nt, Human
gugccugcuuuuaggucauccaaccucuuuccucucuggccacucugcucugcacauuagaggg

SEQ ID NO: 320271 - RNA, 64 nt, Human
ccugggaucuugagauacccaggaagggaggcugucuggccagccucucccugccuccacuugc

SEQ ID NO: 320272 - RNA, 64 nt, Human
uuggcuuuuuccuuguuugguugaucuuccccauucuggccagagcagggcuggagggaaggag

SEQ ID NO: 320273 - RNA, 64 nt, Human
gaucaucugccccaugagugggauagauggguuuucuggccauguugggaaucauggucauucc

SEQ ID NO: 320274 - RNA, 64 nt, Human
uuuagcuuugacuuugggcaagucucuguacuuuucuggccagcuuuuccaggauuuauaaaau

SEQ ID NO: 320275 - RNA, 64 nt, Human
gcagggggacagggaaaauggagcccaaguagccucuggccagggacccaaugucccgaggaau

SEQ ID NO: 320276 - RNA, 64 nt, Human
uucuauugcugucccuacaauauauaaggugacuucuggccaugcugcccugccauuggcggcu

SEQ ID NO: 320277 - RNA, 64 nt, Human
uuggcuggugggaaaugcguaacuggucagugugucuggccagcguggcuguggcacuuggcca

SEQ ID NO: 320278 - RNA, 64 nt, Human; identical to SEQ ID NO: 76442

SEQ ID NO: 320279 - RNA, 64 nt, Human; identical to SEQ ID NO: 76443

SEQ ID NO: 320280 - RNA, 64 nt, Human; identical to SEQ ID NO: 76444

SEQ ID NO: 320281 - RNA, 64 nt, Human
gaagauacugaaucaucaugaaaugaacucuacuucuggccaaagcacaauguauuugcaguuu

SEQ ID NO: 320282 - RNA, 64 nt, Human
acaaagaagaaaggaaaccucauuacucaauccuucuggccaagagugucuugcuuguggcgcc

SEQ ID NO: 320283 - RNA, 64 nt, Human
cacgcagaagggccccuuaaaaguuucucuuucaucuggccaguuuuagauacacaauuuuguc

SEQ ID NO: 320284 - RNA, 64 nt, Human
ccgaggaccggaacacguuucugcgacccggggcucuggccagcacuguguucugcguuugguc

SEQ ID NO: 320285 - RNA, 64 nt, Human
ucuacauugaaaauguuaauauuauuuauggaccucuggccaaaugguacauguacuggaagug

SEQ ID NO: 320286 - RNA, 64 nt, Human
agcccccgagggauguccuuggggaggggucagcucuggccacaauccuccccaccagucucac

SEQ ID NO: 320287 - RNA, 64 nt, Human
ucugccuugagucaucuauucaagcacuuacagcucuggccacaacagggcauuuuacaggugc

SEQ ID NO: 320288 - RNA, 64 nt, Human
uccccggcagcuuuccugggggacuagagcuccuucuggccauguuauaugaaauguaauucuu

SEQ ID NO: 320289 - RNA, 64 nt, Human
aauucuugggccuccaauaagugucccauaggugucuggccaggcccaccugcugcggaugugg

SEQ ID NO: 320290 - RNA, 64 nt, Human
ccauucucaaaugccaguguguucacaucuucgcucuggccagcccauucuguauuuaaagcuu

SEQ ID NO: 320291 - RNA, 64 nt, Human
caggggugggucauuugagaggaguuccagcuguucuggccacacugggcugguggggaaggag

SEQ ID NO: 320292 - RNA, 64 nt, Human
gucugagcgcagggcuugaauuguuagucccaacucuggccaaagauacuuuuuuccagagaca

SEQ ID NO: 320293 - RNA, 64 nt, Human
ucccaagaaaaucacaucacuaccuagagucaacucuggccaggaacucuaagguacacacuuu

SEQ ID NO: 320294 - RNA, 64 nt, Human
uuuuucacaaugugaguaguuuugaaaagucagaucuggccauuugucuuuccuagaauagcau

SEQ ID NO: 320295 - RNA, 64 nt, Human
cagaugucugcaggcauuugcccaucccagccucucuggccagggccuuacugggcccagagca

SEQ ID NO: 320296 - RNA, 64 nt, Human; identical to SEQ ID NO: 76445

SEQ ID NO: 320297 - RNA, 64 nt, Human; identical to SEQ ID NO: 76446

SEQ ID NO: 320298 - RNA, 64 nt, Human; identical to SEQ ID NO: 76448

SEQ ID NO: 320299 - RNA, 64 nt, Human
auguucugugugcugugacgacugucaaagaguaucuggccauggcggacacucagcauuuguu

SEQ ID NO: 320300 - RNA, 64 nt, Human
uuauaaucaugcauauaaccuuuacuuugauggaucuggccagagggguguuggagcccagccc

SEQ ID NO: 320301 - RNA, 64 nt, Human
ugguauaggaauuuggagaggugcauuauuucuuucuggccacugggguuaaauuuaguguacu

SEQ ID NO: 320302 - RNA, 64 nt, Human
uagaaaguuaaccccauguccucagcauuucuuuucuggccaaaagcaguaaauuugcuagcag

SEQ ID NO: 320303 - RNA, 64 nt, Human
gugcuucacaagaggcagucccaugggaggugggucuggccaauggagaugggacaggaaauuu

SEQ ID NO: 320304 - RNA, 64 nt, Human
uacccucuuuggucucauguccuacaaucugcauucuggccauaauggucuucucugcuguucc

SEQ ID NO: 320305 - RNA, 64 nt, Human
aagaggagcccccacugccugcggggcagugaugucuggccaccggcucacaccaaugacuugg

SEQ ID NO: 320306 - RNA, 64 nt, Human
gguguaucacuugaggucaggaguucaagaccaaucuggccaacauggugaaaccccaucucua

SEQ ID NO: 320307 - RNA, 64 nt, Human
acgagauggcucuuguucagucaagaccccagacucuggccacaaaaaugccauaaugccuguu

SEQ ID NO: 320308 - RNA, 64 nt, Human
auacuugcaacucuuuuugaauccauacaggucgucuggccaaugauucuuuuacuuaccuauc

SEQ ID NO: 320309 - RNA, 64 nt, Human
ccuccagggcuucucugugugucuugguugcugcucuggccagggaggcagccccacucccagc

SEQ ID NO: 320310 - RNA, 64 nt, Human
ccuagaaacaguaagaaagaaacguuuucaugcuucuggccaggaauccugggucugcaacuuu

SEQ ID NO: 320311 - RNA, 64 nt, Human
ggggcccagggccugccuugcacguugcagccucucuggccauugcagagcugcuggccuccug

SEQ ID NO: 320312 - RNA, 64 nt, Human
ggaagaugguccugggauucgaacaccgcugggaucuggccagggugcucccugggauucacag

SEQ ID NO: 320313 - RNA, 64 nt, Human
cacagcucuggauuucuacccccuugcuauccucucuggccauuuugaaccuguaccaccuaau

SEQ ID NO: 320314 - RNA, 64 nt, Human; identical to SEQ ID NO: 76452

SEQ ID NO: 320315 - RNA, 64 nt, Human; identical to SEQ ID NO: 76453

SEQ ID NO: 320316 - RNA, 64 nt, Human; identical to SEQ ID NO: 76454

SEQ ID NO: 320317 - RNA, 64 nt, Human
aagcagugagcagaaucuccgggaaaugacuuagucuggccacaugcauagcccaucuucauaa

SEQ ID NO: 320318 - RNA, 64 nt, Human
gguugguuuuuacauguguaaagaagguggggucucuggccaugucauagcccaugucuugugc

SEQ ID NO: 320319 - RNA, 64 nt, Human
agugccuccugcuguuuccuccuuugugguagccucuggccaucuggaccucaauccccagcuu

SEQ ID NO: 320320 - RNA, 64 nt, Human
uuguuuuacaacuguguuuucauuuuuucaaaugucuggccauuuagcaaaguuauuuacuauu

SEQ ID NO: 320321 - RNA, 57 nt, Human
aggagcucagcagaaaguaggcugggcucuggccauccuuuccugccucugugcccc

SEQ ID NO: 320322 - RNA, 64 nt, Human
gagaccagaacuugcagccccucugcagaucuccucuggccacugcagccccuccaaugggcuu

SEQ ID NO: 320323 - RNA, 64 nt, Human
uguaacccuugaauuucuagacaguauugccaccucuggccaaauaugcacuuucccuagaaag

SEQ ID NO: 320324 - RNA, 64 nt, Human
agaaaaggauuuuuaaaauuagauuaguauaauaucuggccauagagugauaagaacaauauga

SEQ ID NO: 320325 - RNA, 64 nt, Human
auuucuuuagccucagauagaaggaccuuuaugaucuggccauauucugaaauagcuucaaucc

SEQ ID NO: 320326 - RNA, 64 nt, Human
gugcccuaaauuucuggaugagaaaauuuucaauucuggccaugagaaagaaaaaaaaauaaac

SEQ ID NO: 320327 - RNA, 64 nt, Human
gcuggaucaccugaggacaggaguucgagaccagucuggccaacauggggaaaccccgucucua

SEQ ID NO: 320328 - RNA, 52 nt, Human
ccauuucuaucguccgcugaccucuggccacaggaagccagguccaccgccc

SEQ ID NO: 320329 - RNA, 64 nt, Human
ucaaaaacacuugagaagacaucuauuggccaucucuggccaauuacacuaagaaacauaucaa

SEQ ID NO: 320330 - RNA, 64 nt, Human
aauuucagucuuggugguucuaucaggggugcauucuggccaaggggugggccugugaaucaau

SEQ ID NO: 320331 - RNA, 52 nt, Human
acucggauaccucuaacuaaucucuggccacacuuuucccugagcuacaugc

SEQ ID NO: 320332 - RNA, 64 nt, Human; identical to SEQ ID NO: 76417

SEQ ID NO: 320333 - RNA, 64 nt, Human; identical to SEQ ID NO: 76418

SEQ ID NO: 320334 - RNA, 64 nt, Human
ccuggacuuagaccagugucugaggugguaacagcggccgcaggccaggguuggccuagaccug

SEQ ID NO: 320335 - RNA, 64 nt, Human
caggugggggcagcaggagggcagagggcagagcucuggccacuucugcccacuucauuagggu

SEQ ID NO: 320336 - RNA, 64 nt, Human
ugucuuuugggagaguacuuuucuccacgagcccucuggccacugugggagggaaggacaaggg

SEQ ID NO: 320337 - RNA, 64 nt, Human
agaagguaccagaaggaacccuccaguccugcucucuggccacaccugugcaggcagcugagag

SEQ ID NO: 320338 - RNA, 64 nt, Human
uaggccugcgggcccauccuuugugcccacccguucuggccacccugccuggacgccagcuguu

SEQ ID NO: 320339 - RNA, 64 nt, Human
cucucaguggaaagagcacgaggauguucucagcucuggccaauacuccauuucauaaaccaug

SEQ ID NO: 320340 - RNA, 64 nt, Human
caggcccuacugcucagggugaaugcagcuggucucuggccagugccuggugcucuggccccuc

SEQ ID NO: 320341 - RNA, 64 nt, Human
ucaaaugccacugcugcaaagcuuucuuugacccucuggccaccucccaagccagaaguuaucu

SEQ ID NO: 320342 - RNA, 64 nt, Human
ugcuaggcaggaaagaugccucuaaguucuugucucuggccagaggugugguauagaaccagaa

SEQ ID NO: 320343 - RNA, 64 nt, Human
gugugguuccuauuuauugaggaagaaagagcugucuggccaaaggaaaucuauuuuuucccuu

SEQ ID NO: 320344 - RNA, 64 nt, Human
caggcaagggaucagaugccccugacaccacgccucuggccacaccagaugccucugcaguccu

SEQ ID NO: 320345 - RNA, 64 nt, Human
aggucauuugagucuucacacaaauaauaaccuaucuggccaggagaauuaucucagaacagaa

SEQ ID NO: 320346 - RNA, 64 nt, Human
agccuccgcccagccgcuaggccagggaccaucuucuggccaaucaaggcuugcuggagugucu

SEQ ID NO: 320347 - RNA, 64 nt, Human
guugagaccugggcuucuuguagccccuucucccucuggccagcugcacagccugugggaggug

SEQ ID NO: 320348 - RNA, 64 nt, Human
acggcuacaucugggaccgccacuacaacaucugucuggccaggcugcggcacgaggauguggu

SEQ ID NO: 320349 - RNA, 64 nt, Human
aucuuggccugcaguaagcggugcugacggggacucuggccacagaggucaggccuccugaaaa

SEQ ID NO: 320350 - RNA, 64 nt, Human; identical to SEQ ID NO: 76458

SEQ ID NO: 320351 - RNA, 64 nt, Human; identical to SEQ ID NO: 76459

SEQ ID NO: 320352 - RNA, 64 nt, Human; identical to SEQ ID NO: 76460

SEQ ID NO: 320353 - RNA, 64 nt, Human
cagccagauggacuccagccugccuggcaggcugucuggccaggccucuuggcagucacaucuc

SEQ ID NO: 320354 - RNA, 64 nt, Human
aggcauaggccugggugcuggcugcccagaccccucuggccaggauggaggggugguccugacu

SEQ ID NO: 320355 - RNA, 64 nt, Human
auauaacaacaagacucuuuuuguacuaccauacucuggccaauaccagagcauaucagcagag

SEQ ID NO: 320356 - RNA, 64 nt, Human
ugcaauucucuaugacacagcuuuaaccuucuucucuggccaggacagucgcaaucuuuguuuu

SEQ ID NO: 320357 - RNA, 64 nt, Human
auuuacuuggacaacuucguagguagccuuaacuucuggccaaguuuguuuuuuauauaaauau

SEQ ID NO: 320358 - RNA, 64 nt, Human
auuuaauaaaaaccaaggagagccaccccugcuuucuggccaucucuucuuugucuaccauuuc

SEQ ID NO: 320359 - RNA, 64 nt, Human
gccaccuucucaguucuugugucuguuauuggagucuggccaggguugacuugagcugagacac

SEQ ID NO: 320360 - RNA, 64 nt, Human
ugggcagaucaugaggucaggagaucgagaccauucuggccaacauagugaaaccccaucucua

SEQ ID NO: 320361 - RNA, 64 nt, Human
gaggggacaaagaagcccuggcccggucagcggcucuggccauacagccuuccgacacacuccc

SEQ ID NO: 320362 - RNA, 64 nt, Human
gcugcccacucuguaaaugaagggcucaguggagucuggccaagcacagaggcugcugucagga

SEQ ID NO: 320363 - RNA, 64 nt, Human
cugcugcuuuucuacaauuggcagaucagguuugucuggccaacuaaggacaccaggaggguug

SEQ ID NO: 320364 - RNA, 64 nt, Human
ucauggacucgcccagcucuccucggccuggggcucuggccaaggaugggcuggaggucauuca

SEQ ID NO: 320365 - RNA, 64 nt, Human
gccacagccaccuccuuguauguuaccuuucagcucuggccaagagugggacaggguuuuaacc

SEQ ID NO: 320366 - RNA, 64 nt, Human
uagcuugagcugacagacuguuagaauacaguucucuggccacagcugaugagggcuuucugua

SEQ ID NO: 320367 - RNA, 64 nt, Human
caggcucccagggacaccugggagaaaucuggcuucuggccaggaagcuuuggugagaaccugg

SEQ ID NO: 320368 - RNA, 64 nt, Human; identical to SEQ ID NO: 76449

SEQ ID NO: 320369 - RNA, 64 nt, Human; identical to SEQ ID NO: 76450

SEQ ID NO: 320370 - RNA, 64 nt, Human; identical to SEQ ID NO: 76464

SEQ ID NO: 320371 - RNA, 64 nt, Human
cgcccacucuuacaggcccaggacuggagcuuucucuggccaaguuucaggccaaugauccccg

SEQ ID NO: 320372 - RNA, 61 nt, Human
ggaacagcuccguguacugaggccccgcagcucuggccacagggaccucugcagugccccc

SEQ ID NO: 320373 - RNA, 64 nt, Human
ugcaucauauuggacucuugaaggcaauccuuccucuggccaggaaauuuuuuaaaaaauaaua

SEQ ID NO: 320374 - RNA, 64 nt, Human
aggcuggcuaccagcuuugacacagcacuguucaucuggccaaacaacugugguuaaaaacaca

SEQ ID NO: 320375 - RNA, 64 nt, Human
accagguugcaguggcguaaggcccccugguuucucuggccacacuccaaggcaccacagugcu

SEQ ID NO: 320376 - RNA, 64 nt, Human
gcaggaagccuugcugccugggacauagagaucaucuggccaccccuagaggcagaugggcuga

SEQ ID NO: 320377 - RNA, 64 nt, Human
aucagaagacgugaaggcagauuuucauucuucuucuggccaaagcucaguacaagacacaugu

SEQ ID NO: 320378 - RNA, 64 nt, Human
cugcaccugccaggaccuaauguucuuaggucccucuggccagaacccacacccggccccuucc

SEQ ID NO: 320379 - RNA, 64 nt, Human
gcaggugacguguggaaagucuaggggguuccauucuggccaugcgagcccagcuccuaccaac

SEQ ID NO: 320380 - RNA, 64 nt, Human
gggaagggaagaacauuuguuuccaggaugacuuucuggccagaauaccggaaagcuuuuagga

SEQ ID NO: 320381 - RNA, 64 nt, Human
aguaccuaaagaucucugauccuaagaaguuacuucuggccaggcgcgguggcucaugccugua

SEQ ID NO: 320382 - RNA, 64 nt, Human
cugagaaauguggggucugaggaagccauuugagucuggccacuagacaucucaucagccacuu

SEQ ID NO: 320383 - RNA, 64 nt, Human
caaauaaaauucaaaucaauuucaaggaaaaacaucuggccagggguagcuugauuucgccccc

SEQ ID NO: 320384 - RNA, 64 nt, Human
cuccugucucagguggcccagcccugucagccugucuggccaacucagccuuugggcacucacc

SEQ ID NO: 320385 - RNA, 64 nt, Human
ccuaaagagcugccucccugcugccgagcccuggucuggccacgagccaccacugccucccgcu

SEQ ID NO: 320386 - RNA, 64 nt, Human; identical to SEQ ID NO: 76467

SEQ ID NO: 320387 - RNA, 64 nt, Human; identical to SEQ ID NO: 76468

SEQ ID NO: 320388 - RNA, 64 nt, Human; identical to SEQ ID NO: 76469

SEQ ID NO: 320389 - RNA, 64 nt, Human
gggacagggacucuagcagcaccucuguauccuuucuggccauuuggacaaaagcaguugcccc

SEQ ID NO: 320390 - RNA, 64 nt, Human
gugguuggagaacccagggggcugccuugggcccucuggccagagggaagcgggcagcucuagc

SEQ ID NO: 320391 - RNA, 64 nt, Human
gggcggugugacuggucauggcacuugcuggccuucuggccagagguccuccuggaagccccuc

SEQ ID NO: 320392 - RNA, 64 nt, Human
aaugaccacugccccugaucccccaccccuugccucuggccacccuguccuccccccaccaccc

SEQ ID NO: 320393 - RNA, 64 nt, Human
agguguguuguucggggacagccaccgccuugagucuggccaaggaggugauuaaacagcucag

SEQ ID NO: 320394 - RNA, 64 nt, Human
ccugcccaggccaccucccacagcccuccacuggucuggccagaugcacugggaacagagccac

SEQ ID NO: 320395 - RNA, 64 nt, Human
uugccuucacuuggaagccaccaggaacagaaggucuggccacccuggaaggagggcaggacau

SEQ ID NO: 320396 - RNA, 64 nt, Human
ugcugcucugcacagcaccggcugcugugaagacucuggccauggugacuggccauguguggca

SEQ ID NO: 320397 - RNA, 64 nt, Human
cucuagcccugcccccucccaggagcccagccccucuggccaggacugaggaggaguggaggga

SEQ ID NO: 320398 - RNA, 64 nt, Human
guagauaguguauuaguuaagacagcuuugucgaucuggccagauguuuuuucuccuuugucca

SEQ ID NO: 320399 - RNA, 51 nt, Human
aggaacugguaagaaaauaguucuggccagaaucaaagauucagcccuaca

SEQ ID NO: 320400 - RNA, 64 nt, Human
uucgaauuuucauuuucauuuacguucuuccccuucuggccaagauuugccagaggcaacauca

SEQ ID NO: 320401 - RNA, 64 nt, Human
uccuuuuauucuguaccuugcagccaugaccaguucuggccaggagcuggaggagcaggcagug

SEQ ID NO: 320402 - RNA, 64 nt, Human
cagcuuccuguguggcagcaccuggcacacuggcucuggccagcauuaugcuaaaacccuguua

SEQ ID NO: 320403 - RNA, 64 nt, Human
gcauuuccuacuccuuugcuacguguauuggaccucuggccaaauuacaaaagauguacucuuu

SEQ ID NO: 320404 - RNA, 64 nt, Human; identical to SEQ ID NO: 76411

SEQ ID NO: 320405 - RNA, 64 nt, Human; identical to SEQ ID NO: 76412

SEQ ID NO: 320406 - RNA, 64 nt, Human; identical to SEQ ID NO: 76470

SEQ ID NO: 320407 - RNA, 55 nt, Human
caaacucucagaaauccugaugacgucuggccacaauuaaggacucauuaacuga

SEQ ID NO: 320408 - RNA, 64 nt, Human
cuauaggaaaugaagcuucccugguccccuccuuucuggccauugucauccauuucccaguuag

SEQ ID NO: 320409 - RNA, 64 nt, Human
caaaauacagggauuacuggugugagccacugugucuggccagaaaaggcauuuuugagaaagc

SEQ ID NO: 320410 - RNA, 64 nt, Human
aaaauagugaaaaagagcagugguugugcucuuuucuggccaaugauuuacaaaagaaucuacu

SEQ ID NO: 320411 - RNA, 64 nt, Human
aagcccagauugugccaggucagcugucccuuccucuggccaccuuuccucccucugggucccu

SEQ ID NO: 320412 - RNA, 64 nt, Human
aggccuaggcgggcggucagggguucgagaccagucuggccaacaucgugaaacccugucucua

SEQ ID NO: 320413 - RNA, 64 nt, Human
gaucuaugucuugaaaauagagaaggaacacaggucuggccagggacgugcugcaauuggugca

SEQ ID NO: 320414 - RNA, 64 nt, Human
aggccuguggggagcacuggaggguuacugacucucuggccaugggaacucagagauucucauc

SEQ ID NO: 320415 - RNA, 64 nt, Human
auaucaguaucucacagucccauccuuccaaccuucuggccagagguuuuccugaugggugagu

SEQ ID NO: 320416 - RNA, 64 nt, Human
cagccucaugcauuccugcggcauguaugacuucucuggccaguuugccuuccacgugaguuuc

SEQ ID NO: 320417 - RNA, 64 nt, Human
cugguuuacgguuucuuauaacucuccuuugcucucuggccacuauuaaguggguuugccccau

SEQ ID NO: 320418 - RNA, 64 nt, Human
auggugcuauuuuguaguuuguuauaugaaagagucuggccaaaacgguaauacgugaaagcaa

SEQ ID NO: 320419 - RNA, 64 nt, Human
cacacuguuuuugagacacaguuguccaaauguuucuggccagcuccggccccuuuuuguauga

SEQ ID NO: 320420 - RNA, 64 nt, Human
gaccccuggggauggggaucuucagggaaggaacucuggccacccaaacaggacaagagcagcc

SEQ ID NO: 320421 - RNA, 64 nt, Human
guagagguccaacaacuacagccugugggccacaucuggccacagccugauuuguaaauaaagu

SEQ ID NO: 320422 - RNA, 64 nt, Human; identical to SEQ ID NO: 76472

SEQ ID NO: 320423 - RNA, 64 nt, Human; identical to SEQ ID NO: 76473

SEQ ID NO: 320424 - RNA, 64 nt, Human; identical to SEQ ID NO: 76474

SEQ ID NO: 320425 - RNA, 64 nt, Human
ugaaagaaauguuauguagauguucuuuagaagaucuggccauuugguacauaauccagcacag

SEQ ID NO: 320426 - RNA, 64 nt, Human
auuuuccgucucucccucuugccagcucugugagucuggccagggcggguagggagcguggagg

SEQ ID NO: 320427 - RNA, 64 nt, Human
uucuucccagccaauccuucugaugacaauguagucuggccaacaucuucacuggacucugacg

SEQ ID NO: 320428 - RNA, 64 nt, Human
guguuugcuacucagaugaggccgccccugaccuucuggccagagagacauugcugccagccag

SEQ ID NO: 320429 - RNA, 64 nt, Human
aacaagaaaacauuaaacuuauacaggaaaaaugucuggccauauguuaguuaguucgggaaug

SEQ ID NO: 320430 - RNA, 64 nt, Human
gccuggugcuccaggauguggcuucucaugaagcucuggccagaggaggggaacuuauuggggg

SEQ ID NO: 320431 - RNA, 64 nt, Human
acgugcucacacccagucagcuugggucccuaucucuggccagaguuuggcaggacugccauua

SEQ ID NO: 320432 - RNA, 64 nt, Human
aucaccauccaucuucaagaagcuacuuugaaagucuggccagugucuauucaggcccacuggg

SEQ ID NO: 320433 - RNA, 64 nt, Human
aaaagccuugcuguacaccuaguuguacagccacucuggccaauuccauuuccugucccucugu

SEQ ID NO: 320434 - RNA, 64 nt, Human
cacacacuggaaggaagagccaucguggucuuugucuggccacaggccaggcugcugggcaucc

SEQ ID NO: 320435 - RNA, 64 nt, Human
guggacgcgcugccucaacacuuguccagacaccucuggccagguuggacccgcacacuuacuu

SEQ ID NO: 320436 - RNA, 64 nt, Human
gacaaagcugcagagcacauuccaugccagacgcucuggccaggaagcugaggccgggcuugag

SEQ ID NO: 320437 - RNA, 64 nt, Human
cuugauacccacucucugugaauaccuacccccuucuggccacggugccauaccuguuucuucc

SEQ ID NO: 320438 - RNA, 64 nt, Human
agaagugcccacaugcuggcaggggccggcccacucuggccagccagauacugcuagauuguaa

SEQ ID NO: 320439 - RNA, 64 nt, Human
aggcuuccuagaaugaugcuaaaaauccacacauucuggccauagcaccagaaauguaccaacu

SEQ ID NO: 320440 - RNA, 64 nt, Human; identical to SEQ ID NO: 76475

SEQ ID NO: 320441 - RNA, 64 nt, Human; identical to SEQ ID NO: 76476

SEQ ID NO: 320442 - RNA, 59 nt, Human; identical to SEQ ID NO: 262690

SEQ ID NO: 320443 - RNA, 64 nt, Human
aagacucuaaaccugauuuuugccauggauuccuucuggccaagaaauuaaagcacaugugauc

SEQ ID NO: 320444 - RNA, 64 nt, Human
gaauggucagaugcuuagggggcauuugugcuccucuggccaggaaagggaacagaguccaucc

SEQ ID NO: 320445 - RNA, 64 nt, Human
ucucaucucuaagugccucauugaguucggugcaucuggccaaugagucugcugagacucuuga

SEQ ID NO: 320446 - RNA, 64 nt, Human
uggaggagucgcugggggcauuuucacccacaauucuggccauacuuaagcaaugggagggaga

SEQ ID NO: 320447 - RNA, 64 nt, Human
cugugcuaccuacugggugguggggagggaagcuucuggccaugcuugggcauucagaccaacc

SEQ ID NO: 320448 - RNA, 64 nt, Human
cuggaucagaccccaggaucagaccuuggggucuucuggccagagcuugucaccagccccaugg

SEQ ID NO: 320449 - RNA, 64 nt, Human
auuagcaucuaaugaaaaggacuguucaagugggucuggccaaaugugacagaugcagaucuua

SEQ ID NO: 320450 - RNA, 64 nt, Human
cggaacaugggaggggacaaauaagggaauaaaaucuggccaccccagccagcagcagcaaccu

SEQ ID NO: 320451 - RNA, 64 nt, Human
uguuuugguuugugagaaaguagcugccccucauucuggccaguucuuuccaguagccaugggg

SEQ ID NO: 320452 - RNA, 64 nt, Human
cccuagggccuucugggccagaggcaccaucccuucuggccauccaucaaguccaucaaggccc

SEQ ID NO: 320453 - RNA, 64 nt, Human
cccgaagagacuccuggcguccuuccuacucugcucuggccaguggugccaggugccacccagg

SEQ ID NO: 320454 - RNA, 64 nt, Human
uccauugaaagcuccacauuaaaccccagcccugucuggccagggagauccaugugcucaaugu

SEQ ID NO: 320455 - RNA, 64 nt, Human
caacaguuuuauaagguauuugcauuuuagaagcucuggccaguaguuguuaagauguuggcau

SEQ ID NO: 320456 - RNA, 64 nt, Human
cuguggcaggucacugggggacaauguacagcauucuggccauccacuucuuuuucacuucaug

SEQ ID NO: 320457 - RNA, 64 nt, Human
caccaaaugccucauccccaggcaaccccacugcucuggccaaugggacugugcaagcacccaa

SEQ ID NO: 320458 - RNA, 61 nt, Human; identical to SEQ ID NO: 76455

SEQ ID NO: 320459 - RNA, 64 nt, Human; identical to SEQ ID NO: 76456

SEQ ID NO: 320460 - RNA, 64 nt, Human; identical to SEQ ID NO: 76465

SEQ ID NO: 320461 - RNA, 64 nt, Human
guacguuguccuguauccagccuuucaacagaugucuggccagacgaagaacauuguguccuaa

SEQ ID NO: 320462 - RNA, 64 nt, Human
gugcccuguaucuauuggcagugaccuuggaaaaucuggccaagccuagggguuuccuuuucca

SEQ ID NO: 320463 - RNA, 64 nt, Human
acucagccugggcuuuaauguguaggaaaagccuucuggccacccagagagccggagcccugcu

SEQ ID NO: 320464 - RNA, 64 nt, Human
ccacugcuuccccaggcgggaagaaagagggaguucuggccaccugagccuuucccuugccaau

SEQ ID NO: 320465 - RNA, 64 nt, Human
ccugguccugcuaccugaacauuggcgccugccuucuggccacgcuggcggcagccaugcucau

SEQ ID NO: 320466 - RNA, 64 nt, Human
cuguggccccggccccugcccaggugugggugguucuggccaggaaggcacaagguagcugugg

SEQ ID NO: 320467 - RNA, 64 nt, Human
cgcggcagcugucuuuuugcuacuauaagggaauucuggccacccugggugggguguggucggg

SEQ ID NO: 320468 - RNA, 64 nt, Human
ccgcccgccccccgcccccaccaaggccccagccucuggccaucaguccuggugccagagcuuu

SEQ ID NO: 320469 - RNA, 64 nt, Human
ggcuacagaugucugcucucuggaccccacgugaucuggccacuggggacccccacccgacccc

SEQ ID NO: 320470 - RNA, 64 nt, Human
aaugaaguuacuagggcuguucuuaccaucuccuucuggccaaauagcacaacauuuccucguu

SEQ ID NO: 320471 - RNA, 64 nt, Human
gccaucaguagcagugugguguuucaggcagagcucuggccaggcugugccagugugucccgga

SEQ ID NO: 320472 - RNA, 64 nt, Human
gccuggcuucuccggccuccccucaccgcacaguucuggccacagcucccgcuccugugcuggc

SEQ ID NO: 320473 - RNA, 64 nt, Human
ugggcucuuuuaggguaagaaguuugugucuuugucuggccacaucuugacuagguauugucua

SEQ ID NO: 320474 - RNA, 64 nt, Human
ccuccuaguugaaucucagcccugaguguccagaucuggccaaggugucuaggguggcccacgg

SEQ ID NO: 320475 - RNA, 64 nt, Human
auugauuauagaagacagggauaauaccuuuaucucuggccacucaaaaaugcagugccaggag

SEQ ID NO: 320476 - RNA, 64 nt, Human
cccucccaccccucacagcucaagccaaguccagcggccgcagucuucaccucuccacacucac

SEQ ID NO: 320477 - RNA, 51 nt, Human
ggaaggagagggggacgugaccggccgcauccuugcacgccccgcggagcu

SEQ ID NO: 320478 - RNA, 64 nt, Human
cuguggucuccuuccggcuguggcugacaguggcucuggccaggguugcuuggagaaggcucag

SEQ ID NO: 320479 - RNA, 64 nt, Human
uccuccugggaggcacccccaccuguuugaaaggucuggccaggcguggugguucaggccugua

SEQ ID NO: 320480 - RNA, 64 nt, Human
uauuuccauguguugaaauggcaaucaaacauuuucuggccaguguuuaaaacuucaguuucac

SEQ ID NO: 320481 - RNA, 64 nt, Human
gcagagggagcccccuugcccuguuuggccacccucuggccagccaaaagcacucugaaaccaa

SEQ ID NO: 320482 - RNA, 64 nt, Human
aucuggaaaaacuugcucccaggagggcuuugugucuggccagcuugauuuuccuaauggucuc

SEQ ID NO: 320483 - RNA, 64 nt, Human
gcuaccuacguguugccgccacaggcuccugcucucuggccaagcccugggugggaggccaggc

SEQ ID NO: 320484 - RNA, 64 nt, Human
ccccugacugcuugccucauauuuaagcugcugcucuggccaagugccuaauuuuaacccagac

SEQ ID NO: 320485 - RNA, 64 nt, Human
gcccacagaugugcuguugguccaggugucccagucuggccacagcccugccuccgcccucacc

SEQ ID NO: 320486 - RNA, 64 nt, Human
augaauguggcacucccuccuuccauuccuaagcucuggccaccgucccuugaucucucauacu

SEQ ID NO: 320487 - RNA, 52 nt, Human
ugggcaaagcccaccuuugaccucuggccagaagccucccuucugugcacag

SEQ ID NO: 320488 - RNA, 64 nt, Human
cgcgaccccgucugggaggugaggagcgucucugucuggccaccccgucugagaagugaggaga

SEQ ID NO: 320489 - RNA, 64 nt, Human
aagccgggccucacacucacacuguaaaugucucucuggccaccaugcguuacguguacccgug

SEQ ID NO: 320490 - RNA, 64 nt, Human
cugccuggucagucccaggugaggccaagggcuuucuggccaucucagggaggggccaccaggu

SEQ ID NO: 320491 - RNA, 64 nt, Human
cgggaagaaaaucagagggaagguuaagguuggcucuggccaggauuccaggcagcagguugga

SEQ ID NO: 320492 - RNA, 64 nt, Human
uaaacucugcagugcagcuucugcucuuggccccucuggccagggccccuguggcuuccugcac

SEQ ID NO: 320493 - RNA, 64 nt, Human; identical to SEQ ID NO: 76434

SEQ ID NO: 320494 - RNA, 64 nt, Human; identical to SEQ ID NO: 76435

SEQ ID NO: 320495 - RNA, 64 nt, Human; identical to SEQ ID NO: 262691

SEQ ID NO: 320496 - RNA, 64 nt, Human
ggaggcauggccagugggacuaguguucccuccaucuggccacagcuuuugggagauggggugg

SEQ ID NO: 320497 - RNA, 64 nt, Human
uucuugccuggugcugucccugcugugggagacgucuggccacaggcagugccccacccagucu

SEQ ID NO: 320498 - RNA, 64 nt, Human
ggaagcucuaagaugagagcaaaugccugaucacucuggccaaaugucagauacuaaagcccau

SEQ ID NO: 320499 - RNA, 64 nt, Human
cccucucuggcccugucuuaccccaucacccgacucuggccacugaccucagggccgaagggga

SEQ ID NO: 320500 - RNA, 64 nt, Human
cagcccgugcaccugugagcagcccggcggccgaucuggccaacgggccuuuuuacaggaacug

SEQ ID NO: 320501 - RNA, 64 nt, Human
gagcagggcagcaccuccauaggaagccuuccuuucuggccaaggugggcgguguuagauugug

SEQ ID NO: 320502 - RNA, 64 nt, Human
gagcaggagcaucaggcggccggcgcauggcgugucuggccaaaucuucccgacaggugagcca

SEQ ID NO: 320503 - RNA, 64 nt, Human
guuggaggauggcacuccggccaccuccuccaucucuggccauauccugccccucgcucggucc

SEQ ID NO: 320504 - RNA, 64 nt, Human
ccacccaggcccucagaacugagccacaggcugcucuggccaggagagaaacagcucuguuguu

SEQ ID NO: 320505 - RNA, 64 nt, Human
cagaugacacccuugcccaugccuggaccuugcuucuggccagggaggggaucaggcccccuug

SEQ ID NO: 320506 - RNA, 64 nt, Human
aacugagagcuuacagugccaaugccguuuguguucuggccagaguggagugcgcagcccugac

SEQ ID NO: 320507 - RNA, 64 nt, Human
gcgccagcccagcucuccccucugcacccuuggcucuggccaaagcuugcucccugcucccaca

SEQ ID NO: 320508 - RNA, 64 nt, Human
ucccuucuguaaauuuuaaaacauuuuccuccccucuggccaguggguugucaccagagcacuu

SEQ ID NO: 320509 - RNA, 64 nt, Human
gcuccugggugugucagaggccagccuggggagcucuggccacugcuucccaugagcugaggga

SEQ ID NO: 320510 - RNA, 64 nt, Human
uaucauguaguuuaauguaccauaugugaaacauucuggccauagcagcaacuaaaaacugcaa

SEQ ID NO: 320511 - RNA, 64 nt, Human; identical to SEQ ID NO: 76404

SEQ ID NO: 320512 - RNA, 64 nt, Human; identical to SEQ ID NO: 76405

SEQ ID NO: 320513 - RNA, 64 nt, Human; identical to SEQ ID NO: 76406

SEQ ID NO: 320514 - RNA, 64 nt, Human
uggccucaaauggaugccagaugccaaccccaguucuggccacguacagccagcgggucagccc

SEQ ID NO: 320515 - RNA, 64 nt, Human
guuucacucucagcuucuccccucgaagggacucucuggccaccuccuccaccgcaguccagcu

SEQ ID NO: 320516 - RNA, 64 nt, Human
ccccuacccaccuccaagaggcuacagcccugugucuggccaugugagcccuggccuuucaccg

SEQ ID NO: 320517 - RNA, 64 nt, Human
acagucuauaagcccgagucaccaggacggccugucuggccacagacaggggcugccuguggag

SEQ ID NO: 320518 - RNA, 64 nt, Human
auuuucuuugccaagguguauuagcggacggcccucuggccaccuacccgagagaucguagggu

SEQ ID NO: 320519 - RNA, 64 nt, Human
ccugcuuccggcaccaaguucauaauagagaucuucuggccagagaaucaggggagaggagagg

SEQ ID NO: 320520 - RNA, 64 nt, Human
uucuagcacgacugguucaugcgggaauagcugcucuggccaccugcaggcagaaaguggggga

SEQ ID NO: 320521 - RNA, 64 nt, Human
gguggaucaccugaggucaggaguucaagaccagucuggccaacauggugaaaugccgucucua

SEQ ID NO: 320522 - RNA, 64 nt, Human
aaaaccaugcauggugcaucagcagcccauggccucuggccaggcauggcgaggcugagguggg

SEQ ID NO: 320523 - RNA, 64 nt, Human
ccaaacccaccagauggaggggcccucccuggucucuggccacccucccagccucugcccaggg

SEQ ID NO: 320524 - RNA, 64 nt, Human
aauuggucuguagaaaugaccuugaaaauggaguucuggccaggugcgguggcucacgccugua

SEQ ID NO: 320525 - RNA, 64 nt, Human
ggggacguucagcugagccgaguguguauacugcucuggccauccacuagcccagggaggaccc

SEQ ID NO: 320526 - RNA, 64 nt, Human
aagaaaaucuguggugaaagggaacaucuuaccaucuggccauucacacugaagagaaacuuca

SEQ ID NO: 320527 - RNA, 64 nt, Human
agcccugccuaggaaccguacaucccaucugcucucuggccaacggcuucacaccuuccccugc

SEQ ID NO: 320528 - RNA, 64 nt, Human
gucuuggggcagcggggaagggguucugaagaacucuggccaagaggacgaggaucugggggug

SEQ ID NO: 320529 - RNA, 64 nt, Human; identical to SEQ ID NO: 76407

SEQ ID NO: 320530 - RNA, 64 nt, Human; identical to SEQ ID NO: 76408

SEQ ID NO: 320531 - RNA, 64 nt, Human; identical to SEQ ID NO: 76410

SEQ ID NO: 320532 - RNA, 64 nt, Human
gccaaggucaggaagaggcccuguggucaccgugucuggccaaucucaggcuuucacuucugua

SEQ ID NO: 320533 - RNA, 64 nt, Human
cccgggcacaccagcccucagagaccugagcucuucuggccacguggaaccucgaacccgagcu

SEQ ID NO: 320534 - RNA, 64 nt, Human
cuagaggacauuggucagcaggagcccaaguuguucuggccacaccuucuuuguggcucagugc

SEQ ID NO: 320535 - RNA, 64 nt, Human
auacaacacuucccagcugcccuuauaguuaaggucuggccagugaaauguauguggaaauguu

SEQ ID NO: 320536 - RNA, 64 nt, Human
gggaaaucucugguguugggaacaggcccccaaaucuggccauaaacuggccccaaaacuggcc

SEQ ID NO: 320537 - RNA, 64 nt, Human
ccguccuuuuccaccagucucgccucuggccuucucuggccacuccugggagggacugccucac

SEQ ID NO: 320538 - RNA, 64 nt, Human
cagaguuccaaccaaugggcuccauccucuggauucuggccaaugaaauaucucccuggcaggg

SEQ ID NO: 320539 - RNA, 64 nt, Human
caaagugcucagauuagagaugugagccgccaugucuggccagauaaauuaagucaaacauuug

SEQ ID NO: 320540 - RNA, 64 nt, Human
ggacccagccucagauccaggcaggagcacgaggucuggccaagguggacgggguugucgagau

SEQ ID NO: 320541 - RNA, 64 nt, Human
cucucucucucuuucucucucuuuuaaaaaaacaucuggccagggcacaguggcucacgccugu

SEQ ID NO: 320542 - RNA, 64 nt, Human
ccuuuagacaugauguuuucuacucauuugucucucuggccaauugaauuauuaauaaaagguc

SEQ ID NO: 320543 - RNA, 64 nt, Human
ggugcugcccuggcaucagccucuuccagucacaucuggccagagggcugucuggaccugggcc

SEQ ID NO: 320544 - RNA, 64 nt, Human
ucuuuuuguaaaaaaaucuuccuugucccugggcucuggccaacccucagaaacccucacaaua

SEQ ID NO: 320545 - RNA, 64 nt, Human
ugugagcagcccagagcccucucuauccacuuggucuggccagccaggcccuuccucaccaggg

SEQ ID NO: 320546 - RNA, 64 nt, Human
ccaggcccuuccucaccagggucugaggggcagcucuggccagugcucaccagggccagcaggg

SEQ ID NO: 320547 - RNA, 64 nt, Human; identical to SEQ ID NO: 76429

SEQ ID NO: 320548 - RNA, 64 nt, Human; identical to SEQ ID NO: 76430

SEQ ID NO: 320549 - RNA, 64 nt, Human; identical to SEQ ID NO: 76440

SEQ ID NO: 320550 - RNA, 64 nt, Human
cacugccauggaauucccuccugagugccccacuucuggccacaucagccccacaggacuuuga

SEQ ID NO: 320551 - RNA, 64 nt, Human
cugucccugaucccauccaugcucaggccuuaggucuggccauucacacacacacacaccccca

SEQ ID NO: 320552 - RNA, 64 nt, Human
gugggcauacguggugggaggguggagggcucccucuggccagugccagcugugcucagcuggc

SEQ ID NO: 320553 - RNA, 64 nt, Human
ggggaacaggagcagggccacagcaccccugaggucuggccaggccccaggcacagagcugccu

SEQ ID NO: 320554 - RNA, 64 nt, Human
uugccugacggcuucucggcucuacccucacccuucuggccaggaucccgcagggcaacagccc

SEQ ID NO: 320555 - RNA, 64 nt, Human
uggagcaguagcagaagccucauuccagaacccaucuggccagagaagcagcagcauccugggg

SEQ ID NO: 320556 - RNA, 64 nt, Human
cugaaaacaguggcguggcuccccugugcccagaucuggccaugggugaggccugcacagaugu

SEQ ID NO: 320557 - RNA, 64 nt, Human
cugggcagucugugguguggagagcagccaucugucuggccauucagaggauucuaaagacaug

SEQ ID NO: 320558 - RNA, 64 nt, Human
aggaucugcccuguaaggggccagccgucaggaaucuggccaugaaaaccucuuuguagugcuu

SEQ ID NO: 320559 - RNA, 64 nt, Human
ggagucagagcccuggcuggguucaggucccacgucuggccaggcacugccuucuccucucugg

SEQ ID NO: 320560 - RNA, 64 nt, Human
cccauccaggcccaugugugagaguccucucccuucuggccagcuccagcccccucacccuugc

SEQ ID NO: 320561 - RNA, 56 nt, Human
aaaggugugggaggugcugaaccuuuucuggccaugaaccauuauaaaaucccaac

SEQ ID NO: 320562 - RNA, 64 nt, Human
caaaauguccagcuucucuugaaaacuugguauaucuggccacacugggcucacauucccaagg

SEQ ID NO: 320563 - RNA, 64 nt, Human
aucuuggucauuuggaagaggacacgguauccccucuggccagaguaugucagagaaggaagag

SEQ ID NO: 320564 - RNA, 64 nt, Human
gccguggugccccuggcuggccgaggagacuggcucuggccaggggccccguccugagaggucc

SEQ ID NO: 320565 - RNA, 64 nt, Human; identical to SEQ ID NO: 76414

SEQ ID NO: 320566 - RNA, 64 nt, Human; identical to SEQ ID NO: 76415

SEQ ID NO: 320567 - RNA, 64 nt, Human; identical to SEQ ID NO: 76416

SEQ ID NO: 320568 - RNA, 64 nt, Human
ggcagaucgcuucagcucaggaguucgagaucauucuggccaacaaggcgaaacccugucucua

SEQ ID NO: 320569 - RNA, 64 nt, Human
caugcacacgcugucuuuagcacucuaaaauuuuucuggccagcccuaagcuuguuuuaagggu

SEQ ID NO: 320570 - RNA, 64 nt, Human
accccaaaauuauagccugaauguucgcuuuuagucuggccagggaucugacuccugaguuggu

SEQ ID NO: 320571 - RNA, 64 nt, Human
uugaauuacagcaguugacucagagugcaagaagucuggccauuuuggaaagcaagguuuccuu

SEQ ID NO: 320572 - RNA, 64 nt, Human
ugaccagcuagccuacgcggggauggccgucaguucuggccacaggacccgagucugggcuugg

SEQ ID NO: 320573 - RNA, 64 nt, Human
cagacacccuggcuggcccugacugacuguauucucuggccacauucaagucccccauuggugg

SEQ ID NO: 320574 - RNA, 64 nt, Human
gagugcaguaccagggacaccucaggacagauucucuggccaggcccuucccugacccaauaaa

SEQ ID NO: 320575 - RNA, 64 nt, Human
agcagagagccaagcaucuucccugggaagucuuucuggccaagucuggccagccuggcccugc

SEQ ID NO: 320576 - RNA, 64 nt, Human
caagcaucuucccugggaagucuuucuggccaagucuggccagccuggcccugcaggucuccca

SEQ ID NO: 320577 - RNA, 64 nt, Human
cacaaguggacaucagugucuucucugugaggcaucuggccauucgcacucccuggugugguca

SEQ ID NO: 320578 - RNA, 64 nt, Human
cuggcccacccucaccacccaaggggucaucaucucuggccaccacuccaccagaugggcagag

SEQ ID NO: 320579 - RNA, 64 nt, Human
gccuggacggggcuuuugucugaugcucugggauucuggccagacccaccccagggcacauguc

SEQ ID NO: 320580 - RNA, 64 nt, Human
caggcaccuuggcaucugugcagagacggcccagucuggccaaauccucuuccucuccccugcu

SEQ ID NO: 320581 - RNA, 64 nt, Human
augccugccuggacccuguugguggcugaagaccucuggccagcuggcuuccgcccuugguggg

SEQ ID NO: 320582 - RNA, 64 nt, Human
ggcagaucaccugaggucaggaguucaagaccagucuggccaacauagcaaaacccugucucua

SEQ ID NO: 320583 - RNA, 64 nt, Human; identical to SEQ ID NO: 76420

SEQ ID NO: 320584 - RNA, 64 nt, Human; identical to SEQ ID NO: 76421

SEQ ID NO: 320585 - RNA, 64 nt, Human; identical to SEQ ID NO: 76422

SEQ ID NO: 320586 - RNA, 64 nt, Human
aggcccagcagcaccugcacccacuuccagcugcucuggccaaaaucuccgcucggccaggccc

SEQ ID NO: 320587 - RNA, 64 nt, Human
ccguagccuccucccaggcaccugucugcaucccucuggccagugcaugcugagcacgugaccu

SEQ ID NO: 320588 - RNA, 64 nt, Human
acagugacauugacccucuugguuuucuccugucucuggccauuucuuccaguuucccuauuuc

SEQ ID NO: 320589 - RNA, 64 nt, Human
aggguccagccugcagggaggccccaggaggggaucuggccagucaaggguccacagggugcca

SEQ ID NO: 320590 - RNA, 64 nt, Human
agcucaagcacggggccuucagcuuccccuguccucuggccacaccgccagcccuugguccuua

SEQ ID NO: 320591 - RNA, 64 nt, Human
uuguccagauggcaggaaggagaacggaugcuugucuggccaugaucuggagagcaucaggccc

SEQ ID NO: 320592 - RNA, 64 nt, Human
ggcggaucaccugaggucaggaguuugagaccagucuggccaacauggcgaaaccccgucucua

SEQ ID NO: 320593 - RNA, 64 nt, Human
cuuucuugcuguuaggggcuaccaugggaccagcucuggccagagggaacuaagcaaauccaau

SEQ ID NO: 320594 - RNA, 64 nt, Human
gaggcgcagccuacgccauugccuuggacaggacucuggccacaggcagggcgggucugugucc

SEQ ID NO: 320595 - RNA, 64 nt, Human
caauucuacugaauggggguggaccuggcauuuaucuggccaaaaacaggagccagagaaauau

SEQ ID NO: 320596 - RNA, 64 nt, Human
auccacuucucuguuaaccuacaaaacguauuuaucuggccauugcacuucggauaauuuucau

SEQ ID NO: 320597 - RNA, 64 nt, Human
guuuccauuguauuuauagucuguuuaugcuaaaucuggccaaagaugagcauuguccaccacu

SEQ ID NO: 320598 - RNA, 64 nt, Human
ugccccuaacccccaugcucuugugccuucccccucuggccaggccucugggcuccgugggggc

SEQ ID NO: 320599 - RNA, 64 nt, Human
aaagcagagauagauugauuuaucaaaauuauuaucuggccaacagugugacuaucagacagca

SEQ ID NO: 320600 - RNA, 64 nt, Human
auuuguccaccuggagacagagguagcuggcagcucuggccaucccuccccuaugaagagcauu

SEQ ID NO: 320601 - RNA, 64 nt, Human; identical to SEQ ID NO: 76426

SEQ ID NO: 320602 - RNA, 64 nt, Human; identical to SEQ ID NO: 76427

SEQ ID NO: 320603 - RNA, 64 nt, Human; identical to SEQ ID NO: 76428

SEQ ID NO: 320604 - RNA, 64 nt, Human
ccauuuggacugcacagagcagcugccgugagcgucuggccacauggagcugcuuucuggggaa

SEQ ID NO: 320605 - RNA, 64 nt, Human
caagauuuaugagaaauauuugaaggcaguacacucuggccaacuguuaccaguugguauuucu

SEQ ID NO: 320606 - RNA, 64 nt, Human
gagcagcaguugaggaauagguuuuuacucaaaaucuggccauuugugaauccuguaaaccuug

SEQ ID NO: 320607 - RNA, 64 nt, Human
gcacgugcugaguccagaggcagucacagagaccucuggccaggggauccuaacuggguucuug

SEQ ID NO: 320608 - RNA, 64 nt, Human
ggcucaucaucgucauagcuggcauguaccuggcucuggccaggugcuaggcacuccucacagc

SEQ ID NO: 320609 - RNA, 64 nt, Human
cauugaccucagcugcacauuccuggccccgggcucuggccacccuggcccgccccucgcugcu

SEQ ID NO: 320610 - RNA, 64 nt, Human; identical to SEQ ID NO: 76423

SEQ ID NO: 320611 - RNA, 64 nt, Human; identical to SEQ ID NO: 76424

SEQ ID NO: 320612 - RNA, 64 nt, Human; identical to SEQ ID NO: 76432

SEQ ID NO: 320613 - RNA, 64 nt, Human; identical to SEQ ID NO: 76433

SEQ ID NO: 320614 - RNA, 64 nt, Human
ugaacuugcuuugaauauuccagauguguuuggucgugcguauggcagugagcagguauguguu

SEQ ID NO: 320615 - RNA, 64 nt, Human
guuuugugugugugugcacauguguguaugcauucgugcguacgagugugugcaugugugcgcc

SEQ ID NO: 320616 - RNA, 64 nt, Human
ugccacaagccaccauguaaccccucucaccugccgugcguacuggcuguggaccaguaggacu

SEQ ID NO: 320617 - RNA, 64 nt, Human
uaggaugccaagcagccacgucuccaagagcucccgugcguaggcuggacacaagcacaggcug

SEQ ID NO: 320618 - RNA, 64 nt, Human
acggcaccacuggccggccccgcgaaagacugcgcgugcguagagcacgccggcgcggccccgg

SEQ ID NO: 320619 - RNA, 51 nt, Human; identical to SEQ ID NO: 76390

SEQ ID NO: 320620 - RNA, 64 nt, Human; identical to SEQ ID NO: 76391

SEQ ID NO: 320621 - RNA, 64 nt, Human; identical to SEQ ID NO: 76392

SEQ ID NO: 320622 - RNA, 64 nt, Human; identical to SEQ ID NO: 76393

SEQ ID NO: 320623 - RNA, 64 nt, Human; identical to SEQ ID NO: 76394

SEQ ID NO: 320624 - RNA, 64 nt, Human; identical to SEQ ID NO: 76395

SEQ ID NO: 320625 - RNA, 64 nt, Human; identical to SEQ ID NO: 76396

SEQ ID NO: 320626 - RNA, 64 nt, Human; identical to SEQ ID NO: 76397

SEQ ID NO: 320627 - RNA, 64 nt, Human; identical to SEQ ID NO: 76398

SEQ ID NO: 320628 - RNA, 64 nt, Human; identical to SEQ ID NO: 76399

SEQ ID NO: 320629 - RNA, 64 nt, Human; identical to SEQ ID NO: 76400

SEQ ID NO: 320630 - RNA, 64 nt, Human; identical to SEQ ID NO: 76401

SEQ ID NO: 320631 - RNA, 64 nt, Human; identical to SEQ ID NO: 76402

SEQ ID NO: 320632 - RNA, 64 nt, Human
cuuuguugucccacuuugggaccggguccagucuggggucuagucucgagcaucagggucaggc

SEQ ID NO: 320633 - RNA, 64 nt, Human
ucugaaaucauccauuuggggacaaauccacauuggggucuagaaacauccacguaucucauca

SEQ ID NO: 320634 - RNA, 64 nt, Human
aucaugauaucaggacugguuacuugguuaaggaggggucuaggagaucugucccuuuuagaga

SEQ ID NO: 320635 - RNA, 64 nt, Human
ggagacuagguuauucucugccauagagcuaacuggggucuauaugcugggugcugagacacug

SEQ ID NO: 320636 - RNA, 64 nt, Human
ucaggggcuuuggaagcucuguugcagguguccgggggucuaggacuuuagggaucuggggaag

SEQ ID NO: 320637 - RNA, 64 nt, Human
auuaugauaucaggacugguuacuugguuaaggaggggucuaggagaucugucccuuuuagaga

SEQ ID NO: 320638 - RNA, 64 nt, Human
gcaaggaaguauuugggcacccuacccuuuaccuggggucuaaccaaaaauggaugggaugagg

SEQ ID NO: 320639 - RNA, 64 nt, Human
ccccgauccuggccgaggugaggaacagacagggggggucuagauucugaggggguugguggau

SEQ ID NO: 320640 - RNA, 64 nt, Human
uguugguuuauugcuggcaacgugaauucucucaggggucuaggaggggcauuuuggagacugc

SEQ ID NO: 320641 - RNA, 64 nt, Human
gcugugcagggugagggccaugcaugcaguaugaggggucuacaccugcaaggacugagaggcu

SEQ ID NO: 320642 - RNA, 64 nt, Human
caaccgggaugcgugggcaacuggacucugcacgggggucuacagguugagggagguuggucac

SEQ ID NO: 320643 - RNA, 64 nt, Human
cugugggguggggaggagcagauccaaguuuugcggggucuaaagcuguguguguugaggggga

SEQ ID NO: 320644 - RNA, 64 nt, Human
uucuaugagucugcuccauccaugugucuguuugggggucuaucucuccaucccucuguuggug

SEQ ID NO: 320645 - RNA, 64 nt, Human
uuucacagaguaagccuguugugacuuugcuuuuggggucuaugucauugguuucugaugcuug

SEQ ID NO: 320646 - RNA, 64 nt, Human; identical to SEQ ID NO: 262693

SEQ ID NO: 320647 - RNA, 64 nt, Human; identical to SEQ ID NO: 262694

SEQ ID NO: 320648 - RNA, 64 nt, Human; identical to SEQ ID NO: 262695

SEQ ID NO: 320649 - RNA, 64 nt, Human
cugcuaacuugugugcuaugauccacuccugaugggggucuacauuaaucuuccaguacuccuu

SEQ ID NO: 320650 - RNA, 64 nt, Human
ucuucuugaacacucaugcugaaagcccaaguagggggucuaaaauuuuuaaggacuuuccuuc

SEQ ID NO: 320651 - RNA, 64 nt, Human
uggaagggaccaagcgaccaaggaugggccaucuggggucuaugcccacauacccacguuuguu

SEQ ID NO: 320652 - RNA, 64 nt, Human
uagguuguccuagaaaggguguggagggaggaagggggucuaaggucuaucaagucaaucauuu

SEQ ID NO: 320653 - RNA, 64 nt, Human
uagagacaggugucucugcccccacaccgcuacuggggucuaauggaggggcuggguucuugaa

SEQ ID NO: 320654 - RNA, 64 nt, Human
accaaggccuagggcggguaugaaguguggggcgggggucuauacauuccugagauucugggaa

SEQ ID NO: 320655 - RNA, 64 nt, Human
uuuccuuuuguccuuguauuaaagugguuuuaaaggggucuaaaaagauuuuggcaaaacauau

SEQ ID NO: 320656 - RNA, 64 nt, Human
cugauuuuuuuaucuugcccaaauuccuaccuaaggggucuagggagucgcgccuuacaaauca

SEQ ID NO: 320657 - RNA, 64 nt, Human
gcagucagcuguuugcaguuuuuagccugauuuuggggucuauagagauugcuuuauuggauac

SEQ ID NO: 320658 - RNA, 64 nt, Human
ucauuuuucuuuuggugcagaaccguugugcaguggggucuaccaugcaauuuucuuucagcac

SEQ ID NO: 320659 - RNA, 64 nt, Human
cccaucucuaaggacuccaagugcuagagacaagggggucuaugagcauuuacugacuuccugu

SEQ ID NO: 320660 - RNA, 64 nt, Human
accaagugauucccauuugucuaaggauuugaagggggucuaaauuggauguaucuuacuuagu

SEQ ID NO: 320661 - RNA, 64 nt, Human
uauuagauaauguauaacuugcacccagggaaugggggucuaugagacaaccccacuuggagaa

SEQ ID NO: 320662 - RNA, 64 nt, Human
acuuaugcagcuuucuacagggagaguuugguuuggggucuauaucuagagggaccuucaaagu

SEQ ID NO: 320663 - RNA, 64 nt, Human
gcuucuucagaucagugcuugaguuuggggaaugcggccgcauucccugagucaccaggaaugu

SEQ ID NO: 320664 - RNA, 64 nt, Human
cgcagagucuguacauaguguauauugcucuacccggccgcacaccacguccugcucuggcuuu

SEQ ID NO: 320665 - RNA, 64 nt, Human
auuugucugcaucagcgugcucuuguaccgaaggcggccgcaccugggaggggagcuugguggc

SEQ ID NO: 320666 - RNA, 64 nt, Human
uguguugucacuggaaguacugucaaagacuuugggggucuaacuaaaauggccaaaguuccaa

SEQ ID NO: 320667 - RNA, 64 nt, Human
caaauuaugguaggcaacuaacgguguuuuuaagggggucuaagccugccuuuucaaugauuua

SEQ ID NO: 320668 - RNA, 64 nt, Human
uuuuaaucccguuauggacucugucuccaggagaggggucuauccaccccugcucauuggugga

SEQ ID NO: 320669 - RNA, 64 nt, Human
gccucuaucuuguuuuuuguuuuuucuucuggggggggucuagaacagugccuggcacauagua

SEQ ID NO: 320670 - RNA, 64 nt, Human
uacagauccucucuuucuuucccuacgucugccuggggucuacuccauaaggguuuacaaaugg

SEQ ID NO: 320671 - RNA, 64 nt, Human
guuaaugagucucuuggcccacuggucccacuugggggucuagaccaggauuauagaggacaca

SEQ ID NO: 320672 - RNA, 64 nt, Human
acugcuaauacagaaacuuaauguagaccuguuuggggucuacuauuguuuuagaaugaaggaa

SEQ ID NO: 320673 - RNA, 64 nt, Human
uuuuuuuuuuuuucuuuuuuggugugaaggugggggggucuauuagacauuuauucaagagcgu

SEQ ID NO: 320674 - RNA, 64 nt, Human
cagaucuaggcaguuucuaaacaacacuuagacuggggucuaacguugacaaauccuucuagaa

SEQ ID NO: 320675 - RNA, 64 nt, Human
aaggaaauguuagaaguuauuuuucccuuccagaggggucuauauguguaagcaaccaggacuu

SEQ ID NO: 320676 - RNA, 64 nt, Human
gggaggggagcaguguugaugccaaaauacccacggggucuaccagccaugggguuugcuugcu

SEQ ID NO: 320677 - RNA, 64 nt, Human
augcuugcugcagcaagagagacugcacaccacuggggucuaugggugcuucucagugggaagg

SEQ ID NO: 320678 - RNA, 64 nt, Human
caccaacagcugugauuucaucccgaaguggaagggggucuaaacagaacaggcugagagaggc

SEQ ID NO: 320679 - RNA, 64 nt, Human
agagccaccugggguacauguugaaaacuuauuuggggucuaccccaaaccuaauaacccaaau

SEQ ID NO: 320680 - RNA, 64 nt, Human
cucuuucugccuccccuccccugggggccgggggcggccgcaugggccuugucuuugcugggac

SEQ ID NO: 320681 - RNA, 64 nt, Human
gaagauggaggggcugguuuccuuccacucuccacggccgcacgcucagaggcuggucuccgca

SEQ ID NO: 320682 - RNA, 64 nt, Human
gggccuuccuguggccccuuuccccaagcaggggcggccgcagcucucacccacuuucuccugc

SEQ ID NO: 320683 - RNA, 64 nt, Human
uaaugugggaaugauuugguuuuaauuauaaacuggggucuaaauccuaaagcaaaauugaaac

SEQ ID NO: 320684 - RNA, 64 nt, Human
uaaauguauucucacauguaaauuugaaaguucaggggucuauuaugaaaugauacacauuuuu

SEQ ID NO: 320685 - RNA, 64 nt, Human
cucuuaacuguggggaccaaaagggagagagccuggggucuacaagaggagacacaucaucaaa

SEQ ID NO: 320686 - RNA, 64 nt, Human
cugcugggggcucuguggcuccauuccuggcuguggggucuagucaagaggcagagggacuugg

SEQ ID NO: 320687 - RNA, 64 nt, Human
uggugguugccauugggcagaggaguauaggacuggggucuaggauaggagcaagacuuccuug

SEQ ID NO: 320688 - RNA, 64 nt, Human
ggacggcagauaugaaaugccuggcacagugcuuggggucuaguauguagcuuccagaacccac

SEQ ID NO: 320689 - RNA, 64 nt, Human
guauaacuaacagcauccccaaaacaaagucuuuggggucuacacugcaaucauaugugaucug

SEQ ID NO: 320690 - RNA, 64 nt, Human
gguaaagugcccaucuggugcucaagagagccugggggucuaacagggagcccggcugccucac

SEQ ID NO: 320691 - RNA, 64 nt, Human
uuaugaguucaugcaaaacucuccaggccaaguaggggucuagccuuuaaugauauuagucaaa

SEQ ID NO: 320692 - RNA, 64 nt, Human
cauccuggugggggagggcagccuucaaacguguggggucuacaguccucaggucuaggcaggg

SEQ ID NO: 320693 - RNA, 64 nt, Human
cccuacagaguuagggaauggagcccaggcaccaggggucuaaagugugagccacugagaagag

SEQ ID NO: 320694 - RNA, 64 nt, Human
uuuggacuauucaggugaacuauuugagggguauggggucuagaaguuaaaagauacgcauguc

SEQ ID NO: 320695 - RNA, 64 nt, Human
gggccccagggaacuaaagggugugggucagggaggggucuagaggcuauuccuaggccucagg

SEQ ID NO: 320696 - RNA, 64 nt, Human
ugagagaggaguagcccccuuuuucagagaguuuggggucuaccucagagcucucccugucaaa

SEQ ID NO: 320697 - RNA, 64 nt, Human
aauauggauuguacauuuggcugcaugagcaagucggccgcacacuuccagacagugugcuguu

SEQ ID NO: 320698 - RNA, 64 nt, Human
gcucagcuccuucuuuucugugcaauacgagacccggccgcaccccgagucacacaggcccccg

SEQ ID NO: 320699 - RNA, 64 nt, Human; identical to SEQ ID NO: 262696

SEQ ID NO: 320700 - RNA, 64 nt, Human
uucuagucaugcugugcaugccgcuuacucuguuggggucuauauaaauuuguugaacucuuac

SEQ ID NO: 320701 - RNA, 64 nt, Human
uguguugggagauggguaaagcguuucuucuaaaggggucuacccagaaagcaugauuuccugc

SEQ ID NO: 320702 - RNA, 64 nt, Human
auagggaacaauguuuauagucguguguacagugggggucuacaacaagaaguguauauuuuca

SEQ ID NO: 320703 - RNA, 64 nt, Human
aucugggacgugcagugauggggauuacaggggaggggucuagcuccuuuuucucucucauauu

SEQ ID NO: 320704 - RNA, 64 nt, Human
ucccaucaccagaaacaucuuuucaggggagcggggggucuauaaaaacagcaauagaaauuaa

SEQ ID NO: 320705 - RNA, 64 nt, Human
cuugggcuccugaugaggagaaaggggccccaccggggucuaauggugacaguccaaaccacuc

SEQ ID NO: 320706 - RNA, 64 nt, Human
ccugaucccugugggaccuuugacagcagggaugggggucuaacagcuguagggugcugccacu

SEQ ID NO: 320707 - RNA, 64 nt, Human
auuccucccugaugugguaaacuggcacacuccaggggucuaaaacauaaaacaguuguguuua

SEQ ID NO: 320708 - RNA, 64 nt, Human
gccuugcgccgcauucgcacugggggacaugggaggggucuagcuggccacugcuggaggcagc

SEQ ID NO: 320709 - RNA, 64 nt, Human
caucuacuccugaaaauaaauguggugccaugcaggggucuacgguuugugguaguaaucuaau

SEQ ID NO: 320710 - RNA, 64 nt, Human
aggaaccucccccuaccuaggacccuuccuguggggggucuacagagucagggacagaagggaa

SEQ ID NO: 320711 - RNA, 64 nt, Human
uccucacaugacugaagggacuagcuaucucuguggggucuauuuuauaagggcacuaacccca

SEQ ID NO: 320712 - RNA, 64 nt, Human
uuguuagaggagcauaugauuagaauucuguuugggggucuaguugucuuggagcaaguaugua

SEQ ID NO: 320713 - RNA, 64 nt, Human
ugaauucauuacgaagaauguucgagagaaagcaggggucuaauccaaaagaaaugucauuaac

SEQ ID NO: 320714 - RNA, 64 nt, Human
acuguccacaguguucaugugcuggagucagggacggccgcaccugccuccgccggcuccagug

SEQ ID NO: 320715 - RNA, 64 nt, Human
gggacaacgugcugcuuacacuccagguguggaccggccgcagcccccacugaccugcccaugu

SEQ ID NO: 320716 - RNA, 64 nt, Human
aguacagaaccaggcaucgagcuagcucccugcacggccgcacccucccagagaacuccuugag

SEQ ID NO: 320717 - RNA, 64 nt, Human
ccuuggcacaugaggccggcucuccccacuggcuggggucuaaccuugaacccucaccacgugc

SEQ ID NO: 320718 - RNA, 64 nt, Human
gcucaguucaccugccacguucucuccaaggaguggggucuacgugaccuuuaguccucuaccu

SEQ ID NO: 320719 - RNA, 64 nt, Human
guacaucuggccuugaaaccaccuuuuauuacauggggucuagaacuugacccccuugagggug

SEQ ID NO: 320720 - RNA, 64 nt, Human
aacacaccacggucugcccugcaaaaacaccaauggggucuagugcagguggacacuuugaacc

SEQ ID NO: 320721 - RNA, 64 nt, Human
gagccugcaugugccugugggguggggaggcguaggggucuacggcugccugagaugggugugc

SEQ ID NO: 320722 - RNA, 64 nt, Human
uacaauuaucuucucagugaaggucauuugugauggggucuaauucuuauuacuucaacaaaua

SEQ ID NO: 320723 - RNA, 64 nt, Human
uuugguauuucggaaacuaaaguccuuaugggauggggucuagaauugauucuccuuuccugag

SEQ ID NO: 320724 - RNA, 64 nt, Human
uuuucucauguuuacagugcacggaguguggaagggggucuaggagagggagagcuggaaaagg

SEQ ID NO: 320725 - RNA, 64 nt, Human
gaaauuguaccuuucuaaugacaucuaugcagcaggggucuaucgccuuguggauggcaccaaa

SEQ ID NO: 320726 - RNA, 64 nt, Human
cuuccuaauaagccugggagugcuaugggagacuggggucuauuucaccccugcagucucgacc

SEQ ID NO: 320727 - RNA, 64 nt, Human
uuuaacagccucugaaauuuaucuuuucuucuauggggucuauaaauguaucuuauaauaaaaa

SEQ ID NO: 320728 - RNA, 64 nt, Human
gagaaggaagugauccacagcauucaggccacuuggggucuagaccaugguggugccagccugg

SEQ ID NO: 320729 - RNA, 64 nt, Human
cagggcuuucauuuggucauccuugcaauccauuggggucuaguuuggaaucugacaacuggaa

SEQ ID NO: 320730 - RNA, 64 nt, Human
ccaagagguaacauuuugccccgggccaaauucaggggucuagugcccugcauuccuuugaggc

SEQ ID NO: 320731 - RNA, 53 nt, Human
gccuggugccggccugcugaccccggccgcacacucgacuuuccuggugcuca

SEQ ID NO: 320732 - RNA, 64 nt, Human
guucagcgaguaugugcuuugccgggaggagcggcggccgcagcccacccccacugcuguucga

SEQ ID NO: 320733 - RNA, 64 nt, Human
gggccacuguguuucugugcuccaaguugagacucggccgcagcggcgucagacuuuucuuugc

SEQ ID NO: 320734 - RNA, 64 nt, Human
ucuggacggggcucuuuugcuucccccucaaucuggggucuagaguugugcaaggaauucagcu

SEQ ID NO: 320735 - RNA, 64 nt, Human
uuucuucgaggaccucagcaaggucgugaguccaggggucuacaagucccgggccccccaguuc

SEQ ID NO: 320736 - RNA, 64 nt, Human
uugcuggggccaggccccauggaggguauacugaggggucuauagguuugugauuaaaauaaua

SEQ ID NO: 320737 - RNA, 64 nt, Human
gcccugcugacugggaaaguuucagggcacugauggggucuaccugguaagcggagggccugag

SEQ ID NO: 320738 - RNA, 64 nt, Human
gucguuacuaugggccauauuacuaaugcccacuggggucuaugauuucucaaaauuuucauuc

SEQ ID NO: 320739 - RNA, 64 nt, Human; identical to SEQ ID NO: 320738

SEQ ID NO: 320740 - RNA, 64 nt, Human
ccguuccuggaccucagcgagccugagccgggcccggccgcacgcugacccccgugcugucccc

SEQ ID NO: 320741 - RNA, 64 nt, Human
acgcggacuccgcgcgaccccggcccucucccugcggccgcagggcuuccccgccuggcgccug

SEQ ID NO: 320742 - RNA, 64 nt, Human
uaccauuaugugccauguacugacccgaaaggcucggccgcagagccggggcccagcgaaucac

SEQ ID NO: 320743 - RNA, 64 nt, Human
acacagccaaggccaacgaggcaagcagaagcagcggccgcagcgaagcugccguucauguguu

SEQ ID NO: 320744 - RNA, 53 nt, Human
aagaccaggacgaguacugagggcggccgcagcccuggcugacugcacagcuu

SEQ ID NO: 320745 - RNA, 64 nt, Human
aggaggggucugccucccacgcugggacacagaccggccgcaugucugcauggcagaagcgucu

SEQ ID NO: 320746 - RNA, 64 nt, Human
uugagcagagcuccaccgcagucccgggugucugcggccgcaacgcaacggacacuggcuggaa

SEQ ID NO: 320747 - RNA, 64 nt, Human
ccauaggcagucccugggcaagggaggauuuucccggccgcagcacagccuuccauucaugugc

SEQ ID NO: 320748 - RNA, 64 nt, Human
ccuccucuuuccccuccugcuccuccuacugagccggccgcagaaauugcagccgcucagcuuc

SEQ ID NO: 320749 - RNA, 64 nt, Human
cagcguccagauggaugcacguucacuacugugacggccgcaccucccccaugcaccccacccu

SEQ ID NO: 320750 - RNA, 64 nt, Human
cccauacauccaggugggucacaucuacuucuggcggccgcagggcagggaaaccccuacugga

SEQ ID NO: 320751 - RNA, 64 nt, Human
gggccgcggaaggggguagggcccgagcuccgcgcggccgcacaauccgagcccccgccccgcg

SEQ ID NO: 320752 - RNA, 64 nt, Human
guccccugcggccccugcugccgcugcgcugucccggccgcaagagcggggccgccccgccgag

SEQ ID NO: 320753 - RNA, 64 nt, Human; identical to SEQ ID NO: 262784

SEQ ID NO: 320754 - RNA, 64 nt, Human; identical to SEQ ID NO: 262785

SEQ ID NO: 320755 - RNA, 64 nt, Human; identical to SEQ ID NO: 262786

SEQ ID NO: 320756 - RNA, 64 nt, Human; identical to SEQ ID NO: 262787

SEQ ID NO: 320757 - RNA, 64 nt, Human; identical to SEQ ID NO: 262788

SEQ ID NO: 320758 - RNA, 61 nt, Human; identical to SEQ ID NO: 262789

SEQ ID NO: 320759 - RNA, 64 nt, Human; identical to SEQ ID NO: 262790

SEQ ID NO: 320760 - RNA, 64 nt, Human; identical to SEQ ID NO: 262791

SEQ ID NO: 320761 - RNA, 64 nt, Human; identical to SEQ ID NO: 262795

SEQ ID NO: 320762 - RNA, 64 nt, Human; identical to SEQ ID NO: 262796

SEQ ID NO: 320763 - RNA, 64 nt, Human; identical to SEQ ID NO: 262797

SEQ ID NO: 320764 - RNA, 64 nt, Human; identical to SEQ ID NO: 262798

SEQ ID NO: 320765 - RNA, 64 nt, Human; identical to SEQ ID NO: 262799

SEQ ID NO: 320766 - RNA, 64 nt, Human; identical to SEQ ID NO: 262800

SEQ ID NO: 320767 - RNA, 64 nt, Human; identical to SEQ ID NO: 262801

SEQ ID NO: 320768 - RNA, 64 nt, Human; identical to SEQ ID NO: 262802

SEQ ID NO: 320769 - RNA, 64 nt, Human; identical to SEQ ID NO: 262803

SEQ ID NO: 320770 - RNA, 64 nt, Human; identical to SEQ ID NO: 262804

SEQ ID NO: 320771 - RNA, 64 nt, Human; identical to SEQ ID NO: 262805

SEQ ID NO: 320772 - RNA, 64 nt, Human; identical to SEQ ID NO: 262806

SEQ ID NO: 320773 - RNA, 64 nt, Human; identical to SEQ ID NO: 262807

SEQ ID NO: 320774 - RNA, 64 nt, Human; identical to SEQ ID NO: 262808

SEQ ID NO: 320775 - RNA, 64 nt, Human; identical to SEQ ID NO: 262809

SEQ ID NO: 320776 - RNA, 64 nt, Human; identical to SEQ ID NO: 262813

SEQ ID NO: 320777 - RNA, 64 nt, Human; identical to SEQ ID NO: 262814

SEQ ID NO: 320778 - RNA, 64 nt, Human; identical to SEQ ID NO: 262815

SEQ ID NO: 320779 - RNA, 64 nt, Human; identical to SEQ ID NO: 262816

SEQ ID NO: 320780 - RNA, 64 nt, Human; identical to SEQ ID NO: 262817

SEQ ID NO: 320781 - RNA, 64 nt, Human; identical to SEQ ID NO: 262818

SEQ ID NO: 320782 - RNA, 64 nt, Human; identical to SEQ ID NO: 262819

SEQ ID NO: 320783 - RNA, 64 nt, Human; identical to SEQ ID NO: 262820

SEQ ID NO: 320784 - RNA, 64 nt, Human; identical to SEQ ID NO: 262821

SEQ ID NO: 320785 - RNA, 64 nt, Human; identical to SEQ ID NO: 262822

SEQ ID NO: 320786 - RNA, 64 nt, Human; identical to SEQ ID NO: 262823

SEQ ID NO: 320787 - RNA, 64 nt, Human; identical to SEQ ID NO: 262824

SEQ ID NO: 320788 - RNA, 64 nt, Human; identical to SEQ ID NO: 262825

SEQ ID NO: 320789 - RNA, 64 nt, Human; identical to SEQ ID NO: 262826

SEQ ID NO: 320790 - RNA, 64 nt, Human; identical to SEQ ID NO: 262827

SEQ ID NO: 320791 - RNA, 64 nt, Human; identical to SEQ ID NO: 262832

SEQ ID NO: 320792 - RNA, 64 nt, Human; identical to SEQ ID NO: 262833

SEQ ID NO: 320793 - RNA, 64 nt, Human; identical to SEQ ID NO: 262834

SEQ ID NO: 320794 - RNA, 64 nt, Human; identical to SEQ ID NO: 262835

SEQ ID NO: 320795 - RNA, 64 nt, Human; identical to SEQ ID NO: 262836

SEQ ID NO: 320796 - RNA, 64 nt, Human; identical to SEQ ID NO: 262837

SEQ ID NO: 320797 - RNA, 64 nt, Human; identical to SEQ ID NO: 262838

SEQ ID NO: 320798 - RNA, 64 nt, Human; identical to SEQ ID NO: 262839

SEQ ID NO: 320799 - RNA, 53 nt, Human; identical to SEQ ID NO: 262840

SEQ ID NO: 320800 - RNA, 64 nt, Human; identical to SEQ ID NO: 262841

SEQ ID NO: 320801 - RNA, 64 nt, Human; identical to SEQ ID NO: 262842

SEQ ID NO: 320802 - RNA, 64 nt, Human; identical to SEQ ID NO: 262843

SEQ ID NO: 320803 - RNA, 64 nt, Human; identical to SEQ ID NO: 262844

SEQ ID NO: 320804 - RNA, 64 nt, Human; identical to SEQ ID NO: 262845

SEQ ID NO: 320805 - RNA, 64 nt, Human; identical to SEQ ID NO: 262846

SEQ ID NO: 320806 - RNA, 64 nt, Human; identical to SEQ ID NO: 262850

SEQ ID NO: 320807 - RNA, 64 nt, Human; identical to SEQ ID NO: 262851

SEQ ID NO: 320808 - RNA, 64 nt, Human; identical to SEQ ID NO: 262852

SEQ ID NO: 320809 - RNA, 64 nt, Human; identical to SEQ ID NO: 262853

SEQ ID NO: 320810 - RNA, 64 nt, Human; identical to SEQ ID NO: 262854

SEQ ID NO: 320811 - RNA, 64 nt, Human; identical to SEQ ID NO: 262855

SEQ ID NO: 320812 - RNA, 64 nt, Human; identical to SEQ ID NO: 262856

SEQ ID NO: 320813 - RNA, 64 nt, Human; identical to SEQ ID NO: 262857

SEQ ID NO: 320814 - RNA, 50 nt, Human; identical to SEQ ID NO: 262858

SEQ ID NO: 320815 - RNA, 64 nt, Human; identical to SEQ ID NO: 262859

SEQ ID NO: 320816 - RNA, 64 nt, Human; identical to SEQ ID NO: 262860

SEQ ID NO: 320817 - RNA, 64 nt, Human; identical to SEQ ID NO: 262861

SEQ ID NO: 320818 - RNA, 64 nt, Human; identical to SEQ ID NO: 262862

SEQ ID NO: 320819 - RNA, 64 nt, Human; identical to SEQ ID NO: 262863

SEQ ID NO: 320820 - RNA, 64 nt, Human; identical to SEQ ID NO: 262864

SEQ ID NO: 320821 - RNA, 64 nt, Human; identical to SEQ ID NO: 262868

SEQ ID NO: 320822 - RNA, 64 nt, Human; identical to SEQ ID NO: 262869

SEQ ID NO: 320823 - RNA, 64 nt, Human; identical to SEQ ID NO: 262870

SEQ ID NO: 320824 - RNA, 64 nt, Human; identical to SEQ ID NO: 262871

SEQ ID NO: 320825 - RNA, 64 nt, Human; identical to SEQ ID NO: 262872

SEQ ID NO: 320826 - RNA, 64 nt, Human; identical to SEQ ID NO: 262873

SEQ ID NO: 320827 - RNA, 64 nt, Human; identical to SEQ ID NO: 262874

SEQ ID NO: 320828 - RNA, 64 nt, Human; identical to SEQ ID NO: 262875

SEQ ID NO: 320829 - RNA, 64 nt, Human; identical to SEQ ID NO: 262876

SEQ ID NO: 320830 - RNA, 64 nt, Human; identical to SEQ ID NO: 262877

SEQ ID NO: 320831 - RNA, 64 nt, Human; identical to SEQ ID NO: 262878

SEQ ID NO: 320832 - RNA, 64 nt, Human; identical to SEQ ID NO: 262879

SEQ ID NO: 320833 - RNA, 64 nt, Human; identical to SEQ ID NO: 262880

SEQ ID NO: 320834 - RNA, 64 nt, Human; identical to SEQ ID NO: 262881

SEQ ID NO: 320835 - RNA, 64 nt, Human; identical to SEQ ID NO: 262882

SEQ ID NO: 320836 - RNA, 64 nt, Human; identical to SEQ ID NO: 262886

SEQ ID NO: 320837 - RNA, 64 nt, Human; identical to SEQ ID NO: 262887

SEQ ID NO: 320838 - RNA, 64 nt, Human; identical to SEQ ID NO: 262888

SEQ ID NO: 320839 - RNA, 64 nt, Human; identical to SEQ ID NO: 262889

SEQ ID NO: 320840 - RNA, 64 nt, Human; identical to SEQ ID NO: 262890

SEQ ID NO: 320841 - RNA, 64 nt, Human; identical to SEQ ID NO: 262891

SEQ ID NO: 320842 - RNA, 64 nt, Human; identical to SEQ ID NO: 262892

SEQ ID NO: 320843 - RNA, 64 nt, Human; identical to SEQ ID NO: 262893

SEQ ID NO: 320844 - RNA, 64 nt, Human; identical to SEQ ID NO: 262894

SEQ ID NO: 320845 - RNA, 64 nt, Human; identical to SEQ ID NO: 262895

SEQ ID NO: 320846 - RNA, 64 nt, Human; identical to SEQ ID NO: 262896

SEQ ID NO: 320847 - RNA, 64 nt, Human; identical to SEQ ID NO: 262897

SEQ ID NO: 320848 - RNA, 64 nt, Human; identical to SEQ ID NO: 262898

SEQ ID NO: 320849 - RNA, 64 nt, Human; identical to SEQ ID NO: 262899

SEQ ID NO: 320850 - RNA, 64 nt, Human; identical to SEQ ID NO: 262900

SEQ ID NO: 320851 - RNA, 64 nt, Human; identical to SEQ ID NO: 262904

SEQ ID NO: 320852 - RNA, 64 nt, Human; identical to SEQ ID NO: 262905

SEQ ID NO: 320853 - RNA, 64 nt, Human; identical to SEQ ID NO: 262906

SEQ ID NO: 320854 - RNA, 64 nt, Human; identical to SEQ ID NO: 262907

SEQ ID NO: 320855 - RNA, 64 nt, Human; identical to SEQ ID NO: 262908

SEQ ID NO: 320856 - RNA, 64 nt, Human; identical to SEQ ID NO: 262909

SEQ ID NO: 320857 - RNA, 64 nt, Human; identical to SEQ ID NO: 262910

SEQ ID NO: 320858 - RNA, 64 nt, Human; identical to SEQ ID NO: 262911

SEQ ID NO: 320859 - RNA, 64 nt, Human; identical to SEQ ID NO: 262912

SEQ ID NO: 320860 - RNA, 64 nt, Human; identical to SEQ ID NO: 262913

SEQ ID NO: 320861 - RNA, 64 nt, Human; identical to SEQ ID NO: 262914

SEQ ID NO: 320862 - RNA, 64 nt, Human; identical to SEQ ID NO: 262915

SEQ ID NO: 320863 - RNA, 64 nt, Human; identical to SEQ ID NO: 262916

SEQ ID NO: 320864 - RNA, 64 nt, Human; identical to SEQ ID NO: 262917

SEQ ID NO: 320865 - RNA, 64 nt, Human; identical to SEQ ID NO: 262918

SEQ ID NO: 320866 - RNA, 64 nt, Human; identical to SEQ ID NO: 262922

SEQ ID NO: 320867 - RNA, 64 nt, Human; identical to SEQ ID NO: 262923

SEQ ID NO: 320868 - RNA, 64 nt, Human; identical to SEQ ID NO: 262924

SEQ ID NO: 320869 - RNA, 62 nt, Human; identical to SEQ ID NO: 262925

SEQ ID NO: 320870 - RNA, 64 nt, Human; identical to SEQ ID NO: 262926

SEQ ID NO: 320871 - RNA, 64 nt, Human; identical to SEQ ID NO: 262927

SEQ ID NO: 320872 - RNA, 64 nt, Human; identical to SEQ ID NO: 262928

SEQ ID NO: 320873 - RNA, 64 nt, Human; identical to SEQ ID NO: 262929

SEQ ID NO: 320874 - RNA, 64 nt, Human; identical to SEQ ID NO: 262930

SEQ ID NO: 320875 - RNA, 64 nt, Human; identical to SEQ ID NO: 262931

SEQ ID NO: 320876 - RNA, 64 nt, Human; identical to SEQ ID NO: 262932

SEQ ID NO: 320877 - RNA, 64 nt, Human; identical to SEQ ID NO: 262933

SEQ ID NO: 320878 - RNA, 64 nt, Human; identical to SEQ ID NO: 262934

SEQ ID NO: 320879 - RNA, 64 nt, Human; identical to SEQ ID NO: 262935

SEQ ID NO: 320880 - RNA, 64 nt, Human; identical to SEQ ID NO: 262936

SEQ ID NO: 320881 - RNA, 64 nt, Human; identical to SEQ ID NO: 262940

SEQ ID NO: 320882 - RNA, 64 nt, Human; identical to SEQ ID NO: 262941

SEQ ID NO: 320883 - RNA, 64 nt, Human; identical to SEQ ID NO: 262942

SEQ ID NO: 320884 - RNA, 64 nt, Human; identical to SEQ ID NO: 262943

SEQ ID NO: 320885 - RNA, 64 nt, Human; identical to SEQ ID NO: 262944

SEQ ID NO: 320886 - RNA, 64 nt, Human; identical to SEQ ID NO: 262945

SEQ ID NO: 320887 - RNA, 64 nt, Human; identical to SEQ ID NO: 262946

SEQ ID NO: 320888 - RNA, 64 nt, Human; identical to SEQ ID NO: 262947

SEQ ID NO: 320889 - RNA, 53 nt, Human; identical to SEQ ID NO: 262948

SEQ ID NO: 320890 - RNA, 64 nt, Human; identical to SEQ ID NO: 262949

SEQ ID NO: 320891 - RNA, 64 nt, Human; identical to SEQ ID NO: 262950

SEQ ID NO: 320892 - RNA, 64 nt, Human; identical to SEQ ID NO: 262951

SEQ ID NO: 320893 - RNA, 64 nt, Human; identical to SEQ ID NO: 262952

SEQ ID NO: 320894 - RNA, 64 nt, Human; identical to SEQ ID NO: 262953

SEQ ID NO: 320895 - RNA, 64 nt, Human; identical to SEQ ID NO: 262954

SEQ ID NO: 320896 - RNA, 64 nt, Human; identical to SEQ ID NO: 262958

SEQ ID NO: 320897 - RNA, 64 nt, Human; identical to SEQ ID NO: 262959

SEQ ID NO: 320898 - RNA, 64 nt, Human; identical to SEQ ID NO: 262960

SEQ ID NO: 320899 - RNA, 64 nt, Human; identical to SEQ ID NO: 262961

SEQ ID NO: 320900 - RNA, 64 nt, Human; identical to SEQ ID NO: 262962

SEQ ID NO: 320901 - RNA, 64 nt, Human; identical to SEQ ID NO: 262963

SEQ ID NO: 320902 - RNA, 64 nt, Human; identical to SEQ ID NO: 262964

SEQ ID NO: 320903 - RNA, 64 nt, Human; identical to SEQ ID NO: 262965

SEQ ID NO: 320904 - RNA, 64 nt, Human; identical to SEQ ID NO: 262966

SEQ ID NO: 320905 - RNA, 64 nt, Human; identical to SEQ ID NO: 262967

SEQ ID NO: 320906 - RNA, 64 nt, Human; identical to SEQ ID NO: 262968

SEQ ID NO: 320907 - RNA, 64 nt, Human; identical to SEQ ID NO: 262969

SEQ ID NO: 320908 - RNA, 64 nt, Human; identical to SEQ ID NO: 262970

SEQ ID NO: 320909 - RNA, 64 nt, Human; identical to SEQ ID NO: 262971

SEQ ID NO: 320910 - RNA, 64 nt, Human; identical to SEQ ID NO: 262972

SEQ ID NO: 320911 - RNA, 64 nt, Human; identical to SEQ ID NO: 262976

SEQ ID NO: 320912 - RNA, 64 nt, Human; identical to SEQ ID NO: 262977

SEQ ID NO: 320913 - RNA, 64 nt, Human; identical to SEQ ID NO: 262978

SEQ ID NO: 320914 - RNA, 64 nt, Human; identical to SEQ ID NO: 262979

SEQ ID NO: 320915 - RNA, 64 nt, Human; identical to SEQ ID NO: 262980

SEQ ID NO: 320916 - RNA, 64 nt, Human; identical to SEQ ID NO: 262981

SEQ ID NO: 320917 - RNA, 64 nt, Human; identical to SEQ ID NO: 262982

SEQ ID NO: 320918 - RNA, 64 nt, Human; identical to SEQ ID NO: 262983

SEQ ID NO: 320919 - RNA, 64 nt, Human; identical to SEQ ID NO: 262984

SEQ ID NO: 320920 - RNA, 64 nt, Human; identical to SEQ ID NO: 262985

SEQ ID NO: 320921 - RNA, 64 nt, Human; identical to SEQ ID NO: 262986

SEQ ID NO: 320922 - RNA, 64 nt, Human; identical to SEQ ID NO: 262987

SEQ ID NO: 320923 - RNA, 64 nt, Human; identical to SEQ ID NO: 262988

SEQ ID NO: 320924 - RNA, 64 nt, Human; identical to SEQ ID NO: 262989

SEQ ID NO: 320925 - RNA, 64 nt, Human; identical to SEQ ID NO: 262990

SEQ ID NO: 320926 - RNA, 64 nt, Human; identical to SEQ ID NO: 262994

SEQ ID NO: 320927 - RNA, 64 nt, Human; identical to SEQ ID NO: 262995

SEQ ID NO: 320928 - RNA, 64 nt, Human; identical to SEQ ID NO: 262996

SEQ ID NO: 320929 - RNA, 64 nt, Human; identical to SEQ ID NO: 262997

SEQ ID NO: 320930 - RNA, 64 nt, Human; identical to SEQ ID NO: 262998

SEQ ID NO: 320931 - RNA, 64 nt, Human; identical to SEQ ID NO: 262999

SEQ ID NO: 320932 - RNA, 64 nt, Human; identical to SEQ ID NO: 263000

SEQ ID NO: 320933 - RNA, 64 nt, Human; identical to SEQ ID NO: 263001

SEQ ID NO: 320934 - RNA, 64 nt, Human; identical to SEQ ID NO: 263002

SEQ ID NO: 320935 - RNA, 64 nt, Human; identical to SEQ ID NO: 263003

SEQ ID NO: 320936 - RNA, 64 nt, Human; identical to SEQ ID NO: 263004

SEQ ID NO: 320937 - RNA, 64 nt, Human; identical to SEQ ID NO: 263005

SEQ ID NO: 320938 - RNA, 64 nt, Human; identical to SEQ ID NO: 263006

SEQ ID NO: 320939 - RNA, 64 nt, Human; identical to SEQ ID NO: 263007

SEQ ID NO: 320940 - RNA, 64 nt, Human; identical to SEQ ID NO: 263008

SEQ ID NO: 320941 - RNA, 64 nt, Human; identical to SEQ ID NO: 263012

SEQ ID NO: 320942 - RNA, 64 nt, Human; identical to SEQ ID NO: 263013

SEQ ID NO: 320943 - RNA, 64 nt, Human; identical to SEQ ID NO: 263014

SEQ ID NO: 320944 - RNA, 64 nt, Human; identical to SEQ ID NO: 263015

SEQ ID NO: 320945 - RNA, 64 nt, Human; identical to SEQ ID NO: 263016

SEQ ID NO: 320946 - RNA, 64 nt, Human; identical to SEQ ID NO: 263017

SEQ ID NO: 320947 - RNA, 64 nt, Human; identical to SEQ ID NO: 263018

SEQ ID NO: 320948 - RNA, 64 nt, Human; identical to SEQ ID NO: 263019

SEQ ID NO: 320949 - RNA, 64 nt, Human; identical to SEQ ID NO: 263020

SEQ ID NO: 320950 - RNA, 64 nt, Human; identical to SEQ ID NO: 263021

SEQ ID NO: 320951 - RNA, 64 nt, Human; identical to SEQ ID NO: 263022

SEQ ID NO: 320952 - RNA, 64 nt, Human; identical to SEQ ID NO: 263023

SEQ ID NO: 320953 - RNA, 64 nt, Human; identical to SEQ ID NO: 263024

SEQ ID NO: 320954 - RNA, 64 nt, Human; identical to SEQ ID NO: 263025

SEQ ID NO: 320955 - RNA, 64 nt, Human; identical to SEQ ID NO: 263026

SEQ ID NO: 320956 - RNA, 64 nt, Human; identical to SEQ ID NO: 263030

SEQ ID NO: 320957 - RNA, 64 nt, Human; identical to SEQ ID NO: 263031

SEQ ID NO: 320958 - RNA, 64 nt, Human; identical to SEQ ID NO: 263032

SEQ ID NO: 320959 - RNA, 64 nt, Human; identical to SEQ ID NO: 263033

SEQ ID NO: 320960 - RNA, 64 nt, Human; identical to SEQ ID NO: 263034

SEQ ID NO: 320961 - RNA, 64 nt, Human; identical to SEQ ID NO: 263035

SEQ ID NO: 320962 - RNA, 64 nt, Human; identical to SEQ ID NO: 263036

SEQ ID NO: 320963 - RNA, 64 nt, Human; identical to SEQ ID NO: 263037

SEQ ID NO: 320964 - RNA, 64 nt, Human; identical to SEQ ID NO: 263038

SEQ ID NO: 320965 - RNA, 64 nt, Human; identical to SEQ ID NO: 263039

SEQ ID NO: 320966 - RNA, 64 nt, Human; identical to SEQ ID NO: 263040

SEQ ID NO: 320967 - RNA, 64 nt, Human; identical to SEQ ID NO: 263041

SEQ ID NO: 320968 - RNA, 64 nt, Human; identical to SEQ ID NO: 263042

SEQ ID NO: 320969 - RNA, 64 nt, Human; identical to SEQ ID NO: 263043

SEQ ID NO: 320970 - RNA, 64 nt, Human; identical to SEQ ID NO: 263044

SEQ ID NO: 320971 - RNA, 64 nt, Human; identical to SEQ ID NO: 263048

SEQ ID NO: 320972 - RNA, 64 nt, Human; identical to SEQ ID NO: 263049

SEQ ID NO: 320973 - RNA, 64 nt, Human; identical to SEQ ID NO: 263050

SEQ ID NO: 320974 - RNA, 64 nt, Human; identical to SEQ ID NO: 263051

SEQ ID NO: 320975 - RNA, 64 nt, Human; identical to SEQ ID NO: 263052

SEQ ID NO: 320976 - RNA, 64 nt, Human; identical to SEQ ID NO: 263053

SEQ ID NO: 320977 - RNA, 64 nt, Human; identical to SEQ ID NO: 263054

SEQ ID NO: 320978 - RNA, 64 nt, Human; identical to SEQ ID NO: 263055

SEQ ID NO: 320979 - RNA, 64 nt, Human; identical to SEQ ID NO: 263056

SEQ ID NO: 320980 - RNA, 64 nt, Human; identical to SEQ ID NO: 263057

SEQ ID NO: 320981 - RNA, 64 nt, Human; identical to SEQ ID NO: 263058

SEQ ID NO: 320982 - RNA, 64 nt, Human; identical to SEQ ID NO: 263059

SEQ ID NO: 320983 - RNA, 64 nt, Human; identical to SEQ ID NO: 263060

SEQ ID NO: 320984 - RNA, 64 nt, Human; identical to SEQ ID NO: 263061

SEQ ID NO: 320985 - RNA, 64 nt, Human; identical to SEQ ID NO: 263062

SEQ ID NO: 320986 - RNA, 64 nt, Human; identical to SEQ ID NO: 263066

SEQ ID NO: 320987 - RNA, 64 nt, Human; identical to SEQ ID NO: 263067

SEQ ID NO: 320988 - RNA, 64 nt, Human; identical to SEQ ID NO: 263068

SEQ ID NO: 320989 - RNA, 64 nt, Human; identical to SEQ ID NO: 263069

SEQ ID NO: 320990 - RNA, 64 nt, Human; identical to SEQ ID NO: 263070

SEQ ID NO: 320991 - RNA, 64 nt, Human; identical to SEQ ID NO: 263071

SEQ ID NO: 320992 - RNA, 64 nt, Human; identical to SEQ ID NO: 263072

SEQ ID NO: 320993 - RNA, 64 nt, Human; identical to SEQ ID NO: 263073

SEQ ID NO: 320994 - RNA, 64 nt, Human; identical to SEQ ID NO: 263074

SEQ ID NO: 320995 - RNA, 57 nt, Human; identical to SEQ ID NO: 263075

SEQ ID NO: 320996 - RNA, 64 nt, Human; identical to SEQ ID NO: 263076

SEQ ID NO: 320997 - RNA, 64 nt, Human; identical to SEQ ID NO: 263077

SEQ ID NO: 320998 - RNA, 64 nt, Human; identical to SEQ ID NO: 263078

SEQ ID NO: 320999 - RNA, 64 nt, Human; identical to SEQ ID NO: 263079

SEQ ID NO: 321000 - RNA, 64 nt, Human; identical to SEQ ID NO: 263080

SEQ ID NO: 321001 - RNA, 64 nt, Human; identical to SEQ ID NO: 263084

SEQ ID NO: 321002 - RNA, 64 nt, Human; identical to SEQ ID NO: 263085

SEQ ID NO: 321003 - RNA, 64 nt, Human; identical to SEQ ID NO: 263086

SEQ ID NO: 321004 - RNA, 64 nt, Human; identical to SEQ ID NO: 263087

SEQ ID NO: 321005 - RNA, 64 nt, Human; identical to SEQ ID NO: 263088

SEQ ID NO: 321006 - RNA, 64 nt, Human; identical to SEQ ID NO: 263089

SEQ ID NO: 321007 - RNA, 58 nt, Human; identical to SEQ ID NO: 263090

SEQ ID NO: 321008 - RNA, 64 nt, Human; identical to SEQ ID NO: 320740

SEQ ID NO: 321009 - RNA, 64 nt, Human; identical to SEQ ID NO: 320741

SEQ ID NO: 321010 - RNA, 64 nt, Human; identical to SEQ ID NO: 320742

SEQ ID NO: 321011 - RNA, 64 nt, Human; identical to SEQ ID NO: 320743

SEQ ID NO: 321012 - RNA, 53 nt, Human; identical to SEQ ID NO: 320744

SEQ ID NO: 321013 - RNA, 64 nt, Human; identical to SEQ ID NO: 320745

SEQ ID NO: 321014 - RNA, 64 nt, Human; identical to SEQ ID NO: 320746

SEQ ID NO: 321015 - RNA, 64 nt, Human; identical to SEQ ID NO: 320747

SEQ ID NO: 321016 - RNA, 64 nt, Human; identical to SEQ ID NO: 320748

SEQ ID NO: 321017 - RNA, 64 nt, Human; identical to SEQ ID NO: 320749

SEQ ID NO: 321018 - RNA, 64 nt, Human; identical to SEQ ID NO: 320750

SEQ ID NO: 321019 - RNA, 64 nt, Human; identical to SEQ ID NO: 320751

SEQ ID NO: 321020 - RNA, 64 nt, Human; identical to SEQ ID NO: 320752

SEQ ID NO: 321021 - RNA, 64 nt, Human; identical to SEQ ID NO: 320242

SEQ ID NO: 321022 - RNA, 64 nt, Human; identical to SEQ ID NO: 320243

SEQ ID NO: 321023 - RNA, 64 nt, Human; identical to SEQ ID NO: 316450

SEQ ID NO: 321024 - RNA, 64 nt, Human; identical to SEQ ID NO: 320476

SEQ ID NO: 321025 - RNA, 51 nt, Human; identical to SEQ ID NO: 320477

SEQ ID NO: 321026 - RNA, 64 nt, Human; identical to SEQ ID NO: 320226

SEQ ID NO: 321027 - RNA, 64 nt, Human; identical to SEQ ID NO: 316466

SEQ ID NO: 321028 - RNA, 64 nt, Human; identical to SEQ ID NO: 320663

SEQ ID NO: 321029 - RNA, 64 nt, Human; identical to SEQ ID NO: 320664

SEQ ID NO: 321030 - RNA, 64 nt, Human; identical to SEQ ID NO: 320665

SEQ ID NO: 321031 - RNA, 64 nt, Human; identical to SEQ ID NO: 320680

SEQ ID NO: 321032 - RNA, 64 nt, Human; identical to SEQ ID NO: 320681

SEQ ID NO: 321033 - RNA, 64 nt, Human; identical to SEQ ID NO: 316467

SEQ ID NO: 321034 - RNA, 64 nt, Human; identical to SEQ ID NO: 320682

SEQ ID NO: 321035 - RNA, 64 nt, Human; identical to SEQ ID NO: 320334

SEQ ID NO: 321036 - RNA, 60 nt, Human; identical to SEQ ID NO: 316468

SEQ ID NO: 321037 - RNA, 64 nt, Human; identical to SEQ ID NO: 320714

SEQ ID NO: 321038 - RNA, 64 nt, Human; identical to SEQ ID NO: 320715

SEQ ID NO: 321039 - RNA, 64 nt, Human; identical to SEQ ID NO: 320716

SEQ ID NO: 321040 - RNA, 53 nt, Human; identical to SEQ ID NO: 320731

SEQ ID NO: 321041 - RNA, 64 nt, Human; identical to SEQ ID NO: 320732

SEQ ID NO: 321042 - RNA, 64 nt, Human; identical to SEQ ID NO: 316469

SEQ ID NO: 321043 - RNA, 64 nt, Human; identical to SEQ ID NO: 320733

SEQ ID NO: 321044 - RNA, 64 nt, Human; identical to SEQ ID NO: 320697

SEQ ID NO: 321045 - RNA, 64 nt, Human; identical to SEQ ID NO: 320698

SEQ ID NO: 321046 - RNA, 64 nt, Human; identical to SEQ ID NO: 316485

SEQ ID NO: 321047 - RNA, 64 nt, Human; identical to SEQ ID NO: 317537

SEQ ID NO: 321048 - RNA, 64 nt, Human; identical to SEQ ID NO: 317260

SEQ ID NO: 321049 - RNA, 64 nt, Human; identical to SEQ ID NO: 317261

SEQ ID NO: 321050 - RNA, 64 nt, Human; identical to SEQ ID NO: 316486

SEQ ID NO: 321051 - RNA, 64 nt, Human; identical to SEQ ID NO: 319863

SEQ ID NO: 321052 - RNA, 64 nt, Human; identical to SEQ ID NO: 262672

SEQ ID NO: 321053 - RNA, 64 nt, Human; identical to SEQ ID NO: 262673

SEQ ID NO: 321054 - RNA, 64 nt, Human; identical to SEQ ID NO: 262674

SEQ ID NO: 321055 - RNA, 64 nt, Human; identical to SEQ ID NO: 262675

SEQ ID NO: 321056 - RNA, 64 nt, Human; identical to SEQ ID NO: 262676

SEQ ID NO: 321057 - RNA, 64 nt, Human; identical to SEQ ID NO: 262677

SEQ ID NO: 321058 - RNA, 64 nt, Human; identical to SEQ ID NO: 262678

SEQ ID NO: 321059 - RNA, 64 nt, Human; identical to SEQ ID NO: 262679

SEQ ID NO: 321060 - RNA, 64 nt, Human; identical to SEQ ID NO: 262680

SEQ ID NO: 321061 - RNA, 64 nt, Human; identical to SEQ ID NO: 262681

SEQ ID NO: 321062 - RNA, 64 nt, Human; identical to SEQ ID NO: 262682

SEQ ID NO: 321063 - RNA, 64 nt, Human; identical to SEQ ID NO: 262686

SEQ ID NO: 321064 - RNA, 64 nt, Human; identical to SEQ ID NO: 262687

SEQ ID NO: 321065 - RNA, 50 nt, Human; identical to SEQ ID NO: 262688

SEQ ID NO: 321066 - RNA, 64 nt, Human; identical to SEQ ID NO: 262689

SEQ ID NO: 321067 - RNA, 59 nt, Human; identical to SEQ ID NO: 262690

SEQ ID NO: 321068 - RNA, 64 nt, Human; identical to SEQ ID NO: 262691

SEQ ID NO: 321069 - RNA, 64 nt, Human; identical to SEQ ID NO: 262692

SEQ ID NO: 321070 - RNA, 64 nt, Human; identical to SEQ ID NO: 262693

SEQ ID NO: 321071 - RNA, 64 nt, Human; identical to SEQ ID NO: 262694

SEQ ID NO: 321072 - RNA, 64 nt, Human; identical to SEQ ID NO: 262695

SEQ ID NO: 321073 - RNA, 64 nt, Human; identical to SEQ ID NO: 262696

SEQ ID NO: 321074 - RNA, 64 nt, Human; identical to SEQ ID NO: 262697

SEQ ID NO: 321075 - RNA, 64 nt, Human; identical to SEQ ID NO: 262698

SEQ ID NO: 321076 - RNA, 64 nt, Human; identical to SEQ ID NO: 262699

SEQ ID NO: 321077 - RNA, 64 nt, Human; identical to SEQ ID NO: 262700

SEQ ID NO: 321078 - RNA, 64 nt, Human; identical to SEQ ID NO: 262704

SEQ ID NO: 321079 - RNA, 64 nt, Human; identical to SEQ ID NO: 262705

SEQ ID NO: 321080 - RNA, 64 nt, Human; identical to SEQ ID NO: 262706

SEQ ID NO: 321081 - RNA, 64 nt, Human; identical to SEQ ID NO: 262707

SEQ ID NO: 321082 - RNA, 64 nt, Human; identical to SEQ ID NO: 262708

SEQ ID NO: 321083 - RNA, 64 nt, Human; identical to SEQ ID NO: 262709

SEQ ID NO: 321084 - RNA, 64 nt, Human; identical to SEQ ID NO: 262710

SEQ ID NO: 321085 - RNA, 64 nt, Human; identical to SEQ ID NO: 262711

SEQ ID NO: 321086 - RNA, 64 nt, Human; identical to SEQ ID NO: 262712

SEQ ID NO: 321087 - RNA, 64 nt, Human; identical to SEQ ID NO: 262713

SEQ ID NO: 321088 - RNA, 64 nt, Human; identical to SEQ ID NO: 262714

SEQ ID NO: 321089 - RNA, 64 nt, Human; identical to SEQ ID NO: 262715

SEQ ID NO: 321090 - RNA, 64 nt, Human; identical to SEQ ID NO: 262716

SEQ ID NO: 321091 - RNA, 64 nt, Human; identical to SEQ ID NO: 262717

SEQ ID NO: 321092 - RNA, 64 nt, Human; identical to SEQ ID NO: 262718

SEQ ID NO: 321093 - RNA, 64 nt, Human; identical to SEQ ID NO: 262722

SEQ ID NO: 321094 - RNA, 64 nt, Human; identical to SEQ ID NO: 262723

SEQ ID NO: 321095 - RNA, 64 nt, Human; identical to SEQ ID NO: 262724

SEQ ID NO: 321096 - RNA, 64 nt, Human; identical to SEQ ID NO: 262725

SEQ ID NO: 321097 - RNA, 64 nt, Human; identical to SEQ ID NO: 262726

SEQ ID NO: 321098 - RNA, 64 nt, Human; identical to SEQ ID NO: 262727

SEQ ID NO: 321099 - RNA, 64 nt, Human; identical to SEQ ID NO: 262728

SEQ ID NO: 321100 - RNA, 64 nt, Human; identical to SEQ ID NO: 262729

SEQ ID NO: 321101 - RNA, 64 nt, Human; identical to SEQ ID NO: 262730

SEQ ID NO: 321102 - RNA, 64 nt, Human; identical to SEQ ID NO: 262731

SEQ ID NO: 321103 - RNA, 64 nt, Human; identical to SEQ ID NO: 262732

SEQ ID NO: 321104 - RNA, 64 nt, Human; identical to SEQ ID NO: 262733

SEQ ID NO: 321105 - RNA, 64 nt, Human; identical to SEQ ID NO: 262734

SEQ ID NO: 321106 - RNA, 64 nt, Human; identical to SEQ ID NO: 262735

SEQ ID NO: 321107 - RNA, 64 nt, Human; identical to SEQ ID NO: 262736

SEQ ID NO: 321108 - RNA, 64 nt, Human; identical to SEQ ID NO: 262741

SEQ ID NO: 321109 - RNA, 64 nt, Human; identical to SEQ ID NO: 262742

SEQ ID NO: 321110 - RNA, 64 nt, Human; identical to SEQ ID NO: 262743

SEQ ID NO: 321111 - RNA, 64 nt, Human; identical to SEQ ID NO: 262744

SEQ ID NO: 321112 - RNA, 64 nt, Human; identical to SEQ ID NO: 262745

SEQ ID NO: 321113 - RNA, 64 nt, Human; identical to SEQ ID NO: 262746

SEQ ID NO: 321114 - RNA, 64 nt, Human; identical to SEQ ID NO: 262747

SEQ ID NO: 321115 - RNA, 64 nt, Human; identical to SEQ ID NO: 262748

SEQ ID NO: 321116 - RNA, 56 nt, Human; identical to SEQ ID NO: 262749

SEQ ID NO: 321117 - RNA, 64 nt, Human; identical to SEQ ID NO: 262750

SEQ ID NO: 321118 - RNA, 64 nt, Human; identical to SEQ ID NO: 262751

SEQ ID NO: 321119 - RNA, 64 nt, Human; identical to SEQ ID NO: 262752

SEQ ID NO: 321120 - RNA, 56 nt, Human; identical to SEQ ID NO: 262753

SEQ ID NO: 321121 - RNA, 64 nt, Human; identical to SEQ ID NO: 262754

SEQ ID NO: 321122 - RNA, 64 nt, Human; identical to SEQ ID NO: 262755

SEQ ID NO: 321123 - RNA, 64 nt, Human; identical to SEQ ID NO: 262759

SEQ ID NO: 321124 - RNA, 64 nt, Human; identical to SEQ ID NO: 262760

SEQ ID NO: 321125 - RNA, 64 nt, Human; identical to SEQ ID NO: 262761

SEQ ID NO: 321126 - RNA, 64 nt, Human; identical to SEQ ID NO: 262762

SEQ ID NO: 321127 - RNA, 64 nt, Human; identical to SEQ ID NO: 262763

SEQ ID NO: 321128 - RNA, 64 nt, Human; identical to SEQ ID NO: 262764

SEQ ID NO: 321129 - RNA, 64 nt, Human; identical to SEQ ID NO: 262765

SEQ ID NO: 321130 - RNA, 64 nt, Human; identical to SEQ ID NO: 262766

SEQ ID NO: 321131 - RNA, 64 nt, Human; identical to SEQ ID NO: 262767

SEQ ID NO: 321132 - RNA, 64 nt, Human; identical to SEQ ID NO: 262768

SEQ ID NO: 321133 - RNA, 64 nt, Human; identical to SEQ ID NO: 262769

SEQ ID NO: 321134 - RNA, 64 nt, Human; identical to SEQ ID NO: 262770

SEQ ID NO: 321135 - RNA, 64 nt, Human; identical to SEQ ID NO: 262771

SEQ ID NO: 321136 - RNA, 64 nt, Human; identical to SEQ ID NO: 262772

SEQ ID NO: 321137 - RNA, 64 nt, Human; identical to SEQ ID NO: 262773

SEQ ID NO: 321138 - RNA, 64 nt, Human; identical to SEQ ID NO: 262777

SEQ ID NO: 321139 - RNA, 64 nt, Human; identical to SEQ ID NO: 262778

SEQ ID NO: 321140 - RNA, 64 nt, Human; identical to SEQ ID NO: 262779

SEQ ID NO: 321141 - RNA, 64 nt, Human; identical to SEQ ID NO: 262780

SEQ ID NO: 321142 - RNA, 64 nt, Human; identical to SEQ ID NO: 262781

SEQ ID NO: 321143 - RNA, 64 nt, Human; identical to SEQ ID NO: 262782

SEQ ID NO: 321144 - RNA, 64 nt, Human; identical to SEQ ID NO: 262783

SEQ ID NO: 321145 - RNA, 64 nt, Human; identical to SEQ ID NO: 262784

SEQ ID NO: 321146 - RNA, 64 nt, Human; identical to SEQ ID NO: 262785

SEQ ID NO: 321147 - RNA, 64 nt, Human; identical to SEQ ID NO: 262786

SEQ ID NO: 321148 - RNA, 64 nt, Human; identical to SEQ ID NO: 262787

SEQ ID NO: 321149 - RNA, 64 nt, Human; identical to SEQ ID NO: 262788

SEQ ID NO: 321150 - RNA, 61 nt, Human; identical to SEQ ID NO: 262789

SEQ ID NO: 321151 - RNA, 64 nt, Human; identical to SEQ ID NO: 262790

SEQ ID NO: 321152 - RNA, 64 nt, Human; identical to SEQ ID NO: 262791

SEQ ID NO: 321153 - RNA, 64 nt, Human; identical to SEQ ID NO: 262795

SEQ ID NO: 321154 - RNA, 64 nt, Human; identical to SEQ ID NO: 262796

SEQ ID NO: 321155 - RNA, 64 nt, Human; identical to SEQ ID NO: 262797

SEQ ID NO: 321156 - RNA, 64 nt, Human; identical to SEQ ID NO: 262798

SEQ ID NO: 321157 - RNA, 64 nt, Human; identical to SEQ ID NO: 262799

SEQ ID NO: 321158 - RNA, 64 nt, Human; identical to SEQ ID NO: 262800

SEQ ID NO: 321159 - RNA, 64 nt, Human; identical to SEQ ID NO: 262801

SEQ ID NO: 321160 - RNA, 64 nt, Human; identical to SEQ ID NO: 262802

SEQ ID NO: 321161 - RNA, 64 nt, Human; identical to SEQ ID NO: 262803

SEQ ID NO: 321162 - RNA, 64 nt, Human; identical to SEQ ID NO: 262804

SEQ ID NO: 321163 - RNA, 64 nt, Human; identical to SEQ ID NO: 262805

SEQ ID NO: 321164 - RNA, 64 nt, Human; identical to SEQ ID NO: 262806

SEQ ID NO: 321165 - RNA, 64 nt, Human; identical to SEQ ID NO: 262807

SEQ ID NO: 321166 - RNA, 64 nt, Human; identical to SEQ ID NO: 262808

SEQ ID NO: 321167 - RNA, 64 nt, Human; identical to SEQ ID NO: 262809

SEQ ID NO: 321168 - RNA, 64 nt, Human; identical to SEQ ID NO: 262813

SEQ ID NO: 321169 - RNA, 64 nt, Human; identical to SEQ ID NO: 262814

SEQ ID NO: 321170 - RNA, 64 nt, Human; identical to SEQ ID NO: 262815

SEQ ID NO: 321171 - RNA, 64 nt, Human; identical to SEQ ID NO: 262816

SEQ ID NO: 321172 - RNA, 64 nt, Human; identical to SEQ ID NO: 262817

SEQ ID NO: 321173 - RNA, 64 nt, Human; identical to SEQ ID NO: 262818

SEQ ID NO: 321174 - RNA, 64 nt, Human; identical to SEQ ID NO: 262819

SEQ ID NO: 321175 - RNA, 64 nt, Human; identical to SEQ ID NO: 262820

SEQ ID NO: 321176 - RNA, 64 nt, Human; identical to SEQ ID NO: 262821

SEQ ID NO: 321177 - RNA, 64 nt, Human; identical to SEQ ID NO: 262822

SEQ ID NO: 321178 - RNA, 64 nt, Human; identical to SEQ ID NO: 262823

SEQ ID NO: 321179 - RNA, 64 nt, Human; identical to SEQ ID NO: 262824

SEQ ID NO: 321180 - RNA, 64 nt, Human; identical to SEQ ID NO: 262825

SEQ ID NO: 321181 - RNA, 64 nt, Human; identical to SEQ ID NO: 262826

SEQ ID NO: 321182 - RNA, 64 nt, Human; identical to SEQ ID NO: 262827

SEQ ID NO: 321183 - RNA, 64 nt, Human; identical to SEQ ID NO: 262832

SEQ ID NO: 321184 - RNA, 64 nt, Human; identical to SEQ ID NO: 262833

SEQ ID NO: 321185 - RNA, 64 nt, Human; identical to SEQ ID NO: 262834

SEQ ID NO: 321186 - RNA, 64 nt, Human; identical to SEQ ID NO: 262835

SEQ ID NO: 321187 - RNA, 64 nt, Human; identical to SEQ ID NO: 262836

SEQ ID NO: 321188 - RNA, 64 nt, Human; identical to SEQ ID NO: 262837

SEQ ID NO: 321189 - RNA, 64 nt, Human; identical to SEQ ID NO: 262838

SEQ ID NO: 321190 - RNA, 64 nt, Human; identical to SEQ ID NO: 262839

SEQ ID NO: 321191 - RNA, 53 nt, Human; identical to SEQ ID NO: 262840

SEQ ID NO: 321192 - RNA, 64 nt, Human; identical to SEQ ID NO: 262841

SEQ ID NO: 321193 - RNA, 64 nt, Human; identical to SEQ ID NO: 262842

SEQ ID NO: 321194 - RNA, 64 nt, Human; identical to SEQ ID NO: 262843

SEQ ID NO: 321195 - RNA, 64 nt, Human; identical to SEQ ID NO: 262844

SEQ ID NO: 321196 - RNA, 64 nt, Human; identical to SEQ ID NO: 262845

SEQ ID NO: 321197 - RNA, 64 nt, Human; identical to SEQ ID NO: 262846

SEQ ID NO: 321198 - RNA, 64 nt, Human; identical to SEQ ID NO: 262850

SEQ ID NO: 321199 - RNA, 64 nt, Human; identical to SEQ ID NO: 262851

SEQ ID NO: 321200 - RNA, 64 nt, Human; identical to SEQ ID NO: 262852

SEQ ID NO: 321201 - RNA, 64 nt, Human; identical to SEQ ID NO: 262853

SEQ ID NO: 321202 - RNA, 64 nt, Human; identical to SEQ ID NO: 262854

SEQ ID NO: 321203 - RNA, 64 nt, Human; identical to SEQ ID NO: 262855

SEQ ID NO: 321204 - RNA, 64 nt, Human; identical to SEQ ID NO: 262856

SEQ ID NO: 321205 - RNA, 64 nt, Human; identical to SEQ ID NO: 262857

SEQ ID NO: 321206 - RNA, 50 nt, Human; identical to SEQ ID NO: 262858

SEQ ID NO: 321207 - RNA, 64 nt, Human; identical to SEQ ID NO: 262859

SEQ ID NO: 321208 - RNA, 64 nt, Human; identical to SEQ ID NO: 262860

SEQ ID NO: 321209 - RNA, 64 nt, Human; identical to SEQ ID NO: 262861

SEQ ID NO: 321210 - RNA, 64 nt, Human; identical to SEQ ID NO: 262862

SEQ ID NO: 321211 - RNA, 64 nt, Human; identical to SEQ ID NO: 262863

SEQ ID NO: 321212 - RNA, 64 nt, Human; identical to SEQ ID NO: 262864

SEQ ID NO: 321213 - RNA, 64 nt, Human; identical to SEQ ID NO: 262868

SEQ ID NO: 321214 - RNA, 64 nt, Human; identical to SEQ ID NO: 262869

SEQ ID NO: 321215 - RNA, 64 nt, Human; identical to SEQ ID NO: 262870

SEQ ID NO: 321216 - RNA, 64 nt, Human; identical to SEQ ID NO: 262871

SEQ ID NO: 321217 - RNA, 64 nt, Human; identical to SEQ ID NO: 262872

SEQ ID NO: 321218 - RNA, 64 nt, Human; identical to SEQ ID NO: 262873

SEQ ID NO: 321219 - RNA, 64 nt, Human; identical to SEQ ID NO: 262874

SEQ ID NO: 321220 - RNA, 64 nt, Human; identical to SEQ ID NO: 262875

SEQ ID NO: 321221 - RNA, 64 nt, Human; identical to SEQ ID NO: 262876

SEQ ID NO: 321222 - RNA, 64 nt, Human; identical to SEQ ID NO: 262877

SEQ ID NO: 321223 - RNA, 64 nt, Human; identical to SEQ ID NO: 262878

SEQ ID NO: 321224 - RNA, 64 nt, Human; identical to SEQ ID NO: 262879

SEQ ID NO: 321225 - RNA, 64 nt, Human; identical to SEQ ID NO: 262880

SEQ ID NO: 321226 - RNA, 64 nt, Human; identical to SEQ ID NO: 262881

SEQ ID NO: 321227 - RNA, 64 nt, Human; identical to SEQ ID NO: 262882

SEQ ID NO: 321228 - RNA, 64 nt, Human; identical to SEQ ID NO: 262886

SEQ ID NO: 321229 - RNA, 64 nt, Human; identical to SEQ ID NO: 262887

SEQ ID NO: 321230 - RNA, 64 nt, Human; identical to SEQ ID NO: 262888

SEQ ID NO: 321231 - RNA, 64 nt, Human; identical to SEQ ID NO: 262889

SEQ ID NO: 321232 - RNA, 64 nt, Human; identical to SEQ ID NO: 262890

SEQ ID NO: 321233 - RNA, 64 nt, Human; identical to SEQ ID NO: 262891

SEQ ID NO: 321234 - RNA, 64 nt, Human; identical to SEQ ID NO: 262892

SEQ ID NO: 321235 - RNA, 64 nt, Human; identical to SEQ ID NO: 262893

SEQ ID NO: 321236 - RNA, 64 nt, Human; identical to SEQ ID NO: 262894

SEQ ID NO: 321237 - RNA, 64 nt, Human; identical to SEQ ID NO: 262895

SEQ ID NO: 321238 - RNA, 64 nt, Human; identical to SEQ ID NO: 262896

SEQ ID NO: 321239 - RNA, 64 nt, Human; identical to SEQ ID NO: 262897

SEQ ID NO: 321240 - RNA, 64 nt, Human; identical to SEQ ID NO: 262898

SEQ ID NO: 321241 - RNA, 64 nt, Human; identical to SEQ ID NO: 262899

SEQ ID NO: 321242 - RNA, 64 nt, Human; identical to SEQ ID NO: 262900

SEQ ID NO: 321243 - RNA, 64 nt, Human; identical to SEQ ID NO: 262904

SEQ ID NO: 321244 - RNA, 64 nt, Human; identical to SEQ ID NO: 262905

SEQ ID NO: 321245 - RNA, 64 nt, Human; identical to SEQ ID NO: 262906

SEQ ID NO: 321246 - RNA, 64 nt, Human; identical to SEQ ID NO: 262907

SEQ ID NO: 321247 - RNA, 64 nt, Human; identical to SEQ ID NO: 262908

SEQ ID NO: 321248 - RNA, 64 nt, Human; identical to SEQ ID NO: 262909

SEQ ID NO: 321249 - RNA, 64 nt, Human; identical to SEQ ID NO: 262910

SEQ ID NO: 321250 - RNA, 64 nt, Human; identical to SEQ ID NO: 262911

SEQ ID NO: 321251 - RNA, 64 nt, Human; identical to SEQ ID NO: 262912

SEQ ID NO: 321252 - RNA, 64 nt, Human; identical to SEQ ID NO: 262913

SEQ ID NO: 321253 - RNA, 64 nt, Human; identical to SEQ ID NO: 262914

SEQ ID NO: 321254 - RNA, 64 nt, Human; identical to SEQ ID NO: 262915

SEQ ID NO: 321255 - RNA, 64 nt, Human; identical to SEQ ID NO: 262916

SEQ ID NO: 321256 - RNA, 64 nt, Human; identical to SEQ ID NO: 262917

SEQ ID NO: 321257 - RNA, 64 nt, Human; identical to SEQ ID NO: 262918

SEQ ID NO: 321258 - RNA, 64 nt, Human; identical to SEQ ID NO: 262922

SEQ ID NO: 321259 - RNA, 64 nt, Human; identical to SEQ ID NO: 262923

SEQ ID NO: 321260 - RNA, 64 nt, Human; identical to SEQ ID NO: 262924

SEQ ID NO: 321261 - RNA, 62 nt, Human; identical to SEQ ID NO: 262925

SEQ ID NO: 321262 - RNA, 64 nt, Human; identical to SEQ ID NO: 262926

SEQ ID NO: 321263 - RNA, 64 nt, Human; identical to SEQ ID NO: 262927

SEQ ID NO: 321264 - RNA, 64 nt, Human; identical to SEQ ID NO: 262928

SEQ ID NO: 321265 - RNA, 64 nt, Human; identical to SEQ ID NO: 262929

SEQ ID NO: 321266 - RNA, 64 nt, Human; identical to SEQ ID NO: 262930

SEQ ID NO: 321267 - RNA, 64 nt, Human; identical to SEQ ID NO: 262931

SEQ ID NO: 321268 - RNA, 64 nt, Human; identical to SEQ ID NO: 262932

SEQ ID NO: 321269 - RNA, 64 nt, Human; identical to SEQ ID NO: 262933

SEQ ID NO: 321270 - RNA, 64 nt, Human; identical to SEQ ID NO: 262934

SEQ ID NO: 321271 - RNA, 64 nt, Human; identical to SEQ ID NO: 262935

SEQ ID NO: 321272 - RNA, 64 nt, Human; identical to SEQ ID NO: 262936

SEQ ID NO: 321273 - RNA, 64 nt, Human; identical to SEQ ID NO: 262940

SEQ ID NO: 321274 - RNA, 64 nt, Human; identical to SEQ ID NO: 262941

SEQ ID NO: 321275 - RNA, 64 nt, Human; identical to SEQ ID NO: 262942

SEQ ID NO: 321276 - RNA, 64 nt, Human; identical to SEQ ID NO: 262943

SEQ ID NO: 321277 - RNA, 64 nt, Human; identical to SEQ ID NO: 262944

SEQ ID NO: 321278 - RNA, 64 nt, Human; identical to SEQ ID NO: 262945

SEQ ID NO: 321279 - RNA, 64 nt, Human; identical to SEQ ID NO: 262946

SEQ ID NO: 321280 - RNA, 64 nt, Human; identical to SEQ ID NO: 262947

SEQ ID NO: 321281 - RNA, 53 nt, Human; identical to SEQ ID NO: 262948

SEQ ID NO: 321282 - RNA, 64 nt, Human; identical to SEQ ID NO: 262949

SEQ ID NO: 321283 - RNA, 64 nt, Human; identical to SEQ ID NO: 262950

SEQ ID NO: 321284 - RNA, 64 nt, Human; identical to SEQ ID NO: 262951

SEQ ID NO: 321285 - RNA, 64 nt, Human; identical to SEQ ID NO: 262952

SEQ ID NO: 321286 - RNA, 64 nt, Human; identical to SEQ ID NO: 262953

SEQ ID NO: 321287 - RNA, 64 nt, Human; identical to SEQ ID NO: 262954

SEQ ID NO: 321288 - RNA, 64 nt, Human; identical to SEQ ID NO: 262958

SEQ ID NO: 321289 - RNA, 64 nt, Human; identical to SEQ ID NO: 262959

SEQ ID NO: 321290 - RNA, 64 nt, Human; identical to SEQ ID NO: 262960

SEQ ID NO: 321291 - RNA, 64 nt, Human; identical to SEQ ID NO: 262961

SEQ ID NO: 321292 - RNA, 64 nt, Human; identical to SEQ ID NO: 262962

SEQ ID NO: 321293 - RNA, 64 nt, Human; identical to SEQ ID NO: 262963

SEQ ID NO: 321294 - RNA, 64 nt, Human; identical to SEQ ID NO: 262964

SEQ ID NO: 321295 - RNA, 64 nt, Human; identical to SEQ ID NO: 262965

SEQ ID NO: 321296 - RNA, 64 nt, Human; identical to SEQ ID NO: 262966

SEQ ID NO: 321297 - RNA, 64 nt, Human; identical to SEQ ID NO: 262967

SEQ ID NO: 321298 - RNA, 64 nt, Human; identical to SEQ ID NO: 262968

SEQ ID NO: 321299 - RNA, 64 nt, Human; identical to SEQ ID NO: 262969

SEQ ID NO: 321300 - RNA, 64 nt, Human; identical to SEQ ID NO: 262970

SEQ ID NO: 321301 - RNA, 64 nt, Human; identical to SEQ ID NO: 262971

SEQ ID NO: 321302 - RNA, 64 nt, Human; identical to SEQ ID NO: 262972

SEQ ID NO: 321303 - RNA, 64 nt, Human; identical to SEQ ID NO: 262976

SEQ ID NO: 321304 - RNA, 64 nt, Human; identical to SEQ ID NO: 262977

SEQ ID NO: 321305 - RNA, 64 nt, Human; identical to SEQ ID NO: 262978

SEQ ID NO: 321306 - RNA, 64 nt, Human; identical to SEQ ID NO: 262979

SEQ ID NO: 321307 - RNA, 64 nt, Human; identical to SEQ ID NO: 262980

SEQ ID NO: 321308 - RNA, 64 nt, Human; identical to SEQ ID NO: 262981

SEQ ID NO: 321309 - RNA, 64 nt, Human; identical to SEQ ID NO: 262982

SEQ ID NO: 321310 - RNA, 64 nt, Human; identical to SEQ ID NO: 262983

SEQ ID NO: 321311 - RNA, 64 nt, Human; identical to SEQ ID NO: 262984

SEQ ID NO: 321312 - RNA, 64 nt, Human; identical to SEQ ID NO: 262985

SEQ ID NO: 321313 - RNA, 64 nt, Human; identical to SEQ ID NO: 262986

SEQ ID NO: 321314 - RNA, 64 nt, Human; identical to SEQ ID NO: 262987

SEQ ID NO: 321315 - RNA, 64 nt, Human; identical to SEQ ID NO: 262988

SEQ ID NO: 321316 - RNA, 64 nt, Human; identical to SEQ ID NO: 262989

SEQ ID NO: 321317 - RNA, 64 nt, Human; identical to SEQ ID NO: 262990

SEQ ID NO: 321318 - RNA, 64 nt, Human; identical to SEQ ID NO: 262994

SEQ ID NO: 321319 - RNA, 64 nt, Human; identical to SEQ ID NO: 262995

SEQ ID NO: 321320 - RNA, 64 nt, Human; identical to SEQ ID NO: 262996

SEQ ID NO: 321321 - RNA, 64 nt, Human; identical to SEQ ID NO: 262997

SEQ ID NO: 321322 - RNA, 64 nt, Human; identical to SEQ ID NO: 262998

SEQ ID NO: 321323 - RNA, 64 nt, Human; identical to SEQ ID NO: 262999

SEQ ID NO: 321324 - RNA, 64 nt, Human; identical to SEQ ID NO: 263000

SEQ ID NO: 321325 - RNA, 64 nt, Human; identical to SEQ ID NO: 263001

SEQ ID NO: 321326 - RNA, 64 nt, Human; identical to SEQ ID NO: 263002

SEQ ID NO: 321327 - RNA, 64 nt, Human; identical to SEQ ID NO: 263003

SEQ ID NO: 321328 - RNA, 64 nt, Human; identical to SEQ ID NO: 263004

SEQ ID NO: 321329 - RNA, 64 nt, Human; identical to SEQ ID NO: 263005

SEQ ID NO: 321330 - RNA, 64 nt, Human; identical to SEQ ID NO: 263006

SEQ ID NO: 321331 - RNA, 64 nt, Human; identical to SEQ ID NO: 263007

SEQ ID NO: 321332 - RNA, 64 nt, Human; identical to SEQ ID NO: 263008

SEQ ID NO: 321333 - RNA, 64 nt, Human; identical to SEQ ID NO: 263012

SEQ ID NO: 321334 - RNA, 64 nt, Human; identical to SEQ ID NO: 263013

SEQ ID NO: 321335 - RNA, 64 nt, Human; identical to SEQ ID NO: 263014

SEQ ID NO: 321336 - RNA, 64 nt, Human; identical to SEQ ID NO: 263015

SEQ ID NO: 321337 - RNA, 64 nt, Human; identical to SEQ ID NO: 263016

SEQ ID NO: 321338 - RNA, 64 nt, Human; identical to SEQ ID NO: 263017

SEQ ID NO: 321339 - RNA, 64 nt, Human; identical to SEQ ID NO: 263018

SEQ ID NO: 321340 - RNA, 64 nt, Human; identical to SEQ ID NO: 263019

SEQ ID NO: 321341 - RNA, 64 nt, Human; identical to SEQ ID NO: 263020

SEQ ID NO: 321342 - RNA, 64 nt, Human; identical to SEQ ID NO: 263021

SEQ ID NO: 321343 - RNA, 64 nt, Human; identical to SEQ ID NO: 263022

SEQ ID NO: 321344 - RNA, 64 nt, Human; identical to SEQ ID NO: 263023

SEQ ID NO: 321345 - RNA, 64 nt, Human; identical to SEQ ID NO: 263024

SEQ ID NO: 321346 - RNA, 64 nt, Human; identical to SEQ ID NO: 263025

SEQ ID NO: 321347 - RNA, 64 nt, Human; identical to SEQ ID NO: 263026

SEQ ID NO: 321348 - RNA, 64 nt, Human; identical to SEQ ID NO: 263030

SEQ ID NO: 321349 - RNA, 64 nt, Human; identical to SEQ ID NO: 263031

SEQ ID NO: 321350 - RNA, 64 nt, Human; identical to SEQ ID NO: 263032

SEQ ID NO: 321351 - RNA, 64 nt, Human; identical to SEQ ID NO: 263033

SEQ ID NO: 321352 - RNA, 64 nt, Human; identical to SEQ ID NO: 263034

SEQ ID NO: 321353 - RNA, 64 nt, Human; identical to SEQ ID NO: 263035

SEQ ID NO: 321354 - RNA, 64 nt, Human; identical to SEQ ID NO: 263036

SEQ ID NO: 321355 - RNA, 64 nt, Human; identical to SEQ ID NO: 263037

SEQ ID NO: 321356 - RNA, 64 nt, Human; identical to SEQ ID NO: 263038

SEQ ID NO: 321357 - RNA, 64 nt, Human; identical to SEQ ID NO: 263039

SEQ ID NO: 321358 - RNA, 64 nt, Human; identical to SEQ ID NO: 263040

SEQ ID NO: 321359 - RNA, 64 nt, Human; identical to SEQ ID NO: 263041

SEQ ID NO: 321360 - RNA, 64 nt, Human; identical to SEQ ID NO: 263042

SEQ ID NO: 321361 - RNA, 64 nt, Human; identical to SEQ ID NO: 263043

SEQ ID NO: 321362 - RNA, 64 nt, Human; identical to SEQ ID NO: 263044

SEQ ID NO: 321363 - RNA, 64 nt, Human; identical to SEQ ID NO: 263048

SEQ ID NO: 321364 - RNA, 64 nt, Human; identical to SEQ ID NO: 263049

SEQ ID NO: 321365 - RNA, 64 nt, Human; identical to SEQ ID NO: 263050

SEQ ID NO: 321366 - RNA, 64 nt, Human; identical to SEQ ID NO: 263051

SEQ ID NO: 321367 - RNA, 64 nt, Human; identical to SEQ ID NO: 263052

SEQ ID NO: 321368 - RNA, 64 nt, Human; identical to SEQ ID NO: 263053

SEQ ID NO: 321369 - RNA, 64 nt, Human; identical to SEQ ID NO: 263054

SEQ ID NO: 321370 - RNA, 64 nt, Human; identical to SEQ ID NO: 263055

SEQ ID NO: 321371 - RNA, 64 nt, Human; identical to SEQ ID NO: 263056

SEQ ID NO: 321372 - RNA, 64 nt, Human; identical to SEQ ID NO: 263057

SEQ ID NO: 321373 - RNA, 64 nt, Human; identical to SEQ ID NO: 263058

SEQ ID NO: 321374 - RNA, 64 nt, Human; identical to SEQ ID NO: 263059

SEQ ID NO: 321375 - RNA, 64 nt, Human; identical to SEQ ID NO: 263060

SEQ ID NO: 321376 - RNA, 64 nt, Human; identical to SEQ ID NO: 263061

SEQ ID NO: 321377 - RNA, 64 nt, Human; identical to SEQ ID NO: 263062

SEQ ID NO: 321378 - RNA, 64 nt, Human; identical to SEQ ID NO: 263066

SEQ ID NO: 321379 - RNA, 64 nt, Human; identical to SEQ ID NO: 263067

SEQ ID NO: 321380 - RNA, 64 nt, Human; identical to SEQ ID NO: 263068

SEQ ID NO: 321381 - RNA, 64 nt, Human; identical to SEQ ID NO: 263069

SEQ ID NO: 321382 - RNA, 64 nt, Human; identical to SEQ ID NO: 263070

SEQ ID NO: 321383 - RNA, 64 nt, Human; identical to SEQ ID NO: 263071

SEQ ID NO: 321384 - RNA, 64 nt, Human; identical to SEQ ID NO: 263072

SEQ ID NO: 321385 - RNA, 64 nt, Human; identical to SEQ ID NO: 263073

SEQ ID NO: 321386 - RNA, 64 nt, Human; identical to SEQ ID NO: 263074

SEQ ID NO: 321387 - RNA, 57 nt, Human; identical to SEQ ID NO: 263075

SEQ ID NO: 321388 - RNA, 64 nt, Human; identical to SEQ ID NO: 263076

SEQ ID NO: 321389 - RNA, 64 nt, Human; identical to SEQ ID NO: 263077

SEQ ID NO: 321390 - RNA, 64 nt, Human; identical to SEQ ID NO: 263078

SEQ ID NO: 321391 - RNA, 64 nt, Human; identical to SEQ ID NO: 263079

SEQ ID NO: 321392 - RNA, 64 nt, Human; identical to SEQ ID NO: 263080

SEQ ID NO: 321393 - RNA, 64 nt, Human; identical to SEQ ID NO: 263084

SEQ ID NO: 321394 - RNA, 64 nt, Human; identical to SEQ ID NO: 263085

SEQ ID NO: 321395 - RNA, 64 nt, Human; identical to SEQ ID NO: 263086

SEQ ID NO: 321396 - RNA, 64 nt, Human; identical to SEQ ID NO: 263087

SEQ ID NO: 321397 - RNA, 64 nt, Human; identical to SEQ ID NO: 263088

SEQ ID NO: 321398 - RNA, 64 nt, Human; identical to SEQ ID NO: 263089

SEQ ID NO: 321399 - RNA, 58 nt, Human; identical to SEQ ID NO: 263090

SEQ ID NO: 321400 - RNA, 64 nt, Human
aguagagacaggguuucgcaauguuggccaggccgaucucgaacuucuggccucuagcgaucug

SEQ ID NO: 321401 - RNA, 64 nt, Human
uucaagccuucagccccuccagcuccaagucucagaucucgaccauugaaaagguuucuucauc

SEQ ID NO: 321402 - RNA, 64 nt, Human
ucgcugugucacccaggcuggagugcagugacgcgaucucgacucacugcaaccuccgccuccc

SEQ ID NO: 321403 - RNA, 64 nt, Human
cucgcccugucgccaggcuggaguguaguggcaugaucucgacucacugcaaaaucugccuccc

SEQ ID NO: 321404 - RNA, 64 nt, Human
uaagaugaacuaaacaaacauauuuuagagcauggaucucgaagcagaauuuggcuaaauuuua

SEQ ID NO: 321405 - RNA, 64 nt, Human; identical to SEQ ID NO: 121811

SEQ ID NO: 321406 - RNA, 64 nt, Human; identical to SEQ ID NO: 121812

SEQ ID NO: 321407 - RNA, 64 nt, Human; identical to SEQ ID NO: 121814

SEQ ID NO: 321408 - RNA, 64 nt, Human
agaagguaccccaguccccaguguacuuagaaaggaucucgaacauugcuggacguccucauag

SEQ ID NO: 321409 - RNA, 64 nt, Human
cgggaugaugauagccaguccaggaguccaaguagaucucgaaguaaaucugaaaccaaaucaa

SEQ ID NO: 321410 - RNA, 64 nt, Human
aguagagaugggguuucacugcguuggccaggaugaucucgaucucuugaccuugggauccacc

SEQ ID NO: 321411 - RNA, 64 nt, Human
aguagaggcaggguuucaccauguuagccaggaugaucucgaucuccugaccucaugauccacc

SEQ ID NO: 321412 - RNA, 64 nt, Human
guagucccagcuauuugggaagcugaggugggaggaucucgagccugcgagaucaaggcugcag

SEQ ID NO: 321413 - RNA, 64 nt, Human
uguagagaugggaucucacuauguugcucaggcugaucucgagcuccugggcucaagugauccu

SEQ ID NO: 321414 - RNA, 64 nt, Human
ugagauuuuaugaagucaaaggggacuuuacacagaucucgaccugcuuugaaaccuagaggug

SEQ ID NO: 321415 - RNA, 64 nt, Human
aaaucuaguugucacuuuauuuuggaccugcugugaucucgacaggaaacgugccacagagcag

SEQ ID NO: 321416 - RNA, 64 nt, Human
aguaaagaugggguuuugccauguuugccaggcugaucucgaacuccugaccucaagugaucug

SEQ ID NO: 321417 - RNA, 64 nt, Human
gaaaacuuugccauuauaguaaauuacauuaguugaucucgauaauuugaggauaacagaugac

SEQ ID NO: 321418 - RNA, 64 nt, Human
guuugucaaagucucagcccaguucaauucaguugaucucgaguggugaguauuuugucucuug

SEQ ID NO: 321419 - RNA, 64 nt, Human
uaaguuauguuuuacaugccccguuuuugagacugaucucgaugcagguggaucuccuugagau

SEQ ID NO: 321420 - RNA, 64 nt, Human
gcaggcccuccuccacuucuugguacuaaacgaagaucucgacaccuugcaguuuuacuucauu

SEQ ID NO: 321421 - RNA, 64 nt, Human
aguagagacgggguuucucuauguuggucaggcugaucucgaacucccgaccucaggugauccg

SEQ ID NO: 321422 - RNA, 64 nt, Human
aguagagacaggguuucaccauguuggucaggcugaucucgagcuccugaccucaggugaucua

SEQ ID NO: 321423 - RNA, 64 nt, Human; identical to SEQ ID NO: 121800

SEQ ID NO: 321424 - RNA, 64 nt, Human; identical to SEQ ID NO: 121801

SEQ ID NO: 321425 - RNA, 64 nt, Human; identical to SEQ ID NO: 121805

SEQ ID NO: 321426 - RNA, 64 nt, Human
ucgcucugucgcccaggcuggagugcaguggcgcgaucucgacucacugcaagcuccgccuccc

SEQ ID NO: 321427 - RNA, 64 nt, Human
aguagagauaggguuucacuauguuggcuaggcugaucucgaacucuugaccucaggugaucug

SEQ ID NO: 321428 - RNA, 64 nt, Human
aagccccaagauguugagucagccauucuccaaggaucucgauuuccuuuuaauggaaaauaac

SEQ ID NO: 321429 - RNA, 64 nt, Human
auuugccacugagcuggugaagccccucuaaagagaucucgacccuggggagcagaauucuugu

SEQ ID NO: 321430 - RNA, 64 nt, Human
uugcucuguugcccaggcuggagugcagcggcaugaucucgacucacugcagccuccgccuccu

SEQ ID NO: 321431 - RNA, 64 nt, Human
uauagagauaggguuucaccguguuggccaggcugaucucgaacuccugaccgcaagugaucca

SEQ ID NO: 321432 - RNA, 64 nt, Human
aguagagacgggguuucaccguguuagccaggaugaucucgaucuccugaccucgugauucgcc

SEQ ID NO: 321433 - RNA, 64 nt, Human
gagaaagaaaagaaaaagaaaaagcacaaaaaaagaucucgaacaagaucacguucucccaagu

SEQ ID NO: 321434 - RNA, 64 nt, Human
aucuguuugggguagguguugagcgaggcaaauggaucucgauauuucagaugggcuuuugaug

SEQ ID NO: 321435 - RNA, 64 nt, Human
ugauguauguccgcucccucgucuguucccccaggaucucgaagugacuccgggcugagcagug

SEQ ID NO: 321436 - RNA, 64 nt, Human
gcuccccaaucccugacccuuugaggcccccagugaucucgacuccccccuggccacagacccc

SEQ ID NO: 321437 - RNA, 64 nt, Human
ucuaguaaacucugauuuuugccucuggauaguagaucucgagcguuuaucucgggcuuuaauu

SEQ ID NO: 321438 - RNA, 64 nt, Human
uugugggauaagaucgcccuggugacgaggagcggaucucgaacggaacuuaauaaagguugcc

SEQ ID NO: 321439 - RNA, 64 nt, Human
ccacuuuguaaaaugaggguggaggugggaauaggaucucgaggagacuauuggcauaugauuc

SEQ ID NO: 321440 - RNA, 64 nt, Human
caauuuaucuuaaugaaauauagaccaauucucugaucucgaguuguuuuuguuuggauacagc

SEQ ID NO: 321441 - RNA, 64 nt, Human; identical to SEQ ID NO: 83251

SEQ ID NO: 321442 - RNA, 64 nt, Human; identical to SEQ ID NO: 83256

SEQ ID NO: 321443 - RNA, 64 nt, Human; identical to SEQ ID NO: 83261

SEQ ID NO: 321444 - RNA, 64 nt, Human
ucacucugucacccaggcuggaguguagugacacgaucucgacucacugcaauuuccaccucuc

SEQ ID NO: 321445 - RNA, 64 nt, Human
ucacucuguggcccaggcuggagugcaguggugcgaucucgacucacugcaacccccgccuccu

SEQ ID NO: 321446 - RNA, 64 nt, Human
uucgucuuuccagauugcaguggacacagcccccgaucucgagccccggcccccggcuucuguc

SEQ ID NO: 321447 - RNA, 64 nt, Human
aauagagaugagguuucaccaugauggccaggcugaucucgaacuccuaaccucaagugauccu

SEQ ID NO: 321448 - RNA, 64 nt, Human
cggcggggacccagggagugguuuggggucgccggaucucgaggcuugcccgagccgugcgagc

SEQ ID NO: 321449 - RNA, 64 nt, Human
caaagaggccauuuuggcugcgggaggacacucugaucucgaagccugccauaaagguagcaaa

SEQ ID NO: 321450 - RNA, 64 nt, Human
gauuuugguugcuaagaccugaaucccauauugagaucucgaguagaauccuuggugugguuuc

SEQ ID NO: 321451 - RNA, 64 nt, Human
gucaucagagcauucugugcccagggacaggacagaucucgaggacaccacaguccaccuguuc

SEQ ID NO: 321452 - RNA, 64 nt, Human
gagagggcaucugcagaauaucaucagggacaaagaucucgaggcuaacgauguagguuucauu

SEQ ID NO: 321453 - RNA, 64 nt, Human
uucuaaacuacagaugucaacuccuuggggugcugaucucgaguguuauuuucugauuguggug

SEQ ID NO: 321454 - RNA, 64 nt, Human
gaaacccagaagugauggagagaaaccaacaagagaucucgaacccugucuagaaggaauguau

SEQ ID NO: 321455 - RNA, 64 nt, Human
ccucuuuccaccagcugccagucaagggcagugggaucucgauggagccuccccccccccccac

SEQ ID NO: 321456 - RNA, 64 nt, Human
gccagccagggguccagagcuagcccaggcuggggaucucgacucagacaagauggugacaaug

SEQ ID NO: 321457 - RNA, 64 nt, Human
cugcgggcuucgguguggagggguggagugcugugaucucgacaacuuacuuucaaagacauaa

SEQ ID NO: 321458 - RNA, 64 nt, Human
ccugauggagaggagaacacuagacaugccaacucgggagcauucugccugccugggaacgggg

SEQ ID NO: 321459 - RNA, 64 nt, Human; identical to SEQ ID NO: 83267

SEQ ID NO: 321460 - RNA, 64 nt, Human; identical to SEQ ID NO: 83272

SEQ ID NO: 321461 - RNA, 64 nt, Human; identical to SEQ ID NO: 83278

SEQ ID NO: 321462 - RNA, 64 nt, Human
ccgggcaggcgguccaccuagacccacagccccucgggagcaccccaccucugugugugaugua

SEQ ID NO: 321463 - RNA, 64 nt, Human
gcugcgccaucaccagcccugcgcaacaggacgucgggagcagggaaccugagacagggccacu

SEQ ID NO: 321464 - RNA, 64 nt, Human
gguacuggauaaaaguaaacuucaaaccuuagggcgggagcacuaaaaccaaaauacauguauu

SEQ ID NO: 321465 - RNA, 64 nt, Human
cugugaguuuaggagucuuaagauccucacagcacgggagcagggagaggcucuagaacaaggu

SEQ ID NO: 321466 - RNA, 64 nt, Human
aaucuacucucccuccaaggcagcaaagcagaaucgggagcaguggagcagaaaugugcaagca

SEQ ID NO: 321467 - RNA, 64 nt, Human
uaggugugacaauccgagcaguggagucauucagcgggagcacugcgcgcuauccccucacauu

SEQ ID NO: 321468 - RNA, 64 nt, Human
cggaagaacugaagguugcgaugccuuacucugacgggagcaucuguauuuuuauguuaaaagc

SEQ ID NO: 321469 - RNA, 64 nt, Human
ggguguaauuaggugaaaacagcccagguccucccgggagcacagaggggcuaggggcuggucc

SEQ ID NO: 321470 - RNA, 64 nt, Human
gaaggccuugccuuguguaugugacuccauaucccgggagcaguugaccuuugccaaacacuuu

SEQ ID NO: 321471 - RNA, 64 nt, Human
ucugcugaaggagaauuuggaauucuacuugaugcgggagcaacaaacagcucagggccaaacc

SEQ ID NO: 321472 - RNA, 64 nt, Human
cggaaucggcaaugacccccacccagggggccagcgggagcagggccugcaugagaccccgaca

SEQ ID NO: 321473 - RNA, 64 nt, Human
ccccccacuucccagcagcucugugguaguggggcgggagcagcagggacguaccuuaagauuu

SEQ ID NO: 321474 - RNA, 64 nt, Human
gccguggcucugggcggcgcggacgcgcguagcgcgggagcagggcacugugcugcugcugugg

SEQ ID NO: 321475 - RNA, 64 nt, Human
caagaguaguccuaggaagcccacugauccccaacgggagcaagacuucuaacggcugauuggu

SEQ ID NO: 321476 - RNA, 64 nt, Human
ugacccaaaugaggagagcucugauucucccauccgggagcagugaugucaaacuucugcugcu

SEQ ID NO: 321477 - RNA, 64 nt, Human
cugacagaaugagaccaaacgcagccagccagaucgggagcaaaccaaagaccaucugaggaau

SEQ ID NO: 321478 - RNA, 64 nt, Human
uuccaguaccuuugucacaauccuaacacauuaucgggagcagugucuuccauaauguauaaag

SEQ ID NO: 321479 - RNA, 64 nt, Human
ccuugggcauggacuagcccaagggaaagaccugcgggagcaucugaagagagaagggaugauu

SEQ ID NO: 321480 - RNA, 64 nt, Human
accucccccugcugcugcugccccagcgucuugacgggagcauuggccccugagcccagagaag

SEQ ID NO: 321481 - RNA, 64 nt, Human
acaagcacggccucgagaaaagagccaagcgcaucgggagcacaccagaaaccggcccugagca

SEQ ID NO: 321482 - RNA, 64 nt, Human
uuggcuggcgcucacggacaugcagucacgguagcgggagcaaucacaaaacuguaauuuacuu

SEQ ID NO: 321483 - RNA, 64 nt, Human
ugacaguuaccggcuggagagccggaggugggaccgggagcaggggaccguagaaccgggccgc

SEQ ID NO: 321484 - RNA, 64 nt, Human
ugagcauaguacuugacuacucuagaggcugagacgggagcaucucuugagccugagaagugga

SEQ ID NO: 321485 - RNA, 64 nt, Human
acuguguuuacaggggggaggggagggguucguacgggagcaauaaaggagaaacugagguacc

SEQ ID NO: 321486 - RNA, 64 nt, Human
cccccuccuccccgcgccccagucacuuccuguccgggagcaguagucauuguuguuuuaaccu

SEQ ID NO: 321487 - RNA, 64 nt, Human
aagcaauggggaacguguucucggggcagguuuccgggagcagaugccaaaaagacuuuuucau

SEQ ID NO: 321488 - RNA, 64 nt, Human
ucugcagaaccccugucagaaugacgggcagugucgggagcagggagccaccuucaccugcgag

SEQ ID NO: 321489 - RNA, 64 nt, Human
uuagccagccgcgcagaggaugccgagcacuuuccgggagcaaucggacuccuggucuccuccg

SEQ ID NO: 321490 - RNA, 64 nt, Human
uguggugauaaggcucacagcccugagcucuuuacgggagcaucaacucacaguuaggggacug

SEQ ID NO: 321491 - RNA, 64 nt, Human
ggugggggcacagggcccaccccgcccgggaccccgggagcagaagacgcgccugggcuccgcg

SEQ ID NO: 321492 - RNA, 64 nt, Human
ccgccucucagguucaagugguucuccuuccucagccucccaaguagcugggauuacaggcacc

SEQ ID NO: 321493 - RNA, 64 nt, Human
cgaacuccugaccucaggugauccacccgccugagccucccaaagugcugggauuacaggcaug

SEQ ID NO: 321494 - RNA, 64 nt, Human
agauagcacugcucuggggccaucugaucaccaucgggagcaaaucucugaccuccuugccugc

SEQ ID NO: 321495 - RNA, 64 nt, Human
caaaucugggcauugagcaagcuaugaggguccccgggagcacacgaacccugccaggcccccg

SEQ ID NO: 321496 - RNA, 64 nt, Human
caggguucucugcagccacacaaucagcccggcucgggagcaaacuccccuggaagaacggagu

SEQ ID NO: 321497 - RNA, 64 nt, Human
gaccucagaaaacaccaauucaccacaguagaaccgggagcagggauagcucagcuucucugaa

SEQ ID NO: 321498 - RNA, 64 nt, Human
ggaauaauagacacuggggagguaggguggggagcgggagcaagagcugaaaaacuuaccuacu

SEQ ID NO: 321499 - RNA, 64 nt, Human
ccacuacuuccagaagcaucuccucauuccccgccgggagcaacaucucucuucucgagacccc

SEQ ID NO: 321500 - RNA, 64 nt, Human
ggcgccggugcccgacaugguggugccaccuccgcgggagcacuggugcgcggggccugcgccg

SEQ ID NO: 321501 - RNA, 64 nt, Human
cccacccuccugacuccugcugaugguuaagggccgggagcagaugcugccaaggccacaugca

SEQ ID NO: 321502 - RNA, 64 nt, Human
uggagcgcagggcuggugaauccaugacaagguccgggagcagcagaccaaaaccacagcagcc

SEQ ID NO: 321503 - RNA, 64 nt, Human
cucggcuuccgcccaacagccucuggaggugaggcgggagcaugcccucagcgaggcugggcgg

SEQ ID NO: 321504 - RNA, 64 nt, Human
uuuguauucacuguccccugcaagggggacggggcgggagcacuggucaccgcgggggccgaug

SEQ ID NO: 321505 - RNA, 64 nt, Human
ccuccucggagagcagcagcaccaaccacagcaucgggagcacccagagcacccccugcuccac

SEQ ID NO: 321506 - RNA, 64 nt, Human
cccugcccaggcugcaguagccgagagcuuugaacgggagcagcugcucuuccgccaacccagc

SEQ ID NO: 321507 - RNA, 64 nt, Human
ccagggugugagggaggugcagaggcauccggggcgggagcaagccccagguugugacaggugc

SEQ ID NO: 321508 - RNA, 64 nt, Human
agguucucgggacugaaggaaggccaagccauuacgggagcacagcaugugcugacuacuguac

SEQ ID NO: 321509 - RNA, 64 nt, Human
ugcagugccgcaaucucggcucacugcaaccuccgccucccagguucaagcaauucuccugccu

SEQ ID NO: 321510 - RNA, 64 nt, Human
ucgcacagugucuagauccgaccgcccaacguuugccucccagccugacucccucggcccuuac

SEQ ID NO: 321511 - RNA, 64 nt, Human
cgaacuccugaccucaggugauccacccaccuuggccucccaaagugcugggauuacaggugug

SEQ ID NO: 321512 - RNA, 64 nt, Human
aggccuauaaccccagcucccuaggagaccaaggcgggagcaucucuugaggccaggaguuuga

SEQ ID NO: 321513 - RNA, 64 nt, Human
aaaaagaaaagagagaacagcccauaaugcuccccgggagcagaggccacuaauggagaguggg

SEQ ID NO: 321514 - RNA, 64 nt, Human
acugucuucucacccuuccccacucccugguccccgggagcagcuccuucugcccgacucacuc

SEQ ID NO: 321515 - RNA, 64 nt, Human
cugacuccgggacgagccaguccuaggcugccuccgggagcacuugagguaucccgcaggccau

SEQ ID NO: 321516 - RNA, 64 nt, Human
cugccggcugcaggagccagagaagugacccccgcgggagcagcggcagguggaucuccacggu

SEQ ID NO: 321517 - RNA, 64 nt, Human
gccuaauaggcacccccuguaccucaggcuguggcgggagcagagucccccccuccggccccuc

SEQ ID NO: 321518 - RNA, 64 nt, Human
auucacugaacgguacggagcaguguucucaucccgggagcagcccaaacuggcuggguuucag

SEQ ID NO: 321519 - RNA, 64 nt, Human
gucccccgccuugcagucuccagccgugcggggccgggagcaggccuccggccucccagacuuc

SEQ ID NO: 321520 - RNA, 64 nt, Human
acccacucaccucuccgauccgcaccccgccccacgggagcacuuccuacccccacgagggcac

SEQ ID NO: 321521 - RNA, 64 nt, Human
cauuuucagggagcucagacgucacaggagggagcgggagcaggauguggcccuggccucgcca

SEQ ID NO: 321522 - RNA, 64 nt, Human
augaauaacuccacagcuccuccuggacccugcgcgggagcaggcagcuccugugcuguaaaga

SEQ ID NO: 321523 - RNA, 64 nt, Human
cucccccugggaaucguagcagcgcuucgggguacgggagcagagagggagacagaggagucau

SEQ ID NO: 321524 - RNA, 64 nt, Human
auaaccaaguguccaccaacuaccugcuaagagccgggagcauggaacguguugggauuuagag

SEQ ID NO: 321525 - RNA, 64 nt, Human
ggugcugagccgccacacccugggccuggcccugcgggagcacccugcccugcugguggaauuc

SEQ ID NO: 321526 - RNA, 64 nt, Human
gcaggcugugagcaucgccaggcugcugugggggcgggagcagccucagugucaagggcccgcc

SEQ ID NO: 321527 - RNA, 64 nt, Human
ugaacuccuaaccucgggugauccacccaccuuggccucccaaaguguuaggauuacaggcaug

SEQ ID NO: 321528 - RNA, 64 nt, Human
caaacuccuggccucaggugauccucuugucucagccucccaaagugcugggauuacaggcaug

SEQ ID NO: 321529 - RNA, 64 nt, Human
cgaauuccagaccucaggugauccacccgccucggccucccaaagugcugggauuacaggugcg

SEQ ID NO: 321530 - RNA, 64 nt, Human
ugcguggugaggagcgggagggguuggaguggugcgggagcaggcugccgaguggagggugcca

SEQ ID NO: 321531 - RNA, 64 nt, Human; identical to SEQ ID NO: 121813

SEQ ID NO: 321532 - RNA, 64 nt, Human; identical to SEQ ID NO: 265543

SEQ ID NO: 321533 - RNA, 64 nt, Human; identical to SEQ ID NO: 265544

SEQ ID NO: 321534 - RNA, 64 nt, Human; identical to SEQ ID NO: 265545

SEQ ID NO: 321535 - RNA, 59 nt, Human; identical to SEQ ID NO: 207819

SEQ ID NO: 321536 - RNA, 64 nt, Human; identical to SEQ ID NO: 265550

SEQ ID NO: 321537 - RNA, 64 nt, Human; identical to SEQ ID NO: 265551

SEQ ID NO: 321538 - RNA, 64 nt, Human
ggaacuuugcuccaacuggugugucucacacaaugccucccaaaacacugcucucaccagaacu

SEQ ID NO: 321539 - RNA, 64 nt, Human
caaacuccugaccucaagugaucugcccgccucggccucccaaagugcugagauuacaggcaug

SEQ ID NO: 321540 - RNA, 64 nt, Human
cuugaucucccgaccucgugaucugcccaccucagccucccaaaaugcugggauuacaggcgug

SEQ ID NO: 321541 - RNA, 64 nt, Human
guccuacugcccgggcagccccagcccagcccgccgggagcaaggauggugcuaggucauucau

SEQ ID NO: 321542 - RNA, 64 nt, Human
cccuucucucucccagacccuucccccaccacaucgggagcaauacccccaccaccccuuucac

SEQ ID NO: 321543 - RNA, 64 nt, Human
gugcaccaccagggaccgccgcgccuacucugcacgggagcagggacagcgcuagauuucgugu

SEQ ID NO: 321544 - RNA, 64 nt, Human
ggaggaggagugccaggcaggggcugccgagaugcgggagcaguucuaccacuccugcaagcag

SEQ ID NO: 321545 - RNA, 64 nt, Human
gggaccaagaaagaguaggaagaaggggacgagccgggagcaaaaccaccucagacacccgggc

SEQ ID NO: 321546 - RNA, 64 nt, Human
cggggucuuggccuggaaccuuccagagaggaggcgggagcaauuuuagccccacccugcuccc

SEQ ID NO: 321547 - RNA, 64 nt, Human
cggcacaguggccucaccucccgucgggcacuggcgggagcaaggucgggggcaggcgcugccc

SEQ ID NO: 321548 - RNA, 64 nt, Human
gaaugugccguuccugcccugccuccacccaccucgggagcagaagcccggccuggacaccccu

SEQ ID NO: 321549 - RNA, 64 nt, Human
ucugcagcugugaggaaacagccuucguuagaggcgggagcagagacgagccgcugcucugugu

SEQ ID NO: 321550 - RNA, 64 nt, Human
ccccugaguucagagucggggacccaggccaggucgggagcacagccgcuccccaaacccagca

SEQ ID NO: 321551 - RNA, 64 nt, Human
uugucaagagcgagacuccaucagcccaggcagacgggagcagguucuuggccagcguagacag

SEQ ID NO: 321552 - RNA, 64 nt, Human
uucaaauguugcccaaagaaaccucccugcucuccgggagcagacuucagcuugcccucucugc

SEQ ID NO: 321553 - RNA, 64 nt, Human
ugaaagaugacugcguccuccucugcggcacggacgggagcaggugcagccacaucuuccaggg

SEQ ID NO: 321554 - RNA, 64 nt, Human
gaguagccgugagggaggcggggaccagccagaccgggagcaaaccgucccuuguccccgucuc

SEQ ID NO: 321555 - RNA, 64 nt, Human
cagggccuaccuggauguggaccucacccugacucgggagcagacggaacguuugucccaccag

SEQ ID NO: 321556 - RNA, 64 nt, Human
cucgaacuacugaccucgugauccaccugccauggccucccaaagugcugggauuacaggcgug

SEQ ID NO: 321557 - RNA, 64 nt, Human
uugaacuccugaccucaagugauccaccaccucggccucccaaaguguugagaugacaggcacg

SEQ ID NO: 321558 - RNA, 64 nt, Human
cugcaguugcagggggcgccauggggcuauaggagccucccacuuucaccagagcagccucacu

SEQ ID NO: 321559 - RNA, 64 nt, Human
cccaaguggagcuuuugguguccaguuaggccagcgggagcagucuccugauuuauuuugaucu

SEQ ID NO: 321560 - RNA, 64 nt, Human
agagaagcugcacacccaggagcuuuccaugacccgggagcaugagugaauggggguuccaguu

SEQ ID NO: 321561 - RNA, 64 nt, Human
uccuccugggaguggacggccgggucccgucccccgggagcaucgcucggcucagcaccuuggc

SEQ ID NO: 321562 - RNA, 64 nt, Human
cacgggcugcgccgucugcucggggcugagcuggcgggagcaguuugcguguuuggguuuuuua

SEQ ID NO: 321563 - RNA, 64 nt, Human
uuuaugcucuugugggaggcgacgggggggcaggcgggagcaggcacgggggugaugcugccac

SEQ ID NO: 321564 - RNA, 64 nt, Human
ggcagugggacgcuggccacggccaggguggugucgggagcaggccucaccccgcuggccgugu

SEQ ID NO: 321565 - RNA, 64 nt, Human
ucagacccacggacaggaccccgggacagaaccccgggagcacugcccuaggagcccggacccc

SEQ ID NO: 321566 - RNA, 64 nt, Human
gagcuucagagguggccccaccugagcccccacccgggagcaguguccugugcuuucugcaugc

SEQ ID NO: 321567 - RNA, 64 nt, Human
ccacaccuugcgcugagcagcugugauugugccacgggagcaugagcccuuuuccccacggccc

SEQ ID NO: 321568 - RNA, 64 nt, Human
agacgugccucuugugugccagcuggcuguggcucgggagcagacgcaggccucuccauugucc

SEQ ID NO: 321569 - RNA, 64 nt, Human
aucaccuggcugagcaguuccccuggagccccuucgggagcagggcugugucccagaugggcca

SEQ ID NO: 321570 - RNA, 64 nt, Human
gcagcacgagugucucgggcugcccggagucgcccgggagcaggugcugcagccagaguuacgc

SEQ ID NO: 321571 - RNA, 64 nt, Human
gaaaacugcacaaaauuaagggguugcagaaucacgggagcauaauaauucccuuccauaaucu

SEQ ID NO: 321572 - RNA, 64 nt, Human
ggcaaaccccaaagagagcacuguccaaggaugucgggagcauccugcugcuuaggggaauguu

SEQ ID NO: 321573 - RNA, 64 nt, Human
ccauauguauuagucccccagugcuccagaacagcgggagcacugugcugugcuccuuucaguu

SEQ ID NO: 321574 - RNA, 64 nt, Human
ggaguuucuguugaugugaagaaggcagcucuuggccucccacucccacacuucuuugccuaua

SEQ ID NO: 321575 - RNA, 64 nt, Human
auacccuuaagccagccccacuacuuccuucccugccucccagcucaguauuuaaacaucaucu

SEQ ID NO: 321576 - RNA, 64 nt, Human
caaacuccugaccucaggugauccacccaccucggccucccaaagugcugggauuacaggugug

SEQ ID NO: 321577 - RNA, 64 nt, Human
cccaccugcccaccuggcccugccuuuguuuucccgggagcacggcuggggccuuucuugaucu

SEQ ID NO: 321578 - RNA, 64 nt, Human; identical to SEQ ID NO: 121784

SEQ ID NO: 321579 - RNA, 64 nt, Human; identical to SEQ ID NO: 121785

SEQ ID NO: 321580 - RNA, 64 nt, Human; identical to SEQ ID NO: 121786

SEQ ID NO: 321581 - RNA, 64 nt, Human; identical to SEQ ID NO: 121787

SEQ ID NO: 321582 - RNA, 64 nt, Human; identical to SEQ ID NO: 121788

SEQ ID NO: 321583 - RNA, 64 nt, Human; identical to SEQ ID NO: 121789

SEQ ID NO: 321584 - RNA, 64 nt, Human; identical to SEQ ID NO: 121790

SEQ ID NO: 321585 - RNA, 64 nt, Human; identical to SEQ ID NO: 121791

SEQ ID NO: 321586 - RNA, 64 nt, Human; identical to SEQ ID NO: 121792

SEQ ID NO: 321587 - RNA, 64 nt, Human; identical to SEQ ID NO: 121793

SEQ ID NO: 321588 - RNA, 64 nt, Human; identical to SEQ ID NO: 121794

SEQ ID NO: 321589 - RNA, 64 nt, Human; identical to SEQ ID NO: 121795

SEQ ID NO: 321590 - RNA, 64 nt, Human; identical to SEQ ID NO: 121796

SEQ ID NO: 321591 - RNA, 55 nt, Human; identical to SEQ ID NO: 121797

SEQ ID NO: 321592 - RNA, 64 nt, Human; identical to SEQ ID NO: 121798

SEQ ID NO: 321593 - RNA, 64 nt, Human; identical to SEQ ID NO: 121799

SEQ ID NO: 321594 - RNA, 64 nt, Human; identical to SEQ ID NO: 265552

SEQ ID NO: 321595 - RNA, 64 nt, Human; identical to SEQ ID NO: 265553

SEQ ID NO: 321596 - RNA, 64 nt, Human; identical to SEQ ID NO: 265554

SEQ ID NO: 321597 - RNA, 64 nt, Human; identical to SEQ ID NO: 265555

SEQ ID NO: 321598 - RNA, 64 nt, Human; identical to SEQ ID NO: 265556

SEQ ID NO: 321599 - RNA, 64 nt, Human; identical to SEQ ID NO: 265557

SEQ ID NO: 321600 - RNA, 64 nt, Human; identical to SEQ ID NO: 265558

SEQ ID NO: 321601 - RNA, 64 nt, Human; identical to SEQ ID NO: 265559

SEQ ID NO: 321602 - RNA, 64 nt, Human; identical to SEQ ID NO: 265560

SEQ ID NO: 321603 - RNA, 64 nt, Human; identical to SEQ ID NO: 265561

SEQ ID NO: 321604 - RNA, 64 nt, Human; identical to SEQ ID NO: 265562

SEQ ID NO: 321605 - RNA, 64 nt, Human; identical to SEQ ID NO: 265563

SEQ ID NO: 321606 - RNA, 64 nt, Human; identical to SEQ ID NO: 265564

SEQ ID NO: 321607 - RNA, 64 nt, Human; identical to SEQ ID NO: 265569

SEQ ID NO: 321608 - RNA, 64 nt, Human; identical to SEQ ID NO: 265570

SEQ ID NO: 321609 - RNA, 64 nt, Human
ugaacuccuggccucaagugguccuccugccucagccucccaaaguguggggauuacaggugcg

SEQ ID NO: 321610 - RNA, 64 nt, Human
cgaacuccugaccucaagugacccgcccuugucggccucccaaagugcugggauuacaggcaug

SEQ ID NO: 321611 - RNA, 64 nt, Human
cucaaacuccugaccucgugauccaccugccucggccucccaaagugcugggguuacaagcaug

SEQ ID NO: 321612 - RNA, 64 nt, Human; identical to SEQ ID NO: 265571

SEQ ID NO: 321613 - RNA, 64 nt, Human; identical to SEQ ID NO: 265572

SEQ ID NO: 321614 - RNA, 64 nt, Human; identical to SEQ ID NO: 265573

SEQ ID NO: 321615 - RNA, 64 nt, Human; identical to SEQ ID NO: 265574

SEQ ID NO: 321616 - RNA, 64 nt, Human; identical to SEQ ID NO: 265575

SEQ ID NO: 321617 - RNA, 64 nt, Human; identical to SEQ ID NO: 265576

SEQ ID NO: 321618 - RNA, 64 nt, Human; identical to SEQ ID NO: 265577

SEQ ID NO: 321619 - RNA, 64 nt, Human; identical to SEQ ID NO: 265578

SEQ ID NO: 321620 - RNA, 64 nt, Human; identical to SEQ ID NO: 265579

SEQ ID NO: 321621 - RNA, 64 nt, Human; identical to SEQ ID NO: 265580

SEQ ID NO: 321622 - RNA, 64 nt, Human; identical to SEQ ID NO: 265581

SEQ ID NO: 321623 - RNA, 64 nt, Human; identical to SEQ ID NO: 265582

SEQ ID NO: 321624 - RNA, 64 nt, Human; identical to SEQ ID NO: 265583

SEQ ID NO: 321625 - RNA, 64 nt, Human; identical to SEQ ID NO: 265588

SEQ ID NO: 321626 - RNA, 64 nt, Human; identical to SEQ ID NO: 265589

SEQ ID NO: 321627 - RNA, 62 nt, Human
augcgacugauuuuaggaggaugcuaccaguuucgguagaguaugauugccucguucaaugu

SEQ ID NO: 321628 - RNA, 62 nt, Human
aaaaaaaaucuuacauauauugaucuaguugaucgguagaggaagcuugugaaguagguagg

SEQ ID NO: 321629 - RNA, 64 nt, Human
cucaaacuccugaccucuugauccgccugccuuggccucccaaagugaugggauuacagaugug

SEQ ID NO: 321630 - RNA, 64 nt, Human; identical to SEQ ID NO: 265590

SEQ ID NO: 321631 - RNA, 64 nt, Human
ucacaugguauugccagccucacuggucagccucgccucccagcaggucgcgggucaucagugg

SEQ ID NO: 321632 - RNA, 64 nt, Human
cucgaucucuugaccucgugaucugccugccuuggccucccaaagugcugggauuacaggcgug

SEQ ID NO: 321633 - RNA, 64 nt, Human
ugcaguggcgcaaucucggcucacugcaaccuccgccucccagguugacaccauucuccugccu

SEQ ID NO: 321634 - RNA, 64 nt, Human
cgaacuccugaccucaggugauccacccaccucggccucccaaagugcugggauuacaggcgug

SEQ ID NO: 321635 - RNA, 64 nt, Human
ccugcuggaugcuguucgugccugucccugcucugccucccacccaguugccugaaucauccca

SEQ ID NO: 321636 - RNA, 64 nt, Human
caaacuccuggguucaagcaauccucccaccucggccucccaaagugcugggauugcaggcaug

SEQ ID NO: 321637 - RNA, 64 nt, Human
uauuaacuaauguuuuauugguaaacauuggcuugccucccaugacuugccauuauaauuaaaa

SEQ ID NO: 321638 - RNA, 64 nt, Human
caaacuccuggguucaagccauccucccaccucagccucccaaaaugcugggauuacaggcaug

SEQ ID NO: 321639 - RNA, 64 nt, Human
ugaacucccaaccucaagcaauccuccugccucagccucccaaagugcugagauuacaggugug

SEQ ID NO: 321640 - RNA, 64 nt, Human
caaacuccuaggcuuaagugauccucccgccuuagccucccaagugcuaggauuacaggcauca

SEQ ID NO: 321641 - RNA, 64 nt, Human
cuugaucuccugaccucgugauccacccaccucggccucccaaagugcugggauuacaggcgug

SEQ ID NO: 321642 - RNA, 64 nt, Human
cucgaacuccugaccucaugagccgcccgccuuggccucccaaagugcugggacgugacaggag

SEQ ID NO: 321643 - RNA, 64 nt, Human
gccuggggccugggcagggcucccagccugcaccgccucccacugccaguggggcaugauucuc

SEQ ID NO: 321644 - RNA, 64 nt, Human
uuucucauauauccccugcccucacacaugcauagccucccaccacuaucaguaucccacacca

SEQ ID NO: 321645 - RNA, 64 nt, Human
uaaacuccugggcucaagugaucccccugccuuggccucccaaacuggugagauuacaggcaug

SEQ ID NO: 321646 - RNA, 64 nt, Human
ccccgggcugagagcugggucccgggagauggaagccucccaggcgcgcgaggcuucccgggcg

SEQ ID NO: 321647 - RNA, 64 nt, Human
ucaccuccugaguucaagccauucuccuaccucagccucccaaguagcugggacuaugggugca

SEQ ID NO: 321648 - RNA, 64 nt, Human
gacacggccagugccuaggggugccaaguccaaggccucccacugggagucaucgcugagaaga

SEQ ID NO: 321649 - RNA, 64 nt, Human
ggaaacccuuggcucaagcaauuugccugccucagccucccaaagugcugggauuacaggcgug

SEQ ID NO: 321650 - RNA, 64 nt, Human; identical to SEQ ID NO: 265591

SEQ ID NO: 321651 - RNA, 64 nt, Human; identical to SEQ ID NO: 265592

SEQ ID NO: 321652 - RNA, 64 nt, Human; identical to SEQ ID NO: 265593

SEQ ID NO: 321653 - RNA, 64 nt, Human; identical to SEQ ID NO: 265594

SEQ ID NO: 321654 - RNA, 64 nt, Human; identical to SEQ ID NO: 265595

SEQ ID NO: 321655 - RNA, 64 nt, Human; identical to SEQ ID NO: 265596

SEQ ID NO: 321656 - RNA, 64 nt, Human; identical to SEQ ID NO: 265597

SEQ ID NO: 321657 - RNA, 64 nt, Human; identical to SEQ ID NO: 265598

SEQ ID NO: 321658 - RNA, 64 nt, Human; identical to SEQ ID NO: 265599

SEQ ID NO: 321659 - RNA, 64 nt, Human; identical to SEQ ID NO: 265600

SEQ ID NO: 321660 - RNA, 64 nt, Human; identical to SEQ ID NO: 265601

SEQ ID NO: 321661 - RNA, 64 nt, Human; identical to SEQ ID NO: 265602

SEQ ID NO: 321662 - RNA, 64 nt, Human; identical to SEQ ID NO: 265607

SEQ ID NO: 321663 - RNA, 60 nt, Human; identical to SEQ ID NO: 207877

SEQ ID NO: 321664 - RNA, 53 nt, Human; identical to SEQ ID NO: 207824

SEQ ID NO: 321665 - RNA, 64 nt, Human
ccaagagcacaaccccagggcgaggucuggggaggccucccagcccgccucuguuuacugugca

SEQ ID NO: 321666 - RNA, 64 nt, Human
ugcaguggugugaucuugggucacugcaaacuccgccucccagguucacgccauucuccugccu

SEQ ID NO: 321667 - RNA, 64 nt, Human
cucgaucuccugaccucaugauccacccgccucggccucccaaagugcuguauuuucuuaucug

SEQ ID NO: 321668 - RNA, 64 nt, Human; identical to SEQ ID NO: 265610

SEQ ID NO: 321669 - RNA, 64 nt, Human; identical to SEQ ID NO: 265611

SEQ ID NO: 321670 - RNA, 64 nt, Human; identical to SEQ ID NO: 265612

SEQ ID NO: 321671 - RNA, 64 nt, Human; identical to SEQ ID NO: 265613

SEQ ID NO: 321672 - RNA, 64 nt, Human; identical to SEQ ID NO: 265614

SEQ ID NO: 321673 - RNA, 64 nt, Human; identical to SEQ ID NO: 265615

SEQ ID NO: 321674 - RNA, 64 nt, Human; identical to SEQ ID NO: 265616

SEQ ID NO: 321675 - RNA, 64 nt, Human; identical to SEQ ID NO: 265617

SEQ ID NO: 321676 - RNA, 64 nt, Human; identical to SEQ ID NO: 265618

SEQ ID NO: 321677 - RNA, 64 nt, Human; identical to SEQ ID NO: 265619

SEQ ID NO: 321678 - RNA, 64 nt, Human; identical to SEQ ID NO: 265620

SEQ ID NO: 321679 - RNA, 64 nt, Human; identical to SEQ ID NO: 265621

SEQ ID NO: 321680 - RNA, 64 nt, Human; identical to SEQ ID NO: 265622

SEQ ID NO: 321681 - RNA, 64 nt, Human; identical to SEQ ID NO: 265624

SEQ ID NO: 321682 - RNA, 64 nt, Human; identical to SEQ ID NO: 265625

SEQ ID NO: 321683 - RNA, 64 nt, Human
ugcaguggcaugaucucggcucacugcaagcuccgccucccagguucaugccauucuccuaccu

SEQ ID NO: 321684 - RNA, 64 nt, Human
caaacuccugcacucaagcaauucuucuacccuggccucccaaguagcuggaauuacaggugug

SEQ ID NO: 321685 - RNA, 64 nt, Human
acuacaguauucuuuccccugcuagcaaccaugugccucccauccugacuguggaguugggaug

SEQ ID NO: 321686 - RNA, 64 nt, Human; identical to SEQ ID NO: 265626

SEQ ID NO: 321687 - RNA, 64 nt, Human; identical to SEQ ID NO: 265627

SEQ ID NO: 321688 - RNA, 64 nt, Human; identical to SEQ ID NO: 265628

SEQ ID NO: 321689 - RNA, 64 nt, Human; identical to SEQ ID NO: 265629

SEQ ID NO: 321690 - RNA, 64 nt, Human; identical to SEQ ID NO: 265630

SEQ ID NO: 321691 - RNA, 64 nt, Human; identical to SEQ ID NO: 265631

SEQ ID NO: 321692 - RNA, 64 nt, Human; identical to SEQ ID NO: 265632

SEQ ID NO: 321693 - RNA, 64 nt, Human; identical to SEQ ID NO: 265633

SEQ ID NO: 321694 - RNA, 64 nt, Human; identical to SEQ ID NO: 265634

SEQ ID NO: 321695 - RNA, 64 nt, Human; identical to SEQ ID NO: 265635

SEQ ID NO: 321696 - RNA, 64 nt, Human; identical to SEQ ID NO: 265636

SEQ ID NO: 321697 - RNA, 64 nt, Human; identical to SEQ ID NO: 265637

SEQ ID NO: 321698 - RNA, 64 nt, Human; identical to SEQ ID NO: 265638

SEQ ID NO: 321699 - RNA, 64 nt, Human; identical to SEQ ID NO: 265642

SEQ ID NO: 321700 - RNA, 64 nt, Human; identical to SEQ ID NO: 265643

SEQ ID NO: 321701 - RNA, 64 nt, Human
acccucaagauacucccagauccuaaauccaguagccucccaggcaaaauauagcaaucugcca

SEQ ID NO: 321702 - RNA, 64 nt, Human
ucccgaacuccugagcucaagcaauccugcuucagccucccaaaguacugggauuacaggcauc

SEQ ID NO: 321703 - RNA, 64 nt, Human
cagcucucccauggagccccuccaccgggcgcaugccucccaggccaccucagucucaccugcc

SEQ ID NO: 321704 - RNA, 64 nt, Human; identical to SEQ ID NO: 265644

SEQ ID NO: 321705 - RNA, 56 nt, Human; identical to SEQ ID NO: 207825

SEQ ID NO: 321706 - RNA, 64 nt, Human; identical to SEQ ID NO: 265646

SEQ ID NO: 321707 - RNA, 64 nt, Human; identical to SEQ ID NO: 265647

SEQ ID NO: 321708 - RNA, 64 nt, Human; identical to SEQ ID NO: 265648

SEQ ID NO: 321709 - RNA, 64 nt, Human; identical to SEQ ID NO: 265649

SEQ ID NO: 321710 - RNA, 64 nt, Human; identical to SEQ ID NO: 265650

SEQ ID NO: 321711 - RNA, 64 nt, Human; identical to SEQ ID NO: 265651

SEQ ID NO: 321712 - RNA, 64 nt, Human; identical to SEQ ID NO: 265652

SEQ ID NO: 321713 - RNA, 56 nt, Human; identical to SEQ ID NO: 207826

SEQ ID NO: 321714 - RNA, 64 nt, Human; identical to SEQ ID NO: 265654

SEQ ID NO: 321715 - RNA, 64 nt, Human; identical to SEQ ID NO: 265655

SEQ ID NO: 321716 - RNA, 64 nt, Human; identical to SEQ ID NO: 265656

SEQ ID NO: 321717 - RNA, 64 nt, Human; identical to SEQ ID NO: 265657

SEQ ID NO: 321718 - RNA, 64 nt, Human; identical to SEQ ID NO: 265661

SEQ ID NO: 321719 - RNA, 64 nt, Human
caaccuccugggcucaagcaauccuccugccucggccucccaaagugcugggauuacagaugug

SEQ ID NO: 321720 - RNA, 64 nt, Human
ugcgguggcgcgaucuuggcuuacugcacccucugccucccagguucaagugguucuccugccu

SEQ ID NO: 321721 - RNA, 64 nt, Human
cucgaacucuggguucaagaaauccucccaccuugccucccaaagugcugggauuacaggugug

SEQ ID NO: 321722 - RNA, 64 nt, Human; identical to SEQ ID NO: 265662

SEQ ID NO: 321723 - RNA, 64 nt, Human; identical to SEQ ID NO: 265663

SEQ ID NO: 321724 - RNA, 64 nt, Human; identical to SEQ ID NO: 265664

SEQ ID NO: 321725 - RNA, 64 nt, Human; identical to SEQ ID NO: 265665

SEQ ID NO: 321726 - RNA, 64 nt, Human; identical to SEQ ID NO: 265666

SEQ ID NO: 321727 - RNA, 64 nt, Human; identical to SEQ ID NO: 265667

SEQ ID NO: 321728 - RNA, 64 nt, Human; identical to SEQ ID NO: 265668

SEQ ID NO: 321729 - RNA, 64 nt, Human; identical to SEQ ID NO: 265669

SEQ ID NO: 321730 - RNA, 64 nt, Human; identical to SEQ ID NO: 265670

SEQ ID NO: 321731 - RNA, 64 nt, Human; identical to SEQ ID NO: 265671

SEQ ID NO: 321732 - RNA, 64 nt, Human; identical to SEQ ID NO: 265672

SEQ ID NO: 321733 - RNA, 64 nt, Human; identical to SEQ ID NO: 265673

SEQ ID NO: 321734 - RNA, 64 nt, Human; identical to SEQ ID NO: 265674

SEQ ID NO: 321735 - RNA, 64 nt, Human; identical to SEQ ID NO: 265675

SEQ ID NO: 321736 - RNA, 64 nt, Human; identical to SEQ ID NO: 265676

SEQ ID NO: 321737 - RNA, 64 nt, Human
cuugaucuccugaccucgugauccacccgccucagccucccaaagugcugggauugcaggcaug

SEQ ID NO: 321738 - RNA, 64 nt, Human
ugaacuccugaccucaggugauccaccugccucagccucccaaagugcugggauuacaggcaug

SEQ ID NO: 321739 - RNA, 64 nt, Human
ggcuaugcucccgucuggaagaugccagcaucuggccucccacuguuuucagcuguguccccca

SEQ ID NO: 321740 - RNA, 64 nt, Human; identical to SEQ ID NO: 263663

SEQ ID NO: 321741 - RNA, 64 nt, Human; identical to SEQ ID NO: 263664

SEQ ID NO: 321742 - RNA, 64 nt, Human; identical to SEQ ID NO: 263665

SEQ ID NO: 321743 - RNA, 64 nt, Human; identical to SEQ ID NO: 263666

SEQ ID NO: 321744 - RNA, 64 nt, Human; identical to SEQ ID NO: 263667

SEQ ID NO: 321745 - RNA, 64 nt, Human; identical to SEQ ID NO: 263668

SEQ ID NO: 321746 - RNA, 64 nt, Human; identical to SEQ ID NO: 263669

SEQ ID NO: 321747 - RNA, 64 nt, Human; identical to SEQ ID NO: 263670

SEQ ID NO: 321748 - RNA, 64 nt, Human; identical to SEQ ID NO: 263671

SEQ ID NO: 321749 - RNA, 64 nt, Human; identical to SEQ ID NO: 263672

SEQ ID NO: 321750 - RNA, 64 nt, Human; identical to SEQ ID NO: 263673

SEQ ID NO: 321751 - RNA, 64 nt, Human; identical to SEQ ID NO: 263674

SEQ ID NO: 321752 - RNA, 64 nt, Human; identical to SEQ ID NO: 263675

SEQ ID NO: 321753 - RNA, 64 nt, Human; identical to SEQ ID NO: 263676

SEQ ID NO: 321754 - RNA, 64 nt, Human; identical to SEQ ID NO: 265679

SEQ ID NO: 321755 - RNA, 64 nt, Human
cucgaacuccugagcucaugauccacccaccucggccucccaaagugcugggauuacgggugug

SEQ ID NO: 321756 - RNA, 64 nt, Human
ugacuccccacucaccuggcucucucucuguccugccucccauuaucuaacacauuuuuuacau

SEQ ID NO: 321757 - RNA, 64 nt, Human
ccaccuccuggguucaagcauuucuccugccucagccucccaaguagcugggauuacaggcagc

SEQ ID NO: 321758 - RNA, 64 nt, Human; identical to SEQ ID NO: 265697

SEQ ID NO: 321759 - RNA, 64 nt, Human; identical to SEQ ID NO: 265698

SEQ ID NO: 321760 - RNA, 64 nt, Human; identical to SEQ ID NO: 265699

SEQ ID NO: 321761 - RNA, 64 nt, Human; identical to SEQ ID NO: 265700

SEQ ID NO: 321762 - RNA, 64 nt, Human; identical to SEQ ID NO: 265701

SEQ ID NO: 321763 - RNA, 64 nt, Human; identical to SEQ ID NO: 265702

SEQ ID NO: 321764 - RNA, 64 nt, Human; identical to SEQ ID NO: 265703

SEQ ID NO: 321765 - RNA, 64 nt, Human; identical to SEQ ID NO: 265704

SEQ ID NO: 321766 - RNA, 64 nt, Human; identical to SEQ ID NO: 265705

SEQ ID NO: 321767 - RNA, 64 nt, Human; identical to SEQ ID NO: 265706

SEQ ID NO: 321768 - RNA, 64 nt, Human; identical to SEQ ID NO: 265707

SEQ ID NO: 321769 - RNA, 64 nt, Human; identical to SEQ ID NO: 265708

SEQ ID NO: 321770 - RNA, 64 nt, Human; identical to SEQ ID NO: 265709

SEQ ID NO: 321771 - RNA, 64 nt, Human; identical to SEQ ID NO: 265710

SEQ ID NO: 321772 - RNA, 64 nt, Human; identical to SEQ ID NO: 265711

SEQ ID NO: 321773 - RNA, 64 nt, Human
ucuccagagcccacauccauccuuucucuauauugccucccacagaugugcuaaaauuuauuua

SEQ ID NO: 321774 - RNA, 64 nt, Human
ugcaguggcgcaaucucgggucacugcaagcucugccucccaaguucaugccauucuccugccu

SEQ ID NO: 321775 - RNA, 64 nt, Human
cugccucccaaguucaugccauucuccugccucagccucccaaguagcugggacuacaggcacc

SEQ ID NO: 321776 - RNA, 64 nt, Human; identical to SEQ ID NO: 265716

SEQ ID NO: 321777 - RNA, 64 nt, Human; identical to SEQ ID NO: 265717

SEQ ID NO: 321778 - RNA, 64 nt, Human; identical to SEQ ID NO: 265718

SEQ ID NO: 321779 - RNA, 64 nt, Human; identical to SEQ ID NO: 265719

SEQ ID NO: 321780 - RNA, 64 nt, Human; identical to SEQ ID NO: 265720

SEQ ID NO: 321781 - RNA, 64 nt, Human; identical to SEQ ID NO: 265721

SEQ ID NO: 321782 - RNA, 64 nt, Human; identical to SEQ ID NO: 265722

SEQ ID NO: 321783 - RNA, 61 nt, Human; identical to SEQ ID NO: 207126

SEQ ID NO: 321784 - RNA, 64 nt, Human; identical to SEQ ID NO: 265724

SEQ ID NO: 321785 - RNA, 55 nt, Human; identical to SEQ ID NO: 207961

SEQ ID NO: 321786 - RNA, 64 nt, Human; identical to SEQ ID NO: 265726

SEQ ID NO: 321787 - RNA, 64 nt, Human; identical to SEQ ID NO: 265727

SEQ ID NO: 321788 - RNA, 64 nt, Human; identical to SEQ ID NO: 265728

SEQ ID NO: 321789 - RNA, 64 nt, Human; identical to SEQ ID NO: 265729

SEQ ID NO: 321790 - RNA, 64 nt, Human; identical to SEQ ID NO: 265730

SEQ ID NO: 321791 - RNA, 64 nt, Human
ggucuugaucugaccucgugauccgccgaccucggccucccaaagugcuggaauuacaggcgug

SEQ ID NO: 321792 - RNA, 64 nt, Human
uguucuaguuuugguuccuuuugcagagugaaaugccucccaggaaaaaaauacauauguauuu

SEQ ID NO: 321793 - RNA, 64 nt, Human
cgagcuccugggcucaagugauccucccaccucagccucccaaagugcugggauuacaggugug

SEQ ID NO: 321794 - RNA, 64 nt, Human; identical to SEQ ID NO: 265731

SEQ ID NO: 321795 - RNA, 64 nt, Human; identical to SEQ ID NO: 265735

SEQ ID NO: 321796 - RNA, 64 nt, Human; identical to SEQ ID NO: 265736

SEQ ID NO: 321797 - RNA, 64 nt, Human; identical to SEQ ID NO: 265737

SEQ ID NO: 321798 - RNA, 64 nt, Human; identical to SEQ ID NO: 265738

SEQ ID NO: 321799 - RNA, 64 nt, Human; identical to SEQ ID NO: 265739

SEQ ID NO: 321800 - RNA, 64 nt, Human; identical to SEQ ID NO: 265740

SEQ ID NO: 321801 - RNA, 64 nt, Human; identical to SEQ ID NO: 265741

SEQ ID NO: 321802 - RNA, 64 nt, Human; identical to SEQ ID NO: 265742

SEQ ID NO: 321803 - RNA, 64 nt, Human; identical to SEQ ID NO: 265743

SEQ ID NO: 321804 - RNA, 64 nt, Human; identical to SEQ ID NO: 265744

SEQ ID NO: 321805 - RNA, 64 nt, Human; identical to SEQ ID NO: 265745

SEQ ID NO: 321806 - RNA, 64 nt, Human; identical to SEQ ID NO: 265746

SEQ ID NO: 321807 - RNA, 64 nt, Human; identical to SEQ ID NO: 265747

SEQ ID NO: 321808 - RNA, 64 nt, Human; identical to SEQ ID NO: 265748

SEQ ID NO: 321809 - RNA, 64 nt, Human
caaacuccugaccucaagugauccaccugccucagccucccaaagugcugggauuauagucgug

SEQ ID NO: 321810 - RNA, 64 nt, Human
cuugaucucuugaccucgugaucugccugccucggccucccaaagugcuggcauuacaggcaug

SEQ ID NO: 321811 - RNA, 64 nt, Human
ccaccucccggguucaagugauucucuggccucagccucccaaguagcugggacuacaggugug

SEQ ID NO: 321812 - RNA, 64 nt, Human; identical to SEQ ID NO: 265749

SEQ ID NO: 321813 - RNA, 64 nt, Human; identical to SEQ ID NO: 265754

SEQ ID NO: 321814 - RNA, 64 nt, Human; identical to SEQ ID NO: 265755

SEQ ID NO: 321815 - RNA, 64 nt, Human; identical to SEQ ID NO: 265756

SEQ ID NO: 321816 - RNA, 64 nt, Human; identical to SEQ ID NO: 265757

SEQ ID NO: 321817 - RNA, 64 nt, Human; identical to SEQ ID NO: 265758

SEQ ID NO: 321818 - RNA, 64 nt, Human; identical to SEQ ID NO: 265759

SEQ ID NO: 321819 - RNA, 64 nt, Human; identical to SEQ ID NO: 265760

SEQ ID NO: 321820 - RNA, 50 nt, Human; identical to SEQ ID NO: 208033

SEQ ID NO: 321821 - RNA, 64 nt, Human; identical to SEQ ID NO: 265762

SEQ ID NO: 321822 - RNA, 52 nt, Human; identical to SEQ ID NO: 208035

SEQ ID NO: 321823 - RNA, 64 nt, Human; identical to SEQ ID NO: 265764

SEQ ID NO: 321824 - RNA, 64 nt, Human; identical to SEQ ID NO: 265765

SEQ ID NO: 321825 - RNA, 64 nt, Human; identical to SEQ ID NO: 265766

SEQ ID NO: 321826 - RNA, 64 nt, Human; identical to SEQ ID NO: 265767

SEQ ID NO: 321827 - RNA, 64 nt, Human
caaacuccugaccuccagugaucugcccaccucggccucccaaagugcugggauuacaggugug

SEQ ID NO: 321828 - RNA, 64 nt, Human
cacaggcucuuuggcacagcagggcucccuaugugccucccaaacgucaaaugcaggcuaccca

SEQ ID NO: 321829 - RNA, 64 nt, Human
cucaaucuccugaccuugugaaccacccgucucggccucccaaagugcugggauuacaggugug

SEQ ID NO: 321830 - RNA, 64 nt, Human; identical to SEQ ID NO: 265768

SEQ ID NO: 321831 - RNA, 64 nt, Human; identical to SEQ ID NO: 265769

SEQ ID NO: 321832 - RNA, 52 nt, Human; identical to SEQ ID NO: 208046

SEQ ID NO: 321833 - RNA, 64 nt, Human; identical to SEQ ID NO: 265774

SEQ ID NO: 321834 - RNA, 64 nt, Human; identical to SEQ ID NO: 265775

SEQ ID NO: 321835 - RNA, 64 nt, Human; identical to SEQ ID NO: 265776

SEQ ID NO: 321836 - RNA, 64 nt, Human; identical to SEQ ID NO: 265777

SEQ ID NO: 321837 - RNA, 60 nt, Human; identical to SEQ ID NO: 208051

SEQ ID NO: 321838 - RNA, 62 nt, Human; identical to SEQ ID NO: 208052

SEQ ID NO: 321839 - RNA, 55 nt, Human; identical to SEQ ID NO: 208053

SEQ ID NO: 321840 - RNA, 64 nt, Human; identical to SEQ ID NO: 265781

SEQ ID NO: 321841 - RNA, 64 nt, Human; identical to SEQ ID NO: 265782

SEQ ID NO: 321842 - RNA, 64 nt, Human; identical to SEQ ID NO: 265783

SEQ ID NO: 321843 - RNA, 64 nt, Human; identical to SEQ ID NO: 265784

SEQ ID NO: 321844 - RNA, 64 nt, Human; identical to SEQ ID NO: 265785

SEQ ID NO: 321845 - RNA, 64 nt, Human
cugcuucccagguucacgccauucuccuggcucagccucccaaguagcugggacuacaggcacc

SEQ ID NO: 321846 - RNA, 64 nt, Human
cucaaucucuugaccucgugaucugccugccuuggccucccaaagugcugggauuacaggugug

SEQ ID NO: 321847 - RNA, 64 nt, Human
gcacaaucucggcucucggcucacugcaaccucugccucccagguucaagcgauucuccugccu

SEQ ID NO: 321848 - RNA, 64 nt, Human; identical to SEQ ID NO: 265786

SEQ ID NO: 321849 - RNA, 64 nt, Human; identical to SEQ ID NO: 265787

SEQ ID NO: 321850 - RNA, 64 nt, Human; identical to SEQ ID NO: 265788

SEQ ID NO: 321851 - RNA, 64 nt, Human; identical to SEQ ID NO: 265792

SEQ ID NO: 321852 - RNA, 64 nt, Human; identical to SEQ ID NO: 265793

SEQ ID NO: 321853 - RNA, 64 nt, Human; identical to SEQ ID NO: 265794

SEQ ID NO: 321854 - RNA, 64 nt, Human; identical to SEQ ID NO: 265795

SEQ ID NO: 321855 - RNA, 64 nt, Human; identical to SEQ ID NO: 265796

SEQ ID NO: 321856 - RNA, 64 nt, Human; identical to SEQ ID NO: 265797

SEQ ID NO: 321857 - RNA, 64 nt, Human; identical to SEQ ID NO: 265798

SEQ ID NO: 321858 - RNA, 64 nt, Human; identical to SEQ ID NO: 265799

SEQ ID NO: 321859 - RNA, 64 nt, Human; identical to SEQ ID NO: 265800

SEQ ID NO: 321860 - RNA, 64 nt, Human; identical to SEQ ID NO: 265801

SEQ ID NO: 321861 - RNA, 64 nt, Human; identical to SEQ ID NO: 265802

SEQ ID NO: 321862 - RNA, 64 nt, Human; identical to SEQ ID NO: 265803

SEQ ID NO: 321863 - RNA, 64 nt, Human
gaaacccuugagcucaagugaucuucccacaccagccucccaaaauacugggauuacaggcuug

SEQ ID NO: 321864 - RNA, 64 nt, Human
ugaccuccuugacucaauugauccucccaucucagccucccaaguagcuaggacuacagacaug

SEQ ID NO: 321865 - RNA, 64 nt, Human
ugaacucccaaccucaggugauccacccuccucagccucccaaagugcugggauuacaggcaug

SEQ ID NO: 321866 - RNA, 64 nt, Human; identical to SEQ ID NO: 265804

SEQ ID NO: 321867 - RNA, 64 nt, Human; identical to SEQ ID NO: 265805

SEQ ID NO: 321868 - RNA, 64 nt, Human; identical to SEQ ID NO: 265806

SEQ ID NO: 321869 - RNA, 64 nt, Human; identical to SEQ ID NO: 265811

SEQ ID NO: 321870 - RNA, 64 nt, Human; identical to SEQ ID NO: 265812

SEQ ID NO: 321871 - RNA, 62 nt, Human; identical to SEQ ID NO: 208087

SEQ ID NO: 321872 - RNA, 64 nt, Human; identical to SEQ ID NO: 265814

SEQ ID NO: 321873 - RNA, 64 nt, Human; identical to SEQ ID NO: 265815

SEQ ID NO: 321874 - RNA, 64 nt, Human; identical to SEQ ID NO: 265816

SEQ ID NO: 321875 - RNA, 64 nt, Human; identical to SEQ ID NO: 265817

SEQ ID NO: 321876 - RNA, 64 nt, Human; identical to SEQ ID NO: 265818

SEQ ID NO: 321877 - RNA, 64 nt, Human; identical to SEQ ID NO: 265819

SEQ ID NO: 321878 - RNA, 64 nt, Human; identical to SEQ ID NO: 265820

SEQ ID NO: 321879 - RNA, 64 nt, Human; identical to SEQ ID NO: 265821

SEQ ID NO: 321880 - RNA, 64 nt, Human; identical to SEQ ID NO: 265822

SEQ ID NO: 321881 - RNA, 62 nt, Human; identical to SEQ ID NO: 84439

SEQ ID NO: 321882 - RNA, 64 nt, Human; identical to SEQ ID NO: 246632

SEQ ID NO: 321883 - RNA, 64 nt, Human; identical to SEQ ID NO: 246638

SEQ ID NO: 321884 - RNA, 64 nt, Human; identical to SEQ ID NO: 265823

SEQ ID NO: 321885 - RNA, 64 nt, Human; identical to SEQ ID NO: 265824

SEQ ID NO: 321886 - RNA, 64 nt, Human; identical to SEQ ID NO: 265825

SEQ ID NO: 321887 - RNA, 64 nt, Human; identical to SEQ ID NO: 265830

SEQ ID NO: 321888 - RNA, 64 nt, Human; identical to SEQ ID NO: 265831

SEQ ID NO: 321889 - RNA, 64 nt, Human; identical to SEQ ID NO: 265832

SEQ ID NO: 321890 - RNA, 64 nt, Human; identical to SEQ ID NO: 265833

SEQ ID NO: 321891 - RNA, 64 nt, Human; identical to SEQ ID NO: 265834

SEQ ID NO: 321892 - RNA, 64 nt, Human; identical to SEQ ID NO: 265835

SEQ ID NO: 321893 - RNA, 64 nt, Human; identical to SEQ ID NO: 265836

SEQ ID NO: 321894 - RNA, 64 nt, Human; identical to SEQ ID NO: 265837

SEQ ID NO: 321895 - RNA, 64 nt, Human; identical to SEQ ID NO: 265838

SEQ ID NO: 321896 - RNA, 64 nt, Human; identical to SEQ ID NO: 265839

SEQ ID NO: 321897 - RNA, 64 nt, Human; identical to SEQ ID NO: 265840

SEQ ID NO: 321898 - RNA, 64 nt, Human; identical to SEQ ID NO: 265841

SEQ ID NO: 321899 - RNA, 64 nt, Human; identical to SEQ ID NO: 265842

SEQ ID NO: 321900 - RNA, 64 nt, Human; identical to SEQ ID NO: 265843

SEQ ID NO: 321901 - RNA, 50 nt, Human; identical to SEQ ID NO: 208118

SEQ ID NO: 321902 - RNA, 64 nt, Human; identical to SEQ ID NO: 265849

SEQ ID NO: 321903 - RNA, 64 nt, Human; identical to SEQ ID NO: 265850

SEQ ID NO: 321904 - RNA, 64 nt, Human; identical to SEQ ID NO: 265851

SEQ ID NO: 321905 - RNA, 64 nt, Human; identical to SEQ ID NO: 265852

SEQ ID NO: 321906 - RNA, 64 nt, Human; identical to SEQ ID NO: 265853

SEQ ID NO: 321907 - RNA, 64 nt, Human; identical to SEQ ID NO: 265854

SEQ ID NO: 321908 - RNA, 64 nt, Human; identical to SEQ ID NO: 265855

SEQ ID NO: 321909 - RNA, 64 nt, Human; identical to SEQ ID NO: 265856

SEQ ID NO: 321910 - RNA, 64 nt, Human; identical to SEQ ID NO: 265857

SEQ ID NO: 321911 - RNA, 64 nt, Human; identical to SEQ ID NO: 265858

SEQ ID NO: 321912 - RNA, 64 nt, Human; identical to SEQ ID NO: 265859

SEQ ID NO: 321913 - RNA, 64 nt, Human; identical to SEQ ID NO: 265860

SEQ ID NO: 321914 - RNA, 57 nt, Human
cuuaccugaugcuaaaauaaugugccucggccacaaaaaagcaugcaaagucauugu

SEQ ID NO: 321915 - RNA, 61 nt, Human
cuguguucucugacaggucacucaguuccuccggccacagcugccccucugugagaugaca

SEQ ID NO: 321916 - RNA, 61 nt, Human
gcaccuggaggagagcaggcuagaggcacagcggccacauggugcuggcucugaacguugg

SEQ ID NO: 321917 - RNA, 64 nt, Human; identical to SEQ ID NO: 265861

SEQ ID NO: 321918 - RNA, 64 nt, Human; identical to SEQ ID NO: 265862

SEQ ID NO: 321919 - RNA, 64 nt, Human; identical to SEQ ID NO: 265863

SEQ ID NO: 321920 - RNA, 64 nt, Human; identical to SEQ ID NO: 265868

SEQ ID NO: 321921 - RNA, 64 nt, Human; identical to SEQ ID NO: 265869

SEQ ID NO: 321922 - RNA, 64 nt, Human; identical to SEQ ID NO: 265870

SEQ ID NO: 321923 - RNA, 64 nt, Human; identical to SEQ ID NO: 265871

SEQ ID NO: 321924 - RNA, 64 nt, Human; identical to SEQ ID NO: 265872

SEQ ID NO: 321925 - RNA, 64 nt, Human; identical to SEQ ID NO: 265873

SEQ ID NO: 321926 - RNA, 64 nt, Human; identical to SEQ ID NO: 265874

SEQ ID NO: 321927 - RNA, 64 nt, Human; identical to SEQ ID NO: 265875

SEQ ID NO: 321928 - RNA, 64 nt, Human; identical to SEQ ID NO: 265876

SEQ ID NO: 321929 - RNA, 64 nt, Human; identical to SEQ ID NO: 265877

SEQ ID NO: 321930 - RNA, 64 nt, Human; identical to SEQ ID NO: 265878

SEQ ID NO: 321931 - RNA, 64 nt, Human; identical to SEQ ID NO: 265879

SEQ ID NO: 321932 - RNA, 61 nt, Human
uacagucauuggaauaaggcauggcucagaucggccacagggcgguaccuugugcccaggg

SEQ ID NO: 321933 - RNA, 55 nt, Human
cucugagucccuccgcguagucugccggccacaccgcaucuuccggccgucggac

SEQ ID NO: 321934 - RNA, 61 nt, Human
gcacugagcuguuggggcacacugcccagcccggccacagcagcucagccagucacagcuc

SEQ ID NO: 321935 - RNA, 64 nt, Human; identical to SEQ ID NO: 265880

SEQ ID NO: 321936 - RNA, 64 nt, Human; identical to SEQ ID NO: 265881

SEQ ID NO: 321937 - RNA, 64 nt, Human; identical to SEQ ID NO: 265882

SEQ ID NO: 321938 - RNA, 64 nt, Human; identical to SEQ ID NO: 265887

SEQ ID NO: 321939 - RNA, 64 nt, Human; identical to SEQ ID NO: 265888

SEQ ID NO: 321940 - RNA, 64 nt, Human; identical to SEQ ID NO: 265889

SEQ ID NO: 321941 - RNA, 64 nt, Human; identical to SEQ ID NO: 265890

SEQ ID NO: 321942 - RNA, 64 nt, Human; identical to SEQ ID NO: 265891

SEQ ID NO: 321943 - RNA, 64 nt, Human; identical to SEQ ID NO: 265892

SEQ ID NO: 321944 - RNA, 64 nt, Human; identical to SEQ ID NO: 265893

SEQ ID NO: 321945 - RNA, 64 nt, Human; identical to SEQ ID NO: 265894

SEQ ID NO: 321946 - RNA, 64 nt, Human; identical to SEQ ID NO: 265895

SEQ ID NO: 321947 - RNA, 64 nt, Human; identical to SEQ ID NO: 265896

SEQ ID NO: 321948 - RNA, 64 nt, Human; identical to SEQ ID NO: 265897

SEQ ID NO: 321949 - RNA, 64 nt, Human; identical to SEQ ID NO: 265898

SEQ ID NO: 321950 - RNA, 61 nt, Human
uuucagcucuaggcaugcagacaaccccacacggccacaccaccacaugcccaaguguaca

SEQ ID NO: 321951 - RNA, 61 nt, Human
auucuccgcaccucuguucagggaagggcggcggccacauccccugccgucugcgugucuc

SEQ ID NO: 321952 - RNA, 61 nt, Human
ugccuccuucacauuuccuccccagcuuuugcggccacaacacaucagugucauuugggug

SEQ ID NO: 321953 - RNA, 64 nt, Human; identical to SEQ ID NO: 265899

SEQ ID NO: 321954 - RNA, 64 nt, Human; identical to SEQ ID NO: 265900

SEQ ID NO: 321955 - RNA, 64 nt, Human; identical to SEQ ID NO: 265901

SEQ ID NO: 321956 - RNA, 53 nt, Human; identical to SEQ ID NO: 208175

SEQ ID NO: 321957 - RNA, 64 nt, Human; identical to SEQ ID NO: 265907

SEQ ID NO: 321958 - RNA, 64 nt, Human; identical to SEQ ID NO: 265908

SEQ ID NO: 321959 - RNA, 64 nt, Human; identical to SEQ ID NO: 265909

SEQ ID NO: 321960 - RNA, 64 nt, Human; identical to SEQ ID NO: 265910

SEQ ID NO: 321961 - RNA, 64 nt, Human; identical to SEQ ID NO: 265911

SEQ ID NO: 321962 - RNA, 64 nt, Human; identical to SEQ ID NO: 265912

SEQ ID NO: 321963 - RNA, 64 nt, Human; identical to SEQ ID NO: 265913

SEQ ID NO: 321964 - RNA, 64 nt, Human; identical to SEQ ID NO: 265914

SEQ ID NO: 321965 - RNA, 64 nt, Human; identical to SEQ ID NO: 265915

SEQ ID NO: 321966 - RNA, 64 nt, Human; identical to SEQ ID NO: 265916

SEQ ID NO: 321967 - RNA, 64 nt, Human; identical to SEQ ID NO: 265917

SEQ ID NO: 321968 - RNA, 61 nt, Human
cgugggcuucugggcaggcucacgcagacgccggccacaccauccaccuggccgccuccau

SEQ ID NO: 321969 - RNA, 61 nt, Human
agagaugggcggccccgccccagcgcagugccggccacacccaugcacugaagcuccuccc

SEQ ID NO: 321970 - RNA, 61 nt, Human
aaaggcuaacgauugggcugccacaggcuuacggccacacgugccccugugggucccaggg

SEQ ID NO: 321971 - RNA, 64 nt, Human; identical to SEQ ID NO: 265918

SEQ ID NO: 321972 - RNA, 64 nt, Human; identical to SEQ ID NO: 265919

SEQ ID NO: 321973 - RNA, 64 nt, Human; identical to SEQ ID NO: 265920

SEQ ID NO: 321974 - RNA, 64 nt, Human; identical to SEQ ID NO: 265925

SEQ ID NO: 321975 - RNA, 64 nt, Human; identical to SEQ ID NO: 265926

SEQ ID NO: 321976 - RNA, 64 nt, Human; identical to SEQ ID NO: 265927

SEQ ID NO: 321977 - RNA, 64 nt, Human; identical to SEQ ID NO: 265928

SEQ ID NO: 321978 - RNA, 64 nt, Human; identical to SEQ ID NO: 265929

SEQ ID NO: 321979 - RNA, 64 nt, Human; identical to SEQ ID NO: 265930

SEQ ID NO: 321980 - RNA, 62 nt, Human; identical to SEQ ID NO: 208204

SEQ ID NO: 321981 - RNA, 64 nt, Human; identical to SEQ ID NO: 265932

SEQ ID NO: 321982 - RNA, 64 nt, Human; identical to SEQ ID NO: 265933

SEQ ID NO: 321983 - RNA, 64 nt, Human; identical to SEQ ID NO: 265934

SEQ ID NO: 321984 - RNA, 64 nt, Human; identical to SEQ ID NO: 265935

SEQ ID NO: 321985 - RNA, 64 nt, Human; identical to SEQ ID NO: 265936

SEQ ID NO: 321986 - RNA, 57 nt, Human
uugcacagcucauguacugagcucucacggccacacagcugccggucgcccuuugcu

SEQ ID NO: 321987 - RNA, 61 nt, Human
gccuugcuggacugucagccagucgcagggccggccacaagacccaugucuccaucugguc

SEQ ID NO: 321988 - RNA, 61 nt, Human
ugagugagcaggcguggguggacucuggccgcggccacacuuggugcucaccagcugcuuc

SEQ ID NO: 321989 - RNA, 64 nt, Human; identical to SEQ ID NO: 265937

SEQ ID NO: 321990 - RNA, 64 nt, Human; identical to SEQ ID NO: 265938

SEQ ID NO: 321991 - RNA, 64 nt, Human; identical to SEQ ID NO: 265939

SEQ ID NO: 321992 - RNA, 64 nt, Human; identical to SEQ ID NO: 265940

SEQ ID NO: 321993 - RNA, 64 nt, Human; identical to SEQ ID NO: 265944

SEQ ID NO: 321994 - RNA, 64 nt, Human; identical to SEQ ID NO: 265945

SEQ ID NO: 321995 - RNA, 64 nt, Human; identical to SEQ ID NO: 265946

SEQ ID NO: 321996 - RNA, 64 nt, Human; identical to SEQ ID NO: 265947

SEQ ID NO: 321997 - RNA, 64 nt, Human; identical to SEQ ID NO: 265948

SEQ ID NO: 321998 - RNA, 55 nt, Human; identical to SEQ ID NO: 208219

SEQ ID NO: 321999 - RNA, 64 nt, Human; identical to SEQ ID NO: 265950

SEQ ID NO: 322000 - RNA, 64 nt, Human; identical to SEQ ID NO: 265951

SEQ ID NO: 322001 - RNA, 64 nt, Human; identical to SEQ ID NO: 265952

SEQ ID NO: 322002 - RNA, 64 nt, Human; identical to SEQ ID NO: 265953

SEQ ID NO: 322003 - RNA, 64 nt, Human; identical to SEQ ID NO: 265954

SEQ ID NO: 322004 - RNA, 64 nt, Human
cuggccugugccuggaggguagcacaucuuuccagccucccagggcuuugcagccugcagaugc

SEQ ID NO: 322005 - RNA, 64 nt, Human
uggaacuguuugggaccuuuuggggauguccugugccucccagauuccucgauucugggaggag

SEQ ID NO: 322006 - RNA, 64 nt, Human
uggaggaaggugagauggccaguuugaagccugugccucccagcuuaaauccuagcaggagaga

SEQ ID NO: 322007 - RNA, 64 nt, Human; identical to SEQ ID NO: 265955

SEQ ID NO: 322008 - RNA, 64 nt, Human; identical to SEQ ID NO: 265956

SEQ ID NO: 322009 - RNA, 64 nt, Human; identical to SEQ ID NO: 265957

SEQ ID NO: 322010 - RNA, 64 nt, Human; identical to SEQ ID NO: 265958

SEQ ID NO: 322011 - RNA, 64 nt, Human; identical to SEQ ID NO: 265959

SEQ ID NO: 322012 - RNA, 64 nt, Human; identical to SEQ ID NO: 265963

SEQ ID NO: 322013 - RNA, 64 nt, Human; identical to SEQ ID NO: 265964

SEQ ID NO: 322014 - RNA, 64 nt, Human; identical to SEQ ID NO: 265965

SEQ ID NO: 322015 - RNA, 64 nt, Human; identical to SEQ ID NO: 265966

SEQ ID NO: 322016 - RNA, 64 nt, Human; identical to SEQ ID NO: 265967

SEQ ID NO: 322017 - RNA, 64 nt, Human; identical to SEQ ID NO: 265968

SEQ ID NO: 322018 - RNA, 64 nt, Human; identical to SEQ ID NO: 265969

SEQ ID NO: 322019 - RNA, 64 nt, Human; identical to SEQ ID NO: 265970

SEQ ID NO: 322020 - RNA, 64 nt, Human; identical to SEQ ID NO: 265971

SEQ ID NO: 322021 - RNA, 64 nt, Human; identical to SEQ ID NO: 265972

SEQ ID NO: 322022 - RNA, 64 nt, Human
cuugaucuccugaccucaugaucugccugccucagccucccaaagugcugggauuacaggcuug

SEQ ID NO: 322023 - RNA, 64 nt, Human
uggaguacaguggugcaaucucacugcaagcucugccucccagguucacaccauucuccugccu

SEQ ID NO: 322024 - RNA, 64 nt, Human
cugccuucuggauucaagugauucuugugccuuagccucccaaguagcugggauuacaggcgug

SEQ ID NO: 322025 - RNA, 64 nt, Human; identical to SEQ ID NO: 265973

SEQ ID NO: 322026 - RNA, 64 nt, Human; identical to SEQ ID NO: 265974

SEQ ID NO: 322027 - RNA, 64 nt, Human; identical to SEQ ID NO: 265975

SEQ ID NO: 322028 - RNA, 64 nt, Human; identical to SEQ ID NO: 265976

SEQ ID NO: 322029 - RNA, 64 nt, Human; identical to SEQ ID NO: 265977

SEQ ID NO: 322030 - RNA, 64 nt, Human; identical to SEQ ID NO: 265982

SEQ ID NO: 322031 - RNA, 64 nt, Human; identical to SEQ ID NO: 265983

SEQ ID NO: 322032 - RNA, 64 nt, Human; identical to SEQ ID NO: 265984

SEQ ID NO: 322033 - RNA, 64 nt, Human; identical to SEQ ID NO: 265985

SEQ ID NO: 322034 - RNA, 64 nt, Human; identical to SEQ ID NO: 265986

SEQ ID NO: 322035 - RNA, 64 nt, Human; identical to SEQ ID NO: 265987

SEQ ID NO: 322036 - RNA, 64 nt, Human; identical to SEQ ID NO: 265988

SEQ ID NO: 322037 - RNA, 64 nt, Human; identical to SEQ ID NO: 265989

SEQ ID NO: 322038 - RNA, 64 nt, Human; identical to SEQ ID NO: 265990

SEQ ID NO: 322039 - RNA, 64 nt, Human; identical to SEQ ID NO: 265991

SEQ ID NO: 322040 - RNA, 64 nt, Human
ucaaacuccuggacucaagugaucacccuccucagccucccaaaaugcugggacuaugggcaug

SEQ ID NO: 322041 - RNA, 64 nt, Human
ugaacuccuggccucaagugauccaccugccucggccucccaaagugcugggauuacaggcaug

SEQ ID NO: 322042 - RNA, 64 nt, Human
cugugagcagccuccacuguguccagagacaugggccucccacuccuguuccuugcuagcccug

SEQ ID NO: 322043 - RNA, 64 nt, Human; identical to SEQ ID NO: 265992

SEQ ID NO: 322044 - RNA, 64 nt, Human; identical to SEQ ID NO: 265993

SEQ ID NO: 322045 - RNA, 64 nt, Human; identical to SEQ ID NO: 265994

SEQ ID NO: 322046 - RNA, 64 nt, Human; identical to SEQ ID NO: 265995

SEQ ID NO: 322047 - RNA, 64 nt, Human; identical to SEQ ID NO: 265996

SEQ ID NO: 322048 - RNA, 64 nt, Human; identical to SEQ ID NO: 265999

SEQ ID NO: 322049 - RNA, 64 nt, Human; identical to SEQ ID NO: 266000

SEQ ID NO: 322050 - RNA, 64 nt, Human; identical to SEQ ID NO: 266001

SEQ ID NO: 322051 - RNA, 64 nt, Human; identical to SEQ ID NO: 266002

SEQ ID NO: 322052 - RNA, 64 nt, Human; identical to SEQ ID NO: 266003

SEQ ID NO: 322053 - RNA, 64 nt, Human; identical to SEQ ID NO: 266004

SEQ ID NO: 322054 - RNA, 64 nt, Human; identical to SEQ ID NO: 266005

SEQ ID NO: 322055 - RNA, 64 nt, Human; identical to SEQ ID NO: 266006

SEQ ID NO: 322056 - RNA, 64 nt, Human; identical to SEQ ID NO: 266007

SEQ ID NO: 322057 - RNA, 64 nt, Human; identical to SEQ ID NO: 266008

SEQ ID NO: 322058 - RNA, 64 nt, Human
cucgaacuccugaccucgugauccacccgucucagccucccaaaguacugggauuacaggcgug

SEQ ID NO: 322059 - RNA, 64 nt, Human
ccaggcuguccugggugugagagaacuagauagagccucccaacccugauuuagaaaugcauuc

SEQ ID NO: 322060 - RNA, 64 nt, Human
ucuuccuacugucaguuucugaaacuucugacuggccucccaguuaugccuccuccucaaguuc

SEQ ID NO: 322061 - RNA, 64 nt, Human; identical to SEQ ID NO: 266009

SEQ ID NO: 322062 - RNA, 64 nt, Human; identical to SEQ ID NO: 266010

SEQ ID NO: 322063 - RNA, 64 nt, Human; identical to SEQ ID NO: 266011

SEQ ID NO: 322064 - RNA, 64 nt, Human; identical to SEQ ID NO: 266012

SEQ ID NO: 322065 - RNA, 64 nt, Human; identical to SEQ ID NO: 266013

SEQ ID NO: 322066 - RNA, 64 nt, Human; identical to SEQ ID NO: 266018

SEQ ID NO: 322067 - RNA, 64 nt, Human; identical to SEQ ID NO: 266019

SEQ ID NO: 322068 - RNA, 64 nt, Human; identical to SEQ ID NO: 266020

SEQ ID NO: 322069 - RNA, 64 nt, Human; identical to SEQ ID NO: 266021

SEQ ID NO: 322070 - RNA, 64 nt, Human; identical to SEQ ID NO: 266022

SEQ ID NO: 322071 - RNA, 64 nt, Human; identical to SEQ ID NO: 266023

SEQ ID NO: 322072 - RNA, 64 nt, Human; identical to SEQ ID NO: 266024

SEQ ID NO: 322073 - RNA, 64 nt, Human; identical to SEQ ID NO: 266025

SEQ ID NO: 322074 - RNA, 64 nt, Human; identical to SEQ ID NO: 266026

SEQ ID NO: 322075 - RNA, 64 nt, Human; identical to SEQ ID NO: 266027

SEQ ID NO: 322076 - RNA, 64 nt, Human
cugccucccgaguucaagcaauucuccugccucagccucccaaguagcugggacuacaggugca

SEQ ID NO: 322077 - RNA, 64 nt, Human
caaccuccuggguuuaagcaguccucccgccucagccucccaaaguacugggauuacaggcaug

SEQ ID NO: 322078 - RNA, 64 nt, Human
ugaacucuugaccucaggugauccacccaccucagccucccaaagugcugggauuacaggcaug

SEQ ID NO: 322079 - RNA, 64 nt, Human; identical to SEQ ID NO: 266028

SEQ ID NO: 322080 - RNA, 64 nt, Human; identical to SEQ ID NO: 266029

SEQ ID NO: 322081 - RNA, 64 nt, Human; identical to SEQ ID NO: 266030

SEQ ID NO: 322082 - RNA, 64 nt, Human; identical to SEQ ID NO: 266031

SEQ ID NO: 322083 - RNA, 64 nt, Human; identical to SEQ ID NO: 266032

SEQ ID NO: 322084 - RNA, 64 nt, Human; identical to SEQ ID NO: 266037

SEQ ID NO: 322085 - RNA, 64 nt, Human; identical to SEQ ID NO: 266038

SEQ ID NO: 322086 - RNA, 64 nt, Human; identical to SEQ ID NO: 266039

SEQ ID NO: 322087 - RNA, 64 nt, Human; identical to SEQ ID NO: 266040

SEQ ID NO: 322088 - RNA, 64 nt, Human; identical to SEQ ID NO: 266041

SEQ ID NO: 322089 - RNA, 64 nt, Human; identical to SEQ ID NO: 266042

SEQ ID NO: 322090 - RNA, 64 nt, Human; identical to SEQ ID NO: 266043

SEQ ID NO: 322091 - RNA, 64 nt, Human; identical to SEQ ID NO: 266044

SEQ ID NO: 322092 - RNA, 64 nt, Human; identical to SEQ ID NO: 266045

SEQ ID NO: 322093 - RNA, 64 nt, Human; identical to SEQ ID NO: 266046

SEQ ID NO: 322094 - RNA, 64 nt, Human
ccgccucccagguucaagcaauucuccugccucagccucccaaguaggugggacuacaggugcc

SEQ ID NO: 322095 - RNA, 64 nt, Human
ugcaauggcgugaucucggcucaccgcaaccuccgccucccagguucaagcaauucuccugccu

SEQ ID NO: 322096 - RNA, 64 nt, Human
ugaacuccuggccacaagugaucugcccgccuuggccucccaaagugcugggauuacaggcgua

SEQ ID NO: 322097 - RNA, 64 nt, Human; identical to SEQ ID NO: 266047

SEQ ID NO: 322098 - RNA, 64 nt, Human; identical to SEQ ID NO: 266048

SEQ ID NO: 322099 - RNA, 64 nt, Human; identical to SEQ ID NO: 266049

SEQ ID NO: 322100 - RNA, 64 nt, Human; identical to SEQ ID NO: 266050

SEQ ID NO: 322101 - RNA, 64 nt, Human; identical to SEQ ID NO: 266051

SEQ ID NO: 322102 - RNA, 64 nt, Human; identical to SEQ ID NO: 266056

SEQ ID NO: 322103 - RNA, 64 nt, Human; identical to SEQ ID NO: 266057

SEQ ID NO: 322104 - RNA, 64 nt, Human; identical to SEQ ID NO: 266058

SEQ ID NO: 322105 - RNA, 64 nt, Human; identical to SEQ ID NO: 266059

SEQ ID NO: 322106 - RNA, 64 nt, Human; identical to SEQ ID NO: 266060

SEQ ID NO: 322107 - RNA, 64 nt, Human; identical to SEQ ID NO: 266061

SEQ ID NO: 322108 - RNA, 64 nt, Human; identical to SEQ ID NO: 266062

SEQ ID NO: 322109 - RNA, 64 nt, Human; identical to SEQ ID NO: 266063

SEQ ID NO: 322110 - RNA, 64 nt, Human; identical to SEQ ID NO: 266064

SEQ ID NO: 322111 - RNA, 53 nt, Human; identical to SEQ ID NO: 208338

SEQ ID NO: 322112 - RNA, 61 nt, Human
gucuggcugucaccuucacaagccacagaaacggccacacauguucacagcucacacgccc

SEQ ID NO: 322113 - RNA, 61 nt, Human
cacaucuuccagggccugccggcaucaccugcggccacaccugagauggaccccacgcagc

SEQ ID NO: 322114 - RNA, 61 nt, Human
ccgccagcucccccagacccccuccaccccccggccacacguguccuauuccccugugauc

SEQ ID NO: 322115 - RNA, 64 nt, Human; identical to SEQ ID NO: 266066

SEQ ID NO: 322116 - RNA, 64 nt, Human; identical to SEQ ID NO: 266067

SEQ ID NO: 322117 - RNA, 64 nt, Human; identical to SEQ ID NO: 266068

SEQ ID NO: 322118 - RNA, 64 nt, Human; identical to SEQ ID NO: 266069

SEQ ID NO: 322119 - RNA, 64 nt, Human; identical to SEQ ID NO: 266070

SEQ ID NO: 322120 - RNA, 64 nt, Human; identical to SEQ ID NO: 266071

SEQ ID NO: 322121 - RNA, 64 nt, Human; identical to SEQ ID NO: 266075

SEQ ID NO: 322122 - RNA, 64 nt, Human; identical to SEQ ID NO: 266076

SEQ ID NO: 322123 - RNA, 64 nt, Human; identical to SEQ ID NO: 266077

SEQ ID NO: 322124 - RNA, 64 nt, Human; identical to SEQ ID NO: 266078

SEQ ID NO: 322125 - RNA, 64 nt, Human; identical to SEQ ID NO: 266079

SEQ ID NO: 322126 - RNA, 64 nt, Human; identical to SEQ ID NO: 266080

SEQ ID NO: 322127 - RNA, 64 nt, Human; identical to SEQ ID NO: 266081

SEQ ID NO: 322128 - RNA, 64 nt, Human; identical to SEQ ID NO: 266082

SEQ ID NO: 322129 - RNA, 64 nt, Human; identical to SEQ ID NO: 266083

SEQ ID NO: 322130 - RNA, 64 nt, Human
cgaacuccugaccucaggugaucugcccaccuuggccucccaaagugcugggauuacaggcaug

SEQ ID NO: 322131 - RNA, 64 nt, Human
acccgaagcccagcuggggcccugguccagccucgccucccagacucugcaccugcuagcacag

SEQ ID NO: 322132 - RNA, 64 nt, Human
ugaacuccugaccucaacugauccgcccaccuuggccucccaagugcugggauuacaggcgcga

SEQ ID NO: 322133 - RNA, 64 nt, Human; identical to SEQ ID NO: 266084

SEQ ID NO: 322134 - RNA, 64 nt, Human; identical to SEQ ID NO: 266085

SEQ ID NO: 322135 - RNA, 64 nt, Human; identical to SEQ ID NO: 266086

SEQ ID NO: 322136 - RNA, 64 nt, Human; identical to SEQ ID NO: 266087

SEQ ID NO: 322137 - RNA, 64 nt, Human; identical to SEQ ID NO: 266088

SEQ ID NO: 322138 - RNA, 64 nt, Human; identical to SEQ ID NO: 266089

SEQ ID NO: 322139 - RNA, 64 nt, Human; identical to SEQ ID NO: 266094

SEQ ID NO: 322140 - RNA, 64 nt, Human; identical to SEQ ID NO: 266095

SEQ ID NO: 322141 - RNA, 64 nt, Human; identical to SEQ ID NO: 266096

SEQ ID NO: 322142 - RNA, 64 nt, Human; identical to SEQ ID NO: 266097

SEQ ID NO: 322143 - RNA, 64 nt, Human; identical to SEQ ID NO: 266098

SEQ ID NO: 322144 - RNA, 64 nt, Human; identical to SEQ ID NO: 266099

SEQ ID NO: 322145 - RNA, 64 nt, Human; identical to SEQ ID NO: 266100

SEQ ID NO: 322146 - RNA, 64 nt, Human; identical to SEQ ID NO: 266101

SEQ ID NO: 322147 - RNA, 64 nt, Human; identical to SEQ ID NO: 266102

SEQ ID NO: 322148 - RNA, 62 nt, Human
ggaaugaaucccuuaccaacucagugccagcaucgguagacaccagucagugcugaucgcuu

SEQ ID NO: 322149 - RNA, 62 nt, Human
gggcagaguggaugccccacugcccuagacccucgguagacguggggucucuggggcggggu

SEQ ID NO: 322150 - RNA, 64 nt, Human
ugugguggcacagucucagcucacugcaaccucugccucccaguucaagcaauucuucugccuc

SEQ ID NO: 322151 - RNA, 64 nt, Human; identical to SEQ ID NO: 266103

SEQ ID NO: 322152 - RNA, 64 nt, Human; identical to SEQ ID NO: 266104

SEQ ID NO: 322153 - RNA, 64 nt, Human; identical to SEQ ID NO: 266105

SEQ ID NO: 322154 - RNA, 64 nt, Human; identical to SEQ ID NO: 266106

SEQ ID NO: 322155 - RNA, 64 nt, Human; identical to SEQ ID NO: 266107

SEQ ID NO: 322156 - RNA, 64 nt, Human; identical to SEQ ID NO: 266108

SEQ ID NO: 322157 - RNA, 64 nt, Human; identical to SEQ ID NO: 266109

SEQ ID NO: 322158 - RNA, 64 nt, Human; identical to SEQ ID NO: 266111

SEQ ID NO: 322159 - RNA, 64 nt, Human; identical to SEQ ID NO: 266112

SEQ ID NO: 322160 - RNA, 64 nt, Human; identical to SEQ ID NO: 266113

SEQ ID NO: 322161 - RNA, 64 nt, Human; identical to SEQ ID NO: 266114

SEQ ID NO: 322162 - RNA, 64 nt, Human; identical to SEQ ID NO: 266115

SEQ ID NO: 322163 - RNA, 64 nt, Human; identical to SEQ ID NO: 266116

SEQ ID NO: 322164 - RNA, 64 nt, Human; identical to SEQ ID NO: 266117

SEQ ID NO: 322165 - RNA, 64 nt, Human; identical to SEQ ID NO: 266118

SEQ ID NO: 322166 - RNA, 62 nt, Human
cacccaaccacgcccagcuaauuuuuguauuuucgguagagacgggauuucaccauguuggc

SEQ ID NO: 322167 - RNA, 62 nt, Human
ucuccaugccuggaauccacgggugaagagagucgguagaucucauaagaaagaauccaguc

SEQ ID NO: 322168 - RNA, 62 nt, Human
aaaaaucaaaauauaauauauuuuuuuaccaaucgguagagaagagacaguuuaauauuugu

SEQ ID NO: 322169 - RNA, 64 nt, Human; identical to SEQ ID NO: 266119

SEQ ID NO: 322170 - RNA, 64 nt, Human; identical to SEQ ID NO: 266120

SEQ ID NO: 322171 - RNA, 64 nt, Human; identical to SEQ ID NO: 266121

SEQ ID NO: 322172 - RNA, 64 nt, Human; identical to SEQ ID NO: 266122

SEQ ID NO: 322173 - RNA, 64 nt, Human; identical to SEQ ID NO: 266123

SEQ ID NO: 322174 - RNA, 64 nt, Human; identical to SEQ ID NO: 266124

SEQ ID NO: 322175 - RNA, 64 nt, Human; identical to SEQ ID NO: 266125

SEQ ID NO: 322176 - RNA, 64 nt, Human; identical to SEQ ID NO: 266130

SEQ ID NO: 322177 - RNA, 64 nt, Human; identical to SEQ ID NO: 266131

SEQ ID NO: 322178 - RNA, 64 nt, Human; identical to SEQ ID NO: 266132

SEQ ID NO: 322179 - RNA, 64 nt, Human; identical to SEQ ID NO: 266133

SEQ ID NO: 322180 - RNA, 64 nt, Human; identical to SEQ ID NO: 266134

SEQ ID NO: 322181 - RNA, 64 nt, Human; identical to SEQ ID NO: 266135

SEQ ID NO: 322182 - RNA, 64 nt, Human; identical to SEQ ID NO: 266136

SEQ ID NO: 322183 - RNA, 64 nt, Human; identical to SEQ ID NO: 266137

SEQ ID NO: 322184 - RNA, 64 nt, Human
cucgaucuccugaccucgugaucccccugccucggccucccaaagugcugggauuacaggcgug

SEQ ID NO: 322185 - RNA, 64 nt, Human
ccggcgggggccgcagacugggagcucccgguccgccucccagcaucccugcgagcguucaugg

SEQ ID NO: 322186 - RNA, 64 nt, Human
ggggagauugaacuuuccccgucucccgucuucugccucccacuccauaccccgccaaggaaag

SEQ ID NO: 322187 - RNA, 64 nt, Human; identical to SEQ ID NO: 266138

SEQ ID NO: 322188 - RNA, 64 nt, Human; identical to SEQ ID NO: 266139

SEQ ID NO: 322189 - RNA, 64 nt, Human; identical to SEQ ID NO: 266140

SEQ ID NO: 322190 - RNA, 64 nt, Human; identical to SEQ ID NO: 266141

SEQ ID NO: 322191 - RNA, 64 nt, Human; identical to SEQ ID NO: 266142

SEQ ID NO: 322192 - RNA, 64 nt, Human; identical to SEQ ID NO: 266143

SEQ ID NO: 322193 - RNA, 64 nt, Human; identical to SEQ ID NO: 266144

SEQ ID NO: 322194 - RNA, 64 nt, Human; identical to SEQ ID NO: 266149

SEQ ID NO: 322195 - RNA, 64 nt, Human; identical to SEQ ID NO: 266150

SEQ ID NO: 322196 - RNA, 64 nt, Human; identical to SEQ ID NO: 266151

SEQ ID NO: 322197 - RNA, 64 nt, Human; identical to SEQ ID NO: 266152

SEQ ID NO: 322198 - RNA, 64 nt, Human; identical to SEQ ID NO: 266153

SEQ ID NO: 322199 - RNA, 64 nt, Human; identical to SEQ ID NO: 266154

SEQ ID NO: 322200 - RNA, 64 nt, Human; identical to SEQ ID NO: 266155

SEQ ID NO: 322201 - RNA, 64 nt, Human; identical to SEQ ID NO: 266156

SEQ ID NO: 322202 - RNA, 62 nt, Human
gagguggccugagucagcacacaucuucccacucgguagacaggcuggccucucccucacuu

SEQ ID NO: 322203 - RNA, 62 nt, Human
cacuguuugcuuuggcaaaugccgaggaguccucgguagaccaccuugaugucugcugugac

SEQ ID NO: 322204 - RNA, 64 nt, Human
caaacuccugaacccuaguaauucuccuaucucagccucccaaagugcuaggguuacagacaug

SEQ ID NO: 322205 - RNA, 64 nt, Human; identical to SEQ ID NO: 266157

SEQ ID NO: 322206 - RNA, 64 nt, Human; identical to SEQ ID NO: 266158

SEQ ID NO: 322207 - RNA, 64 nt, Human; identical to SEQ ID NO: 266159

SEQ ID NO: 322208 - RNA, 56 nt, Human; identical to SEQ ID NO: 208436

SEQ ID NO: 322209 - RNA, 64 nt, Human; identical to SEQ ID NO: 266161

SEQ ID NO: 322210 - RNA, 64 nt, Human; identical to SEQ ID NO: 266162

SEQ ID NO: 322211 - RNA, 64 nt, Human; identical to SEQ ID NO: 266163

SEQ ID NO: 322212 - RNA, 64 nt, Human; identical to SEQ ID NO: 266164

SEQ ID NO: 322213 - RNA, 64 nt, Human; identical to SEQ ID NO: 266168

SEQ ID NO: 322214 - RNA, 64 nt, Human; identical to SEQ ID NO: 266169

SEQ ID NO: 322215 - RNA, 64 nt, Human; identical to SEQ ID NO: 266170

SEQ ID NO: 322216 - RNA, 64 nt, Human; identical to SEQ ID NO: 266171

SEQ ID NO: 322217 - RNA, 64 nt, Human; identical to SEQ ID NO: 266172

SEQ ID NO: 322218 - RNA, 64 nt, Human; identical to SEQ ID NO: 266173

SEQ ID NO: 322219 - RNA, 64 nt, Human; identical to SEQ ID NO: 266174

SEQ ID NO: 322220 - RNA, 64 nt, Human
guuuaugguuucauaggcaaaaauaauggucuaagccucccaauagggauaaauuuagggugac

SEQ ID NO: 322221 - RNA, 64 nt, Human
ccaacuccugagcucaggcagucugcccaccuuggccucccaaagugcugcaguuacaggcgug

SEQ ID NO: 322222 - RNA, 64 nt, Human
caaagaaaaugacauuggggaggggaggugcuccgccucccagcuuuucucaaaauaguccuau

SEQ ID NO: 322223 - RNA, 64 nt, Human; identical to SEQ ID NO: 266175

SEQ ID NO: 322224 - RNA, 64 nt, Human; identical to SEQ ID NO: 266176

SEQ ID NO: 322225 - RNA, 64 nt, Human; identical to SEQ ID NO: 266177

SEQ ID NO: 322226 - RNA, 64 nt, Human; identical to SEQ ID NO: 266178

SEQ ID NO: 322227 - RNA, 64 nt, Human; identical to SEQ ID NO: 266179

SEQ ID NO: 322228 - RNA, 64 nt, Human; identical to SEQ ID NO: 266180

SEQ ID NO: 322229 - RNA, 64 nt, Human; identical to SEQ ID NO: 266181

SEQ ID NO: 322230 - RNA, 64 nt, Human; identical to SEQ ID NO: 266182

SEQ ID NO: 322231 - RNA, 54 nt, Human; identical to SEQ ID NO: 208464

SEQ ID NO: 322232 - RNA, 64 nt, Human; identical to SEQ ID NO: 266188

SEQ ID NO: 322233 - RNA, 64 nt, Human; identical to SEQ ID NO: 266189

SEQ ID NO: 322234 - RNA, 64 nt, Human; identical to SEQ ID NO: 266190

SEQ ID NO: 322235 - RNA, 64 nt, Human; identical to SEQ ID NO: 266191

SEQ ID NO: 322236 - RNA, 64 nt, Human; identical to SEQ ID NO: 266192

SEQ ID NO: 322237 - RNA, 64 nt, Human; identical to SEQ ID NO: 266193

SEQ ID NO: 322238 - RNA, 64 nt, Human
caaacuccugaccucaagugauccgcccuccccagccucccaaagugcugggauuacaggugug

SEQ ID NO: 322239 - RNA, 64 nt, Human
cucaaucuccuaaccuugagauccacccuccacagccucccaaacugcugggauuacaggugug

SEQ ID NO: 322240 - RNA, 64 nt, Human
ccaacucccugguuuaagggauucuccugccucagccucccaaguagcugggauuacagacuca

SEQ ID NO: 322241 - RNA, 64 nt, Human; identical to SEQ ID NO: 266194

SEQ ID NO: 322242 - RNA, 64 nt, Human; identical to SEQ ID NO: 266195

SEQ ID NO: 322243 - RNA, 64 nt, Human; identical to SEQ ID NO: 266196

SEQ ID NO: 322244 - RNA, 64 nt, Human; identical to SEQ ID NO: 266197

SEQ ID NO: 322245 - RNA, 64 nt, Human; identical to SEQ ID NO: 266198

SEQ ID NO: 322246 - RNA, 64 nt, Human; identical to SEQ ID NO: 266199

SEQ ID NO: 322247 - RNA, 64 nt, Human; identical to SEQ ID NO: 266200

SEQ ID NO: 322248 - RNA, 64 nt, Human; identical to SEQ ID NO: 266201

SEQ ID NO: 322249 - RNA, 64 nt, Human; identical to SEQ ID NO: 266202

SEQ ID NO: 322250 - RNA, 64 nt, Human; identical to SEQ ID NO: 266206

SEQ ID NO: 322251 - RNA, 64 nt, Human; identical to SEQ ID NO: 266207

SEQ ID NO: 322252 - RNA, 64 nt, Human; identical to SEQ ID NO: 266208

SEQ ID NO: 322253 - RNA, 64 nt, Human; identical to SEQ ID NO: 266209

SEQ ID NO: 322254 - RNA, 64 nt, Human; identical to SEQ ID NO: 266210

SEQ ID NO: 322255 - RNA, 64 nt, Human; identical to SEQ ID NO: 266211

SEQ ID NO: 322256 - RNA, 64 nt, Human
cucgaucuccugaccucaugauccgcccgccucggccucccaaagugcugggauuacaggcgug

SEQ ID NO: 322257 - RNA, 64 nt, Human
ugaacuccugaccucaggugauccacccaccucggccucccaaaguguugggauuacaggcgug

SEQ ID NO: 322258 - RNA, 64 nt, Human
gcuuaauuuuaacaaaaccauacgucagaccauugccucccaguuaccuugaugaacgguaucu

SEQ ID NO: 322259 - RNA, 64 nt, Human; identical to SEQ ID NO: 266212

SEQ ID NO: 322260 - RNA, 64 nt, Human; identical to SEQ ID NO: 266213

SEQ ID NO: 322261 - RNA, 64 nt, Human; identical to SEQ ID NO: 266214

SEQ ID NO: 322262 - RNA, 64 nt, Human; identical to SEQ ID NO: 266215

SEQ ID NO: 322263 - RNA, 64 nt, Human; identical to SEQ ID NO: 266216

SEQ ID NO: 322264 - RNA, 64 nt, Human; identical to SEQ ID NO: 266217

SEQ ID NO: 322265 - RNA, 64 nt, Human; identical to SEQ ID NO: 266218

SEQ ID NO: 322266 - RNA, 64 nt, Human; identical to SEQ ID NO: 266219

SEQ ID NO: 322267 - RNA, 64 nt, Human; identical to SEQ ID NO: 266220

SEQ ID NO: 322268 - RNA, 64 nt, Human; identical to SEQ ID NO: 266225

SEQ ID NO: 322269 - RNA, 64 nt, Human; identical to SEQ ID NO: 266226

SEQ ID NO: 322270 - RNA, 64 nt, Human; identical to SEQ ID NO: 266227

SEQ ID NO: 322271 - RNA, 64 nt, Human; identical to SEQ ID NO: 266228

SEQ ID NO: 322272 - RNA, 64 nt, Human; identical to SEQ ID NO: 266229

SEQ ID NO: 322273 - RNA, 64 nt, Human; identical to SEQ ID NO: 266230

SEQ ID NO: 322274 - RNA, 64 nt, Human
ccucuacaccaauuaauguagcugcuagcuauuggccucccaaaagacuccaguacuauuuuaa

SEQ ID NO: 322275 - RNA, 64 nt, Human
cgaacuccagaccucaggugauccgcccaccucggccucccaaacugcugggauuacaggcgug

SEQ ID NO: 322276 - RNA, 64 nt, Human
caacuccuggacuuaacgccauccaccugccacagccucccaaagugcuaggaauacaggagug

SEQ ID NO: 322277 - RNA, 64 nt, Human; identical to SEQ ID NO: 266231

SEQ ID NO: 322278 - RNA, 64 nt, Human; identical to SEQ ID NO: 266232

SEQ ID NO: 322279 - RNA, 64 nt, Human; identical to SEQ ID NO: 266233

SEQ ID NO: 322280 - RNA, 64 nt, Human; identical to SEQ ID NO: 266234

SEQ ID NO: 322281 - RNA, 64 nt, Human; identical to SEQ ID NO: 266235

SEQ ID NO: 322282 - RNA, 64 nt, Human; identical to SEQ ID NO: 266236

SEQ ID NO: 322283 - RNA, 64 nt, Human; identical to SEQ ID NO: 266237

SEQ ID NO: 322284 - RNA, 64 nt, Human; identical to SEQ ID NO: 266227

SEQ ID NO: 322285 - RNA, 64 nt, Human; identical to SEQ ID NO: 266239

SEQ ID NO: 322286 - RNA, 64 nt, Human; identical to SEQ ID NO: 266243

SEQ ID NO: 322287 - RNA, 64 nt, Human; identical to SEQ ID NO: 266244

SEQ ID NO: 322288 - RNA, 64 nt, Human; identical to SEQ ID NO: 266245

SEQ ID NO: 322289 - RNA, 64 nt, Human; identical to SEQ ID NO: 266246

SEQ ID NO: 322290 - RNA, 64 nt, Human; identical to SEQ ID NO: 266247

SEQ ID NO: 322291 - RNA, 64 nt, Human; identical to SEQ ID NO: 266248

SEQ ID NO: 322292 - RNA, 64 nt, Human
aaaaucaagcaagccucucuccugcgggacuuaacgugcucaugggcugugugaucucuucagg

SEQ ID NO: 322293 - RNA, 64 nt, Human
ccugcagauccucauggguuugugacagccccugcgugcucagugcccuuuaagugcaucccgc

SEQ ID NO: 322294 - RNA, 64 nt, Human
cugccucccggguucaagcgauucuucugccucagccucccaaaugucagaaaagaaagcauac

SEQ ID NO: 322295 - RNA, 64 nt, Human; identical to SEQ ID NO: 266249

SEQ ID NO: 322296 - RNA, 54 nt, Human; identical to SEQ ID NO: 208529

SEQ ID NO: 322297 - RNA, 64 nt, Human; identical to SEQ ID NO: 266251

SEQ ID NO: 322298 - RNA, 64 nt, Human; identical to SEQ ID NO: 266252

SEQ ID NO: 322299 - RNA, 64 nt, Human; identical to SEQ ID NO: 266253

SEQ ID NO: 322300 - RNA, 64 nt, Human; identical to SEQ ID NO: 266254

SEQ ID NO: 322301 - RNA, 64 nt, Human; identical to SEQ ID NO: 266255

SEQ ID NO: 322302 - RNA, 64 nt, Human; identical to SEQ ID NO: 266256

SEQ ID NO: 322303 - RNA, 64 nt, Human; identical to SEQ ID NO: 266257

SEQ ID NO: 322304 - RNA, 64 nt, Human; identical to SEQ ID NO: 266258

SEQ ID NO: 322305 - RNA, 64 nt, Human; identical to SEQ ID NO: 266262

SEQ ID NO: 322306 - RNA, 64 nt, Human; identical to SEQ ID NO: 266263

SEQ ID NO: 322307 - RNA, 64 nt, Human; identical to SEQ ID NO: 266264

SEQ ID NO: 322308 - RNA, 64 nt, Human; identical to SEQ ID NO: 266265

SEQ ID NO: 322309 - RNA, 64 nt, Human; identical to SEQ ID NO: 266266

SEQ ID NO: 322310 - RNA, 64 nt, Human
uccgccuccugggucaaaugauucuccugcuuuagccucccaaguagcugggacuacaggugua

SEQ ID NO: 322311 - RNA, 64 nt, Human
caaacuccugagcucaagugauccucccgucucagccucccaaagggcugagauuacaggugug

SEQ ID NO: 322312 - RNA, 64 nt, Human
caaacuccugagcucaaaugauccuccugccuuggccucccaaagugcuggaauuacaggcaug

SEQ ID NO: 322313 - RNA, 64 nt, Human; identical to SEQ ID NO: 266267

SEQ ID NO: 322314 - RNA, 64 nt, Human; identical to SEQ ID NO: 266268

SEQ ID NO: 322315 - RNA, 64 nt, Human; identical to SEQ ID NO: 266269

SEQ ID NO: 322316 - RNA, 64 nt, Human; identical to SEQ ID NO: 266270

SEQ ID NO: 322317 - RNA, 64 nt, Human; identical to SEQ ID NO: 266271

SEQ ID NO: 322318 - RNA, 64 nt, Human; identical to SEQ ID NO: 266272

SEQ ID NO: 322319 - RNA, 64 nt, Human; identical to SEQ ID NO: 266273

SEQ ID NO: 322320 - RNA, 64 nt, Human; identical to SEQ ID NO: 266274

SEQ ID NO: 322321 - RNA, 64 nt, Human; identical to SEQ ID NO: 266275

SEQ ID NO: 322322 - RNA, 64 nt, Human; identical to SEQ ID NO: 266276

SEQ ID NO: 322323 - RNA, 64 nt, Human; identical to SEQ ID NO: 266281

SEQ ID NO: 322324 - RNA, 64 nt, Human; identical to SEQ ID NO: 266282

SEQ ID NO: 322325 - RNA, 64 nt, Human; identical to SEQ ID NO: 266283

SEQ ID NO: 322326 - RNA, 64 nt, Human
caaacuccugaccucaggugauucgcccaccucagccucccaaagugcugggauuacaggugug

SEQ ID NO: 322327 - RNA, 64 nt, Human
cugcuuccuagguucaagugauucuccugccucagccucccaaguagcugggauuguaagagua

SEQ ID NO: 322328 - RNA, 64 nt, Human
aaggugacucaaacagccaaacgaaacuuccguugccucccagcccucuguauccaccugguuu

SEQ ID NO: 322329 - RNA, 62 nt, Human
caguuuauugugaagauccccaagggggagguucgguagagaaaaauaguaagcugguuuag

SEQ ID NO: 322330 - RNA, 62 nt, Human
gauuuuuaacaggugucauuugacuaaacguuucgguagaaugcuucauacuugagugaugc

SEQ ID NO: 322331 - RNA, 62 nt, Human
gguguguuugacagcaacucaauucaggaauuucgguagaacugagugaccuguggaacugc

SEQ ID NO: 322332 - RNA, 62 nt, Human
cagugccagggcuuaaagcccgcugcuccuuuucgguagaggagaggcccaucacuggugug

SEQ ID NO: 322333 - RNA, 62 nt, Human
gguucugcugggcagaacauauggguuaaaucucgguagagaguuucccucauccucuaucc

SEQ ID NO: 322334 - RNA, 62 nt, Human
cugucuaucuuccugguuuucaguccacagagucgguagaccagggguuacgugacugggga

SEQ ID NO: 322335 - RNA, 62 nt, Human
ggacaggugccagcccugcaagccgccucuucucgguagaagggagaaggacagagcucucu

SEQ ID NO: 322336 - RNA, 62 nt, Human
cagcucucuuugaagcagaugucuuggugaacucgguagacucuuuuauaccuguugucaca

SEQ ID NO: 322337 - RNA, 62 nt, Human
guggaaguuccaguguucucucuuauuccacuucgguagaggauuucuaguuucuugugggc

SEQ ID NO: 322338 - RNA, 62 nt, Human
cuucaggaggccgagaugggcagaucuugaggucgguagauggagaccauccuggccaacau

SEQ ID NO: 322339 - RNA, 62 nt, Human
uuuuuaaugauacauuagguacgauguguaguucgguagaguccuaaaauuuuuguacuacu

SEQ ID NO: 322340 - RNA, 62 nt, Human
ggaugaaacaguuauuuccgucugaugagcauucgguagaauuuuugaagugagauuuuaug

SEQ ID NO: 322341 - RNA, 62 nt, Human
cauggcagaaugaaaauuagaucuagcuaaucucgguagaugucauuacaaccuggaaaaua

SEQ ID NO: 322342 - RNA, 62 nt, Human
aaugucaguugaacuaaauugugcuucacgccucgguagauuugcauucugaugcaagcccc

SEQ ID NO: 322343 - RNA, 62 nt, Human
aaccauuuccauaccaucuguauauaaccauuucgguagagaacacacuacacugaacccug

SEQ ID NO: 322344 - RNA, 62 nt, Human
cuggcaacugacauacuugauggaggauugauucgguagagagcaguagaaaucuuguucua

SEQ ID NO: 322345 - RNA, 62 nt, Human
gagcucccugugccgucuauccagaccagacuucgguagaugccuuuguuagaucuaucaca

SEQ ID NO: 322346 - RNA, 62 nt, Human
aggcagccuuucccggggagaccuuuccagugucgguagagugugaggauggagaccgguuc

SEQ ID NO: 322347 - RNA, 64 nt, Human
gcugaauacguuagaaaaugacagaugguagagacuuccauagaauuaagaggguucucaugga

SEQ ID NO: 322348 - RNA, 64 nt, Human
ccugccuuuggccuuucuucuucuucuucuuccucuuccauaguuggaucauguauauuuuacu

SEQ ID NO: 322349 - RNA, 64 nt, Human
ugaagcuaguucauuguccugcaggucccuucaucuuccauaccuagcccacucuuuuagcccu

SEQ ID NO: 322350 - RNA, 64 nt, Human
acuuucugguaccucaaagaaaucauuguucaaucuuccauaaggaagagauucuuuaccaggc

SEQ ID NO: 322351 - RNA, 64 nt, Human
uuuuaaaaaaauaaaauaaaacauaaauauuacucuuccauauuccuucugccuauauuuagua

SEQ ID NO: 322352 - RNA, 64 nt, Human
uguuuuuaacucuugguauggucagaauauaauacuuccauaauuacuuauaauucuuuccggu

SEQ ID NO: 322353 - RNA, 64 nt, Human
gggcgugaaagguuaguugagacugaaguguucacuuccauagaagaacaucacuuuuaaccuu

SEQ ID NO: 322354 - RNA, 64 nt, Human
cggacagggaggcaggugccaccuugacaccucucuuccauagcaaugggaaagugaugagugc

SEQ ID NO: 322355 - RNA, 64 nt, Human
agcuguccauaagccauccagaucaacacccuuucuuccauacagaaaagggcuaaccauacca

SEQ ID NO: 322356 - RNA, 64 nt, Human
uauuacucucaguaguaaaauaucacacugaauucuuccauacacaggugugcuucuagucagu

SEQ ID NO: 322357 - RNA, 64 nt, Human
agccucaucccuguuuuucuguuagggcaagacucuuccauaagccugcuaaaaaacagagaug

SEQ ID NO: 322358 - RNA, 64 nt, Human
aauucucauaggauuauucuuuucaugguauuuucuuccauaauaucucauuuuaaaaagaagu

SEQ ID NO: 322359 - RNA, 64 nt, Human
acuucucaugauggaaaaucagccaaggacuaagcuuccauagaaauacacuuuguaucuggac

SEQ ID NO: 322360 - RNA, 64 nt, Human
uuuugguauugaaguaauggguaacuaaaauggacuuccauaguauugacuguagaaggagccu

SEQ ID NO: 322361 - RNA, 64 nt, Human
gauuuuaagccauuuaaaauuuauauaaaacaaccuuccauaaaaauuugacaggugcccagau

SEQ ID NO: 322362 - RNA, 64 nt, Human
uuguuauuccuuucaauauccuuguauuucaaaucuuccauauaagaauuagacauggcaauuc

SEQ ID NO: 322363 - RNA, 64 nt, Human
ugcaguggcaugaucucggcuuacugcaaccuuugccucccagguucaagcgauucuucugccu

SEQ ID NO: 322364 - RNA, 64 nt, Human
ugcuaccucuaccaugagcaauucuccugccucagccucccaaguagcuggaacuacaggcuca

SEQ ID NO: 322365 - RNA, 64 nt, Human
uucaaacuccugacuuugugauccacccgccucggccucccaaagugcugggauuacaggcaug

SEQ ID NO: 322366 - RNA, 64 nt, Human
cuguaaauaaauaauuuuagaacagccuuuuuuucuuccauaaacuacuauugugaucuauuuu

SEQ ID NO: 322367 - RNA, 64 nt, Human
uccagggugagagucacaccacauuacacaugugcuuccauacagugguuucugaagcuuuugc

SEQ ID NO: 322368 - RNA, 64 nt, Human
uagcugccuuaccccuccuuggcacauaguaggccuuccauaaauguuggauggauggauaaau

SEQ ID NO: 322369 - RNA, 64 nt, Human
uuuuaucuaggagaugaaaagaggauaauguuuccuuccauaaagaaaguucuuguaagaauca

SEQ ID NO: 322370 - RNA, 64 nt, Human
augcagagacaaugauaaauaaaacauauaaucucuuccauaagguauuuauuuuuuaaucaag

SEQ ID NO: 322371 - RNA, 64 nt, Human
guuguuacacuuccauaguugucuuagccgaauccuuccauauucuuaugauuacuuggguuaa

SEQ ID NO: 322372 - RNA, 64 nt, Human
caaggguaaugaccaaauuuaugugguuguuacacuuccauaguugucuuagccgaauccuucc

SEQ ID NO: 322373 - RNA, 64 nt, Human
cucaauguaccugucauuaaaaauggaaaaauuccuuccauaucuuuagcaggugccaguuuuu

SEQ ID NO: 322374 - RNA, 64 nt, Human
gcagcucagcuugguugaaacugaguuuugucaucuuccauauuugcaggaagguauuuucuga

SEQ ID NO: 322375 - RNA, 64 nt, Human
gugauauuuuuacuugcauugaauauauuauaaucuuccauacuucuucauucaauacaagugu

SEQ ID NO: 322376 - RNA, 64 nt, Human
aguccccauucuaccuucgaaucccauguauuaucuuccauaagugccagaaauugguacaaag

SEQ ID NO: 322377 - RNA, 64 nt, Human
uacagucaaacuccagagaugcccaagacccccgcuuccauagcgacggcugauggaaccgccc

SEQ ID NO: 322378 - RNA, 64 nt, Human
cacuaccaaaugagugaaagcuugauuaagaguucuuccauauacuagccuccuuggaagaagu

SEQ ID NO: 322379 - RNA, 64 nt, Human
aucccccaagucaugucaacucucauuaaaggugcuuccauauuugagcaggcgucaaacaagg

SEQ ID NO: 322380 - RNA, 64 nt, Human
cucaugcugccuacagagugccuggcacuugggacuuccauaaaggaugagccuggggucacag

SEQ ID NO: 322381 - RNA, 64 nt, Human
caaugucauuauguaauuauuacccagaauugcucuuccauaaagcuugugccuuuguccaagc

SEQ ID NO: 322382 - RNA, 64 nt, Human
ucugccucccaguucaagcaauucuucugccucagccucccaaguagcugggauuacaggcacc

SEQ ID NO: 322383 - RNA, 64 nt, Human
caaacuucugaccucaagugaucugcccaccuuggccucccaaagugcugggauuacaggugua

SEQ ID NO: 322384 - RNA, 64 nt, Human
ccaccucccagguucaagcaauucuucugccucagccucccaaguagcugggauuacaggugcc

SEQ ID NO: 322385 - RNA, 64 nt, Human
auagucagucaaaaugcauuuggaauguaccuugcuuccauaacagacuuugacucuaugaccu

SEQ ID NO: 322386 - RNA, 64 nt, Human
cuucucugcaaggucuuccacuauuucugucugucuuccauaucaagccuggaugcagcugcug

SEQ ID NO: 322387 - RNA, 64 nt, Human
acugaguugggcaaaagcuuggguaggacaagaacuuccauacaaauuugagauagaucucgcc

SEQ ID NO: 322388 - RNA, 64 nt, Human
uggccuccggugaguauuuuauauuuagucuacacuuccauacuuggcuuuuuucugcuuuuau

SEQ ID NO: 322389 - RNA, 64 nt, Human
uuagccccauaauuuuuuuuuuccuuuuaaaacacuuccauaaucuggacuccucuguccaggc

SEQ ID NO: 322390 - RNA, 64 nt, Human
uggaucuauacuguguggucaugaguuguguauacuuccauaacacuguauuuuucuucuguca

SEQ ID NO: 322391 - RNA, 64 nt, Human
uagauuucagcuaugcagaaaaauuuagcuuaugcuuccauauuuuuaaauuuuguuuuuuaag

SEQ ID NO: 322392 - RNA, 64 nt, Human
ucuuguaagcucucuuccuaacagggcacauauucuuccauaauauaaacacuuuucugcccca

SEQ ID NO: 322393 - RNA, 64 nt, Human
uugguucuuaaaagcauucuguacuaauacagcucuuccauagggcaguuguugcuucuuaauu

SEQ ID NO: 322394 - RNA, 64 nt, Human
gguucuugccuugggaaacacuacuagcucugaccuuccauaccucacuugggggagcacaggg

SEQ ID NO: 322395 - RNA, 64 nt, Human
gccggcccagugacaccgaguuccaccccaucggcuuccauaucuuccaggcaagcuccuugcc

SEQ ID NO: 322396 - RNA, 64 nt, Human
auaucaaaauagaacuuuauauugaaaaucacugcuuccauagauuggcauuuuuagcuauuac

SEQ ID NO: 322397 - RNA, 64 nt, Human
gugacaggaguuguaggguuaccccuuugacaagcuuccauagucuucagacacgcacauugau

SEQ ID NO: 322398 - RNA, 64 nt, Human
gagugcccucuugugugacuggggugaugugcagcuuccauaauggaugggacagagagcuggg

SEQ ID NO: 322399 - RNA, 64 nt, Human
uuagauaguuuguuccacaauuuuucauuucaugcuuccauauauauuacccugaacuuucuau

SEQ ID NO: 322400 - RNA, 64 nt, Human
uuuaguacaguccuugcauccauucuauuuuuaacuuccauaucugccauauuuuuacaaaauu

SEQ ID NO: 322401 - RNA, 64 nt, Human
ugcaauggcgcgaucucagcucacugcagccacugccucccagguucaagugauucuccugccu

SEQ ID NO: 322402 - RNA, 64 nt, Human
auguucgacaggcuggucucgaacucccaccucagccucccaaacugcugggauuacaggugug

SEQ ID NO: 322403 - RNA, 64 nt, Human
cucgaucuccugaccucgugauccacccgccucggccucccaaagugccgggauuacaggcgug

SEQ ID NO: 322404 - RNA, 64 nt, Human
uccuacaucggaauccaagcuaauuucuaauggccuuccauaauaauucugcuuuagaugugua

SEQ ID NO: 322405 - RNA, 64 nt, Human
guaaaguguaacauaugcaaacauaacaaaaucacuuccauagugacgauacuccaaccauaug

SEQ ID NO: 322406 - RNA, 64 nt, Human
ccuguguuuccucucuccucuaccauucaucucucuuccauacagucauuugggcuuuuuacuc

SEQ ID NO: 322407 - RNA, 64 nt, Human
gauaacagaauggaaauaagagaugccagaacuacuuccauaacuaacucaccaaaucaaauca

SEQ ID NO: 322408 - RNA, 64 nt, Human
acauauguaagcaacgcuacugguucaccccaaccuuccauauuuaucuguucaaaggagcaag

SEQ ID NO: 322409 - RNA, 64 nt, Human
cuagauagaacauuaagagauuuucaagaucaaacuuccauagcuucauccacugaauuugaag

SEQ ID NO: 322410 - RNA, 64 nt, Human
cugaucacuagccugucauccuuggucuuuguaucuuccauauuuggaagaaaaaaaucuucuc

SEQ ID NO: 322411 - RNA, 64 nt, Human
gcaacaauaaagcaucuucagccaaacaucuagucuuccauagaccaugcauugcaguguaccc

SEQ ID NO: 322412 - RNA, 64 nt, Human
ucugauuuuaguguagccccuaaauuaaaaauggcuuccauaugccacucuguaccccaaagag

SEQ ID NO: 322413 - RNA, 64 nt, Human
cuuaaaaaauaacagacuugaggaaccccucucccuuccauaauuccccucauccaccgcccac

SEQ ID NO: 322414 - RNA, 64 nt, Human
guagucauguaacagcaguaauaacauacuucagcuuccauauaggaauagaagugguagagcc

SEQ ID NO: 322415 - RNA, 64 nt, Human
guuucaaccacucuuggugacugucauccuguuucuuccauauucucugauuucaugaauugaa

SEQ ID NO: 322416 - RNA, 64 nt, Human
agccucugcuauaaauucuccuggcucuccugggcuuccauauuuugggggcuggggugucaaa

SEQ ID NO: 322417 - RNA, 64 nt, Human
cccaaaggacuccacccauccuaucagccugucucuuccauaugaccucaugcaucuccaccug

SEQ ID NO: 322418 - RNA, 64 nt, Human
auaaaggagacaguuuagagucaggacagaaaagcuuccauaauugaacuagauuacauaauag

SEQ ID NO: 322419 - RNA, 64 nt, Human
cauaugauaaaaauacauaaauuugacauucccucuuccauaaaccuuuguuuguagauuuaau

SEQ ID NO: 322420 - RNA, 64 nt, Human
ccaccuccuggguucaagugauucuugugccucagccucccaaguagcugggauuaaaggcacg

SEQ ID NO: 322421 - RNA, 64 nt, Human
caaacuccugacuucaggugaucugucugccucggccucccaaagagcugagauuacaggcgug

SEQ ID NO: 322422 - RNA, 64 nt, Human
ugaacuccuggcaucaagugauccucccaccucagccucccaaaguguugggauuacaggcaug

SEQ ID NO: 322423 - RNA, 64 nt, Human
cauggaagcugcuaaauagccuagucuggggagucuuccauaaaguuuugcauggagcaaacaa

SEQ ID NO: 322424 - RNA, 64 nt, Human
aagauuuuuugcaugacuuuucucucauuuuauucuuccauaauguauuucuacuauaaaauag

SEQ ID NO: 322425 - RNA, 64 nt, Human
aggagguaaaaccaauucuggaagugucuaugaacuuccauaaauaacuuuaauuuuaguauaa

SEQ ID NO: 322426 - RNA, 64 nt, Human
ugucacaauccuaacacauuaucgggagcagugucuuccauaauguauaaagaacaagguaguu

SEQ ID NO: 322427 - RNA, 64 nt, Human
uuuuuuaauagaauauaauuaucggaagcagugccuuccauaauuaugacaguuauacugucgg

SEQ ID NO: 322428 - RNA, 64 nt, Human
cuggucugaaucucugaauuuauaucauccaaaacuuccauauggucaguaguagauguucucu

SEQ ID NO: 322429 - RNA, 64 nt, Human
caaguugaaucaauuugaaaaucauguuuuuaugcuuccauagggaacauuuugguuauuuaaa

SEQ ID NO: 322430 - RNA, 64 nt, Human
uuucacauagcugucuagaguagcuuaccagaagcuuccauaguggugcagaggaaguggaagg

SEQ ID NO: 322431 - RNA, 64 nt, Human
uuuagacucaucuuacuguaccuguuccuuagaccuuccauaaugcuacugucucacugaaaca

SEQ ID NO: 322432 - RNA, 64 nt, Human
ccauauaggaaaaugaagcacagaauuacucagucuuccauauuguauuugacuucauaucaau

SEQ ID NO: 322433 - RNA, 64 nt, Human
uguaauaacuuucuuaccauuaacauuuuuuacccuuccauagaagggagggaauaaaucauga

SEQ ID NO: 322434 - RNA, 64 nt, Human
ugcaaguauguauauauguguaugcucagauuaacuuccauagguacauaagugaaagaagucu

SEQ ID NO: 322435 - RNA, 64 nt, Human
cagauguagacaaaaauaacacaauaacaggagacuuccauaaguuuguguauuauguuagucu

SEQ ID NO: 322436 - RNA, 64 nt, Human
uugccugucaucuaagcgaauuggaaaugcugagcuuccauaagucagcugaguuuuaaaggua

SEQ ID NO: 322437 - RNA, 64 nt, Human
gccuuuuaguagagcugauuuauuccaguaacuucuuccauauuuucucacuaaucucccguua

SEQ ID NO: 322438 - RNA, 64 nt, Human
cucaucuaauauuuuggcuggaauaaaucagagacuuccauaaucaaguaaauuuuaauuuuca

SEQ ID NO: 322439 - RNA, 64 nt, Human
gugcagugggccgucucaguucacugcagccuccgccucccagguucaagugauucucaugccu

SEQ ID NO: 322440 - RNA, 64 nt, Human
cgaacuccugaccucaggugaucagccugcuuuagccucccagagugcugggauuacaggcgug

SEQ ID NO: 322441 - RNA, 64 nt, Human
cuugaacuccugaccucgugaucugcccgccucagccucccaaagugcugggauuacaggcgug

SEQ ID NO: 322442 - RNA, 64 nt, Human
aucuugucucaugaauuuccagauggcccacucucuuccauaucacaaggacauaaacacuccu

SEQ ID NO: 322443 - RNA, 64 nt, Human
ucauagaucuuggcuuccuuuagaagccacuuaacuuccauacacuauaauaaacugugaacau

SEQ ID NO: 322444 - RNA, 64 nt, Human
uauaaccuaaccuuaauuauucuguaagaacaugcuuccauaggaaauaguggauaauuuucag

SEQ ID NO: 322445 - RNA, 64 nt, Human
gaguugcacacuggcagggagaccaaaaacauuacuuccauacuugugucaugauucuuuuuuu

SEQ ID NO: 322446 - RNA, 64 nt, Human
cgacacaacuuccauuacuaacuuucuaacagaacuuccauaacuagaagguggaaaccaaaac

SEQ ID NO: 322447 - RNA, 64 nt, Human
ggaaaaggagaaaguccugcagaaucaaucccgacuuccauaccugcugcuggacuguaccaga

SEQ ID NO: 322448 - RNA, 64 nt, Human
ccaucccugaaaugccuugcuaauacaacuaauccuuccauauaugugccauacuuauuuuuuu

SEQ ID NO: 322449 - RNA, 64 nt, Human
acaguauuagccucuguuaaucuauuuacuguugcuuccauauacauucuucaaugcauauguu

SEQ ID NO: 322450 - RNA, 64 nt, Human
uaauaaguuuuucacgagaacaaacuuuguaaaucuuccauaagcaaaaugacagcuagugcuu

SEQ ID NO: 322451 - RNA, 64 nt, Human
aauaauuguuaaaauucucuacagccuucuuuuucuuccauagcuaaucuuccuucuaauaguu

SEQ ID NO: 322452 - RNA, 64 nt, Human
uuacugaaggugauggagguauuugaaaauuuuacuuccauaggacauacugcauguaagccaa

SEQ ID NO: 322453 - RNA, 64 nt, Human
gugaaguaaagccucacaaagcuaaauaaauucucuuccauaccuuuaaugauuucuagaauau

SEQ ID NO: 322454 - RNA, 64 nt, Human
caaugcacugaaaagucaucugaaaaaauagcuucuuccauaucagcuuauauuaaauacugug

SEQ ID NO: 322455 - RNA, 64 nt, Human
aggggaaguacuacuccucaaauguugagggaagcuuccauaacauugaugacuggcuucaugg

SEQ ID NO: 322456 - RNA, 64 nt, Human
uaugaauaccaucuacuucuguuguuuucccaggcuuccauaaacaauggagauacaugcauau

SEQ ID NO: 322457 - RNA, 64 nt, Human
ugucaagauuagaacugggguucauguuaaaaaccuuccauauuaccugaggguaccugugggg

SEQ ID NO: 322458 - RNA, 58 nt, Human
cccagccagcugcccagugaggcccaccgccucccaccacaccugccaccuguuccug

SEQ ID NO: 322459 - RNA, 64 nt, Human
agacggcguuucaccauuuuggccggccuccucggccucccaaaguucugggauuacaggcaug

SEQ ID NO: 322460 - RNA, 64 nt, Human
cucgaucuccugacgucgugauccacccgccucggccucccaaaaugcugggauuacaggugug

SEQ ID NO: 322461 - RNA, 64 nt, Human
cuucaaccuuuggccuuucagcccuucuuucucucuuccauauucuuugguuuguaugugguuu

SEQ ID NO: 322462 - RNA, 64 nt, Human
gcuggcuaguccagcccagccauggugcaugacucuuccauaagggauccucacccuuccacuu

SEQ ID NO: 322463 - RNA, 61 nt, Human
cgagacgaucaacaaaauaauucuaaauacucuuccauaggggcaucuauucaaaaugcuu

SEQ ID NO: 322464 - RNA, 64 nt, Human
uuuuugaggccaguagcaacauccagagaucauucuuccauacuuuacucccuccuuuuucaga

SEQ ID NO: 322465 - RNA, 64 nt, Human
uaucuuccagcaguaguaacagucuggauaacuucuuccauaucccucccucuuuguuuuuuug

SEQ ID NO: 322466 - RNA, 64 nt, Human
gaaggacgguucuggggcauaggaaacacauacacuuccauaaauagcuuuaacguaugccacc

SEQ ID NO: 322467 - RNA, 64 nt, Human
guagugauucauuguuuguuuuauauaccaaugacuuccauauuuuaaaagagaaaaacaacuu

SEQ ID NO: 322468 - RNA, 64 nt, Human
uguuuuuguaacaauaauuuuuaaaacccacacucuuccauauauggggauaaauaucaccuag

SEQ ID NO: 322469 - RNA, 64 nt, Human
guuuagaauugaaagcugccagcuaacaguaauucuuccauaguugacuugaacuucugaugcu

SEQ ID NO: 322470 - RNA, 64 nt, Human
uuauuuauuuauuugguucccuuccuauuccaagcuuccauagcugcugcccuaguuuucuuuc

SEQ ID NO: 322471 - RNA, 64 nt, Human
uagccaacauguuggcuuaguaagucuaaugaagcuuccauaggaguauugaaaggcaguuuua

SEQ ID NO: 322472 - RNA, 64 nt, Human
cugaaugcucuguagccuaaacuccaaacauccucuuccauauggauccacuggcuggacaaac

SEQ ID NO: 322473 - RNA, 64 nt, Human
aaaaauuuuugaaauguucuguaauucccagagucuuccauaaauaaccaaauggucucauaca

SEQ ID NO: 322474 - RNA, 64 nt, Human
aucucuacugugcaaauaucauuauucacucagacuuccauaagaguaaauaaaaaugaauaug

SEQ ID NO: 322475 - RNA, 64 nt, Human
uuuuaaacguuucuguucagagaacuugcuuaaucuuccauauauucugcucagggcacuugca

SEQ ID NO: 322476 - RNA, 64 nt, Human
aaagucuccugaaaugugguaguaagaggauuuucuuccauaaugcaucugaaaaacuguaaac

SEQ ID NO: 322477 - RNA, 64 nt, Human
ugcaguggcaugaucucggcucacugcaagcuccgccucccagguucaugccauucuccugccu

SEQ ID NO: 322478 - RNA, 64 nt, Human
gacuuuucugcccugcccucagccuguugccccugccucccaaaccccauuagucuagccuugu

SEQ ID NO: 322479 - RNA, 64 nt, Human
caaacuccugggcucaagcaauccacccaccucugccucccaaagugcugggauuacaggcgug

SEQ ID NO: 322480 - RNA, 64 nt, Human
auaaucacacaaauuuaaaaagaaagaaaacagucuuccauagauuuuuaaggaagaaagggcc

SEQ ID NO: 322481 - RNA, 64 nt, Human
ugcaggacacuacaacgugggacauuguuuguuucuuccauauuuggaagauaaauuuaugugu

SEQ ID NO: 322482 - RNA, 64 nt, Human
gaaucaggaauacaacuuaagugaucaugagguccuuccauauuuagauuggguaagcaugaau

SEQ ID NO: 322483 - RNA, 64 nt, Human
gcuccugaagcgagcacucuuuuuaucuaugauacuuccauaauaaucucuucuauuuauagcu

SEQ ID NO: 322484 - RNA, 64 nt, Human
cacuuuucuguauaaaauguauaaagugggguuucuuccauauugacaaaugagggaacaggug

SEQ ID NO: 322485 - RNA, 64 nt, Human
gacugagcaaguggaguagcagaaccaggagccucuuccauacaugaggugaggguugggggac

SEQ ID NO: 322486 - RNA, 64 nt, Human
uauauuuuuugaaauugguucuuaguguucacaacuuccauaagauacugcuaaugcaccagua

SEQ ID NO: 322487 - RNA, 64 nt, Human
aacuuuuaauacaguagccuguaaauaaaacacucuuccauaugauauucaacauuuuacaacu

SEQ ID NO: 322488 - RNA, 59 nt, Human
auccauccagaagcaugugauaagaccuccuuccauacuggccauauuuuggaacacug

SEQ ID NO: 322489 - RNA, 64 nt, Human
aaccugcauagccggugggugaggagauucccaccuuccauagccuccaaacauguucccaagg

SEQ ID NO: 322490 - RNA, 64 nt, Human
aaugucuaaauccuauacucuaguugaggaagaucuuccauaauuuuaugguauuacacaggga

SEQ ID NO: 322491 - RNA, 64 nt, Human
uaauauauaucagugagucuuacagaaagauaugcuuccauaauaugaaauagauuauucaaua

SEQ ID NO: 322492 - RNA, 64 nt, Human
acugagggaaaauaccaaauguaguuuuauacuacuuccauaaaacaggauuggugaaucacgg

SEQ ID NO: 322493 - RNA, 64 nt, Human
ucauccuggauuucuaacucuucuuccucguccucuuccauaaggcugagucugauguaggggc

SEQ ID NO: 322494 - RNA, 64 nt, Human
auuuugggagaacaauaaaacuacauuuuuuccucuuccauacugguagaugcgaaauuuaucu

SEQ ID NO: 322495 - RNA, 64 nt, Human
uaaguguauauuauaagcuauaugcugaaaauggcuuccauagccaugagaacaucuuaaaacu

SEQ ID NO: 322496 - RNA, 64 nt, Human
caaccuccccggcucaagugauccuccugccucagccucccaaguagcugggacuacaggcguu

SEQ ID NO: 322497 - RNA, 64 nt, Human
cgaacuccuggacucaaaguauccucccgccucggccucccaaaguguugggauuauaggagug

SEQ ID NO: 322498 - RNA, 64 nt, Human
ugcaguggcgucaucucggcucacugcaaccuccgccucccagguucaagugauucuccugccu

SEQ ID NO: 322499 - RNA, 64 nt, Human
uggaaucagugcaggcaaaauuuaggauuugccgcuuccauaaaucaaagcaugacuaauaggg

SEQ ID NO: 322500 - RNA, 64 nt, Human
uuuugugcacaccuauauuaccuuaagaaauuuccuuccauagacagcugccucaaagggaaau

SEQ ID NO: 322501 - RNA, 64 nt, Human
gagacaugguggucugcacaagccuggacaaguucuuccauauugaugguggagcaaccccugu

SEQ ID NO: 322502 - RNA, 64 nt, Human
ugcaggaaauuccccaaagcucagaguccaguuccuuccauaaaacaggcuggacaaaugacca

SEQ ID NO: 322503 - RNA, 64 nt, Human
aaauuuuaauauucucacaauauagguuuuggggcuuccauaucaucaaaagacugaaaaauua

SEQ ID NO: 322504 - RNA, 64 nt, Human
aaaaaccaaacauucuuguaaaaacauuuaagaacuuccauagucuuguucauauuguuuaccu

SEQ ID NO: 322505 - RNA, 64 nt, Human
cgcccaccucagcgcccaggagccuugggacuuccuuccauaugauaaaucauucuucuucacg

SEQ ID NO: 322506 - RNA, 64 nt, Human
cuuuucaaaacagggugcuccuccuggcuucuggcuuccauaagaagaaauggagaaaaaaaua

SEQ ID NO: 322507 - RNA, 64 nt, Human
gcaauuacugaaaguggcugcaacagagaaaagacuuccauaaaggacgacaaaagaauuggac

SEQ ID NO: 322508 - RNA, 64 nt, Human
gcggaggcugugcuccgccauggugucccgguaccuuccauacacagaggagugcagccuucuc

SEQ ID NO: 322509 - RNA, 64 nt, Human
gcacugggggcgucaggcugucggauguuccuuccuuccauaccccagcauaccuucuccuugc

SEQ ID NO: 322510 - RNA, 64 nt, Human
auaaauuagcuguuagaucugcugagaugacuuucuuccauauaugugguucauuggaaguucu

SEQ ID NO: 322511 - RNA, 64 nt, Human
uugucauuccauugcuauuuuuuuuccccagagacuuccauaauuuaaaauaaaauccuagauc

SEQ ID NO: 322512 - RNA, 64 nt, Human
aacuugagaucuuaaauagaauuucgguuuguaucuuccauauaauaaccacacacagauaacc

SEQ ID NO: 322513 - RNA, 64 nt, Human
gaggggagagaagcacaccaggggcgcccucugccuuccauaccccacgcuuauaaaacauaac

SEQ ID NO: 322514 - RNA, 64 nt, Human
uguauauuaauaauuguugacuuucuuagauucacuuccauaugugaauguaagcucuuaacua

SEQ ID NO: 322515 - RNA, 64 nt, Human
uacuaauggaauuauauacuggccaguaaaaugggccucccaauugcuguuucagcagguuuua

SEQ ID NO: 322516 - RNA, 64 nt, Human
uucacgaauguuggcccugccuagauguugugaagccucccagaaugcauagagucauucacug

SEQ ID NO: 322517 - RNA, 64 nt, Human
uugcacugugggggcugguccugagucuuggccugccucccagcccugccaggaggcugcggcc

SEQ ID NO: 322518 - RNA, 64 nt, Human
cuaggaacauuacaaagcaaagacuauuuuuaugcuuccauaaccuagaauuaaaaccaaauua

SEQ ID NO: 322519 - RNA, 64 nt, Human
aaaucagacauggcaaaacaauaauggcuguuugcuuccauaaacaagugcaauuuuuuaaagu

SEQ ID NO: 322520 - RNA, 64 nt, Human
ugcuaaaaauaaagaugauagcauguucuucugucuuccauaguuauuacaacuaugagagccu

SEQ ID NO: 322521 - RNA, 64 nt, Human
uguguagaaacguuggguuauggaagacuaguuucuuccauaacccugaauuggagaccuuaau

SEQ ID NO: 322522 - RNA, 64 nt, Human
uuuucuauaugguuuuuccagcuagcaguacucccuuccauaccugugacugggcagugcuuuu

SEQ ID NO: 322523 - RNA, 64 nt, Human
gacucacaggaaggaggagccgaccgggaauaaccuuccauacauuuuuuucuuugucuuaucu

SEQ ID NO: 322524 - RNA, 64 nt, Human
uauauguacagggcugagcugcagagggcuacaacuuccauauaagguagguuuuuuuguggcu

SEQ ID NO: 322525 - RNA, 64 nt, Human
uauuuggaguuaacucccuuaguaauugcuacagcuuccauaauuaacuggaggucagcaguaa

SEQ ID NO: 322526 - RNA, 64 nt, Human
ucuguguccaaaauaaguuuuaaggacaucuguucuuccauacgaaauagguuaggcugccuau

SEQ ID NO: 322527 - RNA, 64 nt, Human
ucuguaaaagaaagggaaaccuaaaacaaauacccuuccauauauaauauauauggaauaugua

SEQ ID NO: 322528 - RNA, 64 nt, Human
uacuuggggugaccccagcagccaauuauccggccuuccauaggggguucagucccaaagacau

SEQ ID NO: 322529 - RNA, 64 nt, Human
gauaaacugagugauugggucaacuaucacuguacuuccauaaugaauuucuucagucauguua

SEQ ID NO: 322530 - RNA, 64 nt, Human
ucacuagucaagaaaaauauaaaaacaacaaauacuuccauauggagcauuuuucagaguuuuc

SEQ ID NO: 322531 - RNA, 64 nt, Human
uuguguaauguugaugaauaucuguaucuuacggcuuccauaauggcuaguugauauucaaaaa

SEQ ID NO: 322532 - RNA, 64 nt, Human
ugauugucaucaugguuaaagcuggucugugcuucuuccauagacagaagcuuagucuguuuuc

SEQ ID NO: 322533 - RNA, 64 nt, Human
uaaugaucauuugguaacauguuuaccugauuaucuuccauagaguaacauaagcugcuuuuca

SEQ ID NO: 322534 - RNA, 64 nt, Human
cccaaagccccuugcucuccccugcccugcugccgccucccagccuggggggucguggcagaua

SEQ ID NO: 322535 - RNA, 64 nt, Human
ggggcuguggacaaaccggcugggggacugcccagccucccaccuguuuauuuaacuuauuuca

SEQ ID NO: 322536 - RNA, 64 nt, Human
ugcaauggugcaauuucgacucacugcaaccucugccucccagguucaagcgauucuccugccu

SEQ ID NO: 322537 - RNA, 64 nt, Human
uggaaaaccagauucauagucaugaaaauggaaacuuccauauucuguuuuugaaaagaugugg

SEQ ID NO: 322538 - RNA, 64 nt, Human
uuugaauuaauaugugguggguucugacauuauucuuccauaagaccauguggguuuccauggu

SEQ ID NO: 322539 - RNA, 64 nt, Human
auuuaguauaaaaguacugagaauuaaguuuguacuuccauaagcuuggauuuuaaacacugau

SEQ ID NO: 322540 - RNA, 64 nt, Human
uuacuuagaaugucuuuguauucauuugcuagggcuuccauagcaaagcaucauagauugcuga

SEQ ID NO: 322541 - RNA, 64 nt, Human
uuucaugacugaagggaguuuuauguuauuauuucuuccauaguuuuguuuugguuuauuuuua

SEQ ID NO: 322542 - RNA, 64 nt, Human
accuagaaucuuugugaauaaugugaggccaguucuuccauaaggaaggcugguuauggauauu

SEQ ID NO: 322543 - RNA, 64 nt, Human
cccugggaggaaauuugaauggguccauuuugcccuuccauagccuaaucccugggcauugcuu

SEQ ID NO: 322544 - RNA, 64 nt, Human
gagagagagauuagauuauuuugacaugggaucccuuccauaacagguacuuugaaggcaagac

SEQ ID NO: 322545 - RNA, 64 nt, Human
cugggaccaaaagaaguccuccucccuuucugggcuuccauaacccaggucguuccuguucuga

SEQ ID NO: 322546 - RNA, 62 nt, Human
ccuaagguaauccuauuaaaacacagcuuuacaacuuccauacuacaaaaaauuuucuauuc

SEQ ID NO: 322547 - RNA, 64 nt, Human
uuuguuuuuuuaauucagugccugaucuuuaaugcuuccauaaggcaguguucccauuuaggaa

SEQ ID NO: 322548 - RNA, 64 nt, Human
aauccaacuuuauuacgauuaguauaugaucaaacuuccauauuugccuugggaauaauggaca

SEQ ID NO: 322549 - RNA, 64 nt, Human
uuuaguguaaacugaguaccacuuuauauuuucucuuccauagugagauguaugcaguaugugg

SEQ ID NO: 322550 - RNA, 64 nt, Human
ggcacgaguucucucagcccauuccccaccuccccuuccauaccccuuccuggaucuccagugc

SEQ ID NO: 322551 - RNA, 64 nt, Human
uuugauguuaguaaauuugguguaauacguggggcuuccauauuucaaaguggaagcuuucuuc

SEQ ID NO: 322552 - RNA, 64 nt, Human
caaaaaucacuuuaacuuuucuuguuccuuuacucuuccauauaaauuguuuauucaaccauca

SEQ ID NO: 322553 - RNA, 64 nt, Human
caaacuccugaccucaaguaauccaccugccucggccucccaaagugcugggauuacagggaug

SEQ ID NO: 322554 - RNA, 64 nt, Human
ucccuuccacuccaaggagcgaggagggcaagcggccucccagcucccugguaccucgaggcac

SEQ ID NO: 322555 - RNA, 64 nt, Human
uacuggcaucagagccuggugcgccccuaggggagccucccacuggagugcccggccaggucuc

SEQ ID NO: 322556 - RNA, 64 nt, Human
caaauaccugucuuagggaauucugacaauuuaucuuccauaugcucuuuaaguaaaauguuuc

SEQ ID NO: 322557 - RNA, 64 nt, Human
ggggaaagaagcaaguugggcaggauauggccuacuuccauaggcuuuucuuuuuucagguuug

SEQ ID NO: 322558 - RNA, 64 nt, Human
cauguguguacugcacuuuacaguuugcaaagcucuuccauacccacucucucaccgaagccua

SEQ ID NO: 322559 - RNA, 64 nt, Human
uuucaguaacugauuuaccuugaucacuuuucaacuuccauauucuucauauaguaaaaggcaa

SEQ ID NO: 322560 - RNA, 64 nt, Human
uuauuguuacacauuaaguaaucaauaaagaaaacuuccauagcuauucauugagucaaauugu

SEQ ID NO: 322561 - RNA, 64 nt, Human
aaucuuaugggucuagauaaucaguaaaagccaucuuccauaguugguguuagaacauugcccu

SEQ ID NO: 322562 - RNA, 64 nt, Human
uuucugaaauacauauuguauuagcuucccagggcuuccauaacaaaugacgacaaacuugggu

SEQ ID NO: 322563 - RNA, 64 nt, Human
uuuucauaccuucaugguggacuacuagucacugcuuccauaaauauuguuuacagggugagau

SEQ ID NO: 322564 - RNA, 64 nt, Human
gccggaggguguuuauguaagagcaccuuccucacuuccauacagcucuacgcggcaaauuaac

SEQ ID NO: 322565 - RNA, 64 nt, Human
gccggaggguguuuauguaagagcaccuuccucacuuccauacagcucuacguggcaaauuaac

SEQ ID NO: 322566 - RNA, 64 nt, Human
cugugucaguggaugcugcucugugguccgaagucuuccauagagacuuugugaaaaaaaauuu

SEQ ID NO: 322567 - RNA, 64 nt, Human
uaagagaucucaaauauuagucuuuguccggacccuuccauaguacaccuuagcgcugagacug

SEQ ID NO: 322568 - RNA, 64 nt, Human
auauuugaauauccauucucguuuuaggacucuucuuccauauuagugucaucuugccucccua

SEQ ID NO: 322569 - RNA, 64 nt, Human
guuuaucaacucaaagauaguuuuauuuuggucucuuccauagcuuauuaacacuaaagaaaac

SEQ ID NO: 322570 - RNA, 64 nt, Human
ugacuccuugacacuucucucauggaccuggaaacuuccauaaguggugacuuucagccagugc

SEQ ID NO: 322571 - RNA, 64 nt, Human
uuuaaauuuaaaugggaauauaacacaguuuucccuuccauauuccucucuugaguuuaugcac

SEQ ID NO: 322572 - RNA, 64 nt, Human
caaucuucugggcucaaguaauccuuccaccucagccucccauauagcuggaacuacaguugug

SEQ ID NO: 322573 - RNA, 64 nt, Human
cugccucccggguucaagcgauucuccugccccagccucccauauagcugggauuauaggugcc

SEQ ID NO: 322574 - RNA, 64 nt, Human
cauggcucacugaagucuugaccccgcugccucagccucccaaauaacuggggccacaggugug

SEQ ID NO: 322575 - RNA, 64 nt, Human
cccagcccauucauggagcccugggccuucuuggcuuccauagauccuaagcucuugacuguag

SEQ ID NO: 322576 - RNA, 64 nt, Human
aagugcuagcacaguuuguguuguggauuugcuacuuccauaguuuacuugacaugguucagac

SEQ ID NO: 322577 - RNA, 64 nt, Human
aguaaaagaggcuaucuuaguaauaagaaauaaacuuccauaacacuagguuagaccacccaau

SEQ ID NO: 322578 - RNA, 64 nt, Human
auuuagaugcaaauaacauuagaaaaaaaagauucuuccauaauuaacauaagugguuccuaac

SEQ ID NO: 322579 - RNA, 64 nt, Human
acuauaaaauauaguaugugauuaaccaauccugcuuccauauuuaagcacugggaauggaaac

SEQ ID NO: 322580 - RNA, 64 nt, Human
augaagauguacugaugacgccccagaaaugcugcuuccauaucagcugcugcuagcgccagcg

SEQ ID NO: 322581 - RNA, 64 nt, Human
cugugggguguagguucucgcgauucaggacguccuuccauaucccugcccagccuguggugcu

SEQ ID NO: 322582 - RNA, 64 nt, Human
ugauuuguagaaacuugguuuucuaagcauaguucuuccauaaccaccuuuuguuguuugagca

SEQ ID NO: 322583 - RNA, 64 nt, Human
cagaaaaccaaagggugcuaggaggugugggugccuuccauacuguuugcccauuuucauucuu

SEQ ID NO: 322584 - RNA, 64 nt, Human
uuccuucuuuugccuaauacagcucagcuaaguccuuccauaaagaugcuaaauaacuuucauc

SEQ ID NO: 322585 - RNA, 64 nt, Human
ccccaacuuugauggcacauuuaauacccaauuucuuccauaauagauauuuuuaauagcagga

SEQ ID NO: 322586 - RNA, 64 nt, Human
uguccccaguuacucuaaccguuauuucauuuagcuuccauauauauuuucuuaccuaagagaa

SEQ ID NO: 322587 - RNA, 64 nt, Human
gcaaggauuguaaauucuuggaagcaacggggagcuuccauauucccaccagagugugggaaug

SEQ ID NO: 322588 - RNA, 64 nt, Human
uuagcacugaguuugaaugguauaaaaaguauaacuuccauagaugagcuguuguuaggaaggc

SEQ ID NO: 322589 - RNA, 64 nt, Human
uuuaaacucucacuaugggcacuuuaccaaaauacuuccauaucaauuauuugaacucgguagu

SEQ ID NO: 322590 - RNA, 64 nt, Human
agagacuuauucuguauuugggggcuagaaccaucuuccauauuuccaagauuuuccaagauga

SEQ ID NO: 322591 - RNA, 64 nt, Human
gagaagcugggccuucauggacacauggaacuaagccucccaaaugggaguucuggcugagccc

SEQ ID NO: 322592 - RNA, 64 nt, Human
agcacuacauguuaugaagcuguaaauaagcaacgccucccauccgguuuuuugauggagccuc

SEQ ID NO: 322593 - RNA, 64 nt, Human
caaacucuugacuucaagugauccgcccgccucagccucccaaagugcugggauuacaggugug

SEQ ID NO: 322594 - RNA, 64 nt, Human
acagggaacccaccaagaccaaccuggucacauucuuccauaccgaccucagcgguuaccuccc

SEQ ID NO: 322595 - RNA, 64 nt, Human
aaauguucuuucugugguggaguagggccuccugcuuccauacugucgcaugggcuagaucuca

SEQ ID NO: 322596 - RNA, 64 nt, Human
gggcauuuucauugcaagucaaaggcaagacaggcuuccauaaagucccaggaggucccuccug

SEQ ID NO: 322597 - RNA, 64 nt, Human
guucccagaggcuccuccugcggugcucccaagacuuccauagaccaucuggaccaguagccca

SEQ ID NO: 322598 - RNA, 64 nt, Human
agcauggccuucuguuugccccgcaguaaaguaacuuccauauaaaaugguauuugaaagugag

SEQ ID NO: 322599 - RNA, 64 nt, Human
uuccccccaggcucuuuguuucccuccacccacccuuccauauccucuggagcaggagacaaug

SEQ ID NO: 322600 - RNA, 64 nt, Human
gggugcucgcuuugucuucuguccuuugguucuccuuccauaaugcuccuguacccaguuuauu

SEQ ID NO: 322601 - RNA, 64 nt, Human
acauccagugaggguuuuauuacgcuagguuucccuuccauagauugugccuuucagaaaugcu

SEQ ID NO: 322602 - RNA, 64 nt, Human
uuguacuuuaugguguuggagugaagccuuguagcuuccauaccccuaugucagaggaggucuu

SEQ ID NO: 322603 - RNA, 64 nt, Human
cacaccucuuggcaaugaaauuugcagcuccucccuuccauaaaugaagucucuuuccccacca

SEQ ID NO: 322604 - RNA, 64 nt, Human
auggacuuacccuaaagaucuucuguacuucucucuuccauaggacaaaugauaaguacuacau

SEQ ID NO: 322605 - RNA, 64 nt, Human
cauuccugucuggaaccagugaaugcauuagaaccuuccauaggaaaagaaaaggggcugaguu

SEQ ID NO: 322606 - RNA, 64 nt, Human
uguuuuuccuagauaauucucuaaaaauaugauucuuccauauagaaugcuaagcuuauuuuua

SEQ ID NO: 322607 - RNA, 64 nt, Human
agauggggaaccugcuagugaacuaggagggagacuuccauagccucagacuuggauaggguag

SEQ ID NO: 322608 - RNA, 64 nt, Human
uucaccuccacuagucugauacaguacaucuguacuuccauauaccuugcacugauuuugucug

SEQ ID NO: 322609 - RNA, 64 nt, Human
aacaucuuuagaaagcuauugcuuuucuaauuuccuuccauaucccucaggccucaguguucag

SEQ ID NO: 322610 - RNA, 64 nt, Human
gccuccuguguguuuggggggaaggguggguggggccucccacuuggccccgggguucaguggu

SEQ ID NO: 322611 - RNA, 64 nt, Human
cucgaucuccugaccucgugauccgcccgccucggccucccaaagugcugggauuacaggcgug

SEQ ID NO: 322612 - RNA, 64 nt, Human
cugccuccugggcucaagcaauucucccaccucagccucccaaauagcugggaucacuggcaca

SEQ ID NO: 322613 - RNA, 64 nt, Human
augcuuagaaacacucugggggggaaaaaagcuccuuccauauacugugagacauuuguuaagu

SEQ ID NO: 322614 - RNA, 64 nt, Human
caggccaugugggcuuuaggggauaagauugcaucuuccauaguggcucaaacugcagguaucc

SEQ ID NO: 322615 - RNA, 64 nt, Human
gaugauuuugcugacuuccacuccaguaaauuuucuuccauaaacucggacaaaucccugggag

SEQ ID NO: 322616 - RNA, 64 nt, Human
ugacuacaaaacaggaauggauagacucuauuuccuuccauaucuguuccucuguuccuuuucc

SEQ ID NO: 322617 - RNA, 64 nt, Human
cugcuccagggggacagccccucguguccagaaccuuccauacccccaagacagugucuugucu

SEQ ID NO: 322618 - RNA, 64 nt, Human
ccuuuucuguggcaacacagccucuuacauauggcuuccauagcuucuugcuaugugaaaggaa

SEQ ID NO: 322619 - RNA, 64 nt, Human
acccagggauccaggagucggcucucagcuggagcuuccauaccuucugggcucccuuugcuga

SEQ ID NO: 322620 - RNA, 64 nt, Human
uuuuuaaagccaaaacaaaaaacaaccaagcacucuuccauauauaaaucuggcuguauucagu

SEQ ID NO: 322621 - RNA, 64 nt, Human
caggccagucccacggcucugugcccggugccaucuuccauauccgggugcucaauaaacuugu

SEQ ID NO: 322622 - RNA, 64 nt, Human
ucuaguuuauucaaggauguguggcaacuuucaacuuccauacguauauauguauguauggaag

SEQ ID NO: 322623 - RNA, 64 nt, Human
auugucuauuccuauuuuuccuuugcccauuguacuuccauauaucuuuucauuaacuuacuug

SEQ ID NO: 322624 - RNA, 64 nt, Human
gcacauaaagaaaucuugaggacuuuguuuaaaccuuccauaaaaaaacaauuuucgguuucuc

SEQ ID NO: 322625 - RNA, 64 nt, Human
acuaugaauguuaguuucauuccgugaaacauuacuuccauauaaagacagaucucuuaauaag

SEQ ID NO: 322626 - RNA, 64 nt, Human
uaugaauguaaggaaugugggaaaaucuuggcuccuuccauaggccuuacuauucaugugucug

SEQ ID NO: 322627 - RNA, 64 nt, Human
cagacuuggaguaaaacuguauaaacaaaagaaucuuccauauuuauacagcagagaagcugua

SEQ ID NO: 322628 - RNA, 64 nt, Human
uuacucuuugugacuucgaaaucuuuucaugugccuuccauacaggccauucacuguggucccu

SEQ ID NO: 322629 - RNA, 64 nt, Human
cugcaacccccagagcucuuugacaggcucccaggccucccaguccuggacaagcaugugcagu

SEQ ID NO: 322630 - RNA, 64 nt, Human
agcucagcucaggccagggcugggcugugcaccugccucccacugacccagacccacuuccucc

SEQ ID NO: 322631 - RNA, 64 nt, Human
ugccgggccccucagggcugucggugugcugucagccucccacaggugguacagccgugcacac

SEQ ID NO: 322632 - RNA, 64 nt, Human
gggagaacaguucuuaguccaguuuugauguuaacuuccauagcugacaaagcuuguuaaguaa

SEQ ID NO: 322633 - RNA, 64 nt, Human
gugaaaauggccucaucucauaccauggcuccaccuuccauacaccagccacacggaacuacug

SEQ ID NO: 322634 - RNA, 64 nt, Human
uuaggacagaaauaauauggacauuuauuaguaucuuccauaauuuuuaagucugacacauuuc

SEQ ID NO: 322635 - RNA, 64 nt, Human
auggucuugcagaacacaccaagaaacccgacggcuuccauauuuucugacccuacaaacaggu

SEQ ID NO: 322636 - RNA, 64 nt, Human
uuuccauuguaagggauuuaaccaaaaucuugcucuuccauaaucuuacucugugaaauagagg

SEQ ID NO: 322637 - RNA, 64 nt, Human
uacaguagauuugaugugauccuuuucucccucccuuccauaauggaucguggucugugugacu

SEQ ID NO: 322638 - RNA, 64 nt, Human
ggcuucauaucuagacuaacacaaaauuaagaaucuuccauaauugcuuuugcucaguaacugu

SEQ ID NO: 322639 - RNA, 64 nt, Human
ggcuccauauuuagacuaauaaaacauuaagaaucuuccauaauuguuuccacaaacacuagca

SEQ ID NO: 322640 - RNA, 64 nt, Human
ugagggaggaaauaaaacugcggaauacaauguccuuccauagcaugggaagaagaaaauaaac

SEQ ID NO: 322641 - RNA, 64 nt, Human
ggcugggcugugaugaagcugagcagaguggaaacuuccauagggagggagcuagaagaaggug

SEQ ID NO: 322642 - RNA, 64 nt, Human
agggguugcagaaucacgggagcauaauaauucccuuccauaaucuuuagcauuguucuuucag

SEQ ID NO: 322643 - RNA, 64 nt, Human
uauaaauguacagaaacaucaccaacuuaauuuucuuccauagcaaaacugagaaaauaccuug

SEQ ID NO: 322644 - RNA, 64 nt, Human
uuaaagguagaauuauuuaauuuugugauuuguucuuccauaugacauugagcaaauagaucug

SEQ ID NO: 322645 - RNA, 64 nt, Human
aauguaaauauuagauuaugauguucaguaacaucuuccauagguauaaacugcugucauuauu

SEQ ID NO: 322646 - RNA, 64 nt, Human
cccaagugcucuuauucuggugagaagaaccuuacuuccauaauuugggaaggaauggaagaug

SEQ ID NO: 322647 - RNA, 64 nt, Human
uacuucuugugccagagauuacguuuucccugagcuuccauaaaguguuuuuaaacagucugua

SEQ ID NO: 322648 - RNA, 64 nt, Human
caaacuccugaccucaggugauccgcccaccucagccucccaaaauggugggauuacaggugug

SEQ ID NO: 322649 - RNA, 64 nt, Human
cgaacucuugacuucagaugauccaucugccuuggccucccacagugcugggauuacaggcgug

SEQ ID NO: 322650 - RNA, 64 nt, Human
ccucccccuggguugaagcaauucucaugccucagccucccaaguagccaggacuauaggcacc

SEQ ID NO: 322651 - RNA, 64 nt, Human
agauauuucaaauuguuuucagugaaaacaaguccuuccauaauaguaacaacuccacagauuu

SEQ ID NO: 322652 - RNA, 64 nt, Human
cuguauaaauaguuugguccccuuaaaugccaaucuuccauauuaguuuuacuuuuuuuuuuuu

SEQ ID NO: 322653 - RNA, 64 nt, Human
acagucucugcuucuaaaaacuucuaugucuagucuuccauaggaaauccucacuguuuaacca

SEQ ID NO: 322654 - RNA, 64 nt, Human
uauaaauguacagaaacaucaccaacuugauuuucuuccauagcaaaacugagaaaauaccuug

SEQ ID NO: 322655 - RNA, 64 nt, Human; identical to SEQ ID NO: 185087

SEQ ID NO: 322656 - RNA, 64 nt, Human; identical to SEQ ID NO: 185088

SEQ ID NO: 322657 - RNA, 64 nt, Human; identical to SEQ ID NO: 185092

SEQ ID NO: 322658 - RNA, 64 nt, Human; identical to SEQ ID NO: 185093

SEQ ID NO: 322659 - RNA, 64 nt, Human; identical to SEQ ID NO: 185094

SEQ ID NO: 322660 - RNA, 64 nt, Human; identical to SEQ ID NO: 185095

SEQ ID NO: 322661 - RNA, 64 nt, Human; identical to SEQ ID NO: 185096

SEQ ID NO: 322662 - RNA, 64 nt, Human; identical to SEQ ID NO: 185097

SEQ ID NO: 322663 - RNA, 64 nt, Human; identical to SEQ ID NO: 185098

SEQ ID NO: 322664 - RNA, 64 nt, Human; identical to SEQ ID NO: 185099

SEQ ID NO: 322665 - RNA, 64 nt, Human; identical to SEQ ID NO: 185100

SEQ ID NO: 322666 - RNA, 64 nt, Human
caaacucuugaccucaggugauccgccgaccucggccucccaaaguccucggauuacaggcaug

SEQ ID NO: 322667 - RNA, 64 nt, Human
caaacucccgaucucaggugaucugcccgccucggccucccaaagugcugggauuacaggcaug

SEQ ID NO: 322668 - RNA, 64 nt, Human
gagacuggcgcaaucuuggcucaccgcaaccuccgccucccagguucaagcaauucuccugcuu

SEQ ID NO: 322669 - RNA, 64 nt, Human
cgaacuccugaccucaagcgauccacccaccucggccucccaaagugcugggauuacaggcgug

SEQ ID NO: 322670 - RNA, 64 nt, Human; identical to SEQ ID NO: 185101

SEQ ID NO: 322671 - RNA, 64 nt, Human; identical to SEQ ID NO: 185102

SEQ ID NO: 322672 - RNA, 64 nt, Human; identical to SEQ ID NO: 185103

SEQ ID NO: 322673 - RNA, 64 nt, Human; identical to SEQ ID NO: 185104

SEQ ID NO: 322674 - RNA, 64 nt, Human; identical to SEQ ID NO: 185105

SEQ ID NO: 322675 - RNA, 64 nt, Human; identical to SEQ ID NO: 185106

SEQ ID NO: 322676 - RNA, 64 nt, Human; identical to SEQ ID NO: 185107

SEQ ID NO: 322677 - RNA, 64 nt, Human; identical to SEQ ID NO: 185111

SEQ ID NO: 322678 - RNA, 64 nt, Human; identical to SEQ ID NO: 185112

SEQ ID NO: 322679 - RNA, 64 nt, Human; identical to SEQ ID NO: 185113

SEQ ID NO: 322680 - RNA, 64 nt, Human; identical to SEQ ID NO: 185114

SEQ ID NO: 322681 - RNA, 64 nt, Human; identical to SEQ ID NO: 185115

SEQ ID NO: 322682 - RNA, 64 nt, Human; identical to SEQ ID NO: 185116

SEQ ID NO: 322683 - RNA, 64 nt, Human; identical to SEQ ID NO: 185117

SEQ ID NO: 322684 - RNA, 64 nt, Human; identical to SEQ ID NO: 185118

SEQ ID NO: 322685 - RNA, 64 nt, Human
cgaacucgugaccgcaggugauccucccgccucggccucccaaagugcugggauuacaggcaug

SEQ ID NO: 322686 - RNA, 64 nt, Human
acaauggcgugaucucggcucacugcaaaucuccgccucccagguucaagcgauucuccugccu

SEQ ID NO: 322687 - RNA, 64 nt, Human
ugcaguggcgccaucuuggcucacugcaaccucugccucccagguucaagcgauucuccugccu

SEQ ID NO: 322688 - RNA, 64 nt, Human; identical to SEQ ID NO: 185119

SEQ ID NO: 322689 - RNA, 64 nt, Human; identical to SEQ ID NO: 185120

SEQ ID NO: 322690 - RNA, 64 nt, Human; identical to SEQ ID NO: 185121

SEQ ID NO: 322691 - RNA, 64 nt, Human; identical to SEQ ID NO: 185122

SEQ ID NO: 322692 - RNA, 64 nt, Human; identical to SEQ ID NO: 185123

SEQ ID NO: 322693 - RNA, 64 nt, Human; identical to SEQ ID NO: 185124

SEQ ID NO: 322694 - RNA, 64 nt, Human; identical to SEQ ID NO: 185125

SEQ ID NO: 322695 - RNA, 64 nt, Human; identical to SEQ ID NO: 185126

SEQ ID NO: 322696 - RNA, 64 nt, Human; identical to SEQ ID NO: 185130

SEQ ID NO: 322697 - RNA, 64 nt, Human; identical to SEQ ID NO: 185131

SEQ ID NO: 322698 - RNA, 64 nt, Human; identical to SEQ ID NO: 185132

SEQ ID NO: 322699 - RNA, 64 nt, Human; identical to SEQ ID NO: 185133

SEQ ID NO: 322700 - RNA, 64 nt, Human; identical to SEQ ID NO: 185134

SEQ ID NO: 322701 - RNA, 64 nt, Human; identical to SEQ ID NO: 185135

SEQ ID NO: 322702 - RNA, 64 nt, Human; identical to SEQ ID NO: 185136

SEQ ID NO: 322703 - RNA, 64 nt, Human
cagacuggcugcacagcccaaccaggaggggucugccucccacgcugggacacagaccggccgc

SEQ ID NO: 322704 - RNA, 64 nt, Human
agucgggacucagcugaggacacauccccacccugccucccaucuggcccuuuggacaacuggc

SEQ ID NO: 322705 - RNA, 64 nt, Human
cucgaucucuugaccuugggauccacccgccuuggccucccaaagugcugggauuacaggugug

SEQ ID NO: 322706 - RNA, 64 nt, Human; identical to SEQ ID NO: 185137

SEQ ID NO: 322707 - RNA, 64 nt, Human; identical to SEQ ID NO: 185138

SEQ ID NO: 322708 - RNA, 64 nt, Human; identical to SEQ ID NO: 185139

SEQ ID NO: 322709 - RNA, 64 nt, Human; identical to SEQ ID NO: 185140

SEQ ID NO: 322710 - RNA, 64 nt, Human; identical to SEQ ID NO: 185141

SEQ ID NO: 322711 - RNA, 64 nt, Human; identical to SEQ ID NO: 185142

SEQ ID NO: 322712 - RNA, 64 nt, Human; identical to SEQ ID NO: 185143

SEQ ID NO: 322713 - RNA, 60 nt, Human; identical to SEQ ID NO: 185144

SEQ ID NO: 322714 - RNA, 64 nt, Human; identical to SEQ ID NO: 185145

SEQ ID NO: 322715 - RNA, 64 nt, Human; identical to SEQ ID NO: 185149

SEQ ID NO: 322716 - RNA, 64 nt, Human; identical to SEQ ID NO: 185150

SEQ ID NO: 322717 - RNA, 64 nt, Human; identical to SEQ ID NO: 185151

SEQ ID NO: 322718 - RNA, 64 nt, Human; identical to SEQ ID NO: 185152

SEQ ID NO: 322719 - RNA, 63 nt, Human; identical to SEQ ID NO: 185153

SEQ ID NO: 322720 - RNA, 64 nt, Human; identical to SEQ ID NO: 185154

SEQ ID NO: 322721 - RNA, 64 nt, Human
ccaccuccuggguucaugccauucuucugccucagccucccaaguagcugggacuacaggugcc

SEQ ID NO: 322722 - RNA, 64 nt, Human
cucgaucuccugaccuugugauccaccugucucggccucccaaagugcugggauuacaggccuc

SEQ ID NO: 322723 - RNA, 64 nt, Human
cgaacuccugaccucaagugauccgccugccucagccucccaaagugcugggauuacaggugug

SEQ ID NO: 322724 - RNA, 64 nt, Human; identical to SEQ ID NO: 185155

SEQ ID NO: 322725 - RNA, 64 nt, Human; identical to SEQ ID NO: 185156

SEQ ID NO: 322726 - RNA, 64 nt, Human; identical to SEQ ID NO: 185157

SEQ ID NO: 322727 - RNA, 64 nt, Human; identical to SEQ ID NO: 185158

SEQ ID NO: 322728 - RNA, 64 nt, Human; identical to SEQ ID NO: 185159

SEQ ID NO: 322729 - RNA, 64 nt, Human; identical to SEQ ID NO: 185160

SEQ ID NO: 322730 - RNA, 64 nt, Human; identical to SEQ ID NO: 185161

SEQ ID NO: 322731 - RNA, 64 nt, Human; identical to SEQ ID NO: 185162

SEQ ID NO: 322732 - RNA, 64 nt, Human; identical to SEQ ID NO: 185163

SEQ ID NO: 322733 - RNA, 64 nt, Human; identical to SEQ ID NO: 185164

SEQ ID NO: 322734 - RNA, 64 nt, Human; identical to SEQ ID NO: 185168

SEQ ID NO: 322735 - RNA, 64 nt, Human; identical to SEQ ID NO: 185169

SEQ ID NO: 322736 - RNA, 64 nt, Human; identical to SEQ ID NO: 185170

SEQ ID NO: 322737 - RNA, 64 nt, Human; identical to SEQ ID NO: 185171

SEQ ID NO: 322738 - RNA, 64 nt, Human; identical to SEQ ID NO: 185172

SEQ ID NO: 322739 - RNA, 64 nt, Human
ugcaggccuguccuccccaaccccagcuggaugugccucccaggccugcugugguucugacaca

SEQ ID NO: 322740 - RNA, 64 nt, Human
ccgcauccgggguucaagccauucuccugccucagccucccaaguaacugggauuacaggcaug

SEQ ID NO: 322741 - RNA, 64 nt, Human
cugccucccagguucaagugguucuccugccucagccucccaaguagcugggauuauaggugug

SEQ ID NO: 322742 - RNA, 64 nt, Human; identical to SEQ ID NO: 185173

SEQ ID NO: 322743 - RNA, 64 nt, Human; identical to SEQ ID NO: 185174

SEQ ID NO: 322744 - RNA, 64 nt, Human; identical to SEQ ID NO: 185175

SEQ ID NO: 322745 - RNA, 64 nt, Human; identical to SEQ ID NO: 185176

SEQ ID NO: 322746 - RNA, 64 nt, Human; identical to SEQ ID NO: 185177

SEQ ID NO: 322747 - RNA, 64 nt, Human; identical to SEQ ID NO: 185178

SEQ ID NO: 322748 - RNA, 64 nt, Human; identical to SEQ ID NO: 185179

SEQ ID NO: 322749 - RNA, 64 nt, Human; identical to SEQ ID NO: 185180

SEQ ID NO: 322750 - RNA, 64 nt, Human; identical to SEQ ID NO: 185181

SEQ ID NO: 322751 - RNA, 64 nt, Human; identical to SEQ ID NO: 185182

SEQ ID NO: 322752 - RNA, 64 nt, Human; identical to SEQ ID NO: 185183

SEQ ID NO: 322753 - RNA, 64 nt, Human; identical to SEQ ID NO: 185187

SEQ ID NO: 322754 - RNA, 64 nt, Human; identical to SEQ ID NO: 185188

SEQ ID NO: 322755 - RNA, 64 nt, Human; identical to SEQ ID NO: 185189

SEQ ID NO: 322756 - RNA, 64 nt, Human; identical to SEQ ID NO: 185190

SEQ ID NO: 322757 - RNA, 64 nt, Human
acaaagugcaauacagagccuucccuacccugacgccucccagucaucaucuccagaacuccca

SEQ ID NO: 322758 - RNA, 64 nt, Human
auggagaacaagcaaaguaugcaggcccccugcagccucccaggacaggcuggcaagggaggag

SEQ ID NO: 322759 - RNA, 64 nt, Human
cccgugugugaauuccugcuccucaugcuggagugccucccauuuccuuccccuuucucuguca

SEQ ID NO: 322760 - RNA, 64 nt, Human; identical to SEQ ID NO: 185191

SEQ ID NO: 322761 - RNA, 64 nt, Human; identical to SEQ ID NO: 185192

SEQ ID NO: 322762 - RNA, 64 nt, Human; identical to SEQ ID NO: 185193

SEQ ID NO: 322763 - RNA, 64 nt, Human; identical to SEQ ID NO: 185194

SEQ ID NO: 322764 - RNA, 64 nt, Human; identical to SEQ ID NO: 185195

SEQ ID NO: 322765 - RNA, 64 nt, Human; identical to SEQ ID NO: 185196

SEQ ID NO: 322766 - RNA, 64 nt, Human; identical to SEQ ID NO: 185197

SEQ ID NO: 322767 - RNA, 64 nt, Human; identical to SEQ ID NO: 185198

SEQ ID NO: 322768 - RNA, 64 nt, Human; identical to SEQ ID NO: 185199

SEQ ID NO: 322769 - RNA, 64 nt, Human; identical to SEQ ID NO: 185200

SEQ ID NO: 322770 - RNA, 64 nt, Human; identical to SEQ ID NO: 185201

SEQ ID NO: 322771 - RNA, 64 nt, Human; identical to SEQ ID NO: 185202

SEQ ID NO: 322772 - RNA, 64 nt, Human; identical to SEQ ID NO: 185206

SEQ ID NO: 322773 - RNA, 64 nt, Human; identical to SEQ ID NO: 185207

SEQ ID NO: 322774 - RNA, 64 nt, Human; identical to SEQ ID NO: 185208

SEQ ID NO: 322775 - RNA, 64 nt, Human
ggaggaacagauaagacugggucagccuagucaugccucccaacuguggugguauauguguaca

SEQ ID NO: 322776 - RNA, 64 nt, Human
ugaacuccugaccucagguaaucgaccugccucggccucccaaagugcugggauuacaggugug

SEQ ID NO: 322777 - RNA, 64 nt, Human
cccaccagcaccagaggucacucuccacauccccgccucccagacauauaccaggagcaauuuc

SEQ ID NO: 322778 - RNA, 64 nt, Human; identical to SEQ ID NO: 185209

SEQ ID NO: 322779 - RNA, 64 nt, Human; identical to SEQ ID NO: 185210

SEQ ID NO: 322780 - RNA, 64 nt, Human; identical to SEQ ID NO: 185211

SEQ ID NO: 322781 - RNA, 64 nt, Human; identical to SEQ ID NO: 185212

SEQ ID NO: 322782 - RNA, 64 nt, Human; identical to SEQ ID NO: 185213

SEQ ID NO: 322783 - RNA, 64 nt, Human; identical to SEQ ID NO: 185214

SEQ ID NO: 322784 - RNA, 64 nt, Human; identical to SEQ ID NO: 185215

SEQ ID NO: 322785 - RNA, 64 nt, Human; identical to SEQ ID NO: 185216

SEQ ID NO: 322786 - RNA, 64 nt, Human; identical to SEQ ID NO: 185217

SEQ ID NO: 322787 - RNA, 64 nt, Human; identical to SEQ ID NO: 185218

SEQ ID NO: 322788 - RNA, 64 nt, Human; identical to SEQ ID NO: 185219

SEQ ID NO: 322789 - RNA, 64 nt, Human; identical to SEQ ID NO: 185220

SEQ ID NO: 322790 - RNA, 64 nt, Human; identical to SEQ ID NO: 185221

SEQ ID NO: 322791 - RNA, 64 nt, Human; identical to SEQ ID NO: 185225

SEQ ID NO: 322792 - RNA, 64 nt, Human; identical to SEQ ID NO: 185226

SEQ ID NO: 322793 - RNA, 64 nt, Human
ugaacuccugaccucaggugauccacccgccuuggccucccaaagugcugggauuacaggugug

SEQ ID NO: 322794 - RNA, 64 nt, Human
cugccucccggauucaagugauucuccugucucagccucccaaguagcugggauuacagugccu

SEQ ID NO: 322795 - RNA, 64 nt, Human
uugucuuuuuaauguuagugauccaccugccucagccucccaaagugcugggauuacaggcuug

SEQ ID NO: 322796 - RNA, 64 nt, Human; identical to SEQ ID NO: 185227

SEQ ID NO: 322797 - RNA, 64 nt, Human; identical to SEQ ID NO: 185228

SEQ ID NO: 322798 - RNA, 64 nt, Human; identical to SEQ ID NO: 185229

SEQ ID NO: 322799 - RNA, 64 nt, Human; identical to SEQ ID NO: 185230

SEQ ID NO: 322800 - RNA, 64 nt, Human; identical to SEQ ID NO: 185231

SEQ ID NO: 322801 - RNA, 64 nt, Human; identical to SEQ ID NO: 185232

SEQ ID NO: 322802 - RNA, 64 nt, Human; identical to SEQ ID NO: 185233

SEQ ID NO: 322803 - RNA, 64 nt, Human; identical to SEQ ID NO: 185234

SEQ ID NO: 322804 - RNA, 64 nt, Human; identical to SEQ ID NO: 185235

SEQ ID NO: 322805 - RNA, 64 nt, Human; identical to SEQ ID NO: 185236

SEQ ID NO: 322806 - RNA, 64 nt, Human; identical to SEQ ID NO: 185237

SEQ ID NO: 322807 - RNA, 64 nt, Human; identical to SEQ ID NO: 185238

SEQ ID NO: 322808 - RNA, 64 nt, Human; identical to SEQ ID NO: 185239

SEQ ID NO: 322809 - RNA, 64 nt, Human; identical to SEQ ID NO: 185240

SEQ ID NO: 322810 - RNA, 64 nt, Human; identical to SEQ ID NO: 185244

SEQ ID NO: 322811 - RNA, 64 nt, Human
cucgaacuccugaccucguaaucugcccaccucggccucccaaaguucugggauuacaggugug

SEQ ID NO: 322812 - RNA, 64 nt, Human
ugcagugacgcgaucucgacucacugcaaccuccgccucccagguucaagcgauucuccugcuu

SEQ ID NO: 322813 - RNA, 64 nt, Human
ggccucuugccuuugagucuuuguggaauggauagccucccacuaggacugggaggagaauaac

SEQ ID NO: 322814 - RNA, 64 nt, Human; identical to SEQ ID NO: 185245

SEQ ID NO: 322815 - RNA, 64 nt, Human; identical to SEQ ID NO: 185246

SEQ ID NO: 322816 - RNA, 64 nt, Human; identical to SEQ ID NO: 185247

SEQ ID NO: 322817 - RNA, 64 nt, Human; identical to SEQ ID NO: 185248

SEQ ID NO: 322818 - RNA, 64 nt, Human; identical to SEQ ID NO: 185249

SEQ ID NO: 322819 - RNA, 64 nt, Human; identical to SEQ ID NO: 185250

SEQ ID NO: 322820 - RNA, 64 nt, Human; identical to SEQ ID NO: 185251

SEQ ID NO: 322821 - RNA, 64 nt, Human; identical to SEQ ID NO: 185252

SEQ ID NO: 322822 - RNA, 64 nt, Human; identical to SEQ ID NO: 185253

SEQ ID NO: 322823 - RNA, 64 nt, Human; identical to SEQ ID NO: 185254

SEQ ID NO: 322824 - RNA, 64 nt, Human; identical to SEQ ID NO: 185255

SEQ ID NO: 322825 - RNA, 64 nt, Human; identical to SEQ ID NO: 185256

SEQ ID NO: 322826 - RNA, 64 nt, Human; identical to SEQ ID NO: 185257

SEQ ID NO: 322827 - RNA, 64 nt, Human; identical to SEQ ID NO: 185258

SEQ ID NO: 322828 - RNA, 60 nt, Human; identical to SEQ ID NO: 185259

SEQ ID NO: 322829 - RNA, 64 nt, Human
ccgcccggggagcacaauggcgcugcacaaaacggccucccacacgugcguccaggcucuugcg

SEQ ID NO: 322830 - RNA, 64 nt, Human
uagagcagagcuccuggccagcguuugaagccuggccucccaccuggggcauuuacugacaccc

SEQ ID NO: 322831 - RNA, 64 nt, Human
ugaaaauugacuuuaauuuaaaacaaaggccugugccucccacccaggaggugggagggugaau

SEQ ID NO: 322832 - RNA, 64 nt, Human; identical to SEQ ID NO: 185263

SEQ ID NO: 322833 - RNA, 64 nt, Human; identical to SEQ ID NO: 185264

SEQ ID NO: 322834 - RNA, 64 nt, Human; identical to SEQ ID NO: 185265

SEQ ID NO: 322835 - RNA, 64 nt, Human; identical to SEQ ID NO: 185266

SEQ ID NO: 322836 - RNA, 64 nt, Human; identical to SEQ ID NO: 185267

SEQ ID NO: 322837 - RNA, 64 nt, Human; identical to SEQ ID NO: 185268

SEQ ID NO: 322838 - RNA, 64 nt, Human; identical to SEQ ID NO: 185269

SEQ ID NO: 322839 - RNA, 64 nt, Human; identical to SEQ ID NO: 185270

SEQ ID NO: 322840 - RNA, 64 nt, Human; identical to SEQ ID NO: 185271

SEQ ID NO: 322841 - RNA, 64 nt, Human; identical to SEQ ID NO: 185272

SEQ ID NO: 322842 - RNA, 64 nt, Human; identical to SEQ ID NO: 185273

SEQ ID NO: 322843 - RNA, 64 nt, Human; identical to SEQ ID NO: 185274

SEQ ID NO: 322844 - RNA, 64 nt, Human; identical to SEQ ID NO: 185275

SEQ ID NO: 322845 - RNA, 64 nt, Human; identical to SEQ ID NO: 185276

SEQ ID NO: 322846 - RNA, 64 nt, Human; identical to SEQ ID NO: 185277

SEQ ID NO: 322847 - RNA, 64 nt, Human
ugggggcuccuuuucugacuacuguuagcacucagccucccauucacauguauuauauuuaagu

SEQ ID NO: 322848 - RNA, 64 nt, Human
uccugcacaguuuucuggcuggagccuagaacaggccucccaaguuuuaggacaaacagcucag

SEQ ID NO: 322849 - RNA, 64 nt, Human
ccgccuccuggguucaagcaauucuccuuccucagccucccaaguagcugggauuacaggcaug

SEQ ID NO: 322850 - RNA, 64 nt, Human; identical to SEQ ID NO: 185278

SEQ ID NO: 322851 - RNA, 64 nt, Human; identical to SEQ ID NO: 185282

SEQ ID NO: 322852 - RNA, 64 nt, Human; identical to SEQ ID NO: 185283

SEQ ID NO: 322853 - RNA, 64 nt, Human; identical to SEQ ID NO: 185284

SEQ ID NO: 322854 - RNA, 64 nt, Human; identical to SEQ ID NO: 185285

SEQ ID NO: 322855 - RNA, 64 nt, Human; identical to SEQ ID NO: 185286

SEQ ID NO: 322856 - RNA, 64 nt, Human; identical to SEQ ID NO: 185287

SEQ ID NO: 322857 - RNA, 64 nt, Human
ugugagugugugcgagugugugggcuggugugugaauaucuauaaauaaguauauaugguguau

SEQ ID NO: 322858 - RNA, 64 nt, Human
gaugaugguaugcccaugcaucauuugcucuucaaauaucuaugugcuuggagccacaguuucc

SEQ ID NO: 322859 - RNA, 64 nt, Human
uuuuccuacuucaacagaagaacaauauaaaauuaauaucuauuaccaaggauuagauacuaua

SEQ ID NO: 322860 - RNA, 64 nt, Human
ggguagaauaggcuguguauuuacaugaauguauaauaucuaugucagcaguauuggcugaguc

SEQ ID NO: 322861 - RNA, 64 nt, Human
aaguaguuuggccuguucacaacuuaucaggaccaauaucuaguguggacucaguguucucuag

SEQ ID NO: 322862 - RNA, 64 nt, Human
gcaucaaagcaguauuucucauuccugccuccucaauaucuaauacugggaagauacuucaaag

SEQ ID NO: 322863 - RNA, 64 nt, Human
gaaaauaauuagaccuguuaaauuauaauauucaaauaucuauuuaaagacauuuauauuaauu

SEQ ID NO: 322864 - RNA, 64 nt, Human
auacucauuuaauaauuuaaaauaauuauuguauaauaucuacauuuggagaauuuugaacuau

SEQ ID NO: 322865 - RNA, 64 nt, Human
cagcugcgucagcccgaguucugaauuaaaacaugccucccacagaaucuauuucugaugaaua

SEQ ID NO: 322866 - RNA, 64 nt, Human
cugccucccggguucaagcgauucuccugccucagccucccaaguagcugggauuacaggcacc

SEQ ID NO: 322867 - RNA, 64 nt, Human; identical to SEQ ID NO: 322611

SEQ ID NO: 322868 - RNA, 64 nt, Human
ggccauuuuuccuuuuggcuuucgagggccuguaaauaucuauauauaauucuguguguauucu

SEQ ID NO: 322869 - RNA, 64 nt, Human
aaagaacuuaaauuuuaucaggaacuguaagauaaauaucuagugcuuauaaauuuucuguccu

SEQ ID NO: 322870 - RNA, 64 nt, Human
uggaagacauuguccugcaagcaggagccagggcaauaucuauauuccuacagugacuauuuuu

SEQ ID NO: 322871 - RNA, 64 nt, Human
ccacagugcucaguuguacuuuuuauuaagcuguaauaucuauuuuuguuuuugucuuuuuccu

SEQ ID NO: 322872 - RNA, 64 nt, Human
uuuccuaaguuucuuugaggguuccaugggagcaaauaucuaaauaauggccugguaggucugg

SEQ ID NO: 322873 - RNA, 64 nt, Human
uauauauauaaauauauguauauguaugguuguaaauaucuauguauacauguacuuaguaugu

SEQ ID NO: 322874 - RNA, 64 nt, Human
cuaguguauucacuuacccuaguucauuauaaaaaauaucuaggcauuguggauauaaaacugu

SEQ ID NO: 322875 - RNA, 64 nt, Human
uguaaaucuucaucauuccuacuguaguuuauuuaauaucuauuguaaauuaugugacuuguag

SEQ ID NO: 322876 - RNA, 64 nt, Human
cucaccacaguugucuaggaaaugacaugaauucaauaucuaaugucaaccaauggggagagcc

SEQ ID NO: 322877 - RNA, 64 nt, Human
uugcuccucauuccuccccugcccuuuucucuggaauaucuaagaugugagcugcauugacucu

SEQ ID NO: 322878 - RNA, 64 nt, Human
uacugucaauuuggcagugauauucaucauaauaaauaucuagaaaugauaauuugcuaaaguu

SEQ ID NO: 322879 - RNA, 64 nt, Human
cuuaaaagccacaggggacaguuaaauaucuuaaaauaucuaaaacauuuuuuaaagcacuuag

SEQ ID NO: 322880 - RNA, 64 nt, Human
uccugcuauccucuucauucaccccugccacuguaauaucuauaaguacuuaagagacuuguga

SEQ ID NO: 322881 - RNA, 64 nt, Human
ucugaguguauguggaaacgauugucaaaucuaaaauaucuauauauuaaaaaguaggaaauug

SEQ ID NO: 322882 - RNA, 64 nt, Human
cuauuugucuuuauuucaaguaccagaauuacaaaauaucuaaguaauauauuuuuguugucgu

SEQ ID NO: 322883 - RNA, 64 nt, Human
ugcaauggcgcaaucucgacucaccacaaccuccgccucccagguucaagcaauucuccugccu

SEQ ID NO: 322884 - RNA, 64 nt, Human
ugaacuccugaccucaggugauccgccugccucggccucccaaagugcugggauuacaggcaua

SEQ ID NO: 322885 - RNA, 64 nt, Human
cuugaacuccugaccucaugauccacccaccuuagccucccaaagugcugggauuaggugugag

SEQ ID NO: 322886 - RNA, 64 nt, Human
aggaacuguaaaaucccuuggucauucauaaauaaauaucuaaauuaggaauacuaauuaauug

SEQ ID NO: 322887 - RNA, 64 nt, Human
auauguuuuaauugccaaccgugugaaacaacaaaauaucuaaaaacuaaucccgauuugaaca

SEQ ID NO: 322888 - RNA, 64 nt, Human
cagagaagcauauauuuuuuauuaacagugcagcaauaucuauaaugacugagaggaucugcca

SEQ ID NO: 322889 - RNA, 64 nt, Human
auaaaaugcagaaacccuucuguacucguugguaaauaucuacucccccaagugacuccaggug

SEQ ID NO: 322890 - RNA, 64 nt, Human
uuggcagcagauauccuaggagggguguuugggaaauaucuagcuauuuuaauagauagauacc

SEQ ID NO: 322891 - RNA, 64 nt, Human
cuucaaaaaaauuuucaauuaaacucaaauauuaaauaucuauaacuuauaaacaccaacuuuc

SEQ ID NO: 322892 - RNA, 64 nt, Human
uuccuuuuuuuuuuuuuuuuuugaaaauguacaaaauaucuaucacuacugauaggagguuaau

SEQ ID NO: 322893 - RNA, 64 nt, Human
gcuuccauugaucagucuuuuacuugaggcauuaaauaucuaauuaaaucgugaaauggcagua

SEQ ID NO: 322894 - RNA, 64 nt, Human
caaaauaaaauucacuuaaguagaacuauaaauaaauaucuagaaucugacuggcucaucauga

SEQ ID NO: 322895 - RNA, 64 nt, Human
aagugaaguuuugugacagaaaaaagguuguuuuaauaucuacuugguuuuucucaaaauggaa

SEQ ID NO: 322896 - RNA, 64 nt, Human
auucuugucacuuggcaucaaccucuucaugauaaauaucuacuacugagacacuucaauucac

SEQ ID NO: 322897 - RNA, 64 nt, Human
gguuuccagggccugguguuggagagugcagagaaauaucuaccucccuggaggugugaagacu

SEQ ID NO: 322898 - RNA, 64 nt, Human
uuaguuucacccagugugcuuuuggauaagcagaaauaucuaaaugggauuuugaguucuccag

SEQ ID NO: 322899 - RNA, 64 nt, Human
uuuggagagacagaaauguaaaaguguaucuagaaauaucuauaucucuauauauuuuuaacug

SEQ ID NO: 322900 - RNA, 64 nt, Human
gcuugguuccuguuguuccuggcaacagaauuugaauaucuaggauaggaugaucaccuccagu

SEQ ID NO: 322901 - RNA, 64 nt, Human
caaacucccgaccucaggugauccacccaccucggccucccaaagugcugggauuacaggcgug

SEQ ID NO: 322902 - RNA, 64 nt, Human
cucgaucuccugaccucgugauccgccugccucugccucccaaagugcugggauuacaggcgug

SEQ ID NO: 322903 - RNA, 64 nt, Human
cgaacuccugaccucaggugauccaccagccucggccucccaaaguucugggauuaaaugcgug

SEQ ID NO: 322904 - RNA, 64 nt, Human
aaugcagggacuguaaaaccaccuuuucugcuucaauaucuaauuccuguguagcuuuguucau

SEQ ID NO: 322905 - RNA, 64 nt, Human
uugcuuuucuuucuguuaaaugagaggaauguuaaauaucuaacaguuuagaaucuuaugcuua

SEQ ID NO: 322906 - RNA, 62 nt, Human
gugaauucuguguccuuugaggggcugauggcaauaucuaaaaccaggcaccagcaugaaca

SEQ ID NO: 322907 - RNA, 64 nt, Human
auauuuuaugccaagaaaagcauacuauaaagcaaauaucuauuauucuccuaaacgaaugccu

SEQ ID NO: 322908 - RNA, 64 nt, Human
uuuuuccccacaguauauauuauacagcagucauaauaucuauaaauacauagaguuuauguug

SEQ ID NO: 322909 - RNA, 64 nt, Human
uucaguaggugccucuguaccaaauauuuuauggaauaucuaaauacuaaaauaaacuaugaau

SEQ ID NO: 322910 - RNA, 64 nt, Human
auuuguaaagucaucagaauaguguggauuauuaaauaucuaguuuggaagaaaauaauuuaua

SEQ ID NO: 322911 - RNA, 64 nt, Human
gguuaaguguuuaucauauauauggguacuuuguaauaucuaaaaacuuagaaacggaaaugga

SEQ ID NO: 322912 - RNA, 64 nt, Human
uuucgaauauaaccagaggaaaaaaggauggagaaauaucuaggaaagguaauuuugcgaaaca

SEQ ID NO: 322913 - RNA, 64 nt, Human
uuucgaauauaaccagagaaaaaaaggauggagaaauaucuaggaaagguaauuuugcgaaaca

SEQ ID NO: 322914 - RNA, 64 nt, Human
uuuuaucccuaaacuuaguaccaaaccagcauuuaauaucuaauuauaaaucuaauuuggccua

SEQ ID NO: 322915 - RNA, 64 nt, Human
uuaacuuuguaaguagcguaccuuccuuccuuaaaauaucuagcuuccugugcccuuucauaga

SEQ ID NO: 322916 - RNA, 64 nt, Human
uuuaggugagugggaaaguauuacccuuguuuuaaauaucuaagcaaugccuaucaacccuuuu

SEQ ID NO: 322917 - RNA, 64 nt, Human
uagaguuauauaaucauaauuuauguuuauuucaaauaucuaaguuuauugcuuggauuucuag

SEQ ID NO: 322918 - RNA, 64 nt, Human
cugcuguuguaaaguauuguuugcagcucuuuccaauaucuagagacauuuuuauuuaugaaua

SEQ ID NO: 322919 - RNA, 64 nt, Human
auaagaguugggcaccauaaauucucuauauuuugccucccauggaggccuuugaaaugcaucu

SEQ ID NO: 322920 - RNA, 64 nt, Human
ugaacuccuggccucaagggauccguccgccucagccucccaaagugcugggauuacaggcaua

SEQ ID NO: 322921 - RNA, 64 nt, Human
ccugccugccugggcgggcccgcccgccaccgcagccucccagcugcucuccgugucuccaauc

SEQ ID NO: 322922 - RNA, 64 nt, Human
ccccuggaggagcacagcacugcauaugcuucuaaauaucuaaacucauuaacauggaaacaca

SEQ ID NO: 322923 - RNA, 64 nt, Human
ugugauuaugguccugcaaggugauucuugcuaaaauaucuaaacuuuuguuuuguuuuaacug

SEQ ID NO: 322924 - RNA, 64 nt, Human
uagacaucaaacaucuuaaaugauacacuguuuuaauaucuaaaaaucugucauucuacuuaau

SEQ ID NO: 322925 - RNA, 64 nt, Human
cuacacaaucagaaacucuugggggagggcccgaaauaucuauguuuuaccaagcccaccacau

SEQ ID NO: 322926 - RNA, 64 nt, Human
auuugggaaaauuuuccaagguuagauuccaauaaauaucuauuuauuauuaaauauuaaaaua

SEQ ID NO: 322927 - RNA, 64 nt, Human
uuccaauaaauaucuauuuauuauuaaauauuaaaauaucuauuuauuauuaaaaccauuuaua

SEQ ID NO: 322928 - RNA, 64 nt, Human
auccuaaguugcuggaucuaguugauauuuaaacaauaucuaguugauauuucucauucaguug

SEQ ID NO: 322929 - RNA, 64 nt, Human
uucuuacuaacauacaaaaauaaugcacaacagaaauaucuaaaaccuuuuccguagacuuuga

SEQ ID NO: 322930 - RNA, 52 nt, Human
aaucugugacuguagagugaggaauaucuauacaaaauguacgaaacuguau

SEQ ID NO: 322931 - RNA, 64 nt, Human
ucagaugcucgccuguaccucaccaggcagaguaaauaucuacucacucauacagccagcccac

SEQ ID NO: 322932 - RNA, 64 nt, Human
aaugugggaaaugguucuccuuucccucucaauaaauaucuauuuuucauuuuuuuacuuugua

SEQ ID NO: 322933 - RNA, 64 nt, Human
augaaaauaaucuggcaucaguuucauuuugcuaaauaucuagucuucuucaaacaguaucuug

SEQ ID NO: 322934 - RNA, 64 nt, Human
gcauauaugucuauuuauucaauaucugucauauaauaucuauuuggaagaagaaacuuucucu

SEQ ID NO: 322935 - RNA, 64 nt, Human
aaucaucucuuuaaccuaagauguaaguauuaagaauaucuaauuuuccuaauuuggacaagau

SEQ ID NO: 322936 - RNA, 64 nt, Human
guauuuauaauagucagcgcaggaaugcacauggaauaucuacuuguccuuuugaaccucacga

SEQ ID NO: 322937 - RNA, 64 nt, Human
ccccugggaaauccccucauccugcccucuggcugccucccagcugggcuuguucucugaggga

SEQ ID NO: 322938 - RNA, 64 nt, Human
cucuucuaccuccugcaacccacccauccuauuagccucccacauucaaggcccgugauacagg

SEQ ID NO: 322939 - RNA, 64 nt, Human
cucgaucuccucaccucgugauccgcccgccucggccucccaaagugcugggauuacaggcaug

SEQ ID NO: 322940 - RNA, 64 nt, Human
aagaaaaaaaaaaguauauuauuaaaauccuguaaauaucuaugguauauuaauaaaacaauuu

SEQ ID NO: 322941 - RNA, 64 nt, Human
uagaaacuuguuauucaugugaaacagugaacauaauaucuaaugauguggagcaaguacauua

SEQ ID NO: 322942 - RNA, 64 nt, Human
caaacuggggcagguuccaggaacuugaacuaaaaauaucuauuuaagccucucucucuuucuc

SEQ ID NO: 322943 - RNA, 64 nt, Human
gcuugggccugggccacagcaacagcaguggucaaauaucuagauuuauuuugaaaagagccaa

SEQ ID NO: 322944 - RNA, 64 nt, Human
uuaacccuugaaucugcuuuauguacauaaucaaaauaucuauaucuauaucuauaucuauauc

SEQ ID NO: 322945 - RNA, 64 nt, Human
gcagucauaccuguucagagaaccaggaagacucaauaucuaucucagaggaaauaugguuacc

SEQ ID NO: 322946 - RNA, 64 nt, Human
uauaaaagauauauauauauauauauauauauaaaauaucuauauucuauacacacccugcccc

SEQ ID NO: 322947 - RNA, 64 nt, Human
aguuccccaaggaaacgaacaaaaugaacucuagaauaucuagcaaauaguuaaagaagcaauu

SEQ ID NO: 322948 - RNA, 64 nt, Human
ggcaauacuuaagcaucucuaaauuuaggugcuaaauaucuauuauucuguuguagucauuagg

SEQ ID NO: 322949 - RNA, 64 nt, Human
uauauaguggguuauauuaaaagaaaagaagaaaaauaucuaauuucucuuggcagauuugcau

SEQ ID NO: 322950 - RNA, 64 nt, Human
gguuuuugguucacuggcuuaagagguuucucagaauaucuauggccacagcagcauaccaguu

SEQ ID NO: 322951 - RNA, 64 nt, Human
guguuagcacugaaauauugucauugauagggaaaauaucuauucuuugagucauuguuacuga

SEQ ID NO: 322952 - RNA, 64 nt, Human
uauuuccuauuuugauuuuuacuuugaagauaggaauaucuaaauuauaucucuagggagaaaa

SEQ ID NO: 322953 - RNA, 64 nt, Human
uccacaguaggaauaaaaaaucuauauucucagaaauaucuagcaugguauauaacaaaacacu

SEQ ID NO: 322954 - RNA, 64 nt, Human
guuuuaaauugagagcauuaaacaucaaaguuauaauaucuaaaacaauuuauuuuucaucaau

SEQ ID NO: 322955 - RNA, 64 nt, Human
aaacagaaccuccaggcugacgaggcaagacaaagccucccaccagacuuggagauugaaguuc

SEQ ID NO: 322956 - RNA, 64 nt, Human
cucgaacuccugaccucaugauccacccaccucagccucccaaagugcugggauuacaggugug

SEQ ID NO: 322957 - RNA, 64 nt, Human
gcaucuccccuuccacccucacccccaggucccagccucccacucagcagagugcccaagggac

SEQ ID NO: 322958 - RNA, 64 nt, Human
uuggaaaacuaagugcagaguuuacagagugguaaauaucuauguuacauguagauuauacaua

SEQ ID NO: 322959 - RNA, 64 nt, Human
ugugcuauccuugaacuaccaauaauuuuuauaaaauaucuaguuuuuacuacuuuuauauaaa

SEQ ID NO: 322960 - RNA, 64 nt, Human
agccauuguugagaauuagaucccacaucguauaaauaucuauuaaccauucuaaauaaagaga

SEQ ID NO: 322961 - RNA, 64 nt, Human
aucuaaaucuuccuuuucuuucagaaauauuaauaauaucuagaguucucuaauuuucauguga

SEQ ID NO: 322962 - RNA, 64 nt, Human
cagauuagcuuucauuuggggaaugaaguucugaaauaucuaaagcaguuuacucaucaauuga

SEQ ID NO: 322963 - RNA, 64 nt, Human
agaaaaaagguuacuuuguuauucagcuuuucauaauaucuaugcugaguauuuucacguaucu

SEQ ID NO: 322964 - RNA, 64 nt, Human
ugaccagcaaguaaacuugaaacaaaaauggacaaauaucuaaaauauuuuuaaauguauguau

SEQ ID NO: 322965 - RNA, 64 nt, Human
gcauugacguguaacuugucuuucuacuguuucuaauaucuauuaauuagaucauaagguaccu

SEQ ID NO: 322966 - RNA, 64 nt, Human
aauguggaaaagaaugaagagcagcaguaaaagaaauaucuagugaaaaaacaggaagcguauu

SEQ ID NO: 322967 - RNA, 64 nt, Human
cuucaagugacacuauguaggaauccuuccaaggaauaucuauguacaauguauauagcugaaa

SEQ ID NO: 322968 - RNA, 64 nt, Human
uaaauuuucacauuagauuucuauucaaaguacuaauaucuacaugguccacacuuuucuauuu

SEQ ID NO: 322969 - RNA, 64 nt, Human
uacguuuuuuauccugcugaaaaaguauauauaaaauaucuaacauuacaggauagagguucag

SEQ ID NO: 322970 - RNA, 64 nt, Human
aauacuaugacuguuaaaaugucagacuauaacaaauaucuaucuuuuauuuuucauuagaccc

SEQ ID NO: 322971 - RNA, 64 nt, Human
uuugguccuccucuguuucauagaaaagucauagaauaucuaugauacauugaaaaguuacugc

SEQ ID NO: 322972 - RNA, 64 nt, Human
uuuuugcaaagacaaaaagagauuacaaaaggaaaauaucuaaaacuauuuucucuuugcccuu

SEQ ID NO: 322973 - RNA, 64 nt, Human
cacacccuuguguugcgcccggagcccgcccuucgccucccagccccucaagacaccgcuggcu

SEQ ID NO: 322974 - RNA, 64 nt, Human
guuaucaggaagcucuguaagaaagaaaaggucagccucccaggcaaaccaguaguggagguuu

SEQ ID NO: 322975 - RNA, 64 nt, Human
gggagacucagcagacggacccucuccguugccugccucccaaaauggagccaggcuuccaacu

SEQ ID NO: 322976 - RNA, 64 nt, Human
gaggaaacagaagagauaaaaacuuuuccaugcaaauaucuauuucuaaaccacaaugaucuga

SEQ ID NO: 322977 - RNA, 64 nt, Human
uuuuuuuuuuuuuuuuugguacuucaggauagcaaauaucuaucugcuauuaaaugguaaauga

SEQ ID NO: 322978 - RNA, 64 nt, Human
ugaaugucuggcaugauuauacacguguauuggaaauaucuaguuuuuuaaauuuuuaauuaau

SEQ ID NO: 322979 - RNA, 64 nt, Human
uccucauuuauaacagggaggagguggauuauguaauaucuaagagcuuuucaguuuuaauacu

SEQ ID NO: 322980 - RNA, 64 nt, Human
auaauuuuauguucuacuuuuaaaaaaauaaauuaauaucuaauuguaaacccuuucccaugug

SEQ ID NO: 322981 - RNA, 64 nt, Human
aacuaacaaaaauauuuggucuucaauaaugcuaaauaucuacauuuuuagaauuuaucaacau

SEQ ID NO: 322982 - RNA, 64 nt, Human
aggagguagcugucuccaaaaaugcuauuguugcaauaucuacauucuauuucauauuaugaaa

SEQ ID NO: 322983 - RNA, 64 nt, Human
gguugugaauaauuuucuggcacugguuguaaguaauaucuauuauuauaaaaauaauauaugc

SEQ ID NO: 322984 - RNA, 64 nt, Human
aagaaaaccuuaugaggcaucacuagccacuguuaauaucuauuuguauucuuauaccuuuuca

SEQ ID NO: 322985 - RNA, 64 nt, Human
ccugaacuuuaaucagucugcacauccuguuucuaauaucuagcaacauuauauucuuucagac

SEQ ID NO: 322986 - RNA, 64 nt, Human
auguuuuugcacuauuuuuuuuaacugaaaaagaaauaucuaagcuguacaugguacacuagaa

SEQ ID NO: 322987 - RNA, 64 nt, Human
cauuuaugcugucuuuggauuauagcauauuuauaauaucuauuuuuuguuauuucaauauacc

SEQ ID NO: 322988 - RNA, 64 nt, Human
gggugggagaauccaaauaguauuuuuguggggaaauaucuaauauaccuucagucaacuuuac

SEQ ID NO: 322989 - RNA, 64 nt, Human
gauuuuucacuugguuagcuaaagaagauguaaaaauaucuaaaauaauguucauggugaaucu

SEQ ID NO: 322990 - RNA, 64 nt, Human
gauugagaacuaugauauuuuucucugauaauuuaauaucuacucuccuacaaaagcucaagcc

SEQ ID NO: 322991 - RNA, 64 nt, Human
cucaaacuccugaccuugugauccacccaccucggccucccaaagugcuggaauuacaggcaug

SEQ ID NO: 322992 - RNA, 64 nt, Human
agccccuucugauuuggcccccugcccgcuuggagccucccagcaccagacagggcagguuugg

SEQ ID NO: 322993 - RNA, 64 nt, Human
gaaagaggggacacgaaggaggagugacugggaagccucccaugccaaggaggugggaggugcc

SEQ ID NO: 322994 - RNA, 64 nt, Human
gaaugaucuuuucaaaucauuagcacaauauuuaaauaucuaaaaauuuaagagauccauacuu

SEQ ID NO: 322995 - RNA, 64 nt, Human
aaaaaaaacuuguuuaaauuuccaucuguuuuguaauaucuagcucuauauguaaaugaugggu

SEQ ID NO: 322996 - RNA, 53 nt, Human
uucuaauaacugcauucugaaaaaauaucuaccccauuuggugaagugaaaaa

SEQ ID NO: 322997 - RNA, 64 nt, Human
uucucauauccauaaaauuggauuacaguauggcaauaucuacagcuucuauucauuaugcaac

SEQ ID NO: 322998 - RNA, 64 nt, Human
ucucuugaugaagaaaugacauauauuaucuuugaauaucuacaaggaaaguuaccaacuuaug

SEQ ID NO: 322999 - RNA, 64 nt, Human
uaucuugucuaagugcuaacacuguuucagugaaaauaucuagccauaagauuaaaaaaauaua

SEQ ID NO: 323000 - RNA, 64 nt, Human
cagugauuuuuucaugguggcuuaggccaaaagaaauaucuaaccauucaauuuauaaauaauu

SEQ ID NO: 323001 - RNA, 64 nt, Human
uccagugacuuacuaugugagaugacuacuaagcaauaucuagcagcguuagcuguccauauag

SEQ ID NO: 323002 - RNA, 64 nt, Human
uuuucccuaggaagucaaaaaugcugugauuuaaaauaucuaauuauauuuuuuucuuucuaug

SEQ ID NO: 323003 - RNA, 64 nt, Human
uaggggaaauggcuguuuuugcuaauuuuuagcuaauaucuagccaggagagcaagcacauagg

SEQ ID NO: 323004 - RNA, 64 nt, Human
uuaauuauuugugaaucaguaaccagaugcagcaaauaucuaggcaauguggacuaccucauuc

SEQ ID NO: 323005 - RNA, 64 nt, Human
uaugacacuucaucuuauauuaaggaagguuuagaauaucuaauacgacuugaauucauuuguu

SEQ ID NO: 323006 - RNA, 64 nt, Human
agaaccauuguuccaagugaaggcacaaacucucaauaucuaaaauaagugcaaggaagcaguc

SEQ ID NO: 323007 - RNA, 64 nt, Human
aucaaaugguaguuagcucagacagugcauuuucaauaucuaacuuaacaugccaccccuuagc

SEQ ID NO: 323008 - RNA, 64 nt, Human
ggagcuuuauguuuagaaacuguacagauuguugaauaucuauauacauaaaaauauauuauau

SEQ ID NO: 323009 - RNA, 64 nt, Human
uacaggcuggucucaaacuccuagguucacuuuggccucccaaagugcugggauuacagacaug

SEQ ID NO: 323010 - RNA, 64 nt, Human
cguccucucuggccgccauccggcucgcacaggggccucccagcgccucaggccccgcguuugu

SEQ ID NO: 323011 - RNA, 64 nt, Human
ugcaguggccugaucucggcucacugcaaccucugccucccagguucaagcgauucuucugccu

SEQ ID NO: 323012 - RNA, 64 nt, Human
ucugugugaauuuucuuguagcgugcuucaugaaaauaucuacuuauccagguuugcaaaugua

SEQ ID NO: 323013 - RNA, 64 nt, Human
cuguuguugugauaaauaugagcaaaugaaguguaauaucuauagaaaaguagagugaggguga

SEQ ID NO: 323014 - RNA, 64 nt, Human
aaauuuauuuuuuuaaugucauauucaucugguaaauaucuacuguuugccaggcauuuaagaa

SEQ ID NO: 323015 - RNA, 64 nt, Human
uguuuguuuuuuuauuuuggaugacaaugaauugaauaucuaauaaggagauuuaagauaagac

SEQ ID NO: 323016 - RNA, 64 nt, Human
ucagugggugugacauauuucaugggaauauucaaauaucuaugguaauauuuugacccuuuau

SEQ ID NO: 323017 - RNA, 64 nt, Human
aaaugaguagauaugauuagauccuuuaccuuuuaauaucuaguuuuuccaaaaaugauaguaa

SEQ ID NO: 323018 - RNA, 64 nt, Human
gcaauuauuuaugagaaaauaaugauaaauguaaaauaucuaaagcaugaaucuaagagcacgc

SEQ ID NO: 323019 - RNA, 64 nt, Human
auguuccaauaauguuuuguacaucauugucaucaauaucuacagaagcucuuugacgguuuga

SEQ ID NO: 323020 - RNA, 64 nt, Human
cuuucuuaaaaacaugaacuaugccagaauaaaaaauaucuauguuuguauauuuuuauaacuc

SEQ ID NO: 323021 - RNA, 64 nt, Human
aaaaacugcaaucaugaauguuugugauauuuuaaauaucuacuacagcacauucagccaauaa

SEQ ID NO: 323022 - RNA, 64 nt, Human
auucccaaggaauauauuccaaaacauuuuugugaauaucuaaguuugugaaacuacuagggca

SEQ ID NO: 323023 - RNA, 64 nt, Human
aagaacaccuaucucuccaacucucugauccugaaauaucuauuccaaaggaaaaucauauuuu

SEQ ID NO: 323024 - RNA, 64 nt, Human
gcacuacucugaggccuguauggccccuuucaucaauaucuauucaaauauacaggugcauaua

SEQ ID NO: 323025 - RNA, 64 nt, Human
cauucgaauaggcagucguucaaagacucuuuggaauaucuaugaaugaauauccucuauucuu

SEQ ID NO: 323026 - RNA, 64 nt, Human
ccuugacauucacccaccucccuuauguaguugaaauaucuagcuaacuuggucuuuuucguug

SEQ ID NO: 323027 - RNA, 64 nt, Human
auccccagucuaccuccuuccuucuacccucacugccucccagucaggagagugagcucucaga

SEQ ID NO: 323028 - RNA, 64 nt, Human
ugaacuccugaccucaggugaucugcccgucucggccucccaaagugcugggauuaccggcaug

SEQ ID NO: 323029 - RNA, 64 nt, Human
guaaaauggugcgaucucggcucacugcaccuccgccucccagguucaagcgauuuuccugccu

SEQ ID NO: 323030 - RNA, 64 nt, Human
gcugauuucuacauauuucuuccauguaucugagaauaucuaacuagaaggaugagaaggaaau

SEQ ID NO: 323031 - RNA, 64 nt, Human
cuuuuuaaaaacuuugguuugguuaauacacagaaauaucuagaaauguucugggacuaguuga

SEQ ID NO: 323032 - RNA, 64 nt, Human
uuaguuauauaagaaaaaagggaguuaugcaauuaauaucuaucagcuugggaaacgcuuuggu

SEQ ID NO: 323033 - RNA, 64 nt, Human
aagucuauauaaauaucagagaauucacaguagaaauaucuaagguacugacacuucagacauu

SEQ ID NO: 323034 - RNA, 64 nt, Human
uuaauuuugaaaacugaagcuaagagagauaauaaauaucuagagauaacuauuaacaguauuc

SEQ ID NO: 323035 - RNA, 64 nt, Human
aaaccaaacuuuuauucugagaaacuggcuguacaauaucuaaaaagaaagugacaugaaggaa

SEQ ID NO: 323036 - RNA, 64 nt, Human
uuauguugauaaaccaaaaacauuugauuaauaaaauaucuauuugaauaaauuaugagcuauc

SEQ ID NO: 323037 - RNA, 64 nt, Human
gaaaucuguaaacauaaaauuccucucauuuucaaauaucuaaagccaguuuuauguuccuaaa

SEQ ID NO: 323038 - RNA, 64 nt, Human
aacuggccauguagucuuaacagucuuuuguacaaauaucuacaaagcagauaauaucccuauc

SEQ ID NO: 323039 - RNA, 64 nt, Human
ccacucccugcccugcuuuaauaaacagcaaaccaauaucuaggaagaaugacugagggauagu

SEQ ID NO: 323040 - RNA, 64 nt, Human
uuuuauuuuauguagcuugacaauucagugacuuaauaucuauuccauuuguauuguacauaaa

SEQ ID NO: 323041 - RNA, 64 nt, Human
guacacauauuuauauguauuuuuaaagauaaagaauaucuaaaauguguuuuuuucuuagcuu

SEQ ID NO: 323042 - RNA, 64 nt, Human
aaugcagugaaugggauuggaaagcaucuacuuaaauaucuauuggguuccccccuccccccac

SEQ ID NO: 323043 - RNA, 64 nt, Human
aaaaguaaauauauauucuaucguauucauaaacaauaucuaucaaauggguuaccuccaaaua

SEQ ID NO: 323044 - RNA, 64 nt, Human
aaauaucagaagaaaaugucugucuuucuguccaaauaucuacuugacuuggggguaagucaaa

SEQ ID NO: 323045 - RNA, 64 nt, Human
cgaacuccugaccucaggugauccgcccgccucggccucccaaagugcugggauuacaggcgug

SEQ ID NO: 323046 - RNA, 64 nt, Human
ccaccucccggguucaagugauucuccugccucagccucccaaguagcugggauuacaggcacc

SEQ ID NO: 323047 - RNA, 64 nt, Human
ugaacuccuggccucaagcaauccucucuccucagccucccaaagugcugggauuacaagugug

SEQ ID NO: 323048 - RNA, 64 nt, Human
gugagaaccacugauuuuuuccacugaccuacugaauaucuagcauccuuagauuggcucaacu

SEQ ID NO: 323049 - RNA, 64 nt, Human
uuauuuuuccacauugaaacacuuugcagacacaaauaucuaugaaaagaugcuuugucagcca

SEQ ID NO: 323050 - RNA, 64 nt, Human
aaaacuuuuagaaauuaagguguacuugaaaacgaauaucuaucauaugaccccugcacucccu

SEQ ID NO: 323051 - RNA, 64 nt, Human
uuuuguucuugacuuuugaaugcuuguaauuaaaaauaucuauuuuuuuccucugaaguaaguu

SEQ ID NO: 323052 - RNA, 64 nt, Human
aauaccugugaaaacugacuaaucagcugccaauaauaucuaauauuuuucaucaugcacgaau

SEQ ID NO: 323053 - RNA, 64 nt, Human
gucuuuucuuuuguacuccuaucauguauucauuaauaucuaccagucccuuuucauucuaaga

SEQ ID NO: 323054 - RNA, 64 nt, Human
aauacacugaaucuuccuuuagagguaagacuuuaauaucuauacuguaaauauuugguuuauu

SEQ ID NO: 323055 - RNA, 64 nt, Human
uucuguauuauaaauugcaccuuaauagaccaaaaauaucuauacagcacugauuuccuugaau

SEQ ID NO: 323056 - RNA, 64 nt, Human
uucuccuccucuuaggucauuuucagcaaacuugaauaucuagaccucucuuccaaugaaaccc

SEQ ID NO: 323057 - RNA, 64 nt, Human
augccuggcccuugauuuuucuuuuuaagaaaaaaauaucuaggaguuucuuagacccuaugua

SEQ ID NO: 323058 - RNA, 64 nt, Human
ggugauauaauguggugcaguuacuuauauauuaaauaucuauuguauccauagaauaggcagc

SEQ ID NO: 323059 - RNA, 64 nt, Human
cauagucccaguuuggagggauuuugugaugcagaauaucuaagucauagaaauagaagacagg

SEQ ID NO: 323060 - RNA, 64 nt, Human
acugaaauagucaauuagcaauuuuguguuucuaaauaucuaugguccccugaaauuuugacuu

SEQ ID NO: 323061 - RNA, 64 nt, Human
accaugaaaagaaacuugugcuucaccgaagaaaaauaucuaaacaucgaaaaacuuaaauauu

SEQ ID NO: 323062 - RNA, 64 nt, Human
uguaguaagaggcccauuucucaacugucuuuuaaauaucuaaagguaguuccuguaacaacua

SEQ ID NO: 323063 - RNA, 64 nt, Human
uaggcagcuucggggcaaggauucaacuccccaggccucccacgguuggugcuggcuccuuggc

SEQ ID NO: 323064 - RNA, 64 nt, Human
ccagcuccugagcucaagugguccuccugcuucagccucccaaagcagcugggacuacaggcau

SEQ ID NO: 323065 - RNA, 64 nt, Human
gcaucucccucuccucccaaucuccauaggcugggccucccaggcgaucugcauacuuuaagga

SEQ ID NO: 323066 - RNA, 64 nt, Human
cuugccugacaguauuuuugaauuauuuauauaaaauaucuaucuuuucaucaugucuauaguu

SEQ ID NO: 323067 - RNA, 64 nt, Human
uuuugaaagaauaauucuccagaaguuaacaucuaauaucuaguaucaccaaacaguaucgcug

SEQ ID NO: 323068 - RNA, 64 nt, Human
uauuuuaaucaaccauacuauucuuauggaaaaaaauaucuauuuuggcagguuucugugccuu

SEQ ID NO: 323069 - RNA, 64 nt, Human
ccccuucugugguaugcccuugcccuguucuauaaauaucuauaaauacucauauauauacaca

SEQ ID NO: 323070 - RNA, 64 nt, Human
ucuuuguuagauauuaggucccaucaauucuuagaauaucuaaacaucuuuguugauguuuaga

SEQ ID NO: 323071 - RNA, 64 nt, Human
acugaugcuucuaucaggucccaucaauucuuagaauaucuaagaaucuuuguuagauauuagg

SEQ ID NO: 323072 - RNA, 64 nt, Human
uuguaauguguugcuucuacauaaguucucuggaaauaucuacaacuaauaggacacauguaaa

SEQ ID NO: 323073 - RNA, 64 nt, Human
ucuauuaauaaugguaguauuauauauacaagcaaauaucuauucucaagugguaaguccacug

SEQ ID NO: 323074 - RNA, 64 nt, Human
ugcaguauccuugaggaauauagugggucaguuaaauaucuagagacauacaaacaucugcuaa

SEQ ID NO: 323075 - RNA, 64 nt, Human
gccuugcuuucugcaucuguaaaguggaaaugauaauaucuaccuugugugauuccuggaagaa

SEQ ID NO: 323076 - RNA, 64 nt, Human
uuuuguuacuauuauuccuuugaaaaaaagacaaaauaucuaaaaaauguuuauaguguucaug

SEQ ID NO: 323077 - RNA, 64 nt, Human
ucuaaugaucuugggcagauacugucaaacuuacaauaucuauauagauguaggucuuuuuaaa

SEQ ID NO: 323078 - RNA, 64 nt, Human
uuuguaguggagguuuuguaaaugaaacaguuguaauaucuaaggucaggcaccuaguaacagg

SEQ ID NO: 323079 - RNA, 64 nt, Human
ccuggacaacauaaugagacccucgucucuacaaaauaucuaaaaauuagcugggcacaguggc

SEQ ID NO: 323080 - RNA, 64 nt, Human
auauuuuuauugagaaauagcauuuuacuuuguuaauaucuaguuuaguucauugucaagacug

SEQ ID NO: 323081 - RNA, 64 nt, Human
ucccaccccgcugccugggcccugugguugcugggccucccaccucaaggaggggaagguugua

SEQ ID NO: 323082 - RNA, 64 nt, Human
ucgggaucggguccccagagccaccaucuccugagccucccaccccgcugccugggcccugugg

SEQ ID NO: 323083 - RNA, 64 nt, Human
gauaccaagccucugaaauccagcaaggaggucugccucccaccagacccucuccaguguacuu

SEQ ID NO: 323084 - RNA, 64 nt, Human
cuugauugacuugcccaaguggcaauagaguucuaauaucuauaauaaagggagauuugcuauu

SEQ ID NO: 323085 - RNA, 64 nt, Human
uuugagaucauguuuguauaagcacuccuugaagaauaucuaagcuuuuucugagaugggcuuu

SEQ ID NO: 323086 - RNA, 64 nt, Human
uguguuacagacugcagaggaugugcagguugagaauaucuacaaaucccuuaccaauuuguca

SEQ ID NO: 323087 - RNA, 64 nt, Human
guuuucaacccaaaaauaagaaaaaauagcucuaaauaucuaaaaggaaaagguuauuuuauga

SEQ ID NO: 323088 - RNA, 64 nt, Human
auaucaggugaucuuacuauggagaagaaaaaccaauaucuaguuacagaugaaaaaauguuua

SEQ ID NO: 323089 - RNA, 64 nt, Human
uuaggguaagucauggguugaggugucagauaguaauaucuauuuguuuuguacauguauauau

SEQ ID NO: 323090 - RNA, 64 nt, Human
gcaaguuucaggauguuccccacugagcuggaggaauaucuacagcagugaugcuugaaauuuu

SEQ ID NO: 323091 - RNA, 64 nt, Human
ucugcugcaugugagcuuguggguuagaggaacaaauaucuagacauucaaucuucacucuuuc

SEQ ID NO: 323092 - RNA, 64 nt, Human
gguauagagaaccauccagauguucacuuuugaaaauaucuaaugaugcaaaguuuuauucuug

SEQ ID NO: 323093 - RNA, 64 nt, Human
ccuuuuuuuguuucuccugacauccagacuuggaaauaucuaacuacuugcaaaacuaaaaaug

SEQ ID NO: 323094 - RNA, 64 nt, Human
cguugcacgggcgccuuaaguuauuggacuaucuaauaucuauguauuuauuucgcugguucuu

SEQ ID NO: 323095 - RNA, 64 nt, Human
uaacaugcaaacaaacaagccacgggaaauauguaauaucuacuagugaguguuguuagagagg

SEQ ID NO: 323096 - RNA, 64 nt, Human
cauuaaucugugauuccaccucuugcaccaaaucaauaucuauuuguugagcacuuauugauua

SEQ ID NO: 323097 - RNA, 64 nt, Human
uugugaauauuuuaagaacuguagagcugcuuucaauaucuagaaauuuuuaauugaguguaaa

SEQ ID NO: 323098 - RNA, 64 nt, Human
acuacaaaauaauaaccaccucaacugauagcaaaauaucuaauuagaaaucaacaguuugaug

SEQ ID NO: 323099 - RNA, 64 nt, Human
ccucugccccacuccaggaauggagcucuucccagccucccaucugacuacagccagggugggg

SEQ ID NO: 323100 - RNA, 64 nt, Human
uuguccugcuggaauuugcugugcagagccauaagccucccauuuuguuagcgucagcuaggcc

SEQ ID NO: 323101 - RNA, 64 nt, Human
ugaacuccuggacucaagcaaccuacccagcguggccucccaaagugcugggauuacagacacg

SEQ ID NO: 323102 - RNA, 64 nt, Human
auguauaauaacucaguuuuucuugguuuauggaaauaucuauauuaaugugaaaauaauuaau

SEQ ID NO: 323103 - RNA, 64 nt, Human
ugccccuuccccacacuaauaauuuauauauauaaauaucuauaugacgcucuuaaaaaaacau

SEQ ID NO: 323104 - RNA, 64 nt, Human
accuuaaaaauauauuaaacucauuauaguaguuaauaucuaaguaaaauaugaugaaauuuaa

SEQ ID NO: 323105 - RNA, 64 nt, Human
ggauaugccuguuuuaaauaacauacauauuaacaauaucuaucaggaaaacccucaagacagc

SEQ ID NO: 323106 - RNA, 64 nt, Human
cacaccuauacccccgaucucagagggggccaccaauaucuagcuauggaucguguguuuuguu

SEQ ID NO: 323107 - RNA, 64 nt, Human
ugcucucucuaagcuuucucuuccucccuuagggaauaucuagggucuguaaccguuuugguuu

SEQ ID NO: 323108 - RNA, 64 nt, Human
auguuuacaccucagggaaagucuuguguucagcaauaucuaaagauaauguuacuaugacaac

SEQ ID NO: 323109 - RNA, 64 nt, Human
uuuugguuuagacuucauuuauauuuuccuuacuaauaucuaauauuuaaugaauaaugaucaa

SEQ ID NO: 323110 - RNA, 64 nt, Human
uuuucguuuagaaucagaauaaaguuguauuucaaauaucuaagcaagugaacucaucccuugu

SEQ ID NO: 323111 - RNA, 64 nt, Human
ccaaauggaaaguaacucauuuguuaaaauuaucaauaucuaauauauaugaauaaaguguaag

SEQ ID NO: 323112 - RNA, 64 nt, Human
uauuuauaauagcaacuuuuguguaaugaaaaugaauaucuauuaauauauguauuauuuauaa

SEQ ID NO: 323113 - RNA, 64 nt, Human
aaggaaagugauccaaaauuugaaauauuaaaauaauaucuaauaaaaagucacaaaguuaucu

SEQ ID NO: 323114 - RNA, 64 nt, Human
uuaugagaucauccucauguuaaaccuuggauuaaauaucuaaccuguaauuauuuuuuuucac

SEQ ID NO: 323115 - RNA, 64 nt, Human
uuaaaacaaacaaacaugaguagucugcauaucgaauaucuagagcucuaaacccccaauacuu

SEQ ID NO: 323116 - RNA, 64 nt, Human
acucuggcuuaccuguuaauggaagaauuugcauaauaucuacuuagaaagguaaguuaaaagu

SEQ ID NO: 323117 - RNA, 64 nt, Human
ugaccucccgggcccagguaguccucccaccucagccucccauguagcaggaaccacaggcagg

SEQ ID NO: 323118 - RNA, 64 nt, Human
cucaaacuccugaccucgugauccacccgccucggccucccaaagcgcugggauuacaggcgug

SEQ ID NO: 323119 - RNA, 64 nt, Human
ugcaguggcgugaucuuggcucacugcaaccucugccucccagcuucaagcgauucuccuguau

SEQ ID NO: 323120 - RNA, 64 nt, Human
accacgaaaagaaauuugugcuucaccgaagaaaaauaucuaaacaucgagaaacuaugggaaa

SEQ ID NO: 323121 - RNA, 64 nt, Human
guauucaguuuacaugcguuauugguuuauaauuaauaucuaaugaaaauacauguuguuauau

SEQ ID NO: 323122 - RNA, 64 nt, Human
uauaaaguacuugggauuuugcauuauuuuucuuaauaucuauuuacuaaguauguaauuuaau

SEQ ID NO: 323123 - RNA, 64 nt, Human
cuaaugaggagagaaaauauauguauuuuuauauaauaucuaaaguuauauuucagauguaaug

SEQ ID NO: 323124 - RNA, 64 nt, Human
ccaaguaucuuuccagcauguuucucccauuuagaauaucuagcauguaaggccuuucaauauu

SEQ ID NO: 323125 - RNA, 64 nt, Human
ccaugauaaaaggagaagacaacagugagcuuagaauaucuauaaagcaaaaaauguagucucu

SEQ ID NO: 323126 - RNA, 64 nt, Human
aaaaaguaaucaguuaaaugauuacuugcuuauaaauaucuaaacuaguccaguuaugaaauca

SEQ ID NO: 323127 - RNA, 64 nt, Human
auuaaauaguuaaaauaauguagugcaacuuaaaaauaucuauggcuuuguuuuuguuuuucuu

SEQ ID NO: 323128 - RNA, 64 nt, Human
uagcaauuuuugacaaguaagauugcaaaauagaaauaucuauaaagauuccacaguuugacau

SEQ ID NO: 323129 - RNA, 64 nt, Human
uuugugagggguguuugaugacuuugacagaauaaauaucuaaacaauuauccuuguuacugcu

SEQ ID NO: 323130 - RNA, 64 nt, Human
cagcaauucacgauuuauauuuuuugaauuaccaaauaucuagauuuaccagcucuauuuuugu

SEQ ID NO: 323131 - RNA, 64 nt, Human
gcguguuuuguuuuugguuucauuuuaaaacaccaauaucuaauaccacagugggaaaaggaaa

SEQ ID NO: 323132 - RNA, 64 nt, Human
acacacagaagggccuuuaaaaaaguagauauuuaauaucuaagcaggggaggggacaggacag

SEQ ID NO: 323133 - RNA, 64 nt, Human
guaguauuuucugauuuuuuuuuccaugagggaaaauaucuaauuuuuauaagacuaaguugag

SEQ ID NO: 323134 - RNA, 64 nt, Human
augccuuuaagagauauaauuaacgugcaguuuuaauaucuacuaaauuaagaaugacuucauu

SEQ ID NO: 323135 - RNA, 64 nt, Human
cgaacuccuaaccucaagugauccacccgccucagccucccaaagugcugggauuacaggugug

SEQ ID NO: 323136 - RNA, 64 nt, Human
ugcuguggugugaucuuagcucacugcaaccuccgccucccagguucaagcaauuuuccugccu

SEQ ID NO: 323137 - RNA, 64 nt, Human
ugaauuccugaccucaggugauccacccaccuuggccucccaaagugcuaguauuaugggcgug

SEQ ID NO: 323138 - RNA, 64 nt, Human
uaguauuuauauuacaaaguuggcauacagggucaauaucuaauuuacuguuguguuuuucuua

SEQ ID NO: 323139 - RNA, 64 nt, Human
aaugauuuuuaaaguuguuggagacgccaauagcaauaucuaggaaauuugcauugagaccauu

SEQ ID NO: 323140 - RNA, 64 nt, Human
acucaaauggcaugugucuccaagacagcuuaugaauaucuaaaaggccagcuaccugccuagg

SEQ ID NO: 323141 - RNA, 64 nt, Human
aguagaaugauuuucaaguuugaauuucuguacaaauaucuaaauaagagaugugcagagagca

SEQ ID NO: 323142 - RNA, 64 nt, Human
cucggccugggauuucagagcuggaaauauagaaaauaucuagcccaaagccuucauuuuaaca

SEQ ID NO: 323143 - RNA, 64 nt, Human
aaaaguuucuuuccuaaaccauucaccaagagccaauaucuaggcauuuucuugguagcacaaa

SEQ ID NO: 323144 - RNA, 64 nt, Human
uuugaugcagaugagagagcacgagcuaaaguaaaauaucuaacaggugaaaaaggugugagga

SEQ ID NO: 323145 - RNA, 64 nt, Human
ugacucaucaguaaaaacugucuacagagaaguaaauaucuauaucuauauauauaaauauacu

SEQ ID NO: 323146 - RNA, 64 nt, Human
guucaguuuccacaguuugaacuggguauagauuaauaucuaaaaccaaaaaaugaacaugugu

SEQ ID NO: 323147 - RNA, 64 nt, Human
gaugcucauucugauacaacuauuuuucgugucaaauaucuacugugcccaaauguacucaauu

SEQ ID NO: 323148 - RNA, 64 nt, Human
uugaggccauguguaaaguuuaaccauauuguaaaauaucuauuccguauuagaaauagcuagu

SEQ ID NO: 323149 - RNA, 64 nt, Human
ggaaccuuggguucuuagguuuggauucuuuaauaauaucuaaaaagcuaaauuuuaaauacca

SEQ ID NO: 323150 - RNA, 64 nt, Human
auuuuguuuuuugcuguuuccagauguaucuauaaauaucuauacauuauaugugugugugugu

SEQ ID NO: 323151 - RNA, 64 nt, Human
augccaagucacugggaccaauuuucuguuuuauaauaucuaaguuuagaacagaauauauacc

SEQ ID NO: 323152 - RNA, 64 nt, Human
ucauaggcaauuagaacuggaagaaacuuccaaaaauaucuagguuuguccucauuuuacaaau

SEQ ID NO: 323153 - RNA, 64 nt, Human
cugccucccagcuucaagcgauucuccuguaucagccucccaaguagcugggauuauaggcaug

SEQ ID NO: 323154 - RNA, 64 nt, Human
cgaccucccaggcucaagcuguccucccaccucagccucccaaguagcugagacuacaggugug

SEQ ID NO: 323155 - RNA, 64 nt, Human
gccccacaggcuuuaagguugauaucaaucaccagccucccacuguggugccugggagugaccu

SEQ ID NO: 323156 - RNA, 64 nt, Human
gggaaugcuacauacccauuucugguauuuaaaaaauaucuaggaggagcuaaaugacaaaaca

SEQ ID NO: 323157 - RNA, 64 nt, Human
auuuguguucugauaucugaggccaguaacuauuaauaucuaguucucagagcauuuggaaagg

SEQ ID NO: 323158 - RNA, 64 nt, Human
acccagccaucuacaagaucugaauucuacugaaaauaucuagaaauguggaagagaccuacuu

SEQ ID NO: 323159 - RNA, 64 nt, Human
uacuugcacauucuuaaccuguauuugaacacaaaauaucuauacuucaugcuccagcccaagc

SEQ ID NO: 323160 - RNA, 64 nt, Human
acauauuagggaagaggaauccauaaguagcugaaauaucuauucuguauuauuguguuaacau

SEQ ID NO: 323161 - RNA, 64 nt, Human
gauugggaagaaguucaaagagcugaaccucaccaauaucuacgcucccccauugccuucacug

SEQ ID NO: 323162 - RNA, 64 nt, Human
uaaaaauauuagacagauauaaaaguaucuauauaauaucuauaaacuguuaaugcugagguau

SEQ ID NO: 323163 - RNA, 64 nt, Human
aaacaugcagucucagugugcucucgcauguaugaauaucuaguccuuucugugguucucagcc

SEQ ID NO: 323164 - RNA, 64 nt, Human
gcaguagcuuauuuccaagccuugcaaaguauauaauaucuaagaggaaagguuuugucauccc

SEQ ID NO: 323165 - RNA, 64 nt, Human
gucaccuaccacauccagccuacacguauuuguuaauaucuaacauaggacuaaccagccacug

SEQ ID NO: 323166 - RNA, 64 nt, Human; identical to SEQ ID NO: 323157

SEQ ID NO: 323167 - RNA, 64 nt, Human
ucagaugagaagacaaauugguuaugaauuuugaaauaucuauuauauguaaaauguggauaug

SEQ ID NO: 323168 - RNA, 64 nt, Human; identical to SEQ ID NO: 323157

SEQ ID NO: 323169 - RNA, 64 nt, Human
uuuucuauuagauguaaauauguuauuuaagaaaaauaucuaaauauauauauuucaacucgaa

SEQ ID NO: 323170 - RNA, 64 nt, Human
gaaucuuguauuuauuuuucuguauaaugaaauuaauaucuagacuugaccacuaucugcccac

SEQ ID NO: 323171 - RNA, 64 nt, Human
ugcaguggcgcauucuaggcucacugcaacuucugccucccaugcuuacgugauccucucaccu

SEQ ID NO: 323172 - RNA, 64 nt, Human
ugaacuacugagcucaagcaaucugccugcuucagccucccaaaguacugggauuuaggcauga

SEQ ID NO: 323173 - RNA, 64 nt, Human
ccgccuccuggguucaagggauucuccugccucagccucccaaguagcugggacuacaggcaca

SEQ ID NO: 323174 - RNA, 64 nt, Human
ugauuucuuuucccugcacacaucuuuccggugcaauaucuaucaauugugaaucuggcugcug

SEQ ID NO: 323175 - RNA, 64 nt, Human
ggcaucucauggugguuuuaauuugcauuuccauaauaucuaauuagguugagcuuuuuuuaug

SEQ ID NO: 323176 - RNA, 64 nt, Human
aaauuuauuuuuauaaaugaauuuuaaaagaaaaaauaucuacuucuuuuaaaguuagaagaaa

SEQ ID NO: 323177 - RNA, 64 nt, Human
cuugauauuuucacaaauuuuaaacaaaaaauuaaauaucuauaaagugaauguucaacaacaa

SEQ ID NO: 323178 - RNA, 64 nt, Human
aguuaccggcaagcauauaaaaugcuacuuggauaauaucuacaugaauauugcaugcuacaug

SEQ ID NO: 323179 - RNA, 64 nt, Human
accucugccaaaaaaaaaaaaaauaggguauccaaauaucuagauucugaucccuuuugagguc

SEQ ID NO: 323180 - RNA, 64 nt, Human
acauguuuuaaagagguuauauaucauuaauaaaaauaucuagcuggucugaagauccugaguu

SEQ ID NO: 323181 - RNA, 64 nt, Human
auuguacaaauauaaagaccaugaaaaagccauuaauaucuauucacaucuuaccacuggagag

SEQ ID NO: 323182 - RNA, 64 nt, Human
ucuauguaaauaucagggaauaauucacaguagaaauaucuagggcauucaagcuuuagacauu

SEQ ID NO: 323183 - RNA, 64 nt, Human
uugugacaggagaccauguggccugcagagcccaaauaucuacugucugauccuacacagaaaa

SEQ ID NO: 323184 - RNA, 64 nt, Human
augaaaucucaaugaaaaacacuuauuuugggggaauaucuauuuuaacugcuucagacaccua

SEQ ID NO: 323185 - RNA, 64 nt, Human
uucaguacuguuaagucauucacauugugcaaugaauaucuagaagucuuuucaacuuaugaaa

SEQ ID NO: 323186 - RNA, 64 nt, Human
aagucuauguaaauaucagagaauucacaguggaaauaucuaagguagggccgggcaugguggc

SEQ ID NO: 323187 - RNA, 64 nt, Human
ugacucggccuuaaacguuugugccauaauggaaaauaucuaucuaucuguucucaaauccugu

SEQ ID NO: 323188 - RNA, 64 nt, Human
uuuuuuuccuuccagcuuaaacaaauuaaaacuaaauaucuaaaccuuguauacagacauuaaa

SEQ ID NO: 323189 - RNA, 64 nt, Human
cgaaugccuggccucaggugauccaccugccuuggccucccaaagugcugggauuacaggcaug

SEQ ID NO: 323190 - RNA, 64 nt, Human
uggccaccucccaaccugaugaccucucuggcuggccucccaggaggagggacacuccagcccc

SEQ ID NO: 323191 - RNA, 64 nt, Human
gugcuguaauuuggcugcaggagcuaggcugaaugccucccagggaugagaaacauacucuccc

SEQ ID NO: 323192 - RNA, 64 nt, Human
cgaauuugcuagugaucugguuuacugccuuaguaauaucuaguuccuaauaugccuaugccuu

SEQ ID NO: 323193 - RNA, 64 nt, Human
uauauaaaaauacugcaaauagaccgcagacauaaauaucuaccaaaugcuaucuuaaauuuug

SEQ ID NO: 323194 - RNA, 64 nt, Human
auaccuaauaagauugagugaaaaauuugagucaaauaucuagggcauucacagaguagcugug

SEQ ID NO: 323195 - RNA, 64 nt, Human
aggaagguauugagaagcaagaaacuggaggcccaauaucuaaccugcaaaucguuuuugaguu

SEQ ID NO: 323196 - RNA, 64 nt, Human
cauuugagcaggacuggauuuuaagccgaagggcaauaucuacguguuuuuccccccuccuucu

SEQ ID NO: 323197 - RNA, 64 nt, Human
uccuucuugaaguugucaauuccucuuauucuuaaauaucuaaagggaaaggaaaccaacuuua

SEQ ID NO: 323198 - RNA, 64 nt, Human
uuuuagucgagauauaaauauuugaggggagagaaauaucuacagguauauauggaaacaaaua

SEQ ID NO: 323199 - RNA, 64 nt, Human
ucugcuauuuugcaucccaauauaggaguagaauaauaucuacuaucagcugauuacuagacac

SEQ ID NO: 323200 - RNA, 64 nt, Human
uauauaaugcuugcaccucagguaaaaaucuguaaauaucuaaguuguaaaccugcuuguucaa

SEQ ID NO: 323201 - RNA, 64 nt, Human
cuacaauauaaaugggaauuaggauaauauagucaauaucuaauaaagucaacccuguacuaag

SEQ ID NO: 323202 - RNA, 64 nt, Human
auggacauaguaaaaugacuugaaacauuucuauaauaucuaccugcaaugguuuacaggcaga

SEQ ID NO: 323203 - RNA, 64 nt, Human
caguucugaaggaaguuagggaggaagccaagaaaauaucuauugugauuaaagguagcaggaa

SEQ ID NO: 323204 - RNA, 64 nt, Human
aacaguaacacugauuauccaacauauauuuuggaauaucuacuaugugcaaggaauuuuucuu

SEQ ID NO: 323205 - RNA, 64 nt, Human
uugcagucuuccauuacauggaaauagcauaucuaauaucuagguuacuugagagaccagcuaa

SEQ ID NO: 323206 - RNA, 64 nt, Human
uuacaugaccagaaaacaaaucuucaagguguaaaauaucuaccugcccucucucaguuauuca

SEQ ID NO: 323207 - RNA, 64 nt, Human
cucgaacuccugaccucgugauccacccaccuuggccucccaaagugcugggauuacaggcaug

SEQ ID NO: 323208 - RNA, 64 nt, Human
ugcaguggcacaaucuuggcucagagcaaccucugccucccaggcucaagcaauccucccacuu

SEQ ID NO: 323209 - RNA, 64 nt, Human
ugaacaccggggcucaaggaaucugcccaucuucgccucccaaaguucugagauagcaggugug

SEQ ID NO: 323210 - RNA, 64 nt, Human
aagggcugccuuauuuuagagcacagauuuucugaauaucuauuuugacagguucgauccucuc

SEQ ID NO: 323211 - RNA, 64 nt, Human
caucaucaccgauucuuccuugccacaaucacuaaauaucuagugcuaaaccuaucuguauugg

SEQ ID NO: 323212 - RNA, 64 nt, Human
uuaaagacaauguuaaacuuauaacccacuuuaaaauaucuacauuaauauacuugaaugaaaa

SEQ ID NO: 323213 - RNA, 64 nt, Human
cuguaaagcaaguuucccaaggggaagaagcccuaauaucuauaauuugaacuguacuggaccc

SEQ ID NO: 323214 - RNA, 64 nt, Human
gaaaaagaaaaaagaagcccaaacuagugagaguaauaucuaauuaucucauuuuuuguagguc

SEQ ID NO: 323215 - RNA, 64 nt, Human
gacuguggccuguugcucaugacuuucuuuuguaaauaucuauaaauggagacagauggagaca

SEQ ID NO: 323216 - RNA, 64 nt, Human
caucuuagcaguugaccuaacacaucuucuuuucaauaucuaagaacuuuugccacugugacua

SEQ ID NO: 323217 - RNA, 64 nt, Human
uuaggaaaaaaaaaaucaugcuauuaauuaaucaaauaucuauaaaugcauaaaguacaguauu

SEQ ID NO: 323218 - RNA, 64 nt, Human
gaauuuuaaauguucauguuacauaccaaauuauaauaucuaauggagcaauuugucuuuugcu

SEQ ID NO: 323219 - RNA, 64 nt, Human
aauucagggaagauuugggcauauuaaaugaaagaauaucuaauugggggaggugugaagggaa

SEQ ID NO: 323220 - RNA, 64 nt, Human
aaauagcaccuaucuaugcauuuaaaaaugcauuaauaucuaacauaaaauuguuaauuuauac

SEQ ID NO: 323221 - RNA, 64 nt, Human
cacuccugauaaauaacaaauuuggagaaauaaaaauaucuaaaauaaauuuugucugcaguau

SEQ ID NO: 323222 - RNA, 64 nt, Human
uuuuuuaagaaaggaauagcgauagauuuauauaaauaucuaaaugucucaguagaggaguaga

SEQ ID NO: 323223 - RNA, 64 nt, Human
ucuuugcuguuuauauauauauauauuauauauaaauaucuauuuaucugucugagcccugccc

SEQ ID NO: 323224 - RNA, 64 nt, Human
gucuugggaucuuaagaucaaugaaccuuuccccaauaucuagucuuugcaaauucuaguagaa

SEQ ID NO: 323225 - RNA, 64 nt, Human
gagacuccuggaaagacucaauagugagaauauagccucccaccccauuaacuucgcucccaug

SEQ ID NO: 323226 - RNA, 64 nt, Human
cgaacuccugggcucaagcgguccaccugccuccgccucccaaagugcugggauugcaggcaug

SEQ ID NO: 323227 - RNA, 64 nt, Human
uggaaaaucuuggaauaaguauaauuaucauccagccucccagaagaauacucaacaacccuug

SEQ ID NO: 323228 - RNA, 64 nt, Human
gucuaauguucugacucucuccuggugcucaauaaauaucuaaucauaacagcaacuucaguug

SEQ ID NO: 323229 - RNA, 64 nt, Human
uauacauagacacacaaacacacacacacacauuaauaucuaucuugggggaggccucgugcca

SEQ ID NO: 323230 - RNA, 64 nt, Human
aaauaagaauagaacaacauauacaacaccaaaaaauaucuaguaauauauuuaaagggaaauu

SEQ ID NO: 323231 - RNA, 64 nt, Human
ucagucucgggcucuuggaauaccuaauuuuaauaauaucuaugaaaucaagggaaacuuucca

SEQ ID NO: 323232 - RNA, 64 nt, Human
caagcaggcgaaucuuaaacaggcaugugccaccaauaucuacuguacauucuacaagcauugc

SEQ ID NO: 323233 - RNA, 64 nt, Human
gaaaucaaauacuaauuuaaacucuggagcccauaauaucuacauaaaagaaaauauaaacuga

SEQ ID NO: 323234 - RNA, 64 nt, Human
acuuguugaugcuauuugaaaaguguuuagauguaauaucuaccuuaaaauuuucacaauaaaa

SEQ ID NO: 323235 - RNA, 64 nt, Human; identical to SEQ ID NO: 323234

SEQ ID NO: 323236 - RNA, 64 nt, Human
uucuaaaacuacugccuuucaaagugcacacacacgcguccacauacacugcauucguugcucc

SEQ ID NO: 323237 - RNA, 64 nt, Human
uuucugcagaaaggggcuucuucggucccgagcucgcguccagguggccaggccucugccggcg

SEQ ID NO: 323238 - RNA, 64 nt, Human
gcugaucacucugcauguuucuucgugugguggucgcguccaucuucaagaacagcucguugug

SEQ ID NO: 323239 - RNA, 64 nt, Human
cuuugguagccugaguggucuuuuucaucucuuucgcguccauuacucaaggagacagcauaac

SEQ ID NO: 323240 - RNA, 64 nt, Human
gcuaugcaggccagcccgugcagaccacccccgacgcguccacuugcaacacccgccucacugu

SEQ ID NO: 323241 - RNA, 64 nt, Human
guuagugucuguccaucugucuguccuacccgcccgcguccaaccccggggcauggacagggcc

SEQ ID NO: 323242 - RNA, 64 nt, Human
agugcuuccccagggcuacgaaggaagcugaacacgcguccaguccaccugcaccucuucaaug

SEQ ID NO: 323243 - RNA, 64 nt, Human
ccucacucggcggaaacccgcgagccggcccuuccgcguccaagaaguuuacuuccuaagccuu

SEQ ID NO: 323244 - RNA, 64 nt, Human
ccucugccucccggguucaagccauucugccucagccucccaaguagcugggaguacaggcguc

SEQ ID NO: 323245 - RNA, 64 nt, Human
cucgauauccugaucucgugauccgccugccucugccucccaaagugcugggauuacaggugug

SEQ ID NO: 323246 - RNA, 64 nt, Human
caaacuccuggccucaugugaucugcccaccucagccucccaaaguacagggauuagaguugug

SEQ ID NO: 323247 - RNA, 64 nt, Human
ggugaguagaccuccauugcugguaggcugaugccgcguccacuacuaggacagccaauuggaa

SEQ ID NO: 323248 - RNA, 64 nt, Human
uggagauauauauacauauauagacagacaggaacgcguccacgagcuauauaucuauauauuu

SEQ ID NO: 323249 - RNA, 64 nt, Human
cugugaggaugccaguugggccgaaagagagagacgcguccauaaucuggucucuucuucuuuc

SEQ ID NO: 323250 - RNA, 64 nt, Human
agaaagcaaaguacagaagcuguacucaucggcacgcguccaccugcggaaccuguguuuccug

SEQ ID NO: 323251 - RNA, 64 nt, Human
ucugauuaguggaucacguagcuacuuucccugucgcguccaauucacuauuugcccagaagcu

SEQ ID NO: 323252 - RNA, 64 nt, Human
gaagugggagcuggggagccaauccacccagacccgcguccaccugggaggcauuugggguugc

SEQ ID NO: 323253 - RNA, 64 nt, Human
aagcggucccggagcaggcuuuccuucgcgccuccgcguccacccagcccaggaggaagacugc

SEQ ID NO: 323254 - RNA, 64 nt, Human
agaggccggagccuuuggaacaaaccgugcggaacgcguccaggggccuucccgcccagccuuu

SEQ ID NO: 323255 - RNA, 64 nt, Human
cgccgcuguggugacggaagccaggaggcaggcgcgcguccaaauccagacguucuccgcgggu

SEQ ID NO: 323256 - RNA, 64 nt, Human
gggagagaaacgugacacuguccgccucgggcaccgcguccaaccucagaguuugcaaauaaag

SEQ ID NO: 323257 - RNA, 64 nt, Human
cggagcagcagguguggccccgggcgggcggcaccgcguccagggcagccucccuccgcugagu

SEQ ID NO: 323258 - RNA, 60 nt, Human
ccaagcacuuccaggacugaccagaggccgcgcguccagcugcccuuccgcaguguggcc

SEQ ID NO: 323259 - RNA, 64 nt, Human
cauccucaccuguguaggccccuguagugacccacgcguccagcagacgcccacccaccgcuag

SEQ ID NO: 323260 - RNA, 64 nt, Human
gggagggggacugggccagugcaccuuccagggccgcguccagcagcuuccccugccucgugug

SEQ ID NO: 323261 - RNA, 64 nt, Human
cuugaucucuugaccucgugauccguccaccucagccucccaaagugcugggauuacaggugug

SEQ ID NO: 323262 - RNA, 64 nt, Human
uggacuccugaccucaggucauccuccugccucggccucccaaagugcugagacuacaggugug

SEQ ID NO: 323263 - RNA, 64 nt, Human
cucgaucucuugaccucgugaucugcccgccucggccucccaaagugccgagauuacaggugug

SEQ ID NO: 323264 - RNA, 64 nt, Human
ggccacucuugcggcaagcagaaggccauccuacuccgcggagugaucauggaaauguauuuua

SEQ ID NO: 323265 - RNA, 64 nt, Human
gcaggaggacgagggugcgcuguggacacagcaguccgcggaauuccguucugggaagccaaug

SEQ ID NO: 323266 - RNA, 64 nt, Human
ggaagggaaacugcauuaaaaaaagaacgaaagcuccgcggagccgcagcggcgccucucccag

SEQ ID NO: 323267 - RNA, 64 nt, Human
agcgcccgccgcacacgcccuauucagcaccagcuccgcggacaguucccgcgguccaggcgcu

SEQ ID NO: 323268 - RNA, 64 nt, Human
uugacgcgcugguacaggugcuccgggaacgccuuccgcggaaugaagcggcccaugcccuugu

SEQ ID NO: 323269 - RNA, 64 nt, Human
cccgcggagcccccgccccucccccuacagauccuccgcggaggccccugagggacgagcagag

SEQ ID NO: 323270 - RNA, 64 nt, Human
gguguguguguucccacgggccccggaggcccacuccgcggagggcacgcggcgcgguaggcga

SEQ ID NO: 323271 - RNA, 64 nt, Human
cgaagcuucuggugcagcagccucuggugcugucuccgcggaagucagggcggcuggauuccag

SEQ ID NO: 323272 - RNA, 64 nt, Human
ccaaccccagcagaaagacaccgcgggcggccccuccgcggaaggcguggcagggaggcagucg

SEQ ID NO: 323273 - RNA, 64 nt, Human
ccccgagaccgagaaccggcguaucacacacaucuccgcggagcagaagcggcgcuucaacauc

SEQ ID NO: 323274 - RNA, 64 nt, Human
uuuaaaauguguauauagagauaguauagacuccuccgcggaagcauggagggaaaggagguug

SEQ ID NO: 323275 - RNA, 64 nt, Human
gagucuauuuuacaaccuccuuucccuccaugcuuccgcggaggagucuauacuaucucuauau

SEQ ID NO: 323276 - RNA, 64 nt, Human
ucauccccgagggcgggggcaacgauucacagccuccgcggacuggggucauuuugacuggcuu

SEQ ID NO: 323277 - RNA, 64 nt, Human
cugccucuuggguucaagcgauucuccugccucagccucccaaguagcugggauuacaggcaua

SEQ ID NO: 323278 - RNA, 64 nt, Human
ugaacuccugaccucaaguaaucugcccaccucggccucccaaagugcuaggauuacaggagug

SEQ ID NO: 323279 - RNA, 64 nt, Human
ccgacugccgacuccuagcucucaucgccucggcgccucccaccuucacccucucggggaugcc

SEQ ID NO: 323280 - RNA, 64 nt, Human
gcagacgggcaaguggagccaccucuuuccucccuccgcggaugaagcccagccacauuucagc

SEQ ID NO: 323281 - RNA, 64 nt, Human
aaccauggcccucugccacugacccaccgccaccuccgcggagaaacugcacuuugcaaugggg

SEQ ID NO: 323282 - RNA, 64 nt, Human
cuagacacacgccagggcgccaagcacggccagcuccgcggacccauggacaagcccagccccg

SEQ ID NO: 323283 - RNA, 64 nt, Human
ggcgacucccgcucgugccccggagucaccgccguccgcggauccggcgcuaguagcggggccu

SEQ ID NO: 323284 - RNA, 64 nt, Human
guuugagcuggucagcaaggagagggggugggguuccgcggaagguucuggaggggucuuggua

SEQ ID NO: 323285 - RNA, 64 nt, Human
cuuuccugcagccccacaguccugcuggcugagcuccgcggaacgguccuuagaccccgcugug

SEQ ID NO: 323286 - RNA, 63 nt, Human
gcagcaucccugcaugccguccguauacaaccccucuuugaaaaaagacacagagaauaaacu

SEQ ID NO: 323287 - RNA, 63 nt, Human
cucaccuuacuccccucaggacccuaccccacccucuuugaaaagacaaagcucugccuacau

SEQ ID NO: 323288 - RNA, 63 nt, Human
aucauuacuguguccauuauaaucuuucucuuucucuuugaaagcuggucaggaaugggagaa

SEQ ID NO: 323289 - RNA, 64 nt, Human
gguguccggucccugucccagugccgagaaggaagccucccacgacugcccggcaggguccuag

SEQ ID NO: 323290 - RNA, 64 nt, Human
cugcccuccagguucaagugauucuccucccucagccucccaaguagcugggauuacaggcacc

SEQ ID NO: 323291 - RNA, 64 nt, Human
gugcaguggugcuaucuuggcucacugcaaacccgccucccagguuuaagcgauucucaugccu

SEQ ID NO: 323292 - RNA, 63 nt, Human
ggauggggaguugcaacuucaguguggaauuuccucuuugaggagccugggcuuggaucuauc

SEQ ID NO: 323293 - RNA, 63 nt, Human
auuucacuaagcuccuccuuuacuuucucucuccucuuugaugucaaacgccuugaaaacaag

SEQ ID NO: 323294 - RNA, 63 nt, Human
ucuccuuuaaauucuuuccuaccuugguccugccucuuugaguauauuaguagguuuuuuuua

SEQ ID NO: 323295 - RNA, 63 nt, Human
gccaaaagaacguguuuuauggggagaaacaaacucuuugaagccaguuaugucaugccuugc

SEQ ID NO: 323296 - RNA, 63 nt, Human
ucaucuauugugugcuauacauguaaaaacugucucuuugaacuauugaaaauuuaagguuca

SEQ ID NO: 323297 - RNA, 63 nt, Human
caaugccgguguuuuaaguggaaaaaaaaugaccucuuugauuugugcuguguacacaagauu

SEQ ID NO: 323298 - RNA, 63 nt, Human
ggcucacuggaccauugucacaacccucuguuucucuuugacuaagugcccuggcuacaggaa

SEQ ID NO: 323299 - RNA, 63 nt, Human
uuugauuuuaggaacaagaucuugauauuuggccucuuugaagagacagcccuggcugcuuuc

SEQ ID NO: 323300 - RNA, 63 nt, Human
cucuguguucaggauacuuaguucauggcuuuucucuuugacuuuacuaaaagagaaugucuc

SEQ ID NO: 323301 - RNA, 63 nt, Human
caucuuuucuuuuuauugccucuuauaucucugcucuuugaccucaaggucuagaggucugca

SEQ ID NO: 323302 - RNA, 63 nt, Human
ccucagaucuuacuugguagugagugccuugcccucuuugagcuauuuggcuacuucccuguc

SEQ ID NO: 323303 - RNA, 63 nt, Human
aaccucacacagcaguuuguaaccgcaagcauucucuuugaauucucacagaauucagcaaga

SEQ ID NO: 323304 - RNA, 63 nt, Human
uaucauuguuguuugauuucugaccuuguaccucucuuugaugguaaccauaauggaagagau

SEQ ID NO: 323305 - RNA, 63 nt, Human
uuugacaugaaaaggaugaacgauucacugauucucuuugacucauuugagacuaaaaugcag

SEQ ID NO: 323306 - RNA, 63 nt, Human
gagcugggagccugggguggacaggaccauacccucuuugagcuucugcgaugccggccuucc

SEQ ID NO: 323307 - RNA, 63 nt, Human
accaugucuauucucaagauccaugccagggagcucuuugacucucgugggaaucccacuguu

SEQ ID NO: 323308 - RNA, 64 nt, Human
cccugugugagugaggcugugaacugagcgugaggccucccaggugggggaacugcuugggccu

SEQ ID NO: 323309 - RNA, 64 nt, Human
uucuuguguuccagccaccugccauuuccucccugccucccacccucccucccugcccccuguc

SEQ ID NO: 323310 - RNA, 64 nt, Human
ccgccuccuggguucaagcaguucucuugccucagccucccaaguagcugggaugacaggcgca

SEQ ID NO: 323311 - RNA, 63 nt, Human
accaggccuuccugcucgacugaaaaaaauuuucucuuugaaaauccccuuuuacucauggcc

SEQ ID NO: 323312 - RNA, 63 nt, Human
cuucugccuccucgccucuccuggacuggcuuccucuuugagaaaaugcacaaagcccuggga

SEQ ID NO: 323313 - RNA, 63 nt, Human
cacauacacacacgacugaaucagaucggauugcucuuugauagcucuuuucauaauuguaau

SEQ ID NO: 323314 - RNA, 63 nt, Human
cagaauugaggcuaaaugguuugaucagguuuucucuuugaagagaccacagccuuaggaaau

SEQ ID NO: 323315 - RNA, 63 nt, Human
cccucuucagaggacacuacccuagggcacuuucucuuugagguggagagacccauaaagccu

SEQ ID NO: 323316 - RNA, 63 nt, Human
ucacccucagcuacuccuuguuuuaaaguucagcucuuugaguaacuucuucaauuucuuuca

SEQ ID NO: 323317 - RNA, 63 nt, Human
uacaaaagauguauccuuccaauuuggaaucuucucuuugacaauuccuagauaaaaagaugg

SEQ ID NO: 323318 - RNA, 63 nt, Human
gacagaugauuacuaugccucaugugcugugugcucuuugaaaggaaugacagcagacuacaa

SEQ ID NO: 323319 - RNA, 63 nt, Human
gcaggcaugugggaaggaaggcucugucuucaacucuuugacccuccauguguaccauagagg

SEQ ID NO: 323320 - RNA, 63 nt, Human
aaaguuacacuuacuaaaauuaggacauguuuucucuuugaaaugaagaauauaguuuaaaag

SEQ ID NO: 323321 - RNA, 63 nt, Human
auacuggaaugggaugucuguaaguccuagaaccucuuugagcauauuucuuacaagccucug

SEQ ID NO: 323322 - RNA, 63 nt, Human
ugaagaugcuauguaagguuauggaagauucugcucuuugaaaaccauccaugaccccaagcc

SEQ ID NO: 323323 - RNA, 63 nt, Human
augcuaaagauaacacaccagcacauugacucucucuuugauaacuaagcaaauggaauuaug

SEQ ID NO: 323324 - RNA, 63 nt, Human
aaacaucacugaaaugcuagcugcaagugacaucucuuugaugucauauggaagaguuaaaac

SEQ ID NO: 323325 - RNA, 63 nt, Human
aucagugaugaaaugucagauuuugagcaguagcucuuugacaguguccuuuuauacccaguc

SEQ ID NO: 323326 - RNA, 63 nt, Human
cucuucauuccuggaaugugugugugugugugucucuuugagcaucucucuucauuccuggaa

SEQ ID NO: 323327 - RNA, 64 nt, Human
aacucuaugucugaucuaggaggcugggggaagagccucccauaaaaucacaccuacucugugg

SEQ ID NO: 323328 - RNA, 64 nt, Human
caaacuccugaccucaagugaucugcccgccucggccucccaaagugcuggaaccacaggccug

SEQ ID NO: 323329 - RNA, 64 nt, Human
caaugaagccauucgaaaugcuaugggcucccuggccucccaggccaccaaggacggcaagaag

SEQ ID NO: 323330 - RNA, 63 nt, Human
auuucuauuccuuaugggaucauuuuuccaggacucuuugaagaaaagaaaaaacaacuaaaa

SEQ ID NO: 323331 - RNA, 63 nt, Human
aauguauagggcuauauuuuggcagcuggguagcucuuugaagguggauaagacuucagaaga

SEQ ID NO: 323332 - RNA, 63 nt, Human
aagacaaugauaacuauuauuugugcaacauuacucuuugaaauaaaaauuggcauguagcca

SEQ ID NO: 323333 - RNA, 52 nt, Human
aguucagacuugagcucugacucucuuugaucacauacuaauuuucuuucca

SEQ ID NO: 323334 - RNA, 63 nt, Human
acuccuuuccauuccccugggugucucaugcugcucuuugacuguuucagcuugaacaugcau

SEQ ID NO: 323335 - RNA, 63 nt, Human
ugcuauauaagccagggaguucuaagacgccagcucuuugagauuugcucauuccccuguauu

SEQ ID NO: 323336 - RNA, 63 nt, Human
auuauuuaaacgagcauguguaauguaacuuuucucuuugaaucauauaaaacuugauuuuac

SEQ ID NO: 323337 - RNA, 63 nt, Human
uaaauucuguuagcugcucacuuaaacaauguccucuuugagaaaauguaaaauaaaggcucu

SEQ ID NO: 323338 - RNA, 63 nt, Human
caugccuaucugguaauguuuaauggguuauuucucuuugaggguggcuuucucuggaacauu

SEQ ID NO: 323339 - RNA, 63 nt, Human
uguaaugaaaauaaaucccugcucugagaaaagcucuuugaagcaaaaaccaaacuuuuuuuu

SEQ ID NO: 323340 - RNA, 63 nt, Human
cagauccuguggguuuaguaucauuaucuucagcucuuugauacccuguguuagaguaauagc

SEQ ID NO: 323341 - RNA, 63 nt, Human
cugggccuggaagaccaucccagccucugaguucucuuugaguaugagugauuacuuggauuu

SEQ ID NO: 323342 - RNA, 63 nt, Human
cugggucuggaagacuguuguggccucucaguucucuuugagucugacugacuguggccaguc

SEQ ID NO: 323343 - RNA, 63 nt, Human
uguaacuaaucauauuuaaauauauuucacuuucucuuugacuuuagaccuuuugaagucugu

SEQ ID NO: 323344 - RNA, 63 nt, Human
uuuuuuuacuuuuuuuuaaacguuuguaaaaaccucuuugaggaugaggagucaguaaaauuc

SEQ ID NO: 323345 - RNA, 63 nt, Human
guaaccccacgcacaagccugcaacccccagagcucuuugacaggcucccaggccucccaguc

SEQ ID NO: 323346 - RNA, 64 nt, Human
caaggguaauuucagcggaugcacacacaacccugccucccacaguuccuccccuaaucugguu

SEQ ID NO: 323347 - RNA, 64 nt, Human
ugaauuccugggcucaagcaauucuuccaccucagccucccaaagugcugagauuacuggcuug

SEQ ID NO: 323348 - RNA, 64 nt, Human
caaacuccugaccucaggugauccacccaccccagccucccaaagugcuaagauuacaggcgug

SEQ ID NO: 323349 - RNA, 63 nt, Human
aaaaauuuaauuauuuaugcuauaggugauauucucuuugaauaaaccuauaauagaaaauag

SEQ ID NO: 323350 - RNA, 63 nt, Human
ucacgguaccucgugugggguggggacugagaacucuuugagaugaaaaaauuuaaaaaaaaa

SEQ ID NO: 323351 - RNA, 63 nt, Human
uuagaauguaagcuaaacagauuuuuucuguugcucuuugaaaacuaugagcccuggccagcu

SEQ ID NO: 323352 - RNA, 63 nt, Human
cuucaugcaaggggaaaaucucagcaaugauuacucuuugagauagaagaacugcaaagguaa

SEQ ID NO: 323353 - RNA, 63 nt, Human
gaagcagucuaaauauaaucaacguacagugagcucuuugaagccaaccaaggcaggcagaac

SEQ ID NO: 323354 - RNA, 63 nt, Human
ucccuuguaaguuggauuccuagguauuuuauucucuuugaagcaauugugaaugggaguuca

SEQ ID NO: 323355 - RNA, 63 nt, Human
guuuuacucuucuuauuuuguauaauuuuuaugcucuuugauuaucuaauaaggccaguauuu

SEQ ID NO: 323356 - RNA, 61 nt, Human
aggaguugaaagaccaguagacgcuccucuacucuuugagacaucacuggccuauaauaaa

SEQ ID NO: 323357 - RNA, 63 nt, Human
ugaaggauuugugaagggaaaaaaaauucuggacucuuugauauaauaaaaugagacuggagg

SEQ ID NO: 323358 - RNA, 63 nt, Human
cuuuugaacccucaaguuaccaucaaacuacuucucuuugaacuaccaauacuguugaaugcc

SEQ ID NO: 323359 - RNA, 63 nt, Human
auuugcauuuuaguguacauuuacgucccugcccucuuugaccuggcaauauaguguuguaua

SEQ ID NO: 323360 - RNA, 63 nt, Human
uuuuuggggaaaggaaacuaguaguguuuccuccucuuugaugcucugauacuguucuguuuu

SEQ ID NO: 323361 - RNA, 63 nt, Human
ucagaaccgugacaggacaggcucccaagcucacucuuugagcuccaacgcuuguuaaacaug

SEQ ID NO: 323362 - RNA, 63 nt, Human
cuaaugcuaguuaacaguuggaaaauauaauugcucuuugauagcauauacuccaauuuuucc

SEQ ID NO: 323363 - RNA, 63 nt, Human
guaguacuuuguauguguugagaguuuacagagcucuuugacauacgcgaucuuagucuuuac

SEQ ID NO: 323364 - RNA, 63 nt, Human
ggcagacagaaucacuauuucaaguuaaaggaucucuuugagaauguguucuucuggcugcaa

SEQ ID NO: 323365 - RNA, 64 nt, Human
ugaacuccugaccucaagugaucugccugccuuggccucccaaagugcugggauuacaggugug

SEQ ID NO: 323366 - RNA, 64 nt, Human
cgggaaguacacugccaucggucaggggacagcugccucccaccuugccugggugauggugaau

SEQ ID NO: 323367 - RNA, 64 nt, Human
uggaguguuguguaugguuucuuuucacaucccagccucccaugggcacuucuaagaagagagg

SEQ ID NO: 323368 - RNA, 63 nt, Human
cuccacggcagagcuuaauuauccuuuuaauuccucuuugaaauccuguggugcccccuuccc

SEQ ID NO: 323369 - RNA, 63 nt, Human
cugaugcacaggcgccaggccaagggggaaaugcucuuugaaagcuccaauuauuggucccca

SEQ ID NO: 323370 - RNA, 63 nt, Human
ccuaaugcaguuagaaagaccuuucuccuugagcucuuugacucccagaagguaccccagucc

SEQ ID NO: 323371 - RNA, 63 nt, Human
aaagggauuuucagcauaacauuuuccuuccaccucuuugaccuucccuccagcguuggccaa

SEQ ID NO: 323372 - RNA, 63 nt, Human
gaagaagaaacugagcaguugaaaaaugcuaaucucuuugacuuagucagaaaaaaacagagg

SEQ ID NO: 323373 - RNA, 63 nt, Human
uguucaaaacggaauugaaaacuggcaccccaucucuuugaaacaucugguaauuugaauucu

SEQ ID NO: 323374 - RNA, 63 nt, Human
gugcgaguauggcaaucuaagcaggggucuggucucuuugacuccaggcuggccuuuggccga

SEQ ID NO: 323375 - RNA, 63 nt, Human
cuauucuauuuucugcaguuuacaauacaauaacucuuugaguaaguugaaguuuaauugugc

SEQ ID NO: 323376 - RNA, 63 nt, Human
uggggucuucuugaggcuugugcuuucacagcucucuuugaagcagaugucuuggugaacucg

SEQ ID NO: 323377 - RNA, 63 nt, Human
uuuuuuguuauuauuuucuuagccagaacaucucucuuugaacucacacugauacacaccugc

SEQ ID NO: 323378 - RNA, 63 nt, Human
cuuucugcuuucuggagggcaccaggggccuuucucuuugauaaauuuuuuuugucuguugac

SEQ ID NO: 323379 - RNA, 63 nt, Human
gaggcauccgugaggcagggacaagucuuucuccucuuugagaccccagugccugcacaucau

SEQ ID NO: 323380 - RNA, 63 nt, Human
gcaaccagaaacuaguuaaaagcuucuauuuuccucuuugaacacucaagauugcauggcaaa

SEQ ID NO: 323381 - RNA, 63 nt, Human
gacugcugcuuggaaaacuguccacacuugcuacucuuugagaaugaaguugucauucagggc

SEQ ID NO: 323382 - RNA, 63 nt, Human
acuccuuucuaggaaugcugauucagagugcaccucuuugacuaggucccaggauccccuugu

SEQ ID NO: 323383 - RNA, 63 nt, Human
auuaaaagcaaaaauaaaguucggccugggucucucuuugaugaaguaagaaagacagcacgc

SEQ ID NO: 323384 - RNA, 64 nt, Human
caaacuccugggcucaagcgauccucccaucucagccucccagagugcugggauuacaggugug

SEQ ID NO: 323385 - RNA, 64 nt, Human
ugcaguggugcaaucuuggcucacuguaaccuccgccucccagguucaagugauucuucugccu

SEQ ID NO: 323386 - RNA, 64 nt, Human
cuggaucuccugaccucgugauccaccugccucggccucccaaagugcugcgauuacaggcaug

SEQ ID NO: 323387 - RNA, 63 nt, Human
ugucuguauacuuuuauaccaacuuauuguaggcucuuugaggucagguauguauuucuuucc

SEQ ID NO: 323388 - RNA, 63 nt, Human
gagagucagacugauagacaccauaggagccgacucuuugauaugccaccagcgaacucucag

SEQ ID NO: 323389 - RNA, 63 nt, Human
ucacaaaauacacuguggcuucuucuuugaucucucuuugaccauacugacacugggaaaagc

SEQ ID NO: 323390 - RNA, 63 nt, Human
gcguuccugaaaugaacugaccauuaacagcgccucuuugauagguuacccugaugcugcuaa

SEQ ID NO: 323391 - RNA, 63 nt, Human
gacagugcaguguggagacaccuuccggcuuaccucuuugaacguuguuuaccuaccccuuuc

SEQ ID NO: 323392 - RNA, 63 nt, Human
cuauauauuuucaacaguaaaguagcagaguuucucuuugaaacccaaaaugucuucuaaaga

SEQ ID NO: 323393 - RNA, 63 nt, Human
ucacagccuuauucugaagugaccacuuuucuucucuuugaggcacuaccuggcagcaccauc

SEQ ID NO: 323394 - RNA, 63 nt, Human
aucagggagagcagccaugccagggaugacuagcucuuugagccuguccucagaggauggcga

SEQ ID NO: 323395 - RNA, 63 nt, Human
gcaccguggagacuauguauuuaaugaaaugcucucuuugaagugagguacaugguucuuaac

SEQ ID NO: 323396 - RNA, 63 nt, Human
uugcccccaauccugcuccuccucucauguuuccucuuugacuaaauggcauuaccacuacca

SEQ ID NO: 323397 - RNA, 63 nt, Human
ugugcucaaaauuugaagaaugaacaaauugaacucuuugaaugacaaagaguagacauuucu

SEQ ID NO: 323398 - RNA, 63 nt, Human
uggcaucacugugacacuggcccucccacuucccucuuugacuuacaaagcccaccaggaaga

SEQ ID NO: 323399 - RNA, 63 nt, Human
aggccaggacacuguuuguuguggaacuaggagcucuuugagacgagacuccaaguaguaauc

SEQ ID NO: 323400 - RNA, 63 nt, Human
uucuuggugguggaugacccccgcaaguuugcacucuuugagcgcgcugagcgucacggccaa

SEQ ID NO: 323401 - RNA, 63 nt, Human
ccaaaacugccacagauagcugccacuggcaugcucuuugauuccuggaagcaaacgugggac

SEQ ID NO: 323402 - RNA, 63 nt, Human
uugauuaaaaagaauaucuggaauguagccccacucuuugagugggauucauuucuuacugcu

SEQ ID NO: 323403 - RNA, 57 nt, Human
gcaauacaagugccgaauaaaaaaaaagccucccaccucugccggauaggcagaguu

SEQ ID NO: 323404 - RNA, 64 nt, Human
uacuagggcggaggggauccgggccuugcgugcagccucccaaccaugggcuggguuuugugcu

SEQ ID NO: 323405 - RNA, 64 nt, Human
ugaccaggggcccuaccuggggaaagccugaagggccucccagcccccaaccccaagaccaagc

SEQ ID NO: 323406 - RNA, 63 nt, Human
cccuccucuugcauuuuaaaguggaggguuugucucuuugaguuugauggcagaaucacugau

SEQ ID NO: 323407 - RNA, 63 nt, Human
gcuguacacaggaaagauuuguaagugagcucucucuuugaaaacaggacccaggcugggcac

SEQ ID NO: 323408 - RNA, 63 nt, Human
gcuucugcuguacaagauguagcaccuuuucuccucuuugaacauggucuagugacacgguag

SEQ ID NO: 323409 - RNA, 63 nt, Human
cuuuuguuuuaccaggaaugaguucgggcuauacucuuugaaacugccuuugugagcaaagug

SEQ ID NO: 323410 - RNA, 63 nt, Human
accuucuguagcuccagcuugucucccuggcuucucuuugaaggagaaaaauguaaaauaugc

SEQ ID NO: 323411 - RNA, 63 nt, Human
guccugccuuuccuagcaugcacacaacauccucucuuugaguuuggguucuccccagccccu

SEQ ID NO: 323412 - RNA, 63 nt, Human
agaaccuuuuccacacaccuccuccuuccuguucucuuugaaccauucaucaccucugccuuc

SEQ ID NO: 323413 - RNA, 63 nt, Human
aaagcaguuggacuucaagaaauuuaaaauucucucuuugagaugggguggacuaagaccacc

SEQ ID NO: 323414 - RNA, 63 nt, Human
aacaaauauuaaugucgauaauaaaacauuggacucuuugaaauguauguuaccauuaauuuc

SEQ ID NO: 323415 - RNA, 63 nt, Human
augucugaagaaaguccccuugaauucugauaucucuuugaaucuaagagauccugauagcuu

SEQ ID NO: 323416 - RNA, 63 nt, Human
gugauuucauaugaaagaugcaugccucuuuggcucuuugaacauuuagcaaguauugggaau

SEQ ID NO: 323417 - RNA, 63 nt, Human
aagucaaccaguggccauggcuuacauguuugucucuuugagaucgccaccagaaccauuugu

SEQ ID NO: 323418 - RNA, 63 nt, Human
uucacgcucagagacagcugcaccgacuuggagcucuuugagaaugggacguugcuguggaca

SEQ ID NO: 323419 - RNA, 63 nt, Human
ggcacuauuccuggugcaguauuucagggauuucucuuugagggguucuuuucugguagcuca

SEQ ID NO: 323420 - RNA, 63 nt, Human
cauuguguaauauuuguaugagaaugacucaagcucuuugagaacauuccaaacuaguaacau

SEQ ID NO: 323421 - RNA, 63 nt, Human
uugucagaaauauucuuauuacucagucaaacacucuuugagcuucccuuccuaaagguaacc

SEQ ID NO: 323422 - RNA, 64 nt, Human; identical to SEQ ID NO: 83273

SEQ ID NO: 323423 - RNA, 53 nt, Human; identical to SEQ ID NO: 83274

SEQ ID NO: 323424 - RNA, 64 nt, Human; identical to SEQ ID NO: 83275

SEQ ID NO: 323425 - RNA, 63 nt, Human
acaugacuuuccucucccaguuuccagacagggcucuuugaauguaugucaaacucaguuacu

SEQ ID NO: 323426 - RNA, 63 nt, Human
agcauggcuuaaauuaaauuuaaacaacuaaugcucuuugaagaaucauaaucagaauaaaga

SEQ ID NO: 323427 - RNA, 63 nt, Human
uauuacagaagcuuuacccaggacauuuuauuucucuuugaauaaaucuauuauuucacuuaa

SEQ ID NO: 323428 - RNA, 63 nt, Human
auauauucuuacaaauuuugcuguauugcuguucucuuugaggcucuccaaagucuugaguuc

SEQ ID NO: 323429 - RNA, 63 nt, Human
uacuaguguaaugacaguaaaauuacuucaauucucuuugaaauguagagugcuuccuccuaa

SEQ ID NO: 323430 - RNA, 63 nt, Human
uauagaaaccaacuggcagcuuucccugacaagcucuuugacacauggacaccauuucauguc

SEQ ID NO: 323431 - RNA, 63 nt, Human
gaaggagacauaauuggcagaucuuugccaucucucuuugagauguccuaaaaaggguuguaa

SEQ ID NO: 323432 - RNA, 63 nt, Human
ugcuaaaacauuucaaaaaacucagagauauuacucuuugaugaaugcauaaguucuguacuu

SEQ ID NO: 323433 - RNA, 63 nt, Human
aggaaaauauauucuaguagguaagacugcugacucuuugaaaaucugagguauuuugaaaaa

SEQ ID NO: 323434 - RNA, 63 nt, Human
aagcgcauugauuaaugucugcaaaggaaucugcucuuugagguuucuuucugcacuagagau

SEQ ID NO: 323435 - RNA, 63 nt, Human
uaguggugcuucuuucugaucucuaguggagaucucuuugacugcuguaguacuaaaguguac

SEQ ID NO: 323436 - RNA, 63 nt, Human
auccgguuuauuuaugugcaauuuccuuccccucucuuugacccccuuugaggcaucugcucc

SEQ ID NO: 323437 - RNA, 63 nt, Human
gauaaauauuugaacagccuguagaguuucaaccucuuugagauauaaguaucuuaaauauca

SEQ ID NO: 323438 - RNA, 63 nt, Human
uggccuuaagucuauucaagcaugacagcauuucucuuugaggaauuaaaaucuuuaggaaag

SEQ ID NO: 323439 - RNA, 63 nt, Human
guaacacaaaauguuacgaagguuuaggaaagccucuuugauuuuuguuuggccuugcauugc

SEQ ID NO: 323440 - RNA, 58 nt, Human
augcacagcagaggcgaugaagcgcuuacucuuugauccuucuccugaaguucagcca

SEQ ID NO: 323441 - RNA, 64 nt, Human; identical to SEQ ID NO: 83276

SEQ ID NO: 323442 - RNA, 64 nt, Human; identical to SEQ ID NO: 83277

SEQ ID NO: 323443 - RNA, 63 nt, Human
ugcaaguaaauaggcccagaaagguauaagagacucuuugaauggacauaaaaauucugcuug

SEQ ID NO: 323444 - RNA, 63 nt, Human
agauuugacuguauuaaauguuggcgagagacucucuuugauacauuaaaaaaacuguuugca

SEQ ID NO: 323445 - RNA, 63 nt, Human
aucugaacacaguuuagugcuuuacaugcugugcucuuugaagagauuucaacaagaauauug

SEQ ID NO: 323446 - RNA, 63 nt, Human
caggagguuggugacugaaacauucacacagggcucuuugauggacccacgaacgcucuuagc

SEQ ID NO: 323447 - RNA, 63 nt, Human
uuauguaguuuaggcuggaaaugguuucacuugcucuuugacugucagcaagacugaagaugg

SEQ ID NO: 323448 - RNA, 63 nt, Human
cugacauuuuauuacaagcugcauguccugacccucuuugaauuaaguggacuguggcaugac

SEQ ID NO: 323449 - RNA, 63 nt, Human
gugccaugcaauggugucuguguaauuauuuugcucuuugauuaaaaaaaagacccccagcaa

SEQ ID NO: 323450 - RNA, 63 nt, Human
cacauuacauuuagucuuccuuucgauauaaaacucuuugaagaaauaugauuuuuagaaauc

SEQ ID NO: 323451 - RNA, 63 nt, Human
agggugugcaagcacaaauuuuaccaaucugaccucuuugaaguugcagaaugcuuugaaauu

SEQ ID NO: 323452 - RNA, 63 nt, Human
acacauugcauuuucuaacuauguuuuuaaaaccucuuugaaugcugaaaggucuucccucag

SEQ ID NO: 323453 - RNA, 63 nt, Human
ucuaagaugcuugugugguggcuucuuguccuucucuuugacuucuguggcauggugcuagug

SEQ ID NO: 323454 - RNA, 63 nt, Human
uuuuguuuccaaagcugaagauccccauucuuucucuuugaaaaaaaaaaaggccuaaugcau

SEQ ID NO: 323455 - RNA, 63 nt, Human
uaagcucaaagaaugucacauccgcccagacagcucuuugaugagggugaugggaacugaaua

SEQ ID NO: 323456 - RNA, 63 nt, Human
uguggauucuucccacacagaauauacauuguccucuuugacuagugacacauuguacauggu

SEQ ID NO: 323457 - RNA, 63 nt, Human
cccccagccuguagggaacuuucuggacucccacucuuugaaucgauauaggcauuuggucuc

SEQ ID NO: 323458 - RNA, 63 nt, Human
acucugauguucaugugaacugguugcuucgggcucuuugaucugucaccuauggaaucugag

SEQ ID NO: 323459 - RNA, 64 nt, Human
caaauuccuacuucgacauaugucuuuucaaaaagccucccagacacaagacaucuuaaccguc

SEQ ID NO: 323460 - RNA, 64 nt, Human
cuaccucccagguucaagcuauucuacugccucagccucccaaguagcugggguuacaggcauu

SEQ ID NO: 323461 - RNA, 64 nt, Human
cugccuccugggcucaagcaauccucccacuucagccucccaaauagcuggggcuaccauggua

SEQ ID NO: 323462 - RNA, 63 nt, Human
augaagaugaaaaagugaagccucagaguuacccucuuugagccgaaccuaaaauaaaaguaa

SEQ ID NO: 323463 - RNA, 63 nt, Human
ugcccugggcagccagcauucauuguaaguucccucuuugaaaacugguguguggguguucag

SEQ ID NO: 323464 - RNA, 63 nt, Human
agaagggagcuaaguauccagccucucccaaaccucuuugaacaaagcuucugucccucccac

SEQ ID NO: 323465 - RNA, 62 nt, Human
gucuuuaugccacggacuaagacccaguggugcucuuugagaguuuacgcccaugagugcag

SEQ ID NO: 323466 - RNA, 63 nt, Human
uagucacuucucuuuacagauaucaaagcucagcucuuugaaacauccagcaagacaggccag

SEQ ID NO: 323467 - RNA, 63 nt, Human
uucggauuacaaacgugagccaucgcaccuagccucuuugaucauuucugugguguucagugg

SEQ ID NO: 323468 - RNA, 63 nt, Human
ggacagcuguccucuucugcaucuuggggacaucucuuugaauuuucuguguuuugcuguacc

SEQ ID NO: 323469 - RNA, 63 nt, Human
gaaguugcucugaagucaguuucuaucauucugcucuuugauucaaagcacuguuucucucac

SEQ ID NO: 323470 - RNA, 63 nt, Human
cgcccgccuaccaacaacaaacgugcuuuuuuccucuuugaaaccugcaguucugugugucug

SEQ ID NO: 323471 - RNA, 63 nt, Human
gcccccuuuuccuucccauuggggugcugcccucucuuugacccccagggacccuugccccag

SEQ ID NO: 323472 - RNA, 63 nt, Human
gugacugugacuguaaucauugcugaacaacaucucuuugaaucaaagguugauuuucccaga

SEQ ID NO: 323473 - RNA, 63 nt, Human
gcagcacuuuauuuuuuucuggaaacccaaguucucuuugacuccucuuuuuguccaaaagug

SEQ ID NO: 323474 - RNA, 63 nt, Human
cagaggaagaacauguugcgauugaauucuaaccucuuugacuccgaagaugaaugaagugua

SEQ ID NO: 323475 - RNA, 63 nt, Human
gggcaaguuccugaccacagggaguaaauuggccucuuugauacacuuuugcuugccucccca

SEQ ID NO: 323476 - RNA, 63 nt, Human
uuuguacaucauugucaucaauaucuacagaagcucuuugacgguuugaauacuauggcucaa

SEQ ID NO: 323477 - RNA, 63 nt, Human
aaagcccccucgaggaaauaaauuagugcgguucucuuugacccccaaagacaagacaagcac

SEQ ID NO: 323478 - RNA, 63 nt, Human
auuauguuaccuaagccucugguggguuaucuccucuuugagauguagaaaauggccagauuu

SEQ ID NO: 323479 - RNA, 63 nt, Human
cgaauaaucuauuugucgaugaaauaaacacaacucuuugaggauuugagacuacauucaccc

SEQ ID NO: 323480 - RNA, 63 nt, Human
uggagaggaguaacuuugucuuauucgaccauucucuuugaacucuucugcaguuauacuaaa

SEQ ID NO: 323481 - RNA, 63 nt, Human
auaugaucaaaccuucauuuuuaaaccucucuucucuuugacaaaacuuccuuaaaaaagaau

SEQ ID NO: 323482 - RNA, 63 nt, Human
aaauauaaagguuaacguccauaauaaauacuucucuuugaagcuaccuuaucaagaacgaaa

SEQ ID NO: 323483 - RNA, 63 nt, Human
cuuuaccuuugugguccccaaaugauggcauuucucuuugaaauuuauuagauacuguuaugu

SEQ ID NO: 323484 - RNA, 63 nt, Human
guauuccugucacgacagaauguuaguauucaucucuuugaaucauuugcucaaauaauaaca

SEQ ID NO: 323485 - RNA, 63 nt, Human
acaaucauguagaaaccugucuugguugacaaucucuuugaaacauuuccgaguuaauuuccc

SEQ ID NO: 323486 - RNA, 63 nt, Human
cuuuucuuugagccuucagaguuuuaaaggacccucuuugacccucaggacuuauuagcuccc

SEQ ID NO: 323487 - RNA, 63 nt, Human
ggccuggugcagggcugcgugcauugaggccgccucuuugacggguccauccagggggacccu

SEQ ID NO: 323488 - RNA, 63 nt, Human
gggcacuuuuagccuucccacaacaguuaagcacucuuugacugcugaaggaaccccauggau

SEQ ID NO: 323489 - RNA, 63 nt, Human
cauauucugguucuugaaaauaagauuccagagcucuuugaucgcuuuuaauaaacugcaagu

SEQ ID NO: 323490 - RNA, 63 nt, Human
cauuuucagcaauuacggcuuugacagugccaccucuuugaugccaaaucagcaaccauuguu

SEQ ID NO: 323491 - RNA, 63 nt, Human
caguuggacugauugugacagugccuugucguccucuuugaaacaccccguguuguccaguau

SEQ ID NO: 323492 - RNA, 63 nt, Human
ccuguguuccuuugucugacgcucuguguauugcucuuugaaucgaguuuggaggaagaguug

SEQ ID NO: 323493 - RNA, 63 nt, Human
uauauacgguauuauauaacaggucaacaagugcucuuugaugauaaaacuuguaauagagca

SEQ ID NO: 323494 - RNA, 63 nt, Human
gaggcuugaguccugggcuaacuaccucugauccucuuugaccuuccauuacauaccuaaucc

SEQ ID NO: 323495 - RNA, 63 nt, Human
gaaguguuauuacauauagccggaauugaggaucucuuugauccuggaaaugguuuaccuaaa

SEQ ID NO: 323496 - RNA, 63 nt, Human
cuuucuuucuggcagcuccaagagguuuuucagcucuuugacaacgccaacugcccaagccua

SEQ ID NO: 323497 - RNA, 63 nt, Human
aauguuuaguauauucagcuguaucuguagaaacucuuugacgaaccucaauuuaaccaauuu

SEQ ID NO: 323498 - RNA, 63 nt, Human
gaugugcuagacaauggaaggaugcaggccaaccucuuugauuacaauugagauucaugugac

SEQ ID NO: 323499 - RNA, 63 nt, Human
aggccacuggcccugcacccuuuaccuucuccacucuuugaucagaaacaggguauaugaaca

SEQ ID NO: 323500 - RNA, 63 nt, Human
ucucagcacccuucccacgucccaugucacaggcucuuugagcugcuggcuuuguucucucaa

SEQ ID NO: 323501 - RNA, 63 nt, Human
gagaaacccacgaccuguccugucuuugaucgccucuuugacauuuuugccaaaauaccacua

SEQ ID NO: 323502 - RNA, 63 nt, Human
guaaaauuuuaacaacggaaaggguuaaauuaacucuuugacaucuucacucaaccuuuucuc

SEQ ID NO: 323503 - RNA, 63 nt, Human
gcagaaucucugcuaauuuuucagauuaaaauucucuuugaaaaaauacagucuguauucaug

SEQ ID NO: 323504 - RNA, 63 nt, Human
uuccaaaaguccaggccaaauggugggcuuagccucuuugaaaaguucugccuugcccccaca

SEQ ID NO: 323505 - RNA, 63 nt, Human
accuuuucuucuaguaagugucaaguacagaugcucuuugacuuaugaugggguuauguccca

SEQ ID NO: 323506 - RNA, 63 nt, Human
ggccgcccggcacacaaggcacguuuggcauuucucuuugagagaguuuaucauugggagaag

SEQ ID NO: 323507 - RNA, 63 nt, Human
uuaacuacuacauuggcugugcccaaaugaguccucuuugaauagaaagugaacccagggcaa

SEQ ID NO: 323508 - RNA, 63 nt, Human
cuagauuuacuagcgugugccuuuugccugcuucucuuugauuucacagaauauucauucaga

SEQ ID NO: 323509 - RNA, 63 nt, Human
agcccaaaaccagucauguucuuccaaaagcuucucuuugauagaauuuugaggccaugccac

SEQ ID NO: 323510 - RNA, 63 nt, Human
ugauuuuauccuggagaauacagugcaauauuucucuuugauuauuuauuccucuugauugug

SEQ ID NO: 323511 - RNA, 63 nt, Human
gggggacagaaugggguggccagguggugauuucucuuugaccaaugcauaguuuggcagaaa

SEQ ID NO: 323512 - RNA, 63 nt, Human
uggcuucuucaaaggcuccucuuguagaacugccucuuugaaauuucgagguaaucuacuuug

SEQ ID NO: 323513 - RNA, 63 nt, Human
acagaagacugaaugaaugcaaggauucauuaacucuuugaauuuguuaaauacuaacaguua

SEQ ID NO: 323514 - RNA, 63 nt, Human
uacuuucugguuuguugaaaaaauacacuggugcucuuugaagugauaaaaugaguguuuaug

SEQ ID NO: 323515 - RNA, 63 nt, Human
ucuccugaguagugauuuuggugacaaguuuuucucuuugaaaucaaaccuuguaacucauuu

SEQ ID NO: 323516 - RNA, 63 nt, Human
cuuauuugugugacuaauugccuagauuguaagcucuuugagggcagggcuugucucuuacac

SEQ ID NO: 323517 - RNA, 63 nt, Human
ugaccuuccaaagacuaagacucgcggcagguucucuuugagucaauagcuugucuucgucca

SEQ ID NO: 323518 - RNA, 63 nt, Human
uauuagccagcaccagaugcaugagcuaauuaucucuuugaguccuugcuucuguuugcucac

SEQ ID NO: 323519 - RNA, 63 nt, Human
cuuagaauauucuuaagucacugucccuugucucucuuugaaguuauaaacaacaaacuuaaa

SEQ ID NO: 323520 - RNA, 63 nt, Human
ucuucugaauucaucucuacaggcucaaaacuccucuuugauaucagaccugauguuauuuuc

SEQ ID NO: 323521 - RNA, 63 nt, Human
auucucuuggguggguaagacuaaaucuguaagcucuuugaaacaacuuucucuuguaaacgu

SEQ ID NO: 323522 - RNA, 63 nt, Human
gagauuuuucuguucuugaaaauacagucugugcucuuugauuuuugcuauuguacgguuuca

SEQ ID NO: 323523 - RNA, 63 nt, Human
ccaagguauuuaaaagggcuuuccugccuccuucucuuugauuuauuuaauuugauuugggcu

SEQ ID NO: 323524 - RNA, 63 nt, Human
ccuuugucuucuauaauauuuccuuuuuuuccccucuuugaaucucuguauauuugauucuua

SEQ ID NO: 323525 - RNA, 63 nt, Human
ugaaguuucuuuaaaaucugaguucccuccccucucuuugacauuccugaaagauuaccagcc

SEQ ID NO: 323526 - RNA, 64 nt, Human
ccaucguaagaaugacugaaccauuacuccagcugccucccagauuaaugcauaaagccaagga

SEQ ID NO: 323527 - RNA, 64 nt, Human
uguugguagcuuaggccaacuggaguccagguucgccucccacuguccccuuuccacuucccca

SEQ ID NO: 323528 - RNA, 64 nt, Human
gacagggcauggauucuucauugcaagugaaggagccucccagcucagccacgugggaugugac

SEQ ID NO: 323529 - RNA, 63 nt, Human
auggagaauccaaaaguauuuuccauugccgugcucuuugaaugcagacuucuauuuccagaa

SEQ ID NO: 323530 - RNA, 63 nt, Human
ggauccagaucauguuggcuacagggagaugcucucuuugagaggcuccugggcauugauucc

SEQ ID NO: 323531 - RNA, 63 nt, Human
uguagaacuguuuuguacugugaauuacggaugcucuuugaaggaaagaaauaucgauucuaa

SEQ ID NO: 323532 - RNA, 63 nt, Human
cccuggucccacacagcucugcccuagagccaccucuuugacccuuuacccacccugagacca

SEQ ID NO: 323533 - RNA, 63 nt, Human
uggucucugaacugaccaguauaucccuaacuccucuuugauagagaaagagucucaaaugga

SEQ ID NO: 323534 - RNA, 63 nt, Human
aucaugaagaagcucuugaccaaguaugacaaccucuuugagacguccuuucccuacuccaug

SEQ ID NO: 323535 - RNA, 63 nt, Human
agagaaaaaugaggacuuuggaaauucagaucccucuuugauaucagagauuuaaacaacaca

SEQ ID NO: 323536 - RNA, 63 nt, Human
ggacaacugcccaugagcauuugacuucccuuacucuuugaugaucguagagaaagacuuggu

SEQ ID NO: 323537 - RNA, 63 nt, Human
gcuguuaaaauuuguuuuguggaaagacuaauucucuuugauacugcagaggcaguggccaug

SEQ ID NO: 323538 - RNA, 63 nt, Human
gaccagagguaggagcccaagguccggcccuugcucuuugauugugggcagccuccugcccuc

SEQ ID NO: 323539 - RNA, 63 nt, Human
ucguggucagcuccgaggaauguggcguccaggcucuuugagagccaugggcugcacccggcc

SEQ ID NO: 323540 - RNA, 63 nt, Human
caacauguaccuguauuaaaagauuccagucuucucuuugaagaauuuaagaaacuuauucgc

SEQ ID NO: 323541 - RNA, 63 nt, Human
uauuaauauguucucuuaacgugugccauuguucucuuugaccauuuuccuauaaugauguug

SEQ ID NO: 323542 - RNA, 63 nt, Human
cuuugcugugggaccucagacaaaacccugcaccucuuugagccuuggcugccuuggugcagc

SEQ ID NO: 323543 - RNA, 63 nt, Human
uuccacucauuccuguuguccuaccaccccuugcucuuugagggcuggcuauugagaacugga

SEQ ID NO: 323544 - RNA, 63 nt, Human
cuuauguaaaugaguguggccaucuguauaagccucuuugacauuuucacccagcucuuucuu

SEQ ID NO: 323545 - RNA, 64 nt, Human; identical to SEQ ID NO: 83254

SEQ ID NO: 323546 - RNA, 64 nt, Human; identical to SEQ ID NO: 83255

SEQ ID NO: 323547 - RNA, 63 nt, Human
caggugcucugaaggaggucaccaggaccugaccucuuugaaggaucagaaaauacuucccug

SEQ ID NO: 323548 - RNA, 63 nt, Human
cagaaagcuggcgggugacauuuguaacauuuccucuuugagacucugaguucaccuagagaa

SEQ ID NO: 323549 - RNA, 63 nt, Human
uggcccugacauccccacaugcccgcagagauccucuuugagugucugucuuuguccagguuu

SEQ ID NO: 323550 - RNA, 63 nt, Human
cauaguggaaaagauauaagcugcaguaauuugcucuuugaaugaccgucacccccaguauag

SEQ ID NO: 323551 - RNA, 63 nt, Human
gcaucuccuuccacagcuguucaguuugucggucucuuugaggcagccaccgucccugagggc

SEQ ID NO: 323552 - RNA, 63 nt, Human
auuucuucauucaauucuguuaucucuguuuuacucuuugaaauugaucaagccacugaauca

SEQ ID NO: 323553 - RNA, 63 nt, Human
uaaaaauauucuccaaacccuugcugccaguuccucuuugauaaauauauaguuaauucgaaa

SEQ ID NO: 323554 - RNA, 63 nt, Human
gcuguuuuguguauauugguguauauuauauaacucuuugagccuuuauugguaaauucuggu

SEQ ID NO: 323555 - RNA, 63 nt, Human
uuguuccuaaggauguguggagcccaggcuguacucuuugacauuccacaggucagucugcgu

SEQ ID NO: 323556 - RNA, 63 nt, Human
ugaguaccauuccauggcuuccagaauuuuauccucuuugaggucuucugugcuaugaauauu

SEQ ID NO: 323557 - RNA, 63 nt, Human
ugugugugugucagagggagaccuggcaggcaccucuuugagaguagcuguggucagagcugu

SEQ ID NO: 323558 - RNA, 63 nt, Human
cccuaagcccccuucugcuuccacgcccuuuuccucuuugaagagucaaguacaauucagaca

SEQ ID NO: 323559 - RNA, 63 nt, Human
agaaugcuuguguuuuucggaagugugaugcuucucuuugacugccaaacucuuuuauggaau

SEQ ID NO: 323560 - RNA, 63 nt, Human
aagccuuuggcuccagaguuucuuucugaagugcucuuugauuaccuuuucuauuuuuaugau

SEQ ID NO: 323561 - RNA, 63 nt, Human
guauggccauuagaucugugcuuuuuaucucugcucuuugaauuucucauauuauauaguaaa

SEQ ID NO: 323562 - RNA, 63 nt, Human
acaauguauuuuauuuuuuggaccaagcagugacucuuugauuuugcacuuuuuuuuugaggg

SEQ ID NO: 323563 - RNA, 64 nt, Human
aucuccaggagccaccacucaacacaauggcccugccucccaccgcuuuauuucuuucgguuuc

SEQ ID NO: 323564 - RNA, 63 nt, Human
cgcagcgugcuuuaaaaaauaaauaagaaacaacucuuugagaaacaacaauuucuacuuuga

SEQ ID NO: 323565 - RNA, 62 nt, Human
uagcaguguccaugacauagacccugcccuuccucuuugaauucuuccgggggaagggguga

SEQ ID NO: 323566 - RNA, 63 nt, Human
guagugcuaauacagacacgggggugcaaauaucucuuugagacucugccuuuaauuccuuua

SEQ ID NO: 323567 - RNA, 63 nt, Human
ccacaggaugagaacaucaugagguccaugcagcucuuugacaaugucaucuagcccccagga

SEQ ID NO: 323568 - RNA, 63 nt, Human
uagacuuuaagaagaacagaaaaucuucuuauccucuuugauauuuuauugcaaacacucagu

SEQ ID NO: 323569 - RNA, 63 nt, Human
ugauacugggaagagcauuagccaagaacuugucucuuugaucuguuucguuaagcugaacca

SEQ ID NO: 323570 - RNA, 63 nt, Human
uugcuuccuguugccagcaugaccuacccucgccucuuugaugccauccgcugccaccuccuu

SEQ ID NO: 323571 - RNA, 63 nt, Human
aauauuccagcaauuguguaccccugggccagucucuuugaacccugaggguggccaggaucu

SEQ ID NO: 323572 - RNA, 63 nt, Human
uuaaaugacuugccagaaguuggaauuuuuuuccucuuugaacauaaccucucccuucucccu

SEQ ID NO: 323573 - RNA, 63 nt, Human
gcucacuucacauuggaugacaccauguucuuccucuuugaaaagaaaaggggaauguguccc

SEQ ID NO: 323574 - RNA, 63 nt, Human
gcucccaauagggagggggcugcccucuacagucucuuugacuguaagacagggcucuguauc

SEQ ID NO: 323575 - RNA, 63 nt, Human
gggaagaauguuagguucaugguaacuaguaugcucuuugagauuuuuacaguguugaaacuu

SEQ ID NO: 323576 - RNA, 63 nt, Human
gggggcucugagggcuagggaaacaggaagggccucuuugacaagguaggagcugugcuugga

SEQ ID NO: 323577 - RNA, 63 nt, Human
cuccacagaucccuucacaugauagaagacagacucuuugaugaggucggcggagcaguucac

SEQ ID NO: 323578 - RNA, 63 nt, Human
ggcagaaccagccaugcuucugcaaaucacaaccucuuugagccucugucaccugaacugcaa

SEQ ID NO: 323579 - RNA, 63 nt, Human
guuagcaugauggcauucccuucauguugcacacucuuugacagcaugcuguuuuguggagaa

SEQ ID NO: 323580 - RNA, 64 nt, Human
cagccucugacccaccuaccaccagaggccugcagccucccacaugccuuaaggggaccguggc

SEQ ID NO: 323581 - RNA, 64 nt, Human
caaacuccugaccucaggugauccgcccaccucagccucccaaagugcugggaugacaggugug

SEQ ID NO: 323582 - RNA, 64 nt, Human
ccacaaaaagcguagcggugugauuucuagcucagccucccaccgucuuccuccuacacaccaa

SEQ ID NO: 323583 - RNA, 63 nt, Human
auucuuuucuaagcagaaugguuuaacuuuguacucuuugaaaaauaaugcugauuuauaaau

SEQ ID NO: 323584 - RNA, 63 nt, Human
gugcccuguugacauaaauguuuccuggguuugcucuuugacaauaaauggagaaggaagguc

SEQ ID NO: 323585 - RNA, 63 nt, Human
guguaagcuuucuccaugucagaagcaagccugcucuuugauaaaucugucuuccugaaaauc

SEQ ID NO: 323586 - RNA, 63 nt, Human
gucucgacuuuuccuuuuuugaguccuguguggcucuuugaaucagcgugaaacugaggcucc

SEQ ID NO: 323587 - RNA, 63 nt, Human
ugugaauugucuuuuacuggcaucuuuguuuuccucuuugauguuaguaaauuugguguaaua

SEQ ID NO: 323588 - RNA, 63 nt, Human
gaggcgcugccaggagagccuuccaucucggggcucuuugagguucccuccuucuggguguuc

SEQ ID NO: 323589 - RNA, 63 nt, Human
uagagcuagucuuucacaguaccaucugaauaccucuuugaaagaaggaagacuuuacguagu

SEQ ID NO: 323590 - RNA, 63 nt, Human
uuacuguguaaauauaugucugauaaugauuugcucuuugacaacuaaaauuaggacuguaua

SEQ ID NO: 323591 - RNA, 63 nt, Human
ucuucccugaggaacaaagcacguaucuuuagucucuuugauauuuauucugagaccaagggc

SEQ ID NO: 323592 - RNA, 63 nt, Human
acauguuuuuaauuuuauaucuaugcuuucagacucuuugaugauaauuuuuuuuuuaaaaau

SEQ ID NO: 323593 - RNA, 63 nt, Human
accuccuagggauugaugccuaacugauggauucucuuugagacuauuuagauauuaugugag

SEQ ID NO: 323594 - RNA, 63 nt, Human
ccaaaacucccacuuuuuacuguuuggaaacuccucuuugaaauauuuauugcuacauaacua

SEQ ID NO: 323595 - RNA, 63 nt, Human
accacaucugguucagaagagugucaaguuggacucuuugaacucuguugcugucugagcaau

SEQ ID NO: 323596 - RNA, 63 nt, Human
uuucaacuaugguuauucauccaacccuuggaucucuuugagucuacugauaaucuccacugg

SEQ ID NO: 323597 - RNA, 63 nt, Human
aaaucccccuucaucccccaggacuguccuuuacucuuugauaguaucccucuauuuucuucc

SEQ ID NO: 323598 - RNA, 63 nt, Human
cuaugcucuuuccugucuuccuugaccaaagcucucuuugagguccaaaaaaggcugcccugg

SEQ ID NO: 323599 - RNA, 64 nt, Human
ugcaguggcgcaaucucagcucacugcaagcucugccucccagguucgcgccauucaccugccu

SEQ ID NO: 323600 - RNA, 64 nt, Human
caaacuccugaccucaggugauccccccgucucagccucccaaagugcugggauuacaggcaug

SEQ ID NO: 323601 - RNA, 64 nt, Human
cucuaucucuugaccucgugaucugcccgccucggccucccaaagugcugggauuacaggcgug

SEQ ID NO: 323602 - RNA, 63 nt, Human
ugagaagaguuaacuugucaaagcagaaugguucucuuugacccacucuggucuauuguguaa

SEQ ID NO: 323603 - RNA, 63 nt, Human
uggggucccggcacccaucuguaucaucagugccucuuugaaggugggaaacauuagugaaaa

SEQ ID NO: 323604 - RNA, 63 nt, Human
uauccuccaaaauauuaaaauaacccagaaaugcucuuugaccgucacuuaaaaccuaagaca

SEQ ID NO: 323605 - RNA, 63 nt, Human
gaacgcauccggcuccaagcacacugugcccugcucuuugagguuggagauuuacaguaugcc

SEQ ID NO: 323606 - RNA, 63 nt, Human
uuuuuauagguggagcaauacaauuugaauagucucuuugagaaguaugugcccuaucucaug

SEQ ID NO: 323607 - RNA, 63 nt, Human
gggaggauaacauuuuugcuuucuuaugugacucucuuugaaaaugugcaguaagaaauuccu

SEQ ID NO: 323608 - RNA, 63 nt, Human
cuuccuccugguguggaagagcuccuugauauccucuuugagugaagcugggagaaccaaaaa

SEQ ID NO: 323609 - RNA, 63 nt, Human
aaauugcaauagcuauaaucacaagagcaauaucucuuugaaugacugucuggacaaacacaa

SEQ ID NO: 323610 - RNA, 63 nt, Human
guaccugguugguccuucgucuuugcauguaagcucuuugagaggaagggugaagccuuauuu

SEQ ID NO: 323611 - RNA, 63 nt, Human
ucuccaugugugccuucucuaguagaaugugagcucuuugaggccaaggucuauuuaauuugu

SEQ ID NO: 323612 - RNA, 63 nt, Human
aagaaaaaaacuggcuucauuucugugaaauugcucuuugaaaauuucuuuuuacacguguaa

SEQ ID NO: 323613 - RNA, 63 nt, Human
aguaguagcaagacaugcuuaguguguauuucucucuuugagacacuguaauuucuaccagaa

SEQ ID NO: 323614 - RNA, 63 nt, Human
cucaguucugcauauacagugcaucagucuguucucuuugaccacaauuggaauacauuucaa

SEQ ID NO: 323615 - RNA, 63 nt, Human
agaauuauuuuucacucuaagucauguauguuucucuuugauuauuugcauguuauguuuaau

SEQ ID NO: 323616 - RNA, 63 nt, Human
cagagauacuaaauauuaguuuuaauuaugcaucucuuugaacaucauaaacacacuuuggug

SEQ ID NO: 323617 - RNA, 63 nt, Human
ugcucauucuccagcacccauuccuacuuuagucucuuugaaaucuuuuuuggagauuuuccu

SEQ ID NO: 323618 - RNA, 53 nt, Human
uucaauccauguuauucugaugacucuuugaagaaagaacuugaaccuaagua

SEQ ID NO: 323619 - RNA, 64 nt, Human
ccgccucccagguuuaagcgauucucaugccucagccucccaguagcugggauuagaggcaugu

SEQ ID NO: 323620 - RNA, 64 nt, Human
cgaacuucuggccucuagcgaucugcccgccucggccucccaaagugcugggaugaccagcauc

SEQ ID NO: 323621 - RNA, 63 nt, Human
aauuuucuugauguuguuugaucuaacuuugcacucuuugauaauaauguuuuagauaaugug

SEQ ID NO: 323622 - RNA, 63 nt, Human
gaauauccaaaaaaguacuguacuguagaaaugcucuuugaaaaagucuaucgacugaccaug

SEQ ID NO: 323623 - RNA, 63 nt, Human
auccugccccgggagucuccugucuccuuggaccucuuugauucugugguuuggaggcuccca

SEQ ID NO: 323624 - RNA, 63 nt, Human
uugggugucugcuaaagaggaagugcacuggcccucuuugaaagggcuuuacagugggggcac

SEQ ID NO: 323625 - RNA, 63 nt, Human
uucgauguuuuccucucaguuguaaaagaugaacucuuugagaugauuucucaccugcugugg

SEQ ID NO: 323626 - RNA, 63 nt, Human
gagacuuaacaaguguacugcagaauaaacuaccucuuugaagaaauugcugaaaggaaguaa

SEQ ID NO: 323627 - RNA, 63 nt, Human
gggcggaguucucuucagaccgauuccuauacucucuuugacagcaguuuggaauucuucuag

SEQ ID NO: 323628 - RNA, 63 nt, Human
uagcccuccaaggucugggaauuuaucgagaagcucuuugauagcucugcauuuguuuucccu

SEQ ID NO: 323629 - RNA, 63 nt, Human
uuuuugggcgggggggagguuuaugaaguuuugcucuuugaaccacagcuuuauuaugguccu

SEQ ID NO: 323630 - RNA, 63 nt, Human
guucuggagaaagguauguuacuguaguaauuacucuuugaacagguuuuguguuuugucauu

SEQ ID NO: 323631 - RNA, 63 nt, Human
cacacugggaugugucuccuacaguuggcuucucucuuugauguuaccuguuagugcugaucu

SEQ ID NO: 323632 - RNA, 63 nt, Human
aguagauuguugaaaaagcaaagccacaccauucucuuugauguaugcagagaguuacguagc

SEQ ID NO: 323633 - RNA, 63 nt, Human
ggcagucccuguuuuuuugcauugggguaacugcucuuugauuuuuuuuaauugcaguauuug

SEQ ID NO: 323634 - RNA, 63 nt, Human
guaacuuaccuguuuguuaggaaauggaauggucucuuugauuuaaaauaaauaaaaauagau

SEQ ID NO: 323635 - RNA, 63 nt, Human
guuuguauuugaaaaucucugugaauaaauucucucuuugaucaauagcuagaugagucaugg

SEQ ID NO: 323636 - RNA, 63 nt, Human
ucuuuauguuuuugaaggaccauuuuuaauuagcucuuugauacaaaguaacucagaacguca

SEQ ID NO: 323637 - RNA, 64 nt, Human
gcagcacuuaugguagcggcacugucuuggcuuucgugcucacaccacugcugcucgagucucc

SEQ ID NO: 323638 - RNA, 64 nt, Human
ugcccggcccuccccggcuaugacgcccccggcccgugcucaacaccgccugggccacagcuag

SEQ ID NO: 323639 - RNA, 64 nt, Human
gcugagcucccuccacacaccucaagccccaugccgugcucauccuacccccaaucccuccaau

SEQ ID NO: 323640 - RNA, 64 nt, Human
auauuucauaauaguuaaaaguagguguuuuuuucgugcucaauuuggcacucaaaauaauguu

SEQ ID NO: 323641 - RNA, 63 nt, Human
ggccuuagaacuuugcauagcagcugcuacuagcucuuugagauaauacauuccgaggggcuc

SEQ ID NO: 323642 - RNA, 63 nt, Human
cauacagauaauucacauucaaaauuacauuuucucuuugaacuagaugguauuccuuauuca

SEQ ID NO: 323643 - RNA, 63 nt, Human
caaauucuuuaguacucaauguuucuggacauucucuuugauaacaaaaaauaaauuuuaaaa

SEQ ID NO: 323644 - RNA, 63 nt, Human
ucacggauugccccgccucaaggucuuuccacccucuuugagaucagcguucggagagguccc

SEQ ID NO: 323645 - RNA, 63 nt, Human
cucauccuuuuuaaaugagacuuguuuuccccucucuuugagucaagucaaauauguagauug

SEQ ID NO: 323646 - RNA, 63 nt, Human
gccuaggguggcaggagccagggaggagugggccucuuugaugagagcguugaguugcaugga

SEQ ID NO: 323647 - RNA, 63 nt, Human
gguauaguagacauacacuaaccaaaaauguagcucuuugaaucucagaaaaaaguagauuuu

SEQ ID NO: 323648 - RNA, 63 nt, Human
ugacaccaugaaaggcugcucuuaacuuugucucucuuugacauguagucagcugaagcuuga

SEQ ID NO: 323649 - RNA, 63 nt, Human
uaauugaggaguaggagacuaaaagaauguucacucuuugaauuuccuggauaagaguucugg

SEQ ID NO: 323650 - RNA, 63 nt, Human
aucuugcuacagaaggagcccuugggcucccuucucuuugauagcaguuauaaugcccuuguu

SEQ ID NO: 323651 - RNA, 63 nt, Human
ugugcuaaaggaaccuguauaucuauuuuggaacucuuugaauagucuaaaauagacuaaaaa

SEQ ID NO: 323652 - RNA, 63 nt, Human
cugcaaaguuggugggugagagaaugggacuuccucuuugagagucuggggagagaaaaggug

SEQ ID NO: 323653 - RNA, 63 nt, Human
uggcaauguccuucaaaauuauaaaagcacuaacucuuugauccaguaguuuccacuucuagg

SEQ ID NO: 323654 - RNA, 63 nt, Human
ccuauuugguuugagaaacaggcugacacuauucucuuugauuagaaaauaaacucauaaaac

SEQ ID NO: 323655 - RNA, 63 nt, Human
uaaaaugcaaugugugugauuuacuuuucugaucucuuugagaaauagagaaauauaaaagug

SEQ ID NO: 323656 - RNA, 63 nt, Human
aucugauuccaagcaaaaaccaggcuccaucuacucuuugaagcuucugcccagcuugcauug

SEQ ID NO: 323657 - RNA, 64 nt, Human
uccaucaggacaagcccacgugggguccucccugcgugcucagagggucuguccagcccuggga

SEQ ID NO: 323658 - RNA, 64 nt, Human
gcgccagagugaggggugcaggaagacaaagacgcgugcucacuuuagaaacgaaaagcuggga

SEQ ID NO: 323659 - RNA, 64 nt, Human
acacccucugugcuugugacaaacuggcagguaccgugcucauugcuaaccacugucugucccu

SEQ ID NO: 323660 - RNA, 64 nt, Human
uggggaggaggggaggagggucucagacagcuuucgugcucaugguggcuuggcuuugacucuc

SEQ ID NO: 323661 - RNA, 63 nt, Human
gccccaaugccagaauucuuccaaacucccugacucuuugaaguuuuuacucaccccauuuca

SEQ ID NO: 323662 - RNA, 63 nt, Human
gacuccaguggaaguuuugccaaacugaauggucucuuugacagcccugucaaggaauaccaa

SEQ ID NO: 323663 - RNA, 63 nt, Human
cagcccugugacgucuggagcauuggcugcauucucuuugaguacuaccggggcuucacacuc

SEQ ID NO: 323664 - RNA, 63 nt, Human
gcuuaccuggaggauucagaucauuuaggaauucucuuugaugaaagaucaguucccauuuga

SEQ ID NO: 323665 - RNA, 63 nt, Human
uuuagagggaaucagaaaaaugccaagccuuuucucuuugaaugugcuauuuuuauaacugaa

SEQ ID NO: 323666 - RNA, 63 nt, Human
caguaaacucagcagauaggagccaggcugcaucucuuugaaaggugugagaucuuccuccua

SEQ ID NO: 323667 - RNA, 63 nt, Human
gaucagaccucaauaauuuuauacuguaauaagcucuuugaauguguauauuauuauuuuuua

SEQ ID NO: 323668 - RNA, 63 nt, Human
ucucccaguaauuuuucuuauuuagcccauaaucucuuugaagguuuauacuaauucagcaau

SEQ ID NO: 323669 - RNA, 63 nt, Human
uuaggacauuuggaaucaguagcagagcaaagccucuuugaaaaaaaccacguagcugauugg

SEQ ID NO: 323670 - RNA, 63 nt, Human
ucuggugguuuucugugauuggucuaaugugagcucuuugaacagacagaucugacagugaau

SEQ ID NO: 323671 - RNA, 63 nt, Human
gugaaacagagauaaguaacccucucucaugaacucuuugaugaggauuuguaaacgaaaaca

SEQ ID NO: 323672 - RNA, 63 nt, Human
ggaguuuuauguuuuauuauuacucaaaucgaucucuuugagcauuugcggagcagagguuuu

SEQ ID NO: 323673 - RNA, 63 nt, Human
uuggggaagaggauaagguuauaucuaggacaacucuuugaguugguccuucauauaagaauc

SEQ ID NO: 323674 - RNA, 63 nt, Human
ugauggacuuguauuuaaauuguauguguuuuacucuuugaaaauaaaucuauaaaaccaaca

SEQ ID NO: 323675 - RNA, 63 nt, Human
cauuagagaccugcaaucaccaagcugagacuucucuuugauuuacucagaaggacuggaaaa

SEQ ID NO: 323676 - RNA, 63 nt, Human
cuuuuuuuuuuuuuuuuuuuuuuuuuuuuuuuacucuuugaaagcuuuguuuugugguagucc

SEQ ID NO: 323677 - RNA, 64 nt, Human
acguugacuaccugccucuuuccucgggcaucgacgugcucauuuccaaagaugauggugcagg

SEQ ID NO: 323678 - RNA, 64 nt, Human
accuguucgcccagugccacgucugcaugugaagcgugcucauuucaugcuggguaugacgccg

SEQ ID NO: 323679 - RNA, 64 nt, Human
agugcacaucccuacgugcccacuggcacacacacgugcucacauacauguccgcauacaggcg

SEQ ID NO: 323680 - RNA, 64 nt, Human
aaccccuagaaccgcguuggguuugugggugucucgugcucagccacucugcccagcuggguug

SEQ ID NO: 323681 - RNA, 63 nt, Human
ggggauaacuuaauauccuauguugugucaagacucuuugaagacuuucuugaauugcuuucg

SEQ ID NO: 323682 - RNA, 63 nt, Human
auauuugguuggaaacuccguuccuacaaaacccucuuugaugcggcggagacgauggucagc

SEQ ID NO: 323683 - RNA, 63 nt, Human
aaugccacucuuuccugcagaauucuccgcuaucucuuugacaacaccuggcuggacgcccug

SEQ ID NO: 323684 - RNA, 63 nt, Human
cugugugucuggguccuugagguuuguacguuucucuuugaugaccaggaagaaaucccagca

SEQ ID NO: 323685 - RNA, 63 nt, Human
cuggaguacugacuggcaccgguaagacagaaucucuuugaauccauuacuccaugcccccuu

SEQ ID NO: 323686 - RNA, 63 nt, Human
cucaguucuccguuccccuucaucuccgucccccucuuugaagcuguccccaucucaguguca

SEQ ID NO: 323687 - RNA, 63 nt, Human
ucccuguaaauugcagaauucaaaagugauuaucucuuugaucuacuugccucauuucccuau

SEQ ID NO: 323688 - RNA, 63 nt, Human
aaggaaggccugacggugcaagaacgguugaagcucuuugaauccagggacuugaagaaagac

SEQ ID NO: 323689 - RNA, 63 nt, Human
gguugugcauuaagggccaguuuacuugucugccucuuugaccaccugugaacucuguugggu

SEQ ID NO: 323690 - RNA, 63 nt, Human
ucccugcaagcacuaugaauggaccuuacuacucucuuugacagaagacucaaacacagccuc

SEQ ID NO: 323691 - RNA, 63 nt, Human
aacaguuucaguauugagauggcucaggagaggcucuuugauuuuuaaaguuuuggggugggg

SEQ ID NO: 323692 - RNA, 63 nt, Human
ucugucucgcuugcucgcucucgcuguuucucucucuuugaggcauuuguuuggaaaaaaucg

SEQ ID NO: 323693 - RNA, 63 nt, Human
agaaaagcucagaguagguggguaggagcccuucucuuugacuuagguuuuuaggagucugag

SEQ ID NO: 323694 - RNA, 63 nt, Human
gucugacaccaacaacauggucucugucccucucucuuugacucucccuuuguccuccccaua

SEQ ID NO: 323695 - RNA, 63 nt, Human
gagcguggcaugagagcaaggagaccauggcuacucuuugaaauggauggggaaaauuagcuu

SEQ ID NO: 323696 - RNA, 63 nt, Human
gagcaugcuggggugagacugggauucuggcuucucuuugaaccaccugcaucccagcccuuc

SEQ ID NO: 323697 - RNA, 64 nt, Human
caggaucucuuggccucaugaucagccugccucggccucccaaagugcugggauuacaggugug

SEQ ID NO: 323698 - RNA, 64 nt, Human
agcaaagccuccagcaucuuuuccauccugaggugccucccaguggccuggcuugucggagcaa

SEQ ID NO: 323699 - RNA, 64 nt, Human
ggaacuucugaccucaggugauccaccugccucagccucccaaagugcugggauuacaggcgug

SEQ ID NO: 323700 - RNA, 63 nt, Human
cgacuuuuuuucagcugugaccauucccgggagcucuuugagccuuucugucucauuuggaac

SEQ ID NO: 323701 - RNA, 63 nt, Human
cugaaaaucuucacaacugaucauuaucuccuucucuuugagaccugacugaaaaaauuaggu

SEQ ID NO: 323702 - RNA, 63 nt, Human
uccagugggggagauaaauguuugcuccuaauucucuuugaaaacugggccucccugcucugu

SEQ ID NO: 323703 - RNA, 63 nt, Human
uuauuuuaauccuuuuacauaaaauaaucugaacucuuugacaaauugcacagagcucuuugg

SEQ ID NO: 323704 - RNA, 63 nt, Human
cuggauuuuugcucugccccugaccccuugucccucuuugagggaggggagcuaugcuaggac

SEQ ID NO: 323705 - RNA, 63 nt, Human
gaccucccuucugucuuuuaggcuauuucaucacucuuugagaaauaaccauuuugaccauuu

SEQ ID NO: 323706 - RNA, 63 nt, Human
aaauugacaaauuguccuccaacauccucccaccucuuugacuucaggacauuuauucaucau

SEQ ID NO: 323707 - RNA, 62 nt, Human
aaaaggguugcuguaauugaaaagcuuguauccucuuugaagacaucuacaaagccauuuag

SEQ ID NO: 323708 - RNA, 63 nt, Human
uaugccguguaaaaaauguacuuauaggaacaucucuuugaauuguauuucuuguauauuaca

SEQ ID NO: 323709 - RNA, 63 nt, Human
ggaaucuucaaacuuuccaacggaacuuguuugcucuuugauuugguuuaaaccugagcuggu

SEQ ID NO: 323710 - RNA, 63 nt, Human
aaagccaagccgugagccgaccagaaggccguccucuuugauaucuuuugcaauuguaccgaa

SEQ ID NO: 323711 - RNA, 63 nt, Human
uuggggugcugaaauugagcugaaaaaaaaaggcucuuugaauauaguuuuaauuucucucua

SEQ ID NO: 323712 - RNA, 63 nt, Human
gcccguguuccuggucucuggcugcuucucugacucuuugauaaccuugggcaagucccuuuc

SEQ ID NO: 323713 - RNA, 63 nt, Human
cugguucuaagauuuaauacagugcuuuuuuuccucuuugaaauauuuuacuuuaauaccagu

SEQ ID NO: 323714 - RNA, 63 nt, Human
ccaggagcacaugcagacacaccaggccggccccucuuugagcucccagaagccaagaguguu

SEQ ID NO: 323715 - RNA, 63 nt, Human
gauuuuucuguacaguaugaaauugggacucaacucuuugaaaacaccuauugagcaguuaua

SEQ ID NO: 323716 - RNA, 64 nt, Human
ccggcucugcuggccuagaagcagagugcacccucgugcucagugcucagugggugucugaacu

SEQ ID NO: 323717 - RNA, 64 nt, Human
cccgcugcaucuccgcgccugugggugcaugucgcgugcucaucuguugcacacagcucacucg

SEQ ID NO: 323718 - RNA, 64 nt, Human
aaaaaccaacaaugugauuuauaacgcacaacuucgugcucaggucaucuaggagcaaggugag

SEQ ID NO: 323719 - RNA, 64 nt, Human
ucuucugagcuuuuggacuuggggaugccaaacacgugcucacccucacacucgccccggcccg

SEQ ID NO: 323720 - RNA, 63 nt, Human
uucucguccucguuuguguucuguuuuguuucgcucuuugagaaauagcuuaugaaaagaauu

SEQ ID NO: 323721 - RNA, 63 nt, Human
aauuuaguccaaguuccaguucuuuuaggccuucucuuugauuuauuuuccccugcaugugag

SEQ ID NO: 323722 - RNA, 63 nt, Human
ucugcugcugguggaaacucauggcuucucucucucuuugaucccauaaagcuacgaggggga

SEQ ID NO: 323723 - RNA, 63 nt, Human
ggucaccagccgggcaggguggaaggagcuugccucuuugagaaaccaaggagucccagugau

SEQ ID NO: 323724 - RNA, 63 nt, Human
gcgcgcucgcgcucucucucucucucucucucucucuuugaucucaggggguccuuuuuggag

SEQ ID NO: 323725 - RNA, 63 nt, Human
aaagcucacagcgacccuggccuccccuguggccucuuugagugucugcagcagcccuggacu

SEQ ID NO: 323726 - RNA, 63 nt, Human
guagcccuuuccucuguucuuuuauuucuuuuucucuuugauugaaaggggacuacgucuuag

SEQ ID NO: 323727 - RNA, 63 nt, Human
ucccucuuaucguuuugagcuaccugccaucuucucuuugaaaaaccuaugggcuugaggagg

SEQ ID NO: 323728 - RNA, 63 nt, Human
gagggccggcccgugguagccaacaucgagccacucuuugaccgguugcucauuuucuggucu

SEQ ID NO: 323729 - RNA, 63 nt, Human
ucugagagcccuggccagcucuucgccccucaccucuuugaaacucuggacguauuuauggcu

SEQ ID NO: 323730 - RNA, 63 nt, Human
cccagggguguauuuuugaaggacuugggagcucucuuugaaaggcaaacaacaagggaaaca

SEQ ID NO: 323731 - RNA, 63 nt, Human
cccguccuccagguguccccaucccuccccugucucuuugagcuggcucuugucacuuagguc

SEQ ID NO: 323732 - RNA, 63 nt, Human
auucacacugaagagaaacuucauaagcauccucucuuugagaaaacguguaauagaugauca

SEQ ID NO: 323733 - RNA, 63 nt, Human
auauugcuacuacaagcauaagggcacaaauaucucuuugagacccugcuuucaauucuuauu

SEQ ID NO: 323734 - RNA, 63 nt, Human
acaggcguaagccacugcgcccggccuugcaugcucuuugacccugaauuugaccuacuugcu

SEQ ID NO: 323735 - RNA, 63 nt, Human
cugagccccagcuccuaccucugaccccaacuucucuuugaucucugaauccccucugacucc

SEQ ID NO: 323736 - RNA, 64 nt, Human
ugggguguaacaguugaauuaaacuuagcaaucacgugcucagagcuuuugccugucaguugug

SEQ ID NO: 323737 - RNA, 64 nt, Human
gcauucgguggccagagccgaggguccucccacacgugcucacccacccgcagccuaggcaggc

SEQ ID NO: 323738 - RNA, 64 nt, Human
ccgucaugaacgucauccacagcaucuucagccucgugcucaaguuccgcagccagcucaucuc

SEQ ID NO: 323739 - RNA, 64 nt, Human
cugcugugcagcugagcgaguugcugacgcugcccgugcucaugaagcgcuccaucacggcacc

SEQ ID NO: 323740 - RNA, 63 nt, Human
cuuccucugcuaggugaauugugccucuccuggcucuuugacaugugcuagugagauuucuuc

SEQ ID NO: 323741 - RNA, 63 nt, Human
gucaaacucaaagacagugagaagaaccgcaagcucuuugaucucuuggaugugcuggaguuu

SEQ ID NO: 323742 - RNA, 63 nt, Human
guguaguuauuucuaaguaguaauucuucccagcucuuugauuugccauauauaaaauaggug

SEQ ID NO: 323743 - RNA, 63 nt, Human
uguccaagggaaagcuuugagaguuuauguuuacucuuugagucccaggagaagccuggcacc

SEQ ID NO: 323744 - RNA, 63 nt, Human
aagccuugguaucugagaggucaggaaggggaccucuuugaggguaauaacagaauuggaacc

SEQ ID NO: 323745 - RNA, 63 nt, Human
cccagaauauuuauccuucaccagcaacucugacucuuugacgggaggccucaguucuagucc

SEQ ID NO: 323746 - RNA, 63 nt, Human
cuucugcccccuaccacuuuucugcuguugccucucuuugacaccuguuuuagucaguuggga

SEQ ID NO: 323747 - RNA, 63 nt, Human
uuaacuuugaaaguuaacucuucaaaugggagacucuuugaaaugacauguuccuuuaaggua

SEQ ID NO: 323748 - RNA, 63 nt, Human
caucaccccccaaaaugcucugcagccucucugcucuuugagaaagggcacaccaugcgcucg

SEQ ID NO: 323749 - RNA, 63 nt, Human
guccccaacuccuccccaccccucccccaucuccucuuugaaagccagaacaagagagcgcuc

SEQ ID NO: 323750 - RNA, 63 nt, Human
ucuucugggcaguuuuguugaaaauaaagguuucucuuugauuucaagaaugaccaaaauggc

SEQ ID NO: 323751 - RNA, 63 nt, Human
uuacuggacagcgauuucuggcuuauaagaguucucuuugauuugcacuagcacuacgauagu

SEQ ID NO: 323752 - RNA, 63 nt, Human
ggcauucuuaaaauucaagaaaauaaaacuaagcucuuugagaacugcuucuaagaugccagc

SEQ ID NO: 323753 - RNA, 63 nt, Human
uuuuauguauguugcagguauugcacacuuuuccucuuugaaaucaaacuuuucuauuucacu

SEQ ID NO: 323754 - RNA, 63 nt, Human
ccucccccaacccccaccccacacuuguuccagcucuuugaaauagucugugugaaggugaaa

SEQ ID NO: 323755 - RNA, 63 nt, Human
cucacugcgguggugugggggcuggugcuguggcucuuugaguaucaccgauccacccugcag

SEQ ID NO: 323756 - RNA, 64 nt, Human
cuugggcccugcugacccccagcggacacaagagcgugcucagcagccagguguguguacauac

SEQ ID NO: 323757 - RNA, 64 nt, Human
guguuucuauaggacaagggcucagaggacuggacgugcucagacaucgguguucuucuuccca

SEQ ID NO: 323758 - RNA, 63 nt, Human
uucuccagcgguuggccgguguuagaacucgcucucuuugagugacuggcuacaagggccuga

SEQ ID NO: 323759 - RNA, 63 nt, Human
cccccaaaccgaagccaucugccaaauuccagccucuuugagcuggccccuccagauggagag

SEQ ID NO: 323760 - RNA, 63 nt, Human
uccagccuuggagcccuucugucucuggucuuucucuuugacccugcugaguguaagcugccu

SEQ ID NO: 323761 - RNA, 63 nt, Human
ccagcccucaccccaggccagccccaccccggccucuuugagaauucucagaacuuuguaccu

SEQ ID NO: 323762 - RNA, 63 nt, Human
accacacucaugggucacuggggcugcgcagggcucuuugagguggguggcuucuuuuggaaa

SEQ ID NO: 323763 - RNA, 63 nt, Human
guguccgucaucccagcccccgguuggagccugcucuuugaacuccgcugccuuccuuagcag

SEQ ID NO: 323764 - RNA, 63 nt, Human
gagcugaagguaagaaacucauaaacaagaugacucuuugaugcaugaacaagauuugaaaau

SEQ ID NO: 323765 - RNA, 63 nt, Human
gccuuuugcaaccaggaacagcaaaugcaaaaacucuuugagaggguaggagggugggaagga

SEQ ID NO: 323766 - RNA, 63 nt, Human
uuuuuuaguagaauuguuuccuaaagaaaaccacucuuugaucauggcucucucugccagaau

SEQ ID NO: 323767 - RNA, 63 nt, Human
uuugaugucuccaaguaguccaccuucauuuaacucuuugaaacuguaucaucuuugccaagu

SEQ ID NO: 323768 - RNA, 63 nt, Human
agaucaaaggccucagaaaccauuguguguuuccucuuugaagcaaugacaagcacuuuacuu

SEQ ID NO: 323769 - RNA, 63 nt, Human
aaacucgaggacauucaccacgaugauuuuccucucuuugauguacuucaagugcaacucaaa

SEQ ID NO: 323770 - RNA, 63 nt, Human
uuguuauugcagaugaaguggaaagggaaggaccucuuugauuuggugugccggacucugggg

SEQ ID NO: 323771 - RNA, 63 nt, Human
agacuuuggcaacuccugggccacacggccugccucuuugauuacuaaugauugucagugacu

SEQ ID NO: 323772 - RNA, 63 nt, Human
gcuuuggggguggcuuguuacccccuuuuccuccucuuugaagacggagcugccccagcugug

SEQ ID NO: 323773 - RNA, 63 nt, Human
uguggcuguuccuuaacguccccacuagccaggcucuuugagggcagggauugugucugguua

SEQ ID NO: 323774 - RNA, 64 nt, Human; identical to SEQ ID NO: 83271

SEQ ID NO: 323775 - RNA, 63 nt, Human
cccuugcugugcauggggcucuggggaguuccacucuuugauggagggcagaggcccugagug

SEQ ID NO: 323776 - RNA, 63 nt, Human
caugcaguggaagaggugaagaacagccugcagcucuuugaggaguauuuucugcaggauaag

SEQ ID NO: 323777 - RNA, 63 nt, Human
caguucuaccuaguuucacagaggaaaaaaauacucuuugaauaaagugaacagaggcucauu

SEQ ID NO: 323778 - RNA, 63 nt, Human
acugaaaagcacauggccuugggugacaaauuccucuuugaugaauguacccuguggggaugu

SEQ ID NO: 323779 - RNA, 63 nt, Human
gcagugguaacacugcacagugcuauguggcuucucuuugaggauuuuuggguuuuguaacua

SEQ ID NO: 323780 - RNA, 63 nt, Human
gacggcgaguucgcccagucccucagcgaccugcucuuugagaagguggccuccggacacggg

SEQ ID NO: 323781 - RNA, 63 nt, Human
ucauuccccccgccaccuguacucacccucacgcucuuugaagaaaaaaaaaaaaaucaccuu

SEQ ID NO: 323782 - RNA, 63 nt, Human
agaguuucuguuugauucuuuuuuaauaaacuacucuuugauuuaauuguuugguguaagcau

SEQ ID NO: 323783 - RNA, 63 nt, Human
caacaacauucccagcagaccaacucccacccccucuuugagguaaaagugccuuuauuggga

SEQ ID NO: 323784 - RNA, 63 nt, Human
cuggucgugugcugagguugggacaauuuuuuccucuuugacuucagcuugcauaugggguug

SEQ ID NO: 323785 - RNA, 63 nt, Human
gcuuuuacuguguugaagcuaaaaaaauaauggcucuuugacaaaacuuguuauguugaucgc

SEQ ID NO: 323786 - RNA, 63 nt, Human
guaaauauauaacuuuguuaacacuuuuguuagcucuuugaccauaaaauaaugacaauaagc

SEQ ID NO: 323787 - RNA, 63 nt, Human
agauugugaauaaugauuuggggauucagauuucucuuugaaacaugcuuguguuucuuagug

SEQ ID NO: 323788 - RNA, 63 nt, Human
uguuucuuuuuuguguagauauuaauaacauuacucuuugacuauagugugcacucugaaaug

SEQ ID NO: 323789 - RNA, 63 nt, Human
agauaauuuuuaaguuuccuagugauucucaaucucuuugaauuuuacuuacauuuacacaca

SEQ ID NO: 323790 - RNA, 63 nt, Human
agauaauguauaaguuucccagugauucucaaccucuuugaauuuuacuuauaauuacauaca

SEQ ID NO: 323791 - RNA, 64 nt, Human
aggcugagaugagaaugcggauuaaaaugccuggcgugcucaccguaacaccacggggaaggcu

SEQ ID NO: 323792 - RNA, 64 nt, Human
cagagcuugucaccagccccauggccucuccaggcgugcucaugcccacaacccgcggccagcc

SEQ ID NO: 323793 - RNA, 64 nt, Human; identical to SEQ ID NO: 83252

SEQ ID NO: 323794 - RNA, 64 nt, Human; identical to SEQ ID NO: 83253

SEQ ID NO: 323795 - RNA, 63 nt, Human
cacugccuccugugacgugaggcccauucuucacucuuugaagcgagcagucagcauucuuag

SEQ ID NO: 323796 - RNA, 63 nt, Human
caugucuucaauugucacgcauuucuucuuuuacucuuugaaacuauucuuugagucaauuuu

SEQ ID NO: 323797 - RNA, 63 nt, Human
gcccuaaccacuucuuacaugucaucuuaacaucucuuugaggaaacacuguuuccucauuuu

SEQ ID NO: 323798 - RNA, 63 nt, Human
acacagaaauguuuuuucacuucaaauucuauccucuuugauacuugauuuuuuaaaaauacu

SEQ ID NO: 323799 - RNA, 63 nt, Human
guguauguguucacuauauaaaauguuccucugcucuuugaaaguaagaguguugugucugua

SEQ ID NO: 323800 - RNA, 63 nt, Human
ggauguaaauagccgcacaaagggguccaacagcucuuugaguaggcauuugguagagcuugg

SEQ ID NO: 323801 - RNA, 63 nt, Human
auuugguuaaucguuaaucuuuaguugcauucucucuuugagugauucauacauucuguuucu

SEQ ID NO: 323802 - RNA, 63 nt, Human
uccaaaugcaaauggcucaugcucuuuagacuacucuuugaauaacaaguaagaugcaaucua

SEQ ID NO: 323803 - RNA, 63 nt, Human
aacaguaauuuuacuuuuaaggaaauuggcuagcucuuugagcuagagagcuguaggaagcuc

SEQ ID NO: 323804 - RNA, 63 nt, Human
cuacucccugcuuuauaugccacccucuuccuucucuuugaccccugugacucuuucuguaac

SEQ ID NO: 323805 - RNA, 63 nt, Human
ccugccuuaaugugacaugaggcccauucuucucucuuugaagagagcagucaacauucuuag

SEQ ID NO: 323806 - RNA, 63 nt, Human
cacugccucgugugauaugaggcccauucuucacucuuugaagagagcagucaguauuguuag

SEQ ID NO: 323807 - RNA, 63 nt, Human
cacugccucgugugauaugaggcccauuccugccucuuugaagagagcagucagcauucuuag

SEQ ID NO: 323808 - RNA, 63 nt, Human; identical to SEQ ID NO: 323795

SEQ ID NO: 323809 - RNA, 64 nt, Human
ucagcaagcugcuucuccaaucaaagcugccugccgugcucacccuguguguuagguuauuuau

SEQ ID NO: 323810 - RNA, 64 nt, Human
cugggccucccaauuggugcuaucuguuacugcccgugcucacggacauggauacagacccugc

SEQ ID NO: 323811 - RNA, 64 nt, Human
gcuggccggggcaccuugucccugcuaugguccacgugcucacgcuguccaccugccaggugga

SEQ ID NO: 323812 - RNA, 64 nt, Human; identical to SEQ ID NO: 224130

SEQ ID NO: 323813 - RNA, 63 nt, Human; identical to SEQ ID NO: 224131

SEQ ID NO: 323814 - RNA, 64 nt, Human; identical to SEQ ID NO: 224132

SEQ ID NO: 323815 - RNA, 64 nt, Human; identical to SEQ ID NO: 224133

SEQ ID NO: 323816 - RNA, 64 nt, Human
cccgcccucccugggcacaugugcacacgugcccaggcacaaguaugucucugggucccuugcc

SEQ ID NO: 323817 - RNA, 64 nt, Human
uuuuuccugcuggcuacagcauggggugcccuauaggcacaagcccagcugaagaacagaaugg

SEQ ID NO: 323818 - RNA, 64 nt, Human
agagucaugaagcuaaauccuugggcuaugucagaggcacaaagucuagaauguguguauucac

SEQ ID NO: 323819 - RNA, 64 nt, Human; identical to SEQ ID NO: 83257

SEQ ID NO: 323820 - RNA, 64 nt, Human; identical to SEQ ID NO: 83258

SEQ ID NO: 323821 - RNA, 64 nt, Human; identical to SEQ ID NO: 83259

SEQ ID NO: 323822 - RNA, 64 nt, Human
ccgaagguggaacaugcuucauggucacacauacaggcacaaaaacagcauuauguggacgccu

SEQ ID NO: 323823 - RNA, 64 nt, Human
accauauuucaggagaaggggugucuacuuuuugaggcacaaagguuccugcugaauauaagua

SEQ ID NO: 323824 - RNA, 54 nt, Human
uucauuacuucagugauuagggugaggcacaaagaguuucuugaucauccagag

SEQ ID NO: 323825 - RNA, 64 nt, Human
uaucaaguaguaguauuuuaugacuagagaucacaggcacaaguugaaacaaacuaacaugaca

SEQ ID NO: 323826 - RNA, 64 nt, Human
gaaguugcccucaucugcuggagaucgauaaggaaggcacaagacguucuccucugcccgugag

SEQ ID NO: 323827 - RNA, 64 nt, Human
uaaaauaaaacacgaauuuaauaaaauaugggaaaggcacaaaccagaagucggcauuugugaa

SEQ ID NO: 323828 - RNA, 64 nt, Human
uguaaaugauuuguaucguaugauuaaggaucuaaggcacaauauuugucacuguucuauuaga

SEQ ID NO: 323829 - RNA, 64 nt, Human
uguaaagauaaucgaagcaaaaguaaucacuuaaaggcacaaauaggauguacuguugaaaaag

SEQ ID NO: 323830 - RNA, 64 nt, Human
gccucuuggggcugggacuuucucacccugcggcaggcacaacagaugcugggacccagucucu

SEQ ID NO: 323831 - RNA, 64 nt, Human
auugucucucccuucuccaguucugggaauuuacaggcacaauacacuuccuuuuccuggagag

SEQ ID NO: 323832 - RNA, 64 nt, Human
ucuccugccucagccuccaacuagcugggauuacaggcacaagccaccaugccuggcuaaaauu

SEQ ID NO: 323833 - RNA, 64 nt, Human
uacgugccuguacugucagcuacuugggaggcugaggcacaauaauuguuugaacccaggaagc

SEQ ID NO: 323834 - RNA, 64 nt, Human
gauugaaguuugacuuuuauugucacaaaucagcaggcacaagaacuguccaugaagaugggaa

SEQ ID NO: 323835 - RNA, 64 nt, Human
aaauuggcauauuuaaagccuaacauucuaauaaaggcacaaauuucuuuuuaauacuuguuuc

SEQ ID NO: 323836 - RNA, 64 nt, Human
cagacagcaguguuugcuauuuacuuugaauugaaggcacaaaaugcaucaauuccugugcugu

SEQ ID NO: 323837 - RNA, 64 nt, Human
uauuguaacgaauggcuaguuuuuauucucgucaaggcacaaaaccaguucaugcuuaaccuuu

SEQ ID NO: 323838 - RNA, 64 nt, Human; identical to SEQ ID NO: 83262

SEQ ID NO: 323839 - RNA, 64 nt, Human; identical to SEQ ID NO: 83263

SEQ ID NO: 323840 - RNA, 64 nt, Human; identical to SEQ ID NO: 83264

SEQ ID NO: 323841 - RNA, 64 nt, Human
gcauucauacuaguugaaauuuuuaauagaaucaaggcacaaaagucuuaaaaccauguggaaa

SEQ ID NO: 323842 - RNA, 64 nt, Human
ugguucuuugcaguuucuuguaaauuuauaaaccaggcacaagguucaaguuuagauuuuaagc

SEQ ID NO: 323843 - RNA, 64 nt, Human
cacaugccuguaaucccagcuacuuuggaggcucaggcacaagaaucacuugaaccuacgaggc

SEQ ID NO: 323844 - RNA, 64 nt, Human
guggugaaaaucaagcuuuggauugugcauuccuaggcacaaaauuaccucauucuuccuaaca

SEQ ID NO: 323845 - RNA, 64 nt, Human
uuuucccuucaucugucacaggaaacagaagcccaggcacaaucuuuuccagcuuugccuguua

SEQ ID NO: 323846 - RNA, 64 nt, Human
cgcauucauaaagcaaaggaguacuacagcaucaaggcacaacacaaaaaccaacacaaaacau

SEQ ID NO: 323847 - RNA, 64 nt, Human
uaguaaacucuagcugucuauuuaaaauguacugaggcacaacaaguauuauacuggaagacuu

SEQ ID NO: 323848 - RNA, 64 nt, Human
uaaaaggauagcauuuuuauacaaauaucuuuaaaggcacaaaagauuuauucacaaguuuugg

SEQ ID NO: 323849 - RNA, 64 nt, Human
uuuuuacacuaaggacauuucaaauuaaguacuaaggcacaaagacaugucaugcaucacagaa

SEQ ID NO: 323850 - RNA, 64 nt, Human
uauuucuuucuauucuuggaaccacgaaugagguaggcacaaauacauuccuuuuagaguuaag

SEQ ID NO: 323851 - RNA, 64 nt, Human
gagaagaugccaauguuucauccaccggcugcacaggcacaaacucccccacccaggacggcug

SEQ ID NO: 323852 - RNA, 64 nt, Human
gccugccugggguggccuggaagccuguucagaaaggcacaauguggagccuggggugucuccc

SEQ ID NO: 323853 - RNA, 64 nt, Human
ugcauuuucauagugugguaagaccuuaaguaaaaggcacaauggguacuacagaauuaaaaug

SEQ ID NO: 323854 - RNA, 50 nt, Human
auggagauacaagccugugaaggcacaagaaucuccaaacaccucucugu

SEQ ID NO: 323855 - RNA, 64 nt, Human
uauuaaaaccugcuuuauacuuucaacugcuuguaggcacaacuucugcaaguuuaaauauuug

SEQ ID NO: 323856 - RNA, 64 nt, Human
auacugagcacuuaccauguaccagaauuuuacuaggcacaaccaugaauaaaaauacaauucu

SEQ ID NO: 323857 - RNA, 64 nt, Human
cuauuugaaguguaauugagaaggaaaauuuuagcgugcucacugaccugccuguagccccagu

SEQ ID NO: 323858 - RNA, 64 nt, Human
aggugaaggucaugcgaugccuggaacaccccaacgugcucaaguucaucggggugcucuacaa

SEQ ID NO: 323859 - RNA, 54 nt, Human
ugguguuccuccggaccugagcuccgugcucaacccccagcccaccccacccuc

SEQ ID NO: 323860 - RNA, 64 nt, Human
caccugccuguaaucucagcuacucaggaggcugaggcacaagaaucgcuugaauccaggaagc

SEQ ID NO: 323861 - RNA, 64 nt, Human
aacauuaauuauuuuggguuuguuuaaaaccuagaggcacaaucuugacuugucaauuacuacc

SEQ ID NO: 323862 - RNA, 64 nt, Human
cuagugaggaaagauuuuuguuguuauuucuuacaggcacaaaaugauggacccaaugcacaca

SEQ ID NO: 323863 - RNA, 64 nt, Human
cauaggccuguaauuccagcuacucuggcugcugaggcacaagaaucauuugaaccuaggaggu

SEQ ID NO: 323864 - RNA, 64 nt, Human
gccccagauggacggggcugugaggggugucuccaggcacaaaggcccgaacacaggaagccug

SEQ ID NO: 323865 - RNA, 64 nt, Human
aagcaggaaagcagguuuccugagugauauguugaggcacaauuauuuuuuccuuuuugguuac

SEQ ID NO: 323866 - RNA, 64 nt, Human
uuugacaaguuuauuuaauccagugugguagaaaaggcacaauuccaauguaucauuuagaauu

SEQ ID NO: 323867 - RNA, 64 nt, Human
cauuuccuacagagaagcguucccacccccucucaggcacaaaagccgguguccagggacucaa

SEQ ID NO: 323868 - RNA, 64 nt, Human
ggauuugucaaaagaauggagcuuuguaggaaacaggcacaaagacgcaaacccagggcuuaac

SEQ ID NO: 323869 - RNA, 64 nt, Human
cagccucuuucacauuacaauaauauaccauaggaggcacaagcaccauuauuaagccacuuug

SEQ ID NO: 323870 - RNA, 64 nt, Human
aggaacuaaggaaggaauccccuucuuagagcagaggcacaaguuagagcaggcccagcauuug

SEQ ID NO: 323871 - RNA, 64 nt, Human
cuccugugaguggccuccagaugucuuugugcauaggcacaagugggccagggcuggagggagg

SEQ ID NO: 323872 - RNA, 64 nt, Human
acauaagcgugcaugccauguuguuuugaauuggaggcacaauuucauuauucgagaguaaaag

SEQ ID NO: 323873 - RNA, 64 nt, Human
agcugcuuuuaauuuuagcaaaauguuuuaugcaaggcacaauaggaagucaguucuccugcac

SEQ ID NO: 323874 - RNA, 64 nt, Human
cuguaguggaugaagcugaggcuuauaguagguaaggcacaaaguuaaaaaguaacaucacugg

SEQ ID NO: 323875 - RNA, 64 nt, Human
aacaaaucaacuuccauuuggauuguaggugugaaggcacaacucuaauugcuauuagucuaca

SEQ ID NO: 323876 - RNA, 64 nt, Human
gaaugggaaguugugacguugcagcuccaaccgacgugcucauagugaucagcugugcaggagc

SEQ ID NO: 323877 - RNA, 64 nt, Human
gagccucuccuuguacuuuggcagccauagaaagcgugcucauuuucuguuuuccuguguuagg

SEQ ID NO: 323878 - RNA, 64 nt, Human
ucucagcuguggcugccacccagccagguuucuccgugcucacuaauuuauuuccaggaaggug

SEQ ID NO: 323879 - RNA, 64 nt, Human
uguuuugauucuuuguuguuguuuuuauuuuaaaaggcacaaacucuagauauuaguugaaugu

SEQ ID NO: 323880 - RNA, 64 nt, Human
acagcagggccaaaacuagagugauacucaucucaggcacaaauauauauggggacaucaaaac

SEQ ID NO: 323881 - RNA, 64 nt, Human
auaauguacuaauauuuaaaauaccuucagccuaaggcacaaggaugccaaaaaaacaaaggug

SEQ ID NO: 323882 - RNA, 64 nt, Human
uucagguuuuggcaacacauagaucauaugucugaggcacaaguuggcuguucaucuuugaaac

SEQ ID NO: 323883 - RNA, 64 nt, Human
auuuaaguuaggagagggggcgauauagagaauaaggcacaaaauuuuguuuaaaacucagaau

SEQ ID NO: 323884 - RNA, 64 nt, Human
aaggaaaaggaggaaauuuccuuucucuuuuaggaggcacaacaguucucuucuaggauuuguu

SEQ ID NO: 323885 - RNA, 64 nt, Human
cacucuuuugucuacaaaaugcuucuaguccaggaggcacaaccaagaacugggauuaaugaag

SEQ ID NO: 323886 - RNA, 64 nt, Human
aaugaguucuucucaaaaaauaauuaguuaggccaggcacaauggcucacaccuguaaugccag

SEQ ID NO: 323887 - RNA, 64 nt, Human
ugcacguuuguaaucccaguuacucaggaggcugaggcacaagaauugaguaucacuuuaacuc

SEQ ID NO: 323888 - RNA, 64 nt, Human
gggaaagucuuagcugagaacuaagagaugagggaggcacaaacucugcacgggggaacugugu

SEQ ID NO: 323889 - RNA, 64 nt, Human
ucuuuaaggcaccuccugccacuuucucccucagaggcacaaacacuuuguguuccacgucagu

SEQ ID NO: 323890 - RNA, 64 nt, Human
cuggguauuugaaaugucaauuuuagcacucuccaggcacaaggacagcccagcaccagcuuua

SEQ ID NO: 323891 - RNA, 64 nt, Human
cugccuucuguccaccaacauuuagugccagccuaggcacaacuuguccugguccaaguccuua

SEQ ID NO: 323892 - RNA, 64 nt, Human
uguucuggaagggagaggggcuggaggcacccacaggcacaagcugaaggcagcagcuuggcua

SEQ ID NO: 323893 - RNA, 64 nt, Human
gcuggugcugguggaggcagcggagcagaggcucaggcacaaugaagcguggauguguucugca

SEQ ID NO: 323894 - RNA, 64 nt, Human
ugugaugcuuuacacucuacaaaguaugguuuaaaggcacaaggucauggccuuugucauagca

SEQ ID NO: 323895 - RNA, 64 nt, Human
gccaucauggucauugccuucauauaacaugcuucgugcucauggucauugccuucauauaaca

SEQ ID NO: 323896 - RNA, 64 nt, Human
uccucccgcuccagcggcaccacguccggcacugcgugcucaacgagcuggcccagcugggccu

SEQ ID NO: 323897 - RNA, 64 nt, Human
cuguuccacccaggaggaggaaacuucacauagccgugcucacaguuuuuuauuuuaaaggaau

SEQ ID NO: 323898 - RNA, 64 nt, Human
ucauauugcccaguggucaccucacacuccuccaaggcacaauuuuaauucaaaagaucaaaug

SEQ ID NO: 323899 - RNA, 64 nt, Human
aaagcauaguuggucuuggugucauauggaucagaggcacaagugcagaggcuguggucaugcg

SEQ ID NO: 323900 - RNA, 64 nt, Human
aaugcauguaggcacauggacccagucuacacucaggcacaaaaggagcuacauuaguuacauu

SEQ ID NO: 323901 - RNA, 64 nt, Human
cugccccuugguugagaaccauuguuccaagugaaggcacaaacucucaauaucuaaaauaagu

SEQ ID NO: 323902 - RNA, 64 nt, Human
cggggcaugugccucaucacaccauccauccuggaggcacaaggccuggcuggcugcgagcuca

SEQ ID NO: 323903 - RNA, 64 nt, Human
uuucacauauuuuuuauugcucuuuaguaaagaaaggcacaagaaagaaaauauccagcucucu

SEQ ID NO: 323904 - RNA, 64 nt, Human
aggccaaaagggcuguuggcuguaauccuacgccaggcacaaggcaucuuguugccuugccacg

SEQ ID NO: 323905 - RNA, 64 nt, Human
uguggcugggcuucuauccuagagauggaguagaaggcacaacugguuugauaguuacuauuuu

SEQ ID NO: 323906 - RNA, 64 nt, Human
aaguaccuccuugaugccugucggcacuucugaaaggcacaaggccaagaacuccuggccagga

SEQ ID NO: 323907 - RNA, 64 nt, Human
cucagucuggccuccccagccucaagguccacucaggcacaagagccacaguacccuagauagu

SEQ ID NO: 323908 - RNA, 64 nt, Human
uugcaagaaguugguuuauagacguuuacucuggaggcacaagcuggcugccaugcugaguaag

SEQ ID NO: 323909 - RNA, 64 nt, Human
ucuugucuggugacccagagaucaccaugacuugaggcacaaaucacuguggggaaacaauuuu

SEQ ID NO: 323910 - RNA, 64 nt, Human
uugcagucuucagaugaaacuaaaucucuagaagaggcacaagaauggcuaaagcaauucaucc

SEQ ID NO: 323911 - RNA, 64 nt, Human
augaucauaaaagaagaggcgaguagggcacaacaggcacaaagggagaccauaaggagacaca

SEQ ID NO: 323912 - RNA, 64 nt, Human
cuuuccucgucuaauuaugauccugccauauuccaggcacaagagaaagcucuggggcuugagu

SEQ ID NO: 323913 - RNA, 64 nt, Human
caacuuaacauguaaauguacauaauaaaauuccaggcacaauacauaugaacgcuuuuagaga

SEQ ID NO: 323914 - RNA, 64 nt, Human
gagcccccgugccuuggucuccccccugggcacacgugcucacucaggcccagcaaugaccucu

SEQ ID NO: 323915 - RNA, 64 nt, Human
cccaggacaugauuuucaccuacuaacaccuccacgugcucagcaauuuugcaugucccuuuuc

SEQ ID NO: 323916 - RNA, 64 nt, Human
auggaaugcagcaguaaauccaaguagguauauccgugcucagagagaauucuccauaguucug

SEQ ID NO: 323917 - RNA, 64 nt, Human
uuuguaagagcaguuuuauguuuacagaaaaauuaggcacaaagggauucccauaucccuccuc

SEQ ID NO: 323918 - RNA, 64 nt, Human
acggacuugguugccacaguccaggagcauuugaaggcacaaugcaggggcucagauuggcaca

SEQ ID NO: 323919 - RNA, 64 nt, Human
ggaaggucacaaggccugggguuguucacaccacaggcacaauacagagcuguccacucuugaa

SEQ ID NO: 323920 - RNA, 64 nt, Human
gaagaaugcagaagucaaacccucaugacaaaguaggcacaagucuacaauaagcuaaaucaga

SEQ ID NO: 323921 - RNA, 64 nt, Human
caagcauccuuuacuaacaagagcaggaauucagaggcacaagaaaaagcauuggcaugagcca

SEQ ID NO: 323922 - RNA, 64 nt, Human
cacaugcugguaauagcagcuacugagguggcugaggcacaagaauugcuuggacccuggaggu

SEQ ID NO: 323923 - RNA, 64 nt, Human
uuuugaauggcuauggcguuagguugaaauggccaggcacaaauuuagucuggucauuuuguuu

SEQ ID NO: 323924 - RNA, 64 nt, Human
auguaugggaacuguuuuauagagaauggggcagaggcacaacuccaggaauucucuagcuccu

SEQ ID NO: 323925 - RNA, 64 nt, Human
ugggcaccuguaaucucagcuacuugggaggcugaggcacaagaaucacuugaacuugggaggu

SEQ ID NO: 323926 - RNA, 64 nt, Human
ugugacuagaaaguauuuuauuuuaaauuuacauaggcacaaguggcuaguggcuacuguauug

SEQ ID NO: 323927 - RNA, 64 nt, Human
auaaaagcaguuuuacauuggggguugcugagguaggcacaagaaaaagucaggcauaaagcac

SEQ ID NO: 323928 - RNA, 64 nt, Human
aagacucugucucaaaaaaaacaaaacaaaaaggaggcacaaaaccccaggcuucaagucucug

SEQ ID NO: 323929 - RNA, 64 nt, Human
guaauucauaaaugcuucccauggaguuuugcuaaggcacaagacaauaaucugaauaagacaa

SEQ ID NO: 323930 - RNA, 64 nt, Human
uauuaaaaagaaaacaaaacaaaaaaaaaaggcaaggcacaacaaaaaaauauccugggcaaua

SEQ ID NO: 323931 - RNA, 64 nt, Human
cuuuugguuuuuuucucuauuuagcauucuguuaaggcacaaaaacuauguacuguaugggaaa

SEQ ID NO: 323932 - RNA, 52 nt, Human
ucucagaaauugccaacuaggcaggcacaaaucuugggucuuggggacuaac

SEQ ID NO: 323933 - RNA, 64 nt, Human
aggacgcugcaacgggucaggcuggcgggcccggcgugcucaucaucucugccccagguguacg

SEQ ID NO: 323934 - RNA, 59 nt, Human
gucccugggaagcugcaugauguggaacacgugcucaucgaugugggaacuggguacua

SEQ ID NO: 323935 - RNA, 64 nt, Human
cccacagccuaaacugagccaguggccaaacaaccgugcucagccuguuucucucugcccucua

SEQ ID NO: 323936 - RNA, 64 nt, Human
cagcauaguagcaaaaagaacgacaucaguuuaaaggcacaauacuuaaucagugacuggcaac

SEQ ID NO: 323937 - RNA, 64 nt, Human
cgggguggggacagguagaccaggugcucagcccaggcacaacuucagcaggggauggcgcuag

SEQ ID NO: 323938 - RNA, 64 nt, Human
cagacagcuguaaucucagcugcucgggaggcugaggcacaagaaucgcuugagccagggaggu

SEQ ID NO: 323939 - RNA, 64 nt, Human
gcgugugugugugugugugugugucuggaggcacaggcacaaagcauugcuuggguuggucaaa

SEQ ID NO: 323940 - RNA, 57 nt, Human
aguuucaugaagacuacuagcccugccaggcacaaugacucacgccuguaaucccag

SEQ ID NO: 323941 - RNA, 64 nt, Human
cugaggcggaagaucgcaagucagaguggcuggcaggcacaaccuccuggcacaccagaggcag

SEQ ID NO: 323942 - RNA, 64 nt, Human
agucauacaauuggauaaagcauaauauaaaauaaggcacaauugcuauaugaaacuguggauu

SEQ ID NO: 323943 - RNA, 64 nt, Human
cuugaaauucaucaugggagucugcugcuauaccaggcacaagauaaaacuccaaaauuucugu

SEQ ID NO: 323944 - RNA, 64 nt, Human
caagugagcacugagggucuggugccaauccuguaggcacaaaaccagaaguuucuacauucuc

SEQ ID NO: 323945 - RNA, 64 nt, Human
uaaggcuuugauuuuuaugauuaugaaagaaauaaggcacaaccacaguuuuucuuucuuaaau

SEQ ID NO: 323946 - RNA, 64 nt, Human
cucugugaucaguuuguuauuuuuuuucuccuuaaggcacaaaauaauugguuugagguaugug

SEQ ID NO: 323947 - RNA, 64 nt, Human
ugauauauuguaagugagagguaaaggaaaauguaggcacaauaagcacugcuauuuuucucuu

SEQ ID NO: 323948 - RNA, 64 nt, Human
uuuggggggggacauuuauucacaaaugagaaguaggcacaaaguaaaaaauggaaccaucuac

SEQ ID NO: 323949 - RNA, 64 nt, Human
gcucuuugcagugcaccaggcacguugagaguggaggcacaauggaaauccucugugggacccc

SEQ ID NO: 323950 - RNA, 64 nt, Human
uaauccucacccuugcugcuccugaugcaaagccaggcacaacaagggaaauccauguccaaag

SEQ ID NO: 323951 - RNA, 64 nt, Human
gcuuagugaaacacaaaauuagaauguucaugucaggcacaaggguuuggauuuugugcaagcu

SEQ ID NO: 323952 - RNA, 64 nt, Human; identical to SEQ ID NO: 83265

SEQ ID NO: 323953 - RNA, 64 nt, Human; identical to SEQ ID NO: 83266

SEQ ID NO: 323954 - RNA, 64 nt, Human
agcaaaagaaaccucuuaaaggucaaauccuauuaggcacaagucggaguuacauuuaaaaaaa

SEQ ID NO: 323955 - RNA, 64 nt, Human
auacauguacaccauacauagacaagcaucauaaaggcacaagugcacacacaucuaugcagac

SEQ ID NO: 323956 - RNA, 64 nt, Human
gucuuacugcaucaccagauagggcuuugcuacaaggcacaaaugauccaaaucaaggaggcua

SEQ ID NO: 323957 - RNA, 64 nt, Human
ggucugaacuucauccuggcaaaaacaaaguugcaggcacaacaguuuaagaaugcauuccucc

SEQ ID NO: 323958 - RNA, 64 nt, Human
cauuugaauguaaucaccuguguuaccacgaaugaggcacaacuauacuacauggacagaguac

SEQ ID NO: 323959 - RNA, 64 nt, Human
uauucaauaucauaccauaaugugucauagcuauaggcacaagaaaaacaacaguuugagagaa

SEQ ID NO: 323960 - RNA, 64 nt, Human
cucaugccucagccucccgaguagcugggacuacaggcacaagucaccaugccuggcuaauuuu

SEQ ID NO: 323961 - RNA, 64 nt, Human
uucauaaacuacaauauuuggauuuuuuuccccaaggcacaaaauguauaauggagaccaaaua

SEQ ID NO: 323962 - RNA, 64 nt, Human
guggugcuggcuagaggucccugccccugucuggaggcacaacgcccauccuuaggccaaacag

SEQ ID NO: 323963 - RNA, 64 nt, Human
guggugcuuguaaugucagcuacccaggagucugaggcacaagaaucacucgaaccugggaggu

SEQ ID NO: 323964 - RNA, 64 nt, Human
ugucugccuguggucccagcuacucgggaggcugaggcacaagaaucacuugaacccaggaggc

SEQ ID NO: 323965 - RNA, 64 nt, Human
aaaggaugaaaaaaauaaacagaaaacucagcucaggcacaauugucaccaaggaguuaaaagc

SEQ ID NO: 323966 - RNA, 64 nt, Human
ugaucaguauaauuuuuuaaaguuacuuugucagaggcacaaaaggguuuaaacugauucauaa

SEQ ID NO: 323967 - RNA, 64 nt, Human
agacugagucuacaggagcuuugggccugagggaaggcacaagagugcaaagguuccucgaacu

SEQ ID NO: 323968 - RNA, 64 nt, Human
guucugaauucucagacuugguccugugaaauacaggcacaaaauguaucugaagugguuugag

SEQ ID NO: 323969 - RNA, 64 nt, Human
agaugagcaagaaggccccagaacccaugccccaaggcacaaagaggagcucaggguaggccca

SEQ ID NO: 323970 - RNA, 64 nt, Human
aguuggcuauaccuuguccacuuccaguacuggacgugcucagggucuagggucacagauggug

SEQ ID NO: 323971 - RNA, 64 nt, Human
uugcuuugguuuuguccugccuucuccaauaucacgugcucaguuuugccucuacuuacccaug

SEQ ID NO: 323972 - RNA, 64 nt, Human
uauggaacucugcugauggggacccaagcgcccacgugcucagccacccucuggcucagcgggg

SEQ ID NO: 323973 - RNA, 64 nt, Human
ugcacaccuguaaucccagcuacucgggaggcugaggcacaagaaucgcuugaacacgggaggc

SEQ ID NO: 323974 - RNA, 64 nt, Human
ggcacagcagugucauggggcugucuccccugacaggcacaacuccccgggcagaaaacgugcc

SEQ ID NO: 323975 - RNA, 64 nt, Human
acagcuggcuuaauuguugaaagagauauguagaaggcacaauaugggcacuuuaaaugaagcu

SEQ ID NO: 323976 - RNA, 64 nt, Human
aucuauauauuucucucacccuauuuugagacagaggcacaaagacucagcaauuuuuuucccu

SEQ ID NO: 323977 - RNA, 64 nt, Human
uaucugcaacacccugaaaaauuaucuaauaaaaaggcacaaagaaaaagcuugucaauguugu

SEQ ID NO: 323978 - RNA, 64 nt, Human
accauggcaugaggaagaaacaaggucccugagcaggcacaaguccugacagucaagggacugc

SEQ ID NO: 323979 - RNA, 64 nt, Human
ucugagaggcucaucccucaguggcaacagaaacaggcacaacuggaagacuuggaaccucaaa

SEQ ID NO: 323980 - RNA, 64 nt, Human
ggaauauaugaagauggcuuugauacuagaggugaggcacaaguguuuuauguacucucagugu

SEQ ID NO: 323981 - RNA, 64 nt, Human
uaaguuuacaguuuuuuauuaguccgggaaaagaaggcacaauaguuuucgacacuggacugga

SEQ ID NO: 323982 - RNA, 64 nt, Human
gagccagagcgaccccauuucccgugugaaccauaggcacaacccaggaaguuuccccacuugu

SEQ ID NO: 323983 - RNA, 64 nt, Human
ucuacucucagcuuuaggacaaaagcucugucagaggcacaagcugaaggucaaaaaugauuua

SEQ ID NO: 323984 - RNA, 64 nt, Human
caugcaccugcaaucccagcuacucgggaggcugaggcacaagaaucacuugaacccgggaggc

SEQ ID NO: 323985 - RNA, 57 nt, Human
acaaaggaaaaucucuuuaagaacagaaggcacaacucaaauguguaaagaaggaag

SEQ ID NO: 323986 - RNA, 64 nt, Human
uuccucgcugccuuuggcuggcaggaggcuuuggaggcacaagccauuauaaccuucuuggccc

SEQ ID NO: 323987 - RNA, 64 nt, Human
cccuuucauucaucauagggauaagauuuuuuguaggcacaagaccaagguauacaucuucccc

SEQ ID NO: 323988 - RNA, 61 nt, Human
aggccagaucucuuacuuaaugacuuggggaaggcacaaaacaugagagaaagguaacugc

SEQ ID NO: 323989 - RNA, 64 nt, Human
cuauuuuuuauuuuauaaaugaacaggguuuuaacgugcucaacuuuaauuuuuuucaauugua

SEQ ID NO: 323990 - RNA, 64 nt, Human
aagaaauagacagcaugagagggaugaggcaacccgugcucagcugucaaggcucagucgcuag

SEQ ID NO: 323991 - RNA, 64 nt, Human
aagauucuccccauggggcagaguggucuccuuacgugcucacacccagucagcuugggucccu

SEQ ID NO: 323992 - RNA, 64 nt, Human
uauaaauauauguaaucuauuuucuucauaaaacaggcacaaaaguuuuaucaguaaggaauua

SEQ ID NO: 323993 - RNA, 64 nt, Human
cucccaccucagccucccaagcagccgggacugcaggcacaagccaccaugccuggcuguuuuu

SEQ ID NO: 323994 - RNA, 64 nt, Human
guagaauuacacuucuuuuuacagguaaaugucaaggcacaaucaguuuucaggaagugcuuca

SEQ ID NO: 323995 - RNA, 64 nt, Human
uugacaggauugauggaacaugcucuccugcucaaggcacaaccucugggcuggaguagaggac

SEQ ID NO: 323996 - RNA, 64 nt, Human
ucucugggguuccccuggaaaggcugcaggaacuaggcacaagcucucugagccagucccucag

SEQ ID NO: 323997 - RNA, 64 nt, Human
cagucuagucuggaaaacaaacaugaagcaaagaaggcacaacaccauauggaaaagcaagaca

SEQ ID NO: 323998 - RNA, 64 nt, Human
cucauuuuauuuuccuugacccauuuauuucccaaggcacaaucacuaaagacuuuguacuuuc

SEQ ID NO: 323999 - RNA, 64 nt, Human
uuagaguaggaaucagcauagugggaugcccagcaggcacaaaccauggguccagggagucuca

SEQ ID NO: 324000 - RNA, 64 nt, Human
agccggaccugccugccacccuccucucccacucaggcacaauggugccuaaaguguuuccaau

SEQ ID NO: 324001 - RNA, 64 nt, Human
cuucuguugagauuuuucccucaccuugccucucaggcacaauaaauauaguuauaccacugcc

SEQ ID NO: 324002 - RNA, 64 nt, Human
gagcaggcuggagucucuacuuuguauucuugugaggcacaaauauaggcuagaauccaggccc

SEQ ID NO: 324003 - RNA, 64 nt, Human
uuucaguguagcacuuuuagagccaaaaaaacucaggcacaaagaaguuaaauaacuugccggg

SEQ ID NO: 324004 - RNA, 64 nt, Human
cuuagcccacaacagaaccagaaugaaucuuugaaggcacaagacucugcuuuugccacucuuc

SEQ ID NO: 324005 - RNA, 64 nt, Human
ucaccuuuguccuguuuucuacagguuagaagcaaggcacaagucauaccuacauucaaggaga

SEQ ID NO: 324006 - RNA, 64 nt, Human
acaugugaucugccuggugaaggcuaucuggggcaggcacaaauugguggaaaucacaucuuaa

SEQ ID NO: 324007 - RNA, 64 nt, Human
cucaaaacaaaacaaaaaaaauuagccuacuuaaaggcacaacuaaaugcuuuauuaccuuucu

SEQ ID NO: 324008 - RNA, 64 nt, Human
accgggacccgagcccccgcgaugcccugggggccgugcucacuaccaaauguuaauaaagccc

SEQ ID NO: 324009 - RNA, 64 nt, Human
gucccucucagcucugcgccugccaggcagggcacgugcucacagcccuggguugauuuauuuu

SEQ ID NO: 324010 - RNA, 64 nt, Human; identical to SEQ ID NO: 83260

SEQ ID NO: 324011 - RNA, 64 nt, Human
uuaaaaacaaaucaaauuuauugaacaaaugacaaggcacaaauacuuucagaauuguauuuca

SEQ ID NO: 324012 - RNA, 64 nt, Human
cuagugguguagggagcaagagaaugcagcuggaaggcacaaggggaggacauuguggcauuca

SEQ ID NO: 324013 - RNA, 64 nt, Human
uaaacuugaaaacaguaaaucugcagauacugugaggcacaaauuauacugucaaccuacuguu

SEQ ID NO: 324014 - RNA, 64 nt, Human
ccaguuagcagcuuagccccccuagcaaaccccaaggcacaaagugggcauccugacucaucuc

SEQ ID NO: 324015 - RNA, 64 nt, Human
ccaggccuugggcauaauuauuuccccccaaaaaaggcacaaaaauagguuuuggaucaaagaa

SEQ ID NO: 324016 - RNA, 64 nt, Human
uauaaaugcaguuuuaauaaaccauggaauaccaaggcacaacauaucaaacacauuggauccc

SEQ ID NO: 324017 - RNA, 64 nt, Human
uacuuagucacauaauuaucuuugauaaagguagaggcacaaagaggcaaacuaagcaagucaa

SEQ ID NO: 324018 - RNA, 64 nt, Human
gccccugcccaggugugggugguucuggccaggaaggcacaagguagcugugggccaagacacc

SEQ ID NO: 324019 - RNA, 64 nt, Human
ccacgccaggaggaggacacggccgccgagagcaaggcacaaccucgaguucuuggggcgcaga

SEQ ID NO: 324020 - RNA, 64 nt, Human
gggggcguggacccgucuuguaccagcuggccacaggcacaagggcugcagcugcuucuuccag

SEQ ID NO: 324021 - RNA, 64 nt, Human
agcccagccaagacuucaguguugacugcuuuggaggcacaaacccaugcaagcguuaguucca

SEQ ID NO: 324022 - RNA, 64 nt, Human
uucccacuucagccucccaaagugcagggauuacaggcacaagccaccgugcccagccaagaau

SEQ ID NO: 324023 - RNA, 64 nt, Human
caugugccuguaaucccagcuucuugggaagcugaggcacaagaauugccugaacccaggaggu

SEQ ID NO: 324024 - RNA, 64 nt, Human
uccuuaagauuaugcuccagugggagacccugguaggcacaaagcuugugccuugacuggaccc

SEQ ID NO: 324025 - RNA, 64 nt, Human
cuuuaaaacauuuuuaaugaacuaaguugaauaaaggcacaauuaaaaacugucaucaaagccc

SEQ ID NO: 324026 - RNA, 64 nt, Human
aaccuagaaaauacugaucuaaaugcaagaagccaggcacaaaaggccacauaguauauguucc

SEQ ID NO: 324027 - RNA, 64 nt, Human
guacuuaauuuacuuaaguguucauuuuaaguaacgugcucacuguguauaggaauuuguauuu

SEQ ID NO: 324028 - RNA, 64 nt, Human
gcaaguaccgggaggcugcccggcuagaaaucaacgugcucaaaaaaaucaaggagaaggacaa

SEQ ID NO: 324029 - RNA, 64 nt, Human
auggauuucagauuuuaaagagaggaaugcucuacgugcucagaacugaauuaaaauggcauua

SEQ ID NO: 324030 - RNA, 64 nt, Human
gccacagacaccccacaaaguuccccuguugugcaggcacaaauauuuccugaaauaaauguuu

SEQ ID NO: 324031 - RNA, 64 nt, Human
ugcucuucccgagacagggucccuuccccagcucaggcacaacagagucuggcaggcucuggca

SEQ ID NO: 324032 - RNA, 64 nt, Human
uaaaccaaggagucucuggacaagaagcugggagaggcacaaacuggacaucucucucucucau

SEQ ID NO: 324033 - RNA, 64 nt, Human
cuaacccucuuuuccuacaaaggagaaagauaaaaggcacaaagguuaccgccaaggcccguca

SEQ ID NO: 324034 - RNA, 64 nt, Human
uacacgucugucaucccagcagcucuuaaggcugaggcacaagaauugcuugaacccgggaggc

SEQ ID NO: 324035 - RNA, 64 nt, Human
acuuauaagugggagcugcgcuaugaagauacaaaggcacaagaaugauacaauggauuuuggg

SEQ ID NO: 324036 - RNA, 64 nt, Human
ucuuaccggugccagucaguacuccagggaugggaggcacaaguugugauugggcaaaguuuau

SEQ ID NO: 324037 - RNA, 64 nt, Human
cacaccugccugaugcuaucaagaggcugaagaaaggcacaaaaugugcuauuuuuggucacuu

SEQ ID NO: 324038 - RNA, 64 nt, Human
gaucauguccugaugccauggaaugacugaagacaggcacaaaaugugacaucuuuggucauuu

SEQ ID NO: 324039 - RNA, 64 nt, Human
aaacaacuguguauuggauuuuguaauuuaacuaaggcacaauggacuuguuuaaaauauuuua

SEQ ID NO: 324040 - RNA, 64 nt, Human
cuccugccuuagccuccugaguaacugagauuacaggcacaagcugcugcacccagcucuguag

SEQ ID NO: 324041 - RNA, 64 nt, Human
cucccgccuuggccucccaaagugcugggauuauaggcacaagacaccacaauaauuauugccu

SEQ ID NO: 324042 - RNA, 64 nt, Human
ucagggagugauuaguccuggggaaauucaguggaggcacaagccugaagcacucuucuaccaa

SEQ ID NO: 324043 - RNA, 64 nt, Human
cuguuaaacaguaguuguauucuucuguauuucuaggcacaagguugguugcuaagaagccuau

SEQ ID NO: 324044 - RNA, 64 nt, Human
guucuaguggccaugugaagaauggaaccaagggaggcacaauuagaggcagagggaaaccagg

SEQ ID NO: 324045 - RNA, 64 nt, Human
cuccaggccugguccacggacuggcagggaccccaggcacaagagcugccaccccucugcccgg

SEQ ID NO: 324046 - RNA, 64 nt, Human; identical to SEQ ID NO: 83268

SEQ ID NO: 324047 - RNA, 64 nt, Human; identical to SEQ ID NO: 83269

SEQ ID NO: 324048 - RNA, 64 nt, Human; identical to SEQ ID NO: 83270

SEQ ID NO: 324049 - RNA, 64 nt, Human
uguuacacgcagucaucagaccucacccucacagaggcacaaacccacauaguuguggacgccu

SEQ ID NO: 324050 - RNA, 64 nt, Human
ugaggccagcaucauucuaauaccaaaaccugacaggcacaaugaaaaaagaaaacuucaggcu

SEQ ID NO: 324051 - RNA, 64 nt, Human
gccuuaugaguguagugaaugugggaaauucuuuaggcacaacucaaaucauauuagacaucgg

SEQ ID NO: 324052 - RNA, 64 nt, Human
ccccacuggcagccgcuggugucucuucacacagaggcacaaccuggacccaggcagccucuuu

SEQ ID NO: 324053 - RNA, 64 nt, Human
cuggcuuguuaucugcaacaggaacauguccuuaaggcacaaaucacucaugguauuguuugug

SEQ ID NO: 324054 - RNA, 64 nt, Human
cuggcuuguuaucugcaacaggaauauguccuuaaggcacaaaucacucaugcuauuguuugug

SEQ ID NO: 324055 - RNA, 64 nt, Human
guguagacagcccucccccaaccccaggccagucaggcacaauccccccaccccccaaacgucc

SEQ ID NO: 324056 - RNA, 64 nt, Human
guuaggucuuuaucaaguuauaaaauauguugaaaggcacaaaagaacaccugaaaaaugauau

SEQ ID NO: 324057 - RNA, 64 nt, Human
ccaucaucuccaggugccccacgccuggggguggaggcacaaccucuccccuaacccugcuccc

SEQ ID NO: 324058 - RNA, 64 nt, Human
ugugcaccuuuaguuccagcuacuugagaggcugaggcacaagagucgcuuaaaccugggaggu

SEQ ID NO: 324059 - RNA, 64 nt, Human
auauaagagcacguuguaaacuugaaagagacaaaggcacaaauguggcuguugauuaauuuga

SEQ ID NO: 324060 - RNA, 64 nt, Human
cgacagccuuuaguuuuccugaaaucaccaggucaggcacaaggagaaaagguuccuggauacu

SEQ ID NO: 324061 - RNA, 64 nt, Human
ucuuuguuuuuguuuaaauauauuuuuaagauaaaggcacaaaaauaaaagaagcguauuacug

SEQ ID NO: 324062 - RNA, 64 nt, Human
ccccucaccuuccacagucaggcagggaaguuauaggcacaaagcuacgucuggaaccccuuug

SEQ ID NO: 324063 - RNA, 64 nt, Human
caucaagagggugguccugaagacuccggccaagaggcacaagcagcucaguaugccagcccca

SEQ ID NO: 324064 - RNA, 64 nt, Human
gcacacaccuguaaucccagcuacucggaggcugaggcacaagaauugcuugaaccugggaggc

SEQ ID NO: 324065 - RNA, 64 nt, Human
aggacugccggucacacaccagcacgucccaccucgugcucacggauuuuauuacacagauagu

SEQ ID NO: 324066 - RNA, 64 nt, Human
uaagguugucuacgggggcacuuggaggaccuggcgugcucagacccaacagcaaaggaacuag

SEQ ID NO: 324067 - RNA, 64 nt, Human
agcuguugcggguuugcuccuuuuucuugcuuugcgugcucaguuuuuacagacuguaaaggag

SEQ ID NO: 324068 - RNA, 64 nt, Human
ucaucuacuguggucagaucaagaaagguaugagaggcacaaccuuggaggguaccaagguugc

SEQ ID NO: 324069 - RNA, 64 nt, Human
cuuggaaagcacugguuuagggacuuagagagguaggcacaaggugggucuccuggguaaggga

SEQ ID NO: 324070 - RNA, 64 nt, Human
aggcugaaagacuguuguaccaguaaaaacuuaaaggcacaaauucuccuugaagaccuucucc

SEQ ID NO: 324071 - RNA, 64 nt, Human
agcuaauugaucugucacacucaggcucaugggcaggcacaagaaggggaauaaaggggcugug

SEQ ID NO: 324072 - RNA, 64 nt, Human
caagacuuggggguggcaaguaaggcuuugccucaggcacaaaauuuaagggggcuccaaaaaa

SEQ ID NO: 324073 - RNA, 64 nt, Human
cacacgccugugugcugugagccccccacucugccgugcucacacagacacacccagcugcaca

SEQ ID NO: 324074 - RNA, 64 nt, Human
cucccaaagugcugagacuacaggugugagccaccgugcucagccacuagcuuugguuuuuuaa

SEQ ID NO: 324075 - RNA, 64 nt, Human
agcuaggcccuuccgcccccgcccugggcgccgccgugcucaugcugccgugacaacaggccac

SEQ ID NO: 324076 - RNA, 64 nt, Human
ggcgaagacaccuucccugcccugguuuggcugacgugcucagcaaaaccccaugugcccugcu

SEQ ID NO: 324077 - RNA, 64 nt, Human
uuggcagcucuuuucuucugcucagacccuuccccgugcucagacagugcaccgcugucccauc

SEQ ID NO: 324078 - RNA, 64 nt, Human
uuucaaaaucauuaaaaccagguauggaagccuacgugcucacaguuaucuaaugagguuauuu

SEQ ID NO: 324079 - RNA, 64 nt, Human
ccaucauagucugggugccagcgcccugaagcuccgugcucaacugauuaaacuuuacugcccu

SEQ ID NO: 324080 - RNA, 64 nt, Human
gaucagaacauuccuucuuuacuggucacagccacgugcucauuccauucuucuuuuuguagac

SEQ ID NO: 324081 - RNA, 64 nt, Human
ggguucagacuugggggcagaaguucagacacaccgugcucaggagggacccagagccgaguuu

SEQ ID NO: 324082 - RNA, 64 nt, Human
gaauaauuucacugccuuaauguguucuggagagcgugcucacccaagucuauggacauguacc

SEQ ID NO: 324083 - RNA, 64 nt, Human
cacgauccuuguagacgcaccugcugagaauccccgugcucacaguagcuuccuagaccauuua

SEQ ID NO: 324084 - RNA, 64 nt, Human
uuuuuuuuggaaagcacaaacuucuguaacgggucgugcucaugucuguuaauaaagaaaucca

SEQ ID NO: 324085 - RNA, 64 nt, Human
ugcauuggcgcgaucucggcucaccgcaaaguccgccucccaggcgauucuccugccucagccu

SEQ ID NO: 324086 - RNA, 64 nt, Human
cucaaucuccugacccugcgaucugcccaccucagccucccaaagugcugggauuacaggcgua

SEQ ID NO: 324087 - RNA, 64 nt, Human
gaaaacgugcuggaacaaaauugcgaaggcuuuugccucccaguaaauagaaaggaaaauauau

SEQ ID NO: 324088 - RNA, 64 nt, Human
cucgaucuccugaccucgugauccaccugccucggccucccaaagugcugggauuacgggugug

SEQ ID NO: 324089 - RNA, 64 nt, Human
auccugaccugaaucuggucaguucucuagaucugccucccaauuuaaggaaaacauaagaaua

SEQ ID NO: 324090 - RNA, 64 nt, Human
uugaacuccugaccuugugauccaccccgccuuggccucccaaagugcugggauuacaggugug

SEQ ID NO: 324091 - RNA, 64 nt, Human
guuggccucgaacucaggugaucugccagccuccgccucccaacgugcugggauuacaggcaug

SEQ ID NO: 324092 - RNA, 64 nt, Human
cugcuuccuggguucaaacaauucucaugccucagccucccaagcagcugggacuacaggcaug

SEQ ID NO: 324093 - RNA, 64 nt, Human
gugucugcccaggagguuucuuucaaacaucauggccucccauccaaucaacaucaucaaauua

SEQ ID NO: 324094 - RNA, 64 nt, Human
ccaacuccugaccucagguaauccgccugccuuggccucccaaagugcugggauuacagacaug

SEQ ID NO: 324095 - RNA, 64 nt, Human
cucgaucuccugaccucgugauccacccgacucggccucccaaagugcugggauuacaggugua

SEQ ID NO: 324096 - RNA, 64 nt, Human
ccucugccucccggguucaagcaguucugccucagccucccaaguagcugugacuaaaggugca

SEQ ID NO: 324097 - RNA, 63 nt, Human
ucgaucuccugaccucaugauccacccgccucagccucccaaaguguugggauuacaggcgug

SEQ ID NO: 324098 - RNA, 64 nt, Human
cugccuccuggguucaagcgauucuccugccucugccucccaaguagcugggauuacaggcacc

SEQ ID NO: 324099 - RNA, 64 nt, Human
cuccaucuccugaccucgugauucacccgccucggccucccaaagugcugggauuacaggcgug

SEQ ID NO: 324100 - RNA, 64 nt, Human
acgccucccggguucaagugauucuccugccucagccucccaaguagcugggauuacaggcaug

SEQ ID NO: 324101 - RNA, 64 nt, Human
caaacuccugggcucaagugauccucccaccucugccucccaaagggcugggacugcaggugca

SEQ ID NO: 324102 - RNA, 64 nt, Human
cucgaacuccuggccuaaugaucugcccaccucugccucccaaagugcugggaucacaggcaug

SEQ ID NO: 324103 - RNA, 64 nt, Human
gucuaucucuugaccuugugauccacccgccucagccucccagagugcugggauuacaggugcg

SEQ ID NO: 324104 - RNA, 64 nt, Human
gcaccuacauccccaggucucuccacugcucucagccucccaaccccagggcccccacaggccc

SEQ ID NO: 324105 - RNA, 64 nt, Human
ccaccuuccugguucaagggauucuccugccucagccucccaaguagcugggauuacaggcaug

SEQ ID NO: 324106 - RNA, 64 nt, Human
cgaacuucugaccucaggugaucugcccaccucggccucccaaagugcugggauuacaggcgug

SEQ ID NO: 324107 - RNA, 64 nt, Human
caaacugcugacuucaggugauccacccgccucagccucccaaaguguugggauuacaggugug

SEQ ID NO: 324108 - RNA, 64 nt, Human
ugcagugguaugaucucggcucacuguaaccuccgccucccagguucaggugauucuccugccu

SEQ ID NO: 324109 - RNA, 64 nt, Human
cucgaacuccugaccucgugauccgccugccucagccucccaaagugcugggauuacaggcaug

SEQ ID NO: 324110 - RNA, 64 nt, Human
cuguggacagaugugcuuccugagcauggguugugccucccaucaguaaaaaaauguuuaguuc

SEQ ID NO: 324111 - RNA, 64 nt, Human
ggaacuccugggcucaagugauccuccugccuuggccucccaaaaugcugggauuacaggcaug

SEQ ID NO: 324112 - RNA, 64 nt, Human
ccgccucccggguucaagcaauucuccugccucagccucccaaguagcugggauuacagguguc

SEQ ID NO: 324113 - RNA, 64 nt, Human
cgaacuccugaccucaggugauccacccgccucagccucccaaagugcugggauuacaggcaaa

SEQ ID NO: 324114 - RNA, 64 nt, Human
cucgaacuccugaccuugugaugcucccaccucggccucccaaagugcugggauuaaagcugug

SEQ ID NO: 324115 - RNA, 64 nt, Human
cucgaucuccugaccucaugauccucccgccucagccucccaaaaugcugggauuacaggcgug

SEQ ID NO: 324116 - RNA, 64 nt, Human
cugccuccugggcucaacggauccuuccaccucagccucccaaguagcuuggacuauaggugca

SEQ ID NO: 324117 - RNA, 64 nt, Human
ugaacuccugggcucaagccauccucccuccucagccucccaaaauucugggauuacaggcaua

SEQ ID NO: 324118 - RNA, 64 nt, Human
ugcaguggcgcgaucucagcucacugcaaccuccgccucccagguucaagcgauucuccugccu

SEQ ID NO: 324119 - RNA, 64 nt, Human
gucuaucucuugaccucgugauccaccccacucagccucccaaauugcugggauuuacaggcau

SEQ ID NO: 324120 - RNA, 64 nt, Human
uuuaaacucuugaccucauguuccacccgccacggccucccaaagugcugugauuaccggugug

SEQ ID NO: 324121 - RNA, 64 nt, Human
uuaacuucugagcucaagagaugcacuccccucagccucccaaagugcugggauuacaggcggc

SEQ ID NO: 324122 - RNA, 64 nt, Human
caacugauguuuguuuuuuaaaggguaagaugcugccucccaaugggugaugccaucugacugg

SEQ ID NO: 324123 - RNA, 64 nt, Human
ccaccucccagguucaagugauucuccugucucagccucccaaguagcugggacuacaggcaug

SEQ ID NO: 324124 - RNA, 64 nt, Human
ggacucauccgauccuuaguggggcuguuugagagccucccaagagggccgggugagggaugag

SEQ ID NO: 324125 - RNA, 64 nt, Human
ccgccuccuggguucaagcaauucuccugccucagccucccaaguagcuuggacuacaggcccu

SEQ ID NO: 324126 - RNA, 64 nt, Human
gaggaccugagccagaugcacaccaucucugauggccucccaaaccaaugugccuguuucucuu

SEQ ID NO: 324127 - RNA, 64 nt, Human
uccugacaaggaggcagcauccagccuugaccaggccucccaguucccuggaaccguaucaggc

SEQ ID NO: 324128 - RNA, 64 nt, Human
cucgaucuccugaccucgugauccgcccgccuuggccucccaaggugcugggauuacaagcgug

SEQ ID NO: 324129 - RNA, 64 nt, Human
uggggccagccuggucucccaggccugaggacaugccucccaccaaauguccccugcuccaguc

SEQ ID NO: 324130 - RNA, 64 nt, Human
uaagugccgccugacccuuguacacuaggagcuggccucccaccucugcaggguuauucccugc

SEQ ID NO: 324131 - RNA, 64 nt, Human
agccuggcuggagagcugcuaugcuaaaccuccugccucccaauaccagcaggagguucugggc

SEQ ID NO: 324132 - RNA, 64 nt, Human
caaacuccugcgcucaagcaauccucccaccugggccucccaaaaugcuggguguacaggcaug

SEQ ID NO: 324133 - RNA, 64 nt, Human
cagccgugcggacaccacuccucucugcagcacugccucccagcgccagggucgcgggcacauc

SEQ ID NO: 324134 - RNA, 64 nt, Human
agugggcacccuggugcuucccagacccuguggagccucccagcaccaacuugcuuaauguguu

SEQ ID NO: 324135 - RNA, 64 nt, Human
aaccuauccacugaugagucuaacuguuccaaacgccucccaccuggugugcacagcugccugg

SEQ ID NO: 324136 - RNA, 64 nt, Human
uagcacuaaccuccacuuccuucucugccccauugccucccaaauaugcuauggagcuauuuuu

SEQ ID NO: 324137 - RNA, 64 nt, Human
uggacuccugguuucaagugauccucucaucuuggccucccaaagugcugggauuacagggacg

SEQ ID NO: 324138 - RNA, 64 nt, Human
ggucucgaacucgaccucgugauccgccgccucggccucccaaagugcuaggauuacaggcgug

SEQ ID NO: 324139 - RNA, 64 nt, Human
ugaccaaucaguggcccaaauuuuccagccccuugccucccagaaccccagcccagaacucuuc

SEQ ID NO: 324140 - RNA, 64 nt, Human
caaacuucugaucucaagugauccaucugccuuggccucccaaagugcugggauuacaggcaug

SEQ ID NO: 324141 - RNA, 64 nt, Human
caaccuccugaccucaagugaucugcccgccucagccucccaaagugcugggaugauaggcgug

SEQ ID NO: 324142 - RNA, 64 nt, Human
ugaacuccuggucucgagugaucuuccuaucucagccucccaaagugcugggacuacaggcaug

SEQ ID NO: 324143 - RNA, 64 nt, Human
ccaacuccugggcucaagcaauccugcugucucagccucccaaguaacuaagacuacaggcaug

SEQ ID NO: 324144 - RNA, 64 nt, Human
ugaacuccugaccucaagugaucuuccggccucagccucccaaagugcuggauuacaggcguga

SEQ ID NO: 324145 - RNA, 64 nt, Human
ucuuggcucauugcaaccucugccucccaggucagccucccaaguagcugggauuacaccacca

SEQ ID NO: 324146 - RNA, 64 nt, Human
ugcaguggcacuaucuuggcucauugcaaccucugccucccaggucagccucccaaguagcugg

SEQ ID NO: 324147 - RNA, 64 nt, Human
cuaacucccagguucaagcuauucuccugccucagccucccaaguagcuggauuacaggcauac

SEQ ID NO: 324148 - RNA, 64 nt, Human
ccgccucccagguucaagcgauucuccugccucagccucccaauuuacugggauuacaggcacc

SEQ ID NO: 324149 - RNA, 64 nt, Human
ugcaguggcacgaucucggcucacuacaaccuccgccucccagguucaagcgauucuccugccu

SEQ ID NO: 324150 - RNA, 64 nt, Human
ugaacuccugaccucaagugauucaccugccucggccucccaaagugcugggauuacaggcgug

SEQ ID NO: 324151 - RNA, 64 nt, Human
cuaccuccuggguucaagcaagucuccugucucagccucccaaguagcugggauuacaggcaug

SEQ ID NO: 324152 - RNA, 64 nt, Human
cgaacucgugaccgcaagcgauucacccaccucagccucccaaagugcugggauuaccggcuug

SEQ ID NO: 324153 - RNA, 64 nt, Human
gaacuuccugaccucagguuauccacccaccucagccucccaaagugcugggauuacaggugug

SEQ ID NO: 324154 - RNA, 64 nt, Human
ccaccuccuggguucaagugauucucgugccucagccucccaaguagcugggguuacaggcgcc

SEQ ID NO: 324155 - RNA, 64 nt, Human
cucaaucuccugaccucgugauccacccgccuuggccucccaaagugcugggauuacaggcgug

SEQ ID NO: 324156 - RNA, 64 nt, Human
uacaguggcgcgaucucagcucacugcaagcuccgccucccaaguucacuccauucuccugccu

SEQ ID NO: 324157 - RNA, 64 nt, Human
uugaacuccuggccucaagucauuccccaccuuagccucccaaaguguugggauuauaagcgug

SEQ ID NO: 324158 - RNA, 64 nt, Human
ugcaauggugcgaucucagcucacugcaaccuccgccucccaguucaagugauucuccugccuc

SEQ ID NO: 324159 - RNA, 64 nt, Human
gacuccuucguccccaguugccgucuaggauugggccucccauaauugcuuugccaaaauacca

SEQ ID NO: 324160 - RNA, 64 nt, Human
ugacccagugagauuacagaggaaguuauccucugccucccauucugaccacccuucucauucc

SEQ ID NO: 324161 - RNA, 64 nt, Human
caaacuccugaccucaggugauccacuugccucggccucccaaagugcugagauuacaagugug

SEQ ID NO: 324162 - RNA, 64 nt, Human
ccaccuccuggguucaagcgauucuucugccucagccucccaaguagcuaggauuacaagugcc

SEQ ID NO: 324163 - RNA, 64 nt, Human
ugaacucccgaccucaggugauccacccaccccggccucccaaaaugcugggaucacaggcgug

SEQ ID NO: 324164 - RNA, 64 nt, Human
cucaaacuccugaccucaugauuugccugccucggccucccaaagcacugggauuacaggcgug

SEQ ID NO: 324165 - RNA, 56 nt, Human
ggcuuuauuaugugaacuaaaacauggccucccacuggaagcaaggacuagauucc

SEQ ID NO: 324166 - RNA, 64 nt, Human
acaagauaggacauggccuggaccagggaggcaggccucccacucagagucugggucucacugg

SEQ ID NO: 324167 - RNA, 64 nt, Human
caaugccuugcuguggcccccaaccacugcuuaggccucccaacuucuccccaggccaaguaug

SEQ ID NO: 324168 - RNA, 64 nt, Human
gguggcuuggcgcucgugauugcuuccugugaacgccucccaaggacgagcccaguguaguugu

SEQ ID NO: 324169 - RNA, 64 nt, Human
gucuugaggguccauccuuuuucucuaauuggucgccucccaccagacucaccugcuuuucaac

SEQ ID NO: 324170 - RNA, 64 nt, Human
caaacuccuaggcucaggcgauccucuugcccuggccucccauguagcugcaacuauaggugug

SEQ ID NO: 324171 - RNA, 64 nt, Human
gaacuccugggcucagaugauccuccuguccucagccucccaaaaugcugggagccaccaggca

SEQ ID NO: 324172 - RNA, 64 nt, Human
ggaacuccuagccucaagcagucuucuugccucagccucccaaagugcugggauuacaggcgug

SEQ ID NO: 324173 - RNA, 64 nt, Human
ugaacuccugggcucaagcgauccucccaccucagccucccaaguagcugggacuacaggcacc

SEQ ID NO: 324174 - RNA, 64 nt, Human
cuugauguccugaccucgugauccaccggccucggccucccaaagugcugggauuaccggcgua

SEQ ID NO: 324175 - RNA, 64 nt, Human
guguccuugagaugcucacauuacugcccggccugccucccaccuggaagucugggaaugagga

SEQ ID NO: 324176 - RNA, 64 nt, Human
gaacuccuggccuccuugaacuccuccugccuuggccucccaaaaugcugagauuacaggugug

SEQ ID NO: 324177 - RNA, 64 nt, Human
uucacuggugugaucucagcucacugcaaccucugccucccagguucaagcacuucucguaccu

SEQ ID NO: 324178 - RNA, 64 nt, Human
gugaugcgauugaucauggcucacuguaaccucugccucccaggcucgauccucccaugucagc

SEQ ID NO: 324179 - RNA, 64 nt, Human
accucugccucccaggcucgauccucccaugucagccucccaaguagcugggacuacaugcaca

SEQ ID NO: 324180 - RNA, 64 nt, Human
cgcucucccgggcuccagugauccucccgccucagccucccaaguagcugggauuauaggugug

SEQ ID NO: 324181 - RNA, 64 nt, Human
acaacucauuccagaucccaggccccuggaggcugccucccaacaguggggaagagugacucuc

SEQ ID NO: 324182 - RNA, 64 nt, Human
ugaaauucugggcuaaagcaauccuaccaccuuggccucccaaagugcugagauuacaggcaug

SEQ ID NO: 324183 - RNA, 64 nt, Human
ugcagugaugcuaucucggcucacugcaaccuuugccucccagguucaagugauucuccugccu

SEQ ID NO: 324184 - RNA, 64 nt, Human
uugccucccagguucaagugauucuccugccucagccucccaaguagcugggauuacaggcgug

SEQ ID NO: 324185 - RNA, 64 nt, Human
cgaacucccgaccucaggugauccgccagccucagccucccaaagugcugggauuacaggcgug

SEQ ID NO: 324186 - RNA, 64 nt, Human
uggguccagcagagggaguggaggaagggccacugccucccaccuagagcuucuccgaaugaca

SEQ ID NO: 324187 - RNA, 64 nt, Human
cauaggggagcuggugaggagugagguggcucuggccucccaugucagguagggugagagaggc

SEQ ID NO: 324188 - RNA, 64 nt, Human
ugaacuccugaacucaagugauccgcccaccucagccucccaaaguguugggauuacagacauu

SEQ ID NO: 324189 - RNA, 64 nt, Human
caaccuucccagcucaagugauccuccuaccucagccucccaaguaguugggaccacaggugug

SEQ ID NO: 324190 - RNA, 64 nt, Human
cagacugcugggcucaagcgauccucacaccucagccucccagagugcugggauuacaguugug

SEQ ID NO: 324191 - RNA, 64 nt, Human
caaauuccugaccucaagugauccaccugccuuagccucccaaagugcugggauuacaggcaug

SEQ ID NO: 324192 - RNA, 64 nt, Human
ugcaguggugcgaucuuggcucauggcaaccucugccucccagguucaagcgauuguccugccu

SEQ ID NO: 324193 - RNA, 64 nt, Human
cucgaucucuugaccuuguguuccacccgccuuggccucccaaagugcuggaauuacaggcaug

SEQ ID NO: 324194 - RNA, 64 nt, Human
aggaaucauuagaccagguuguaaagaugucuuggccucccagacagucuuuggaccacuauuu

SEQ ID NO: 324195 - RNA, 64 nt, Human
cugccuccuggauucaagcgauucuccugucccagccucccagguagcugggacuauaggcacg

SEQ ID NO: 324196 - RNA, 64 nt, Human
cuagaucuccugaccuugugaucugccugccucggccucccaaagugcugggauuacaggcgug

SEQ ID NO: 324197 - RNA, 64 nt, Human
ucaacuccugaccucaggugguccacccgccucagccucccaaagugcugggauuacaggugug

SEQ ID NO: 324198 - RNA, 64 nt, Human
ucaaaucuuggucucgagcaaugcuaccaccuuggccucccaaugcucugggauuacagacaug

SEQ ID NO: 324199 - RNA, 64 nt, Human
cuggcuuuccggucauggguuccaguuaauucaugccucccauggaccuauggagagcagcaag

SEQ ID NO: 324200 - RNA, 64 nt, Human
cugacuccaggguucaggugauuauuuugccucagccucccaagcagcugggauuauagacacc

SEQ ID NO: 324201 - RNA, 64 nt, Human
ugaacuccugaccucaggugauccgcccgccucggccucccaaagugcugggauuacagacgug

SEQ ID NO: 324202 - RNA, 64 nt, Human
aggugucuugaaagaauucuacaaauaccacacagccucccaccaguaauugaaugugcuacac

SEQ ID NO: 324203 - RNA, 64 nt, Human
ugcaguggccccaucucggcucacugcaaccuccgccucccagguucaagcgauucuccugcag

SEQ ID NO: 324204 - RNA, 64 nt, Human
ugaacuccuggccucaagcgauccgccuaccucagccucccaaagugcuaggauuacaggcaua

SEQ ID NO: 324205 - RNA, 64 nt, Human
ccuccuccuggauucaagcaauucucuugcuucagccucccaaguagcugagacuacaagcacc

SEQ ID NO: 324206 - RNA, 64 nt, Human
gucgaucuccugaccucgugauccacccgccucggccucccaaagugcugggauuacaggcuug

SEQ ID NO: 324207 - RNA, 64 nt, Human
caaacuccugaccucaggugauccaccugccucggccucccaaagugcagggcuuacaggugug

SEQ ID NO: 324208 - RNA, 64 nt, Human
aauaaugaguggcagcuggcgccagggaacgauggccucccaauagauaggaaacaccugaagc

SEQ ID NO: 324209 - RNA, 64 nt, Human
gcagggcuggagggaaggagccaggagggagagagccucccaccuuuccccugcugcggaugcu

SEQ ID NO: 324210 - RNA, 64 nt, Human
caaacuccugaguucaagcaauccaccuuccucggccucccaaaguacuaggaguacaggcaua

SEQ ID NO: 324211 - RNA, 64 nt, Human
caacgucccccgcucaggugguccuuccaccucagccucccaaguagcugggaccacaagugug

SEQ ID NO: 324212 - RNA, 64 nt, Human
cgagcuccugaccucaggugaucuacccaccucggccucccaaagugcugggauuacaggcgug

SEQ ID NO: 324213 - RNA, 64 nt, Human
ugcaauggugcaaucucagcucacugcaaccucugccucccagguucaggugauucuccugccu

SEQ ID NO: 324214 - RNA, 64 nt, Human
cucgaacuccugaccuugugaucugcccaccuuggccucccaaaguucagggauuacaggcaug

SEQ ID NO: 324215 - RNA, 64 nt, Human
ugcaauggcacgaucucggcucacugcaaccuccgccucccagguucaagugauucuccugucu

SEQ ID NO: 324216 - RNA, 64 nt, Human
ucaacuuuagugcuccccuuuaccuaacccuacggccucccaugcaucuguacucccccugugu

SEQ ID NO: 324217 - RNA, 64 nt, Human
gggaacucccccagagguggauacuggggggcaggccucccaagcugauggacaugagaguagg

SEQ ID NO: 324218 - RNA, 64 nt, Human
cucgaucuccugaccuugugaucugcccgccucggccucccaaagugcugggauuacaggcgug

SEQ ID NO: 324219 - RNA, 64 nt, Human
cucgaucuccuaaccuggugauccgcccgccucggccucccaaaguauugggauuacccgcgug

SEQ ID NO: 324220 - RNA, 64 nt, Human
ccgccucucggguucacgccauucuccugccucagccucccaaguagcucggacuacaggcguc

SEQ ID NO: 324221 - RNA, 64 nt, Human
ugaauuccugaccucaggugaucugcccaccucagccucccaaagugcugggauuacaggcgug

SEQ ID NO: 324222 - RNA, 64 nt, Human
aggcaguccaggccucucucugcuccaucccccugccucccauucugcaccacaccuggcaugg

SEQ ID NO: 324223 - RNA, 64 nt, Human
caggauuacagccauugcuugggaaggcugggaggccucccauccaggacacugggggcaggag

SEQ ID NO: 324224 - RNA, 64 nt, Human
ucggacggugccagggccgcccgcguccucgccagccucccagcagcaggcgcgcccuuccggc

SEQ ID NO: 324225 - RNA, 64 nt, Human
ccucuggccagggacccaaugucccgaggaaucugccucccacccacugacucagggcucagac

SEQ ID NO: 324226 - RNA, 64 nt, Human
cugccuaccggguucaagagauuccccugccucagccucccaaguagcuggaauuacagacacc

SEQ ID NO: 324227 - RNA, 64 nt, Human
uuuuuuccuguguuaguucaaagaaucucuucuugccucccauugcugauuuucuguauugaug

SEQ ID NO: 324228 - RNA, 64 nt, Human
ugcaguggcgcgaucuuagcucucugcaaccucugccucccagguucaagccuccugaguaacu

SEQ ID NO: 324229 - RNA, 64 nt, Human
gccaaccagccacuggcuuuccugcccaggcuuggccucccaggacaucuggccugaggggauu

SEQ ID NO: 324230 - RNA, 62 nt, Human
ccaggaaagauuauaccuagugacucggcucugccucccaguccgcacaccucucccaucca

SEQ ID NO: 324231 - RNA, 64 nt, Human
agacuauuuuuaaacacacaccucuaaggaagaagccucccauauagacuugaucucaaagaag

SEQ ID NO: 324232 - RNA, 64 nt, Human
cucgaucuccugaccucgugauccgcccaccuuggccucccagagugcugggauuacaggcgug

SEQ ID NO: 324233 - RNA, 64 nt, Human
cgaacuccugaccucaggugauccgccugccucggccucccaaagugcugggauuagaggcuug

SEQ ID NO: 324234 - RNA, 64 nt, Human
ugaacuccugaguucaagagauccuccugccuuagccucccaaagugcugggauuacaagcaua

SEQ ID NO: 324235 - RNA, 64 nt, Human
cuggauuuacagaacauuagcacauguaccuugugccucccauucaagugaaguuauaauuuac

SEQ ID NO: 324236 - RNA, 64 nt, Human
ucggcccacgggagggcaggcuccggggcccgcagccucccacgcugucugagagaucucagac

SEQ ID NO: 324237 - RNA, 64 nt, Human
cgaacuccugaccacagguaaucagcccgccucggccucccaaagugcugggauuacaggcgug

SEQ ID NO: 324238 - RNA, 64 nt, Human
ggucuugaacugaccucaugauccaccugccucagccucccaaaaugcugggauuacaggcuug

SEQ ID NO: 324239 - RNA, 64 nt, Human
caaacuccugggcucaagagauccuuuugcuucagccucccaagcagcuaggacuacaggcaca

SEQ ID NO: 324240 - RNA, 64 nt, Human
caaacuccugaccucaggugguccuucugccuuggccucccaaagugcugggauuacaggcgug

SEQ ID NO: 324241 - RNA, 64 nt, Human
cucgaucuccugaccucgugaucugcccgccucagccucccaaagugcugggauuacaggagug

SEQ ID NO: 324242 - RNA, 64 nt, Human
gcuguaagcagccuucgacaccuguccugccacggccucccagccggugcgggagccccucacu

SEQ ID NO: 324243 - RNA, 64 nt, Human
acguagggaggggcugggggucaguccagcccgggccucccagaacaccaggcccgugugggug

SEQ ID NO: 324244 - RNA, 64 nt, Human
cucgaucuccugaccuggugauccacccaccuuggccucccaaagugcugggauuacaggcgug

SEQ ID NO: 324245 - RNA, 64 nt, Human
gucucaaucucgaccucgugauccgcccaccuuggccucccaaaguguugggauuacaggcgug

SEQ ID NO: 324246 - RNA, 64 nt, Human
caaacucuugaccucagcugaugcgccugccuuggccucccaaacugcugagauuacagaugug

SEQ ID NO: 324247 - RNA, 64 nt, Human
cgaacgccugaccucgugugauccgcccuccucagccucccaaagugcugggauuacaggcaug

SEQ ID NO: 324248 - RNA, 64 nt, Human
ugcaauggcgugaucucagcucaccgcaaccucugccucccagauucaagcaauucuccugccu

SEQ ID NO: 324249 - RNA, 64 nt, Human
caaacucccaaccucaggugauaugcccgccucggccucccaaaauguugggauuacaggcaug

SEQ ID NO: 324250 - RNA, 64 nt, Human
ccgccucucagguucaagcaauucuccugccuccgccucccaaguagcugggauuacaggcaug

SEQ ID NO: 324251 - RNA, 64 nt, Human
gcgucccucagugccccgugcacccgcggccgcggccucccaggcagugcucaugcgcuggccg

SEQ ID NO: 324252 - RNA, 64 nt, Human
gagcugcugggcugcggcuguggggcugggggccgccucccaggcuggcccaaggggagugccu

SEQ ID NO: 324253 - RNA, 64 nt, Human
uuuuuuuuuuauuuugagcaauucuccugccucagccucccaaauagcugggauuacaggugca

SEQ ID NO: 324254 - RNA, 64 nt, Human
caaacuccugaccucagaugauccgccugccuuggccucccaaagugcugggauuacaggugug

SEQ ID NO: 324255 - RNA, 64 nt, Human
caaacuccuggacucaagaaauccacccaccucagccucccaaagugcuaggauuacaggcaug

SEQ ID NO: 324256 - RNA, 64 nt, Human
uguguuaucaaccauuaagaagaaagaaccacaagccucccaaguauuuggguucuaucuuagg

SEQ ID NO: 324257 - RNA, 64 nt, Human
ucaggcggaggugaccaugcccuucaccaaagcugccucccaguggccacacagaacucucccu

SEQ ID NO: 324258 - RNA, 64 nt, Human
ggcagaugaaugucuugaaagcucccgggccucagccucccaucuccucuccuucccaggaauc

SEQ ID NO: 324259 - RNA, 64 nt, Human
caaacucccaaccucaggugaucugcccuccuuggccucccagagugcugggauuacaggugug

SEQ ID NO: 324260 - RNA, 64 nt, Human
auuuggccugccuuuucccuuccuauuucacuuugccucccaucacacaacugcguguaaaugg

SEQ ID NO: 324261 - RNA, 64 nt, Human
uuguguuagucucaauuccuaccacacugagggagccucccaaauaacuauuuucuuaucugca

SEQ ID NO: 324262 - RNA, 64 nt, Human
cuugaucuccugaccucaugauccacccaccucagccucccaaaguguugggauuacaggcgug

SEQ ID NO: 324263 - RNA, 64 nt, Human
gcuagagucugagccucaggcucuccugcccugggccucccaauuggugcuaucuguuacugcc

SEQ ID NO: 324264 - RNA, 64 nt, Human
uccucuucccaccuccuccuggcuauguucugcagccucccagaguagaaaacuacuuuguuac

SEQ ID NO: 324265 - RNA, 64 nt, Human
ccuggcuggccagcugcucagggcucaggcuggggccucccauugacauccucccccuacacuc

SEQ ID NO: 324266 - RNA, 64 nt, Human
agcuuccucuggccuggcgcaggccguuccaucugccucccaggucugcgucccuaaccccuuc

SEQ ID NO: 324267 - RNA, 64 nt, Human
ugaacuccugaccucaggugauacacccaucucggccucccaaagugcugggauuacaggcuug

SEQ ID NO: 324268 - RNA, 64 nt, Human
auacaggcuggccucaagugauccucuuaccuuggccucccaaacaccgggauuauaggcguga

SEQ ID NO: 324269 - RNA, 64 nt, Human
cgaacucuugaccucaggugaucugcccaccucggccucccaaagugcugggauuacagaugug

SEQ ID NO: 324270 - RNA, 64 nt, Human
ugaacucccgacgucaggugaucuaccugccucggccucccaaagugcugggauuacaggcgug

SEQ ID NO: 324271 - RNA, 64 nt, Human
cuuggacuccugaccucgugauccacccaccuuggccucccaaaguucuaggauuacaggugug

SEQ ID NO: 324272 - RNA, 64 nt, Human
ucccuuaccucgugaagaggggaagucucuuccugccucccaagcagcugaagggugacuaaac

SEQ ID NO: 324273 - RNA, 64 nt, Human
gucucaaucucgaccucgugauccgcccaccucggccucccaaaguguugggauuacaggcaug

SEQ ID NO: 324274 - RNA, 64 nt, Human
cuugaucuccugaccuugugauccgccugccucagccucccaaagugcugggauuacaggcuug

SEQ ID NO: 324275 - RNA, 64 nt, Human
ugcaguggcgcggucucggcucacugcaagcucugccucccagguucacgccauucuccugccu

SEQ ID NO: 324276 - RNA, 64 nt, Human
auuggagggggagcagggcagugcugugucugcugccucccaugcccguucugaccucagccuu

SEQ ID NO: 324277 - RNA, 64 nt, Human
ucgaacugccgaccucaggcugucugcccguccagccucccaaagugcugggauugcaggcaug

SEQ ID NO: 324278 - RNA, 64 nt, Human
uguuauccugguucucaccaggaggugucgcacugccucccacccugugucugcuuccgaauaa

SEQ ID NO: 324279 - RNA, 64 nt, Human
cuugaacuccugaccucgugauccacccgccuuggccucccaaagugcugggauuacaggcaug

SEQ ID NO: 324280 - RNA, 64 nt, Human
ucugccucccggguucaagcaauucucugccucagccucccaaguaguugggauuacaggcacc

SEQ ID NO: 324281 - RNA, 64 nt, Human
uuucuaagcacuuguaagaacccaguggguuggagccucccacuuugucccuccuuugaagugg

SEQ ID NO: 324282 - RNA, 64 nt, Human
ugaacuccucaccucaggugauccacaugacucugccucccaaagugcugccauuacaggcgug

SEQ ID NO: 324283 - RNA, 64 nt, Human
ugcaguggcaugaucucggcucacugcaaccucugccucccagguucaagcgauucuccugccu

SEQ ID NO: 324284 - RNA, 64 nt, Human
acucacacuggacagggcaggaggagggggccgugccucccacccuucucagggacccccacgc

SEQ ID NO: 324285 - RNA, 64 nt, Human
auugugugaagugugucugucuccagcccuucgggccucccacgagccccuccagccucuccaa

SEQ ID NO: 324286 - RNA, 64 nt, Human
gcaaauggcuugaucuugguucacugcaaccucugccucccagguucaagcaauucucuugccu

SEQ ID NO: 324287 - RNA, 64 nt, Human
ugcaguggcgggaucucggcucacugcaagcuccgccucccagguucacgccauucuccugccu

SEQ ID NO: 324288 - RNA, 64 nt, Human
cuggcuucuccuguagggcaccucccugccccuagccucccaggaaauggugcucuccuggccc

SEQ ID NO: 324289 - RNA, 64 nt, Human
uaaggaguccuucuacagaauaggucagaucuuggccucccaaaccccuuauuuuuaaaauacu

SEQ ID NO: 324290 - RNA, 64 nt, Human
caaacuccugagcucaggcaaucugcccgccuuggccucccaaagugcuaggauuacagguaug

SEQ ID NO: 324291 - RNA, 64 nt, Human
cgaacuccugaccucaagugauccacccaccucggccucccaaagugcuaggauuacaggcccg

SEQ ID NO: 324292 - RNA, 64 nt, Human
cugccucuuggguucaagugauucuuccaccucagccucccagguagcugggauuacaggcacc

SEQ ID NO: 324293 - RNA, 64 nt, Human
uuaaaaaaagggggugauucugaggcacugaagugccucccagauguggaggagugaagccacc

SEQ ID NO: 324294 - RNA, 64 nt, Human
gaccaccgggugacauccgucccacaucagggcggccucccaggucccauaaggguagcccccu

SEQ ID NO: 324295 - RNA, 64 nt, Human
cucgaucuccugaccucgugaugggcccgccucggccucccaaagugcugggauuaaggcguga

SEQ ID NO: 324296 - RNA, 64 nt, Human
ccgccucccggguucacgccauucuccugccucagccucccauagcugggacuacaggcgcccg

SEQ ID NO: 324297 - RNA, 64 nt, Human
gcuuugaaugcuggaaauggcuucauagugaagugccucccacagggcgggugggucagcguug

SEQ ID NO: 324298 - RNA, 64 nt, Human
cugacuccugacuaaaagugaucugcccaccucggccucccaaaguucugggauuacgggcgug

SEQ ID NO: 324299 - RNA, 64 nt, Human
ugucacccugaucucaggccaccagccucugccggccucccagccgggcuccugaagcccgcug

SEQ ID NO: 324300 - RNA, 64 nt, Human
ccuccaccucccaggcucaagagauccucccacagccucccagguagcugggacuacaggcgug

SEQ ID NO: 324301 - RNA, 64 nt, Human
uacuccuagcuaguaaggaauggaucuacagccugccucccagguuucuggcuuguggggggca

SEQ ID NO: 324302 - RNA, 64 nt, Human
cucuggguuugagagcccuagagucaaagggaaagccucccagccuccagggcuucucugugug

SEQ ID NO: 324303 - RNA, 64 nt, Human
ugcaguggcgcaauuucagcucacugcaaccucugccucccagguucaagugauucuccugccu

SEQ ID NO: 324304 - RNA, 64 nt, Human
cuccaacuccugacuucaugauccacccaccucggccucccaaagugcugagauuacagacgug

SEQ ID NO: 324305 - RNA, 64 nt, Human
ugcaguagcacaaucacggcucacugcaaucucugccucccaguuucaagugauucugcugucu

SEQ ID NO: 324306 - RNA, 64 nt, Human
cugccucccaguuucaagugauucugcugucucagccucccaaguagcugggacuacaggcaug

SEQ ID NO: 324307 - RNA, 64 nt, Human
cuccaucucuugacauugugauccaccugccucggccucccaaagugcugggauuacaggcaug

SEQ ID NO: 324308 - RNA, 64 nt, Human
auuccugggcuccagggauccacagucccccuuggccucccaaaguguugggauuacaugcaug

SEQ ID NO: 324309 - RNA, 64 nt, Human
cuugaacuccugagcucaugauccacccgccucagccucccaaagugcugggauuacaggcccc

SEQ ID NO: 324310 - RNA, 64 nt, Human
agcucacugccugggcucaagugaucuuacuccagccucccaagcagcugggacuacaccacca

SEQ ID NO: 324311 - RNA, 64 nt, Human
cgaacuccugagcucaagggauccucccgccucagccucccaaagugcugguguuacaggcaua

SEQ ID NO: 324312 - RNA, 58 nt, Human
uggaggaguuagagugcugagcuccugggccucccagcccuccaguggccugugggug

SEQ ID NO: 324313 - RNA, 64 nt, Human
ggagauaucaucucuccugcaggaaggaaguccugccucccacugauccacucagcgcacagcc

SEQ ID NO: 324314 - RNA, 64 nt, Human
ugcgguggcgcugucucagcucacugcaaccuccgccucccagguucaagugauucuccugccu

SEQ ID NO: 324315 - RNA, 64 nt, Human
caaacuccuaaccucaacugauccaccugccucagccucccaaagugccgccgggauuacaggc

SEQ ID NO: 324316 - RNA, 64 nt, Human
gccauuucccuguuguccugaggaggaacuccaggccucccaucgugugcccuaaggccuccug

SEQ ID NO: 324317 - RNA, 64 nt, Human
gugugcccuaaggccuccugcguccuggagcccugccucccacugccugacuuccugccacacg

SEQ ID NO: 324318 - RNA, 64 nt, Human
gaaaaccacugcaagccccaaggagccagcugaagccucccaauccccagggcacugcagaguc

SEQ ID NO: 324319 - RNA, 64 nt, Human
uucuucggccuuuggacucaggcuugccacagaggccucccagggcucucggccagucagccuc

SEQ ID NO: 324320 - RNA, 64 nt, Human
ccaacuccugagcucaagcgaucugcccaucucggccucccaaagugcugggauuacaggcgug

SEQ ID NO: 324321 - RNA, 64 nt, Human
caaacuuguggccucaagcaauccaccugccuuggccucccaaagugcugagauugcagaugug

SEQ ID NO: 324322 - RNA, 64 nt, Human
cgaacuccugaccucaagugauccacucaccucggccucccaaagugcugggauuacaggugug

SEQ ID NO: 324323 - RNA, 64 nt, Human
ugcaguggugcaaucucagcucacugcaaccuccgccucccagguucaagcgauuucgugccuc

SEQ ID NO: 324324 - RNA, 64 nt, Human
ggaaccccuaggcucaaaugaugugcccaacucggccucccaaagugcugggauuacaggcaug

SEQ ID NO: 324325 - RNA, 64 nt, Human
cccaggcucaggcucaggugauccucacaccuuagccucccaaguaccugggacuacaggcacg

SEQ ID NO: 324326 - RNA, 64 nt, Human
aguuucccgcaaagugccucugggggaccccccagccucccacccuggucccagguuccacaag

SEQ ID NO: 324327 - RNA, 64 nt, Human
ccaggauguccuggcucacuccgcaagccccccagccucccacccuggucccaguuucccgcaa

SEQ ID NO: 324328 - RNA, 64 nt, Human
ucucucacuuucuuuaguugugccuugcccuaucgccucccauuuucccuucaaaguagaaugu

SEQ ID NO: 324329 - RNA, 64 nt, Human
uacaagaauauggcauuuaugaucauguucuuuugccucccauagccucuugcuuuucuacguu

SEQ ID NO: 324330 - RNA, 64 nt, Human
cucaaucuccugaccuugugauccgccugccuuggccucccaaagugcugggauuacaggcgug

SEQ ID NO: 324331 - RNA, 64 nt, Human
ucacuuuuaagauaaaugcacuauuucacuguucgccucccauucuaaggaggugaggugguug

SEQ ID NO: 324332 - RNA, 64 nt, Human
cccggcauccgcagagccagcugacgcccucccugccucccagggcagcuggccagccucgggc

SEQ ID NO: 324333 - RNA, 64 nt, Human
agguuuucggcccagugaagaggccacuggccaggccucccaggcagguguuuuauguucagca

SEQ ID NO: 324334 - RNA, 64 nt, Human
agggguuggggggugggugugggggagccguuaggccucccagguccuuaggaucaggguugcc

SEQ ID NO: 324335 - RNA, 64 nt, Human
cucgaucuccugaccucgugauccgcccaccucggccucccaaaucgcuagaauggccggcgug

SEQ ID NO: 324336 - RNA, 64 nt, Human
ugcaauggcgcgaucuuggcucaccauaaccuccgccucccagguucaagcaauucuccugccu

SEQ ID NO: 324337 - RNA, 64 nt, Human
caaacuccugaccucaggugaucugcccgccucagccucccaaagugcuggaauuacaggcgug

SEQ ID NO: 324338 - RNA, 64 nt, Human
aauaacuaguuaaaugaaauuuuagcuacacacugccucccaaauauuaguugugccugguucu

SEQ ID NO: 324339 - RNA, 64 nt, Human
ugcaguggugugaucucgucucacugcaaccuccgccucccagauucaagcgauucuccugucu

SEQ ID NO: 324340 - RNA, 64 nt, Human
ugaacuccugaccucaggugauccacccgccucagccucccaaagugcugggauuacagguggg

SEQ ID NO: 324341 - RNA, 64 nt, Human
ugaaaccacuacugaggguaauuuacuagcuguggccucccacuaacuagcauuccuuuaaaga

SEQ ID NO: 324342 - RNA, 64 nt, Human
cgcucaggacccccggagccccgcgaaaacaucugccucccaggagggugccgagcugccucac

SEQ ID NO: 324343 - RNA, 64 nt, Human
ucuucugucuuccauaguuauuacaacuaugagagccucccaagucaucuuaucaacucaacuc

SEQ ID NO: 324344 - RNA, 64 nt, Human
ccgccaccuagguucaagugauucucaugccucagccucccaaguagcugggacuacaggugug

SEQ ID NO: 324345 - RNA, 64 nt, Human
cgaacuccugaccuuaggugauccgcccgccucagccucccaaaguguugggauuacaggcaug

SEQ ID NO: 324346 - RNA, 64 nt, Human
caaacuccugaccucaggugauccaccugccucagccucccagacuguugggauuacaggcaug

SEQ ID NO: 324347 - RNA, 64 nt, Human
cucaaucuccugaccucgugauccacccgccuuggccucccaaagugcgggauuacaagcguga

SEQ ID NO: 324348 - RNA, 64 nt, Human
ggagccagcgucccagccuaaucacggaucugcugccucccagcugucuugacugaaggccacc

SEQ ID NO: 324349 - RNA, 64 nt, Human
ucccauaauccaugaugaaaggugaggucacguggccucccaggccugacuucccaaccuacag

SEQ ID NO: 324350 - RNA, 64 nt, Human
uguccauugcuuuuauagggugagguaagagacagccucccaagcccaggcuuuggcacucaga

SEQ ID NO: 324351 - RNA, 64 nt, Human
cgggagaaacgcugcucgccccacaccccguccugccucccaccacacuuacacacacgggacu

SEQ ID NO: 324352 - RNA, 64 nt, Human
ccucuuucuggcuauaacaggcagagucggagcugccucccaccccagucagaagccuggcacc

SEQ ID NO: 324353 - RNA, 64 nt, Human
cucgaucuccugaccucgugauccacccaccucggccucccaaagugcugggauuauaggugug

SEQ ID NO: 324354 - RNA, 64 nt, Human
ggugaggcugcagccccugcgggcggguguggaugccucccagccaccuucccagaccugcggc

SEQ ID NO: 324355 - RNA, 64 nt, Human
auauucugaacaaagcuauaggguuuuaaguucagccucccaacuuagucauccuaacaugauu

SEQ ID NO: 324356 - RNA, 64 nt, Human
cucgaacgccugaccucaugaucuacccgccucggccucccaaagugcugggauuacaggcaug

SEQ ID NO: 324357 - RNA, 64 nt, Human
cgacaugugucagccaugccucuguggggagucugccucccagacuggcuacuguauguaaugu

SEQ ID NO: 324358 - RNA, 64 nt, Human
aaaaucuuuuuaguuagauuguaggcuuccuggggccucccaugccaggacugcaaagugaucc

SEQ ID NO: 324359 - RNA, 64 nt, Human
ugaacuccugaccucaggugauccgcccgccucugccucccaaagugcugggauuacaggugua

SEQ ID NO: 324360 - RNA, 64 nt, Human
cgaacuccugaccucaagugaucugccugccuuggccucccaaagugcugggauuacagguguc

SEQ ID NO: 324361 - RNA, 64 nt, Human
uucaaugugaugcucuagaggccaaggccugagggccucccaccacugcccagccccugguccc

SEQ ID NO: 324362 - RNA, 64 nt, Human
agggaaaccaugucuugcuaaaccuguuucuggugccucccauccccagacccaccagacacca

SEQ ID NO: 324363 - RNA, 64 nt, Human
cgaacuccuaaccucaggugauccacccaccucugccucccaaagugcugggauuacaggcaug

SEQ ID NO: 324364 - RNA, 64 nt, Human
gcucagagggccuggggcccucacuccugcccacgccucccagaccccagaacggagcuucaag

SEQ ID NO: 324365 - RNA, 64 nt, Human
caagcagcccagcgggcgggccccuuccgagggagccucccacggagugaagagacauggggga

SEQ ID NO: 324366 - RNA, 64 nt, Human
cucaaucuccugaccucgugaucugcccgccucggccucccaaagugcugggauuacaggcgug

SEQ ID NO: 324367 - RNA, 64 nt, Human
ugcaauggugcaaucucggcucacugcgaccucugccucccagguucaagcaguucuccugccu

SEQ ID NO: 324368 - RNA, 64 nt, Human
cgaacuccuggccucaagugauccaccggccucggccucccaaagugcugggaugacaggcaug

SEQ ID NO: 324369 - RNA, 64 nt, Human
caaacuccugaccucaggugauccgcccgccucagccucccaaagugcugagauuacaggugug

SEQ ID NO: 324370 - RNA, 64 nt, Human
ccaccuccuggguuccagcgauucuccugccucagccucccaaauagcugugauuacaggcgug

SEQ ID NO: 324371 - RNA, 64 nt, Human
accaccaauuucccagggacuccaggguccugaggccucccaggagggccuugggggugaugac

SEQ ID NO: 324372 - RNA, 64 nt, Human
ccccuccucugacacagggcuggcccgccagguggccucccagcaagccagccuuuuuuguaag

SEQ ID NO: 324373 - RNA, 64 nt, Human
gccagggcgucaagggagggcuggugccuucggagccucccacugccgaccgcacagcucccuc

SEQ ID NO: 324374 - RNA, 64 nt, Human
guccaggccugggggcuucugcugggccagcccggccucccacacccacuuggagggugagacu

SEQ ID NO: 324375 - RNA, 64 nt, Human
acuuuuucucuuggcuggagguccaauugccagagccucccacacugcacauacaaaggucuga

SEQ ID NO: 324376 - RNA, 64 nt, Human
auaagcccagcugagcagguggggaucucagccagccucccagacugcaccucuucuauugcuc

SEQ ID NO: 324377 - RNA, 64 nt, Human
cagccacgcccauggccagguuggccucuucucagccucccaggugccuugagcccucuugcaa

SEQ ID NO: 324378 - RNA, 64 nt, Human
ccugaccucaggugauacccgcccccccgccucagccucccaaagugcugggauuacaggcgug

SEQ ID NO: 324379 - RNA, 64 nt, Human
ccaccucccagguucaagcaauucuccugccucagccucccaaguagcugggauuacaggcacc

SEQ ID NO: 324380 - RNA, 64 nt, Human
cgaacuucugaccucaggugauccaccugccucagccucccaaauugcugggauuacaggcgug

SEQ ID NO: 324381 - RNA, 64 nt, Human
caggcaaaucaguuacuaagaagaaaauugcugugccucccaaaauuguuuugagcuuuccaug

SEQ ID NO: 324382 - RNA, 64 nt, Human
ucccaagagcagagccaccguagccggaguccuagccucccaaauucggaaauccaauccaacg

SEQ ID NO: 324383 - RNA, 64 nt, Human
cucaaucuccugaccucauauuccacccgccucggccucccaaagugcugggauuacaggcguu

SEQ ID NO: 324384 - RNA, 64 nt, Human
agaauccacccucccaucaucugcuucccccaaggccucccacaggugacagaauguucugccu

SEQ ID NO: 324385 - RNA, 64 nt, Human
ucacuuuauugcuaucgcccuccuuucccuuauugccucccaggcaagcagcuggucagucuuu

SEQ ID NO: 324386 - RNA, 64 nt, Human
cuugccccuaccucagcgucucuuccaccugcuggccucccaguuuccccuccugccaguccuu

SEQ ID NO: 324387 - RNA, 55 nt, Human
uagaugagagcucugucugagcccagccucccagaacaaaugcucuuccaagcca

SEQ ID NO: 324388 - RNA, 64 nt, Human
cgaacuccugaccucaggugauccaccugccuuggccucccaaagcacugggauuacaagcaug

SEQ ID NO: 324389 - RNA, 64 nt, Human
caaaccccugaccuuaggugaucagcccgccucggccucccagagugcugggauuacaggcgug

SEQ ID NO: 324390 - RNA, 64 nt, Human
guaaccaguccugucccauuuccucagucccugggccucccagccuucaggcuguagggcugcc

SEQ ID NO: 324391 - RNA, 64 nt, Human
uucucaccaggccuccuuuccuaugggcauuggugccucccagagguuucuugggcugcuggcu

SEQ ID NO: 324392 - RNA, 64 nt, Human
cucagcccugccugcccuggccugggcucucccagccucccagcccucugcccccucagauggc

SEQ ID NO: 324393 - RNA, 64 nt, Human
ucgaacuccugaccucaggugauccaccgccuaggccucccaaaaccauuagggcucagaggaa

SEQ ID NO: 324394 - RNA, 64 nt, Human
auuuaagcaaauacuuagcaaaaaguggggcagagccucccaaggagaacaaauauucagaaua

SEQ ID NO: 324395 - RNA, 64 nt, Human
ccaccucccagguccaagcgauucucuugccucagccucccaaguagcugggacuacaggcaca

SEQ ID NO: 324396 - RNA, 64 nt, Human
cgaacuccugacuucaggugauccacccaucucagccucccaaagugcugggauuacaggcgug

SEQ ID NO: 324397 - RNA, 64 nt, Human
aacaugucuucuuucagaaugggaauauaugugugccucccaacauuuacuguuaaaguguguu

SEQ ID NO: 324398 - RNA, 64 nt, Human
cuggucuucuggcuucuggauaucgcccaccuuggccucccaaagugcugggauuacagggaug

SEQ ID NO: 324399 - RNA, 64 nt, Human
uuuauuucuuguagagaugaggucuccugccucagccucccaaagugcuggaauuuacagguag

SEQ ID NO: 324400 - RNA, 64 nt, Human
cucaaacuccugacccugugauccgcccgccucggccucccaaagugcugggauuacaggcaug

SEQ ID NO: 324401 - RNA, 64 nt, Human
aacuuguccggguagggagggccggaggcauguggccucccagaccuccugaccugggugguug

SEQ ID NO: 324402 - RNA, 64 nt, Human
gugguacucacuggaugcacccaggccggcccgagccucccaccgcagacaguguggaacagag

SEQ ID NO: 324403 - RNA, 64 nt, Human
cgaacuccugaccucaggugauccgccugucucggccucccaaagugcugggauuaaaggugug

SEQ ID NO: 324404 - RNA, 64 nt, Human
augacucacuuagaacaaaguaccuggcauugaagccucccagacccagccccuuuuccuccau

SEQ ID NO: 324405 - RNA, 64 nt, Human
cucauggguaauauagggauaauuacuggcaccugccucccaggccauucugacguguaaccgc

SEQ ID NO: 324406 - RNA, 64 nt, Human
cucgaucuccugaccucaugaucuacccgccucggccucccaaagugcugggauuacaggcgug

SEQ ID NO: 324407 - RNA, 64 nt, Human
caaauuccuggccucaggugauccaccugccucagccucccaaagugcugggauuacaggcaug

SEQ ID NO: 324408 - RNA, 64 nt, Human
ccaccucccagguucaagcgauucuccugccucagccucccaaguagcugggauuacuggcgcc

SEQ ID NO: 324409 - RNA, 64 nt, Human
acgccuucuggguucacgugauucucuugccuuagccucccaaguagcugggacuacaggcacg

SEQ ID NO: 324410 - RNA, 64 nt, Human
ucucugggugaggcucccaaccuggcaguccccagccucccagcaucugugagcgucuguugga

SEQ ID NO: 324411 - RNA, 64 nt, Human
ggucucaaucugaccuugugaucugcccaccucggccucccaaagugcuaggauuacuggcgug

SEQ ID NO: 324412 - RNA, 64 nt, Human
uuugaucuccugaccucgugauccgcccgccuuggccucccaaaagugcugggauuauaggcgu

SEQ ID NO: 324413 - RNA, 64 nt, Human
caaacccuugaccccaggugaucugccugccucagccucccaaaguucugggauuacaggcaug

SEQ ID NO: 324414 - RNA, 57 nt, Human
agcauuccagucugggcugaugucccagccucccauaccagcaaaaugcccccugcu

SEQ ID NO: 324415 - RNA, 64 nt, Human
cuuugugcaagaaauuugaaacuuauugggaaaagccucccaguagauuaauuguucauaucag

SEQ ID NO: 324416 - RNA, 64 nt, Human
ugaugacaaguagagacgagcaguggaggaaacagccucccaaaaggacagagaacuaaaaaau

SEQ ID NO: 324417 - RNA, 64 nt, Human
uucuuuugcugcugccauguaagaagugccuuuugccucccaccaugauucugaggcuuuccca

SEQ ID NO: 324418 - RNA, 64 nt, Human
caaacuccuggccuuaugcauuccucccacccuggccucccagagugcugggauuacaggugug

SEQ ID NO: 324419 - RNA, 64 nt, Human
ccccauguauagccauugcccucuagcaggccaggccucccagugggaaggccuggguccaggg

SEQ ID NO: 324420 - RNA, 64 nt, Human
caaacuccuggccucaagugguccuccugccuuggccucccaaaauguugcaauuacaggcaug

SEQ ID NO: 324421 - RNA, 64 nt, Human
cacuuugggaggccgaguugguuuugaacuccuggccucccaaggugcugauaguacaggcaug

SEQ ID NO: 324422 - RNA, 64 nt, Human
uuuguucuuuuugaaguuuuauuauuuuuaaagugccucccaccuaggcguaggccaugaccau

SEQ ID NO: 324423 - RNA, 64 nt, Human
cugggaaccuagcuacacugagcagggagaccaugccucccagagcuuguugucuccacuugua

SEQ ID NO: 324424 - RNA, 64 nt, Human
auucccauuaaauacaagcuguuuuuacuuuuucgccucccagggccugugggaucuggucccc

SEQ ID NO: 324425 - RNA, 64 nt, Human
cuccaaacugaccugggccguggcugccucgugagccucccagagcccaggccuccguggccuc

SEQ ID NO: 324426 - RNA, 64 nt, Human
ugaaugugaggcugggacagagggagagaacaaggccucccagcacucugaugucagaguagua

SEQ ID NO: 324427 - RNA, 64 nt, Human
cccaggggucucccuggcucccuccuccaggccugccucccacuucacugcgaagacccucuug

SEQ ID NO: 324428 - RNA, 64 nt, Human
agaagccaauccuugcauuccaggaguggccugugccucccaccucuuccuucccacugccaaa

SEQ ID NO: 324429 - RNA, 64 nt, Human
ggauuaccucucaacacacagcaagcaugucccugccucccaugaaucuuaccauguaaaucca

SEQ ID NO: 324430 - RNA, 64 nt, Human
ccgccucccugguucaagugauucuccuaucucagccucccaaguagcugggacuauaggcaca

SEQ ID NO: 324431 - RNA, 64 nt, Human
caaacuccugaccucaggugauccaccugccucagccucccaaagugcugggauuacaggcgug

SEQ ID NO: 324432 - RNA, 64 nt, Human
cucaaacuucugaccucauaauccacccaccuuggccucccaaagugcuaggauuacaggcaug

SEQ ID NO: 324433 - RNA, 64 nt, Human
cacccccugcuccaggacaggccaugggcaagcugccucccaucacugccugcuggcugcucuc

SEQ ID NO: 324434 - RNA, 64 nt, Human
gcuggacccggcucagggcagguggaggagcugggccucccacagggugcccgggcagugccau

SEQ ID NO: 324435 - RNA, 63 nt, Human
gaccuggguccccagccugaggagggagcgugagccucccagagccccaggacugggccagag

SEQ ID NO: 324436 - RNA, 64 nt, Human
caaacuccugacucgaagugauccgcccaccuuggccucccaaagcguugggauuauaggcaug

SEQ ID NO: 324437 - RNA, 64 nt, Human
ggugcuccuggaagccccaagagcauccaggauugccucccagcugccuggccagcccacccuc

SEQ ID NO: 324438 - RNA, 64 nt, Human
ugcuauggugacacagcguuucuaggacagaggggccucccagucuccccccaccacccgugca

SEQ ID NO: 324439 - RNA, 64 nt, Human
ggcuuccacccuuguuaaugaugcuccugccucugccucccagccccucacccagcacagcucu

SEQ ID NO: 324440 - RNA, 64 nt, Human
gguaucucccaggcucuacauucucgggagcggcgccucccaaggggguccugggaccuucucg

SEQ ID NO: 324441 - RNA, 64 nt, Human
caggcaccaucuccuuguucccccucucucuuuugccucccacugacugcccuuuuccaugugu

SEQ ID NO: 324442 - RNA, 64 nt, Human
ggaggcggcagaggacugggccaagccccaaccugccucccagccaggcuccuccaggccucug

SEQ ID NO: 324443 - RNA, 64 nt, Human
agaggaggggcccguugucucccuggcccucaaggccucccacagugacucgggcuccugugcc

SEQ ID NO: 324444 - RNA, 64 nt, Human
augaaaacagagcuucccgugcaaaaagggucacgccucccacccccgcccccucccugcaccu

SEQ ID NO: 324445 - RNA, 64 nt, Human
gcccuaccugcauuucccacaugacuuucuggaagccucccaacuauucuugcuuuucccagac

SEQ ID NO: 324446 - RNA, 64 nt, Human
guuacucuggugcuguccuguuuuacuggaccccgccucccagccccaggggugccuguggggg

SEQ ID NO: 324447 - RNA, 64 nt, Human
ccugaaaaucagguccagccgguccaagcacauggccucccaucugggagagcccacuguccca

SEQ ID NO: 324448 - RNA, 64 nt, Human
ugcgggcaguggcaugacuggagcacagccuccugccucccagcccggacccaaugcacuuucu

SEQ ID NO: 324449 - RNA, 64 nt, Human
ccguucuugccccucguguccuaggcccaacccagccucccagaccucacuuuccccaucagca

SEQ ID NO: 324450 - RNA, 64 nt, Human
acagcaaccucaacauaagauuuuuuuucuaguagccucccacugauuaaagaagcaaguuuga

SEQ ID NO: 324451 - RNA, 64 nt, Human
uuucgaacucggcucaagugaucuaccugccucugccucccaaagugcuaggauuacaggcgug

SEQ ID NO: 324452 - RNA, 64 nt, Human
ugcaguggcgugaucuuggcucacugcaaccuccgccucccagguucaagcgauucuccugccu

SEQ ID NO: 324453 - RNA, 64 nt, Human
caaacuccugggcucaagcgaacugucagccucagccucccagugugcugggauuacaggcaug

SEQ ID NO: 324454 - RNA, 64 nt, Human
uacaauaguaugaucucggcucacugcaacuucugccucccaguuucaagggauucucgugccu

SEQ ID NO: 324455 - RNA, 64 nt, Human
cugccucccaguuucaagggauucucgugccucagccucccagguagcugguacuacaggcacg

SEQ ID NO: 324456 - RNA, 64 nt, Human
ugaacuuuugagcucgagugauccacccaccucagccucccaaaaugcugggauuacagaugug

SEQ ID NO: 324457 - RNA, 64 nt, Human
acugaguucuauauucuggugaguuaaugggguugccucccagcuucuuauaagacucacagua

SEQ ID NO: 324458 - RNA, 64 nt, Human
ccaccucaugccuggccccccuccaggcaugcuggccucccaauaaagcuggacaagaagcugc

SEQ ID NO: 324459 - RNA, 64 nt, Human
cgaacuccugagcucaggcaauccgcccaccucagccucccaaaguguugggauuacaggcaug

SEQ ID NO: 324460 - RNA, 64 nt, Human
uaccgaccuaacuucucuuuucccucccaacuuggccucccacacguuccauuucauuuuggcc

SEQ ID NO: 324461 - RNA, 64 nt, Human
gagaagacuuuucucuggcagacuaucaguguuugccucccaaaucccaggaccaggaugacau

SEQ ID NO: 324462 - RNA, 64 nt, Human
gcgauggccccaccaaggccuagacacggcacuggccucccaggagggcaggggcauugggaau

SEQ ID NO: 324463 - RNA, 64 nt, Human
uucuuugcccuucucuguccuguuccaaucuucugccucccagucacucccuggggacuauggg

SEQ ID NO: 324464 - RNA, 64 nt, Human
cagcagcccugggaaaaggcuguggccucagggcgccucccagugccagaaaauaaaguccuuu

SEQ ID NO: 324465 - RNA, 64 nt, Human
cucgaucuccugaccucaugauccgcccuccucagccucccacagugcugggauuagaggcaug

SEQ ID NO: 324466 - RNA, 64 nt, Human
cucgaucuccugaccuugugauccacccgccucagccucccaaaguguugggauuacaggugug

SEQ ID NO: 324467 - RNA, 64 nt, Human
agaaccucugaccucaggugauccacccgccucggccucccaaagugcugggauuacaggcgug

SEQ ID NO: 324468 - RNA, 64 nt, Human
ccaccucucagauucaagcaauucuccugccucagccucccaaguagcugggauuacaggugcc

SEQ ID NO: 324469 - RNA, 64 nt, Human
agggaggggucuagaggcuauuccuaggccucaggccucccaaauaugccccuccccaguagcu

SEQ ID NO: 324470 - RNA, 64 nt, Human
cuucccauuucccaucucauuuucaauaacuucagccucccauucuuuccuuuggaaugagagu

SEQ ID NO: 324471 - RNA, 64 nt, Human
caugauuugguuagaagcacaagcaaacugaucagccucccagaccugccagcagaugcugugu

SEQ ID NO: 324472 - RNA, 64 nt, Human
cucaaacaccugaccuugugauccguccgccuuggccucccaaagugcugggauuacaggcgug

SEQ ID NO: 324473 - RNA, 64 nt, Human
ccucugccucccaggaucaagcaauucugacucagccucccaaguagcugggauuacaggcgca

SEQ ID NO: 324474 - RNA, 64 nt, Human
ugcaguggugugaucacugcucagugcaaccucugccucccaggaucaagcaauucugacucag

SEQ ID NO: 324475 - RNA, 64 nt, Human
cucgaucuccugaccucgugauucgcccgccucggccucccaaagugcuggaauuacuggcgug

SEQ ID NO: 324476 - RNA, 64 nt, Human
cacugcagccugaaacuccuuggcuuccaccucagccucccaaagcauuaggauuauaggcgug

SEQ ID NO: 324477 - RNA, 64 nt, Human
ugaacuccuaugcucaagugauccucccaccucagccucccaaaguacugugauuacaagcgug

SEQ ID NO: 324478 - RNA, 64 nt, Human
cucgaucuccugaccucaugauccacccgccauggccucccaaagugcugggauuacaggcgug

SEQ ID NO: 324479 - RNA, 64 nt, Human
accaugggccacgcccauguuuuccaggcccccagccucccacucgacuuuccucuuaggaacc

SEQ ID NO: 324480 - RNA, 64 nt, Human
ucaacuccagaucucaggugaucuacccuccucggccucccaaaguacugggauuacaggccug

SEQ ID NO: 324481 - RNA, 64 nt, Human
ugcaguggcacgaucucggcucacugcaaccuccgccucccaaguucaagcgauucuccucucu

SEQ ID NO: 324482 - RNA, 64 nt, Human
cucgaucuccugaccucaugauccacccaccucggccucccaaagugcugggauuccaggcgug

SEQ ID NO: 324483 - RNA, 64 nt, Human
cucgaucuccugaccucgugauccacccgccucagccucccaaagugcugggauuacaggcuug

SEQ ID NO: 324484 - RNA, 64 nt, Human
ugcaguggcgcaauuucagcucacugcaaccucugccucccagguucaagcgauuccuuuuuuu

SEQ ID NO: 324485 - RNA, 64 nt, Human
ucuccugugagcuccccaauccaacccaugcauggccucccagccacccggaucuccaggccca

SEQ ID NO: 324486 - RNA, 64 nt, Human
gagucuuaacaagaugagaaguccuccccuucuugccucccacacuuuucuuugaugggagguu

SEQ ID NO: 324487 - RNA, 64 nt, Human
ggauuucacagucgaaaaggaagccaccacugaugccucccacugugacaggcccugucaccac

SEQ ID NO: 324488 - RNA, 53 nt, Human
ugcgccuguaucaugacugaggugccucccaacgcuccgcccacgcugacaau

SEQ ID NO: 324489 - RNA, 64 nt, Human
ucugcccaccucacaugccuccccauggauuggggccucccaggccccccaccuuaugucaacc

SEQ ID NO: 324490 - RNA, 64 nt, Human
aagggccugagugccagcccuggcagacugaggagccucccaggagcagcggggcagugugggg

SEQ ID NO: 324491 - RNA, 64 nt, Human
ggcucgagcaacccggggaacuucacccucaggggccucccacaccuucuccagcgaggagguc

SEQ ID NO: 324492 - RNA, 61 nt, Human
aauggcacgaucucagcuaacugaaaccuccgccucccagaaaagaaaaaccucuuuuuaa

SEQ ID NO: 324493 - RNA, 64 nt, Human
ccgcagcagccacaagugggcccagacuauugcagccucccauaaacaugugagcauguucuga

SEQ ID NO: 324494 - RNA, 64 nt, Human
cuagcaacaauuaagugacccccgucaacccacugccucccaccccgaccccagcaucaaaaaa

SEQ ID NO: 324495 - RNA, 64 nt, Human
cucgaucuccugaccucgugauccaccugccuaggccucccaaaguguugggauuacaggcgug

SEQ ID NO: 324496 - RNA, 64 nt, Human
uucaguggcacaaucucggcucacugcaagcucugccucccagguucaugccguucuccugccu

SEQ ID NO: 324497 - RNA, 64 nt, Human
cucaaucucuugaccuugugaucugccugccucggccucccaaaguacugggauuauaggcaug

SEQ ID NO: 324498 - RNA, 64 nt, Human
cuccuggccucaagugaucuaucugccucccucagccucccaaagucugggauugcagacaagu

SEQ ID NO: 324499 - RNA, 64 nt, Human
ggaugcauuacauucaccaggcuuugcaaacccagccucccagugcucauuugggaaugcucau

SEQ ID NO: 324500 - RNA, 64 nt, Human
gggcucaccaguuccccgucugaucugccugugcgccucccauucuucucuacccagaaccugu

SEQ ID NO: 324501 - RNA, 64 nt, Human
ugaacuccugaccucaaaugacccacccaccucagccucccaaagugcugagauuacaggcgug

SEQ ID NO: 324502 - RNA, 64 nt, Human
cucgaacuccugaccuggugauuugcccgccuuggccucccaaagugcugggauuacaggcgug

SEQ ID NO: 324503 - RNA, 64 nt, Human
ggagcucagcugcagcguugcauugggcuucuuggccucccaacucuucccacucccagaaucc

SEQ ID NO: 324504 - RNA, 64 nt, Human
gucagcagaaucuaaaccccuacauuaaagcuuugccucccauucugugguuguggugguggua

SEQ ID NO: 324505 - RNA, 64 nt, Human
ccuuggccauaucaaggcagcacggcccacccaggccucccauugccgcaaccccuccaguacu

SEQ ID NO: 324506 - RNA, 64 nt, Human
gccuacugaagagguguuuauuuuuuaacuaacagccucccaccccauuaagacucaccaggag

SEQ ID NO: 324507 - RNA, 64 nt, Human
gcucauugcaagcucaagugauccuccugacucagccucccaaguagcuaggacugcaggcacc

SEQ ID NO: 324508 - RNA, 64 nt, Human
cucgaacuccugaccuugugaucugcccgccucagccucccaaaguacugggauuauaggcaug

SEQ ID NO: 324509 - RNA, 64 nt, Human
cagcuucccuaauagcuaggauuacagguguguggccucccaccccaccccacccuucacaccu

SEQ ID NO: 324510 - RNA, 64 nt, Human
uugccuguucuauuagcauccaaaaauguggaaggccucccaaccaccauuucugcuguguccu

SEQ ID NO: 324511 - RNA, 64 nt, Human
cccgucuccaggggugccccagacccagagauuagccucccacuucggcgcagaaaacaaaagc

SEQ ID NO: 324512 - RNA, 64 nt, Human
guaucuuuaagcugugauguuguauauauacaaugccucccagcuagacuguaagcccuuuggg

SEQ ID NO: 324513 - RNA, 64 nt, Human
cuaccuccuggguucaagggauucuccugccucagccucccaaguagcugggauuacaggcgcc

SEQ ID NO: 324514 - RNA, 64 nt, Human
caaacuccugaccugaggcgaucugcccaccucggccucccaaagugcugggauuacaggcgug

SEQ ID NO: 324515 - RNA, 53 nt, Human
gcaggagugcccgcgacugagccgccucccaccacuccacuccuccagccacc

SEQ ID NO: 324516 - RNA, 64 nt, Human
caccacccacaaucacaagaagauucccaccccugccucccaugccuggucccaagacagugag

SEQ ID NO: 324517 - RNA, 64 nt, Human
uaccucgcgccaccagaacgcgccgcccgcgccggccucccaauagccgccgcccgcugccugc

SEQ ID NO: 324518 - RNA, 64 nt, Human
cuuuauucccacuguacagucuguucuauccucugccucccaucaggcccuguuucuuuguucc

SEQ ID NO: 324519 - RNA, 64 nt, Human
uucugguuauugagcccuuccuguuagaccuaccgccucccaccucuucugugucugcugugua

SEQ ID NO: 324520 - RNA, 64 nt, Human
cgaacuccugaccucaggugauccacccgcguuggccucccaacgugcugggauuauaggcgug

SEQ ID NO: 324521 - RNA, 64 nt, Human
ucaaacuccugggcucaagugauccacccgccuugccucccaaagugcugggauugcaggcaug

SEQ ID NO: 324522 - RNA, 64 nt, Human
cugccucccggguucgcaccauucuccugccucagccucccaauuagcuuggccuacagucauc

SEQ ID NO: 324523 - RNA, 64 nt, Human
cucgaucuccugaccucgugauccgcccaccucggccucccaaagugcugggauuacaggcaug

SEQ ID NO: 324524 - RNA, 64 nt, Human
cucgaucuccugaccuugugauccacccaccucggccucccaaagugcugggauuacaggcgug

SEQ ID NO: 324525 - RNA, 64 nt, Human
ccgccuccuggguucacgugauucucaugccucagccucccaaguagcugggaucacaggcgug

SEQ ID NO: 324526 - RNA, 64 nt, Human
cucgaucuccugaccuugugauccgcccgccucggccucccaaagugcugggauuacaggcgug

SEQ ID NO: 324527 - RNA, 64 nt, Human
uaaaauugggcagcuaaauuuuucaguuccaugugccucccaaauaaaaaacagaaaauaagua

SEQ ID NO: 324528 - RNA, 64 nt, Human
cucgaucucuugaccucaugaucuacccgccuuggccucccaaagugcugagauuacaggcgug

SEQ ID NO: 324529 - RNA, 64 nt, Human
cagacuccuggguucaagcaauccuccugccucagccucccaaguagcugagacuacaggcacg

SEQ ID NO: 324530 - RNA, 64 nt, Human
ugaacucuuggccucaaguaauccuccugccucagccucccaaaguguugggauugcagauaug

SEQ ID NO: 324531 - RNA, 64 nt, Human
ccucaaccuggguucaagugauccucucaccucagccucccaaguaguugugccuccuaggcac

SEQ ID NO: 324532 - RNA, 64 nt, Human
cgaacaccugggcucaacugauccgccugccucggccucccaaagugcugggauuacaggugug

SEQ ID NO: 324533 - RNA, 64 nt, Human
caaacucuugacuucagguaauccacccaccuuggccucccaaagugcugggauuacaggcaug

SEQ ID NO: 324534 - RNA, 64 nt, Human
ugcaguggugcaaucucugcucacugcaacaucugccucccagguccaagcgauucuccugccu

SEQ ID NO: 324535 - RNA, 64 nt, Human
ugaacuccuggccucaagugaucugcccaccucggccucccaaagugcugggauuacagacuug

SEQ ID NO: 324536 - RNA, 64 nt, Human
cgaaugucugaccucaggugauccacccgccuuggccucccaaagugcugggauuacaggcgcg

SEQ ID NO: 324537 - RNA, 64 nt, Human
cucugccugugggaaucuggacacauuuugggaggccucccaaggcugugggacgugcuugcuc

SEQ ID NO: 324538 - RNA, 64 nt, Human
agugaaucugcucucccagcucacacacuccccugccucccauggcuuacacacuaggauccag

SEQ ID NO: 324539 - RNA, 64 nt, Human
ucaaacuucugaccucaaaugauugccugccucagccucccaaagugcugggauuacaggugua

SEQ ID NO: 324540 - RNA, 64 nt, Human
cagaccccacacagcauguccgccccagggcaaagccucccaccuucgcucugcgcccguccca

SEQ ID NO: 324541 - RNA, 64 nt, Human
agggauagccccgucuggugccaguguggaagcugccucccaucucaacucccugagagccaca

SEQ ID NO: 324542 - RNA, 64 nt, Human
ccgccucccggguucaagugauucuccugccucagccucccaaguaggugggauuacaggcgcc

SEQ ID NO: 324543 - RNA, 64 nt, Human
cucgaacuccugaccucgugauuggcccaccucagccucccaaagugcugguauuacagaugug

SEQ ID NO: 324544 - RNA, 64 nt, Human
ccgacauccagggacggggugugaggaagacgcugccucccaauggccuggacgggauguuucc

SEQ ID NO: 324545 - RNA, 64 nt, Human
agggguauuuuggaguccaccugcugagcuggaggccucccacugcaacuuuucagcucagggg

SEQ ID NO: 324546 - RNA, 64 nt, Human
cgaacuccugaccgcaagugauccacccgccuccgccucccaaagugcugggauuacaggcgug

SEQ ID NO: 324547 - RNA, 64 nt, Human
ccaccuccuggguucaagugauuuuccugccucagccucccaaguagcugggaauacaggcacg

SEQ ID NO: 324548 - RNA, 64 nt, Human
cgaacuccugaccucaagugaucugccugccucggccucccaagugcugggauuacaggcguga

SEQ ID NO: 324549 - RNA, 64 nt, Human
ccgcccccuggguucaagcaauucuccugccucagccucccaaguagcugggauuacagucagg

SEQ ID NO: 324550 - RNA, 64 nt, Human
cuaacuccugggcuuaagugaucugcccgccuuggccucccaaagugcugggauuacagaugug

SEQ ID NO: 324551 - RNA, 64 nt, Human
ugaacuccugagcucaagaaaucaacacaucuuggccucccaaguugcugggauuacugacaca

SEQ ID NO: 324552 - RNA, 64 nt, Human
cucaaacuccugaccuagugauccacccuccucggccucccaaagugcugggauuacaggcaug

SEQ ID NO: 324553 - RNA, 64 nt, Human
ccgucucccggguucaagugauucuccugccucagccucccaaguagcuggguuuauaggugcc

SEQ ID NO: 324554 - RNA, 64 nt, Human
ucuccagccgugcggggccgggagcaggccuccggccucccagacuucuagagcccgccgggcc

SEQ ID NO: 324555 - RNA, 64 nt, Human
ugcugaggcuugcagaggcaucccagcggcaccagccucccacugcacagcuuccuucccuccu

SEQ ID NO: 324556 - RNA, 64 nt, Human
ccauuagcaguuccagcuaagcuggcuucucccugccucccaauuucuguccuuuggaucacuc

SEQ ID NO: 324557 - RNA, 64 nt, Human
auguggucauguacguuugacaccugugcugggggccucccagccccggagccucauagaucau

SEQ ID NO: 324558 - RNA, 64 nt, Human
cacaugugggcauuuucacaacaaucucuccccagccucccaaaucaagucucuccaucacuug

SEQ ID NO: 324559 - RNA, 64 nt, Human
cgaacuccugagcucaggugauccacccgucuuggccucccaaagugcuggauuacaggcauaa

SEQ ID NO: 324560 - RNA, 64 nt, Human
cgaacuccugaccucaagugaucuguccaccucggccucccagagugcugggauuacaggcgug

SEQ ID NO: 324561 - RNA, 64 nt, Human
ucuugaacugggcucaagugauccucacgccuuggccucccaaagugcugggauuauaggcaug

SEQ ID NO: 324562 - RNA, 64 nt, Human
ccagcuccuggguucaggugauucuccugccucagccucccaaguagcuggcacuacagacacg

SEQ ID NO: 324563 - RNA, 64 nt, Human
agaggaagugcugcuguaauugggagcacaaggggccucccaaaaaggagccccaccucagcau

SEQ ID NO: 324564 - RNA, 64 nt, Human
uuaacuccugaccucaggugauccaccuuucucggccucccaaagugcugggauuacgggugug

SEQ ID NO: 324565 - RNA, 64 nt, Human
ccaccuccuggguuccagcaguucuccugccucagccucccaaguagcugagauuacaggcgcc

SEQ ID NO: 324566 - RNA, 64 nt, Human
cuugaacuccugaccuugugauccacccaccucggccucccagagugcugggauuacaggcaug

SEQ ID NO: 324567 - RNA, 64 nt, Human
caaacuccugggcucaagcgaugcuccugcuucagccucccaaagugcugggguuacaggcaug

SEQ ID NO: 324568 - RNA, 64 nt, Human
caaacuccuugcuucaagggauccucccaccucagccucccaagcagccgggacugcaggcaca

SEQ ID NO: 324569 - RNA, 64 nt, Human
ugaacuccugaccucaggugauccaccugccucugccucccaaagugcugagauuacaggcaua

SEQ ID NO: 324570 - RNA, 64 nt, Human
cuugaacuccugacccugugauccgaccaccuuggccucccaaagugcugggauuacaggugug

SEQ ID NO: 324571 - RNA, 64 nt, Human
uguuggaugcucccgggaugccuucuagaagggggccucccaccuuaaguucaggcgccaucug

SEQ ID NO: 324572 - RNA, 64 nt, Human
ccaaccccugaguucaagugauucaccucccuuggccucccaaaguacugggauuacaggcgug

SEQ ID NO: 324573 - RNA, 64 nt, Human
gggaccacgagcccugguucagucacccagggaagccucccagcggcucaugaagcaucgagcu

SEQ ID NO: 324574 - RNA, 64 nt, Human
ggcaguucccagaaagagacaagaaauccuaguggccucccagacugcaggguccccaaggaug

SEQ ID NO: 324575 - RNA, 64 nt, Human
agcggagaaggggccucccacccuuguccgaguugccucccacuggaggucaggagucuacacu

SEQ ID NO: 324576 - RNA, 64 nt, Human
acucuugggcuuucuuggugggagcggagaaggggccucccacccuuguccgaguugccuccca

SEQ ID NO: 324577 - RNA, 64 nt, Human
cuugaacuccugaccucgugauccacccgccuuagccucccaaagugcugggauuacaggcgug

SEQ ID NO: 324578 - RNA, 64 nt, Human
caaacuccugaccucaggugauccaccugccucggccucccacagugcugggauuacaggccug

SEQ ID NO: 324579 - RNA, 64 nt, Human
ucuugaucuccugacuugugauccgccugccucggccucccaaagugcuuggauuacaggugua

SEQ ID NO: 324580 - RNA, 64 nt, Human
cgagcuccugaccucaggugauccgccugccuuggccucccaaaguggugggaucacaggcgug

SEQ ID NO: 324581 - RNA, 64 nt, Human
uaaacugagcucgcagcccccgcgcccucccuccgccucccaucccgcuuagcgcucuggacag

SEQ ID NO: 324582 - RNA, 64 nt, Human
ucccagcggacagccccccagccccacagccugagccucccagcugccaugugccuguugcaca

SEQ ID NO: 324583 - RNA, 64 nt, Human
cucaaacuccugaccuugugauccacccaccucagccucccaaagugcugggauuacaggcgug

SEQ ID NO: 324584 - RNA, 64 nt, Human
caccaggcugcacccuggugucuuccacccgcaggccucccaugcuccaagcagccucccccag

SEQ ID NO: 324585 - RNA, 64 nt, Human
gagcguccucuaggugccccuaguucuuuguccugccucccagagggaggaaaagccccugggg

SEQ ID NO: 324586 - RNA, 64 nt, Human
uugaacucuugaccucaggugauccugagccucagccucccaaagugcuggaauuauaggcgug

SEQ ID NO: 324587 - RNA, 64 nt, Human
ugaacuccugaccucaggugauccgcccgccucggccucccaaagugcuuggauuacaggcaug

SEQ ID NO: 324588 - RNA, 64 nt, Human
aaagccaaggaacuugagugagcuuccuuggcaagccucccauugccuuucugcaucaaugugu

SEQ ID NO: 324589 - RNA, 64 nt, Human
ggaacuccugagcucaagugaucugcccaucucagccucccaaagugcugggauuacagguaug

SEQ ID NO: 324590 - RNA, 64 nt, Human
cuugaucuccugaccucgugauccgccugccucggccucccaaagugcugggauuacaggugug

SEQ ID NO: 324591 - RNA, 64 nt, Human
ugggaugguuaucacaggaguuuagaaagacucugccucccagcaucuugaauaucuccagccu

SEQ ID NO: 324592 - RNA, 64 nt, Human
uguagaugggggccaggcacccccaccacucgcugccucccaggucagggucccggagccggug

SEQ ID NO: 324593 - RNA, 64 nt, Human
cacucuccugaccucaagcaaucugccugucucagccucccaaagugcugggauuacaggcgug

SEQ ID NO: 324594 - RNA, 64 nt, Human
cagccuccuggauucaggcaacacuccugccucagccucccacguggcugggauuacaggugcc

SEQ ID NO: 324595 - RNA, 64 nt, Human
cucgaucuccugaccuugugaucugcccgccucagccucccaaagugcugggauuacaggugug

SEQ ID NO: 324596 - RNA, 64 nt, Human
cgaacuccugaccucagaugauccgcccacauuggccucccaaagugcugggauuacaggugug

SEQ ID NO: 324597 - RNA, 64 nt, Human
ugcaguggcaugaucucggcucacugcaacuucugccucccagguucaagccauucuccugccu

SEQ ID NO: 324598 - RNA, 64 nt, Human
cugccuccuagauucaagcaauucuccugucucagccucccaaguagcugggauuacaggugcg

SEQ ID NO: 324599 - RNA, 64 nt, Human
cccaaacguggucucccguccagcccuggcugcagccucccaguucccaaacugcacuuuacau

SEQ ID NO: 324600 - RNA, 64 nt, Human
ccgccucccagauucaagcgauuuuccugccucagccucccaaguagcugggauuacaggugcc

SEQ ID NO: 324601 - RNA, 64 nt, Human
cgcaguggcaccaucucggcucacuacaaccuccgccucccagauucaagcgauuuuccugccu

SEQ ID NO: 324602 - RNA, 64 nt, Human
ugcaauggcacgaucucagcucacugcaaccuccgccucccagguucaaguaauucuccugccu

SEQ ID NO: 324603 - RNA, 64 nt, Human
ucgaacuccugaccucaggugaccacccgccucagccucccaaagugcugggauuacaggcaug

SEQ ID NO: 324604 - RNA, 64 nt, Human
ugaacuccugggcucaagcuauccuccugccucagccucccaaaguacugggauuauaggugug

SEQ ID NO: 324605 - RNA, 64 nt, Human
cgaacuccugaccucaggugaucugcccacuuuggccucccaaagugcugggauuacaggcaug

SEQ ID NO: 324606 - RNA, 64 nt, Human
uucaauggcugcgaaagaauuuguaguaaaccaggccucccaggauggcgagcuccaguaagau

SEQ ID NO: 324607 - RNA, 64 nt, Human
caaacuccuggcuucaagagauccacccaccucagccucccaaagcgcuaggauuacaaguaug

SEQ ID NO: 324608 - RNA, 64 nt, Human
cgaacuucugaccucagaugaucugcccgccucagccucccaaagugcugggauuacaggcaug

SEQ ID NO: 324609 - RNA, 64 nt, Human
ugaacucccgaccucagguaauccgcccgccucggccucccaaaaugcugggauuagaggugug

SEQ ID NO: 324610 - RNA, 64 nt, Human
guuuguucugcagagacuucuaggaggaugcugugccucccaagcucagagcagccucuguccu

SEQ ID NO: 324611 - RNA, 64 nt, Human
aacacgggaacugucacgacuggaagggcgugaggccucccagcagugccgcagcguuucgagg

SEQ ID NO: 324612 - RNA, 64 nt, Human
ccgccuccuggguucaagugauucuccugccacagccucccaaguagcugggauuacaggugcc

SEQ ID NO: 324613 - RNA, 64 nt, Human
cgaacuccugaccucaguugauccgccugccucagccucccaaagugcugggcuuacaggccug

SEQ ID NO: 324614 - RNA, 64 nt, Human
gauagagcaggaggcagggagacagggcugcagggccucccaccuuccaacagacaggcucugc

SEQ ID NO: 324615 - RNA, 64 nt, Human
cuuccuccaggguucaagugauucucccaccucagccucccaaguagcugggacuacgggcaca

SEQ ID NO: 324616 - RNA, 64 nt, Human
caaacuccugaccucaagcgauccacccaccuaggccucccaaagugcugggauuacaggcaug

SEQ ID NO: 324617 - RNA, 64 nt, Human
caaacucccgaccucaggugauccgcccgccugggccucccaaagugcugggauuacaggcgug

SEQ ID NO: 324618 - RNA, 64 nt, Human
cuccaucuccugaccucgugauccgccuaccucggccucccaaagugcugggauuacaggcgug

SEQ ID NO: 324619 - RNA, 64 nt, Human
gucgguuguucaucccagccuccccauggcccucgccucccaugucuuugaagcaccccuccag

SEQ ID NO: 324620 - RNA, 64 nt, Human
cuccagcuuuuguuggugggaguggucuccggaggccucccagaaccaaggguagccgggcagc

SEQ ID NO: 324621 - RNA, 64 nt, Human
gacccccacaugugccauaucccugugggcgggugccucccacgcccuugcccccucgucagcu

SEQ ID NO: 324622 - RNA, 64 nt, Human
guggaugcccuccucccucagagcuggggcagcugccucccaggggugggacucugggcucaga

SEQ ID NO: 324623 - RNA, 64 nt, Human
ugaacuccugggcucaagcaauucaucccccucagccucccaaagugcuaggauuacaggugug

SEQ ID NO: 324624 - RNA, 64 nt, Human
ugaacuccugggcucgaaugauccucccaccuuggccucccaaagugcugggauuauaggcgua

SEQ ID NO: 324625 - RNA, 64 nt, Human
cuugaucuccugaccucaugauccgcccaccuuggccucccaaagugcugggauuauaggcaug

SEQ ID NO: 324626 - RNA, 64 nt, Human
ugcaauggcgcaaucucagcucacugcaagcuccgccucccagguucaugccauucuccugccu

SEQ ID NO: 324627 - RNA, 64 nt, Human
ugaagaaugcuguucuuuccuagccaccuuucuggccucccacuugcccugaaaggccaagauc

SEQ ID NO: 324628 - RNA, 64 nt, Human
ugaacgacugggcugaagugaucuucccaccucagccucccaaguagcugggaauacagguguc

SEQ ID NO: 324629 - RNA, 64 nt, Human
uuaacuccuaggcucaagugauccucccaccucagccucccaaagugcuuggaugacaggugcg

SEQ ID NO: 324630 - RNA, 64 nt, Human
caaucuccugggcucaaaugauccuuccaccucagccucccauguggcugggacuauaggugca

SEQ ID NO: 324631 - RNA, 64 nt, Human
cuugaucuccugaccucgugaucugcccgccucggccucccaaagugcugggauuauaggcaug

SEQ ID NO: 324632 - RNA, 64 nt, Human
aaaggcggcacccagcuccucaaucgaagcaucugccucccaccccucggcccccucaagccca

SEQ ID NO: 324633 - RNA, 64 nt, Human
ugaacuccugaccucaggugguccacccgccucggccucccaaagugcuggcauuacaggcgug

SEQ ID NO: 324634 - RNA, 64 nt, Human
cgaacuccugaccucaagugaucugccugccucagccucccaaagugcugggauuacacgcgug

SEQ ID NO: 324635 - RNA, 64 nt, Human
agauuuccuuucuccccugacaaagcccucaacagccucccaggcuaucaguauccugcaccac

SEQ ID NO: 324636 - RNA, 64 nt, Human
caaaggucagucccucugcuccccagcaaacggugccucccaggcauucucagugccagggcuu

SEQ ID NO: 324637 - RNA, 64 nt, Human
ggaaacauguccaguguugcugcccaguguguaugccucccaguacccacucugcucggccgcc

SEQ ID NO: 324638 - RNA, 64 nt, Human
cucgaucuccugacguugugauccgcccgccucagccucccaaagugcugggauuacaggcaug

SEQ ID NO: 324639 - RNA, 64 nt, Human
auaggaaaaccuaccaucucagugagcaccagcugccucccaaaggaggggcagccgugcuuau

SEQ ID NO: 324640 - RNA, 64 nt, Human
cuucagagcugcaguuaugccagaccaucagccugccucccaguagaggcccuucaccuggaga

SEQ ID NO: 324641 - RNA, 64 nt, Human
cagccuccuggauuuaagugauucuccugccucagccucccaaguagcugggauuacaggugug

SEQ ID NO: 324642 - RNA, 64 nt, Human
cucgaacuccugaccucgugauccgccugccucagccucccaaagugcugggauuacaggugug

SEQ ID NO: 324643 - RNA, 64 nt, Human
cugccuccuggguucaagcaauucucccaccucagccucccaaguagcugggauuacagacgug

SEQ ID NO: 324644 - RNA, 64 nt, Human
ugaacuccugaccucaggugauccuccugccucggccucccaaagugcugggauuacaggcaug

SEQ ID NO: 324645 - RNA, 64 nt, Human
ucaacaugcgggaggugucccagcgcuuccgccugccucccagcgaguacgucaucgugcccuc

SEQ ID NO: 324646 - RNA, 64 nt, Human
cuuggacuccugacgucgugauccacccgccuuggccucccaaaguacugggauuacaggcgug

SEQ ID NO: 324647 - RNA, 64 nt, Human
ccgccuccuggguucaggcaauuuuccugccucagccucccaaguagcugggauuacaggcacc

SEQ ID NO: 324648 - RNA, 64 nt, Human
ugaacuccugaccucaggugauccuccugcauuggccucccaaagugcuggaauuccaggcaug

SEQ ID NO: 324649 - RNA, 64 nt, Human
gaacuccuggggcucaagugauccuccugccuuggccucccaaaaugcuggauuacaggcaugu

SEQ ID NO: 324650 - RNA, 64 nt, Human
ugaacuccugaccucaggugauccaccugccucagccucccaaagugcugagauuacaggcaug

SEQ ID NO: 324651 - RNA, 64 nt, Human
ugccucagccugaagucgugaucugcccgccucggccucccaaagugcugggauuacaggcguc

SEQ ID NO: 324652 - RNA, 64 nt, Human
uugaccuuuguggucuucugugauuauuuaugcugccucccaaggauagaauugaaauaaaaug

SEQ ID NO: 324653 - RNA, 64 nt, Human
ccaccucgcagguucaagcaauccucccacuucagccucccaagcaccugggauuacaagcaug

SEQ ID NO: 324654 - RNA, 64 nt, Human
ugcaguggcgcgaucucagcucacuacaaccuccgccucccauguucaagcgauucuccugccu

SEQ ID NO: 324655 - RNA, 64 nt, Human
cuccaucucuugaccucgugauccacccgccucagccucccaaagugcugggauuaacagguau

SEQ ID NO: 324656 - RNA, 64 nt, Human
ugcaguggcaucaucucagcucacugcaaccucugccucccagguucaagugcuucuccagccu

SEQ ID NO: 324657 - RNA, 64 nt, Human
cugccucccagguucaagugcuucuccagccucagccucccaaguagcugagacuacaggcaca

SEQ ID NO: 324658 - RNA, 64 nt, Human
guucuaggaugcugaggcccuggcccggacucuggccucccagauccccagcugccucacuucu

SEQ ID NO: 324659 - RNA, 51 nt, Human
uuggaaaugcaaauaagugaagccucccaagggacugaaguauacauuuag

SEQ ID NO: 324660 - RNA, 64 nt, Human
cccagaggauuuaauuauccugguuugcaaaagagccucccaugccaguaccgcccagccuugg

SEQ ID NO: 324661 - RNA, 64 nt, Human
cugagaguuacgugaggcacuuguuaaaaauucagccucccaggucccuccccucggagaggcu

SEQ ID NO: 324662 - RNA, 64 nt, Human
uggcaugcagcacacacggcugcuccaguucauggccucccaggggugcuggggaugcauccaa

SEQ ID NO: 324663 - RNA, 64 nt, Human
guggggaggggcgcuggcccagccggccucucuggccucccacccgaugcugcuuuccccugug

SEQ ID NO: 324664 - RNA, 64 nt, Human
uuggacaagccacacggguaucccaucccgaucugccucccagaacugugacacacugggcucu

SEQ ID NO: 324665 - RNA, 64 nt, Human
cucgaucucuugaccuugugacucacccgcaucggccucccaaagugcugggauuacaggcaug

SEQ ID NO: 324666 - RNA, 64 nt, Human
agcggaaaaagcugagcucauaggugcccagccagccucccagcuaaaggugcucagagcccca

SEQ ID NO: 324667 - RNA, 64 nt, Human
cugccuggggguuauucgggaugguucagccagggccucccaggaagagugcuguggagccacg

SEQ ID NO: 324668 - RNA, 64 nt, Human
agcgcugcacuugccaugcuggaaaccagcccaggccucccagggaagggcccagccacuucca

SEQ ID NO: 324669 - RNA, 64 nt, Human
ugaacuccugaacucaagcaauccuccugccucagccucccaaagugcugggauuacuggugug

SEQ ID NO: 324670 - RNA, 64 nt, Human
caacuuccugggcucaagugauccuuccacuucagccucccaaguagcugggacuacaggcaug

SEQ ID NO: 324671 - RNA, 58 nt, Human
acagcaaaauugauucaugaaguuuuuugccucccacguugggaagucauuaguugaa

SEQ ID NO: 324672 - RNA, 64 nt, Human
cugccuccuggguucaagugauucuucugccucagccucccaacuagcugggacuacagguaca

SEQ ID NO: 324673 - RNA, 64 nt, Human
cucaaacuccugaccucgugauccacccgccucggccucccaaaauccugggauuacaggcgcg

SEQ ID NO: 324674 - RNA, 64 nt, Human
cucgaucucuugaccucgugauccgcccaccucagccucccaaagugcuaggauuacaggcgug

SEQ ID NO: 324675 - RNA, 64 nt, Human
cgaacuccugaccucaggugauccacucgccucggccucccaaagugcugggauuauaggcaug

SEQ ID NO: 324676 - RNA, 64 nt, Human
cugccuccuggguucaagcaguucuccugccucagccucccaaguagcugggauuacaggcguc

SEQ ID NO: 324677 - RNA, 64 nt, Human
cucgaacuccugaccuugugauccgcaugccucagccucccaaagugcugggauuacaggcaug

SEQ ID NO: 324678 - RNA, 55 nt, Human
cugcucagcgccacaagugaccagugccucccaggaguccucaggcccuggggac

SEQ ID NO: 324679 - RNA, 64 nt, Human
cucgaacuccugaccuugugaucugcccaccucagccucccaaagugcuaugauuacagacgug

SEQ ID NO: 324680 - RNA, 64 nt, Human
uccaguggcacuaucucagcucacugcaaccuccgccucccagguucaagcaauucuccugccu

SEQ ID NO: 324681 - RNA, 64 nt, Human
cacacacacacacacacacacacacacacacacugccucccauccuucccucaugcccgccagu

SEQ ID NO: 324682 - RNA, 64 nt, Human
cgaacuccugaccucaaaugacccaccugccucggccucccaaagugcuaggauuacaagugug

SEQ ID NO: 324683 - RNA, 64 nt, Human
uuuuuaauuauuguaaaucauuaccucauuuccagccucccaggcuccauccaucccagcaucu

SEQ ID NO: 324684 - RNA, 64 nt, Human
gaacuccuggaccucaagugaucuacccgccuuggccucccaaagugcuggcauuacaggugug

SEQ ID NO: 324685 - RNA, 64 nt, Human
uggagccucgguagccguuccuccugcccgcugggccucccaacgggcccuccuccccuccuug

SEQ ID NO: 324686 - RNA, 64 nt, Human
cagguccugcggccaaaucugucucccuucaugggccucccagggaaggaggaagcccugcugu

SEQ ID NO: 324687 - RNA, 64 nt, Human
ugcaguggcgcgaucuuagcucacugcaagcuccgccucccagguucacaccauucuccugccu

SEQ ID NO: 324688 - RNA, 64 nt, Human
caaacuccagggcucaagcaguccucccaccucagccucccaaagugcugggaucacaggcaug

SEQ ID NO: 324689 - RNA, 64 nt, Human
accaggcccuagucucggucagggagucugcucugccucccaggcgggaucgcugguuucucuc

SEQ ID NO: 324690 - RNA, 64 nt, Human
caucauucauucauccauucuagagccagucucugccucccagacgcggcgggagccaagcucc

SEQ ID NO: 324691 - RNA, 64 nt, Human
gggagcaaggauggugcuaggucauucauggcuggccucccagcccccggguggggaccuggcc

SEQ ID NO: 324692 - RNA, 64 nt, Human
ggucucaaacuccuaaggucauccaccugccucggccucccagagugcugagauuacaggcgug

SEQ ID NO: 324693 - RNA, 64 nt, Human
aggaggucccuccuguagggcacaaggccaggcugccucccagcccccaggcccucucccaccu

SEQ ID NO: 324694 - RNA, 64 nt, Human
uucucagcggagcgcuucucggcacuucugaugugccucccauggagggagccgggcccuugcu

SEQ ID NO: 324695 - RNA, 64 nt, Human
ggucaccugcacucccagccaaguggugauguaugccucccacucucugcaagguuuuccucau

SEQ ID NO: 324696 - RNA, 64 nt, Human
ggggccaggggagcccaggcugcccugcacuccugccucccagcccacagccaggugcuuucau

SEQ ID NO: 324697 - RNA, 64 nt, Human
ccaucucccugguucaagcaauucuccuaugucagccucccaaguagcugggacuauagucacu

SEQ ID NO: 324698 - RNA, 64 nt, Human
caaacucuugaccucaggugauccacccaccucagccucccaaagugcugggauuacaagcgug

SEQ ID NO: 324699 - RNA, 64 nt, Human
ugaacuccuggccucaagugauucuccugccucagccucccaaagugcugggauuacaggugug

SEQ ID NO: 324700 - RNA, 64 nt, Human
caaacuccugaccucaagugaucugccugccuuggccucccaaauugcuagguuuacaggcaug

SEQ ID NO: 324701 - RNA, 64 nt, Human
gcuccgccucccggguucacgccauucugcgucagccucccaaguagcugggacuacaggcacc

SEQ ID NO: 324702 - RNA, 64 nt, Human
cuugaucuccugaccgcauaauccacccaccucggccucccaaagugcugggauuacaggcgug

SEQ ID NO: 324703 - RNA, 64 nt, Human
gcccagggaggagucaguaccccugguaaaccaagccucccacacugaaaccaaaacauaaaaa

SEQ ID NO: 324704 - RNA, 64 nt, Human
ccaacucccagguucaagugagucucgugccucagccucccaaguagcugggauuacaggcacc

SEQ ID NO: 324705 - RNA, 64 nt, Human
caaacuccugaccucaggugcuccaccugccuuggccucccaaagugcugggauuacaggcgug

SEQ ID NO: 324706 - RNA, 64 nt, Human
accuccugggcucaaaugaucuccucccaccucagccucccaaguagcugagacuacagguuca

SEQ ID NO: 324707 - RNA, 64 nt, Human
ugcaguggcgugaucucagcucacugcaacccccgccucccagguucgagcacuuuucaugccu

SEQ ID NO: 324708 - RNA, 64 nt, Human
caaacuccugaccucaggugauccaccugccucggccucccagagugcugggauuacaggcaug

SEQ ID NO: 324709 - RNA, 64 nt, Human
ccgccuccuggguucaagugauucuccugccucagccucccaaguagcugggauuacuggugca

SEQ ID NO: 324710 - RNA, 64 nt, Human
ugaacuccuggccucaaaugaucuucccacuucagccucccaaagugcagggauuacaggcaca

SEQ ID NO: 324711 - RNA, 64 nt, Human
caaacuccugaccucaggugaucuaccugccucagccucccaaagugcugagauuacagacaug

SEQ ID NO: 324712 - RNA, 64 nt, Human
cagccccucugcccugucccugcacaccuccacugccucccagcagaucuguggagacaaaaca

SEQ ID NO: 324713 - RNA, 64 nt, Human
ugaacuccugggcucaagugaucuucccacgugggccucccaaaacgcuggaacuacaagugug

SEQ ID NO: 324714 - RNA, 64 nt, Human
cgaacuccuguccucagguaauccgcccaccucagccucccaaagugcugggauuacaggcgug

SEQ ID NO: 324715 - RNA, 64 nt, Human
cgaccuccuggguucaagcgauucucccaccccagccucccaaguagcugggauuacaggugug

SEQ ID NO: 324716 - RNA, 64 nt, Human
caaacuccugggcucaagcgauccuccuggcucagccucccaaagugcugggauuacaggcgug

SEQ ID NO: 324717 - RNA, 64 nt, Human
gaccauucuccaccugccagggacagaggggguggccucccaacucaccccagccccaaaacuc

SEQ ID NO: 324718 - RNA, 64 nt, Human
gcccaggcuuagucacugagacagcccgggcucugccucccaucacccgcuaagagggagggag

SEQ ID NO: 324719 - RNA, 64 nt, Human
cccccagccucuccccuccuccuccuugucacuggccucccacaacuccccuucuggcugccug

SEQ ID NO: 324720 - RNA, 64 nt, Human
gaggaaccugcuaaaaucgauggagaugcuucuagccucccaguaggaggccccagccaugccu

SEQ ID NO: 324721 - RNA, 64 nt, Human
cuggaguuaugcucuuuugaaaugucacaaggccgccucccaccucuggggcauuguacaaguu

SEQ ID NO: 324722 - RNA, 64 nt, Human
cgaacuccuggcaucaagcgauccuccugccuuagccucccagaguacugggauuacaggcucu

SEQ ID NO: 324723 - RNA, 64 nt, Human
ccugggguuggagagucagugccugcagucaagugccucccagccucggcucagcacaucccuu

SEQ ID NO: 324724 - RNA, 64 nt, Human
ggccguccugcauuucugguuuccagaccccaaugccucccauucggauggaucucugcguuuu

SEQ ID NO: 324725 - RNA, 64 nt, Human
uguccucccaggcucaagcuauccuugcaccucagccucccaaguagcugggaccacaggcaug

SEQ ID NO: 324726 - RNA, 64 nt, Human
caaacuccugggcucaagugauccucccaucuuggccucccagaguauugggauuacagacaug

SEQ ID NO: 324727 - RNA, 64 nt, Human
gacauaaaaauucagucccuuuguccuuccccgugccucccaaaguuacuuuaagauccuuaga

SEQ ID NO: 324728 - RNA, 64 nt, Human
uuccuuccgccucuguuccucuucuggagccuuugccucccaucucuuaucuccuugauauaau

SEQ ID NO: 324729 - RNA, 52 nt, Human
gcacggugggacgggacugacagccucccagaggcccguggaggagcccacc

SEQ ID NO: 324730 - RNA, 64 nt, Human
ccgccucccggguucaagcaauucucaugcaucagccucccaaguaccugggacuacaggcgug

SEQ ID NO: 324731 - RNA, 64 nt, Human
gaacuccugaccucaggugaucccccccaccucagccucccaaagugcugggauuacaggcgug

SEQ ID NO: 324732 - RNA, 64 nt, Human
caaacuccugaccucaggugaugcacccaccucagccucccaaagugcagggauuacaggcaug

SEQ ID NO: 324733 - RNA, 64 nt, Human
gagugcaguggugcaaucuuggcucgcaaccuccgccucccagguucaagagauucuccugccu

SEQ ID NO: 324734 - RNA, 64 nt, Human
cgaacuccugaccucaggugauccacccgccucagccucccaaagugcugggauuacaggcaug

SEQ ID NO: 324735 - RNA, 64 nt, Human
aagcagccagagggguuguggggccugaaccccggccucccacccugggggaggcccucuguga

SEQ ID NO: 324736 - RNA, 64 nt, Human
cgaacuccugaccucaggugauccgccugccuuggccucccagagugcugggauuacaggcgug

SEQ ID NO: 324737 - RNA, 64 nt, Human
cccucuucuccccgcccucccccagcuccuaccugccucccacgccucagguguggcugccugu

SEQ ID NO: 324738 - RNA, 55 nt, Human
uuguggaucucuuggcauaaccacugccucccagggaacacaaggccuuugccau

SEQ ID NO: 324739 - RNA, 64 nt, Human
cccugccugccccccggguggggcugcggcucuggccucccaggcccauccucaacagcuaccc

SEQ ID NO: 324740 - RNA, 64 nt, Human
uggcaggcucuggcacccugggccuccuccgggagccucccaucugggcaguggagccauaaac

SEQ ID NO: 324741 - RNA, 64 nt, Human
ggaauaauccugcccuugagagaaaggaucuccagccucccagaagccugcugugcuuucgucc

SEQ ID NO: 324742 - RNA, 64 nt, Human
cucgaucuccugaccucgugauccacccaacucggccucccaaagugcugggauuacaggcaug

SEQ ID NO: 324743 - RNA, 64 nt, Human
caaacuccugaccucaggugauccgccuaccucagccucccaaagugcugggauuacaggcgug

SEQ ID NO: 324744 - RNA, 64 nt, Human
ugcaguggugugaucucggcucacugcaaccucugccucccagguuccagcaauucuccugccu

SEQ ID NO: 324745 - RNA, 64 nt, Human
cgaaugccugaccucaggugauccacccgccuuggccucccaaagugcuggaauuacaggugug

SEQ ID NO: 324746 - RNA, 64 nt, Human
cugccuccuggguucaauccauucuccugccucagccucccaaguagcugggauuacaggcaca

SEQ ID NO: 324747 - RNA, 64 nt, Human
caaacuccuagccuugauugauccuccugccuuggccucccaaagugcugggacuacaggugca

SEQ ID NO: 324748 - RNA, 64 nt, Human
cucgaucuccugaccucgugaucugcccuccucagccucccaggugcugggauuauaggcguga

SEQ ID NO: 324749 - RNA, 64 nt, Human
gaaggagccaccucucagugccucaccucccccugccucccagccuccgcagaugagguuccug

SEQ ID NO: 324750 - RNA, 64 nt, Human
gacaaagagcucucgcaagaagagacagcgugaugccucccacaguccaccccagacccugggg

SEQ ID NO: 324751 - RNA, 64 nt, Human
uccauucaagacucugaugacaccccuccccgaggccucccacugccggggucccaggacccuu

SEQ ID NO: 324752 - RNA, 57 nt, Human
cucuccugcaguaugagugaccacagggccucccagcccaacaucuccagcuggauc

SEQ ID NO: 324753 - RNA, 64 nt, Human
gcuagagcccagggucccugcagggccuggccucgccucccagggcugucucuccuacaccugg

SEQ ID NO: 324754 - RNA, 64 nt, Human
cauagaaaauaaacuuugcccaaucacaacuugugccucccaucccuggaguacugacuggcac

SEQ ID NO: 324755 - RNA, 64 nt, Human
cuguguccugggcucaagugauccuccugccucagccucccaaguagcuaggaccacaggugcg

SEQ ID NO: 324756 - RNA, 64 nt, Human
cgaacucccgaccucaggugauccaccugccucggccucccaaaguguugggauuacaggcgug

SEQ ID NO: 324757 - RNA, 64 nt, Human
caaacuccuaaccucaagugauucgccugccucggccucccaaagugcugggauuacagguggg

SEQ ID NO: 324758 - RNA, 64 nt, Human
gauuuuacuuaagcagcuaccauuccauggacuugccucccagagcagcacaaugcccgucuga

SEQ ID NO: 324759 - RNA, 64 nt, Human
gguuuugaguuuguagugcugagccugcaucugugccucccagcccccugcacugagggagcaa

SEQ ID NO: 324760 - RNA, 64 nt, Human
aucccccacuagagagguccggugugcacagccggccucccagugugccaaaaugaacugcucu

SEQ ID NO: 324761 - RNA, 64 nt, Human
ugaauucccgggcucaagugguccuccugccucagccucccacaggaucgggauuacaggcaag

SEQ ID NO: 324762 - RNA, 64 nt, Human
uggauaagaacucgugucuccugagugagguagcgccucccaucugcuccccaauucuugaucu

SEQ ID NO: 324763 - RNA, 64 nt, Human
cacuacaaccuccaccucccagccaccugccuuggccucccaaagugccgagauugcagccucu

SEQ ID NO: 324764 - RNA, 64 nt, Human
cgaauuccuggucucaagcaguccucccaccucagccucccaaggugcugggauuacaggugug

SEQ ID NO: 324765 - RNA, 64 nt, Human
aaacuccugaacucaagugauaacacccaccuuggccucccaaagugcugggauuacaggugug

SEQ ID NO: 324766 - RNA, 64 nt, Human
ugcaguggcuugaucuuggcucacugcaaccuccgccucccagguucaagcaauucuccugccu

SEQ ID NO: 324767 - RNA, 64 nt, Human
cgaacuccuggccucaagugaucugcccgccucggccucccaaagugcugggauuacaggcgug

SEQ ID NO: 324768 - RNA, 64 nt, Human
cgaacuccugaccucaagugauccaccugccuuggccucccaaggugcuaggauuacaggcaug

SEQ ID NO: 324769 - RNA, 64 nt, Human
ucucacacugaccucaggugauccacccgccuuggccucccaaaguguugggauuacaggcaug

SEQ ID NO: 324770 - RNA, 64 nt, Human
ugccucccugcagucccucccauggaugacucaggccucccagaagcaauuucuaucugucccc

SEQ ID NO: 324771 - RNA, 64 nt, Human
cagcaugccccuacggccaggggacugucugccagccucccaggcccaugcccuccuggugccc

SEQ ID NO: 324772 - RNA, 64 nt, Human
gccucuguuagcugggugggugucaucagccccugccucccaggccagaaccugagaacgggcc

SEQ ID NO: 324773 - RNA, 64 nt, Human
ugcaguggugugaucuuggcucacugcaaccucugccucccagguucaagcaauucuccugccu

SEQ ID NO: 324774 - RNA, 64 nt, Human
cugccucccagguucaagcaauucuccugccucagccucccaaguagcugggacuacaggcaca

SEQ ID NO: 324775 - RNA, 64 nt, Human
cuccaucucuugaccuugugauccacccaccucagccucccaaagugcugggauuacaggcaug

SEQ ID NO: 324776 - RNA, 64 nt, Human
ccaacuccugaccuaaagugaucugcccgccuuggccucccaaagugcugggauuacagacaug

SEQ ID NO: 324777 - RNA, 64 nt, Human
cgugcaauggcgcaguugacucacuacagccucugccucccagguucaagcgauucucaugccu

SEQ ID NO: 324778 - RNA, 64 nt, Human
cugccucccagguucaagcgauucucaugccuuagccucccaaguagcugggauuacaggugug

SEQ ID NO: 324779 - RNA, 64 nt, Human
cucagccucugccagcgccaaaacaagccaaagagccucccaccagagccgggaggaaaaggcc

SEQ ID NO: 324780 - RNA, 54 nt, Human
cacagcucacucgaccuugaggaggccucccacgaagggcgaagauggccgaga

SEQ ID NO: 324781 - RNA, 64 nt, Human
cuggcaaugggcucccuacccacacuggcuuccugccucccaccccucacaccuggcuucuaga

SEQ ID NO: 324782 - RNA, 64 nt, Human
ugaauuccugagcucaagcaaccugccggccucggccucccaaaguacugggauuacacgcaga

SEQ ID NO: 324783 - RNA, 64 nt, Human
guucccugcugagcggaggcagcccaccuguccugccucccaggagcccuuggccaccucgcgc

SEQ ID NO: 324784 - RNA, 64 nt, Human
cucaaacuccuaaccuugugauucgcccgccuuggccucccaaagugcugggauuccaggcgug

SEQ ID NO: 324785 - RNA, 64 nt, Human
ugcgaggugaugggggcuggggccccaggcgucagccucccagagggacagcugagcccccugc

SEQ ID NO: 324786 - RNA, 64 nt, Human
caugccugccacccuggcaucggcuuucugugccgccucccacacaaaucagccccagaaggcc

SEQ ID NO: 324787 - RNA, 64 nt, Human
gcggcgcuccuuuaucugaugugguuuaguaaaagccucccacacaccuccccguggccuggga

SEQ ID NO: 324788 - RNA, 64 nt, Human
ugaacuccuggucucaagugaucugcccgccucggccucccaaagugcugggauuacaggugug

SEQ ID NO: 324789 - RNA, 64 nt, Human
cgaacuccugaccucaggugauccacccgccucggccucccaaagugcugggauuacaggcgug

SEQ ID NO: 324790 - RNA, 64 nt, Human
cucgaucuccugaccucgugauccaccugccucggccucccaaagugcugggaugacaggcaug

SEQ ID NO: 324791 - RNA, 64 nt, Human
cgaacucuugaccucaggugaucugcccgccuuggccucccaaagugcugggauuacaggugug

SEQ ID NO: 324792 - RNA, 64 nt, Human
cgaacuccugaccucaggugauccgcccaccucggccucccaaagugcugggauuacaggugug

SEQ ID NO: 324793 - RNA, 64 nt, Human
ggccccaccuucuucaucccucagacccgaggaggccucccaguaaggaguuucccaagagggg

SEQ ID NO: 324794 - RNA, 64 nt, Human
cucgaacuccugaccuggugaucugcccacccaggccucccaaagugcugggauuaaaggugug

SEQ ID NO: 324795 - RNA, 64 nt, Human
caaacuccugggcucaggcgauccaccugucucagccucccagagugcugggauuacaauugug

SEQ ID NO: 324796 - RNA, 64 nt, Human
acugacauucuccacuucuuguuccccacugacagccucccacccccaucucucccuccccugc

SEQ ID NO: 324797 - RNA, 64 nt, Human
cucaaacuccugaccucgugaugcacccaccucggccucccaaagugcugggauuacaugcgug

SEQ ID NO: 324798 - RNA, 64 nt, Human
caaacuccugaccucaggugauccacccaccucagccucccaaagugcugggauuacaagcgug

SEQ ID NO: 324799 - RNA, 64 nt, Human
aaacuccuuggagagacgacuaggaggacagcuugccucccaggccccuuguggacuuagacuc

SEQ ID NO: 324800 - RNA, 64 nt, Human
guuuccauggaaaugccaccgugucugcucccaggccucccacuagucaggaccagcuucagcc

SEQ ID NO: 324801 - RNA, 64 nt, Human
ugcaguggugugaucucaguucacugcaaccucugccucccacguucaagcgauccuccugccu

SEQ ID NO: 324802 - RNA, 64 nt, Human
auggugccuugggccccuuagccccagcgccagggccucccagcugaggccacaggacaagcac

SEQ ID NO: 324803 - RNA, 64 nt, Human
cacacuccgaguccugggucccaguccagcugcugccucccaacccaugcccgcuagaaaccug

SEQ ID NO: 324804 - RNA, 64 nt, Human
uccuggagauuccugcaguggaacuccaugccccgccucccaacggaccuggacguagagggcc

SEQ ID NO: 324805 - RNA, 64 nt, Human
caaaguagcacuucgagcacgccagguucuuauugccucccauuugccaucauaugagcuucgc

SEQ ID NO: 324806 - RNA, 64 nt, Human
cgaacuccuggucucaagcaguccuccugucuuagccucccaaagugcugggauuacaguugug

SEQ ID NO: 324807 - RNA, 64 nt, Human
ggaaacaaagacuggacacucuacuucuaaggacgccucccauccaccuacaguacucacaaca

SEQ ID NO: 324808 - RNA, 64 nt, Human
ccccuggaguucagaaguccucucuguaaagccugccucccacuaggucaagaggaacuagagu

SEQ ID NO: 324809 - RNA, 64 nt, Human
cauauauaaaaccacuguccuguccuuuguggcugccucccaagccugcuucuuuguccucgcc

SEQ ID NO: 324810 - RNA, 64 nt, Human
gcccucaccagccuuggagucuguucuagggaaggccucccagcaucugggacucgagaguggg

SEQ ID NO: 324811 - RNA, 64 nt, Human
ugaacuccugaccgcagguaauccaccugcuucggccucccaaagugcugggauuacaggcgca

SEQ ID NO: 324812 - RNA, 64 nt, Human
aguggccugaagaguccucugaaugaaccuucuggccucccacagacucaaaugcucagaccag

SEQ ID NO: 324813 - RNA, 64 nt, Human
gacaaccugugacacccugaguccaaacccuugugccucccaguucuuccaagugucuaacuag

SEQ ID NO: 324814 - RNA, 64 nt, Human
caaaccccugggcucaagcaagccuccugccuuggccucccaaagugcugggauuacaggugug

SEQ ID NO: 324815 - RNA, 64 nt, Human
ggaccucccaagcucaagcaauccuccugccucugccucccaaguagcugggaccacagguggg

SEQ ID NO: 324816 - RNA, 64 nt, Human
ggccucgcagcagcaaggugggggcaagcagaaugccucccaggauuucacaccugagcccugc

SEQ ID NO: 324817 - RNA, 64 nt, Human
gucaggaagacccucagauguggccagagcaccggccucccagagaaagcccaggaaguccccg

SEQ ID NO: 324818 - RNA, 64 nt, Human
aaggaagagggaaagagggcugccauuccugacagccucccagccagggcuggcgauaaaggac

SEQ ID NO: 324819 - RNA, 64 nt, Human
gagcucuggccccgcuagcggggccaggagccgggccucccaccgcagcgucccccgccgcgcc

SEQ ID NO: 324820 - RNA, 64 nt, Human
gguccagagcccgcaaauggacucggagccgagggccucccagcagagcuugggaagggccaug

SEQ ID NO: 324821 - RNA, 64 nt, Human
ucgcggccccaccgaggcgucggccgcccgaagagccucccaagccagcgcggcugucacgggc

SEQ ID NO: 324822 - RNA, 64 nt, Human
aucagggaaaucuccacuucgggaccuucuaucugccucccaacuccucaaggucaccuauaga

SEQ ID NO: 324823 - RNA, 64 nt, Human
agaauaguucucauuggaggcugaggucgaagcagccucccaccagcgaucccuuggggcgggc

SEQ ID NO: 324824 - RNA, 64 nt, Human
agcaugcggagugcccagagugcagaccuccccugccucccauggugaugggggcucagcagcg

SEQ ID NO: 324825 - RNA, 64 nt, Human
gauaagaagacccaguaggcccuccugccucccugccucccacccucaucucucuacccuaccc

SEQ ID NO: 324826 - RNA, 64 nt, Human
cgaacuccugaccucaggugauccaccugccucggccucccaaagugcuaggauuacaggcgug

SEQ ID NO: 324827 - RNA, 64 nt, Human
cgaacuccugaccucaggugauccgcccaccuuggccucccaaagugcugggauuacacgcgug

SEQ ID NO: 324828 - RNA, 64 nt, Human
acgggcccgcccagcacccugagaccacacuguugccucccagugacccugcugggacaccagg

SEQ ID NO: 324829 - RNA, 64 nt, Human
gccagggaaguggggagggggggcggaaacccaugccucccagcugagcacugggaaugucagc

SEQ ID NO: 324830 - RNA, 64 nt, Human
uuuuuacaccaauuugguaaaaaugcugcucucagccucccacaauuaaaccgcaugugaucuc

SEQ ID NO: 324831 - RNA, 64 nt, Human
gauguagguguuaggcaugucccacccacccgccgccucccacggcaccucggggacaccagag

SEQ ID NO: 324832 - RNA, 64 nt, Human
ugaauaguuugguuauaguguuuaggcuagaaaugccucccacauugguaauaaacauuacaaa

SEQ ID NO: 324833 - RNA, 64 nt, Human
ggcugggcucaaacuccugaauccgccugccucggccucccaaagugcugggauuacaggugug

SEQ ID NO: 324834 - RNA, 64 nt, Human
ugaacagugccgccaguacauggacuucaccucugccucccagaugucugacuccacccuucau

SEQ ID NO: 324835 - RNA, 64 nt, Human
ggaacuccuuggcucaagcaauccugcugccuuggccucccaaguauguaggacuacagguacu

SEQ ID NO: 324836 - RNA, 64 nt, Human
caaacuccugggcugaaacaauccucccgccuuggccucccaaagugcugggauuauaggcaca

SEQ ID NO: 324837 - RNA, 64 nt, Human
caaacuccccagcuaaagcaguccuccagccucggccucccaaaguacugggauuacaggcgug

SEQ ID NO: 324838 - RNA, 64 nt, Human
ccacaucccggguucaagugauucuccugccuuagccucccagguagcugggacuacaagcgug

SEQ ID NO: 324839 - RNA, 64 nt, Human; identical to SEQ ID NO: 324218

SEQ ID NO: 324840 - RNA, 64 nt, Human
ugcaguggcgcgaucucggcucacugcaagcucugccucccagguucacaccauucuccugccu

SEQ ID NO: 324841 - RNA, 64 nt, Human
ugcaguggcgcaaucucagcucacugcaaccuccgccucccagguucaagcaguucuccugccu

SEQ ID NO: 324842 - RNA, 64 nt, Human
cucgaucuccugaccucgugauccgccugccucggccucccaaagugcugggauuacaggcaug

SEQ ID NO: 324843 - RNA, 64 nt, Human
caaacuccugaccucaggugauccaccugccucggccucccaaagugcugggauuacaggcgug

SEQ ID NO: 324844 - RNA, 64 nt, Human
uucugcaggugucaugugcuggcccugugauuuugccucccacacccagccacuaccucccagc

SEQ ID NO: 324845 - RNA, 64 nt, Human
uuucccuguauaacguaaacacacuugcccucaugccucccagaauaugaggucuaauuaagaa

SEQ ID NO: 324846 - RNA, 64 nt, Human
cucaaucucuugaccuggugaucugcccaccugggccucccaaaaugcugggauuacaggcaug

SEQ ID NO: 324847 - RNA, 64 nt, Human
ccccuucaaguugagaacuggucagggcaaaccugccucccauucuacucaaagucaucccucu

SEQ ID NO: 324848 - RNA, 64 nt, Human
ugcgaggcugacgcugguguguaugcgagcgcccgccucccagccccggugcccgcagaagacg

SEQ ID NO: 324849 - RNA, 64 nt, Human
accccggcccgaggcgcccaggccugagccccaugccucccagcaaccagggcccgcgggugug

SEQ ID NO: 324850 - RNA, 64 nt, Human
agagcaggaaacccggccguggccuggcagcuccgccucccaugcccgcacgcuggggucuguc

SEQ ID NO: 324851 - RNA, 64 nt, Human
cagcagcaaggugcgcaacauggcugccagccccgccucccacccccaccccgaguccugagcu

SEQ ID NO: 324852 - RNA, 64 nt, Human
cugccucccguguucaagcaguucuccugccucagccucccaaauagcugggauuacaguugcc

SEQ ID NO: 324853 - RNA, 64 nt, Human
cgaacuccugaccucaagugauccacccgccuuggccucccaaagugcugggauaauagguguc

SEQ ID NO: 324854 - RNA, 64 nt, Human
caacuuccugggcucaaguaauccucccaccccagccucccagguagcuaguacuauaggugug

SEQ ID NO: 324855 - RNA, 64 nt, Human
gauggggagcucagcccucgaaggccgcagagacgccucccaggcccgucugccagggcgccgg

SEQ ID NO: 324856 - RNA, 64 nt, Human
gccuccuucaggcaccaaucaggagaaggguucugccucccauccccucuaccugcagacaggg

SEQ ID NO: 324857 - RNA, 64 nt, Human
ugaacuccuggacuuagacgauccuccugccucagccucccaagcaacugggauucauccuuuc

SEQ ID NO: 324858 - RNA, 64 nt, Human
guguuaaguggggagcccugggggagucucuccugccucccagccucucccaagaccucccccc

SEQ ID NO: 324859 - RNA, 64 nt, Human
ccuagagcgugauucucccaucugaggcaaucuugccucccaggggaaauuuugcaauguuugg

SEQ ID NO: 324860 - RNA, 64 nt, Human
guuagagcagaggaggucccagauaccaaguggcgccucccaggaaaggcugggagaagaggug

SEQ ID NO: 324861 - RNA, 64 nt, Human
ugaacugcuggccuaaagcgauccccccgccuaggccucccaaagugcuggguuuaccagcgug

SEQ ID NO: 324862 - RNA, 64 nt, Human
cucaaacuccagaccucaugauuuacccaccucggccucccaaaaugcugggauuacagacaug

SEQ ID NO: 324863 - RNA, 64 nt, Human
cuugaacuccagaccucaugauucgccugccucggccucccaaaaugcugggauuacagauaug

SEQ ID NO: 324864 - RNA, 64 nt, Human
acggacacccccucgcuuggacggcugggcacacgccucccacugggguccagggagcaggcgg

SEQ ID NO: 324865 - RNA, 64 nt, Human
caaacuccuggccucaggugaucugcccaccucggccucccaaagugcugggaucaaauccacu

SEQ ID NO: 324866 - RNA, 64 nt, Human
ccgccuccugcguucaagugauuguccugucucagccucccaaguagcugggauuacaggcacc

SEQ ID NO: 324867 - RNA, 64 nt, Human
ugaacuccuaaccucaggugauccacccgccucggccucccaaagugcugggauuacaggcccg

SEQ ID NO: 324868 - RNA, 64 nt, Human
cggccuccuggguucaaaugauucuccugccucagccucccaaguagcugggauaacaggcgcc

SEQ ID NO: 324869 - RNA, 64 nt, Human
gaacuccuugaccucagguaaucugccuaccuuggccucccaaagugcugggaucacaggcgug

SEQ ID NO: 324870 - RNA, 64 nt, Human
ugaacuccugaccucaggugauccgcuggccucggccucccagagugcugggauuauaggcgug

SEQ ID NO: 324871 - RNA, 64 nt, Human
gagugcaguggugugacggcucacugcagccugcgccucccagcguccagcaauucuuguuucu

SEQ ID NO: 324872 - RNA, 64 nt, Human
gcgccucccagcguccagcaauucuuguuucucggccucccaaguagcugggacuauaggugcg

SEQ ID NO: 324873 - RNA, 64 nt, Human
cugaccacccccugcccuccugccggacccuggggccucccaccccagccucccugaggcccau

SEQ ID NO: 324874 - RNA, 64 nt, Human
cugccuccuggguuuaagccauucuucugccucagccucccaaguagcugggauuacaggugcc

SEQ ID NO: 324875 - RNA, 64 nt, Human
ugaacuccugaccucaugugauccgcccgccucagccucccaaagugcugggauuacaggcuug

SEQ ID NO: 324876 - RNA, 64 nt, Human
cucgaucucuugaccucgugauccaucugccucggccucccaacgugcuggaauuacaggcaug

SEQ ID NO: 324877 - RNA, 64 nt, Human
gaacuccugacuucaaaagugaucgcccucuuuggccucccaaagugcugggguuuacaggcuu

SEQ ID NO: 324878 - RNA, 64 nt, Human
uugugguucacagcagccgcagccaaacccggcugccucccaccccagccucaaaaccucuucc

SEQ ID NO: 324879 - RNA, 64 nt, Human
cacccccgccccacugaggccaguagggggccaggccucccacuccucccagcccgggagaugc

SEQ ID NO: 324880 - RNA, 64 nt, Human
caaacuccuagucuuaagcaaucuuccugcuuuggccucccaaagcgcuaggauuccaggugug

SEQ ID NO: 324881 - RNA, 64 nt, Human
ugcgacgcccugcacugcucccgccuccaccagcgccucccacugaugucguggucccgggccu

SEQ ID NO: 324882 - RNA, 64 nt, Human
cgaacuccugaacucaagugauucacccaccuuagccucccaaagugcugggauuacaggcgug

SEQ ID NO: 324883 - RNA, 64 nt, Human
ucaccuaccgaguucaagugauuuuccugccuuggccucccaaguagcugggauuacaggugug

SEQ ID NO: 324884 - RNA, 64 nt, Human
aaaacuccugaccucaagugaucugcccaccucagccucccaaagugcugagauuacaggcaug

SEQ ID NO: 324885 - RNA, 64 nt, Human
ugcaguggcgcuaucucagcucacugcaagcuccgccucccagguucacgccauucuccugccu

SEQ ID NO: 324886 - RNA, 64 nt, Human
ugaacucuuggcuccaagugauacuucugccuuggccucccaaagugcugaauuaagcagcuca

SEQ ID NO: 324887 - RNA, 64 nt, Human
ggauaucuggggacaagaugguggccucaggccugccucccaggcaguuggcugggcucccaac

SEQ ID NO: 324888 - RNA, 64 nt, Human
cuuguucgucuggacgacacuggaguggaacacugccucccacuuucuugggacuuggagggag

SEQ ID NO: 324889 - RNA, 64 nt, Human
cuuuucugcuugaggcuaaggcacuguaucccaggccucccaauguucccgagccaggaacucu

SEQ ID NO: 324890 - RNA, 64 nt, Human
cucgaucuccugaccuccugaugcgccugccucagccucccagugcugggauuauaggugugag

SEQ ID NO: 324891 - RNA, 64 nt, Human
gucaaacaaaaccggagagggggugggggagccagccucccagcgugcugugcccgcaggcacc

SEQ ID NO: 324892 - RNA, 64 nt, Human
cgaacuccgcaucucaggugaucugcucgccuuggccucccaaagugaugggauuacaggcaug

SEQ ID NO: 324893 - RNA, 64 nt, Human
caaauucuugaucucaagugaucuguccgccccggccucccagagugcuggguugggauuacag

SEQ ID NO: 324894 - RNA, 64 nt, Human
ugcaguggcaugaucuuggcucacugcagccuccgccucccagguucaagcgauucuccugccu

SEQ ID NO: 324895 - RNA, 64 nt, Human
cucaaacuccugaccucaugauccgccuuccucggccucccaaagugcugggauuacagguguu

SEQ ID NO: 324896 - RNA, 64 nt, Human
gugcccaacccuaucccagagaccuugaugcuuggccucccaaucuugcccuaggauacccaga

SEQ ID NO: 324897 - RNA, 64 nt, Human
ggagucaacaaacuguggccauuggccaaauauggccucccaacuguuuuuuuaaaauaaaguu

SEQ ID NO: 324898 - RNA, 64 nt, Human
ccaacuccugaccucaagugauauguucaccucagccucccaaagugcugggauuacaggcaug

SEQ ID NO: 324899 - RNA, 64 nt, Human
ccgccucccggguucaagcaauucuccugccucagccucccaaguagcugggauuacaggcgug

SEQ ID NO: 324900 - RNA, 64 nt, Human
ccgccuccuggguucaagcgauucuccugccccagccucccaaguagcugggaggacaggugug

SEQ ID NO: 324901 - RNA, 64 nt, Human
cugggacauccucccugcuguccucucucccccggccucccagcugccaggaauuucugcgccu

SEQ ID NO: 324902 - RNA, 64 nt, Human
gaaccucuuggguucaagugauucuugugccucagccucccaaguagcuggaauuacaggcaca

SEQ ID NO: 324903 - RNA, 64 nt, Human
cgaacuccugaccucaggugauccacccaccuuggccucccaaagugcugagauuauaggcaug

SEQ ID NO: 324904 - RNA, 64 nt, Human
ggaacuccugacuucaaauuacccaccugccucagccucccaaagugcuggcauuacaggcgcu

SEQ ID NO: 324905 - RNA, 64 nt, Human
ugcaguggcacaaucauggcucacugcagucucugccucccaggcucaagugauccucccaccu

SEQ ID NO: 324906 - RNA, 64 nt, Human
ugaccuccugagcucaagcaguccaucugccucagccucccaaagugcugggacuacagacaug

SEQ ID NO: 324907 - RNA, 64 nt, Human
ccgccucccggguucacgccauucuccugccucagccucccaaguagcugggacuacaggcacc

SEQ ID NO: 324908 - RNA, 64 nt, Human
cucgaucuccugaccucgugauccgcccgccucagccucccaaagugcugggauuacaggcgug

SEQ ID NO: 324909 - RNA, 64 nt, Human
ugcagugcugugaucuuggcucacugcaagcuccgccucccagguucaugccauucuccugccu

SEQ ID NO: 324910 - RNA, 64 nt, Human
uuagguggcaugauuucggcucacugcaaccucugccucccaaguucaacugauucuucugccu

SEQ ID NO: 324911 - RNA, 64 nt, Human
cugccucccggguucaugccauucuccugccucagccucccaaguagcugggacuacaggcgcc

SEQ ID NO: 324912 - RNA, 64 nt, Human
cucgaucuccugaccucgugauccacccgccucggccucccaaagugcugggauuacaggcgug

SEQ ID NO: 324913 - RNA, 64 nt, Human
ccaacuacuggccucaaacgauccuccugccucggccucccaaagcacuggaauuucaggcaug

SEQ ID NO: 324914 - RNA, 64 nt, Human
ccuggugaacacagaugugcuugggaugacgggugccucccaagagcuucccaucucccuagaa

SEQ ID NO: 324915 - RNA, 59 nt, Human
acgccaagaccaagcgaugacgccugcccgccucccacccgccucuccugccgucccgc

SEQ ID NO: 324916 - RNA, 64 nt, Human
cuugaucuccugaccuugugauccaccagccucagccucccaaagugcugggauuacaggcgug

SEQ ID NO: 324917 - RNA, 64 nt, Human
ugcaguggugggaucucggcucacugcaagcuccgccucccagauucacgccauucuccugccu

SEQ ID NO: 324918 - RNA, 64 nt, Human
ccaccuccuggguucaagugauucuccugcuucagccucccaaguagcugggauuacaggugug

SEQ ID NO: 324919 - RNA, 64 nt, Human
ugaacuccuggccuccagugauccuccauccucggccucccaaagugcuggaaucacaggggug

SEQ ID NO: 324920 - RNA, 64 nt, Human
ggacacccgccacguggucccggaguggaacggugccucccacugcagccucugccugcucugc

SEQ ID NO: 324921 - RNA, 64 nt, Human
cucaaacuccugaccucgggauccgcccaccucggccucccaaagugcugggauuacaggcaug

SEQ ID NO: 324922 - RNA, 64 nt, Human
ggaaucagcagccaggacagacauccuagcagccgccucccagcccugccuaggaaccguacau

SEQ ID NO: 324923 - RNA, 64 nt, Human
cacggaugccgacggccgggccccuccccgacaagccucccagggccccggcaccccggucggc

SEQ ID NO: 324924 - RNA, 64 nt, Human
ggccugcggugggggcgcuuccuguggacgcugcgccucccaucgcccgggugccuguccuugc

SEQ ID NO: 324925 - RNA, 64 nt, Human
ugaggacagagaacauggucuccugcagggcccugccucccaagccccgcccucagaaagccaa

SEQ ID NO: 324926 - RNA, 64 nt, Human
ugaacucccgaccucagaugaucugcccgccucggccucccaaaauugcugggauuacaggugu

SEQ ID NO: 324927 - RNA, 64 nt, Human
gucagaucugaccuuuggugauccaccugccuuggccucccaaagugcugggauuacaggccug

SEQ ID NO: 324928 - RNA, 64 nt, Human
cuggccccucuacuguaaaugugccuuagccuaagccucccauccuguguuagcguugccuggu

SEQ ID NO: 324929 - RNA, 64 nt, Human
cuccaucuccugaguuugugaucugcccgccuuggccucccaaagugcugggauuacaggugug

SEQ ID NO: 324930 - RNA, 64 nt, Human
cuccugaccucaggugauccacccgcccgccuuggccucccaaagugcuaggauuccaggcgug

SEQ ID NO: 324931 - RNA, 64 nt, Human
cauguguguacgauuaaaaguuggccguccccaggccucccagcgcaaacuucaagagacaggg

SEQ ID NO: 324932 - RNA, 64 nt, Human
ggacuaugccagugccuugauauuggacuucccagccucccaaaccaugagaaauaaauguuug

SEQ ID NO: 324933 - RNA, 64 nt, Human
cuugaucuccugaccucgugauccgcccuccucggccucccaaagugcugggauuauaggcgug

SEQ ID NO: 324934 - RNA, 64 nt, Human
ugaacuccugaccucagguaauccaccugccuuggccucccaaagugcugggauuacaggcgug

SEQ ID NO: 324935 - RNA, 64 nt, Human
uugccuaggcuggagugaaaguggcgcaaccucugccucccaggucaaagcaauccugccucag

SEQ ID NO: 324936 - RNA, 64 nt, Human
uaaacucuugaccucaaaugauccacccaccuuggccucccaaauuguucguuuuacuuuuuuu

SEQ ID NO: 324937 - RNA, 64 nt, Human
caaacuccugaccucaggugaucugccugccucggccucccaaagugcugggauuacaggugug

SEQ ID NO: 324938 - RNA, 64 nt, Human
ccgccucccggauucaagcaauucuccugccgcagccucccaagaagcugggauuacaggcaug

SEQ ID NO: 324939 - RNA, 64 nt, Human
cagagugucccagcacgccgggaggggcaaccaggccucccagcgaguccugcagggcccaucu

SEQ ID NO: 324940 - RNA, 64 nt, Human
uggucccugccccgcaagcaaaccugcccccucugccucccagugcacccaaugacccccuccc

SEQ ID NO: 324941 - RNA, 64 nt, Human
ugggccccagcaccuccccuccuccagccuccuggccucccagccacuuccucacccccagugc

SEQ ID NO: 324942 - RNA, 64 nt, Human
cgaacuccugaccucaagugauccaccugccuuggccucccaaaguguugggauuauaggcgug

SEQ ID NO: 324943 - RNA, 64 nt, Human
uggagaccaacgaccaaguguuccugcaaggagagccucccacagcugucaccaugcuccaacu

SEQ ID NO: 324944 - RNA, 64 nt, Human
caaacuccugaccucauaugauccaccugccucagccucccaaagugcuuggauuacaggcaua

SEQ ID NO: 324945 - RNA, 64 nt, Human
cugccuuccagguucaagcaauuauccugccucagccucccaaguagcugggauuacaggcacc

SEQ ID NO: 324946 - RNA, 64 nt, Human
cgaaauccugaccucaaaugauccacccaccucagccucccaaagugcugggauuacaggcaug

SEQ ID NO: 324947 - RNA, 64 nt, Human
ccgcccccugggaucaagcgauucuccuaccucagccucccaaauagcugggacuacaaggugc

SEQ ID NO: 324948 - RNA, 64 nt, Human
ugaauuccugaccucaggugauccaccugcuucggccucccaaagugcuaggauuacaggugug

SEQ ID NO: 324949 - RNA, 64 nt, Human
cucgauuuccugaccuugugaucccccugccucggccucccaaagugcugggauuacaggcaug

SEQ ID NO: 324950 - RNA, 64 nt, Human
caaacucccgaccucaggugauccacccgccucagccucccaaagugcugggauuacaggcaug

SEQ ID NO: 324951 - RNA, 64 nt, Human
ugcaguggcgcagucuuggcucaccucaaccucugccucccagguucaggcuauucuccugcuc

SEQ ID NO: 324952 - RNA, 64 nt, Human
ucaacuccugaccucaggugauccaccugccuuggccucccaaggugcugggauuacaggcgug

SEQ ID NO: 324953 - RNA, 64 nt, Human
uccccaggcccuccuggagcucacugagcuccuugccucccacaacaacuacgcccgcuaccgc

SEQ ID NO: 324954 - RNA, 64 nt, Human
caauaccagguggggcucuuccuguccacucccagccucccacugucccaccgccuccugccuc

SEQ ID NO: 324955 - RNA, 64 nt, Human
ggggugcccugaaaccaaacuggaagcccccucugccucccagcuggggccucugggguggggu

SEQ ID NO: 324956 - RNA, 64 nt, Human
cucaaucuccugacuucaugguccgccugccucagccucccaaaguucugggauuacaggugug

SEQ ID NO: 324957 - RNA, 64 nt, Human
acuuccuuuugccaaaucagaucccguccaaagugccucccaugccuaccaccaucaucacauc

SEQ ID NO: 324958 - RNA, 64 nt, Human
ugaacuccugggcucaagagauccuccugccuuggccucccaaagugcucagauuagagaugug

SEQ ID NO: 324959 - RNA, 64 nt, Human
caaacuucuggccucaagugauccuccugccucggccucccaaaaugcugggauuacagaugug

SEQ ID NO: 324960 - RNA, 64 nt, Human
ugaacuccuggccucaagugauccacccaccucagccucccaaagugcugggauuacaggccac

SEQ ID NO: 324961 - RNA, 64 nt, Human
ucaacuccugggcucaagcaguccucccaccuuggccucccagaaugcuggguuuauagaugug

SEQ ID NO: 324962 - RNA, 64 nt, Human
cucgaucuccugaccucgugaucugcccaccucggccucccacagugcugggauuaccggcgug

SEQ ID NO: 324963 - RNA, 64 nt, Human
cucgaucuccugaccuugucauccaccugucuuggccucccaaagugcugggauuacuggcaug

SEQ ID NO: 324964 - RNA, 56 nt, Human
ccccuguccgggacuacugaccaugugccucccacugaauggcaguuuccaggacc

SEQ ID NO: 324965 - RNA, 64 nt, Human
cagacuccugggcucaagcaaucugcccgccucugccucccaaagugcugggauuacagacgug

SEQ ID NO: 324966 - RNA, 64 nt, Human
caaccugccagguugaagugagccucccauuucagccucccaaguagcugggacuacaauugug

SEQ ID NO: 324967 - RNA, 64 nt, Human
cucacuguagccucaaccugccagguugaagugagccucccauuucagccucccaaguagcugg

SEQ ID NO: 324968 - RNA, 64 nt, Human
ugaacgccugaccucagaugauccacccaccuuggccucccaaagugcugggauuacaggcaug

SEQ ID NO: 324969 - RNA, 64 nt, Human
ccgccuccuggguucaagugauucucgugcuucagccucccaaguaccugggacuacaggugug

SEQ ID NO: 324970 - RNA, 64 nt, Human
cucgaacuccugaccucgugauccgcccgccucagccucccaaaguguuaggauuaggggcaug

SEQ ID NO: 324971 - RNA, 64 nt, Human
cugccucccagguucaagcaauucuccugccucagccucccaaguagccaggauuacaggcacg

SEQ ID NO: 324972 - RNA, 64 nt, Human
ugcaguggggcaaucucggcucacugcaaccucugccucccagguucaagcaauucuccugccu

SEQ ID NO: 324973 - RNA, 64 nt, Human
ugcaguggcaugaucuugacucacuacaaccuccgccucccagguucaagcgauccuccugccu

SEQ ID NO: 324974 - RNA, 64 nt, Human
ugaauuccagggcucaagcgauccagccguauuggccucccaaggugcugggauuacagccaug

SEQ ID NO: 324975 - RNA, 64 nt, Human
caaacuccugaccucaggcaaucugcccaccucagccucccaaagugcugggauuacaggcgug

SEQ ID NO: 324976 - RNA, 64 nt, Human
cgaacuccugaccucaggugauccuccugccucggccucccaaagugcugggauuacaggugug

SEQ ID NO: 324977 - RNA, 64 nt, Human
ugaacucuugaccucauguaguccacccgccucugccucccaaagugcugcgauuacaggcgug

SEQ ID NO: 324978 - RNA, 64 nt, Human
gggccucccagguucaagugauucuccuaccucagccucccaaggagcugagauuacgaguaca

SEQ ID NO: 324979 - RNA, 64 nt, Human
ugcaguggugcaaucuuggcucacugcaacuugggccucccagguucaagugauucuccuaccu

SEQ ID NO: 324980 - RNA, 64 nt, Human
cuugaacuccugaccucaugauccgcccaccucagccucccaaaguguugggauuacaggcaug

SEQ ID NO: 324981 - RNA, 64 nt, Human
ugcaguggcaugaucuccacucacagcaaccucugccucccagguucaagcaguucuccugccu

SEQ ID NO: 324982 - RNA, 64 nt, Human
ccaacuccugagcucaagugauccacccgccucagccucccaaagugcugggauuacaggggug

SEQ ID NO: 324983 - RNA, 64 nt, Human
cccaguccagggugguagugcugggcuguucccagccucccacagcagagcuggacgcugugga

SEQ ID NO: 324984 - RNA, 64 nt, Human
ugaacucuugggcucaagugauccucccgccucagccucccaaaguguugggauuacaggugug

SEQ ID NO: 324985 - RNA, 64 nt, Human
ugaccucccaggcucaagcgauccuccugccucagccucccaaguagcugggagccugggcaug

SEQ ID NO: 324986 - RNA, 64 nt, Human
aaaacuccugggcucaagugauccuccugccucagccucccaaagcguugggauuauaggcgug

SEQ ID NO: 324987 - RNA, 64 nt, Human
cgacuucuuaggcucaggugauccucccaccucagccucccaagcagcugggaugacagacuug

SEQ ID NO: 324988 - RNA, 64 nt, Human
ggcugggguggacucagaugccaggaaagggacagccucccauugucaggcagaagcugcccaa

SEQ ID NO: 324989 - RNA, 64 nt, Human
uuuauggugcucuguauucuggcauuaugcagcagccucccagaagcucucuucugcuucaaaa

SEQ ID NO: 324990 - RNA, 64 nt, Human
ugcaacggcaugauuuuggcucacugcagccucugccucccaggcucaagcacuuuuccugucu

SEQ ID NO: 324991 - RNA, 64 nt, Human
ugaacuccugaccucaggugauccacccaccugggccucccauagugcugggauucaauuuuuu

SEQ ID NO: 324992 - RNA, 64 nt, Human
cgaacuccugacaucaggugauccaccugccucggccucccaaagugcugggauuacaggugug

SEQ ID NO: 324993 - RNA, 64 nt, Human
ucacagccuugccccuccccaaggcuggcaaccugccucccauugcccaagagagagggcaggg

SEQ ID NO: 324994 - RNA, 64 nt, Human
caucacucauaucccuuucagaauguuaggaacugccucccacauucuucccugucuuuuuggg

SEQ ID NO: 324995 - RNA, 64 nt, Human
ugcaaucgcgcaaucucggcucacgguaaccucugccucccagguucaagcgagucuccugccu

SEQ ID NO: 324996 - RNA, 64 nt, Human
caaaccccggaccucaggugauccccccaccuuggccucccaaagugccaggauuacaggcaug

SEQ ID NO: 324997 - RNA, 64 nt, Human
cauuugcucucucgauuccccuuuccuccucacugccucccaagcccacccuacuccaaaauaa

SEQ ID NO: 324998 - RNA, 64 nt, Human
ugaacuccugaccucaggugauccacccgccucagccucccacacugcugggauuacaggcaug

SEQ ID NO: 324999 - RNA, 64 nt, Human
ugcaguggcgccaucucggcucacugcaaccuccgccucccagguucaagcaauucuccugccu

SEQ ID NO: 325000 - RNA, 64 nt, Human
ccgccucccagguucaagcaauucuccugccucagccucccagguagcugccacuacaggugcu

SEQ ID NO: 325001 - RNA, 64 nt, Human
cuugaacuccugaccuugugauccacccgccucggccucccaaagugcugggauuacaggcgug

SEQ ID NO: 325002 - RNA, 64 nt, Human
gaggugagacaaggguccaacuuuuccuggauucgccucccagcggacgugagcuuccacugcg

SEQ ID NO: 325003 - RNA, 64 nt, Human
ugaacuccugagcucaagugauccacccaccucagccucccagagugcuaggauuacaggccuu

SEQ ID NO: 325004 - RNA, 64 nt, Human
uuuggagaagcaguuggaacccacguguggugaugccucccacaucggccugcuugggguucua

SEQ ID NO: 325005 - RNA, 64 nt, Human
uguaguggugcgaucucagcucacugcaaccuccgccucccagguucaagcgauucuccugccu

SEQ ID NO: 325006 - RNA, 64 nt, Human
uuaaagguuucucugccuucccuucuacccacccgccucccaccagaucccaucuggaaaucau

SEQ ID NO: 325007 - RNA, 64 nt, Human
ccgccucccggguucaagcgauucuccugccucagccucccaaguagcugggauuacaggcacg

SEQ ID NO: 325008 - RNA, 64 nt, Human
caaagcucuguucuagagggaaaguuaggaauaggccucccagaggauacuccagacaguugac

SEQ ID NO: 325009 - RNA, 64 nt, Human
ugaacucccgaccucaggugauccaccugucuuggccucccaaagugcugggauuacaggcaug

SEQ ID NO: 325010 - RNA, 64 nt, Human
uuucuccuuccaccaugguuguaaguuuccugaggccucccagucaugcuuccuguuaagccug

SEQ ID NO: 325011 - RNA, 64 nt, Human
cgaacuccugggcuuaagggauccuucuaccucagccucccagguagcaggaacuauaggcaug

SEQ ID NO: 325012 - RNA, 64 nt, Human
auccagaaucccagaauucuaggaaauuguaucagccucccaagcauauaacccccuaaggaau

SEQ ID NO: 325013 - RNA, 64 nt, Human
cuugaacuccugaccucgugauccacccgccuaggccucccaaaguguugggauuacaggcgug

SEQ ID NO: 325014 - RNA, 64 nt, Human
ccgccucugggguucaagugauucuccugucucagccucccaaguagcuggaauuacagggacc

SEQ ID NO: 325015 - RNA, 64 nt, Human
uuuuagccucuccuuagaggugaaugugaaugaagccucccaggcacccgcugaauuucugagg

SEQ ID NO: 325016 - RNA, 64 nt, Human
cugcaccucccggguucaagugauucucaucucagccucccaaguagugugaacuaaaggcaug

SEQ ID NO: 325017 - RNA, 64 nt, Human
cugccuccugagcucaagugauccucccaccucagccucccaagggugugugugacuacaagua

SEQ ID NO: 325018 - RNA, 64 nt, Human
ugucugaacucaugugucagaagccuccaagccugccucccaggguccucucaguucucucccu

SEQ ID NO: 325019 - RNA, 64 nt, Human; identical to SEQ ID NO: 321511

SEQ ID NO: 325020 - RNA, 64 nt, Human
caaacuccugaccucaggugauccaccugccucagccucccaaagugcugggauuacaggcaug

SEQ ID NO: 325021 - RNA, 64 nt, Human
ugaacucauggccucaagucauccuccugugucagccucccaaagugcugggauuacaagcaug

SEQ ID NO: 325022 - RNA, 64 nt, Human
cucaccauugugaagcaccuacuaugugcugggugccucccacacuugcuggggcucacggggc

SEQ ID NO: 325023 - RNA, 64 nt, Human
ccacuuugauuuaauccuuuggcugugggcugaggccucccagggaagcuggguggggugggug

SEQ ID NO: 325024 - RNA, 64 nt, Human
ccaguucacauucaccccacaagaguuucaggaggccucccacggugccugugcuggguggcgg

SEQ ID NO: 325025 - RNA, 64 nt, Human
ugagcucugaagcccccuccucaaucccuugauggccucccacccuguaagaggcuuugcuugu

SEQ ID NO: 325026 - RNA, 64 nt, Human
auuccuccccugcuaaaguucuucaugguagugagccucccaggaucacucaugcuguccugag

SEQ ID NO: 325027 - RNA, 64 nt, Human
cugcuucccggguucaagugauucuccugccucagccucccaaguagcugggauuacaggugcc

SEQ ID NO: 325028 - RNA, 64 nt, Human
cucgaacuccugaccucgugauuugccugccugggccucccaaagugcuaggauuacaggcaug

SEQ ID NO: 325029 - RNA, 64 nt, Human
cuugaucuccugagcucgugaucugcccgccucggccucccaaagugcugggauuacaggugug

SEQ ID NO: 325030 - RNA, 64 nt, Human
cucgccucugcccagccugccccagccugccccagccucccagcuuucugugugcacaguuggc

SEQ ID NO: 325031 - RNA, 64 nt, Human
gccuggggucucugccuucuccccuuacccucccgccucccacccucccugcaacaacagcccu

SEQ ID NO: 325032 - RNA, 64 nt, Human
ugaacuccugaccucaagugaucugcccaccucagccucccaaagugcugggauuacaggugug

SEQ ID NO: 325033 - RNA, 64 nt, Human
ugcaguggcgcuaucuuggcucacugcaacguccgccucccagguucaagcgauucucaugccu

SEQ ID NO: 325034 - RNA, 64 nt, Human
guaagccaagcuaaaugaugguuaaaguuaucaggccucccaugaaauugcguucuuccugcau

SEQ ID NO: 325035 - RNA, 64 nt, Human
ccugccccuguguggcugcgcaaguauucugcccgccucccaccaucagccuucgcccaagggg

SEQ ID NO: 325036 - RNA, 64 nt, Human
aaccucuccagauucaagugauccucccaucucagccucccaaguagcugggacuacaguugug

SEQ ID NO: 325037 - RNA, 64 nt, Human
caaacuccugggcuccaacgaucugcccaccuuggccucccaaagugcugagauuacaggcgug

SEQ ID NO: 325038 - RNA, 64 nt, Human
uucaguggugcaaucucagcucacugcaagcucugccucccagguuccaacgauugucuugucu

SEQ ID NO: 325039 - RNA, 64 nt, Human
cgcaauggugugaucuuggcucacugcaacauccgccucccagguucaagugauucuccugccu

SEQ ID NO: 325040 - RNA, 64 nt, Human
cuuggacuccugaccucaugcuccacccgcuucggccucccaaaguucugggauuacaggugug

SEQ ID NO: 325041 - RNA, 64 nt, Human
ccacuucuuggguucaagugauucuccugucucagccucccaaguagcugggauuacaggcaug

SEQ ID NO: 325042 - RNA, 64 nt, Human
ugaacuccugaccucaggugauccacccgccuuggccucccaaagugcugggauuacaggcgug

SEQ ID NO: 325043 - RNA, 64 nt, Human
ccgccuccuggguucaagugauucucccaccucagccucccaaguaggugggauuacagguacu

SEQ ID NO: 325044 - RNA, 64 nt, Human
cgaacuccugaccucagauggucugcccaccuccgccucccaaagugcugggauuacaggcgug

SEQ ID NO: 325045 - RNA, 64 nt, Human
cgaacucccgaccucaggugaucugccugccucagccucccaaagugcugggauuacaggugug

SEQ ID NO: 325046 - RNA, 64 nt, Human
cagcaaaacgcggccaguccccuucuccacugcugccucccagcagagggccccaggaucucca

SEQ ID NO: 325047 - RNA, 64 nt, Human
aagaauucagaaggccugucaggugaagucuucagccucccacagcgcagggucccagcaucuc

SEQ ID NO: 325048 - RNA, 64 nt, Human
cggcuucagcucggaggcggacguccccacucuggccucccagaaggccgcggaggagccggau

SEQ ID NO: 325049 - RNA, 64 nt, Human
ugccccagggcgaucucagcucacugcaaccuuugccucccaggcucaaucacuucugcugccu

SEQ ID NO: 325050 - RNA, 64 nt, Human
cgaacuguuggccucaagugauccgcccgccucagccucccaaagugcugggauuacaggcguc

SEQ ID NO: 325051 - RNA, 64 nt, Human
guccuccaacaccaagcacagcagccuggggcuggccucccaaaugagccaugagaugauacau

SEQ ID NO: 325052 - RNA, 64 nt, Human
gagauucaagggacccaugaguuggggucuggcagccucccauccagggcccccaucucaugcc

SEQ ID NO: 325053 - RNA, 64 nt, Human
ugaaauccugggcucaagugauccuccugcuuuggccucccaaaaugcugggauuauaggcaug

SEQ ID NO: 325054 - RNA, 64 nt, Human
ggucuuccucucucgcccaaguucucaugccucagccucccaaauagcugggacuacaggcaca

SEQ ID NO: 325055 - RNA, 64 nt, Human
ugaacuccuagacucaagugauccuccugucuuggccucccaaagugcugagauuacaggugug

SEQ ID NO: 325056 - RNA, 64 nt, Human
cuugaacuccugaccucgugacccacccgccuuggccucccaaagugcugggauuacaggugug

SEQ ID NO: 325057 - RNA, 64 nt, Human
cgaacuccugaccucaggugauccacccaccuuggccucccagcgugcugggauuauaggcaug

SEQ ID NO: 325058 - RNA, 64 nt, Human
uccaccuccugguucaagcgauucuccugccucagccucccaaguagcugggauuacaggcacg

SEQ ID NO: 325059 - RNA, 64 nt, Human
caaaccccugaccucaaaugaugugccugcuucagccucccacagugcugggauuacaggcaug

SEQ ID NO: 325060 - RNA, 64 nt, Human
ccgccuccugaguucaagcgauucuccugccucagccucccaaguagcugggacugcaggcgcg

SEQ ID NO: 325061 - RNA, 64 nt, Human
aaacuccugacuucaggugauccacccgccuucagccucccaacgugcugggauuacagccgug

SEQ ID NO: 325062 - RNA, 64 nt, Human
gggcucaccacccagaaguggggagagacuuugggccucccacccaguggggcuuggccuggcu

SEQ ID NO: 325063 - RNA, 64 nt, Human
ugcaauggcguaaucucggcucagugcaaccucugccucccagguugaagcgauucuccugccu

SEQ ID NO: 325064 - RNA, 64 nt, Human
cugccucccagguugaagcgauucuccugccucagccucccaaguagcugggauuacaggcaug

SEQ ID NO: 325065 - RNA, 64 nt, Human
cucgaugaucugaccucgugaucugcccgccucggccucccaaagugcugggauuacaggccug

SEQ ID NO: 325066 - RNA, 64 nt, Human
ccaccuccugaguucaagcaauucuccugccucagccucccaaguagcugggacuacaggcaug

SEQ ID NO: 325067 - RNA, 64 nt, Human
ugcagugucacgaucucagcucacugcaaccuccgccucccagguacaagagauucuccugccu

SEQ ID NO: 325068 - RNA, 64 nt, Human
ugaacuccuggacucaaucgauccucccaccucugccucccaaguaacugggacuauagcaugc

SEQ ID NO: 325069 - RNA, 64 nt, Human
ugaacuccuggacucaauugauccucccacuucugccucccaaguaacugggacuauagcaugc

SEQ ID NO: 325070 - RNA, 64 nt, Human
gugaaagacugagaugaaugucuuuccucucccugccucccaccagacuuccuccuggaaaacg

SEQ ID NO: 325071 - RNA, 64 nt, Human
caaguucucgcuuccuccuuugggcaucucuucugccucccaaucaaggaagcuccaugcucag

SEQ ID NO: 325072 - RNA, 64 nt, Human
cugccucccguguucaagcgauucuccugccuuggccucccaaguagcugggacuacaggcgcc

SEQ ID NO: 325073 - RNA, 64 nt, Human
cucgaucuccugaccucuugaucugcccaccuuggccucccaaagugcugggauuacaggcgug

SEQ ID NO: 325074 - RNA, 64 nt, Human
cugccccaagggucccaccacagccagcgggcuggccucccaccccagcauccauacacguagg

SEQ ID NO: 325075 - RNA, 64 nt, Human
ugcccucagcuuucgcugaucugcccggccuggagccucccaucaccccgcuucuuguugggcc

SEQ ID NO: 325076 - RNA, 64 nt, Human
ugaacuccugaccucaggugauccgccuaucucagccucccaaagugcugggauuacaggcgug

SEQ ID NO: 325077 - RNA, 64 nt, Human
ccaggaguuuaugggagaagggacugggccggcugccucccagcgaugcacuugaccugacacu

SEQ ID NO: 325078 - RNA, 64 nt, Human
uggagcguugucuggagguuccagggacagggcagccucccagagccgagcaagagcucaaggu

SEQ ID NO: 325079 - RNA, 64 nt, Human
cuggccguuaacucagcacccaggccaagcccccgccucccacuugaagcccccucuuacaacu

SEQ ID NO: 325080 - RNA, 64 nt, Human
cuuugguggguuuccuggauggaugugaaguugggccucccaugggcccaagggaguaggaagc

SEQ ID NO: 325081 - RNA, 64 nt, Human
cucgaacaccugaccucgugguccacccgccucggccucccaaagcacugggauuacaggcgug

SEQ ID NO: 325082 - RNA, 64 nt, Human
cacacuugcagagcugcuggaggugaggucaggugccucccagcccugcccagaguaugggcac

SEQ ID NO: 325083 - RNA, 64 nt, Human
caggguucggcggcagcguuuguuccagaacgccgccucccacccagaucgcgguauauagaga

SEQ ID NO: 325084 - RNA, 64 nt, Human
gcccaggccccucagcugucagcugguuuugauggccucccacugccccacacgccgcgggacc

SEQ ID NO: 325085 - RNA, 64 nt, Human
uagggguggggugugagaugggugccuccccucugccucccauuucugccccugaccuuggguc

SEQ ID NO: 325086 - RNA, 64 nt, Human
cgaaccccugagcucaggugauccaccugccucggccucccaaagugggaaaugggucauuuuc

SEQ ID NO: 325087 - RNA, 64 nt, Human
ggguuucucuguagugucugcugcccuccuccuggccucccagguuucaguugugucugacaga

SEQ ID NO: 325088 - RNA, 64 nt, Human
caaacuccuggccucaagcaauccucacgccucagccucccaaaguguugaugagccacuguac

SEQ ID NO: 325089 - RNA, 64 nt, Human
acccauucuguuccaccacuguuugaucucucuggccucccaccaggaaugccguuuccuuuuu

SEQ ID NO: 325090 - RNA, 64 nt, Human
cuccaucuccugaccucgugaucugcccaccucggccucccaaagugcugggauuacaggcgug

SEQ ID NO: 325091 - RNA, 64 nt, Human
acacguggugaccucacacaccucugccccuugggccucccacucccauggcucugggcggucc

SEQ ID NO: 325092 - RNA, 64 nt, Human
ccucuagucacccauucccaccccccagggagcugccucccaggcagggggugcagaaaaugau

SEQ ID NO: 325093 - RNA, 64 nt, Human
ccccugaggacccaggcccacacccagcccuucugccucccaauucucucuccuccguccccuu

SEQ ID NO: 325094 - RNA, 64 nt, Human
gaccuguacauucugcccuugccucuuaccccuugccucccagugguauuugaauaaaguaugu

SEQ ID NO: 325095 - RNA, 64 nt, Human
cacuggccuucccuccugccccacuccuggcugugccucccauuuccccucaccuguacccaca

SEQ ID NO: 325096 - RNA, 64 nt, Human
uuuggggaggugaagcugccaggugugcacaggggccucccaggcuccuggcuccaccagccaa

SEQ ID NO: 325097 - RNA, 64 nt, Human
accagacuucucuggucccacaggacagccaguggccucccaacuugguucugggcccccgccu

SEQ ID NO: 325098 - RNA, 64 nt, Human
cagcucucuucugguugggccuuugaaaggcucagccucccauugugcagugcuuggguuugga

SEQ ID NO: 325099 - RNA, 64 nt, Human
accuggagagggggucuggcuuccugcccaagaugccucccagcccugccagggcccggugcag

SEQ ID NO: 325100 - RNA, 64 nt, Human
ggucauucugugaccaccacccccuccccucaccgccucccagguggcccgggagcugcaggug

SEQ ID NO: 325101 - RNA, 64 nt, Human
ccgucgucccgcccaccucaaaccccgcaggugugccucccagcggauuauuuauuguagaaag

SEQ ID NO: 325102 - RNA, 50 nt, Human
gcugccugucggacgccugagccucccagcccugcccggcugcucugcuu

SEQ ID NO: 325103 - RNA, 64 nt, Human; identical to SEQ ID NO: 322939

SEQ ID NO: 325104 - RNA, 64 nt, Human
cucuucuaccuccugcaacccacccauccuauuagccucccacauucuaggcccgugauacagg

SEQ ID NO: 325105 - RNA, 64 nt, Human
caaccuccugggcucaagugacccuccugccucagccucccaaaguucugagaugauaggcaug

SEQ ID NO: 325106 - RNA, 64 nt, Human
aggccuugggagugaggugugggaguagccaccagccucccacugacuaggcauguuaggaauu

SEQ ID NO: 325107 - RNA, 64 nt, Human
cgaacuccugaccucaggugauccguccaccucagccucccaaagagcugggauuacaggugug

SEQ ID NO: 325108 - RNA, 64 nt, Human
uugguaguugccgguggacagcauggccgugccagccucccacacugaggccaggucuaccccc

SEQ ID NO: 325109 - RNA, 64 nt, Human
agcucauuccagccuguaccuuggaugagggguagccucccacugcaucccauccugaauaucc

SEQ ID NO: 325110 - RNA, 64 nt, Human
cgaacucuugaccucaagugauccacucgcuucggccucccaaagugcugggauuauaggcgug

SEQ ID NO: 325111 - RNA, 64 nt, Human
cucgaacuccugaccucaugauccuccugccucggccucccaaagugcugggauuauaggcaug

SEQ ID NO: 325112 - RNA, 64 nt, Human
cuugaacuccugaccucgugaucuacccaccucggccucccaaaaugcugggauuacaggggug

SEQ ID NO: 325113 - RNA, 64 nt, Human
gcucaaaagaccuuaaaggucuguaggguucccugccucccaucuuuccacuguuguaaaaagu

SEQ ID NO: 325114 - RNA, 64 nt, Human
uaaacuccuaaccucaggugauccacccgccuuggccucccaaagugcugggauuacaggugug

SEQ ID NO: 325115 - RNA, 64 nt, Human
cuccaucuccugaccucaugauccgcccaccuuggccucccaaaaugcugggauuacaggcaug

SEQ ID NO: 325116 - RNA, 64 nt, Human
ugaacuccugggcucaugcaauccuccugccuuggccucccaaagcgcuaggauuagaggugug

SEQ ID NO: 325117 - RNA, 64 nt, Human
aagaccucuauauccuggugccuaagaaacuucugccucccacagacaacuaagugcuuauuca

SEQ ID NO: 325118 - RNA, 64 nt, Human
cgaacuccugaccucaagugauccgccugccucagccucccacagugcugggauuacaggcgug

SEQ ID NO: 325119 - RNA, 64 nt, Human
cacaguuccugccagguuaacacccucccuucaggccucccaaaggcauaggcuugcaaagagc

SEQ ID NO: 325120 - RNA, 64 nt, Human
ucuccaccaagggcuugggccucucggggcuggggccucccaggggauggggacccagagugca

SEQ ID NO: 325121 - RNA, 64 nt, Human
cugccuccugacuucaagcaauucuccugccucagccucccaaagugcugggauuacaggugug

SEQ ID NO: 325122 - RNA, 64 nt, Human
caaacuccugaccucaguugauccacccgccucagccucccaaagugcuaggauuacaggcaug

SEQ ID NO: 325123 - RNA, 64 nt, Human
cuugaacuccugaccucgugaucugcccgccuuggccucccaaaguacugggauuacaggcgug

SEQ ID NO: 325124 - RNA, 64 nt, Human
ugcaguggcgcaaucuuggcucacugcaaccuccgccucccagguucaggcgauucuccugccu

SEQ ID NO: 325125 - RNA, 64 nt, Human
uucaagacaauuuuaauugugaaccuaccauguugccucccaucuucugaaaaaacaaaaaaau

SEQ ID NO: 325126 - RNA, 64 nt, Human
ugcuacuucugcguccauaaggguccugcacguugccucccaccaccccagcucugccagaaua

SEQ ID NO: 325127 - RNA, 64 nt, Human
aaagaucugaacuggaagcagagguugagauucugccucccaggagagggauuuaccugccccc

SEQ ID NO: 325128 - RNA, 64 nt, Human
uuucuucucuucauucccaggacucaccaucucugccucccaugaggcuuacagaguucaaugu

SEQ ID NO: 325129 - RNA, 64 nt, Human
ugcaguggcgugagcucggcugacugcaaacucugccucccagguuuaagcgauucuccuguca

SEQ ID NO: 325130 - RNA, 60 nt, Human
aguguguucaaacaucauaaaauggggaucgccucccaacagcagauuucgacauuaccu

SEQ ID NO: 325131 - RNA, 64 nt, Human
ucgcgcccuccucaucucgcucaucccugggcgcgccucccaccuuccacccccaacucccuuc

SEQ ID NO: 325132 - RNA, 64 nt, Human
cuauuucuuucuagaagcucaggguuuucuuagugccucccagaacauuuuguaguuaauuggg

SEQ ID NO: 325133 - RNA, 64 nt, Human
cacuucuucuuuuugaguuccgcaacuugcuccugccucccagccccacuggcacugaccauga

SEQ ID NO: 325134 - RNA, 64 nt, Human
ucguguuuuuuuuuuuuuuguggugggauuaugugccucccauucacuagaaaaugagaaaauu

SEQ ID NO: 325135 - RNA, 64 nt, Human
gugaaguccuuugucacuucucuugccuuagugugccucccaauacucccuucuuccugccccc

SEQ ID NO: 325136 - RNA, 64 nt, Human
gugggguggcuugcaggauuggccuguuuccagggccucccacacucauuggccagauugugaa

SEQ ID NO: 325137 - RNA, 64 nt, Human
uccccaugcccccucccugagcaccaccggcaccgccucccaaacagggcugcugguuuccgca

SEQ ID NO: 325138 - RNA, 64 nt, Human
caccucccggguuccagcaaauucuccugccucagccucccaaguagcugggauugcaggcgcc

SEQ ID NO: 325139 - RNA, 64 nt, Human
cgaucuccugaccucaggugauccacccgccucggccucccaaagugcugggaugacaggcgug

SEQ ID NO: 325140 - RNA, 64 nt, Human
caggggccgggcucuccuccaccgcucccccggagccucccaggcagcaauaaggaaauaguuc

SEQ ID NO: 325141 - RNA, 64 nt, Human
cgaacuccugaccucaggugaucugcccgccucggccucccaacgugcccccaguuuuauaaac

SEQ ID NO: 325142 - RNA, 64 nt, Human
uggacuggaaagcuguuccgcagagaaaacugaagccucccaucgugcccacgauagcuggcaa

SEQ ID NO: 325143 - RNA, 64 nt, Human
cgaacuccugaccucaggugauccaccugccucggccucccaaagugcugggauuacaggcuug

SEQ ID NO: 325144 - RNA, 64 nt, Human
uugccucccgggcucaagcgauucuccugccucagccucccaaguagcugggauuacaggcacc

SEQ ID NO: 325145 - RNA, 64 nt, Human
gggacuggaucccagcagugauguugguugaggcagcaaacagauggcaggaugggcacugccg

SEQ ID NO: 325146 - RNA, 64 nt, Human
uugauucaccgggauguacaguuuacaguugaagagcaaacagaaagguuuucucuugguggga

SEQ ID NO: 325147 - RNA, 64 nt, Human
ccaacuuggaaagcuguauuuguucccaugauucagcaaacaaugaguaccuacuguguguaga

SEQ ID NO: 325148 - RNA, 64 nt, Human
agaccauuguacugcaauacuugaguauuuguguagcaaacagccucuuagguuggagaguauu

SEQ ID NO: 325149 - RNA, 64 nt, Human
cgggauuuggcauugguuccagaugagcuuuuaaagcaaacauagcaguuguuugccauuucuu

SEQ ID NO: 325150 - RNA, 64 nt, Human
uagcugaaucacuagcucagauuuuucugaucuaagcaaacaacucccagcugaggaaugcagg

SEQ ID NO: 325151 - RNA, 64 nt, Human
auugagucaguuuuuugugauuagugauuaucagagcaaacaucauguagauagcacaaguauu

SEQ ID NO: 325152 - RNA, 64 nt, Human
ugggcugguuuuaguacucugaaggacaaaaacaagcaaacaaaaaccccugcugcagcauuuc

SEQ ID NO: 325153 - RNA, 64 nt, Human
aaggaaaauuuaaauggagacuggaaaaauccugagcaaacaaaaccaccuggcccuuagaaau

SEQ ID NO: 325154 - RNA, 64 nt, Human
cgcugaagcggucagacuggaggucgaagcaaucagcaaacacaauaagagucuccuucucuuc

SEQ ID NO: 325155 - RNA, 64 nt, Human
guccacgcaacgguucuucucugaacagcaacagagcaaacagauaggaggaggcaaagcccag

SEQ ID NO: 325156 - RNA, 64 nt, Human
gguuucaccaacugaaaugucucccuuugaaaguagcaaacaugauuuguauguuaacuuaacu

SEQ ID NO: 325157 - RNA, 64 nt, Human
uaaaauagugucucagcuaaauggaaaacuguuaagcaaacauccauaguaaaacaaauaaucu

SEQ ID NO: 325158 - RNA, 64 nt, Human
aaucuguaaaagguaaaaaugaaaaacaaaaacaagcaaacaaacaaaaaacaauggaaaagau

SEQ ID NO: 325159 - RNA, 61 nt, Human
ggagacucaccgcagaggccacgugaacccacggccacagagaggcaggacggcagagcca

SEQ ID NO: 325160 - RNA, 61 nt, Human
auauuuacagauaugcccagccaguccuggucggccacaccagugucccaaagaggagagc

SEQ ID NO: 325161 - RNA, 64 nt, Human; identical to SEQ ID NO: 185658

SEQ ID NO: 325162 - RNA, 64 nt, Human
ugggccguggacuaucugaucuugguccuggccgagcaaacagcccggagguaagguucagaaa

SEQ ID NO: 325163 - RNA, 64 nt, Human
aagucaauucuguuaaaacucaaggcuuauauuaagcaaacacuugaagugagaagaugaucca

SEQ ID NO: 325164 - RNA, 64 nt, Human
aaauguguguuaauuuggcuguaauggcauuuaaagcaaacaaacaaacaaaaaaagcugugaa

SEQ ID NO: 325165 - RNA, 64 nt, Human
agcccugcugcuuugcuuggugguagggcaggagagcaaacaaacagucauggucuaaaaccca

SEQ ID NO: 325166 - RNA, 64 nt, Human
cuagugcuuugucuuaguaguuuuaagaaauuaaagcaaacaaauuuaaguuuucuuguauuga

SEQ ID NO: 325167 - RNA, 64 nt, Human
aagacccagcuuauuuucugcuugcuguaaauuaagcaaacaugcuauaauaaaaacaaaauga

SEQ ID NO: 325168 - RNA, 64 nt, Human
acuccucaaccacucuccuaaugauuggaacaaaagcaaacaaaaaagaaaucucucuauaaaa

SEQ ID NO: 325169 - RNA, 64 nt, Human
aagggcuacucucuggcaucuccagguguuuuguagcaaacagccacuuagugcuuuguccugg

SEQ ID NO: 325170 - RNA, 64 nt, Human
agugcagaugguggcggaggcagaaucgaccaucagcaaacaugagcacucuucccuuucuccc

SEQ ID NO: 325171 - RNA, 64 nt, Human
ggcaggcagccacagagggcauguuaucugcuaaagcaaacaguccuccugaggcccugagggu

SEQ ID NO: 325172 - RNA, 64 nt, Human
acauuuugaaaaugcaggaccugaccuuuugcaaagcaaacauagauuuggugauaagacccuc

SEQ ID NO: 325173 - RNA, 64 nt, Human
uugcacugagguccuggaggccuugaugaggcccagcaaacaggcauucucacagcuggguuua

SEQ ID NO: 325174 - RNA, 64 nt, Human
cacagcaaaaacaauggacaggcccagaggcugaagcaaacagugucccuucuggcuguguugg

SEQ ID NO: 325175 - RNA, 64 nt, Human
gaggaaaugaauucauaucuagaagucuggagugagcaaacaagagcaagaaacaaaaagaagc

SEQ ID NO: 325176 - RNA, 64 nt, Human; identical to SEQ ID NO: 246621

SEQ ID NO: 325177 - RNA, 64 nt, Human; identical to SEQ ID NO: 246622

SEQ ID NO: 325178 - RNA, 64 nt, Human
ucagcagugggggacaccacuaaagaaacaucugagcaaacaaauacagucaguaaaacuccua

SEQ ID NO: 325179 - RNA, 64 nt, Human
ucugaaaacugcaaagugaacuuaacugagauccagcaaacagguucuguuuaagaaaaauaau

SEQ ID NO: 325180 - RNA, 64 nt, Human
agggcuccucaucuggaaacauaugagaaaggucagcaaacagaugcaagaccuauaaggcuag

SEQ ID NO: 325181 - RNA, 64 nt, Human
uaaaggcaggagaccugcucugggccugacucaaagcaaacacgugggugcagaagacccaugg

SEQ ID NO: 325182 - RNA, 64 nt, Human
aaaaauuacagaauggaaaauaauauuuugggcaagcaaacaaauucacugagaauuccaaaag

SEQ ID NO: 325183 - RNA, 64 nt, Human
auguuuuaaaaagauacacucuaucacauauuuaagcaaacaucacauuuggagaagaggaaau

SEQ ID NO: 325184 - RNA, 64 nt, Human
aucugcuccccccacaggggugcagguggcuggcagcaaacaggcucucugaagacaguagcca

SEQ ID NO: 325185 - RNA, 64 nt, Human
uacuuguguucuuuauaaagugugauuuucagaaagcaaacaacacaauuacaagguugaaucu

SEQ ID NO: 325186 - RNA, 64 nt, Human
auauguuugaaauacuucauaaugugcauguuguagcaaacauuucuguaaauuaucacaagcu

SEQ ID NO: 325187 - RNA, 64 nt, Human
ugaauagcauuuuaaugaccucuuggcucacauaagcaaacaacauagggacguaucugcuaug

SEQ ID NO: 325188 - RNA, 64 nt, Human
augcaauaauaugcauguuaacaacauuaaaaacagcaaacagcaaucuaaguacagaaaagcu

SEQ ID NO: 325189 - RNA, 64 nt, Human
uucuuuuacugcaaagaacagaaaaaagaaagaaagcaaacaagaagacuccggcucugcuauc

SEQ ID NO: 325190 - RNA, 64 nt, Human
accuccugucuugcccccuaaaagaaauaaauagagcaaacaucuugacucucccuuuuuaaaa

SEQ ID NO: 325191 - RNA, 64 nt, Human
cuauaaguguuugggauugagcaucauacuggaaagcaaacaccuuuccuccagcuccagaauu

SEQ ID NO: 325192 - RNA, 64 nt, Human; identical to SEQ ID NO: 185656

SEQ ID NO: 325193 - RNA, 64 nt, Human; identical to SEQ ID NO: 185656

SEQ ID NO: 325194 - RNA, 64 nt, Human
cauacugggcgugugcaucugaauccugcuggagagcaaacacgaacuucuguucccugcaaaa

SEQ ID NO: 325195 - RNA, 64 nt, Human
guauuuuguucuggcauuagaagaaaaacaagcaagcaaacaaaaacacagccuccgaugccaa

SEQ ID NO: 325196 - RNA, 64 nt, Human
acacacacaaaaauauucuuaagggcucagauuuagcaaacacggaagaauuuuaaaaugagcu

SEQ ID NO: 325197 - RNA, 64 nt, Human
augcuucacaauguuaaguuauauggggagcaacagcaaacaggugcuaauuuguuuuggauau

SEQ ID NO: 325198 - RNA, 64 nt, Human
aggugacugaauuuugaaacuacacccucaguaaagcaaacaggaguuguagauaaaaugucau

SEQ ID NO: 325199 - RNA, 64 nt, Human
uuauaauauaccaauguuacauuuucugaaacguagcaaacaggauauucaaaagauucuuugg

SEQ ID NO: 325200 - RNA, 64 nt, Human
cacaccugucccaugcccacccugagggaucaggagcaaacagacccugcaagguccuccaggc

SEQ ID NO: 325201 - RNA, 64 nt, Human
auucaucaucagagaagaaaauaacaaaaauggaagcaaacaacaucagaaccccuguaaguuu

SEQ ID NO: 325202 - RNA, 64 nt, Human
aaaguggccguaugggaauuuaguucauucauccagcaaacauugaguaccaauuauuugcuag

SEQ ID NO: 325203 - RNA, 64 nt, Human
caauuguuucuuuccuuuucuccuuugugagcaaagcaaacaaguacuguccaaggacagccuu

SEQ ID NO: 325204 - RNA, 64 nt, Human
cugucuagacuaaaaauauccuugaaagaauaguagcaaacaguaugcaguacuccuguguucu

SEQ ID NO: 325205 - RNA, 64 nt, Human
agugcagggucaguuaaugcuacaguuacuguauagcaaacaguauccuuuuuucuccuucccc

SEQ ID NO: 325206 - RNA, 64 nt, Human
auggcuauuuuaaauugucccuaauucguugcugagcaaacauguugcuguuuccaguuccguu

SEQ ID NO: 325207 - RNA, 64 nt, Human
accagcuuugaggauggcacugaagaacccuuggagcaaacauaccucccuugugacucccaca

SEQ ID NO: 325208 - RNA, 64 nt, Human
gggagggggaagagcagaaguuagagaaaaaaagccaccggaggaaaggaaaaaacaucggcca

SEQ ID NO: 325209 - RNA, 64 nt, Human
ucaccuaugaguuccugcaggagcaggucaacccccaccggaccuacaacccgcagucccacau

SEQ ID NO: 325210 - RNA, 64 nt, Human
aaugaagacaaaggaaucuaguguaaaaaacaacagcaaacaaaaaggugaagucuaaaugaag

SEQ ID NO: 325211 - RNA, 64 nt, Human
gcuuuuagauacuuuuuuguccauucuaaaaguaagcaaacaugauugccuucuuguuuucugu

SEQ ID NO: 325212 - RNA, 64 nt, Human
ggaaauaauuccugugaauauucuuuuucaauucagcaaacauuugaaaaucuaugaugugcaa

SEQ ID NO: 325213 - RNA, 64 nt, Human
ugacuuucaaauccccuuucgcagugaaagaaacagcaaacacuuaagauucagcaucuguucu

SEQ ID NO: 325214 - RNA, 64 nt, Human
caaaucaggguagcaaucuuguugccacaugugcagcaaacaaaguggaaguauagaucuucuu

SEQ ID NO: 325215 - RNA, 64 nt, Human
gagccagggaaaggcagaaccaccuccaugcuguagcaaacaauuucuagauacuagaagcaua

SEQ ID NO: 325216 - RNA, 64 nt, Human
uguaugaugcuuuaggcuaguuagugcauuuuuuagcaaacauuuaucuuaaacaucacagauc

SEQ ID NO: 325217 - RNA, 64 nt, Human
ccaacccugccuugaagcaauucaauaaagaggaagcaaacagccaggcucccugagggccagg

SEQ ID NO: 325218 - RNA, 64 nt, Human
uucacugccugaugauaauggugcuuggaaaucaagcaaacagcgcacaucaacuucugacucu

SEQ ID NO: 325219 - RNA, 64 nt, Human
aaaauauacauaaaaggguaaaauucacacauacagcaaacaaaaaugcacaaagccugcuucg

SEQ ID NO: 325220 - RNA, 64 nt, Human
aaaauugccuaaagaggaaggaccaaggagaugaagcaaacacauuaagccuuccacacucacc

SEQ ID NO: 325221 - RNA, 64 nt, Human
gggggcccacgacucaccuggugggccugggcucagcaaacagcccucccucccaguauuucau

SEQ ID NO: 325222 - RNA, 64 nt, Human
aaugucaggaaucuagcaguguugucugcccuggagcaaacaaacaguaugugauuuugcuucg

SEQ ID NO: 325223 - RNA, 64 nt, Human
aguagugauauagucaauggacacagugaaauagagcaaacaccuuuaguuucaucagauccug

SEQ ID NO: 325224 - RNA, 64 nt, Human
ggagcgaccccgacguggaacgcugccucagggcccaccggaacgacauggagaccaucuaccc

SEQ ID NO: 325225 - RNA, 64 nt, Human
ggcccaguaagauggaauuucagugagauauggaccaccggagucagcgagagugacugaaaca

SEQ ID NO: 325226 - RNA, 64 nt, Human
ucugaaaagaucugcaggggccaagauguugcagccaccggaggcugcaaggauguggguucuu

SEQ ID NO: 325227 - RNA, 64 nt, Human
aacuuuuaaagggauccuuucaaaaggaucacuuagcaaacacauguugacuuuuaacugaugu

SEQ ID NO: 325228 - RNA, 64 nt, Human
uagagaagucaggugauagaugauauuaaaaauuagcaaacaaaagugacuugcucagggucau

SEQ ID NO: 325229 - RNA, 64 nt, Human
aaaagccuucccaggcgucuguaccgaaaggagcagcaaacaaggggcuaauccaugagcagug

SEQ ID NO: 325230 - RNA, 64 nt, Human
uuuuauguuuuuuaauuaaucagucacuuguaaaagcaaacaagcgguccauccccuuuucaag

SEQ ID NO: 325231 - RNA, 64 nt, Human
caucuaaguuuucacuuauaaacuguuauuucaaagcaaacauacuagugauauauauaugauu

SEQ ID NO: 325232 - RNA, 64 nt, Human
gaacuuccaguauaguggggacaaucaguuaauaagcaaacaaacacauuucuauuuauaaaug

SEQ ID NO: 325233 - RNA, 64 nt, Human
ugugcauuugcuaugcuuuaccugucuggcaucuagcaaacauucuucacauguuugcuguuau

SEQ ID NO: 325234 - RNA, 64 nt, Human
cugcaaccaugcagcuacccugccaggggcacucagcaaacagaaccacagggcccaggaggca

SEQ ID NO: 325235 - RNA, 64 nt, Human
guaaggaauauggaauugcuaagauaucauugguagcaaacaucucugguaaggugcauauauu

SEQ ID NO: 325236 - RNA, 64 nt, Human
aauuguggacugaaucacuagccuuaggucuuucagcaaacagccuaucagggccauuuaucau

SEQ ID NO: 325237 - RNA, 64 nt, Human
guaguucuucggggccuauuucugcugaugccugagcaaacaaccugcuuccucuugugcucug

SEQ ID NO: 325238 - RNA, 64 nt, Human
uagucuggggagucuuccauaaaguuuugcauggagcaaacaaacaggauuaaacuagguuugg

SEQ ID NO: 325239 - RNA, 64 nt, Human
ccugccuucccaccaccaccaccgugcauggggcagcaaacacguggggccgcagacauagccu

SEQ ID NO: 325240 - RNA, 64 nt, Human
caggcaucaggaaaguugaguguaagauggaaaaagcaaacagccuauuuacaaguggaaacac

SEQ ID NO: 325241 - RNA, 64 nt, Human
ccucuucccccaggcccuccccagccgacgacagccaccggagaggagaucggaacacgauugu

SEQ ID NO: 325242 - RNA, 64 nt, Human
augugguucccagggaugggccuguacauagaagccaccggauggcacuuccccaccggaugga

SEQ ID NO: 325243 - RNA, 64 nt, Human
gacuucggaggggcggaugcagagcccagggcccccaccggaagauguguacagcuggucuuua

SEQ ID NO: 325244 - RNA, 64 nt, Human
uccagaaagcaccaaggaaaaagcagagaaugacagcaaacagaucacuaggccucugaccaca

SEQ ID NO: 325245 - RNA, 64 nt, Human
uagaaaaaaaaaucuuguuaacaaugaaaaaaugagcaaacaaaaaaaucgaaagacaaacggg

SEQ ID NO: 325246 - RNA, 64 nt, Human
ugaagcaauguaacaguguaaucuaguucaauucagcaaacauucauggaguucuucaugucug

SEQ ID NO: 325247 - RNA, 64 nt, Human
ucuugaauggaguauaaguuuuccguuguuaaaaagcaaacaaaaaaccaacaaaaaauccaag

SEQ ID NO: 325248 - RNA, 64 nt, Human
ugaaaguaugaccucacagucuucauuuguccauagcaaacauauguguguguguguguauaua

SEQ ID NO: 325249 - RNA, 64 nt, Human
ucaaacuaucacaauucagugugaugagcagcauagcaaacagauggauuugaagcuaaaagca

SEQ ID NO: 325250 - RNA, 64 nt, Human
auuccuauaaaucuaaugacauucaauaaaguugagcaaacauuuuacuuaauuaugagcaauu

SEQ ID NO: 325251 - RNA, 64 nt, Human
acucucugcuaucccacuguauagauccacagggagcaaacacuuagaaaugauagagaacuga

SEQ ID NO: 325252 - RNA, 64 nt, Human
uuguuauucucucaugaauagaaauuuauguagaagcaaacaaaauacuuuuacccacuuaaaa

SEQ ID NO: 325253 - RNA, 64 nt, Human
uuuucuaaacagcuuuacacccuuggugccuuggagcaaacauguuuuuugaaccuugucauuu

SEQ ID NO: 325254 - RNA, 64 nt, Human
acuacuggcucucauugacuuccuuacuaagcauagcaaacagaggaagaauuuguuaucagua

SEQ ID NO: 325255 - RNA, 64 nt, Human
uaggaauccggcagaagaccuucauuaauuaagaagcaaacaaaaagagagcaacccaaccaaa

SEQ ID NO: 325256 - RNA, 64 nt, Human
uucuuuucaccaccccuuuggcucaccuuguaucagcaaacaaaguacuucuucagggaaaccu

SEQ ID NO: 325257 - RNA, 64 nt, Human
ugucugacagugugagauguuagaccgagagaaaagcaaacaaauaaaucacuuaaucuugaac

SEQ ID NO: 325258 - RNA, 64 nt, Human
ucuagagguuggaaagagaagagaggcugggagcggauggaaagcaugacugcaucuggagccc

SEQ ID NO: 325259 - RNA, 64 nt, Human
uguggagcugggcgucuggaucaaaacugcuuugggauggaaccucgagcccuagcagugaaga

SEQ ID NO: 325260 - RNA, 64 nt, Human
cucuuauuucaaguucaaugaaagacuuuacaaaagcaaacaaagcagacuuuguccuuuugcc

SEQ ID NO: 325261 - RNA, 64 nt, Human
ggcugguugguuuuaguacuguaaacugcuucugagcaaacacggaaauuuagcaaaauuaugu

SEQ ID NO: 325262 - RNA, 64 nt, Human
cacacguggugcagcuaaaacaaaacaaaacaugagcaaacacaaaacccaaggcagcuuaggg

SEQ ID NO: 325263 - RNA, 64 nt, Human
uaauaaauacacagcaugcagacugggaguugcuagcaaacaaauggcuuacuuacaaaagcag

SEQ ID NO: 325264 - RNA, 64 nt, Human
auggggagcccagcccccaccccccaccuccgacagcaaacagcaacugacugcaggugcuggc

SEQ ID NO: 325265 - RNA, 64 nt, Human
aucagcuguuaaucugaauuuucaagagaaaacaagcaaacauaacugaucagcugccgguaug

SEQ ID NO: 325266 - RNA, 64 nt, Human
gcaacagaggccaaagaaacgaagcaagacaaacagcaaacaggcauuuuggucaggucauuug

SEQ ID NO: 325267 - RNA, 64 nt, Human
aauacuuuucaggccuuuuuaaaaaauucauuacagcaaacagcuggggaaggacaugcagucc

SEQ ID NO: 325268 - RNA, 64 nt, Human
uugacaaagugccgugauaauuuuugaaaagagaagcaaacaauggugucucuuuuauguucag

SEQ ID NO: 325269 - RNA, 64 nt, Human
acuucucaugauacauuuuaguuauucuuauaaaagcaaacaggcaaacaugaguguaaauuaa

SEQ ID NO: 325270 - RNA, 64 nt, Human
caccuuaguaauaaauuuaucuuuugaggucauuagcaaacaugaacucacagggauccagaga

SEQ ID NO: 325271 - RNA, 64 nt, Human
gcugaaauuugaagaccagauaaugaaacugaaaagcaaacaauuuuacugaaucugucuaccc

SEQ ID NO: 325272 - RNA, 64 nt, Human
cuacauuaaaagcuuuagauugaaauuuaugacuagcaaacaaaaauagaauauauaaacgaua

SEQ ID NO: 325273 - RNA, 64 nt, Human
aaguuaacaauuuuuaauggaaagagcauguuagagcaaacaaaugcauaagcaagacugagca

SEQ ID NO: 325274 - RNA, 64 nt, Human
uuucagauacaugguugugaccugaggauuuaagggauggaaaaggaagacuagaggcuugcau

SEQ ID NO: 325275 - RNA, 64 nt, Human
ggggggaggagggaacuggagguuauugggguuaggauggaagggaacucugcacaaaaccuuu

SEQ ID NO: 325276 - RNA, 64 nt, Human
uucuguucuccagugucacuguucuguuuccacgggauggaaagcgcaugggccuguguccauu

SEQ ID NO: 325277 - RNA, 64 nt, Human
uacuguggcuauguaggagaacauucuuguucuuagcaaacauacugaaguuuuuagauauuaa

SEQ ID NO: 325278 - RNA, 64 nt, Human
caggagagguaaugcaccccugaaggauaugaggggauggaagagagggcuggcugcccaaggg

SEQ ID NO: 325279 - RNA, 64 nt, Human
uccacagaggccacaaaauguugcaagucaugauggauggaaauauguucuaacagcaucugcc

SEQ ID NO: 325280 - RNA, 64 nt, Human
aacucaguaagaacaugccugcgacucccuuucuggauggaaccugggcuguggcucucugucg

SEQ ID NO: 325281 - RNA, 64 nt, Human
uuagcaguggccuggcacaaaacaaaugcucaguggauggaagcugccuauuauuauugucguu

SEQ ID NO: 325282 - RNA, 64 nt, Human
uugaauuaauagaggccuuauuagaguggauuguggauggaaagcacuccuacccuccagguaa

SEQ ID NO: 325283 - RNA, 64 nt, Human
cacuaaaaaagaagguuucuaaauuguaggagcaggauggaaauacuuugcugcccuugccauc

SEQ ID NO: 325284 - RNA, 64 nt, Human
guagaagccaucaaccuacugaaguuguguggagggauggaaagugggucaguggagaagggau

SEQ ID NO: 325285 - RNA, 64 nt, Human
uucuacuaacugagugagacaugacgcugugcguggauggaauagucuggacaccugguggggg

SEQ ID NO: 325286 - RNA, 64 nt, Human; identical to SEQ ID NO: 190084

SEQ ID NO: 325287 - RNA, 64 nt, Human; identical to SEQ ID NO: 190085

SEQ ID NO: 325288 - RNA, 64 nt, Human; identical to SEQ ID NO: 190440

SEQ ID NO: 325289 - RNA, 64 nt, Human; identical to SEQ ID NO: 190459

SEQ ID NO: 325290 - RNA, 64 nt, Human; identical to SEQ ID NO: 190460

SEQ ID NO: 325291 - RNA, 64 nt, Human; identical to SEQ ID NO: 190461

SEQ ID NO: 325292 - RNA, 64 nt, Human; identical to SEQ ID NO: 190462

SEQ ID NO: 325293 - RNA, 64 nt, Human; identical to SEQ ID NO: 190463

SEQ ID NO: 325294 - RNA, 60 nt, Human
caguccuacagcaaguuugacacaaaaucgcacaacgaugacgcacugcucaagaacuac

SEQ ID NO: 325295 - RNA, 64 nt, Human
cauuguaaguuuucucagguuauuauuauuagagagguuggaaacauugguaaacucuguugau

SEQ ID NO: 325296 - RNA, 64 nt, Human
acaguuuuggaccuggaaucauguguaacuaacaagguuggacguuucuuccccaucaggguag

SEQ ID NO: 325297 - RNA, 64 nt, Human
uaauguuguuuugauguaauuuuaaaagacuuuuagcaaacaugcauuucuuuauaugauauau

SEQ ID NO: 325298 - RNA, 64 nt, Human
accggcauuuuauuaaacuuaaaacuuuguagaaagcaaacaaaauuguucuugggagaaaauc

SEQ ID NO: 325299 - RNA, 64 nt, Human
aauaugccaucccauuucaccuugcaugugagacagcaaacaaaauccacaaauggugugaacu

SEQ ID NO: 325300 - RNA, 64 nt, Human
agcuuuacucagcaugacuguagauaaggauagcagcaaacaaucauuggagcuuaaugaacau

SEQ ID NO: 325301 - RNA, 64 nt, Human
uccauauuaaccacagacuguccucuccaccuuuagcaaacauaugguuuacuucauuguuuug

SEQ ID NO: 325302 - RNA, 64 nt, Human
gcucugcuauuuguuugcagaacacccaagagcgagcaaacaugcucucuucacagcaguaccu

SEQ ID NO: 325303 - RNA, 64 nt, Human
aguaaaauauggaucuuuuaagaagaauuugagaagcaaacaauuacaugucaugucaaggggg

SEQ ID NO: 325304 - RNA, 64 nt, Human
caaccgguuuucccuuuucugggucuguucaaaaagcaaacauuaagggugggcacauaaucca

SEQ ID NO: 325305 - RNA, 64 nt, Human
uauucugggcugggcucuucuggaguagggggucagcaaacauugucugcaaagggccagauac

SEQ ID NO: 325306 - RNA, 64 nt, Human
cuggccauuuaacuagcacuuuauaagccaaugaagcaaacacacagacucugugagauucuaa

SEQ ID NO: 325307 - RNA, 64 nt, Human
ggugagccugccuguuguccacguggcugcagcaagcaaacauggguuuuccuuggaaggacug

SEQ ID NO: 325308 - RNA, 64 nt, Human
caaucuaggugguguucuuggucuuaaauuuaacagcaaacacagcacauaucuauuaucacua

SEQ ID NO: 325309 - RNA, 64 nt, Human
cuccuuguagaacaucagagaaggcacauugacuagcaaacagcacuuuaggaaaagucaccgu

SEQ ID NO: 325310 - RNA, 64 nt, Human
cagggccaaggcagcaggcggcaggaguagcagcagcaaacaaaggaaggagcuggguggccuu

SEQ ID NO: 325311 - RNA, 64 nt, Human
aaaugcaguguagggagaggagauggcaggacacagcaaacaggacacauuugccugcuucucu

SEQ ID NO: 325312 - RNA, 64 nt, Human
cucuguccucuuuuagucuagugucugguuuucuagcaaacaguaaauuuaaacaaguaaacua

SEQ ID NO: 325313 - RNA, 64 nt, Human
ucacagcugugcucugagugccuagcggaguuccagcaaacaaaauggacucaagagagauuug

SEQ ID NO: 325314 - RNA, 64 nt, Human
gcucccagagcagccucugucaccgcuucuguguagcaaacauuaacgaugacagggguagaaa

SEQ ID NO: 325315 - RNA, 64 nt, Human
guguguccucaucugcggcaggcaggagagggggagcaaacaggaaauuccacagcugccucca

SEQ ID NO: 325316 - RNA, 64 nt, Human
uauucuuuuuauucauuguuucaguucugauuucagcaaacaugagcaaaccacuuugacugaa

SEQ ID NO: 325317 - RNA, 64 nt, Human
caagccucagaaaaacacacaagaacaauaacacagcaaacagauugagggauuguugugguuu

SEQ ID NO: 325318 - RNA, 64 nt, Human
ucuacuuuaaaucaaucauuaaaggaauccacaaagcaaacagaguucagucucaucuugcaag

SEQ ID NO: 325319 - RNA, 64 nt, Human
uuuuuaauuucugaagugcuaaguguuuuuauacagcaaacaaaaagucaauuuugcuuuccac

SEQ ID NO: 325320 - RNA, 56 nt, Human
agaccaaaguugaccaguaggauaauagcaaacauuucuaacucuauuaaugaggu

SEQ ID NO: 325321 - RNA, 64 nt, Human
uguaauuacagcccuaucuggagacagcgaauacagcaaacagauuuuauuaccuaguucgcuc

SEQ ID NO: 325322 - RNA, 64 nt, Human
aaugagcgacuuuucuuuguucagcuuuaguuuuagcaaacaccacaaauauguuuuaaguaac

SEQ ID NO: 325323 - RNA, 64 nt, Human
aaaaauaacaagaugugacagaagccacuuaggcagcaaacauaaauguugcagugaaaaaaga

SEQ ID NO: 325324 - RNA, 64 nt, Human
aagaaaaggaaucuagauuuuguugcauuguaggagcaaacaaggcuucauauucuuuuuaaaa

SEQ ID NO: 325325 - RNA, 64 nt, Human
cuaagauaagaggccaggccagucaguuuggcccagcaaacauguggguacuucuccaccuagg

SEQ ID NO: 325326 - RNA, 64 nt, Human
acacgagagacagaaggaaagagaggaagagagaagcaaacauguaggaaaaaauauaaaucag

SEQ ID NO: 325327 - RNA, 64 nt, Human
ucagucugacuugaaggggccugguuuggaucuaagcaaacacccagaugggguucucuggucu

SEQ ID NO: 325328 - RNA, 64 nt, Human
uuucuuugaaaggggccuguucucaguaaagaugagcaaacauuuggaauuuacaugugggcag

SEQ ID NO: 325329 - RNA, 64 nt, Human
gauuccagcaagugguaaauugguauuuguaaaaagcaaacaaacauuacaaggcaguuaucuc

SEQ ID NO: 325330 - RNA, 64 nt, Human
uccuuuuuaagaguaaguugguuacuucaaaaagagcaaacacuggggaucaaauuauuuuaag

SEQ ID NO: 325331 - RNA, 64 nt, Human
gcugaucccauggggcggagguccccaguggcugagcaaacagccccuucucucgcuuuggguc

SEQ ID NO: 325332 - RNA, 64 nt, Human
uuuuuugccuuucuuuuucccaccaugaagagaaagcaaacaaacagaaaccccaacuagguca

SEQ ID NO: 325333 - RNA, 64 nt, Human
auuuaauguagacauuaucuuuuggcucugaagaagcaaacaugacuagagacgcaccuugcug

SEQ ID NO: 325334 - RNA, 64 nt, Human
uauuuuuaucugaagcuagaggaauaaagcugugagcaaacagaggaggccagccucaccucau

SEQ ID NO: 325335 - RNA, 64 nt, Human
gaacauaucuucacauuagaguuaagaauucucuagcaaacaacagauuuuuuuguuguuguua

SEQ ID NO: 325336 - RNA, 64 nt, Human
auuuguuuagauaugacauuuauucaaaguuaaaagcaaacacuuacagaauuaugaagaggua

SEQ ID NO: 325337 - RNA, 56 nt, Human
agcaagagucaucugcuugaaugugaagcaaacacagcaucgugaucacugagcca

SEQ ID NO: 325338 - RNA, 64 nt, Human
uauuuuguauuugcauauguauuuuugucauagcagcaaacagagugaaaugccauuuuucaua

SEQ ID NO: 325339 - RNA, 64 nt, Human
uggggaauggaggauagcaugggauguauggagaggauggaagauuuucauguaaaauaaaauu

SEQ ID NO: 325340 - RNA, 64 nt, Human
ucagacacuaccccauauacaccuggaacauugaggauggaaacuggacucacauucgacauac

SEQ ID NO: 325341 - RNA, 64 nt, Human
uuuguucacaggaguuuuuggugcggggugggaaggauggaaggccuuggauuuauauugcacu

SEQ ID NO: 325342 - RNA, 64 nt, Human
aaagaugucaccuguggaacauaaaaaggacaucagcaaacaggaucaguuaacuauugcauuu

SEQ ID NO: 325343 - RNA, 64 nt, Human
gcaaaaagccagagauucugcaacacgaauucgaagcaaacaaacacaacacaacagaauuccu

SEQ ID NO: 325344 - RNA, 64 nt, Human
ugcaugaaaauacagauggaccugcaggaaagugagcaaacaucgcugaguuuguuuucuuguu

SEQ ID NO: 325345 - RNA, 64 nt, Human
uuuugguccucucguaguugugaaacacuugcagagcaaacaaagcagaggcaagaacugagga

SEQ ID NO: 325346 - RNA, 64 nt, Human
aaaaauuuuuuuuuauauuugcacaggacuauacagcaaacaaccaugugguuggauuacaugg

SEQ ID NO: 325347 - RNA, 64 nt, Human
caggucacgaggguggacucccuacaaucaacaaagcaaacagagagccugugggaggggcuga

SEQ ID NO: 325348 - RNA, 64 nt, Human
agaauggcaauaaggacuccgaauacauaauaaaagcaaacagaacacuccaacuuagagcaau

SEQ ID NO: 325349 - RNA, 64 nt, Human
uaauuuauguaaagcaguagaguaccuggcacaaagcaaacaauaaauauuauuguuauuguug

SEQ ID NO: 325350 - RNA, 64 nt, Human
caauugaauuaguuuuuucuuccuuuuugcuugaagcaaacaguugacaauuuuuaaccuuuuc

SEQ ID NO: 325351 - RNA, 64 nt, Human
cuaacaucaccauuaaaaggaugagagaagcaagagcaaacacauucaaaagcuagcagaaggc

SEQ ID NO: 325352 - RNA, 64 nt, Human
gaaaugauguggaccuugcuggaaacaaaggcuuagcaaacaauuuuuguucaaugcccaccaa

SEQ ID NO: 325353 - RNA, 62 nt, Human
aaccaccaggaaaacacuaaagaagauaacuaagcaaacaaguuggaauucaccaagauugg

SEQ ID NO: 325354 - RNA, 64 nt, Human
uuugaaccuuauguaccgagcaaaugccaggucuagcaaacauaaugcuaguccuagauuacuu

SEQ ID NO: 325355 - RNA, 64 nt, Human
gcugccaggugagaaacuguuugaaaacuucagaagcaaacaauauugucucccuuccagcaau

SEQ ID NO: 325356 - RNA, 64 nt, Human
acacaaggucuacauuacaaaagacagaauucagggauggaaaggagaaugaacaaauguggga

SEQ ID NO: 325357 - RNA, 64 nt, Human
cuggcucugccuagcuguuuacauuugcaaauguagcaaacaagguaaugaagcaacuauuucu

SEQ ID NO: 325358 - RNA, 64 nt, Human
cuagggagaaggaugcacaaauaaguaauggaugagcaaacagaauuaccugagcuaacuucaa

SEQ ID NO: 325359 - RNA, 64 nt, Human
aucuagcacuuacaucucucuaugcuguucuacaagcaaacaaacaaaaauaggaguauaggaa

SEQ ID NO: 325360 - RNA, 64 nt, Human
aaaguuggugcaucuagaaagcuuugaaugcagaagcaaacaagcuugauuuuucuagcauccu

SEQ ID NO: 325361 - RNA, 64 nt, Human
uacugaauguauacguauugugccugagcucaccagcaaacagaagcaucaagcccagggguaa

SEQ ID NO: 325362 - RNA, 64 nt, Human
uuuaaucaauaaaguaugucuguugaagcaagcaagcaaacaaauccauaacaaccacaacaag

SEQ ID NO: 325363 - RNA, 64 nt, Human
ccacuuagacauaauccauuccacucauuauuccagcaaacacuuacugacaaaucggguccug

SEQ ID NO: 325364 - RNA, 64 nt, Human
cauacugggcgugugcaucugaaucccgcuggagagcaaacacgaacuucuguucgcugcaaaa

SEQ ID NO: 325365 - RNA, 64 nt, Human
guauuuuguucuggcauuaaaagaaaaacaagcaagcaaacaaaaacacagccuccgaugccaa

SEQ ID NO: 325366 - RNA, 64 nt, Human
aaauucucguacuuuugccauguugauacuguucagcaaacaagcuaccaggaacugugaggcu

SEQ ID NO: 325367 - RNA, 64 nt, Human
accauugugucaggagucaaacaaauguuuagaaagcaaacaugacgucucuauuguacaaccu

SEQ ID NO: 325368 - RNA, 64 nt, Human
uggaauuaugccaaagcauaggaagcugggaauaagcaaacaaaugcugauauagucagcaaau

SEQ ID NO: 325369 - RNA, 64 nt, Human; identical to SEQ ID NO: 325365

SEQ ID NO: 325370 - RNA, 64 nt, Human
cuuuacuugcaaauucaggggcuuagaaaaugaaagcaaacacaaaaccuugagugugcuuugg

SEQ ID NO: 325371 - RNA, 64 nt, Human
auaaaaacugaauuccugucauucaggacaacauggauggaauuggagggcauauguuaaguga

SEQ ID NO: 325372 - RNA, 64 nt, Human
cugcauagaucccauuuuuguacagaauugaaugggauggaauagguaagcaaaaguagaagcc

SEQ ID NO: 325373 - RNA, 64 nt, Human
gggggugaauacuuccccaagauucuuccugggaggauggaaacagugcagcccaggucccaug

SEQ ID NO: 325374 - RNA, 64 nt, Human
auaaauaagagaccaaaaguaggcuaucacccaaagcaaacauccuuaacugacccuaacgugu

SEQ ID NO: 325375 - RNA, 64 nt, Human
cacacgaccaagucagcgagagcuagcccugguaagcaaacauagcccauuacagguucagaac

SEQ ID NO: 325376 - RNA, 64 nt, Human
ucuagcuacuuaaugguucuguucuuuuauaugcagcaaacacaccguccauuucugaagaggc

SEQ ID NO: 325377 - RNA, 64 nt, Human
gaccacccgagcuaaucauggaaugucuguucccagcaaacacgauaaagaaagauugugcacu

SEQ ID NO: 325378 - RNA, 64 nt, Human
uagacuucaaagccaguauuuguuuaggucaugaagcaaacaaugcucuaaucacaauauuaac

SEQ ID NO: 325379 - RNA, 64 nt, Human
uuuaugugcaauggugucguccaugcacgacagcagcaaacauucuggggcugcuuuuuauugu

SEQ ID NO: 325380 - RNA, 64 nt, Human
acacauuuccuugcaacuugaucaaauuucuuaaagcaaacaacaaaaauguacauuucuguuu

SEQ ID NO: 325381 - RNA, 64 nt, Human
agagcauaccacuugaagaaggaaagaaccgaagagcaaacaaaaguucugcguaaugagacuc

SEQ ID NO: 325382 - RNA, 64 nt, Human
gagaaaaaccuuauuuucuuuuguaagagcugggagcaaacacguuuaugagugugucggaauc

SEQ ID NO: 325383 - RNA, 64 nt, Human
acuucagcuagcuagauauauccaugguccagaaagcaaacauaauaaauuuuuaucuugaagu

SEQ ID NO: 325384 - RNA, 64 nt, Human
uguguagccaugccuaucaguaaaaagauuuuugagcaaacacuugaauauguguguccuuuua

SEQ ID NO: 325385 - RNA, 64 nt, Human
ccacaaccgcuaacacuuacaauuuuggugcaaaagcaaacaguuccagcaggcucucuaaaga

SEQ ID NO: 325386 - RNA, 64 nt, Human
gcccuuguucagucauuuucucuaaggccuuggaagcaaacaucuucuggcauauggcuuguua

SEQ ID NO: 325387 - RNA, 64 nt, Human
uugguuggggggcgcgggcauauaaccugucagaagcaaacaggagcggcaacuucuaacuuug

SEQ ID NO: 325388 - RNA, 64 nt, Human
gaagccagggcauggauggggcuuuggguccucgagguuggaccccagcuucuugccaccuucc

SEQ ID NO: 325389 - RNA, 64 nt, Human
cuuguuuucuaugauccaaaacagcccuauaagaagguuggaaaaggaggaacuauauagcagc

SEQ ID NO: 325390 - RNA, 64 nt, Human
uaggggauauuguaacccaguauaauuuucugacagguuggacuuugacccuaauggacuuacu

SEQ ID NO: 325391 - RNA, 64 nt, Human
guacacugcuagcacugcuagcacacaguagcaaagcaaacagcuacauuaucuuuaacauaag

SEQ ID NO: 325392 - RNA, 64 nt, Human
agcugagcugcgauaggaaaaucugaauggaggcagcaaacagccaaaacaaacauuccccacc

SEQ ID NO: 325393 - RNA, 64 nt, Human
ucugugcuaauuuaaacugccaaauauugacugcagcaaacaagaauuauauucagaauuuaug

SEQ ID NO: 325394 - RNA, 64 nt, Human
cauucacacugacuugggcagugacagagcccagagcaaacagggccaggccagcccaaaucca

SEQ ID NO: 325395 - RNA, 64 nt, Human
aauaucauuuugugacuguaaacaauuauuuauuagcaaacaauugaucccagaagggcaaauu

SEQ ID NO: 325396 - RNA, 64 nt, Human
acagguacuggacuuuucccuccugcaugaaacaagcaaacaauggacaaaauaugugaaacaa

SEQ ID NO: 325397 - RNA, 64 nt, Human
caauggaagcuggagugugacuggaaaaauacucagcaaacaaaguuaccaauuccauacagag

SEQ ID NO: 325398 - RNA, 64 nt, Human
gccauggugcucugugguggcgcaugauucacugagcaaacagcacuuuacagaagaaaaucuu

SEQ ID NO: 325399 - RNA, 64 nt, Human
uaaaccauguaaagaacauaaauaacaaaucucaagcaaacagcuucacaaauucucacacaca

SEQ ID NO: 325400 - RNA, 64 nt, Human
uauauaugugggaagugcaugcauuucguuuauuagcaaacauagcuggauuaagacaaaguug

SEQ ID NO: 325401 - RNA, 64 nt, Human
aauuaucagugaccugccugcaagcauccccagaagcaaacagcagagguagaagauaucacug

SEQ ID NO: 325402 - RNA, 64 nt, Human
auccuggcccaggcuggggguacagaucugcugaagcaaacacaggagcgcuacuuggccaaga

SEQ ID NO: 325403 - RNA, 64 nt, Human
gaguucauggauauguuauacugaaccaggccagagcaaacagaaaaagaagguugagggcaau

SEQ ID NO: 325404 - RNA, 64 nt, Human
acccagggagucuuggguguuccuuaucuggggaagcaaacauuucacuagucucuuuuuuuca

SEQ ID NO: 325405 - RNA, 64 nt, Human; identical to SEQ ID NO: 246627

SEQ ID NO: 325406 - RNA, 64 nt, Human; identical to SEQ ID NO: 246631

SEQ ID NO: 325407 - RNA, 64 nt, Human
ugaggguuguuuuauagccaucaaaguauucaagagguuggauggcacucaaaagauucuacau

SEQ ID NO: 325408 - RNA, 64 nt, Human
ucuaaaacuuucacuggauuucuuuagacauugaagcaaacauuuuuuucuaagaauugcuucu

SEQ ID NO: 325409 - RNA, 56 nt, Human
agagaugcacucuccagugacuccccagcaaacacaaggugcagcagggucccaaa

SEQ ID NO: 325410 - RNA, 64 nt, Human
cuccuuugcacuaagugcuuugcagacacggcacagcaaacauuuugcaaacugcagcagaaau

SEQ ID NO: 325411 - RNA, 64 nt, Human
cagggcuuaauuagaacaggcuguauuuccucccagcaaacaguuguggccacacuaaaaacaa

SEQ ID NO: 325412 - RNA, 64 nt, Human
auaaagauuuuucaugugaaaggacugggguuuuagcaaacacaggucuaaucucuuuuguguu

SEQ ID NO: 325413 - RNA, 64 nt, Human
gaauacaugccacaaggaugaagcuugugaguagagcaaacaaacguuuuuccaaagaauucac

SEQ ID NO: 325414 - RNA, 64 nt, Human
gggaaagucagcaaaagaaagaaugcauuucgaaagcaaacagaagaaaaaaguauauucucac

SEQ ID NO: 325415 - RNA, 64 nt, Human
ucuuaaaccaguuuuuacuugucaguuuucucucagcaaacagucuuacuauuauguggaauuu

SEQ ID NO: 325416 - RNA, 64 nt, Human
uuuacauuucccucaucuuucuuacuucagaguuagcaaacaacaaguugaauggcaacuugac

SEQ ID NO: 325417 - RNA, 64 nt, Human
cuuucuccuggcagcagaaaaggaagaacacaagagcaaacacacaacaaugaugguggcaaag

SEQ ID NO: 325418 - RNA, 64 nt, Human
cuaggugacagagcaagacucugucucaaaaacaagcaaacagacuuccuucaacaaauauuua

SEQ ID NO: 325419 - RNA, 64 nt, Human
uucccacccucugcaagcuccugagauuuguuuuagcaaacagauggauucucuccaggccaug

SEQ ID NO: 325420 - RNA, 64 nt, Human
gcagugugguacacuccagggacuugggaaaaugagcaaacacacagcguguuauuccuuaaag

SEQ ID NO: 325421 - RNA, 64 nt, Human
acacacacacagacacacauacacccaugaugugagcaaacacacacacgugcgccuucauagc

SEQ ID NO: 325422 - RNA, 64 nt, Human
uuuuuuuuuuuuugagggucucacucugucacccagguuggagugcagcaggggcaugaucagc

SEQ ID NO: 325423 - RNA, 64 nt, Human
ugguuuaaaagauuaaagaaacgauuaagagaaaagguuggaagcuuuauacuaaaugggcucc

SEQ ID NO: 325424 - RNA, 64 nt, Human
caccgagacaaugauaugcaagugcaaaagaaugagguuggaccuuuacucacacuaugugcaa

SEQ ID NO: 325425 - RNA, 64 nt, Human
gccaaguagcuuugggcauaggcugcccaaucugagcaaacaccagugaggcucuauugagcca

SEQ ID NO: 325426 - RNA, 64 nt, Human
uaaaagauaaacaguuuagcccaucucuccagagagcaaacauaggaauaugacucaggagccu

SEQ ID NO: 325427 - RNA, 64 nt, Human
cgcggcccaggccugaaggggagcucugagacagagcaaacacccaccccagaacaagccgaca

SEQ ID NO: 325428 - RNA, 64 nt, Human
acuccagggguggcugggagacugggcagccaccagcaaacagacccuguggccccugcccggc

SEQ ID NO: 325429 - RNA, 64 nt, Human
ucaaagcauacauuggaaauaaacaguagaaauaagcaaacaauauaaagagacacgggaaaug

SEQ ID NO: 325430 - RNA, 64 nt, Human
cagccucacucuaagaggcuuuuuugcugagucaagcaaacacuugccugcucugccccuugga

SEQ ID NO: 325431 - RNA, 64 nt, Human
guuuuaaaagaugaguuuuuccuacauucugaaaagcaaacaugaaaaacugaacacaguuuuu

SEQ ID NO: 325432 - RNA, 64 nt, Human
guugaagagguaaaaaauaaauaaauacauaaaaagcaaacaagcggggacaccugcagucuua

SEQ ID NO: 325433 - RNA, 64 nt, Human
ccacauuuucauggaaugguacugugggagacugagcaaacacucuuuuggcaacuuaguagaa

SEQ ID NO: 325434 - RNA, 64 nt, Human
aacucugauaagaaaaguguucaauuuguauuuaagcaaacagugaacgacguuugcaaucaac

SEQ ID NO: 325435 - RNA, 64 nt, Human
gcaccagguaauaggggaaaauugugugaccuccagcaaacacaugaaugguuauuuccuggag

SEQ ID NO: 325436 - RNA, 63 nt, Human
gccaguguuguagcaacugaggggguggcuagcagcaaacaaguauggagcuagcacaagagc

SEQ ID NO: 325437 - RNA, 64 nt, Human
uccuuguauccauguaauuucagaugaauuauuaagcaaacauuuuaaagugaauucauuauua

SEQ ID NO: 325438 - RNA, 64 nt, Human
aaaagguuauguucauuuuucaaaaagggaaguaagcaaacaaauauugccaacucuucuauuu

SEQ ID NO: 325439 - RNA, 64 nt, Human
gcagcugcagucugucaggaugagauaucagauuagguuggauagguggggaaaucugaagugg

SEQ ID NO: 325440 - RNA, 64 nt, Human
agauacccuccuuggaguugcaaguauucuuucaagguuggaagagggauuuugaagagguauc

SEQ ID NO: 325441 - RNA, 64 nt, Human
gaagaggcugggugguugcacaggccaggugcacagguuggaaaugcacugaacucugggugcc

SEQ ID NO: 325442 - RNA, 64 nt, Human
uuuauuaaagaguuguauucaaucuuggcaauaaagcaaacauaauggcaacaggauuuucuuu

SEQ ID NO: 325443 - RNA, 64 nt, Human
uuagaaacacccacaaacuucacauaucauaauuagcaaacaauuggaaggaaguugcuugaau

SEQ ID NO: 325444 - RNA, 64 nt, Human
gucauuuacaguauugggguuuuuaugaaugugaagcaaacaaaaaaaauuuguauguaaacug

SEQ ID NO: 325445 - RNA, 64 nt, Human
ucaaaaggcuuggaaagaaaaaacaaauacaacaagcaaacaacaauaucaacaacaagagauu

SEQ ID NO: 325446 - RNA, 64 nt, Human
gaaggacuugcuuuuccaugaagaagacgaaaacagcaaacaagggcaagaaggucugagaggg

SEQ ID NO: 325447 - RNA, 64 nt, Human
ggcgggccugggguucagacccacagcugccucaagcaaacaggguaucacgcuugccccuggg

SEQ ID NO: 325448 - RNA, 64 nt, Human
gccccuuccucugccaggugcuuggcucucugagagcaaacaggaacacuagagaccaaaaagg

SEQ ID NO: 325449 - RNA, 64 nt, Human
ucaagagacaaaaaaaauuaaaauaacuacccucagcaaacacuagcuguucugcucauauaug

SEQ ID NO: 325450 - RNA, 64 nt, Human
acauuaaaauaacuaagcaaguauauuuauuucuagcaaacagauguuuguuuucaaaauacuu

SEQ ID NO: 325451 - RNA, 64 nt, Human
gcuuguuggguggguaagcaccaccuggucucucagcaaacacuccugagugguugaagaugcu

SEQ ID NO: 325452 - RNA, 64 nt, Human
guauauuuauccaguuaaagggcuaaauuauauaagcaaacacuacuuuuuuuaaaacgucugg

SEQ ID NO: 325453 - RNA, 64 nt, Human
ccgaagcauaacucacuugcgccugugggggaagagcaaacaggaaggagagcuaccuccuaag

SEQ ID NO: 325454 - RNA, 64 nt, Human
uggucuuuccggccaucuuucuugcuggcaagucagcaaacauuaccuucuuagucacgugcau

SEQ ID NO: 325455 - RNA, 64 nt, Human
uauacuacugagauccuaaguuaagacucuccaaagcaaacauuugguuuaaaucauuuaucug

SEQ ID NO: 325456 - RNA, 64 nt, Human
uaauauaggccauugugauucaggaagaaacccaagguuggagggugggaugaguacccucuga

SEQ ID NO: 325457 - RNA, 64 nt, Human
uugguaacugauuaccugccaauugcuaccgagaagguuggagguggggaaggcuuuguauaau

SEQ ID NO: 325458 - RNA, 64 nt, Human
uucauccuuccccaacuucccuaguccccguacuagguuggacagcccccuucgguuacaggaa

SEQ ID NO: 325459 - RNA, 64 nt, Human
uucaagcauuuugcagugagcuucuuuuauauauagcaaacaauuugaaagaauacaaaaauau

SEQ ID NO: 325460 - RNA, 64 nt, Human
acuaagcagaauuuagaaagagaaguuuuuaaaaagcaaacaguguaaaaaaagucaucuccca

SEQ ID NO: 325461 - RNA, 64 nt, Human
guacacugccuuugguuuuagcaguucuuugaaaagcaaacacuuucauguccugucuauucau

SEQ ID NO: 325462 - RNA, 64 nt, Human
gugauuauuuuuuaaagucuucuuucauguaaguagcaaacagggcuuuacuaucuuuucaucu

SEQ ID NO: 325463 - RNA, 64 nt, Human
caucuccaagccaucugucaucagaucaaaaagcagcaaacagagggucagucacaggauguuc

SEQ ID NO: 325464 - RNA, 64 nt, Human
uuuguauuguggucauuuccuaugcaaauaauggagcaaacagcuguauaguuguagaauuuuu

SEQ ID NO: 325465 - RNA, 64 nt, Human
ccaaaccccaagacagcuacauuuucaacaaaaaagcaaacagagaaaaauaaaugaacuuuaa

SEQ ID NO: 325466 - RNA, 64 nt, Human
gaaugucauaguacauugugugcuaaccauggcaagcaaacauuuacauuuguuuuuuacaaua

SEQ ID NO: 325467 - RNA, 64 nt, Human
acucuguggaguuuguucagugguacgguguccaagcaaacagcagaaugcaacuuucuaaaca

SEQ ID NO: 325468 - RNA, 64 nt, Human
caaacagcagaaugcaacuuucuaaacagccccaagcaaacagcagaauucaacuuuuuaaaca

SEQ ID NO: 325469 - RNA, 64 nt, Human
gaaguccagggaaaggcaucuggucugucuggaaagcaaacauuauguggccucugguaguuuu

SEQ ID NO: 325470 - RNA, 64 nt, Human
augauuauaauaaaaaguuacaggucacuuuaaaagcaaacaguaccacuugaugauuuugcau

SEQ ID NO: 325471 - RNA, 64 nt, Human
ucccugaguauaaaggaaaaacagcaaaacaaaaagcaaacaaaaaaaaacugcaaaagucuaa

SEQ ID NO: 325472 - RNA, 64 nt, Human
ucugggauuucuaaacagcaguuaagcuacaaaaagcaaacaaaaccacacauauugauggagu

SEQ ID NO: 325473 - RNA, 64 nt, Human
agccucagcaguguacagaguccccggcgcucugagguuggagagaaagaacagaccagcgccc

SEQ ID NO: 325474 - RNA, 64 nt, Human
cucaugccuauaauccuggcauuuuaggaggcugagguuggagaaucgcuugaggccagaagug

SEQ ID NO: 325475 - RNA, 64 nt, Human
aucaagucacaagaaucaccucacuuguguagguagguuggaaucaggauagacacugugauca

SEQ ID NO: 325476 - RNA, 64 nt, Human
ccaacucggaaguaagcccaagagaacaacauaaagcaaacaacauaaagcacaauaaaaaugc

SEQ ID NO: 325477 - RNA, 64 nt, Human
augcccaaggcacucacuggggaggaagcaaggaagcaaacagucugagaaaaugaugcaagaa

SEQ ID NO: 325478 - RNA, 64 nt, Human
ggaaagauuugugcuucagagguagacugcagaaagcaaacagucuacccagcagcucugaaug

SEQ ID NO: 325479 - RNA, 64 nt, Human
auucaacacuguguaaacaccaaagccuuaacuuagcaaacaguuguuagaagugggacacucc

SEQ ID NO: 325480 - RNA, 64 nt, Human
aacaaucccaaucuuucuauauaaaauguauucaagcaaacaucaaauaaauuucugggauauu

SEQ ID NO: 325481 - RNA, 64 nt, Human
ggagugucaggggaaccaugagagagagucuaggagcaaacacaucaccacccugagcagauac

SEQ ID NO: 325482 - RNA, 64 nt, Human
uaugaaucagcaaauuuuuaagauuguaccacauagcaaacauacagcuguugaaaaauaaugu

SEQ ID NO: 325483 - RNA, 64 nt, Human
uagccaugcugguagcaagagagaaaaaaucaacagcaaacaaaaccacacaaaccaaaccguc

SEQ ID NO: 325484 - RNA, 64 nt, Human
uuuugauaaaguaugaauuuguuuuauuuuaaaaagcaaacauacuaaauuuuuuuuauuuuau

SEQ ID NO: 325485 - RNA, 64 nt, Human
accgggauugcaaaucuaauugggaaaagaguugagcaaacagcuuggacuguuuggaguuguu

SEQ ID NO: 325486 - RNA, 64 nt, Human
cauguuuaaagcuuuauguaaaaacaagccaguuagcaaacaguccuggaaaaauauggugaga

SEQ ID NO: 325487 - RNA, 64 nt, Human
aggcaccauaucagccugcgggacuaggguggggagcaaacaggccagcgguggaggucuggac

SEQ ID NO: 325488 - RNA, 64 nt, Human
ucagauguuuccaagaugucccauugauaauucgagcaaacaacuuucuggaaaaacaggauac

SEQ ID NO: 325489 - RNA, 64 nt, Human
accacaccagggaggaaaaaugacauucagaaccagcaaacacugaauuucucuuguuguuuua

SEQ ID NO: 325490 - RNA, 64 nt, Human
ggaacacuuggaagguuuuaagcagagaagugacagguuggaaaagaugguuuggauuauugau

SEQ ID NO: 325491 - RNA, 64 nt, Human
caaagugccagggagaacagccaggugaggugggagguuggagagccaggugaggucucuguaa

SEQ ID NO: 325492 - RNA, 64 nt, Human
aggggcuuccucaguggugaggggagcugccuacagguuggaccgggaggcaguggcuuggaga

SEQ ID NO: 325493 - RNA, 64 nt, Human
aggcaugucagagaagggaggacucacuagaauuagcaaacaaaaccacccugacauccuccuu

SEQ ID NO: 325494 - RNA, 64 nt, Human
ccucucuccagcccaucaucuucguuucggacagagcaaacagcaacaaggagcugggugugga

SEQ ID NO: 325495 - RNA, 64 nt, Human
ggaacguuguccacaggggauuuauggauacaacagcaaacauuuuauaaacuaugcacaugca

SEQ ID NO: 325496 - RNA, 64 nt, Human
gaccguucucugaggcaaaggagggcaaccugacagcaaacacagucacuguugguuccuucug

SEQ ID NO: 325497 - RNA, 64 nt, Human
gcaccuguccccacccuccacucagcuguccugcagcaaacacuccacccuccaccuuccauuu

SEQ ID NO: 325498 - RNA, 64 nt, Human
uuuucuuuaaacauuuuuuuacuauuuuuuguaaagcaaacagaacccaaugccucccuuugcu

SEQ ID NO: 325499 - RNA, 64 nt, Human
gcuucccuccuucagacauugacaugagaucuuaagcaaacagucccaaaccucuuagggguga

SEQ ID NO: 325500 - RNA, 64 nt, Human
agaaacgucaaaguugugcccaacacuguggaucagcaaacacgauagaggagaccagucagua

SEQ ID NO: 325501 - RNA, 64 nt, Human
gaucacggauguuggcucccccucgcccuaugcaagcaaacacacucucaccuccucucccagc

SEQ ID NO: 325502 - RNA, 64 nt, Human
caggagagagcugaacguucucucagcccagagcagcaaacacaugaaagucagaagucucuaa

SEQ ID NO: 325503 - RNA, 64 nt, Human
uuugugccuugauguugagagcgccucucuuuugagcaaacaagcauucuauaugcaaccagag

SEQ ID NO: 325504 - RNA, 64 nt, Human
aucuggccugggggcuguuagcucagaggagaggagcaaacaggaaaaugacuucuguucuguc

SEQ ID NO: 325505 - RNA, 64 nt, Human
cgaccucugaccugcugucaucguagagguagaaagcaaacaaucuggggcucagcacaccugg

SEQ ID NO: 325506 - RNA, 64 nt, Human
cuuuaguagccacuagacaaccacccuuucugaaagcaaacagugcugcucuuuauuccagaca

SEQ ID NO: 325507 - RNA, 64 nt, Human
aauggcagaagugggggaaaauuuuuagaagaaaagcaaacaugugagaccaaucauuaucaaa

SEQ ID NO: 325508 - RNA, 64 nt, Human
gacacugcucuuuguaacccagccaccaccaaaaagcaaacagaaagaaggaaggaugguuaag

SEQ ID NO: 325509 - RNA, 64 nt, Human
cauguacacuuugauccugcuggaaaauuuuaucagcaaacacauugucuaaucuuucaaaaca

SEQ ID NO: 325510 - RNA, 64 nt, Human
cauggauggucagucucuugcccucaaacacuacagcaaacaagcuaccccugccaguccuaga

SEQ ID NO: 325511 - RNA, 64 nt, Human
uguuuaggcaauguaacauuuaccggcuguguacagcaaacaagcuauuuuuuagaaaccgacg

SEQ ID NO: 325512 - RNA, 64 nt, Human
cggacacaccucugcuccaaaggaaauccaaaaaagcaaacacaagaaaucaaaauccaaaauu

SEQ ID NO: 325513 - RNA, 64 nt, Human
gucccaugaggaugugggcccuuuaauaaaggauagcaaacagggagcuuguggccuguuuguu

SEQ ID NO: 325514 - RNA, 64 nt, Human
uucuagagggagaagacugugcggcacaggaaacagcaaacaguggggugaucugcagcccaga

SEQ ID NO: 325515 - RNA, 64 nt, Human
aaccugcucaccccacaugaccuucuguguauucagcaaacacucacuaggugacagcggccac

SEQ ID NO: 325516 - RNA, 64 nt, Human
cuguaauauuugguugcucagcauaagugauggaagcaaacacuaauuucuaauaaaauugugu

SEQ ID NO: 325517 - RNA, 64 nt, Human
uaaugucagcuggcaucauacaaagagcaggagaagcaaacacccagaacucuuuugcugguca

SEQ ID NO: 325518 - RNA, 64 nt, Human
aagggcuucaaagauauaggguguggcuccuaccagcaaacagcugaaagaggaggaccccugc

SEQ ID NO: 325519 - RNA, 64 nt, Human
augacaccaaauauguccgcagaauggacuugauagcaaacacugggggcaccuuaagauuuug

SEQ ID NO: 325520 - RNA, 64 nt, Human
uaaucccuugccuuuucucaaaccaguucaacucagcaaacacuuccugagcaccugcuacaug

SEQ ID NO: 325521 - RNA, 64 nt, Human; identical to SEQ ID NO: 246624

SEQ ID NO: 325522 - RNA, 64 nt, Human; identical to SEQ ID NO: 246625

SEQ ID NO: 325523 - RNA, 64 nt, Human; identical to SEQ ID NO: 246626

SEQ ID NO: 325524 - RNA, 64 nt, Human
auuggcaagcaggggcgcuaugugaguuuucugaagcaaacaucuggugccaagaucuacauuu

SEQ ID NO: 325525 - RNA, 64 nt, Human
ucuuucuuucacgugcaaaacauuuuucugaaauagcaaacaaccuacauguuugcugauaaaa

SEQ ID NO: 325526 - RNA, 64 nt, Human
aucguugagauugagcagcgcuuggugaucucucagcaaacaaccccugcccgugggccaaucu

SEQ ID NO: 325527 - RNA, 64 nt, Human
gcccagcucauuacuuucucccuuucucuaccacagcaaacacauucuccaccaugucagucua

SEQ ID NO: 325528 - RNA, 64 nt, Human
caagggacaggaagcugauagaaagugaacaggaagcaaacaggaagugagcaaggggccacuu

SEQ ID NO: 325529 - RNA, 64 nt, Human
cacaggccccaaccugugugcugggguccccagcagcaaacacuggaaagucuguuuuuuuuuu

SEQ ID NO: 325530 - RNA, 64 nt, Human
aaugaauguagaaaaggcugaauucuguaauaaaagcaaacagccuggcuuagcaaggagccaa

SEQ ID NO: 325531 - RNA, 64 nt, Human
aguuucacaugguacaaauaaguaaaaccaaaugagcaaacacggucuuuguuucugauuccuu

SEQ ID NO: 325532 - RNA, 64 nt, Human
ugaucugaagucagucggaauuuguaaacaggguagcaaacaagauauuuuucuuccauguaua

SEQ ID NO: 325533 - RNA, 64 nt, Human
cauccucuguaacgugguucaucccugguuaaaaagcaaacaaacacaggcugaaaacccaugc

SEQ ID NO: 325534 - RNA, 64 nt, Human
agaguaugagaauuaccauuuucaguuuucauucagcaaacaaauuuaccaagugccugcucug

SEQ ID NO: 325535 - RNA, 64 nt, Human
guauauaaaaauaugugggcucucgauuuauuugagcaaacauugcaaugaggguguucauuau

SEQ ID NO: 325536 - RNA, 64 nt, Human
aauaauucaauuuugugucuuuucucaauuuauuagcaaacacaagacauuuuauguauuauuu

SEQ ID NO: 325537 - RNA, 64 nt, Human
acccccaaaauaagacuuucauucacauucacaaagcaaacaucuaguacaugucuuucacuuc

SEQ ID NO: 325538 - RNA, 64 nt, Human; identical to SEQ ID NO: 246642

SEQ ID NO: 325539 - RNA, 64 nt, Human
cagaagacuacuauaugugagaggcgugauaucuggauggaaguugggcuggaugaucuccaaa

SEQ ID NO: 325540 - RNA, 64 nt, Human
uauguuuuacaguuuuccccauuuuaaaaagaaaagcaaacaaagaaacaaaaguuuuuccuaa

SEQ ID NO: 325541 - RNA, 64 nt, Human
gggugguucaguucaaaagguaauaucaaccgucagcaaacaugucaguuuaaaaauaaguucg

SEQ ID NO: 325542 - RNA, 64 nt, Human
cagccgugugauaauuaacaugguaagccuuagcagcaaacauucuuccuaaaaggaagacuuc

SEQ ID NO: 325543 - RNA, 64 nt, Human
auauauguaugaagggcauguauauguaugaaugagcaaacauauuugaaaguuaacuuuugga

SEQ ID NO: 325544 - RNA, 64 nt, Human
auaaaaucuagcuggacaacuaagaagcuaugguagcaaacagugauguugauggaaugagaau

SEQ ID NO: 325545 - RNA, 64 nt, Human
uuucugucugguagagaguuugcuucucaaauggagcaaacaaauuugauuauuuuuucauugu

SEQ ID NO: 325546 - RNA, 64 nt, Human
agacgggagcagguucuuggccagcguagacagcagcaaacagcagcagggaagccauucucac

SEQ ID NO: 325547 - RNA, 64 nt, Human
aauggaaaaaaaaaucaaaaaucuuaaaaaaacaagcaaacaguccagcuuccuguccuccuaa

SEQ ID NO: 325548 - RNA, 64 nt, Human
cuaacaucacaauuaaaagaacuagaauugcaagagcaaacacagucaaaaacuagcagaaggc

SEQ ID NO: 325549 - RNA, 64 nt, Human
acagggcggaggugggcaccacugaguugcacucagcaaacacauuggguaucuugugcccaag

SEQ ID NO: 325550 - RNA, 64 nt, Human
gcucuugguaucuauaacuuuugcagagaccagaagcaaacaauuugugggccagugucaacac

SEQ ID NO: 325551 - RNA, 64 nt, Human
cucucuucaacacuccccugcguaccccgguucuagcaaacaccaauugauugacugagaaucu

SEQ ID NO: 325552 - RNA, 64 nt, Human
ccucaaccuuucagacgacaaggacaagaugagcagcaaacaccagcuccucagcuucgugucc

SEQ ID NO: 325553 - RNA, 64 nt, Human
gguuuguuacauugauaggauacauacugaaaucagcaaacaaaacagauguauagauuagagu

SEQ ID NO: 325554 - RNA, 64 nt, Human; identical to SEQ ID NO: 246633

SEQ ID NO: 325555 - RNA, 64 nt, Human; identical to SEQ ID NO: 246634

SEQ ID NO: 325556 - RNA, 64 nt, Human; identical to SEQ ID NO: 246635

SEQ ID NO: 325557 - RNA, 62 nt, Human
uaguucugucucucgccugaugcuggaagaggagcaaacacuggccucugguguccacccuc

SEQ ID NO: 325558 - RNA, 64 nt, Human
ggguuacgcaaugauuucuuaguacacaaaacacagcaaacauaaaaaguuguuacacuucauc

SEQ ID NO: 325559 - RNA, 64 nt, Human
ggguccucaucuuuucccucaugauuagguucugagcaaacaugaucuagcucucaccaaaagg

SEQ ID NO: 325560 - RNA, 64 nt, Human
gugaccaacucaguauaccacuggaggcucugugagcaaacagcaaacuguucucaugaaagca

SEQ ID NO: 325561 - RNA, 64 nt, Human
ccucuccuccuugggcagggucucugcuccagcaagcaaacaggguggcccagguggcuauuuu

SEQ ID NO: 325562 - RNA, 64 nt, Human
uauaagucgugaggauguuuuuauauuuaaauguagcaaacauacaugacaguucuugcugugu

SEQ ID NO: 325563 - RNA, 64 nt, Human
aaauccuugauuuugaaauuaucaauuauggaauagcaaacaauuuguaagugaagaaaaucca

SEQ ID NO: 325564 - RNA, 64 nt, Human
gggcaguagagucagucuccaucucaaagaaaccagcaaacaaaaaauauuaaaaaaaaacauu

SEQ ID NO: 325565 - RNA, 64 nt, Human
cagguuucucuaauuuccuccacucccaguucgaagcaaacagcuuacugccuaguccccgcca

SEQ ID NO: 325566 - RNA, 64 nt, Human
agcccuguaguagggaguuuccaccuuguacguaagcaaacacugaaucaacuuuuuuuuuuuu

SEQ ID NO: 325567 - RNA, 64 nt, Human
cgcugaauccaccugcuucuccuuugcaaccgacagcaaacagcuuucuccggccucagggcag

SEQ ID NO: 325568 - RNA, 64 nt, Human
uuaagaggagacaugaucucuaccagggacucucagcaaacacgggacuguguucaguccacaa

SEQ ID NO: 325569 - RNA, 64 nt, Human
ccugccggugaagagcugcagaugccgagaagccagcaaacacagggcccacuggaaaaaaaua

SEQ ID NO: 325570 - RNA, 64 nt, Human
ucucacuuucaguaaaaauaaauaaaacagcagcagcaaacaaauaaaaugaaauaaaagaaac

SEQ ID NO: 325571 - RNA, 64 nt, Human; identical to SEQ ID NO: 246639

SEQ ID NO: 325572 - RNA, 64 nt, Human; identical to SEQ ID NO: 246640

SEQ ID NO: 325573 - RNA, 64 nt, Human; identical to SEQ ID NO: 246641

SEQ ID NO: 325574 - RNA, 64 nt, Human
cuacuaagacucuuuccuuagguucuuuccucugagcaaacacugacuggcauccugcuuucca

SEQ ID NO: 325575 - RNA, 64 nt, Human
cuaaagugcuguauccuuuaguaaaauuggagguagcaaacacuaaggugaaaagauaaugauc

SEQ ID NO: 325576 - RNA, 64 nt, Human
cccacauuuuuuugaaagacuggacuggaaucuuagcaaacaauuguaagucuccuccuuaaag

SEQ ID NO: 325577 - RNA, 64 nt, Human
ccacuggaugaaaaucuaggacuguauggaaguaagcaaacauuacauuuuuagguggaaauag

SEQ ID NO: 325578 - RNA, 64 nt, Human
aaccaggcaguagaugugcuucugaaccgcaaggagcaaacacugaaauaaaauaguuuauuuu

SEQ ID NO: 325579 - RNA, 64 nt, Human
aacaccagucuauuuuuacugagagcuggacaacagcaaacacuugacaaauaaacuuauuuac

SEQ ID NO: 325580 - RNA, 64 nt, Human
ucagagaugauacagucagugccuguucuuaugaagcaaacauucuauaauaguaggaccagua

SEQ ID NO: 325581 - RNA, 64 nt, Human
auaggugaaaggguuaaaaugaguaaagcaguugagcaaacaccaacccgagcuucgggcgcag

SEQ ID NO: 325582 - RNA, 64 nt, Human
agacuucauauuucucaucccuuuauugcuuuuuagcaaacauaagaaaccaugagucauuuug

SEQ ID NO: 325583 - RNA, 64 nt, Human
ccaucucacaucugccucagugagggaucagggcagcaaacaagggccaagaccaucugagcca

SEQ ID NO: 325584 - RNA, 64 nt, Human
ggagcagacgcaccugacuuuuuggaguuugcacagcaaacauuuuacacaguuuuauuucuaa

SEQ ID NO: 325585 - RNA, 64 nt, Human
ugaaguucuucagacaugucucuaaugcuauaaaagcaaacaacuuggauuggguuuuauaaau

SEQ ID NO: 325586 - RNA, 64 nt, Human
ccgccggccccagcacccaggggacgcgcuggaaagcaaacaggaagauucccggagggaaacu

SEQ ID NO: 325587 - RNA, 64 nt, Human
cauaagaacugugcaguagccguuugugguuuaaagcaaacaugcaagaugaaccugagggaug

SEQ ID NO: 325588 - RNA, 64 nt, Human
aggcucguagggagcaggaucaugccagaaauagggauggaagugcauccucugggaaaaagau

SEQ ID NO: 325589 - RNA, 64 nt, Human
uuucuuuuucuuuauagauaugaugccagcaaagggauggaaagucuagaggacaccuuuguau

SEQ ID NO: 325590 - RNA, 64 nt, Human
uauagggcaagugguucuuuuucucugaauuacaggauggaaaaaggucauauccuuugucagg

SEQ ID NO: 325591 - RNA, 64 nt, Human
gugacauuacaguuaaauuucccaauugaaaacaagcaaacagacacucaaacugguccuguaa

SEQ ID NO: 325592 - RNA, 64 nt, Human
cuguagguugguuccuguauaccuugggccagagagcaaacauagguggccugagagagcccug

SEQ ID NO: 325593 - RNA, 64 nt, Human
aggugugcauucggcugcaaauaacagaaaacccagcaaacacugaagggcuggauaagaaccc

SEQ ID NO: 325594 - RNA, 64 nt, Human
auaaucuggaauauucuacauggcuugauuacauagcaaacaagaccaagauuuagggcugucu

SEQ ID NO: 325595 - RNA, 64 nt, Human
guuuuuggcuaaguagaggacauggacuaguuguagcaaacagaacaugcuguuugcucuugcc

SEQ ID NO: 325596 - RNA, 64 nt, Human
cccuucaugccuuucaauucugagugggaggaaaagcaaacaucaaaacagugcuucagccaaa

SEQ ID NO: 325597 - RNA, 64 nt, Human
uacauaguaaguuucacacuaccuuauuaccaaaagcaaacaccucuuacuuuaaacuacauua

SEQ ID NO: 325598 - RNA, 64 nt, Human
gcccaaaugaacauuguaccauagucuucuggaaagcaaacaugcuuccugcuauguaauugcu

SEQ ID NO: 325599 - RNA, 64 nt, Human
gauggucccugugguauauacuuucuccuacucuagcaaacauguaguuuaaucuuaauguguu

SEQ ID NO: 325600 - RNA, 64 nt, Human
aucacuacacucuuagagaaucccucuguucuccagcaaacaugggauguaaagccucacaggg

SEQ ID NO: 325601 - RNA, 64 nt, Human
uuuuguacccuuuaaaucauuugccaaacauugcagcaaacaagugugcguauguaacaagcuu

SEQ ID NO: 325602 - RNA, 64 nt, Human
uuucuauucaccuuuaauauauuuuuacaaaaaaagcaaacaauuuaaaaacaagcccaccgcu

SEQ ID NO: 325603 - RNA, 64 nt, Human
cuucuccaaccauuuuacccauuuccugucccugagcaaacaacgcccgaaauacccucugcua

SEQ ID NO: 325604 - RNA, 64 nt, Human
aaaccaguuaccucauugcuuaccagcucaugauagcaaacagagacuagauucuauuagcuac

SEQ ID NO: 325605 - RNA, 64 nt, Human; identical to SEQ ID NO: 246636

SEQ ID NO: 325606 - RNA, 64 nt, Human; identical to SEQ ID NO: 246637

SEQ ID NO: 325607 - RNA, 64 nt, Human
gaucauaauaggaagcaaaaagaaaaaaaugaaaagcaaacauaugcacgcacuuuucuuguug

SEQ ID NO: 325608 - RNA, 64 nt, Human
aaacaguuacggcuuauuuacugaauaaauacaaagcaaacaaacucaaguuaugucauaccuu

SEQ ID NO: 325609 - RNA, 64 nt, Human
uuaaucugcuauaucaaacuccuucccugaaaccagcaaacaccgggaaacauuuuggcucauu

SEQ ID NO: 325610 - RNA, 64 nt, Human
gaagucuuauccaaacccaguaaaacagauucuaagcaaacaguccaaucagugagucauaaug

SEQ ID NO: 325611 - RNA, 64 nt, Human; identical to SEQ ID NO: 325610

SEQ ID NO: 325612 - RNA, 64 nt, Human
cagaugaguacaaaaaugcagacacuuaacaaaaagcaaacagaaaaaaaaguguggaaugugu

SEQ ID NO: 325613 - RNA, 64 nt, Human
aaaugcaauuaauauccgugcgugauauauauaaagcaaacauaagacugaaggauggagcaag

SEQ ID NO: 325614 - RNA, 64 nt, Human; identical to SEQ ID NO: 246608

SEQ ID NO: 325615 - RNA, 64 nt, Human; identical to SEQ ID NO: 246609

SEQ ID NO: 325616 - RNA, 64 nt, Human; identical to SEQ ID NO: 246613

SEQ ID NO: 325617 - RNA, 64 nt, Human; identical to SEQ ID NO: 246614

SEQ ID NO: 325618 - RNA, 64 nt, Human; identical to SEQ ID NO: 246615

SEQ ID NO: 325619 - RNA, 64 nt, Human; identical to SEQ ID NO: 246616

SEQ ID NO: 325620 - RNA, 64 nt, Human; identical to SEQ ID NO: 246617

SEQ ID NO: 325621 - RNA, 64 nt, Human; identical to SEQ ID NO: 246618

SEQ ID NO: 325622 - RNA, 64 nt, Human; identical to SEQ ID NO: 246619

SEQ ID NO: 325623 - RNA, 64 nt, Human; identical to SEQ ID NO: 246620

SEQ ID NO: 325624 - RNA, 64 nt, Human
caccuugaccgaggauggagcuaagaguucagaggccaucaaggagagcagcaaguuuccauuu

SEQ ID NO: 325625 - RNA, 64 nt, Human
cugucccaccgguggaugcagaggggaauccgaggccaucaaccuuggugacagcagcgcagug

SEQ ID NO: 325626 - RNA, 64 nt, Human
uugugagacccaaauguguaggcucuaaauuccagccaucaaauccaauuccugguggggaaaa

SEQ ID NO: 325627 - RNA, 64 nt, Human
accccugcacuacuaugagaccguucgcauggcagccaucaaagagguucggggcuggguaugg

SEQ ID NO: 325628 - RNA, 64 nt, Human
gagcccagccucaggaggggccaagaaccagggggccaucaaaagcaucgggauuuggcauugg

SEQ ID NO: 325629 - RNA, 64 nt, Human
caaaguaaaacuugcugccugaagaacaguaacugccaucaagaugagagaacuggaggaguuc

SEQ ID NO: 325630 - RNA, 64 nt, Human
agcacuggcuggggcauucucauucucugauggagccaucaaugagauuuaacuuagucaaccu

SEQ ID NO: 325631 - RNA, 64 nt, Human
cuucucauucucuucuuuagcccccagcccaauugccaucaagacuccugaagccagcugugcu

SEQ ID NO: 325632 - RNA, 64 nt, Human
caccggcuaagaaaacuugcuacuaaacuauuaggccaucaauggcuugaauaaaaaccagaga

SEQ ID NO: 325633 - RNA, 64 nt, Human
ccagaaacuugucuucuaaaagggaggacuccaggccaucaauaaagauguccaggcagugagc

SEQ ID NO: 325634 - RNA, 64 nt, Human
gaucauggcugccaucaagccuuuucuggauccagccaucaaggacauguuuguggugugaugc

SEQ ID NO: 325635 - RNA, 64 nt, Human
gcuguggggcugccugccaggcaggaucauggcugccaucaagccuuuucuggauccagccauc

SEQ ID NO: 325636 - RNA, 64 nt, Human
gcagccugugaccgggucuggggcgaggccaggggccaucaaaaacaggcugaucaccaaaguc

SEQ ID NO: 325637 - RNA, 64 nt, Human
gcuagucuaggugugagagcccacauugucuguagccaucaaaaauaauaauaauaaacuggac

SEQ ID NO: 325638 - RNA, 64 nt, Human
caaguggagggucggggcagaggccuccaccaaggccaucaauaaccaggugugagcuacaggu

SEQ ID NO: 325639 - RNA, 51 nt, Human
ucacagacacccaccuguaaaggauggaaacccagaagacguaacccugga

SEQ ID NO: 325640 - RNA, 59 nt, Human
gcguggagacgguugugugacaauggucuggauggaaaggauugcugcucuccauuagg

SEQ ID NO: 325641 - RNA, 64 nt, Human
ucuuuguuuuuucccccuucuccugaaucagcagggauggaaggaggguagggaaguuaugaau

SEQ ID NO: 325642 - RNA, 64 nt, Human
uuaagaugcaaaucaacucucuccuggucgcuuugccaucaagaaacauucagaccagggaacg

SEQ ID NO: 325643 - RNA, 64 nt, Human
cccccaugcuuacuaauacauucccuuccccauagccaucaaaacuggaccaacuggccucuuc

SEQ ID NO: 325644 - RNA, 64 nt, Human
augugugauuucuguucccaacuagguucuaagugccaucaaagcacgguugggucucccuugu

SEQ ID NO: 325645 - RNA, 64 nt, Human
agacuggauguguucagaacuaggaccaaacgaugccaucaaauacuuccuccugccagucaug

SEQ ID NO: 325646 - RNA, 64 nt, Human
auauuaaaagugcagacuuuuacuguccuuaagugccaucaacucucagcucccuuguagcuuu

SEQ ID NO: 325647 - RNA, 64 nt, Human
cuaguuugguucaacauuugaggguuguuuuauagccaucaaaguauucaagagguuggauggc

SEQ ID NO: 325648 - RNA, 64 nt, Human
aagcaaaaaauaaaauaaguccuaaagugaagaagccaucaauuuuaacauuugaugucuagau

SEQ ID NO: 325649 - RNA, 64 nt, Human
uguucaugcauaugcaggagucacacggucauaggccaucaaagcuggaggagaccucagaauc

SEQ ID NO: 325650 - RNA, 64 nt, Human
ccaagggaauuauagcugcagguucucucucacugccaucaaacuguaaaagauuaaacugcga

SEQ ID NO: 325651 - RNA, 64 nt, Human
aaaaaucuuauuuauaaaugugaagcuuuuugaugccaucaaaacuuauuaaaaaauaggauuu

SEQ ID NO: 325652 - RNA, 64 nt, Human
uguggugcccaaggaugucaacgcugccauugcugccaucaagaccaagugcagcauucaguuu

SEQ ID NO: 325653 - RNA, 64 nt, Human
aaccaguccuuuguauucaguuaccuaauggggugccaucaauaagcugcgauacagcccugga

SEQ ID NO: 325654 - RNA, 64 nt, Human
caacauuagguucaggcuugaagucccugauuucgccaucaaagucagauccaggggggacgau

SEQ ID NO: 325655 - RNA, 64 nt, Human
cuuguacaggaugcaaacuaaaaaccuaaucccugccaucaaauuuauuagaagagaccuauau

SEQ ID NO: 325656 - RNA, 64 nt, Human
ugaaugucaaugucagaaggaaaagagaauuuuggccaucaaaauccagcuccaagugaacuua

SEQ ID NO: 325657 - RNA, 64 nt, Human
auuuuauuguagaguuuugcugguuuuguaaaauggauggaagaacuuuguauuuauacuguga

SEQ ID NO: 325658 - RNA, 64 nt, Human
gcacagacccuguccuuugccucuauuaagcagaggauggaaguauuaaggauuuuguaacacc

SEQ ID NO: 325659 - RNA, 64 nt, Human
ccugcaugucggggccccugcguguguucucuccggauggaaucacagccaauaaacaccagug

SEQ ID NO: 325660 - RNA, 64 nt, Human
ccuagcuggggucaaggggccuggaccaguagaagccaucaaccuacugaaguuguguggaggg

SEQ ID NO: 325661 - RNA, 64 nt, Human
augaggcagaugccucuagaagagacguuuaaaagccaucaaacacaaugccucaucuucccug

SEQ ID NO: 325662 - RNA, 64 nt, Human
uauuguucuguauauuucaaaaugguauuuugaugccaucaaaugcccaggaaauugacuuugc

SEQ ID NO: 325663 - RNA, 64 nt, Human
uuuuguccaguuuauuggcucuucuacauucauugccaucaagucgucagcuuguucuggaaac

SEQ ID NO: 325664 - RNA, 64 nt, Human
agguugccauugguugaaaacauaagugucucuggccaucaaagugaucuuguuuacagcagug

SEQ ID NO: 325665 - RNA, 64 nt, Human
acacaagaaaaagauaagaaauacuagaguaaaggccaucaaacuacgcgauagucucuguucu

SEQ ID NO: 325666 - RNA, 64 nt, Human
augcaucuccaauccuuaggccauaucaacuuuggccaucaauaucucuccuuaaacaauuaua

SEQ ID NO: 325667 - RNA, 64 nt, Human
uuaccaauucuccaaugcugccauuuuaauucaggccaucaaccuaccuaaauuauagcaacag

SEQ ID NO: 325668 - RNA, 64 nt, Human
cugggaaaauacaagaaccaaggaaucaugucaggccaucaaggaguauauggacacuacacug

SEQ ID NO: 325669 - RNA, 64 nt, Human
uuuuuuuuaauaaggacaccucuuuccaaacagugccaucaaauauguucuuaucucagacuua

SEQ ID NO: 325670 - RNA, 64 nt, Human
guuuugacaacucugaaauguguuaacucuuagugccaucaagaaccccauuugggaguauuuu

SEQ ID NO: 325671 - RNA, 64 nt, Human
auguaugcuuuucagaauacaguugucuagccaagccaucaagugucugaaauucaauauuggu

SEQ ID NO: 325672 - RNA, 64 nt, Human
uacuuaauauugucaaauaacuugugauugucuugccaucaauaaaauaaugcauaguuguguu

SEQ ID NO: 325673 - RNA, 63 nt, Human
caccacaacguucaagauagagagacacagcaagccaucaacuaugguuaauuuugaaaaaug

SEQ ID NO: 325674 - RNA, 64 nt, Human
aauguauuuugucuuuuugcauuuugguguauaagccaucaauauucagcaaaaugauuccuuu

SEQ ID NO: 325675 - RNA, 64 nt, Human
gcucuggagguguuguggggauggugauggagagggauggaaauaacggguggcauuggguggc

SEQ ID NO: 325676 - RNA, 64 nt, Human
uuuacccuuuuuacugaaaguaagugacuuaaaaggauggaagaaaaacuacaugguuggagug

SEQ ID NO: 325677 - RNA, 64 nt, Human
aaugaucaaggaucuggaccccaaagaauagacuggauggaaagacaaacugcacaggcagaug

SEQ ID NO: 325678 - RNA, 64 nt, Human
auuguuuuucuaagacugaucugagagccauugggccaucaagccuuuauauaucugcuucuaa

SEQ ID NO: 325679 - RNA, 64 nt, Human
uuuaaaaagucuuugaauugccaguucuguaagugccaucaauuaaaauaguuuugugcaguga

SEQ ID NO: 325680 - RNA, 64 nt, Human
gaaaguccuuagauaaagagagaauauuguaugggccaucaaccauuuacuuuucccugaaugu

SEQ ID NO: 325681 - RNA, 55 nt, Human
cagaguugccgcaagucugaauggcgccaucaaacuuaugggcagggauaacagu

SEQ ID NO: 325682 - RNA, 64 nt, Human
gaucagaucuggccuauuuucauauuuauccuaagccaucaaaugggguagugccucuuaaacc

SEQ ID NO: 325683 - RNA, 64 nt, Human
uacaauggaaagaauggaggaagcacuucaaguagccaucaacaacaacagaggauuugucuca

SEQ ID NO: 325684 - RNA, 64 nt, Human
ugcuuguaguugcuuuuaucacugccgcaaaacagccaucaagagccaucugcuuuccagguga

SEQ ID NO: 325685 - RNA, 64 nt, Human
uuucaccaggaacccaaauuuagaauauugaaaagccaucaaaaaguugugauaucaaaaaugu

SEQ ID NO: 325686 - RNA, 64 nt, Human
gccagcacccaaggaagaugaccggagaacaucugccaucaaggcccuuaaugcuacaggacaa

SEQ ID NO: 325687 - RNA, 64 nt, Human
uugaaauugagcuggaccucaccaagcugcuguggccaucaaccucuguauuugaaucagccua

SEQ ID NO: 325688 - RNA, 64 nt, Human
uaugucauacuccacaauuuacauguauauuacagccaucaaacacauaaacaucaagauauuu

SEQ ID NO: 325689 - RNA, 64 nt, Human
caggcaccuuuaggccaugggucacucaccgugagccaucaaugugcucuggucugacaugguu

SEQ ID NO: 325690 - RNA, 64 nt, Human
ugcccaugcuauuuguucuucaagaacuuucucugccaucaacuacuauucaaaaccucaaauc

SEQ ID NO: 325691 - RNA, 64 nt, Human
cgaaucugccuuugagaugcuggcagaucucaaggccaucaauuauugggggagggagggacaa

SEQ ID NO: 325692 - RNA, 64 nt, Human
agaguagagggaguagagaauggauguuggguaggccaucaauaagguccauucugcgcaguau

SEQ ID NO: 325693 - RNA, 64 nt, Human
cauucuugcugcaauugaacauccucaagaguugggauggaaauggugauuuuuacaugugucc

SEQ ID NO: 325694 - RNA, 64 nt, Human
aagcuuaaggagaggagagcaucugcucugagacggauggaaggagagagguugaggaugcacu

SEQ ID NO: 325695 - RNA, 64 nt, Human
uucauuuugucuauuugcuguugauuguaccaagggauggaagaaguaaauauagcucagguag

SEQ ID NO: 325696 - RNA, 64 nt, Human
ugcuuaagacaauugcaucagauuuggaaguuuugccaucaaaauucuuugcagaauuggaagu

SEQ ID NO: 325697 - RNA, 64 nt, Human
aacaucaccuaaauaggccuuuucuuccuaauuggccaucaaauuaaagccuauccuuucucaa

SEQ ID NO: 325698 - RNA, 64 nt, Human
aagcaaacauggguuuuccuuggaaggacugugggccaucaacccauuaauugccgaguugcuu

SEQ ID NO: 325699 - RNA, 64 nt, Human
cuggacgcaaauuaaaggccgagaaagaggccuugccaucaauggaauacugccauuuauauug

SEQ ID NO: 325700 - RNA, 64 nt, Human
acugucaagauauauugcagauuacuuaaauauggccaucaaaacaaaaguuacaacacguauc

SEQ ID NO: 325701 - RNA, 64 nt, Human
ugaacauguaaauauaaaucugucagccacuacagccaucaaaagagagcaucuggaagaacag

SEQ ID NO: 325702 - RNA, 64 nt, Human
uuaacugaauggaauuaaacauagcaauugucaagccaucaaaauuauauaucgaaccacuuag

SEQ ID NO: 325703 - RNA, 64 nt, Human
caguauaauuaacauguuaaaccaugggauaaaugccaucaauaaaaaauuaugacauacuuuu

SEQ ID NO: 325704 - RNA, 64 nt, Human
uuccuccagaaagaggagcgugucucugaacugcgccaucaacuccagucucggcagcagcucc

SEQ ID NO: 325705 - RNA, 64 nt, Human
ggagagguagugugagcagagcagcugaaaucuugccaucaagcaacccucauucucaugccug

SEQ ID NO: 325706 - RNA, 64 nt, Human
acacaauuggaagucuaagaacccauggaaaaaugccaucaaaugaauaaugccuuuguaacca

SEQ ID NO: 325707 - RNA, 64 nt, Human
aaacccacauuuucucuuuuaauauuuuaugauugccaucaaagaagaagaaaaagaaggaaca

SEQ ID NO: 325708 - RNA, 64 nt, Human
uaccacugcaagacaaaacugauaucuuaacccggccaucaacccaaauuggacauuccagacu

SEQ ID NO: 325709 - RNA, 64 nt, Human
uagccccagugacagcuaggaugugcauucuccagccaucaagagacugagucaaguuguuccu

SEQ ID NO: 325710 - RNA, 64 nt, Human
guaacaagagagacuuuacagccccaugcuacaggccaucaagaugaccuggagcagagagcau

SEQ ID NO: 325711 - RNA, 64 nt, Human
ugucuaauuuagaacugccucacuaaauucuuagggauggaaguauuuggaaaaaaaccuaaca

SEQ ID NO: 325712 - RNA, 64 nt, Human
ucuuuaauuuagaacugccucaguaaauucuuagggauggaaguauuuggacaaaaaccuaaua

SEQ ID NO: 325713 - RNA, 64 nt, Human
ucccuacuuagcaugauccuugagucuccucucuggauggaauccgcgagcuggccaccuggcc

SEQ ID NO: 325714 - RNA, 64 nt, Human
gugggguggugucugugugugugcacgcacgccugccaucaaagcagcagggcugagggggugc

SEQ ID NO: 325715 - RNA, 64 nt, Human
caauugucauauuauuuuuagaugauguaacauagccaucaaaauuaauauuauguaaugccua

SEQ ID NO: 325716 - RNA, 64 nt, Human
gaagauucagacaccuucuccccaggagauguaugccaucaaauugccagucaccucuuugucu

SEQ ID NO: 325717 - RNA, 64 nt, Human
acacuguagcuacauuuucagaaguuaacaucaagccaucaaaccuggguauagugcagaaaac

SEQ ID NO: 325718 - RNA, 64 nt, Human
ucucaucucuugcagcagcagcugcugaacuccagccaucaacacggugggaggcagcgggggc

SEQ ID NO: 325719 - RNA, 61 nt, Human
uccugaaaaguuguguguaaaggaagaauuugccaucaagccauuucccccuuuuguuucu

SEQ ID NO: 325720 - RNA, 64 nt, Human
ugggcugcaucugggauucccaccaaggucuucagccaucaacaagaguugucuuguccccucu

SEQ ID NO: 325721 - RNA, 64 nt, Human
uccacuuaggaagaaaugcccaaaagagguccuggccaucaaacauaauucucucacaaagucc

SEQ ID NO: 325722 - RNA, 64 nt, Human
cuaaggaaaaaaccugccaauuaaaucaugauaugccaucaauuaugagacaucccaauuugag

SEQ ID NO: 325723 - RNA, 64 nt, Human
cucccacuuugcaaccuauguggcagccaugagggccaucaacaucgcagaugagcugccccgc

SEQ ID NO: 325724 - RNA, 64 nt, Human
uuccuucuuuaucuauagcaacucauuggugguagccaucaagcacuucccaggaucugcucca

SEQ ID NO: 325725 - RNA, 64 nt, Human
cuucauuuucaccaccacaaagcuggucuaagcugccaucaauucccaccuggacaacugcaaa

SEQ ID NO: 325726 - RNA, 64 nt, Human
aauuaucuuuaaaaaaaaaaucacaucaguauaggccaucaauaucacaauagauuucucaagg

SEQ ID NO: 325727 - RNA, 64 nt, Human
ugaugagauguauagcugggggacaaaacauaaagccaucaagcacgugcuugagaaaaaaauu

SEQ ID NO: 325728 - RNA, 64 nt, Human
accuagaaggaaacugucguguguccuauacauugccaucaacuuuguuuccucaucucaaaua

SEQ ID NO: 325729 - RNA, 64 nt, Human
auaacugucaauuuauuuggauggauggauggagggauggaaggagggagggaaggaugucugg

SEQ ID NO: 325730 - RNA, 64 nt, Human
aacaagagaagauugacaaacuuaugauagagauggauggaacagaaaauaaaucuaaauuugg

SEQ ID NO: 325731 - RNA, 64 nt, Human
ggcgacgacaaggguccaggagaacugagacgcaggauggaagacagagaagaccccccggagc

SEQ ID NO: 325732 - RNA, 64 nt, Human
auauggaacuuggcuaccucugccugaaauggcugccaucaacacaauguuaaaacugacacga

SEQ ID NO: 325733 - RNA, 64 nt, Human
uccuaagagaaacucccaggugauaaaaguugaugccaucaaaccuugacaccgggugcucugc

SEQ ID NO: 325734 - RNA, 64 nt, Human
gcuacuuccuugggcucaguucccugggucaucagccaucaaaucuuguugaguuuaaaaaaua

SEQ ID NO: 325735 - RNA, 64 nt, Human
agaaaugcuggagcaggcuguucagaccgacguugccaucaaaacacauacacccagaaagaaa

SEQ ID NO: 325736 - RNA, 64 nt, Human
uuuuuuaaaggaaaucccaaucuuauuauggaaagccaucaacuggguguggggaguaggucag

SEQ ID NO: 325737 - RNA, 64 nt, Human
cacuggcucuggucuuaagugccugggcuugguggccaucaagagggagccagucaggccugug

SEQ ID NO: 325738 - RNA, 64 nt, Human
gcaagcagcagcaggggcugacagcaggcuuacugccaucaacauugcuugaaaugccucuaug

SEQ ID NO: 325739 - RNA, 64 nt, Human
aggacugacauuugagccuagaccugaagggugagccaucaagcuaagacaauuggggaagagc

SEQ ID NO: 325740 - RNA, 64 nt, Human
acuacccuguuaagagcagccugggaacguacaggccaucaagacuauuuauuuaaauacaaaa

SEQ ID NO: 325741 - RNA, 64 nt, Human
auguuuugagcuaugcuucaaacacaacuggaaagccaucaaucuucaaaggccucaaaaauac

SEQ ID NO: 325742 - RNA, 64 nt, Human
aaauuuguuaagaaggaaguacccacagaucacugccaucaacuccccagaaguugcacucaag

SEQ ID NO: 325743 - RNA, 64 nt, Human
agagcugaaggccaccuacagggagcacguagaggccaucaaaauuggccucaccaaggcccug

SEQ ID NO: 325744 - RNA, 64 nt, Human
ucugcuggcaugagccacaguuucuugacuggaggccaucaacccucuugguugaggccuuguu

SEQ ID NO: 325745 - RNA, 55 nt, Human
uaagauuacagaacagcugauugaagccaucaacaauggggacuuugaggccuac

SEQ ID NO: 325746 - RNA, 64 nt, Human
uauagcuccaaguuccacaggucugcuaccacaggccaucaaaauauaaguuuccaggcuuugc

SEQ ID NO: 325747 - RNA, 64 nt, Human
gcuugacucaugauagacaaaguauaugccugcuggauggaagaaucucuugggcgagcaccau

SEQ ID NO: 325748 - RNA, 64 nt, Human
uccagaagaagcaucuuccucagaagaucuggggggauggaaagcaaaauaaaggaggugccug

SEQ ID NO: 325749 - RNA, 64 nt, Human
ucccaggaauacucauucgucuacucugauguugggauggaauggccucugaaagacuucacua

SEQ ID NO: 325750 - RNA, 64 nt, Human
auagagguggggcuugugguacuuaacacuuguagccaucaacugacugagaccuugggcuaaa

SEQ ID NO: 325751 - RNA, 64 nt, Human
ggcacagagucuggcuccugcuaggugagaccuggccaucaaaugacacaaacaacuaaacgau

SEQ ID NO: 325752 - RNA, 64 nt, Human
gcuaagaggaagacuggccaggcccaaggacccagccaucaaaaccagccucaaaucugguugu

SEQ ID NO: 325753 - RNA, 64 nt, Human
augcaaaguuuuauucuugaacuuggacacugaugccaucaaacaauuaacaaauauauuuaag

SEQ ID NO: 325754 - RNA, 64 nt, Human
gaggaagauggcagugaauaucaaacaguagaccgccaucaacuucuaacagccaguacacaca

SEQ ID NO: 325755 - RNA, 64 nt, Human
ggaauaguugagugugcuguuugggggcucaggagccaucaaggcuguggggaggaaccauaaa

SEQ ID NO: 325756 - RNA, 64 nt, Human
ggcagaaaaguaucuuaauuaaugaaagagcuaagccaucaagcugggacuuaauuggauuuaa

SEQ ID NO: 325757 - RNA, 64 nt, Human
augaauucuggcguggcuuaugaaauuaaaaguugccaucaaagccauuuucuuuuaauuucac

SEQ ID NO: 325758 - RNA, 64 nt, Human
ggagggugcuuggcacuuauugaauauaugaucggccaucaagggaagaacuauugugcucaga

SEQ ID NO: 325759 - RNA, 64 nt, Human
acuucuaacauguagccaauaaaucuauuugauagccaucaaaggaauaaaaagcuggccguac

SEQ ID NO: 325760 - RNA, 64 nt, Human
gcaucccuagucuccuaaacuccagcucugauucgccaucaacccauggagcaauuccaaggcc

SEQ ID NO: 325761 - RNA, 64 nt, Human
uuuugugguuucucugagucacagauaaacuucugccaucaaauggcuacaguucauuuaaauu

SEQ ID NO: 325762 - RNA, 64 nt, Human
uccuucaucagguguuuuaagaugucucugagaagccaucaaggcaaaagagaacuuuaaguuc

SEQ ID NO: 325763 - RNA, 64 nt, Human
cgggagaugccagccaucacucacugccaccugggccaucaacugugaauucucagcaccaguu

SEQ ID NO: 325764 - RNA, 64 nt, Human
gguauuuaaacuuuauucaacagccauuuagagugccaucaagauggcuugaaauggaauuuug

SEQ ID NO: 325765 - RNA, 64 nt, Human
gggaaacauggcuuguuuaaggacuuggaguuauggauggaauuuaugggacccacgugagcag

SEQ ID NO: 325766 - RNA, 64 nt, Human
caggugaauggaggaguuaggggagaggaaaaguggauggaagugucuggaaagggcacgagag

SEQ ID NO: 325767 - RNA, 64 nt, Human
ggaaagggucucuggccuugcaaggauuugggcaggauggaagucuuugucuaggucugaaauc

SEQ ID NO: 325768 - RNA, 64 nt, Human
agcaaauauuuucuaaauauucauugacuaaacagccaucaagaugaaacaggacaggagagaa

SEQ ID NO: 325769 - RNA, 64 nt, Human
uucuauuccuaugagaaaugagaauuauuuauuugccaucaacacauuuuauacuuugcaucuc

SEQ ID NO: 325770 - RNA, 64 nt, Human
cgugaagaauccugauggugggagcuacgccuaugccaucaaccccaacagcuucauccugggu

SEQ ID NO: 325771 - RNA, 64 nt, Human
ccuugggucaguccagcccccuccacaucacugagccaucaaugagcugagagaucaaugacuu

SEQ ID NO: 325772 - RNA, 64 nt, Human
gugcugggauuacaggcaugagccaccacgcccagccaucaaugcauuuuuuuuauuuuuuuuu

SEQ ID NO: 325773 - RNA, 55 nt, Human
ccaaucccaagcaagccuagagcuugccaucaagcaguggggcucucaguaagga

SEQ ID NO: 325774 - RNA, 64 nt, Human
guucagcaucuaucgccagccagguuguuucucagccaucaaaugauaaugacuaaaauuucug

SEQ ID NO: 325775 - RNA, 64 nt, Human
cccuauaaaaggccuaaaauugaucuggggcucagccaucaaggggcugguguugcuccugucc

SEQ ID NO: 325776 - RNA, 64 nt, Human
ggccaagauugagaagaucaagggcagcaagaaggccaucaagguguucuccagugccaaguac

SEQ ID NO: 325777 - RNA, 64 nt, Human
gcugaugaggcccuaaguaaauaugugagcauuggccaucaaccccaucaaaccagccacagcc

SEQ ID NO: 325778 - RNA, 64 nt, Human
cucacacaacgugcucuucagcggcucccugaaggccaucaaggucugggacaucgugggcacu

SEQ ID NO: 325779 - RNA, 64 nt, Human
agucgcuauuuaggaaaaaaaacccacuaguuaggccaucaacaagcauucuuuuuauauuucu

SEQ ID NO: 325780 - RNA, 64 nt, Human
acugaacuagaagccgagccuagaaacuaacacagccaucaagggaaugacuugggcggccuug

SEQ ID NO: 325781 - RNA, 64 nt, Human
agacgcuaaucugugacaucuuuucuucaagccugccaucaaggacauuucuuaagacccaacu

SEQ ID NO: 325782 - RNA, 64 nt, Human
aagaccccagagaugcuuagagacaggacaccuggccaucaaacccaguuuggcccagccuggu

SEQ ID NO: 325783 - RNA, 64 nt, Human
gguuggggacaauccugcccaaaggcagggcaguggauggaauaacuccuuguggcauucugaa

SEQ ID NO: 325784 - RNA, 64 nt, Human
cugguucugugaauaaaggaauguauagauguuuggauggaaacaaaagcacuagacugaguuu

SEQ ID NO: 325785 - RNA, 64 nt, Human
acuccuacccugaccuucguaccuaugauuauacggauggaaaagcucagaacucaggugaaac

SEQ ID NO: 325786 - RNA, 64 nt, Human
auccccauccucaugggucuguggcugggugcaggccaucaaaauggacaccacgagacagaag

SEQ ID NO: 325787 - RNA, 64 nt, Human
ugugcaggaagggcugacggagcucaacagcacagccaucaagccacaggugcagccuuggauc

SEQ ID NO: 325788 - RNA, 64 nt, Human
uauuauuauuauguuauuauuacacugucuuuuugccaucaaaaugaggccugugaaauacaag

SEQ ID NO: 325789 - RNA, 64 nt, Human
aagaaccagaggcccaggcugcacacccauuucagccaucaagaacccacacagacggcaggga

SEQ ID NO: 325790 - RNA, 64 nt, Human
caaggcagagcugaggggacagggaggagcagaagccaucaagauggucaaagggccugcagag

SEQ ID NO: 325791 - RNA, 64 nt, Human
aaauuaacuuuauuucuaaagcauauuuugauuugccaucaagagcaauaaagcauuaaaucuu

SEQ ID NO: 325792 - RNA, 64 nt, Human
aguaugguuucuucucuuucuuuaaauguuuuuggccaucaaguagcagucgucaguaggaguu

SEQ ID NO: 325793 - RNA, 64 nt, Human
uuuuuuaaguuugacuacauagucaaguccacaagccaucaagcacuccuaccuuaauuauugc

SEQ ID NO: 325794 - RNA, 64 nt, Human
cuuuuuuauaucuuuugguuauucuaagcccuuugccaucaaugaucauaucaauuggcaguga

SEQ ID NO: 325795 - RNA, 64 nt, Human
uuuaaauguugucucacuugcauuuccagucuuggccaucaaaucaaugauuuaaugacuccaa

SEQ ID NO: 325796 - RNA, 64 nt, Human
caagagauugaaauacaguuuacaaacuuucauugccaucaaaaucuuuugcugccauaacuau

SEQ ID NO: 325797 - RNA, 64 nt, Human
auuuugaaggaagcacccaucuucacuuggugcugccaucaacuuuguaagauugcauucuauu

SEQ ID NO: 325798 - RNA, 64 nt, Human
uuguacacauccugguuuucuaagaagggaacuugccaucaagauuccuguaccaggcccacgg

SEQ ID NO: 325799 - RNA, 64 nt, Human
uucucuaaaagcuuuaaaugucugcaugcagccagccaucaaauagugaauggucucucuuugg

SEQ ID NO: 325800 - RNA, 64 nt, Human
cugccuggcugccucccuuaacccugacuucuaagccaucaauuucauguuauuuauuauugcc

SEQ ID NO: 325801 - RNA, 64 nt, Human
uuuugggagugcuauggcaaguagaaguucugccggauggaaagaggcugccccauuugagguc

SEQ ID NO: 325802 - RNA, 64 nt, Human
aguuauaacguuugauggcugggggguaggaagaggauggaauugagauguuugagccucauuu

SEQ ID NO: 325803 - RNA, 64 nt, Human
ugugaauuauguagaaggagacaaaugcugauugggauggaagaccaaccaagagaucaagcua

SEQ ID NO: 325804 - RNA, 64 nt, Human
gagacaguuguuucaaaugccauuaguauagcaagccaucaagcauuaauugacauuacaguua

SEQ ID NO: 325805 - RNA, 64 nt, Human
uugccagaggcccucggucagcgacuggaugcucgccaucaagguccaguggaaguucuucaag

SEQ ID NO: 325806 - RNA, 64 nt, Human
aaguauugcagagauuccuaaguauuuuauagcagccaucaaaauuggacuuuguauuguuuau

SEQ ID NO: 325807 - RNA, 64 nt, Human
uucuacuucuccaucuagagauuuuugugugugugccaucaagguuagcaaacuuuauacguag

SEQ ID NO: 325808 - RNA, 64 nt, Human
cccuaacaacuucccauccgcugaccccuccaacgccaucaaucuccagcugugguuguugaac

SEQ ID NO: 325809 - RNA, 64 nt, Human
cuggaaaggcccggagaugcaucuguggccuggggccaucaagaucaaagaaccaggaggccug

SEQ ID NO: 325810 - RNA, 64 nt, Human
ccaaaugauggaucaccauuauauuuugaaagaagccaucaagucuuaaguuuuucauuucaac

SEQ ID NO: 325811 - RNA, 64 nt, Human
gagguauucacaacagcaagcagggauuuggccugccaucaauuuuauuuaaaaagcaauuaag

SEQ ID NO: 325812 - RNA, 64 nt, Human
uugcuguucaucuuuugggagggaauaagcuagagccaucaauacaauuccgcuuguggggaaa

SEQ ID NO: 325813 - RNA, 64 nt, Human
aguaucugauaaaauuuacaauagccacgcaauagccaucaaggagaauuucuauuaugauuau

SEQ ID NO: 325814 - RNA, 64 nt, Human
guuuaaauugcucacaguuauuacauacacaucagccaucaacuaaaguuguacuuuaaaaauu

SEQ ID NO: 325815 - RNA, 64 nt, Human
auggaugcuuaucuuaaucaugcuaguauaugcugccaucaauucuccugcuugucagcaguga

SEQ ID NO: 325816 - RNA, 64 nt, Human
gugcugggauuacaggcuugagcccccgcgcccagccaucaaaaugcuuuuuauuucugcauau

SEQ ID NO: 325817 - RNA, 64 nt, Human
cccugagcuuucuucauggaaccucuugaaugauggauggaagagcuauaagaggugguaggca

SEQ ID NO: 325818 - RNA, 64 nt, Human
uguaaaauucuuuuuuuucuuauuacuaugaaauggauggaauaaggagggggaacacaacuag

SEQ ID NO: 325819 - RNA, 64 nt, Human
cucugccuaccugaggagcuuucuuuggaaaccaggauggaaacuucuucccugccuuaccuuc

SEQ ID NO: 325820 - RNA, 64 nt, Human
cacucaguccugcugccugcuucaccagaagcagcccugugagugugggguggggaagucccuu

SEQ ID NO: 325821 - RNA, 64 nt, Human
uuaaaucucagcugggauccuggaccugggaggccccugugagggccagcucuggaaaaaccug

SEQ ID NO: 325822 - RNA, 64 nt, Human
gcacgaggggggccagggguucugagaagcgcugcccugugagagccacgcuggccuucgucuc

SEQ ID NO: 325823 - RNA, 64 nt, Human
uguuuagccacauggugagaccguggugaaagggggauggaaauugcuuggccagucuuugccu

SEQ ID NO: 325824 - RNA, 64 nt, Human
uguagcuggcagaaaguucuguccaguaaacgcaggauggaauuuuccugggacucuacaccca

SEQ ID NO: 325825 - RNA, 64 nt, Human
guacuuuucauuggaagauucccaacaagaauuuggauggaaaaccugaucccuagcaagaagu

SEQ ID NO: 325826 - RNA, 64 nt, Human
cugggugugaccauguuuccucucaauaaaguuccccugugacacuccuccugucucucuucca

SEQ ID NO: 325827 - RNA, 64 nt, Human
cagcaacccugucaguguuccacccugucccaggcccugugauauuuauuguggcuaaaggcaa

SEQ ID NO: 325828 - RNA, 64 nt, Human
ucagaccucugagcccaagcaaagccaucauauccccugugaccugcauguauacauccagaug

SEQ ID NO: 325829 - RNA, 64 nt, Human
aucacaaaggauggucuuggccauaugcuagggccccugugaaaauaaguaguuuugagaaguu

SEQ ID NO: 325830 - RNA, 64 nt, Human
ccuguuccucuuucuccccgacuccaccccagcucccugugaagagagaguuaauauauuuguu

SEQ ID NO: 325831 - RNA, 64 nt, Human
agaagccacuucuuaguguaaucagcuccuguuucccugugagccuuaguuauauuuuaauuca

SEQ ID NO: 325832 - RNA, 64 nt, Human
uagagcugauuugauggacaauggagagagcuuucccugugauuauaaaaaaggaagcuagcug

SEQ ID NO: 325833 - RNA, 64 nt, Human
ccccuccccaugcucuccucccucagccuugcuacccugugacuuacugggaggagaaagaguc

SEQ ID NO: 325834 - RNA, 64 nt, Human
uuuucugcccuggcugcugcccccaccccggggacccugugacauggugccugagaggcaggca

SEQ ID NO: 325835 - RNA, 64 nt, Human
caccuuguggguaucucagcucuccgcgucuuuacccugugaucccagccccgccacugaccau

SEQ ID NO: 325836 - RNA, 64 nt, Human
uggucccaucugccucuuuucucuccccagccugcccugugacccuugccucuuccugauacuc

SEQ ID NO: 325837 - RNA, 64 nt, Human
cugauuuugaaaauauguauccaaagugggaggccccugugacauuuugccaacuuaaacgaga

SEQ ID NO: 325838 - RNA, 64 nt, Human
cagggcccaugcugccacccucgaggagauggaacccugugaugcaaaagcuuugcuggugugu

SEQ ID NO: 325839 - RNA, 64 nt, Human
gcguagcccccagcacccagguucuucugucagacccugugaccugcgagcugcuacuacugua

SEQ ID NO: 325840 - RNA, 64 nt, Human
aaagccugaaacugaguugaauagagaagugugacccugugacaaaaugauacugugagaaaug

SEQ ID NO: 325841 - RNA, 64 nt, Human
ccuugcucucagccaccuugauagucacugggcucccugugacuucugacccugacaccccucc

SEQ ID NO: 325842 - RNA, 64 nt, Human
cagggggucagggaaagggaggggggcaugugagggauggaaaugaccuccuggcaccaggcuc

SEQ ID NO: 325843 - RNA, 64 nt, Human
cuuaagcuaauuaauauuggucauuaaauuuaaaggauggaaauuuaucauguuuaaaaauuau

SEQ ID NO: 325844 - RNA, 64 nt, Human
aucacagggccuuauuuggaagagcgggcaaagaggauggaaaucauaaaauauuucaugggaa

SEQ ID NO: 325845 - RNA, 64 nt, Human
agaugcagaugcuguugugaucagcaugaaguuucccugugaggccgugguuagcguggacauc

SEQ ID NO: 325846 - RNA, 64 nt, Human
cgcaccuugcuggaugcuucuccaguagugcugccccugugacaggcaucagcucccugcugga

SEQ ID NO: 325847 - RNA, 64 nt, Human
ggcgggggcggguccagcuuuggaagccaggcuccccugugagccguggcuugucuggucuucg

SEQ ID NO: 325848 - RNA, 64 nt, Human
uuuucuagccuugaauucauuuuaucuucauuaucccugugaaguaggugggacaaguauaagg

SEQ ID NO: 325849 - RNA, 64 nt, Human
ggcccuguugguggagaccagugccugaacuggacccugugaaaucugucccgugggaauccug

SEQ ID NO: 325850 - RNA, 64 nt, Human
aaucuggcccuuccuuggcaaaagcaaaaauucucccugugagagcucaacaucucaaauacaa

SEQ ID NO: 325851 - RNA, 64 nt, Human
uuuccccuacuggcucucauucucacucuugccgcccugugaagaggugccuuccaccgugauu

SEQ ID NO: 325852 - RNA, 64 nt, Human
uaagcagacaauucaacugccauguuuugccacccccugugagcagggauuagguguucaggcc

SEQ ID NO: 325853 - RNA, 64 nt, Human
uggagagagcagguguguuaaaugggacuggagucccugugaagacugggugaggauaacacaa

SEQ ID NO: 325854 - RNA, 64 nt, Human
gcaccugagguucacgcugcuagcguggacauagcccugugauacugcaucucacuggggccag

SEQ ID NO: 325855 - RNA, 64 nt, Human
acagaacaaaaauaauguucuuuuuaugcaaauccccugugaaaauaaaauuuucaauguuuuu

SEQ ID NO: 325856 - RNA, 64 nt, Human
uucaggccugaggcuuuugugaaaugcgucagcccccugugacaguagguuuugaugcuaguga

SEQ ID NO: 325857 - RNA, 64 nt, Human
gccuaaagcgggagccaggccugaguguuccugucccugugagugggaaggucuucuggcuccc

SEQ ID NO: 325858 - RNA, 64 nt, Human
ggggaaguucagaagguguguccuugaacugaggcccugugauauggcggccugcaguggugug

SEQ ID NO: 325859 - RNA, 64 nt, Human
gaugcaagaacccuguuguacuggcguuuuccuccccugugaaaacguaacuacuguugggagu

SEQ ID NO: 325860 - RNA, 64 nt, Human
uugccaggguccccuggggccccuucugcccagucccugugacgucacacugcacacacucacc

SEQ ID NO: 325861 - RNA, 64 nt, Human
gguuuccugcccugggaggcagugauggguuaguggauggaaggggcugacagacagcccucca

SEQ ID NO: 325862 - RNA, 64 nt, Human
ggauacugcugcgucauuacagggcacaggccauggauggaaaacgcucucuacucugcuuuuu

SEQ ID NO: 325863 - RNA, 64 nt, Human
gugagcaagugagagaagguuagguaaggggagaggauggaaugcuugccuccaaugaacuuug

SEQ ID NO: 325864 - RNA, 64 nt, Human
ggauggacuugcccacaccuccaccuccccugagcccugugagaggcacgacugucuaugccaa

SEQ ID NO: 325865 - RNA, 64 nt, Human
aggcugguggcaggagcugggggagaggacucuccccugugagacuccuccuugugaagggcca

SEQ ID NO: 325866 - RNA, 64 nt, Human
ucaaagcucuggacaggagacaccugcuccaggccccugugaucccaguucuguucucuugccc

SEQ ID NO: 325867 - RNA, 64 nt, Human
ugggcuccuuugcucaguugccccaggaaggcuucccugugaguaaugcuuauggaaucugaca

SEQ ID NO: 325868 - RNA, 64 nt, Human
uccaguuuccauucuucagucagaguaugaugaucccugugacaguuuuugcucugaaauagua

SEQ ID NO: 325869 - RNA, 64 nt, Human
cagcccuccugucccuuccccccagucaguauuacccugugaagccccuucccuccuuuauuau

SEQ ID NO: 325870 - RNA, 64 nt, Human
aucuucaaauguaccagaaccugagccaacgccucccugugaaacuguugcugaucuguaguac

SEQ ID NO: 325871 - RNA, 58 nt, Human; identical to SEQ ID NO: 183065

SEQ ID NO: 325872 - RNA, 64 nt, Human
cccucuaucacccuuauuaccaagccuugugguucccugugauuuuagauaaugucugauauuu

SEQ ID NO: 325873 - RNA, 64 nt, Human
aucacucccagccauugauuuuggugacccacuucccugugaugaucuucugaucuaguuucuc

SEQ ID NO: 325874 - RNA, 64 nt, Human
gaucuuuccagagguccaugguggaagacgauaacccugugaaauacuuuauaaaaugucuuaa

SEQ ID NO: 325875 - RNA, 64 nt, Human
cauguacuuauugugggguaccuuuagaugaauucccugugagugagagaaguugaucacccca

SEQ ID NO: 325876 - RNA, 64 nt, Human
uccuugcugcucccuacugacucuagcuuacuuccccugugaagaaacagguguucucggcuga

SEQ ID NO: 325877 - RNA, 64 nt, Human
auuucuguguuuaaacuucugagcagugagacaucccugugagcagauacaauagccaaugcaa

SEQ ID NO: 325878 - RNA, 64 nt, Human
uaaguguggaaucaaaugagcacauaagcugugucccugugaaaagagguuuguagccuuucag

SEQ ID NO: 325879 - RNA, 64 nt, Human
ucccccugcugcagggcgaguggccuguccagaccccugugaggccccgggaaagguacagccc

SEQ ID NO: 325880 - RNA, 64 nt, Human
ccuggggccuacccaucuucuggacagccaagugccaccggagccuacccugccacuggccccu

SEQ ID NO: 325881 - RNA, 64 nt, Human
ccggccccgcucuacggaggccuggcacugcugaccaccggagccuucgcgcucuucggggucu

SEQ ID NO: 325882 - RNA, 64 nt, Human
cagacggcaugacguggugcggggcagcguggccccaccggacuagcacaugaugaauguaaag

SEQ ID NO: 325883 - RNA, 64 nt, Human
acaaauguacaauucucuauucugacauuacagaccaccggauaaggccccauucuuccuuuac

SEQ ID NO: 325884 - RNA, 64 nt, Human
cugcgccccagacuccaggccgccugcagccugccccugugaucccuucggcgccagcagcucc

SEQ ID NO: 325885 - RNA, 64 nt, Human
uucacucauggauguuaggaaaucuagucaucuucccugugauugcccuguuaaguauuuaacc

SEQ ID NO: 325886 - RNA, 64 nt, Human
uucaaaaaaaauuuuuuuuuagaaauguuauuuucccugugauagaggaugacuucccaguuuc

SEQ ID NO: 325887 - RNA, 64 nt, Human
gguagggggcagagaaggaaaagcugaggggggucccugugagggaggaaagaaggaucauuug

SEQ ID NO: 325888 - RNA, 64 nt, Human
uugugcagcuuacaaucuauuuaacuauuagaggcccugugagauguaggcaguuauuuacaga

SEQ ID NO: 325889 - RNA, 64 nt, Human
ugaaagcaaaacuaauauuuauuuucuagauuaucccugugaauaauugagaacuuuuuggagu

SEQ ID NO: 325890 - RNA, 64 nt, Human
uuacaugcauuaucuucuuuuguucuugcuacaacccugugagauaguaguauuaucucauuuu

SEQ ID NO: 325891 - RNA, 64 nt, Human
cgucaucauaauuaaacaacccauauuggggacccccugugacuaguagcagcuggaaaauucu

SEQ ID NO: 325892 - RNA, 64 nt, Human
auugauacugcucaacacagcccaaccuauagugcccugugacuucucuccuccccuuugcuca

SEQ ID NO: 325893 - RNA, 64 nt, Human
guuuccaggucagaaaccauuguucagaagaccucccugugagagaguugcuccucaggguccc

SEQ ID NO: 325894 - RNA, 64 nt, Human
aguuacccgaacccuucgccugaauaacuccagccccugugacauccgccuggauugggagacc

SEQ ID NO: 325895 - RNA, 64 nt, Human
caaguuucugaugaacauucugcauccauauacacccugugacagucagcagucugcuauuaag

SEQ ID NO: 325896 - RNA, 64 nt, Human
ggggcuccuagcuguggcugggggcuccaggcgccccugugauuaccuccuacugccaccaugg

SEQ ID NO: 325897 - RNA, 64 nt, Human
gucaggccucugagcccaagccaagcaucgcauccccugugauuugcacguauacauccagaug

SEQ ID NO: 325898 - RNA, 64 nt, Human
aaggaacccucagagccggcaacugaaucuuggucccugugaugucaagcccauugcucuccca

SEQ ID NO: 325899 - RNA, 64 nt, Human
cccagcccucuguauccaccugguuuuguucuuucccugugagcauuugugguuauagcuuccc

SEQ ID NO: 325900 - RNA, 64 nt, Human
aacuugcuuacuaaugugugauuccuaguuguagccaccggaugugcugaggccuaaauguuag

SEQ ID NO: 325901 - RNA, 64 nt, Human
agcccugacuccuggacuccggaggacugagcccccaccggaacugggcuggcgcuuggaucug

SEQ ID NO: 325902 - RNA, 64 nt, Human
cacagcaccgugccaaccccacccagcuccaggcccaccggaugcugugccuggccuccgaugc

SEQ ID NO: 325903 - RNA, 64 nt, Human
ggugggccaguucugccucucugacaaccaucagccaccggaccccaccccgaggcaucaccac

SEQ ID NO: 325904 - RNA, 64 nt, Human
ugcccgugccccuagcaggagcccuggugcuacccccugugaagagccaagcagcagggcacgc

SEQ ID NO: 325905 - RNA, 64 nt, Human
ucuagcugcagccuuaaauuagcuucuuugcccacccugugagccucauccgugauucugccuu

SEQ ID NO: 325906 - RNA, 64 nt, Human
aguuacuuuaggggguuuuuggugggguuuuucccccugugaaaacuuacuuugccccuagucu

SEQ ID NO: 325907 - RNA, 64 nt, Human
cauacaagcaggcccccguccuaucaguacaccccccugugaugccucugaaauauguacccuc

SEQ ID NO: 325908 - RNA, 64 nt, Human
ggucuuauuuguauucugaaucagcaauuauauucccugugauuauuuggaagaguguguagga

SEQ ID NO: 325909 - RNA, 64 nt, Human
cauguuggagacugagcugggugcacuggccaugcccugugaauccucaggcugugacgcccuc

SEQ ID NO: 325910 - RNA, 64 nt, Human
ggguaguacccagccugcuccccgaguccagcgacccugugacaccggucugcagggaguuggg

SEQ ID NO: 325911 - RNA, 64 nt, Human
aagccaaacucaaagaauggggugguggggggcacccugugagguggccccugagagguggggg

SEQ ID NO: 325912 - RNA, 64 nt, Human
ccugcuuucccgcggacuuccuagugcccaaaugcccugugaggcugagagacccaggccccug

SEQ ID NO: 325913 - RNA, 64 nt, Human
aaaacuucaaauuagccucaugaagagaauuuuucccugugaaaaguaagaccaagaaaaaaca

SEQ ID NO: 325914 - RNA, 64 nt, Human
acuuaggaaguccuuacaugcaagcuguagccagcccugugagaccugccagcccuucagcacc

SEQ ID NO: 325915 - RNA, 64 nt, Human
cgacauggcugggcuacgugaauagcgcccucaacccugugaucuauaccaccuucaauaucga

SEQ ID NO: 325916 - RNA, 64 nt, Human
cuuucuaagauacggacucagcuggucuauuuuacccugugacauuuaaauauacuuuugaaua

SEQ ID NO: 325917 - RNA, 64 nt, Human
ccaaucaucugugccauugguaauaaggaguagccccugugaggucagguacacaguaaagagg

SEQ ID NO: 325918 - RNA, 64 nt, Human
uuuggaucacauuagagauauuuagaacauauuacccugugacuuacguaggaaaccuaauaug

SEQ ID NO: 325919 - RNA, 64 nt, Human
uuguucaacacugcaauuguuuguuagauguaaacccugugacuauaguacguugcuucuuguu

SEQ ID NO: 325920 - RNA, 64 nt, Human
gacccagccaguccuggugacuggccucugccuuccaccggagagacuacugaccuucucaccu

SEQ ID NO: 325921 - RNA, 64 nt, Human
gcgugcgggagggcuaggcccgugcccccgccugccaccggaggucacuccaccauccccaccc

SEQ ID NO: 325922 - RNA, 64 nt, Human
uuucuaaaaucgccuguaugaaaaauaccucgcuggauggaaaaguagauaugaacuuacauuu

SEQ ID NO: 325923 - RNA, 64 nt, Human
auuugggcaguacugcugugcaacccagcugcaaggauggaaggcagaggguggguguggggcc

SEQ ID NO: 325924 - RNA, 64 nt, Human
uggggagcucuuuccugugucagaaccaguccugcccugugaauuacugcuacaaucaaggcca

SEQ ID NO: 325925 - RNA, 64 nt, Human
ggguggcaccugccucucccaccuccagucuuuccccugugaugagcagaugaccaccgcccuc

SEQ ID NO: 325926 - RNA, 64 nt, Human
gagguccccuccucuccuagcuucccgccucugccccugugaacacccaucugcaguauccccu

SEQ ID NO: 325927 - RNA, 64 nt, Human
cugcuaguccuugccagagacauucuuaccucugcccugugauaauauuuuaugcuugacagug

SEQ ID NO: 325928 - RNA, 64 nt, Human
uggcuuugcuaucuggguagaaauuaauacaauucccugugaucuauuccaauguucuuccaag

SEQ ID NO: 325929 - RNA, 64 nt, Human
uauguuguuuauuuucagugacacuuauguaaggcccugugaguuguauuuauccuguauccgg

SEQ ID NO: 325930 - RNA, 64 nt, Human
uguagugcaagggacucauuuuuugcgaacuugucccugugacuaguagauucccccuuuuccu

SEQ ID NO: 325931 - RNA, 64 nt, Human
aacuuagugauaacauuaugaacaauucuaaaagcccugugauuugaaaaauauagaaucauua

SEQ ID NO: 325932 - RNA, 64 nt, Human
guuggaguuccugugucugguuuuccuguuuauucccugugaugcccagaguaauggcccaucc

SEQ ID NO: 325933 - RNA, 64 nt, Human
gaugaagccggccagagccccucugcccagcaugcccugugaucgccuggcccagcaggagcug

SEQ ID NO: 325934 - RNA, 64 nt, Human
cuuuuucucucacuuuugcccuuuguuuauccuucccugugauuagauaaacaaaauaaaaaac

SEQ ID NO: 325935 - RNA, 64 nt, Human
cuagguguggucccauaggagcagccuuagcauccccugugaacuuaucaaaaaugcaaauucu

SEQ ID NO: 325936 - RNA, 64 nt, Human
aaagcuccuuaaaguucugggcagcuaaaagcaucccugugagcaaaaaugccaggcagaaaac

SEQ ID NO: 325937 - RNA, 64 nt, Human
auacacugguuugaauuucuauucaauuuauuuucccugugaucuguuaggcaugaaagcaguu

SEQ ID NO: 325938 - RNA, 64 nt, Human
caccaucuuggucaaguuggucuggaacuccugacccugugauccaccugccuuggcuucccaa

SEQ ID NO: 325939 - RNA, 64 nt, Human
aaaguaaaucuugaacagguucacuaagcacccacccugugaaaaguauuauggaaaucacugc

SEQ ID NO: 325940 - RNA, 64 nt, Human
ggacccucacugccuccgucuguucaucaccugcccaccggagccgcaugcucuuccuggaacu

SEQ ID NO: 325941 - RNA, 64 nt, Human
gcggggcggccugcaucccagggccccuccaaucccaccggacccaggcccugggcuaggggca

SEQ ID NO: 325942 - RNA, 64 nt, Human
aggacuuccucuuuacacccacagaggugcugcgccaccggaagcagcacgugugagcugggcc

SEQ ID NO: 325943 - RNA, 64 nt, Human
agggccgggaucgugaccgggagcgacggcggagccaccggagcgagcgcgagcggcgccggga

SEQ ID NO: 325944 - RNA, 64 nt, Human
guagucacuuuaggaguugggacagagucgagcacccugugaaagucucccuugaguucaggug

SEQ ID NO: 325945 - RNA, 64 nt, Human
gaaagugaagacugagauucaggagcucaggugccccugugauccaggucuucuacccugaaac

SEQ ID NO: 325946 - RNA, 64 nt, Human
auaggcauuuggucucacuacuugaccauucucacccugugaaacgucccacacuuugaagcaa

SEQ ID NO: 325947 - RNA, 64 nt, Human
ucuccccaacccccaagaaccccacuacugcuuucccugugagguaggagauaucagugggccu

SEQ ID NO: 325948 - RNA, 64 nt, Human
acugucugucaauguguaaccugaugucucaacccccugugagaagaguccauuauuugguguu

SEQ ID NO: 325949 - RNA, 64 nt, Human
gaaauugucagaauggcagguggcuucuuaacagcccugugagaagcagacagaugcaaagaaa

SEQ ID NO: 325950 - RNA, 64 nt, Human
ccucuggcacggagggagagacccugggugagaccccugugagcaugggaagggccugcagugg

SEQ ID NO: 325951 - RNA, 64 nt, Human
ggcaugggucccuccauccuugggcuucccgggccccugugacaggggaaagggcucucuuaca

SEQ ID NO: 325952 - RNA, 64 nt, Human
uuauauagguucugaugaaagcuucauaauuucacccugugacuauccugaaaagaaauaauaa

SEQ ID NO: 325953 - RNA, 64 nt, Human
ucuuaggcccucagcucccugacguccugagccucccugugacgcucuggccuucucuguaccu

SEQ ID NO: 325954 - RNA, 64 nt, Human
gacaggaaaacccaccuauggaauaggugccuaucccugugaagaugaaccucuggcccuucca

SEQ ID NO: 325955 - RNA, 64 nt, Human
cuccaucuucuaccucugaauggccacccuuagacccugugauccauccucucuccuagcugag

SEQ ID NO: 325956 - RNA, 64 nt, Human
ccuaacaaacacaaccuucucagcagcauuucuccccugugauggaaauaaaguguuuagggca

SEQ ID NO: 325957 - RNA, 64 nt, Human
cccggugccccugugucccacuacacacagaaaacccugugagauggccagucuucauaauagc

SEQ ID NO: 325958 - RNA, 64 nt, Human
uauucaaaaccaguacaagaacugcugccugguacccugugagucauuucuaugaaauuccaua

SEQ ID NO: 325959 - RNA, 64 nt, Human
aacacacacaccacacacacacacacacacaaaacccugugacuggaguguuauauuacuaugc

SEQ ID NO: 325960 - RNA, 64 nt, Human
augagucccacccaugaccugccgacaguguugcccaccggaacuuuuguggccccuaccgcuc

SEQ ID NO: 325961 - RNA, 64 nt, Human
ccggucccaggcugcugacuggccccacacugugccaccggacaaucgagaccacuucccaucc

SEQ ID NO: 325962 - RNA, 64 nt, Human
cccagggacugggggcgauucuguguggggaaacccaccggaccuugcaggggaccauggggaa

SEQ ID NO: 325963 - RNA, 64 nt, Human
cucagucuccucagggucugagaccccggcgcugccaccggaacccgccuucaggggcgcacgc

SEQ ID NO: 325964 - RNA, 64 nt, Human
uuuuuugaaaaaucagcaguucugaugccuugaccccugugaugaccugguagucuuagcaggg

SEQ ID NO: 325965 - RNA, 64 nt, Human
gcuauccaaucucaucucuuguaaauacaugucccccugugaguucugggcugauuugggucuc

SEQ ID NO: 325966 - RNA, 64 nt, Human
uugcauguuguagcagugauucaguaaguagcaacccugugauacuauuaccaccaccugcuca

SEQ ID NO: 325967 - RNA, 64 nt, Human
caguaauuuugaggaaauugaagaugccaucuuccccugugagugacaugucuuuaauuuuuua

SEQ ID NO: 325968 - RNA, 64 nt, Human
cccagacagaagagacccuguuuccccuccucuccccugugacuucacaagagcuugggcuagg

SEQ ID NO: 325969 - RNA, 64 nt, Human
uucuuuaucuugcuuaccuuauagauuauaaguccccugugaguaaguaagagucauguuuuuc

SEQ ID NO: 325970 - RNA, 64 nt, Human
cccugccuugcagggcgggcuggcuugacucaggcccugugagauagagggcccagcccagccc

SEQ ID NO: 325971 - RNA, 64 nt, Human
gccagaggcaggucuucuggaguucucaggggggcccugugacccccucuccacaaccauggcc

SEQ ID NO: 325972 - RNA, 64 nt, Human
ggaguaccgggaccagaagccauacugcaucagccccugugagccuggcuucagugucuccaag

SEQ ID NO: 325973 - RNA, 64 nt, Human
auucuuuugugguucuagacccuggcuucuaucucccugugauuuguuuuaaugcugaaaugac

SEQ ID NO: 325974 - RNA, 64 nt, Human
uuauuuugcuuuaaaucucugguaguuuuuccaccccugugacacaauccuaauagacaguguc

SEQ ID NO: 325975 - RNA, 64 nt, Human
auauucuuucuguaaagucaaacaggauuccauccccugugaaauaacacaaaauuucacucuc

SEQ ID NO: 325976 - RNA, 64 nt, Human
agugauguucaugucuaucucaaccaggaccagacccugugacuuacucgguaauaacagucca

SEQ ID NO: 325977 - RNA, 64 nt, Human
uuuccugggugacaaaauuaccuguacaccacaccccugugacacacaacuuacucauguaaca

SEQ ID NO: 325978 - RNA, 64 nt, Human
caugagugaucuuccuuugaaagagaaugaaagacccugugacauuucacuucaaaaauaagcc

SEQ ID NO: 325979 - RNA, 64 nt, Human
cgagcaggauggggaugggaaaacuaaaggggcccccugugaccgaggagcaggguccccaggg

SEQ ID NO: 325980 - RNA, 64 nt, Human
ugguaagccgccaacgcaccugggggcugcaaccccaccggacgggugguccggagggaggcug

SEQ ID NO: 325981 - RNA, 64 nt, Human
ucugaagaugauuuggccgagcggaagguguggaccaccggaaaguucuuaaaaguugcuggug

SEQ ID NO: 325982 - RNA, 64 nt, Human
cagccgucugagcagggcaggugcccaacaccccccaccggaggacacgcugccccucagcgau

SEQ ID NO: 325983 - RNA, 64 nt, Human
cacggugauuagucccagagcucggcugccaccuccaccggacaccucagacacgcuucugcag

SEQ ID NO: 325984 - RNA, 64 nt, Human
ucuacauaucuugaaagaaaagucugugagaaaacccugugauuagagggcaacuuaaugcaag

SEQ ID NO: 325985 - RNA, 64 nt, Human
uccccacuguagcggggcaggggguguccaacuucccugugagacugauuaucaauaauaaugu

SEQ ID NO: 325986 - RNA, 64 nt, Human
gaguacguagaccagugucgucgugagggugggacccugugaaggucugaccaccguuucgcuu

SEQ ID NO: 325987 - RNA, 64 nt, Human
ucccugccuugucugucuaggcccauuuggggcucccugugagugauuccccucucucugcuau

SEQ ID NO: 325988 - RNA, 64 nt, Human
acacuggacacccuucgaguguggguuuuaacaucccugugagauugaauacuugugccacaca

SEQ ID NO: 325989 - RNA, 58 nt, Human; identical to SEQ ID NO: 183159

SEQ ID NO: 325990 - RNA, 64 nt, Human
ucuucuucaacacgucccuccccaggguguuccucccugugacccagccgccucgacuucggcc

SEQ ID NO: 325991 - RNA, 64 nt, Human
ccugaaaccacaugcaucauucaggaagccuucacccugugacuauucagccucccugaauaug

SEQ ID NO: 325992 - RNA, 64 nt, Human
gccaacaaccgcugacuccaggauugcauaagcccccugugaaaucggugcuguacugcauacc

SEQ ID NO: 325993 - RNA, 64 nt, Human
guuauaccauuguuuuuucccucaaguauuuuuucccugugaagaagauuauuuaucugcuuuu

SEQ ID NO: 325994 - RNA, 64 nt, Human
gauggcucuguucauuaauagauuguuuuguugacccugugaggauuagucuguggaucuugga

SEQ ID NO: 325995 - RNA, 64 nt, Human
ucuccgcuuugccugcaaaaguaacccaguugcacccugugaagugucugacaaaggcagaaug

SEQ ID NO: 325996 - RNA, 64 nt, Human
guuuuuguaugucuuuugagauccugaguucauccccugugaaucagagugcacaagcaccucu

SEQ ID NO: 325997 - RNA, 64 nt, Human
aaugagcauaauaaauguaaaaccuauauaguaucccugugauuauuguaugagccuuuguuug

SEQ ID NO: 325998 - RNA, 64 nt, Human
ugauuuaggaauuuucucucuuggaaaaggcuuccccugugaugaaaaugaugugccagcuaaa

SEQ ID NO: 325999 - RNA, 64 nt, Human
aguaguuccaggacucagggacucaggccagucacccugugaccgcagguugcuuucccacccu

SEQ ID NO: 326000 - RNA, 64 nt, Human
aaaucaggcauacggagaggcugugagcuggcggccaccggaucugagaggggggagccucagg

SEQ ID NO: 326001 - RNA, 64 nt, Human
ucgccucugucuccaucuguaaauauguguccccccaccggaugucgccacccucacucaccug

SEQ ID NO: 326002 - RNA, 64 nt, Human
uuccccuggcagagcuggguggcagcucuuccucccaccggacaccgacccgcccgcugcugug

SEQ ID NO: 326003 - RNA, 64 nt, Human
cuuccauaauuugggaaggaauggaagauggacaccaccggacaccaccagacacuaggauggg

SEQ ID NO: 326004 - RNA, 64 nt, Human
ugucucaaggaacauuuuaaaaagaacgucuguccccugugaugcuggcuguuaugccuuugaa

SEQ ID NO: 326005 - RNA, 64 nt, Human
cgggcuggguccccugcccaccugccucccugcccccugugacggagggggcaagcaagccccc

SEQ ID NO: 326006 - RNA, 64 nt, Human
agugagaaggagccacaaguuguggcugagaguucccugugaacuugaguaguucauagagugc

SEQ ID NO: 326007 - RNA, 64 nt, Human
uaagugcugcuugucuucccaguguugguuugaacccugugagccugagacagagagggccagg

SEQ ID NO: 326008 - RNA, 64 nt, Human
uuuggagcuggaagaaucugcucuccgguggcugcccugugaacagagggcucccggucagcuu

SEQ ID NO: 326009 - RNA, 64 nt, Human
acucgagagaucaucccuuugucugcauugacggcccugugacggccuccagcccacaggccug

SEQ ID NO: 326010 - RNA, 64 nt, Human
cugguauggccaagcugcuagaagaugcugcugucccugugaucccagcagcccucccuucacc

SEQ ID NO: 326011 - RNA, 64 nt, Human
cuauccccgugguucaucugauauaauuaguguucccugugaauucccccccucuaugggaagg

SEQ ID NO: 326012 - RNA, 64 nt, Human
aagaugaugaggucuuugaaguaauucugaacuccccugugaaugcaguucuuggcacaaagac

SEQ ID NO: 326013 - RNA, 64 nt, Human
ccacguuauguuacggcacaaaauuaauuucugccccugugauugggccacgguugccaaggua

SEQ ID NO: 326014 - RNA, 64 nt, Human
aaacauaguggguauaaucauggaucgcuuguaccccugugaaaauauauuuuuuaaaaauauc

SEQ ID NO: 326015 - RNA, 64 nt, Human
agaguucugugcauaacaggaucccauaccaaagcccugugaguucaucagagucagcuccagg

SEQ ID NO: 326016 - RNA, 64 nt, Human
agaagccuggguucugguuguagcucuggccccucccugugaucuucaacaagccacuugcuuu

SEQ ID NO: 326017 - RNA, 64 nt, Human
acucuggaugcuuggauggaaagggaaaaauggacccugugaugcuaauaaaacuguucucccu

SEQ ID NO: 326018 - RNA, 64 nt, Human
ucuaccuuuguauccaggagaaacugcagagcagcccugugacuuuacaaaauaugcuaccuca

SEQ ID NO: 326019 - RNA, 64 nt, Human
cgaggauggcacaagcgauucacguaggaucugccccugugaccaaaacaccucccauugggcc

SEQ ID NO: 326020 - RNA, 64 nt, Human
ggcccagagcucgggagaugcccgccucgccgccccaccggaccucguccucccccugcacgga

SEQ ID NO: 326021 - RNA, 64 nt, Human
ggccuguacauagaagccaccggauggcacuuccccaccggauggacaguuauuuuguugauaa

SEQ ID NO: 326022 - RNA, 64 nt, Human
ggguuacaggcaggcugcacacagcagucccaggcccugugaggggcuucagacuccagcuaca

SEQ ID NO: 326023 - RNA, 64 nt, Human
acccucggagagagguggugggaugggagagagccccugugaaagccugugaggaucugaagag

SEQ ID NO: 326024 - RNA, 64 nt, Human
accaucuggaguuuuaaaaggcucccaugugagucccugugauggccaggccaggggaccccug

SEQ ID NO: 326025 - RNA, 64 nt, Human
gacuguuaccagacagaggcaacugaugaaaaagcccugugaaagauaggaugugaggugagca

SEQ ID NO: 326026 - RNA, 64 nt, Human
gaaagaaggugucugcucuuacauuauuguggagcccugugauagaaauauguaaaaucucaua

SEQ ID NO: 326027 - RNA, 64 nt, Human
ugugggcugaaggacacggugcagcagagggugucccugugagaguucugcagagugcugggca

SEQ ID NO: 326028 - RNA, 64 nt, Human
cacaguguccccggcuucuaagccuccaauaucacccugugagccucgcacagcucagccccaa

SEQ ID NO: 326029 - RNA, 64 nt, Human
cacuccucaaccuugacuucugcccaaauccccucccugugacccguuccauaucccuuucucu

SEQ ID NO: 326030 - RNA, 64 nt, Human
uggaguguaagagcuuuguuucuuuauggaacuccccugugauugcaguaaauuacuguauugu

SEQ ID NO: 326031 - RNA, 64 nt, Human
acagagcacagcuugugcaacucugguagcguuacccugugacacuguuuugagguccacuucc

SEQ ID NO: 326032 - RNA, 64 nt, Human
guggugaccucauucagucgguuaagagccugagcccugugaaguuaaacaccugcucaugguc

SEQ ID NO: 326033 - RNA, 64 nt, Human
aaaucaucacguaacaggaucuucagaaaaacuacccugugacuaugaagaaaauauauauugc

SEQ ID NO: 326034 - RNA, 64 nt, Human
uuuagcauuuauuuauauuucucuguaggguguucccugugacauugucucuuuaguuugcucu

SEQ ID NO: 326035 - RNA, 64 nt, Human
agugauucuugagagggcaaacucaggaggggagcccugugauuguccagcucaugcuccgagg

SEQ ID NO: 326036 - RNA, 64 nt, Human
acaucaccucucucuccuagacgcccaggaccggcccugugagccgugcuggccccacccgagg

SEQ ID NO: 326037 - RNA, 64 nt, Human
ugcuguccuggagcuuccgaucucuguucggggacccugugagccuucuggccggcugcgugca

SEQ ID NO: 326038 - RNA, 64 nt, Human
ggcacaagaauggcuaaagcaauucauccaagggccaccggaaguaauuagagcuuugaaaaaa

SEQ ID NO: 326039 - RNA, 64 nt, Human
cccgugccagcacugccgcuuccaccugggccacccaccggacccucgcacgccgugccaggcc

SEQ ID NO: 326040 - RNA, 64 nt, Human
uucuggccagucccugcauccucccugggguggaggauggaaggaaagcugggacaagcaggga

SEQ ID NO: 326041 - RNA, 64 nt, Human
gcagcuuaugaaaccauauaaagaauucuuuugaggauggaauucuguccacaaaauaauuuug

SEQ ID NO: 326042 - RNA, 64 nt, Human
caccauguuagccaggcuggucucaaacuccugacccugugauccgcccgccucggccucccaa

SEQ ID NO: 326043 - RNA, 64 nt, Human
caggaaucucuuuaacugauuuugcuaaaaaucucccugugagccuuccacucaacucuuaaua

SEQ ID NO: 326044 - RNA, 64 nt, Human
uuuauuuuacaggccacaauugauuaugaagucacccugugauucucuuugcccacaugaccac

SEQ ID NO: 326045 - RNA, 64 nt, Human
uucaucuaccucagaccccuaucauggggcucuacccugugacaagagccaaacccauucucca

SEQ ID NO: 326046 - RNA, 64 nt, Human
caguggugccccagcacgguggugcccaagccaacccugugacugacauguacgauucacuccu

SEQ ID NO: 326047 - RNA, 64 nt, Human
guucuuugugggggccagaucagaagagagaggccccugugacgcccgggcugcuuggucacaa

SEQ ID NO: 326048 - RNA, 64 nt, Human
agaaaagaaaaagggagaaaaccucuuagcaaagcccugugaguuugggggucagguucaagaa

SEQ ID NO: 326049 - RNA, 64 nt, Human
gacugcccucuguggaagccagcuuaaacccuagcccugugagagcuuccugugcccagcagga

SEQ ID NO: 326050 - RNA, 64 nt, Human
ucuggccuccccugugcaccugggggguccuggccccugugaugcucccccauccccacccacu

SEQ ID NO: 326051 - RNA, 64 nt, Human
gaccacauuugaaauuguuuucccuuucauuuuacccugugaaagcaucucuccuagagccuug

SEQ ID NO: 326052 - RNA, 64 nt, Human
uaagcuggccuuugggccuuuuccuuucuaccuccccugugaccuuuccuagccucagaucugu

SEQ ID NO: 326053 - RNA, 64 nt, Human
uuaaacacaggcuguccuuaacccaccucuccugcccugugauaugucugcugaguuggccugg

SEQ ID NO: 326054 - RNA, 64 nt, Human
gcccuuaaagucuuagccaagagccaagacauagcccugugacaaggugaacaguuggguggga

SEQ ID NO: 326055 - RNA, 64 nt, Human
agauuucacacaugugaccaggggccaccaaagucccugugaccuuugugacuaggauccuaau

SEQ ID NO: 326056 - RNA, 64 nt, Human
agcaagcuuugaggaggcaggagauuccgugggucccugugacauauugcauuaagaucguggc

SEQ ID NO: 326057 - RNA, 64 nt, Human
caaacacugacccagcuucuggguauggaaauaacccugugaugauguguuaauauaaaauguu

SEQ ID NO: 326058 - RNA, 64 nt, Human; identical to SEQ ID NO: 185661

SEQ ID NO: 326059 - RNA, 64 nt, Human
auuucuuuuucagugacguucaaguguuucucacggauggaauucuagucagcugcaggcggga

SEQ ID NO: 326060 - RNA, 64 nt, Human
uaaagaguuugcucacguaaacgcccgugcugggcccugugaagccagcauguucaccacuggu

SEQ ID NO: 326061 - RNA, 64 nt, Human
caccuucaagucucuccaguguguggggacgggucccugugagcaacaaaacugcacuguuucu

SEQ ID NO: 326062 - RNA, 64 nt, Human
cucuggcagccccaggccauggcguugccagccucccugugacagagccuggugaacagugagc

SEQ ID NO: 326063 - RNA, 64 nt, Human
ugcugcuacagcugaggccuggaucccggccuuucccugugacuuacgugucugucaccggcag

SEQ ID NO: 326064 - RNA, 64 nt, Human
ucagguguaggcaggugggcucugcuucccgauucccugugagcgcccacccucucgaaagaau

SEQ ID NO: 326065 - RNA, 64 nt, Human
gaacauguauaacaaaaagcucucuccagaucaucccugugaaugccaaaguaaacuuuaugua

SEQ ID NO: 326066 - RNA, 64 nt, Human
ugcuauuacuacuucuuaucaaaaaucuguaaugcccugugauuuuuaugauacuucuucaaua

SEQ ID NO: 326067 - RNA, 64 nt, Human
uugguccugcccucggcuggaguuccuuucucaccccugugauuuggagguguggagaagggga

SEQ ID NO: 326068 - RNA, 64 nt, Human
cucccccuacucccugcugugaaacaaucccucucccugugagaggaaacuguggagcguuucu

SEQ ID NO: 326069 - RNA, 64 nt, Human
cuuuguccaggccugggugguauagggcguuuggcccugugacuauggcucuggcaccacuagg

SEQ ID NO: 326070 - RNA, 64 nt, Human
guuuggccugccccagugacagugggacgggcugcccugugaguguccaccuggagggaucccc

SEQ ID NO: 326071 - RNA, 64 nt, Human
ucauucuuggaccucuccuggcugagcucugauucccugugagcacgaugcugaugcaauaguc

SEQ ID NO: 326072 - RNA, 64 nt, Human
gguuuugcuauuuccaaagcuuccccuuaucguccccugugauuaucucccaaccccgugacaa

SEQ ID NO: 326073 - RNA, 64 nt, Human
uacaccuuucauaacaggcucagaucacucagcucccugugaccuuuguauucacccaggcuuc

SEQ ID NO: 326074 - RNA, 64 nt, Human
gcauaggucaaauggauuucagagguuuaaacuucccugugauucccccgaauacccccaaaau

SEQ ID NO: 326075 - RNA, 64 nt, Human
uccgucagucugucuuucuccgcucuucucugaccccugugaggaaccuccuuacccuguucug

SEQ ID NO: 326076 - RNA, 64 nt, Human
caggcaucguagcuccacagcccgaggggacacaggauggaaaccccaggaugagaagggagca

SEQ ID NO: 326077 - RNA, 64 nt, Human
gcugcguggauguuuccuuaaccucagcugacuucccugugaaugucuaaugcuaguucagggc

SEQ ID NO: 326078 - RNA, 64 nt, Human
cagcuccuggcucugcaggcggcacagccuggggcccugugauccucugguuucuuccauuggg

SEQ ID NO: 326079 - RNA, 64 nt, Human
gacgagccccccacauggugccgcggcacguccccccugugacgcguuccagaccaacaugacc

SEQ ID NO: 326080 - RNA, 64 nt, Human
agaaugucacucuuaccgucaugucuugcaacaacccugugagggcaguauuaaugcccccuua

SEQ ID NO: 326081 - RNA, 64 nt, Human
aucugucacccuggagaagggaaacuguacuuuucccugugaggaaacggcuuuguauuuucuc

SEQ ID NO: 326082 - RNA, 51 nt, Human; identical to SEQ ID NO: 183239

SEQ ID NO: 326083 - RNA, 64 nt, Human
agucccuggagcaggcaguguggaggcagccauccccugugaugacuggcagcuaaggaggacc

SEQ ID NO: 326084 - RNA, 64 nt, Human
uccuccaggggucuugggugggggagcccagggccccugugaccccuccuuucuuccuccaauc

SEQ ID NO: 326085 - RNA, 64 nt, Human
ugccugauugggguggggacuguccuacuguaaccccugugaaaaaccuugaaauauaacacuc

SEQ ID NO: 326086 - RNA, 64 nt, Human
acaggccauaauuguuccauagaccccucucuagcccugugacuguaguuaguuacuuugauaa

SEQ ID NO: 326087 - RNA, 64 nt, Human
cauuugggagcuggagaacagggguuaucccuaccccugugaacucuguuaacagcuuacauag

SEQ ID NO: 326088 - RNA, 64 nt, Human
ugucccugccaggaauuuccaacaaaccccaccacccugugagcacucuacuggcugucccuga

SEQ ID NO: 326089 - RNA, 64 nt, Human
ggucacaucaaccgccagaaguggaguugggcagcccugugaagccagaggagauggacugguc

SEQ ID NO: 326090 - RNA, 64 nt, Human
ugcucucuuaugucacagcuggccugcagcaggucccugugagcacauaagcagaggcugcagg

SEQ ID NO: 326091 - RNA, 64 nt, Human
gcuucugcauuugguugguuuccugaagcgcagccccugugaauaacagguggcuuuucaugga

SEQ ID NO: 326092 - RNA, 64 nt, Human
caccauguuggccaggcuggucuugaacuccugacccugugauccgaccaccuuggccucccaa

SEQ ID NO: 326093 - RNA, 61 nt, Human
cacuuguccagcugagcgccaggauggaacacggccacaucaaagaggcugaggcuggcac

SEQ ID NO: 326094 - RNA, 61 nt, Human
ucgaaggcugccuucagugccuggaugucugcggccacaccggccggacacgugguagaug

SEQ ID NO: 326095 - RNA, 61 nt, Human
ggccggcgucucgcagacuaggggcugggggcggccacagacggccucgaaaccacagccc

SEQ ID NO: 326096 - RNA, 64 nt, Human
auugacccgacuccacuccaggaaggccaucugacccugugacaggcauagcucauaaacuacc

SEQ ID NO: 326097 - RNA, 64 nt, Human
ucaugguggacgcguucugcucacgggcccagagcccugugaaaugcaucaagguccucuccgc

SEQ ID NO: 326098 - RNA, 64 nt, Human
uccugucugaguaagcccucaggagccucugcuccccugugaacccacugaaccuucugagccc

SEQ ID NO: 326099 - RNA, 64 nt, Human
gaauagcaggacugcaaauuauccuucugccugccccugugacacacacacacacacacacaca

SEQ ID NO: 326100 - RNA, 64 nt, Human
uccugcacugcauccugccuccuugcugaggggccccugugagaggccucuggaugggcauggg

SEQ ID NO: 326101 - RNA, 64 nt, Human
cuuccaagaauuuuauaguacaucuuguuugucucccugugaaaacaacuggaaucuuaaaaaa

SEQ ID NO: 326102 - RNA, 64 nt, Human
ugauggguaaacaucccuuccugucucccacaaccccugugacugcccugcauguguucaugac

SEQ ID NO: 326103 - RNA, 64 nt, Human
cccaaaagacuuuuuugaaucugucauucacauacccugugaagacaauacuaucuacaauuuu

SEQ ID NO: 326104 - RNA, 64 nt, Human
ugccccaucgggcucgcugacgaggaagcgcugucccugugaugagguucucucucagagaguc

SEQ ID NO: 326105 - RNA, 64 nt, Human
ugccaugaagggccaggaugcccagaugcuuggccccugugaagugcugucuggagcagcagga

SEQ ID NO: 326106 - RNA, 64 nt, Human
ucaccuuacuguucaccucaucaaaucaguucugcccugugaaaagauccagccuucccugccg

SEQ ID NO: 326107 - RNA, 64 nt, Human; identical to SEQ ID NO: 326106

SEQ ID NO: 326108 - RNA, 64 nt, Human
uauuuuccuuguguaacaaauggaaaacauucuccccugugagaaauaaugcaauuucuaauua

SEQ ID NO: 326109 - RNA, 64 nt, Human
gcugagucgcggccccugggagcugaucuggacacccugugacacuggcguucuccucuccccu

SEQ ID NO: 326110 - RNA, 64 nt, Human
aguauuuucuuaagccaugaugugaaaccaaugacccugugaccacauggcacagaacacuaaa

SEQ ID NO: 326111 - RNA, 64 nt, Human
gguagucucauuguagguuugugcaccagagugacccugugagccuuuguuaauagguugggag

SEQ ID NO: 326112 - RNA, 61 nt, Human
caucugcccagccucacugaggcucaggacacggccacaccaagugcagcccucguccugg

SEQ ID NO: 326113 - RNA, 61 nt, Human
uccauggccuaggagcuacugggcagguucccggccacacaucuggugggcuguuuuguuu

SEQ ID NO: 326114 - RNA, 61 nt, Human
cacguggagacagaggcagacuggagugaugcggccacaagcccagggacaccuggagccc

SEQ ID NO: 326115 - RNA, 64 nt, Human
gcacugagcaauuuuauuucaggcuuccagcugucccugugaguuauccuggacauuucgaugg

SEQ ID NO: 326116 - RNA, 64 nt, Human
aggcacgccaccugcuccugagccuccacuaucucccugugacgggugaacuucguguacugug

SEQ ID NO: 326117 - RNA, 64 nt, Human
gaguacacagcuggcaccagagcaucacagagagcccugugagccaaaaaguauaguuuuggaa

SEQ ID NO: 326118 - RNA, 64 nt, Human
gcccgugugccuacccacuggaggccauggacagcccugugagccuacaggacgagcaccaggg

SEQ ID NO: 326119 - RNA, 64 nt, Human
gauuacaggcgugagacacugcgcccagccucaucccugugaauuucuuauuguacacaaguuc

SEQ ID NO: 326120 - RNA, 64 nt, Human
ugccucccaggcauucucagugccagggcuucaucccugugaaggcacagggccugcuaguggg

SEQ ID NO: 326121 - RNA, 64 nt, Human
cugguccaaguguguggagggcugagugugcuggcccugugacucaggaccagcucuggagucu

SEQ ID NO: 326122 - RNA, 64 nt, Human
cucagcauggcuuaugugcacguguaaauggagucccugugaaugacagcauguuucuuacaua

SEQ ID NO: 326123 - RNA, 64 nt, Human
auucucccuccaagaggggcccagcauuguauuucccugugaccccuuacucuccuggccagaa

SEQ ID NO: 326124 - RNA, 64 nt, Human
cagaauaugggacaggacauggucagggagaggacccugugaguuggugacauauauguggcag

SEQ ID NO: 326125 - RNA, 64 nt, Human
gggaucccagcuagacuuagaacuuggacuuuuccccugugaagggggcugccaggacaucuca

SEQ ID NO: 326126 - RNA, 64 nt, Human
cccaucuuggcuugcagagcugggcugggcacagcccugugacgucuggagcauuggcugcauu

SEQ ID NO: 326127 - RNA, 64 nt, Human
uucuggaaacaaagggcucaagcaccccuuucaacccugugacugggguccucccucgggcugu

SEQ ID NO: 326128 - RNA, 64 nt, Human
ucuuaucaccuuuauuagauaaaucaugaagugucccugugaaauugaagugaaacuaucucug

SEQ ID NO: 326129 - RNA, 64 nt, Human
guuacgaaucuucuuaaauauauauauauacacacccugugagaacuguaaaaaguaccucugg

SEQ ID NO: 326130 - RNA, 64 nt, Human
aaaccagcuugcgaauaacaguccccguggccaucccugugagggugacguuagcauuaccccc

SEQ ID NO: 326131 - RNA, 64 nt, Human; identical to SEQ ID NO: 185656

SEQ ID NO: 326132 - RNA, 64 nt, Human; identical to SEQ ID NO: 185657

SEQ ID NO: 326133 - RNA, 64 nt, Human; identical to SEQ ID NO: 185659

SEQ ID NO: 326134 - RNA, 64 nt, Human; identical to SEQ ID NO: 185660

SEQ ID NO: 326135 - RNA, 64 nt, Human
uauauaaugacacuguguucugugagggagcaggcccugugagaaucaauucaggacaguauuu

SEQ ID NO: 326136 - RNA, 64 nt, Human
gaaggggagugagaguucagggaggcccuucccacccugugaggcuugacuugaucuggauugg

SEQ ID NO: 326137 - RNA, 64 nt, Human
auucccaaaaaaucccaggaacuccuaaaccuuccccugugacagaagaugagguuggcagcug

SEQ ID NO: 326138 - RNA, 64 nt, Human
cccuauccagagaggugcagcaagagagccauuucccugugacauuuaguggacuggccaguuc

SEQ ID NO: 326139 - RNA, 64 nt, Human
gccugccagacggcacggucugggugcggguguucccugugagcccgaguccgcuucaggaggg

SEQ ID NO: 326140 - RNA, 64 nt, Human
uugccaggaagaaauaggacgugacgguacugggcccugugauucucccagcccuugcaguccg

SEQ ID NO: 326141 - RNA, 64 nt, Human
cgugcuucugucaccugcucccuuucuugcgucucccugugaugggcccuuaggccuggcuggg

SEQ ID NO: 326142 - RNA, 64 nt, Human
augccccugcuagcguauuacuguucugugacuucccugugaccucugcagaacuccucauccu

SEQ ID NO: 326143 - RNA, 64 nt, Human
gcuuaauggccuuccccucggccucguuaagcaucccugugacgcucucaacuucauucuaagg

SEQ ID NO: 326144 - RNA, 64 nt, Human
gagucuuuggagucggggauggaggagguucugccccugugagguguuauacaugaccaucaaa

SEQ ID NO: 326145 - RNA, 64 nt, Human
caaucauuccagcuagaagagcuucccccugacacccugugacugagccuguguccugucugcc

SEQ ID NO: 326146 - RNA, 64 nt, Human
uuauuaaaugcccagccccuucugacccaugcugcccugugaguacuacaguccucccaucuca

SEQ ID NO: 326147 - RNA, 64 nt, Human
uuccaggcugggagagccuuccaggggugggacacccugugauggggcccugccuccuuuguga

SEQ ID NO: 326148 - RNA, 64 nt, Human
caccugagggagggggagggaucggccaccuccucccugugagacggaugcagguccuucccuc

SEQ ID NO: 326149 - RNA, 64 nt, Human
ccuggagagcuccuauuucaaggagaagccccuacccugugagccggagcucaugccgaccuuu

SEQ ID NO: 326150 - RNA, 64 nt, Human
caccuucuuuuccuggcccugucucuggacucuccccugugaggcccaauuccaagacagacuc

SEQ ID NO: 326151 - RNA, 64 nt, Human
cugaaagaaaugacguauacuuuaaaacaaucugggauggaacagaggaaauaugucaaaaaau

SEQ ID NO: 326152 - RNA, 64 nt, Human
cuuguaauucucuauccaggacaucaggagugagggauggaaaaggggauaaaaggccuggagc

SEQ ID NO: 326153 - RNA, 64 nt, Human
caguuccucgaccaccccuccccauccucagccuggauggaaccccgguacaaggaggcagcua

SEQ ID NO: 326154 - RNA, 64 nt, Human
ccuaacuguugcguggaguucacaguucgacuaacccugugaacacccaagccaggaguucuau

SEQ ID NO: 326155 - RNA, 64 nt, Human
guguaggaaaggacacgccgucuguccucacgcccccugugacuuuucauauuuccguuuucca

SEQ ID NO: 326156 - RNA, 64 nt, Human
cugcaaccuggaccccaucugggugugggucagacccugugacccacaugccacccccacccuc

SEQ ID NO: 326157 - RNA, 64 nt, Human
uaguccagagaggugagauuagaucuucuugguucccugugagguuucaggcacuaaaacucua

SEQ ID NO: 326158 - RNA, 52 nt, Human; identical to SEQ ID NO: 183302

SEQ ID NO: 326159 - RNA, 64 nt, Human
ccucgcauccgccucugagccaggagccuccugacccugugaugccugacacaggggacacuga

SEQ ID NO: 326160 - RNA, 64 nt, Human
cauuacugauauuucauuauaauuaguucaccuucccugugaaacaagagaauuguaaaauguu

SEQ ID NO: 326161 - RNA, 64 nt, Human
uagccaguuguugccaaccuuauagggaugaguccccugugagauuuugcuuuuccacugccug

SEQ ID NO: 326162 - RNA, 64 nt, Human
uugaagcugacaucuccaagagguacagcgggcgcccugugaaccugaugggaaccucucugug

SEQ ID NO: 326163 - RNA, 64 nt, Human
uuggcaguuucacuugcaaaauuacacagcuggucccugugaugugucucgacaccaauacaca

SEQ ID NO: 326164 - RNA, 64 nt, Human
accgagccacugcaaagcacagcugauccuggcccccugugaagaaguguucuggucaaaacua

SEQ ID NO: 326165 - RNA, 64 nt, Human
aagccauugagggcagcguccaggagagcucgggcccugugaccacgaucuacaugcuggcagg

SEQ ID NO: 326166 - RNA, 64 nt, Human
auuugauaugauuuuaauucauuacagaaagaaacccugugaaggguauucaaaaacauaacuc

SEQ ID NO: 326167 - RNA, 64 nt, Human
uuucuggcaaauaagauucuaaaagcacuuauaucccugugaauacuucagaggacuuuggccu

SEQ ID NO: 326168 - RNA, 64 nt, Human
guguucacccauggugcccaugucguucuucucucccugugacacagcuuguacagucugauuc

SEQ ID NO: 326169 - RNA, 64 nt, Human
gaucaguuuccuccaacuccugguucagccauugcccugugagggcucacucggcuuccaggga

SEQ ID NO: 326170 - RNA, 64 nt, Human
cggcugggcucuuggacaccugguucucagagaacccugugaugaucacccaagccccaggcug

SEQ ID NO: 326171 - RNA, 64 nt, Human
cucagcccagguaggggcaggauggagggcugagcccugugacaaccugcuguuaccaacugaa

SEQ ID NO: 326172 - RNA, 64 nt, Human
uguccucugucagucaugcguccacuuucccuuccccugugacuccucccuuccccacucugcu

SEQ ID NO: 326173 - RNA, 64 nt, Human
gggaaagaaaaggauuuaagcaaaggcucccucgcccugugagggcgagcggcaaaggcccggc

SEQ ID NO: 326174 - RNA, 64 nt, Human
gacagacuucuugcguuucaaaacugccaugccccccugugaugcucccgugaaggaaugcacu

SEQ ID NO: 326175 - RNA, 64 nt, Human
gggcagcuguggcuucuagcugcccggguggcaucccugugaccccuccccagugccucuccug

SEQ ID NO: 326176 - RNA, 64 nt, Human; identical to SEQ ID NO: 326175

SEQ ID NO: 326177 - RNA, 64 nt, Human
ccugugagggagugcagaacaccuggccgggucacccugugacccucucacuuugguuggaacu

SEQ ID NO: 326178 - RNA, 64 nt, Human
uaccuccugggaaaggggccgcugcugucuggugcccugugagcugugauugauugccuuuggu

SEQ ID NO: 326179 - RNA, 64 nt, Human
accaugccccuuccucuuucuccuccuaccucugcccugugagcccauccauaaggcucucaga

SEQ ID NO: 326180 - RNA, 64 nt, Human
ugagccuagguggccaaggcuuccugcauugcuucccugugaguccaaggccuucccccaccac

SEQ ID NO: 326181 - RNA, 64 nt, Human
cuuuccuucuaccuaucuugccuuaauuaacauucccugugaccuaguuggugcaguggcuuga

SEQ ID NO: 326182 - RNA, 64 nt, Human
gcagacugccccccgagcaguguccccagccuagcccugugagaccccauggggacacgggugc

SEQ ID NO: 326183 - RNA, 64 nt, Human
cagccauauugucaccucagcacuguggacaccucccugugaagagauccuuccauuccaucua

SEQ ID NO: 326184 - RNA, 64 nt, Human
aaauucauucagaaccuguuagauuaaagcugcacccugugauuauuugaaaagaauuagcuug

SEQ ID NO: 326185 - RNA, 64 nt, Human
ugagccuuugaauucugcaggugucaugugcuggcccugugauuuugccucccacacccagcca

SEQ ID NO: 326186 - RNA, 64 nt, Human; identical to SEQ ID NO: 185661

SEQ ID NO: 326187 - RNA, 64 nt, Human
cuuuuccucguccacccugggcuuggggacccccccaccggacucuccacucuccggcaggucc

SEQ ID NO: 326188 - RNA, 64 nt, Human
cggacucuccacucuccggcagguccuaggggagccaccggaaggaaggagagguuugccugcu

SEQ ID NO: 326189 - RNA, 64 nt, Human
agggcuaauuccaaaaagcaaggcuagaaaauagcccugugaggucaagacaauuuaauuuauu

SEQ ID NO: 326190 - RNA, 64 nt, Human
cgggaucagccccuccugaguggccagccuuucccccugugaaagcaaaauagcuuggaccccu

SEQ ID NO: 326191 - RNA, 64 nt, Human
gaguuaccaacccugccugagccucaguuuccuccccugugaaaugagaacacgggguaacugc

SEQ ID NO: 326192 - RNA, 64 nt, Human
ucgauuucauaaaaggacacacacuggagagaaacccugugaauguaagaaauguagaaaagca

SEQ ID NO: 326193 - RNA, 64 nt, Human
gauggaaguguucagacaguuuauaauaguaagccccugugacccucucacuuaccccgagacc

SEQ ID NO: 326194 - RNA, 64 nt, Human
gaagagcaugcccuuugccguugcaugcaaccagcccugugauuccacgugcagaucccagcag

SEQ ID NO: 326195 - RNA, 64 nt, Human
uuuuggacugcgaccuccuucccuccugggagagcccugugaccugcaugcuacucuuaacugu

SEQ ID NO: 326196 - RNA, 64 nt, Human
ucuaccaguuguccccaccaucccccgcccuccucccugugagacacugggccaaaggcucacu

SEQ ID NO: 326197 - RNA, 64 nt, Human
agggccuggcuguggucuucuuggucuugcugcccccugugacccaaaggcaugggauggacag

SEQ ID NO: 326198 - RNA, 64 nt, Human
uacuaggcagcagagaauucauacuggagagaagcccugugaauguuaacaaauguggaaaagc

SEQ ID NO: 326199 - RNA, 64 nt, Human
uccuguccugaguacugggaaguuucuccugaagcccugugagauggcucuguggcugguaucc

SEQ ID NO: 326200 - RNA, 64 nt, Human
ccggccacgcccccacccaccccgcguguuucugcccugugacuccuggaaccugcguccuccc

SEQ ID NO: 326201 - RNA, 64 nt, Human
uggcguucacugcagggcgggggcggcaccgcuccccugugacugcaucccgccucccugggga

SEQ ID NO: 326202 - RNA, 64 nt, Human
ucccagggccccggcaccccggucggcagccugccccugugagacccacccucccgagcggcca

SEQ ID NO: 326203 - RNA, 64 nt, Human
acucagaggagcgggcugccuuccgccuggggcucccugugaccucucaguccccuggcccggc

SEQ ID NO: 326204 - RNA, 64 nt, Human
ccacggccuaaaagccucuuuguggcugaaaggucccugugacauuuucugccacccaaacgga

SEQ ID NO: 326205 - RNA, 64 nt, Human; identical to SEQ ID NO: 185657

SEQ ID NO: 326206 - RNA, 64 nt, Human; identical to SEQ ID NO: 185658

SEQ ID NO: 326207 - RNA, 64 nt, Human; identical to SEQ ID NO: 185659

SEQ ID NO: 326208 - RNA, 64 nt, Human; identical to SEQ ID NO: 185660

SEQ ID NO: 326209 - RNA, 64 nt, Human
uucagauacuuguacgaaacacauuggagauagacccugugaauguaagcacuugguaaagccu

SEQ ID NO: 326210 - RNA, 64 nt, Human
cccccuccaccccccggccacacguguccuauuccccugugauccguaaggccggcggcucggg

SEQ ID NO: 326211 - RNA, 64 nt, Human
ccacuuccagacucuccccucucccacccuucuacccugugaagggaaaugagggcuuuaguuu

SEQ ID NO: 326212 - RNA, 64 nt, Human
uuuuacaaaauauauauauggagaugcucccucccccugugaaccccccagugcccccgugggg

SEQ ID NO: 326213 - RNA, 64 nt, Human
acgaugcccuggugucuuucuccugggcuucuaucccugugaggagaggugcugucugcuggag

SEQ ID NO: 326214 - RNA, 64 nt, Human
ucugauaauuuauacuaacuagaaacagaauugucccugugaaaucuuuuuauggcagguaauc

SEQ ID NO: 326215 - RNA, 64 nt, Human
cucuccucucuccccagaacauccagagucuguccccugugaagaagaagaagauggugccugg

SEQ ID NO: 326216 - RNA, 64 nt, Human
acauuucuuccaccuuuccugcuaguucccacuccccugugaccacuggggccucagggaagau

SEQ ID NO: 326217 - RNA, 64 nt, Human
cacuguauuuuacauaauugauuuucuacuccugcccugugaauuaaggcagaguuuuacugua

SEQ ID NO: 326218 - RNA, 64 nt, Human
cuggacuggggccgcaacccaggguccgaaugagcccugugaggcccacacccccaggugaacc

SEQ ID NO: 326219 - RNA, 63 nt, Human
ucgccugcucccucugcugacauuucaagcugacccugugaucucugcccugucuucgggcga

SEQ ID NO: 326220 - RNA, 64 nt, Human
ucuugacaucuuuucacuucacguaguccuaagucccugugaccugccagagucucuuccccag

SEQ ID NO: 326221 - RNA, 64 nt, Human
ucaauaaauauuuaauggaagguuccacaagucacccugugaucaacaguacccguaugggaca

SEQ ID NO: 326222 - RNA, 64 nt, Human
cccuaggggaagggggcauuuggcuagggggugccccugugagccucgaccuugcccccucguc

SEQ ID NO: 326223 - RNA, 64 nt, Human
uaacuaacacaugagcagucacuuuggagagaagcccugugaauacagugaauguaaggauccc

SEQ ID NO: 326224 - RNA, 64 nt, Human
auaagugaauaauaauuagguuaacauuguugcucccugugacaaaauuuuauaagcaaauuuc

SEQ ID NO: 326225 - RNA, 64 nt, Human
agccaucauccucuuccuaccuugaguuuuucuacccugugaggugggacuuucaguaaaagcc

SEQ ID NO: 326226 - RNA, 64 nt, Human
cucuccuagccccugucaugguguccagacagagcccugugaggcuggguccaauuguggcacu

SEQ ID NO: 326227 - RNA, 64 nt, Human
cacugagcuggguaggcucuaaacuucacaauaacccugugacuuaacuacuuuaucuccauuu

SEQ ID NO: 326228 - RNA, 64 nt, Human
cagccggggcugccagcgcauccagccagcccagcccugugaaagauggagcugacuugcugca

SEQ ID NO: 326229 - RNA, 64 nt, Human
cucaaaugaccuuuugucuuuggggcguucuucccccugugauagcggcaguggcuuuuucugg

SEQ ID NO: 326230 - RNA, 64 nt, Human
gcuguuugcauggcagggcuccagcugccuucagcccugugacgucuccucagggcagcuggac

SEQ ID NO: 326231 - RNA, 64 nt, Human
aagcuguauuuuacccuugagcuuagccgcgggucccugugaaccggcacauuccuuuccuuua

SEQ ID NO: 326232 - RNA, 64 nt, Human
gaggccuggggccggcgagaaaucuccugugaugcccugugaaauggcuugucuccucccccau

SEQ ID NO: 326233 - RNA, 64 nt, Human
cuucccgaguuagcucuuuggguggccccugagccccugugagugcacuugaccgggugcggag

SEQ ID NO: 326234 - RNA, 64 nt, Human
acaccaggccgggcgcggcugggucccccgggggcccugugagagagguggcggugaccguggu

SEQ ID NO: 326235 - RNA, 64 nt, Human
aggcccgucagccauggcugccaucuggcuucugcccugugaccccgugaccccgugaccccga

SEQ ID NO: 326236 - RNA, 64 nt, Human
aguccccagcagguggugcgggugugugaguggccccugugauggccagccuggcuuggacacg

SEQ ID NO: 326237 - RNA, 64 nt, Human
gggauuacaggggugagccgcugugccuggcuggcccugugauauuucugugaaauaaauuggg

SEQ ID NO: 326238 - RNA, 64 nt, Human
gugacacgcagcgcguuggugucuccguguuugucccugugaaaacauguaacgucugccuuag

SEQ ID NO: 326239 - RNA, 64 nt, Human
acacuccuaggacgcacgcauaucagcccguguacccugugacagugacuguccccaccuccua

SEQ ID NO: 326240 - RNA, 64 nt, Human
cuuuugucugcugggcugagggacacgagggcaacccugugacaauggcagguagugugcaucc

SEQ ID NO: 326241 - RNA, 64 nt, Human; identical to SEQ ID NO: 185657

SEQ ID NO: 326242 - RNA, 64 nt, Human; identical to SEQ ID NO: 185658

SEQ ID NO: 326243 - RNA, 64 nt, Human; identical to SEQ ID NO: 185659

SEQ ID NO: 326244 - RNA, 64 nt, Human; identical to SEQ ID NO: 185660

SEQ ID NO: 326245 - RNA, 64 nt, Human
ugaugaaugccaucagucccuccugcuguugccucccugugaccuggaggacagugugugccau

SEQ ID NO: 326246 - RNA, 64 nt, Human
aggaccaggaaggggacucugggggacuggcuuccccugugagcagcagagcagcacaauaaau

SEQ ID NO: 326247 - RNA, 64 nt, Human
aggaccaggaaggggacucugggggaccggcuuccccugugagcagcagagcagcacaauaaau

SEQ ID NO: 326248 - RNA, 64 nt, Human
caugaagccuuuuuccuggucccagcagcaucugcccugugaaguuuguuuucucccacugccu

SEQ ID NO: 326249 - RNA, 64 nt, Human
uccccagcagccuccuacagagcaggaagaggcgcccugugaacccugaguguugcaggcccag

SEQ ID NO: 326250 - RNA, 64 nt, Human
agaagccccgcuccaugagcagugacuccccaggcccugugaccucccuccugucuugcagcuc

SEQ ID NO: 326251 - RNA, 64 nt, Human
guggcgcgccccaccugccuggcuggugguaggccccugugagcuggucccgggcugcuaaaag

SEQ ID NO: 326252 - RNA, 64 nt, Human
caggguggaggggccucggccucagagucaugugcccugugaccacugaagggugucagcagag

SEQ ID NO: 326253 - RNA, 64 nt, Human
ugcccaugaaaucaauggccucuguauggagcgacccugugagaagcacuuggcuggcugagca

SEQ ID NO: 326254 - RNA, 64 nt, Human
aggaugaggaagaggacuuugggggacgggcuuccccugugagcagcagagcagcauaauaaau

SEQ ID NO: 326255 - RNA, 64 nt, Human
aacuaauugugagauggugaagauaaauuuucugcccugugagugacacuggccaggggauagg

SEQ ID NO: 326256 - RNA, 64 nt, Human
cacgggaaaccagagucaaaaguuaucucccucucccugugaugccuugagauuuuuuucugcg

SEQ ID NO: 326257 - RNA, 64 nt, Human
uucugauggcugccuugcuccuugcucccccacccccugugaggacuucucuaggaaguccuuc

SEQ ID NO: 326258 - RNA, 64 nt, Human
aucuucacaauuugugucucguuguucagaacaacccugugaaguaguuuuggcaaugucugug

SEQ ID NO: 326259 - RNA, 64 nt, Human
ucaggacccaucccugccuggaggcuccucuaggcccugugagcacaaagaagaaagcugauuu

SEQ ID NO: 326260 - RNA, 64 nt, Human
gcgcagcguuaaugcgcauugcgugcgaaugaaccccugugaacgguugacuagaugaguaauc

SEQ ID NO: 326261 - RNA, 64 nt, Human; identical to SEQ ID NO: 185661

SEQ ID NO: 326262 - RNA, 64 nt, Human
aaaaaauuguaaaugugggagaaaaaacccugcaggauggaaacaauuauuaagaauguagauc

SEQ ID NO: 326263 - RNA, 64 nt, Human
uucuggaguuccaaaugcaauauagaaaaaaaaacccugugacucuggauuuuauuuuaaguuc

SEQ ID NO: 326264 - RNA, 64 nt, Human
ggccaugcaccaccucagaucuccaaacugaugucccugugaacaccugcacuaugagaagguu

SEQ ID NO: 326265 - RNA, 64 nt, Human
gaaguacacauaaguuauuuccuaggauuuuucccccugugaacaggcauguuguauuauauaa

SEQ ID NO: 326266 - RNA, 64 nt, Human
aacagcuucgugucuaguaugagcucaguacuugcccugugaaaaucccagaagcccccgcugu

SEQ ID NO: 326267 - RNA, 64 nt, Human
caggaaggaagcaccagggcaaggcggacgcucacccugugaccacgauggugaccgugacugu

SEQ ID NO: 326268 - RNA, 64 nt, Human
ggagcccaaaccauccucuccuuaccacucccaucccugugagcccuaccuuaccccucugccc

SEQ ID NO: 326269 - RNA, 64 nt, Human
ugguguuuuccaguauuacaagaucaacuucugacccugugaaaugugagaaguacacauuucu

SEQ ID NO: 326270 - RNA, 64 nt, Human
gauagggcuggagggcuauggauucccagcccaucccugugaaggaguaggccacucuuuaagu

SEQ ID NO: 326271 - RNA, 64 nt, Human
uuaaaggaauuuggcuggggagcugaacagggcucccugugaucugaagaaagcuuuuggugcu

SEQ ID NO: 326272 - RNA, 64 nt, Human
cucagucaugccagucuggacaugcucuguugugcccugugacaaaacugcucaguauuccuau

SEQ ID NO: 326273 - RNA, 64 nt, Human
cauugcuuuucuuguuaagauaaucucuuuacuccccugugagugauucacugccuugucauua

SEQ ID NO: 326274 - RNA, 64 nt, Human
agaguacuccugaccccagugacagcuagcccuccccugugaugguggugguggauacuaauac

SEQ ID NO: 326275 - RNA, 64 nt, Human
uuuuuuucuuuaauuuuaggacauuuaggguccccccugugaauuagaaaguugcuuggcugga

SEQ ID NO: 326276 - RNA, 64 nt, Human
cuccucauguucuugcauggcccaagauguauuucccugugacugaaccaggagaucuggcugg

SEQ ID NO: 326277 - RNA, 64 nt, Human
ugcuuuauaugccacccucuuccuucucuuugaccccugugacucuuucuguaacuuucccagu

SEQ ID NO: 326278 - RNA, 64 nt, Human
gaggagaguacaccguucacuauuguagaguaaccccugugacucaauauuaccauagugcgau

SEQ ID NO: 326279 - RNA, 61 nt, Human
gcccgaccagcuuauacugcuccaucuuccccggccacaugccccgccaaguacugcacag

SEQ ID NO: 326280 - RNA, 61 nt, Human
caaaucugugccuuauggagggguccggcagcggccacaauugucuuguccccucaccccc

SEQ ID NO: 326281 - RNA, 61 nt, Human
cucucccucugcuucccugggggagccccgacggccacaggacuccagcuccaaguggguu

SEQ ID NO: 326282 - RNA, 64 nt, Human
cagcccuggggcuggggggcuucaacuauaguugcccugugacuguaguccaccccugccugcc

SEQ ID NO: 326283 - RNA, 64 nt, Human
aggccauucucauggucaccuauacaguguguuucccugugagcuagcagacacaaugaccagg

SEQ ID NO: 326284 - RNA, 64 nt, Human
auccacaaaugaugcaggugcaaaugguuuauagcccugugaaguucuuaaaguuuagaggcua

SEQ ID NO: 326285 - RNA, 64 nt, Human; identical to SEQ ID NO: 271128

SEQ ID NO: 326286 - RNA, 64 nt, Human; identical to SEQ ID NO: 271129

SEQ ID NO: 326287 - RNA, 64 nt, Human; identical to SEQ ID NO: 271130

SEQ ID NO: 326288 - RNA, 64 nt, Human; identical to SEQ ID NO: 271131

SEQ ID NO: 326289 - RNA, 64 nt, Human; identical to SEQ ID NO: 271135

SEQ ID NO: 326290 - RNA, 64 nt, Human; identical to SEQ ID NO: 271136

SEQ ID NO: 326291 - RNA, 64 nt, Human; identical to SEQ ID NO: 271137

SEQ ID NO: 326292 - RNA, 64 nt, Human; identical to SEQ ID NO: 271138

SEQ ID NO: 326293 - RNA, 64 nt, Human; identical to SEQ ID NO: 271139

SEQ ID NO: 326294 - RNA, 64 nt, Human; identical to SEQ ID NO: 271140

SEQ ID NO: 326295 - RNA, 64 nt, Human; identical to SEQ ID NO: 271141

SEQ ID NO: 326296 - RNA, 64 nt, Human; identical to SEQ ID NO: 271142

SEQ ID NO: 326297 - RNA, 64 nt, Human; identical to SEQ ID NO: 271143

SEQ ID NO: 326298 - RNA, 64 nt, Human; identical to SEQ ID NO: 271144

SEQ ID NO: 326299 - RNA, 64 nt, Human; identical to SEQ ID NO: 271145

SEQ ID NO: 326300 - RNA, 64 nt, Human; identical to SEQ ID NO: 271146

SEQ ID NO: 326301 - RNA, 64 nt, Human; identical to SEQ ID NO: 271147

SEQ ID NO: 326302 - RNA, 64 nt, Human; identical to SEQ ID NO: 271148

SEQ ID NO: 326303 - RNA, 64 nt, Human; identical to SEQ ID NO: 271149

SEQ ID NO: 326304 - RNA, 64 nt, Human; identical to SEQ ID NO: 271153

SEQ ID NO: 326305 - RNA, 64 nt, Human; identical to SEQ ID NO: 271154

SEQ ID NO: 326306 - RNA, 64 nt, Human; identical to SEQ ID NO: 271155

SEQ ID NO: 326307 - RNA, 64 nt, Human; identical to SEQ ID NO: 271156

SEQ ID NO: 326308 - RNA, 64 nt, Human; identical to SEQ ID NO: 271157

SEQ ID NO: 326309 - RNA, 64 nt, Human; identical to SEQ ID NO: 271158

SEQ ID NO: 326310 - RNA, 61 nt, Human
ugcugggauuacaggcgugagccacugcgcccggccacauucaguucuuaucaaagaaaua

SEQ ID NO: 326311 - RNA, 61 nt, Human
cugugcucaucaagaacaauaucgacuuccccggccacaacuacaccacguaagugcccag

SEQ ID NO: 326312 - RNA, 61 nt, Human
agaccuuugcaaguuugccaccaguagauaccggccacaggcucgacaaauaguggucuuu

SEQ ID NO: 326313 - RNA, 64 nt, Human; identical to SEQ ID NO: 271159

SEQ ID NO: 326314 - RNA, 64 nt, Human; identical to SEQ ID NO: 271160

SEQ ID NO: 326315 - RNA, 64 nt, Human; identical to SEQ ID NO: 271161

SEQ ID NO: 326316 - RNA, 64 nt, Human; identical to SEQ ID NO: 271162

SEQ ID NO: 326317 - RNA, 64 nt, Human; identical to SEQ ID NO: 271163

SEQ ID NO: 326318 - RNA, 64 nt, Human; identical to SEQ ID NO: 271164

SEQ ID NO: 326319 - RNA, 64 nt, Human; identical to SEQ ID NO: 271165

SEQ ID NO: 326320 - RNA, 64 nt, Human; identical to SEQ ID NO: 271166

SEQ ID NO: 326321 - RNA, 64 nt, Human; identical to SEQ ID NO: 271167

SEQ ID NO: 326322 - RNA, 64 nt, Human; identical to SEQ ID NO: 271171

SEQ ID NO: 326323 - RNA, 64 nt, Human; identical to SEQ ID NO: 271172

SEQ ID NO: 326324 - RNA, 64 nt, Human; identical to SEQ ID NO: 271173

SEQ ID NO: 326325 - RNA, 64 nt, Human; identical to SEQ ID NO: 271174

SEQ ID NO: 326326 - RNA, 57 nt, Human; identical to SEQ ID NO: 271175

SEQ ID NO: 326327 - RNA, 64 nt, Human; identical to SEQ ID NO: 271176

SEQ ID NO: 326328 - RNA, 61 nt, Human
guuuccccaggacuggccuaggaaggagcaccggccacagcugcuccccgugccacucagg

SEQ ID NO: 326329 - RNA, 51 nt, Human
gagccgccucuccaaaauaaccggccacacucccaaacuccaagacagcca

SEQ ID NO: 326330 - RNA, 61 nt, Human
ugaucccuggggggcaggcucugccagcccucggccacacguggcuccggcacccaugguc

SEQ ID NO: 326331 - RNA, 64 nt, Human; identical to SEQ ID NO: 271177

SEQ ID NO: 326332 - RNA, 55 nt, Human; identical to SEQ ID NO: 271178

SEQ ID NO: 326333 - RNA, 64 nt, Human; identical to SEQ ID NO: 271179

SEQ ID NO: 326334 - RNA, 64 nt, Human; identical to SEQ ID NO: 271180

SEQ ID NO: 326335 - RNA, 64 nt, Human; identical to SEQ ID NO: 271181

SEQ ID NO: 326336 - RNA, 64 nt, Human; identical to SEQ ID NO: 271182

SEQ ID NO: 326337 - RNA, 51 nt, Human; identical to SEQ ID NO: 271183

SEQ ID NO: 326338 - RNA, 64 nt, Human; identical to SEQ ID NO: 271184

SEQ ID NO: 326339 - RNA, 64 nt, Human; identical to SEQ ID NO: 271185

SEQ ID NO: 326340 - RNA, 60 nt, Human; identical to SEQ ID NO: 271189

SEQ ID NO: 326341 - RNA, 64 nt, Human; identical to SEQ ID NO: 271190

SEQ ID NO: 326342 - RNA, 64 nt, Human; identical to SEQ ID NO: 271191

SEQ ID NO: 326343 - RNA, 53 nt, Human; identical to SEQ ID NO: 271192

SEQ ID NO: 326344 - RNA, 64 nt, Human; identical to SEQ ID NO: 271193

SEQ ID NO: 326345 - RNA, 64 nt, Human; identical to SEQ ID NO: 271194

SEQ ID NO: 326346 - RNA, 61 nt, Human
uuucagauuugguuuuuaauuucaugcccuucggccacaggcucaacgggacaugcaacau

SEQ ID NO: 326347 - RNA, 51 nt, Human
uucagucccucaccuccugaccggccacauccuugccgccacaucccgggu

SEQ ID NO: 326348 - RNA, 61 nt, Human
uacauugagguugugggccuucucaaaccgccggccacacuggucacaggcaaaguccagc

SEQ ID NO: 326349 - RNA, 64 nt, Human; identical to SEQ ID NO: 271195

SEQ ID NO: 326350 - RNA, 64 nt, Human; identical to SEQ ID NO: 271196

SEQ ID NO: 326351 - RNA, 64 nt, Human; identical to SEQ ID NO: 271197

SEQ ID NO: 326352 - RNA, 64 nt, Human; identical to SEQ ID NO: 271198

SEQ ID NO: 326353 - RNA, 64 nt, Human; identical to SEQ ID NO: 271199

SEQ ID NO: 326354 - RNA, 64 nt, Human; identical to SEQ ID NO: 271200

SEQ ID NO: 326355 - RNA, 64 nt, Human; identical to SEQ ID NO: 271201

SEQ ID NO: 326356 - RNA, 64 nt, Human; identical to SEQ ID NO: 271202

SEQ ID NO: 326357 - RNA, 64 nt, Human; identical to SEQ ID NO: 271203

SEQ ID NO: 326358 - RNA, 64 nt, Human; identical to SEQ ID NO: 271207

SEQ ID NO: 326359 - RNA, 64 nt, Human; identical to SEQ ID NO: 271208

SEQ ID NO: 326360 - RNA, 64 nt, Human; identical to SEQ ID NO: 271209

SEQ ID NO: 326361 - RNA, 64 nt, Human; identical to SEQ ID NO: 271210

SEQ ID NO: 326362 - RNA, 64 nt, Human; identical to SEQ ID NO: 271211

SEQ ID NO: 326363 - RNA, 64 nt, Human; identical to SEQ ID NO: 271212

SEQ ID NO: 326364 - RNA, 61 nt, Human
gggaacugcuggcucgccuggcaccaccacacggccacagccagccaucugcucugccagg

SEQ ID NO: 326365 - RNA, 61 nt, Human
gggcugcagguuggaacuaugcagugugcuccggccacacauccugcugggcccccuaccc

SEQ ID NO: 326366 - RNA, 64 nt, Human; identical to SEQ ID NO: 271213

SEQ ID NO: 326367 - RNA, 64 nt, Human; identical to SEQ ID NO: 271214

SEQ ID NO: 326368 - RNA, 64 nt, Human; identical to SEQ ID NO: 271215

SEQ ID NO: 326369 - RNA, 64 nt, Human; identical to SEQ ID NO: 271216

SEQ ID NO: 326370 - RNA, 64 nt, Human; identical to SEQ ID NO: 271217

SEQ ID NO: 326371 - RNA, 64 nt, Human; identical to SEQ ID NO: 271218

SEQ ID NO: 326372 - RNA, 64 nt, Human; identical to SEQ ID NO: 271219

SEQ ID NO: 326373 - RNA, 64 nt, Human; identical to SEQ ID NO: 271220

SEQ ID NO: 326374 - RNA, 64 nt, Human; identical to SEQ ID NO: 271221

SEQ ID NO: 326375 - RNA, 64 nt, Human; identical to SEQ ID NO: 271225

SEQ ID NO: 326376 - RNA, 64 nt, Human; identical to SEQ ID NO: 271226

SEQ ID NO: 326377 - RNA, 64 nt, Human; identical to SEQ ID NO: 271227

SEQ ID NO: 326378 - RNA, 64 nt, Human; identical to SEQ ID NO: 271228

SEQ ID NO: 326379 - RNA, 64 nt, Human; identical to SEQ ID NO: 271229

SEQ ID NO: 326380 - RNA, 64 nt, Human; identical to SEQ ID NO: 271230

SEQ ID NO: 326381 - RNA, 61 nt, Human
ugacgguacuggucaagaugggucaagcaagcggccacaagggacugaggcaagcacaaug

SEQ ID NO: 326382 - RNA, 61 nt, Human
gacacauuagagucgguugaggccacaccugcggccacagacugcgaccgcgauugcaggg

SEQ ID NO: 326383 - RNA, 61 nt, Human
gagucacugagcugccuuuggugggaccacccggccacagaaauggcggugggaggaggac

SEQ ID NO: 326384 - RNA, 64 nt, Human; identical to SEQ ID NO: 271231

SEQ ID NO: 326385 - RNA, 64 nt, Human; identical to SEQ ID NO: 271232

SEQ ID NO: 326386 - RNA, 64 nt, Human; identical to SEQ ID NO: 271233

SEQ ID NO: 326387 - RNA, 64 nt, Human; identical to SEQ ID NO: 271234

SEQ ID NO: 326388 - RNA, 64 nt, Human; identical to SEQ ID NO: 271235

SEQ ID NO: 326389 - RNA, 64 nt, Human; identical to SEQ ID NO: 271236

SEQ ID NO: 326390 - RNA, 64 nt, Human; identical to SEQ ID NO: 271237

SEQ ID NO: 326391 - RNA, 64 nt, Human; identical to SEQ ID NO: 271238

SEQ ID NO: 326392 - RNA, 64 nt, Human; identical to SEQ ID NO: 271239

SEQ ID NO: 326393 - RNA, 64 nt, Human; identical to SEQ ID NO: 271243

SEQ ID NO: 326394 - RNA, 64 nt, Human; identical to SEQ ID NO: 271244

SEQ ID NO: 326395 - RNA, 64 nt, Human; identical to SEQ ID NO: 271245

SEQ ID NO: 326396 - RNA, 64 nt, Human; identical to SEQ ID NO: 271246

SEQ ID NO: 326397 - RNA, 64 nt, Human; identical to SEQ ID NO: 271247

SEQ ID NO: 326398 - RNA, 64 nt, Human; identical to SEQ ID NO: 271248

SEQ ID NO: 326399 - RNA, 61 nt, Human
cagaggccacccagaggcccuuccugagggccggccacauucccgcccuccugggcagauu

SEQ ID NO: 326400 - RNA, 61 nt, Human
gagcugggccccugcacaggcacacagggcccggccacacccagcggccccccgcacagcc

SEQ ID NO: 326401 - RNA, 61 nt, Human
acagcugaucccuuacccccaggcugggaugcggccacaaagcacgucuauuuuuuuauga

SEQ ID NO: 326402 - RNA, 64 nt, Human; identical to SEQ ID NO: 271249

SEQ ID NO: 326403 - RNA, 64 nt, Human; identical to SEQ ID NO: 271250

SEQ ID NO: 326404 - RNA, 64 nt, Human; identical to SEQ ID NO: 271251

SEQ ID NO: 326405 - RNA, 64 nt, Human; identical to SEQ ID NO: 271252

SEQ ID NO: 326406 - RNA, 64 nt, Human; identical to SEQ ID NO: 271253

SEQ ID NO: 326407 - RNA, 64 nt, Human; identical to SEQ ID NO: 271254

SEQ ID NO: 326408 - RNA, 64 nt, Human; identical to SEQ ID NO: 271255

SEQ ID NO: 326409 - RNA, 64 nt, Human; identical to SEQ ID NO: 271256

SEQ ID NO: 326410 - RNA, 64 nt, Human; identical to SEQ ID NO: 271257

SEQ ID NO: 326411 - RNA, 64 nt, Human; identical to SEQ ID NO: 271261

SEQ ID NO: 326412 - RNA, 64 nt, Human; identical to SEQ ID NO: 271262

SEQ ID NO: 326413 - RNA, 64 nt, Human; identical to SEQ ID NO: 271263

SEQ ID NO: 326414 - RNA, 64 nt, Human; identical to SEQ ID NO: 271264

SEQ ID NO: 326415 - RNA, 64 nt, Human; identical to SEQ ID NO: 271265

SEQ ID NO: 326416 - RNA, 64 nt, Human; identical to SEQ ID NO: 271266

SEQ ID NO: 326417 - RNA, 61 nt, Human
ccccuccacccauccaguggacucuggggcgcggccacaggggacgggaugaggagcggga

SEQ ID NO: 326418 - RNA, 61 nt, Human
agacagaagucaggugucaucaucagacuugcggccacagcacuagagucacccccccagg

SEQ ID NO: 326419 - RNA, 61 nt, Human
agacgccucccaggcccgucugccagggcgccggccacaauccugcagggccaaggacugg

SEQ ID NO: 326420 - RNA, 64 nt, Human; identical to SEQ ID NO: 271267

SEQ ID NO: 326421 - RNA, 58 nt, Human; identical to SEQ ID NO: 271268

SEQ ID NO: 326422 - RNA, 64 nt, Human; identical to SEQ ID NO: 271269

SEQ ID NO: 326423 - RNA, 64 nt, Human; identical to SEQ ID NO: 271270

SEQ ID NO: 326424 - RNA, 64 nt, Human; identical to SEQ ID NO: 271271

SEQ ID NO: 326425 - RNA, 64 nt, Human; identical to SEQ ID NO: 271272

SEQ ID NO: 326426 - RNA, 62 nt, Human; identical to SEQ ID NO: 271273

SEQ ID NO: 326427 - RNA, 64 nt, Human; identical to SEQ ID NO: 271274

SEQ ID NO: 326428 - RNA, 64 nt, Human; identical to SEQ ID NO: 271275

SEQ ID NO: 326429 - RNA, 64 nt, Human; identical to SEQ ID NO: 271278

SEQ ID NO: 326430 - RNA, 64 nt, Human; identical to SEQ ID NO: 271279

SEQ ID NO: 326431 - RNA, 64 nt, Human; identical to SEQ ID NO: 271280

SEQ ID NO: 326432 - RNA, 64 nt, Human; identical to SEQ ID NO: 271281

SEQ ID NO: 326433 - RNA, 64 nt, Human; identical to SEQ ID NO: 271281

SEQ ID NO: 326434 - RNA, 64 nt, Human; identical to SEQ ID NO: 271283

SEQ ID NO: 326435 - RNA, 61 nt, Human
cgcacccuguccugcacacccugggccacgccggccacaccccucugcugcaacaagcuca

SEQ ID NO: 326436 - RNA, 61 nt, Human
ccccgccuggguuaggugacuaaaagggcuucggccacaggcaggucacagaaaggcaggu

SEQ ID NO: 326437 - RNA, 64 nt, Human
uuuuaggaaaacuucgagcagagauagagaaucuccaccggacuuuugguaaguuccggcaugu

SEQ ID NO: 326438 - RNA, 64 nt, Human; identical to SEQ ID NO: 271284

SEQ ID NO: 326439 - RNA, 64 nt, Human; identical to SEQ ID NO: 271285

SEQ ID NO: 326440 - RNA, 64 nt, Human; identical to SEQ ID NO: 271286

SEQ ID NO: 326441 - RNA, 64 nt, Human; identical to SEQ ID NO: 271287

SEQ ID NO: 326442 - RNA, 64 nt, Human; identical to SEQ ID NO: 271288

SEQ ID NO: 326443 - RNA, 64 nt, Human; identical to SEQ ID NO: 271289

SEQ ID NO: 326444 - RNA, 64 nt, Human; identical to SEQ ID NO: 271290

SEQ ID NO: 326445 - RNA, 64 nt, Human; identical to SEQ ID NO: 271291

SEQ ID NO: 326446 - RNA, 64 nt, Human; identical to SEQ ID NO: 271292

SEQ ID NO: 326447 - RNA, 64 nt, Human; identical to SEQ ID NO: 271296

SEQ ID NO: 326448 - RNA, 64 nt, Human; identical to SEQ ID NO: 271297

SEQ ID NO: 326449 - RNA, 64 nt, Human; identical to SEQ ID NO: 271298

SEQ ID NO: 326450 - RNA, 64 nt, Human; identical to SEQ ID NO: 271299

SEQ ID NO: 326451 - RNA, 64 nt, Human; identical to SEQ ID NO: 271300

SEQ ID NO: 326452 - RNA, 64 nt, Human; identical to SEQ ID NO: 271301

SEQ ID NO: 326453 - RNA, 61 nt, Human
cccacccucaccccggccccccacccgcagccggccacacuggagcagcucccagcacagc

SEQ ID NO: 326454 - RNA, 61 nt, Human
ccuccccaccgaguccuguggccauucagagcggccacaugacuuuugcauccauuguauu

SEQ ID NO: 326455 - RNA, 61 nt, Human
aggcgcccagaggaagucagcagcccuagcucggccacacuuggugcucccagcaucccag

SEQ ID NO: 326456 - RNA, 64 nt, Human; identical to SEQ ID NO: 271302

SEQ ID NO: 326457 - RNA, 64 nt, Human; identical to SEQ ID NO: 271303

SEQ ID NO: 326458 - RNA, 64 nt, Human; identical to SEQ ID NO: 271304

SEQ ID NO: 326459 - RNA, 64 nt, Human; identical to SEQ ID NO: 271305

SEQ ID NO: 326460 - RNA, 64 nt, Human; identical to SEQ ID NO: 271306

SEQ ID NO: 326461 - RNA, 64 nt, Human; identical to SEQ ID NO: 271307

SEQ ID NO: 326462 - RNA, 64 nt, Human; identical to SEQ ID NO: 271308

SEQ ID NO: 326463 - RNA, 64 nt, Human; identical to SEQ ID NO: 271309

SEQ ID NO: 326464 - RNA, 64 nt, Human; identical to SEQ ID NO: 271310

SEQ ID NO: 326465 - RNA, 64 nt, Human; identical to SEQ ID NO: 271314

SEQ ID NO: 326466 - RNA, 64 nt, Human; identical to SEQ ID NO: 271315

SEQ ID NO: 326467 - RNA, 64 nt, Human; identical to SEQ ID NO: 271316

SEQ ID NO: 326468 - RNA, 64 nt, Human; identical to SEQ ID NO: 271317

SEQ ID NO: 326469 - RNA, 64 nt, Human; identical to SEQ ID NO: 271318

SEQ ID NO: 326470 - RNA, 64 nt, Human; identical to SEQ ID NO: 271319

SEQ ID NO: 326471 - RNA, 61 nt, Human
cuccccuccucuucccuuagccucucccacccggccacagcugcuggagaauaaauuuggg

SEQ ID NO: 326472 - RNA, 61 nt, Human
ugcugggguuacaggugugagccacugcacccggccacaagauguaauuuuuacuuuaucu

SEQ ID NO: 326473 - RNA, 61 nt, Human
ggugaccaaaggcugagcccccaccccggcccggccacacccaugcccuccuccgugccuu

SEQ ID NO: 326474 - RNA, 64 nt, Human; identical to SEQ ID NO: 271320

SEQ ID NO: 326475 - RNA, 64 nt, Human; identical to SEQ ID NO: 271321

SEQ ID NO: 326476 - RNA, 64 nt, Human; identical to SEQ ID NO: 271322

SEQ ID NO: 326477 - RNA, 64 nt, Human; identical to SEQ ID NO: 271323

SEQ ID NO: 326478 - RNA, 64 nt, Human; identical to SEQ ID NO: 271324

SEQ ID NO: 326479 - RNA, 64 nt, Human; identical to SEQ ID NO: 271325

SEQ ID NO: 326480 - RNA, 64 nt, Human; identical to SEQ ID NO: 271326

SEQ ID NO: 326481 - RNA, 64 nt, Human; identical to SEQ ID NO: 271327

SEQ ID NO: 326482 - RNA, 64 nt, Human; identical to SEQ ID NO: 271328

SEQ ID NO: 326483 - RNA, 64 nt, Human; identical to SEQ ID NO: 271332

SEQ ID NO: 326484 - RNA, 64 nt, Human; identical to SEQ ID NO: 271333

SEQ ID NO: 326485 - RNA, 64 nt, Human; identical to SEQ ID NO: 271334

SEQ ID NO: 326486 - RNA, 64 nt, Human; identical to SEQ ID NO: 271335

SEQ ID NO: 326487 - RNA, 64 nt, Human; identical to SEQ ID NO: 271336

SEQ ID NO: 326488 - RNA, 64 nt, Human; identical to SEQ ID NO: 271337

SEQ ID NO: 326489 - RNA, 61 nt, Human
cgcuguccuggcugagccccugcaggagccccggccacacacagcaagaaagauacaucug

SEQ ID NO: 326490 - RNA, 61 nt, Human
cacccggguauagacaccugggaaguggggccggccacagccauagccccagcuagugacc

SEQ ID NO: 326491 - RNA, 61 nt, Human
gcggggccgggaaccacacaccccacugggccggccacagucuggacccgcacguccuguu

SEQ ID NO: 326492 - RNA, 64 nt, Human; identical to SEQ ID NO: 271338

SEQ ID NO: 326493 - RNA, 64 nt, Human; identical to SEQ ID NO: 271339

SEQ ID NO: 326494 - RNA, 64 nt, Human; identical to SEQ ID NO: 271340

SEQ ID NO: 326495 - RNA, 64 nt, Human; identical to SEQ ID NO: 271341

SEQ ID NO: 326496 - RNA, 64 nt, Human; identical to SEQ ID NO: 271342

SEQ ID NO: 326497 - RNA, 55 nt, Human; identical to SEQ ID NO: 271343

SEQ ID NO: 326498 - RNA, 64 nt, Human; identical to SEQ ID NO: 271344

SEQ ID NO: 326499 - RNA, 64 nt, Human; identical to SEQ ID NO: 271345

SEQ ID NO: 326500 - RNA, 64 nt, Human; identical to SEQ ID NO: 271346

SEQ ID NO: 326501 - RNA, 64 nt, Human; identical to SEQ ID NO: 271350

SEQ ID NO: 326502 - RNA, 64 nt, Human; identical to SEQ ID NO: 271351

SEQ ID NO: 326503 - RNA, 64 nt, Human; identical to SEQ ID NO: 271352

SEQ ID NO: 326504 - RNA, 50 nt, Human; identical to SEQ ID NO: 271353

SEQ ID NO: 326505 - RNA, 64 nt, Human; identical to SEQ ID NO: 271354

SEQ ID NO: 326506 - RNA, 64 nt, Human; identical to SEQ ID NO: 271355

SEQ ID NO: 326507 - RNA, 61 nt, Human
acacagacacgcaaucgcagauacgcccuuccggccacagaaacacaccauuacacacaca

SEQ ID NO: 326508 - RNA, 61 nt, Human
auccuaaauguuugauuaccucuccaugaagcggccacagaaacuguuggugcacauuauc

SEQ ID NO: 326509 - RNA, 61 nt, Human
ucuccucuuguuucugccuuaauaauucccacggccacaggcaaggggguugcaguggccg

SEQ ID NO: 326510 - RNA, 64 nt, Human; identical to SEQ ID NO: 271356

SEQ ID NO: 326511 - RNA, 64 nt, Human; identical to SEQ ID NO: 271357

SEQ ID NO: 326512 - RNA, 64 nt, Human; identical to SEQ ID NO: 271358

SEQ ID NO: 326513 - RNA, 64 nt, Human; identical to SEQ ID NO: 271359

SEQ ID NO: 326514 - RNA, 64 nt, Human; identical to SEQ ID NO: 271360

SEQ ID NO: 326515 - RNA, 64 nt, Human; identical to SEQ ID NO: 271361

SEQ ID NO: 326516 - RNA, 64 nt, Human; identical to SEQ ID NO: 271362

SEQ ID NO: 326517 - RNA, 64 nt, Human; identical to SEQ ID NO: 271363

SEQ ID NO: 326518 - RNA, 64 nt, Human; identical to SEQ ID NO: 271364

SEQ ID NO: 326519 - RNA, 64 nt, Human; identical to SEQ ID NO: 271368

SEQ ID NO: 326520 - RNA, 64 nt, Human; identical to SEQ ID NO: 271369

SEQ ID NO: 326521 - RNA, 64 nt, Human; identical to SEQ ID NO: 271370

SEQ ID NO: 326522 - RNA, 64 nt, Human; identical to SEQ ID NO: 271371

SEQ ID NO: 326523 - RNA, 64 nt, Human; identical to SEQ ID NO: 271372

SEQ ID NO: 326524 - RNA, 64 nt, Human; identical to SEQ ID NO: 271373

SEQ ID NO: 326525 - RNA, 61 nt, Human
auccuaccuggguuuuuauccacaaagguagcggccacaugguuuuuaaaguaugagaaac

SEQ ID NO: 326526 - RNA, 61 nt, Human
uuuaaaggucacugggagcguuucugauucccggccacacuuugcauuucaacacucagcc

SEQ ID NO: 326527 - RNA, 61 nt, Human
uacucacuuaaagcccgccugacagaaaccacggccacauuugguucuaagaaacccucug

SEQ ID NO: 326528 - RNA, 64 nt, Human; identical to SEQ ID NO: 271374

SEQ ID NO: 326529 - RNA, 52 nt, Human; identical to SEQ ID NO: 271375

SEQ ID NO: 326530 - RNA, 64 nt, Human; identical to SEQ ID NO: 271376

SEQ ID NO: 326531 - RNA, 64 nt, Human; identical to SEQ ID NO: 271377

SEQ ID NO: 326532 - RNA, 64 nt, Human; identical to SEQ ID NO: 271378

SEQ ID NO: 326533 - RNA, 64 nt, Human; identical to SEQ ID NO: 271379

SEQ ID NO: 326534 - RNA, 64 nt, Human; identical to SEQ ID NO: 271380

SEQ ID NO: 326535 - RNA, 64 nt, Human; identical to SEQ ID NO: 271381

SEQ ID NO: 326536 - RNA, 64 nt, Human; identical to SEQ ID NO: 271382

SEQ ID NO: 326537 - RNA, 64 nt, Human; identical to SEQ ID NO: 271386

SEQ ID NO: 326538 - RNA, 64 nt, Human; identical to SEQ ID NO: 271387

SEQ ID NO: 326539 - RNA, 64 nt, Human; identical to SEQ ID NO: 271388

SEQ ID NO: 326540 - RNA, 64 nt, Human; identical to SEQ ID NO: 271389

SEQ ID NO: 326541 - RNA, 64 nt, Human; identical to SEQ ID NO: 271390

SEQ ID NO: 326542 - RNA, 64 nt, Human; identical to SEQ ID NO: 271391

SEQ ID NO: 326543 - RNA, 61 nt, Human
agccaggcgcugaggagcgggcccguggugacggccacacggguagggggcuggcgaacag

SEQ ID NO: 326544 - RNA, 61 nt, Human
gagguagggcuguguucuaaucagcuuuguucggccacacgcugugguuauccacaguggg

SEQ ID NO: 326545 - RNA, 61 nt, Human
uaguacauucugaaaugcuggcaccaggagacggccacagacacacacugcuaaaugugaa

SEQ ID NO: 326546 - RNA, 64 nt, Human; identical to SEQ ID NO: 271392

SEQ ID NO: 326547 - RNA, 64 nt, Human; identical to SEQ ID NO: 271393

SEQ ID NO: 326548 - RNA, 64 nt, Human; identical to SEQ ID NO: 271394

SEQ ID NO: 326549 - RNA, 64 nt, Human; identical to SEQ ID NO: 271395

SEQ ID NO: 326550 - RNA, 64 nt, Human; identical to SEQ ID NO: 271396

SEQ ID NO: 326551 - RNA, 64 nt, Human; identical to SEQ ID NO: 271397

SEQ ID NO: 326552 - RNA, 64 nt, Human; identical to SEQ ID NO: 271398

SEQ ID NO: 326553 - RNA, 64 nt, Human; identical to SEQ ID NO: 271399

SEQ ID NO: 326554 - RNA, 64 nt, Human; identical to SEQ ID NO: 271400

SEQ ID NO: 326555 - RNA, 64 nt, Human; identical to SEQ ID NO: 271402

SEQ ID NO: 326556 - RNA, 64 nt, Human; identical to SEQ ID NO: 271403

SEQ ID NO: 326557 - RNA, 64 nt, Human; identical to SEQ ID NO: 271404

SEQ ID NO: 326558 - RNA, 64 nt, Human; identical to SEQ ID NO: 271405

SEQ ID NO: 326559 - RNA, 64 nt, Human; identical to SEQ ID NO: 271406

SEQ ID NO: 326560 - RNA, 54 nt, Human; identical to SEQ ID NO: 271407

SEQ ID NO: 326561 - RNA, 61 nt, Human
uucacaaaagucaucgcaacuucagagcgaacggccacaucuccccaccucucacccccac

SEQ ID NO: 326562 - RNA, 61 nt, Human
aucuugaaucugcucauugcaugagucaagucggccacagacuugagcgcuuuauuauuag

SEQ ID NO: 326563 - RNA, 61 nt, Human
ggacagcugcugggacccaccucccccuccccggccacaugccgcgucccugccccgaccc

SEQ ID NO: 326564 - RNA, 64 nt, Human; identical to SEQ ID NO: 271408

SEQ ID NO: 326565 - RNA, 61 nt, Human; identical to SEQ ID NO: 271409

SEQ ID NO: 326566 - RNA, 64 nt, Human; identical to SEQ ID NO: 271410

SEQ ID NO: 326567 - RNA, 64 nt, Human; identical to SEQ ID NO: 271411

SEQ ID NO: 326568 - RNA, 56 nt, Human; identical to SEQ ID NO: 271412

SEQ ID NO: 326569 - RNA, 64 nt, Human; identical to SEQ ID NO: 271413

SEQ ID NO: 326570 - RNA, 64 nt, Human; identical to SEQ ID NO: 271414

SEQ ID NO: 326571 - RNA, 64 nt, Human; identical to SEQ ID NO: 271415

SEQ ID NO: 326572 - RNA, 64 nt, Human; identical to SEQ ID NO: 271416

SEQ ID NO: 326573 - RNA, 64 nt, Human; identical to SEQ ID NO: 271417

SEQ ID NO: 326574 - RNA, 64 nt, Human; identical to SEQ ID NO: 271418

SEQ ID NO: 326575 - RNA, 64 nt, Human; identical to SEQ ID NO: 271419

SEQ ID NO: 326576 - RNA, 64 nt, Human; identical to SEQ ID NO: 271420

SEQ ID NO: 326577 - RNA, 64 nt, Human; identical to SEQ ID NO: 271421

SEQ ID NO: 326578 - RNA, 64 nt, Human; identical to SEQ ID NO: 271422

SEQ ID NO: 326579 - RNA, 61 nt, Human
cugacgccccgcggaggccuggcccggagcccggccacacuccgaguccugggucccaguc

SEQ ID NO: 326580 - RNA, 61 nt, Human
gggcuguauuguuguccacugcaguaggcaccggccacaugugacugcuggcaugaaauag

SEQ ID NO: 326581 - RNA, 64 nt, Human
uagcaugcuuuccagcugcaaggaaaagagacgaccaccggauaauucuuuuuaugugcgaaca

SEQ ID NO: 326582 - RNA, 64 nt, Human; identical to SEQ ID NO: 271423

SEQ ID NO: 326583 - RNA, 64 nt, Human; identical to SEQ ID NO: 271424

SEQ ID NO: 326584 - RNA, 64 nt, Human; identical to SEQ ID NO: 271425

SEQ ID NO: 326585 - RNA, 64 nt, Human; identical to SEQ ID NO: 271426

SEQ ID NO: 326586 - RNA, 64 nt, Human; identical to SEQ ID NO: 271427

SEQ ID NO: 326587 - RNA, 64 nt, Human; identical to SEQ ID NO: 271428

SEQ ID NO: 326588 - RNA, 64 nt, Human; identical to SEQ ID NO: 271429

SEQ ID NO: 326589 - RNA, 64 nt, Human; identical to SEQ ID NO: 271430

SEQ ID NO: 326590 - RNA, 64 nt, Human; identical to SEQ ID NO: 271431

SEQ ID NO: 326591 - RNA, 64 nt, Human; identical to SEQ ID NO: 271434

SEQ ID NO: 326592 - RNA, 64 nt, Human; identical to SEQ ID NO: 271435

SEQ ID NO: 326593 - RNA, 64 nt, Human; identical to SEQ ID NO: 271436

SEQ ID NO: 326594 - RNA, 64 nt, Human; identical to SEQ ID NO: 271437

SEQ ID NO: 326595 - RNA, 64 nt, Human; identical to SEQ ID NO: 271438

SEQ ID NO: 326596 - RNA, 64 nt, Human; identical to SEQ ID NO: 271439

SEQ ID NO: 326597 - RNA, 61 nt, Human
ugaucacucccuauaacagauguucaaaauucggccacagcucucuuaugaaggcagaguc

SEQ ID NO: 326598 - RNA, 61 nt, Human
caaaugucagaagcuuggcaugaccucauuccggccacaucauucugugucucugcaucca

SEQ ID NO: 326599 - RNA, 61 nt, Human
agaggcgcaguggcugcaggcugcccccugccggccacaagggagcagcguccgcgccgcc

SEQ ID NO: 326600 - RNA, 64 nt, Human; identical to SEQ ID NO: 271440

SEQ ID NO: 326601 - RNA, 64 nt, Human; identical to SEQ ID NO: 271441

SEQ ID NO: 326602 - RNA, 64 nt, Human; identical to SEQ ID NO: 271442

SEQ ID NO: 326603 - RNA, 64 nt, Human; identical to SEQ ID NO: 271443

SEQ ID NO: 326604 - RNA, 64 nt, Human; identical to SEQ ID NO: 271444

SEQ ID NO: 326605 - RNA, 64 nt, Human; identical to SEQ ID NO: 271445

SEQ ID NO: 326606 - RNA, 64 nt, Human; identical to SEQ ID NO: 271446

SEQ ID NO: 326607 - RNA, 64 nt, Human; identical to SEQ ID NO: 271447

SEQ ID NO: 326608 - RNA, 64 nt, Human; identical to SEQ ID NO: 271448

SEQ ID NO: 326609 - RNA, 64 nt, Human; identical to SEQ ID NO: 271452

SEQ ID NO: 326610 - RNA, 64 nt, Human; identical to SEQ ID NO: 271453

SEQ ID NO: 326611 - RNA, 64 nt, Human; identical to SEQ ID NO: 271454

SEQ ID NO: 326612 - RNA, 64 nt, Human; identical to SEQ ID NO: 271455

SEQ ID NO: 326613 - RNA, 64 nt, Human; identical to SEQ ID NO: 271456

SEQ ID NO: 326614 - RNA, 64 nt, Human; identical to SEQ ID NO: 271457

SEQ ID NO: 326615 - RNA, 61 nt, Human
agcaguagaggacugcagcugucuaggucugcggccacaucuuggggacacacuggacugu

SEQ ID NO: 326616 - RNA, 61 nt, Human
cccgucagggcaccuuuuccucagagcaauccggccacacgaauagaaggcugucgugaau

SEQ ID NO: 326617 - RNA, 61 nt, Human
ccggcggcugugaacacggccucuuccccuacggccacaggggccccuccucuaaugagug

SEQ ID NO: 326618 - RNA, 64 nt, Human; identical to SEQ ID NO: 271458

SEQ ID NO: 326619 - RNA, 64 nt, Human; identical to SEQ ID NO: 271459

SEQ ID NO: 326620 - RNA, 64 nt, Human; identical to SEQ ID NO: 271460

SEQ ID NO: 326621 - RNA, 64 nt, Human; identical to SEQ ID NO: 271461

SEQ ID NO: 326622 - RNA, 64 nt, Human; identical to SEQ ID NO: 271462

SEQ ID NO: 326623 - RNA, 64 nt, Human; identical to SEQ ID NO: 271463

SEQ ID NO: 326624 - RNA, 64 nt, Human; identical to SEQ ID NO: 271464

SEQ ID NO: 326625 - RNA, 64 nt, Human; identical to SEQ ID NO: 271465

SEQ ID NO: 326626 - RNA, 64 nt, Human; identical to SEQ ID NO: 271466

SEQ ID NO: 326627 - RNA, 64 nt, Human; identical to SEQ ID NO: 271470

SEQ ID NO: 326628 - RNA, 64 nt, Human; identical to SEQ ID NO: 271471

SEQ ID NO: 326629 - RNA, 64 nt, Human; identical to SEQ ID NO: 271472

SEQ ID NO: 326630 - RNA, 64 nt, Human; identical to SEQ ID NO: 271473

SEQ ID NO: 326631 - RNA, 64 nt, Human; identical to SEQ ID NO: 271474

SEQ ID NO: 326632 - RNA, 64 nt, Human; identical to SEQ ID NO: 271475

SEQ ID NO: 326633 - RNA, 61 nt, Human
uggcucccuucccuggagcggcagggcgugacggccacagggucugcccgcugcacguucu

SEQ ID NO: 326634 - RNA, 61 nt, Human
ucccguuacacuacuacucagcccucuccugcggccacaucaacggaugcaagucacaguc

SEQ ID NO: 326635 - RNA, 61 nt, Human
cuccucauugucgcugccaaacaggaggcaccggccacaggcccauucaucugcucguaga

SEQ ID NO: 326636 - RNA, 64 nt, Human; identical to SEQ ID NO: 271476

SEQ ID NO: 326637 - RNA, 64 nt, Human; identical to SEQ ID NO: 271477

SEQ ID NO: 326638 - RNA, 64 nt, Human; identical to SEQ ID NO: 271478

SEQ ID NO: 326639 - RNA, 64 nt, Human; identical to SEQ ID NO: 271479

SEQ ID NO: 326640 - RNA, 64 nt, Human; identical to SEQ ID NO: 271480

SEQ ID NO: 326641 - RNA, 64 nt, Human; identical to SEQ ID NO: 271481

SEQ ID NO: 326642 - RNA, 64 nt, Human; identical to SEQ ID NO: 271482

SEQ ID NO: 326643 - RNA, 64 nt, Human; identical to SEQ ID NO: 271483

SEQ ID NO: 326644 - RNA, 64 nt, Human; identical to SEQ ID NO: 271484

SEQ ID NO: 326645 - RNA, 64 nt, Human; identical to SEQ ID NO: 271488

SEQ ID NO: 326646 - RNA, 64 nt, Human; identical to SEQ ID NO: 271489

SEQ ID NO: 326647 - RNA, 64 nt, Human; identical to SEQ ID NO: 271490

SEQ ID NO: 326648 - RNA, 64 nt, Human; identical to SEQ ID NO: 271491

SEQ ID NO: 326649 - RNA, 64 nt, Human; identical to SEQ ID NO: 271492

SEQ ID NO: 326650 - RNA, 64 nt, Human; identical to SEQ ID NO: 271493

SEQ ID NO: 326651 - RNA, 61 nt, Human
ugccagaagcuggugggugaccguugggaaucggccacaccugguguccaugggcagccug

SEQ ID NO: 326652 - RNA, 61 nt, Human
gggcuaagccgagaggcacaggcgggcgaggcggccacaggcgagggugggcugaggcuga

SEQ ID NO: 326653 - RNA, 61 nt, Human
ccagagccguggacauagcuuccaaggagugcggccacaagccggugccagcaugagagca

SEQ ID NO: 326654 - RNA, 64 nt, Human; identical to SEQ ID NO: 271494

SEQ ID NO: 326655 - RNA, 64 nt, Human; identical to SEQ ID NO: 271495

SEQ ID NO: 326656 - RNA, 64 nt, Human; identical to SEQ ID NO: 271496

SEQ ID NO: 326657 - RNA, 64 nt, Human; identical to SEQ ID NO: 271497

SEQ ID NO: 326658 - RNA, 64 nt, Human; identical to SEQ ID NO: 271498

SEQ ID NO: 326659 - RNA, 64 nt, Human; identical to SEQ ID NO: 271499

SEQ ID NO: 326660 - RNA, 64 nt, Human; identical to SEQ ID NO: 271500

SEQ ID NO: 326661 - RNA, 64 nt, Human; identical to SEQ ID NO: 271501

SEQ ID NO: 326662 - RNA, 64 nt, Human; identical to SEQ ID NO: 271502

SEQ ID NO: 326663 - RNA, 64 nt, Human; identical to SEQ ID NO: 271506

SEQ ID NO: 326664 - RNA, 64 nt, Human; identical to SEQ ID NO: 271507

SEQ ID NO: 326665 - RNA, 64 nt, Human; identical to SEQ ID NO: 271508

SEQ ID NO: 326666 - RNA, 64 nt, Human; identical to SEQ ID NO: 271509

SEQ ID NO: 326667 - RNA, 64 nt, Human; identical to SEQ ID NO: 271510

SEQ ID NO: 326668 - RNA, 64 nt, Human; identical to SEQ ID NO: 271511

SEQ ID NO: 326669 - RNA, 61 nt, Human
gggccgccuagcccgaguaggccccagggcgcggccacagacuggcgggccgcggaagggg

SEQ ID NO: 326670 - RNA, 61 nt, Human
gccuccccgacucccaagagugcaccugcugcggccacagcuccguggaaggacucccccu

SEQ ID NO: 326671 - RNA, 61 nt, Human
cagaggucccaugacagccuuugacccacaacggccacacagccgccuccagaccagcacu

SEQ ID NO: 326672 - RNA, 64 nt, Human; identical to SEQ ID NO: 271512

SEQ ID NO: 326673 - RNA, 64 nt, Human; identical to SEQ ID NO: 271513

SEQ ID NO: 326674 - RNA, 64 nt, Human; identical to SEQ ID NO: 271514

SEQ ID NO: 326675 - RNA, 64 nt, Human; identical to SEQ ID NO: 271515

SEQ ID NO: 326676 - RNA, 64 nt, Human; identical to SEQ ID NO: 271516

SEQ ID NO: 326677 - RNA, 64 nt, Human; identical to SEQ ID NO: 271517

SEQ ID NO: 326678 - RNA, 64 nt, Human; identical to SEQ ID NO: 271518

SEQ ID NO: 326679 - RNA, 64 nt, Human; identical to SEQ ID NO: 271519

SEQ ID NO: 326680 - RNA, 55 nt, Human; identical to SEQ ID NO: 271520

SEQ ID NO: 326681 - RNA, 64 nt, Human; identical to SEQ ID NO: 271524

SEQ ID NO: 326682 - RNA, 64 nt, Human; identical to SEQ ID NO: 271525

SEQ ID NO: 326683 - RNA, 64 nt, Human; identical to SEQ ID NO: 271526

SEQ ID NO: 326684 - RNA, 64 nt, Human; identical to SEQ ID NO: 271527

SEQ ID NO: 326685 - RNA, 64 nt, Human; identical to SEQ ID NO: 271528

SEQ ID NO: 326686 - RNA, 64 nt, Human; identical to SEQ ID NO: 271529

SEQ ID NO: 326687 - RNA, 61 nt, Human
ccccucagcccagcccaccccacccgcuguccggccacauuccaaaccucuaccgucaccu

SEQ ID NO: 326688 - RNA, 53 nt, Human
agcagccuguuuacaucugaccgcggccacacgcgguggcaugcauggaggac

SEQ ID NO: 326689 - RNA, 61 nt, Human
cagagccgugccacccacccucccacacagccggccacagggagaacuggugcuaaccagg

SEQ ID NO: 326690 - RNA, 64 nt, Human; identical to SEQ ID NO: 271530

SEQ ID NO: 326691 - RNA, 64 nt, Human; identical to SEQ ID NO: 271531

SEQ ID NO: 326692 - RNA, 64 nt, Human; identical to SEQ ID NO: 271532

SEQ ID NO: 326693 - RNA, 64 nt, Human; identical to SEQ ID NO: 271533

SEQ ID NO: 326694 - RNA, 64 nt, Human; identical to SEQ ID NO: 271534

SEQ ID NO: 326695 - RNA, 64 nt, Human; identical to SEQ ID NO: 271535

SEQ ID NO: 326696 - RNA, 62 nt, Human; identical to SEQ ID NO: 271536

SEQ ID NO: 326697 - RNA, 64 nt, Human; identical to SEQ ID NO: 271537

SEQ ID NO: 326698 - RNA, 64 nt, Human; identical to SEQ ID NO: 271538

SEQ ID NO: 326699 - RNA, 64 nt, Human; identical to SEQ ID NO: 271542

SEQ ID NO: 326700 - RNA, 64 nt, Human; identical to SEQ ID NO: 271543

SEQ ID NO: 326701 - RNA, 64 nt, Human; identical to SEQ ID NO: 271544

SEQ ID NO: 326702 - RNA, 64 nt, Human; identical to SEQ ID NO: 271545

SEQ ID NO: 326703 - RNA, 64 nt, Human; identical to SEQ ID NO: 271546

SEQ ID NO: 326704 - RNA, 64 nt, Human; identical to SEQ ID NO: 271547

SEQ ID NO: 326705 - RNA, 61 nt, Human
aaauaggguuggcgcauacccacccccgccacggccacaagcccuggcauccccugcaaau

SEQ ID NO: 326706 - RNA, 61 nt, Human
uagcaccuccccagacagggcuccagccugucggccacaccccagacuccaggcccccguu

SEQ ID NO: 326707 - RNA, 61 nt, Human
ccagccccgcccucuccucauugcccagaaccggccacaccgcugaaggccaaagaggcca

SEQ ID NO: 326708 - RNA, 64 nt, Human; identical to SEQ ID NO: 271548

SEQ ID NO: 326709 - RNA, 64 nt, Human; identical to SEQ ID NO: 271549

SEQ ID NO: 326710 - RNA, 64 nt, Human; identical to SEQ ID NO: 271550

SEQ ID NO: 326711 - RNA, 64 nt, Human; identical to SEQ ID NO: 271551

SEQ ID NO: 326712 - RNA, 64 nt, Human; identical to SEQ ID NO: 271552

SEQ ID NO: 326713 - RNA, 64 nt, Human; identical to SEQ ID NO: 271553

SEQ ID NO: 326714 - RNA, 58 nt, Human; identical to SEQ ID NO: 271554

SEQ ID NO: 326715 - RNA, 64 nt, Human; identical to SEQ ID NO: 271555

SEQ ID NO: 326716 - RNA, 64 nt, Human; identical to SEQ ID NO: 271556

SEQ ID NO: 326717 - RNA, 64 nt, Human; identical to SEQ ID NO: 271560

SEQ ID NO: 326718 - RNA, 64 nt, Human; identical to SEQ ID NO: 271561

SEQ ID NO: 326719 - RNA, 64 nt, Human; identical to SEQ ID NO: 271562

SEQ ID NO: 326720 - RNA, 64 nt, Human; identical to SEQ ID NO: 271563

SEQ ID NO: 326721 - RNA, 61 nt, Human
ucccuggcacugaggcccugaccccugcucccggccacaggcaguggagaaagccaggugg

SEQ ID NO: 326722 - RNA, 61 nt, Human
caagccccuacugauuucuggguuucugccacggccacagguucauauccagaggaauggc

SEQ ID NO: 326723 - RNA, 61 nt, Human
cuuuaacauguuuaagaaauauggauggggccggccacaguggcucacgccuguaauccca

SEQ ID NO: 326724 - RNA, 61 nt, Human
gcgucgucagcuggcacugucucugcugcagcggccacacuguacucugcacuggugugag

SEQ ID NO: 326725 - RNA, 61 nt, Human
auaguucuacuaugcuagaaguggcauccagcggccacagcuagaaaacagucugcagugu

SEQ ID NO: 326726 - RNA, 61 nt, Human
acaguggccaagaucacaguggccacggccacggccacagucaugguggccacggccacag

SEQ ID NO: 326727 - RNA, 61 nt, Human
gccacggccacggccacagucaugguggccacggccacagccacuaaucaggaggccaggc

SEQ ID NO: 326728 - RNA, 61 nt, Human
uggaagcaauuaaauaugcguaacagugcuacggccacaccagcaccuccuggcugaaggu

SEQ ID NO: 326729 - RNA, 61 nt, Human
ucaugcccggcuacugcgugcagggcaccgucggccacaagauccucagcgggcagcggaa

SEQ ID NO: 326730 - RNA, 64 nt, Human; identical to SEQ ID NO: 203629

SEQ ID NO: 326731 - RNA, 64 nt, Human; identical to SEQ ID NO: 203630

SEQ ID NO: 326732 - RNA, 64 nt, Human; identical to SEQ ID NO: 203631

SEQ ID NO: 326733 - RNA, 64 nt, Human; identical to SEQ ID NO: 203632

SEQ ID NO: 326734 - RNA, 64 nt, Human; identical to SEQ ID NO: 203633

SEQ ID NO: 326735 - RNA, 64 nt, Human; identical to SEQ ID NO: 203634

SEQ ID NO: 326736 - RNA, 64 nt, Human; identical to SEQ ID NO: 203635

SEQ ID NO: 326737 - RNA, 52 nt, Human; identical to SEQ ID NO: 203636

SEQ ID NO: 326738 - RNA, 64 nt, Human; identical to SEQ ID NO: 203637

SEQ ID NO: 326739 - RNA, 64 nt, Human; identical to SEQ ID NO: 203638

SEQ ID NO: 326740 - RNA, 64 nt, Human; identical to SEQ ID NO: 203639

SEQ ID NO: 326741 - RNA, 64 nt, Human; identical to SEQ ID NO: 203640

SEQ ID NO: 326742 - RNA, 64 nt, Human; identical to SEQ ID NO: 203641

SEQ ID NO: 326743 - RNA, 64 nt, Human; identical to SEQ ID NO: 203642

SEQ ID NO: 326744 - RNA, 64 nt, Human; identical to SEQ ID NO: 203643

SEQ ID NO: 326745 - RNA, 64 nt, Human
cuggaaucagcauggaugagaccagaggagguauggauggaaacaagcucuauggaaaauaaag

SEQ ID NO: 326746 - RNA, 64 nt, Human
ugucuaacuggagggacugugauccuuccaccuuggauggaagaggcuuaccugacagccagcc

SEQ ID NO: 326747 - RNA, 64 nt, Human
ccucagccucacccacagcagccccaucgccaaaggauggaaguaauuugaauagcucaggugu

SEQ ID NO: 326748 - RNA, 64 nt, Human; identical to SEQ ID NO: 203644

SEQ ID NO: 326749 - RNA, 64 nt, Human; identical to SEQ ID NO: 203645

SEQ ID NO: 326750 - RNA, 64 nt, Human; identical to SEQ ID NO: 203646

SEQ ID NO: 326751 - RNA, 64 nt, Human; identical to SEQ ID NO: 203647

SEQ ID NO: 326752 - RNA, 64 nt, Human; identical to SEQ ID NO: 203648

SEQ ID NO: 326753 - RNA, 64 nt, Human; identical to SEQ ID NO: 203649

SEQ ID NO: 326754 - RNA, 64 nt, Human; identical to SEQ ID NO: 203650

SEQ ID NO: 326755 - RNA, 64 nt, Human; identical to SEQ ID NO: 203651

SEQ ID NO: 326756 - RNA, 64 nt, Human; identical to SEQ ID NO: 203652

SEQ ID NO: 326757 - RNA, 64 nt, Human; identical to SEQ ID NO: 203653

SEQ ID NO: 326758 - RNA, 64 nt, Human; identical to SEQ ID NO: 203654

SEQ ID NO: 326759 - RNA, 64 nt, Human; identical to SEQ ID NO: 203655

SEQ ID NO: 326760 - RNA, 64 nt, Human; identical to SEQ ID NO: 203656

SEQ ID NO: 326761 - RNA, 64 nt, Human; identical to SEQ ID NO: 203657

SEQ ID NO: 326762 - RNA, 64 nt, Human
ggggggaggcugaacaaacucaggaccugguggcccaccggagguguuaccggguuuccuuucu

SEQ ID NO: 326763 - RNA, 64 nt, Human
ggggguggucugagucuccucacagcagagagacccaccggagcccccucaacuuugcagaugc

SEQ ID NO: 326764 - RNA, 64 nt, Human
ggcugugcacagacugucuugaacaucccaaaugccaccggaaccccagcccuuagcuccccuc

SEQ ID NO: 326765 - RNA, 64 nt, Human
gaccagaaccaggcugagcgcaggaggacaggcaccaccggaugccacaccaggcaggaggagg

SEQ ID NO: 326766 - RNA, 64 nt, Human
gcaaguuuccauuuggcauuagcccagcacagagccaccggaacaucaagauccuagaggacga

SEQ ID NO: 326767 - RNA, 64 nt, Human
ucaacucuucuuccuagaacuggaagcuguccacccaccggaagcgcucuuuacuuggucgcug

SEQ ID NO: 326768 - RNA, 64 nt, Human
uguuuuguaaaucaucuuauccccaaccucaguaccaccggaucuucacuucucagugggauuu

SEQ ID NO: 326769 - RNA, 61 nt, Human
ugcaguccguggucaucuaggcccuacuccgccaccggaucugcucugaccgcacuugaag

SEQ ID NO: 326770 - RNA, 64 nt, Human
acggcugcugaaagaggcuguccaccuggcggaaccaccggagcccggaggcuugggggcuccg

SEQ ID NO: 326771 - RNA, 64 nt, Human
uaaccucuccuccugggccaccuggggcaccuuaccaccggagccgaaucuggucccuggggga

SEQ ID NO: 326772 - RNA, 64 nt, Human
aagcuaaggacagugaugaggaagauggcaguggccaccggaggacuggagcagucccuccuca

SEQ ID NO: 326773 - RNA, 64 nt, Human
ccacugacgacugucaaggccucauuugcagaggccaccggagcuagggcacuagccugacuuu

SEQ ID NO: 326774 - RNA, 64 nt, Human
ugccaagcacagccuuauuucugccggggccuccccaccggagagcccagggggccggccgggu

SEQ ID NO: 326775 - RNA, 64 nt, Human
aggauagcaaugucuggauuggccuccaugacccccaccggaucagucugcugcaucuucuacc

SEQ ID NO: 326776 - RNA, 64 nt, Human
ucuguuaauagugguuuuucuccuguugacagagccaccggauuaugacacaggaugaggaaga

SEQ ID NO: 326777 - RNA, 64 nt, Human
accccagauguggcaacaggacccucgcucacauccaccggaguguauguguggggaggggcuu

SEQ ID NO: 326778 - RNA, 64 nt, Human
ucucaaggaagagucaacuggaacaagcacaagcccaccggacauggccuugguaaagguuagc

SEQ ID NO: 326779 - RNA, 64 nt, Human
cauucaguguagagggaaaaaagcauguauugggccaccggaagacaagcuaauaaauaggcug

SEQ ID NO: 326780 - RNA, 64 nt, Human
ccucccgaugcuccaggccaggagacguucaacgccaccggaguccuccugagccgcaacggcu

SEQ ID NO: 326781 - RNA, 64 nt, Human
caacacgauuuacauaaaaaaucuuacacaucugccaccggaaauaccaugcacagaguccuua

SEQ ID NO: 326782 - RNA, 64 nt, Human
cagucaucggaaucacccgaucacagacgaguggccaccggaaucacccgauaacagcccauca

SEQ ID NO: 326783 - RNA, 64 nt, Human
cggucaccggaaucgcccgaucacagacgagcggccaccggaaucgcccaaucacagacaagca

SEQ ID NO: 326784 - RNA, 64 nt, Human
ggaagacuagcgcggccaccgcgaagccgccaacccaccggagagggggcuucugaacuuggac

SEQ ID NO: 326785 - RNA, 64 nt, Human
acuuugaauacucugagguccuuacccaccaaauggauggaauucagcugcucaaucacugccu

SEQ ID NO: 326786 - RNA, 64 nt, Human
ggaaaguacugcaauugagcuaaaauuuuaucuaggauggaaaaucaggauagacucguuuaaa

SEQ ID NO: 326787 - RNA, 64 nt, Human
uauagaaaugaaauaauuuuauuuuugacagacuggauggaaugaguguguaaugauugauaaa

SEQ ID NO: 326788 - RNA, 64 nt, Human
ggggacccuggguggggccuccaggugcagcuguggauggaagacagggauuggccugugcuuc

SEQ ID NO: 326789 - RNA, 64 nt, Human
gugugacaucaagauaaagagcggagguggauggggauggaagaugaugcuccuauccucccug

SEQ ID NO: 326790 - RNA, 64 nt, Human
agaaauaaagagucuguuuuugcucaaaccaucaggauggaaacagucaggcacugacuggggu

SEQ ID NO: 326791 - RNA, 64 nt, Human
uccuaaacuauacuaaagcccuuuucccaugcauggauggaaauggaagauuuuuuuuuaacuu

SEQ ID NO: 326792 - RNA, 64 nt, Human
acaccccuccguuugcaccaguugccugcagguuggauggaacacagugccccacuuuucugca

SEQ ID NO: 326793 - RNA, 64 nt, Human
cgugagcucuauaucugugaauucaaccaaguuuggauggaaaauuuuuuuuuuuuuuuuuuuu

SEQ ID NO: 326794 - RNA, 64 nt, Human
accuuucugugacuuguucggaauuaacuccucuggauggaaacuuccaucuuacuugguuaca

SEQ ID NO: 326795 - RNA, 64 nt, Human
uuagcacuuucaaacuuagggacauuauuaaauuggauggaaugcacuucuaaauguuuaaauu

SEQ ID NO: 326796 - RNA, 64 nt, Human
aaagguguacuuacuuccuuauuuaucugcaaaaggauggaaacugugggagucaaagccuauu

SEQ ID NO: 326797 - RNA, 64 nt, Human
augaggacaacccuuuuuggugagguuggaagauggauggaagccaagugcuuagugaugucaa

SEQ ID NO: 326798 - RNA, 64 nt, Human
uucuaagcaucucuucuauacucugugcugaaacggauggaauucauggcuuauggaaaucaaa

SEQ ID NO: 326799 - RNA, 61 nt, Human
aucucacuaccacaucaugauaguaaaaucaggauggaaauaagagggugccugauaaaug

SEQ ID NO: 326800 - RNA, 58 nt, Human
aagaaaagaagagcaccuaaaccagacuggauggaaacuuccugcccucucuguaccu

SEQ ID NO: 326801 - RNA, 64 nt, Human
ggcuccugcccccucgucuccuccucugaguggaggauggaaaacuacugccugcacugcccug

SEQ ID NO: 326802 - RNA, 64 nt, Human
cccacucugcuaagccugguuuucuugagcagagggauggaacagagggugagagaggcagugg

SEQ ID NO: 326803 - RNA, 64 nt, Human
caagucagggcagagaggaggagggaggcugucaggauggaaauaccuggacuuuucuuugcuu

SEQ ID NO: 326804 - RNA, 64 nt, Human
caaaaauaaaaauuccuuuuuauuccugucaacuggauggaaacacaaauuucauggagcugug

SEQ ID NO: 326805 - RNA, 64 nt, Human
gaagaauuuuuagcugugcagauaggugauguugggauggaaaaugcuaaucaacuacccuuuc

SEQ ID NO: 326806 - RNA, 64 nt, Human
guguaaagcaaagaauagcagaagcagcuugguaggauggaaggcacgcaguggcauggccugg

SEQ ID NO: 326807 - RNA, 64 nt, Human
cuaucccugugaagaugaaccucuggcccuuccaggauggaaggagugcaauguagucaacucc

SEQ ID NO: 326808 - RNA, 64 nt, Human
caggggcccaggcccuccaaccauaaacaguccaggauggaaccugguucacccuucauaccag

SEQ ID NO: 326809 - RNA, 64 nt, Human
cgugagggucgcugugguggugguuucugugaguggauggaaugagcagcccugcaggggcgcu

SEQ ID NO: 326810 - RNA, 64 nt, Human
acuuggcauccaacucaugaguggauuuuauauaggauggaacaggaagguauguccugucagu

SEQ ID NO: 326811 - RNA, 63 nt, Human
uggagcccucuuacaucuaaaagaucucugguuggauggaaaucaacugucagaauuaccuca

SEQ ID NO: 326812 - RNA, 64 nt, Human
ugcccuguauuccgaaggguaauauaauuuaucuggauggaaauuuuaaagaugaaucccccuu

SEQ ID NO: 326813 - RNA, 64 nt, Human
uaaacucuagaagcuucaauaaugaugugugauuggauggaauugaaucaaacugaaaaaguau

SEQ ID NO: 326814 - RNA, 64 nt, Human
aauggggcuaagggaagugcugaaauagagcaaaggauggaagauaauauagacuaccacccac

SEQ ID NO: 326815 - RNA, 64 nt, Human
uuaacaccuucugccacuuucugucggugcuaauggauggaacuccugcacaaguuuuaacuga

SEQ ID NO: 326816 - RNA, 64 nt, Human
aaguuaaaauguugaugugaguuuuauuucacauggauggaauaaacuugugguuguccuuuaa

SEQ ID NO: 326817 - RNA, 64 nt, Human
guguuucagccucgucuguccggcuggagcuucgggauggaaagugcuaugugucccugcauau

SEQ ID NO: 326818 - RNA, 64 nt, Human
gaaaacucacucguuuaugaaguuaucccaccuuggauggaaaagucauuaggcaccguauugc

SEQ ID NO: 326819 - RNA, 64 nt, Human
uaauugagacuacuguagugacaucugagaaaugggauggaagagugaccauguuuuauuuucu

SEQ ID NO: 326820 - RNA, 64 nt, Human
uaggucuuuccagggcagcaugugauucauuuggggauggaaggaaucugucccgcaucgggaa

SEQ ID NO: 326821 - RNA, 64 nt, Human
cccaccccaauucccuuacaaguaauggagccggggauggaaauaaaugacguccaaggucuuu

SEQ ID NO: 326822 - RNA, 64 nt, Human
cuccacuucacaggacucuuaauaagaccugcacggauggaaacagaaaauauucacaauguau

SEQ ID NO: 326823 - RNA, 64 nt, Human
guggagucggagggaggaagugaggaagggucaaggauggaagaguucuuucacuuacccuuuu

SEQ ID NO: 326824 - RNA, 64 nt, Human
gcuggaucuuugccuugagagcuccgugucaccaggauggaagggggugccucucggaggagcc

SEQ ID NO: 326825 - RNA, 64 nt, Human
guggcgcagagccggguuucaucuggaauuaacuggauggaagggaaaauaaagcuaucuagcg

SEQ ID NO: 326826 - RNA, 64 nt, Human
cucugucccuuccugggcaaagaagaaacggaggggauggaauucuuccuuagacuuacuuuug

SEQ ID NO: 326827 - RNA, 64 nt, Human
auagcagugcaaagaguuccuuuauccuccccaaggauggaaaaauacaauuuauuuugcuuac

SEQ ID NO: 326828 - RNA, 64 nt, Human
uccucccggggcccccacuguggagauaagaaggggauggaaugggggaagaggaggagcagga

SEQ ID NO: 326829 - RNA, 64 nt, Human
ucugcagaccugguucccacugaggcccuuugcaggauggaacuacggggcuuacaggagcuuu

SEQ ID NO: 326830 - RNA, 64 nt, Human
aaauggaaagaaggaaaaaaggaggauagaaaaaggauggaagaaagaagcauugaaaacaaag

SEQ ID NO: 326831 - RNA, 64 nt, Human
gugcuggaguaggggacaaugggaauccuagaggggauggaagacgcggggagugagcugggug

SEQ ID NO: 326832 - RNA, 64 nt, Human
ucccugagaagugaguaaaaguccgcagagguggggauggaagaucucuccuuagauagaaccu

SEQ ID NO: 326833 - RNA, 64 nt, Human
uugggaagagaaaguuaucaagagaaagaggugaggauggaaggauggagaaaaacagacugug

SEQ ID NO: 326834 - RNA, 64 nt, Human
gaugacuucuuuucugauggagagaguccaggagggauggaaaacuccuggauuuaagcucagc

SEQ ID NO: 326835 - RNA, 64 nt, Human
auguccuuuuaugauugucuaggauuccauggauggauggaauauaauugagucaucugguaga

SEQ ID NO: 326836 - RNA, 64 nt, Human
uuauuauuuaucugggcaauuauugugugugugaggauggaaggguagggaauaaucgaacauc

SEQ ID NO: 326837 - RNA, 64 nt, Human
uuuuucucacagcagaggaaccuuuccaagguggggauggaagcacagucgggacagaauucga

SEQ ID NO: 326838 - RNA, 64 nt, Human
aaaccuaaacauuaaauaaauaucuccaauauuaggauggaauacauauguauggcauguacua

SEQ ID NO: 326839 - RNA, 64 nt, Human
acuauugggugaauaugguggaaaauaauuuaguggauggaauaucagaaguauaucuguacag

SEQ ID NO: 326840 - RNA, 64 nt, Human
accuaagcauauacuauucuaugcuuuaaaaugaggauggaaaaguuucaugucauaagucacc

SEQ ID NO: 326841 - RNA, 64 nt, Human
agagccagaaaacagaucuggaggcagcagugcuggauggaauugucuaggcuguggcauguug

SEQ ID NO: 326842 - RNA, 64 nt, Human
guuagauccuuguaagcaucgcuacccgaguccaggauggaauuucacaggaaagugaagggau

SEQ ID NO: 326843 - RNA, 64 nt, Human
aguuggaacccggacacuugccccucacugguguggauggaaaucugccuuucgugggaccaaa

SEQ ID NO: 326844 - RNA, 64 nt, Human
uucuguuucauuucaagguaucaaugcuguagauggauggaagaggcuucccacaggaaggugc

SEQ ID NO: 326845 - RNA, 64 nt, Human
aaggguugauauucugggggaggucacugcagaaggauggaacugaccuuuauuccccaguggg

SEQ ID NO: 326846 - RNA, 64 nt, Human
uauagacgugcacgauggugguguggcuuacccaggauggaaacacugcaguucuuacuugcau

SEQ ID NO: 326847 - RNA, 64 nt, Human
uuucucaacaaauguuguuacuaugcauguauauggauggaauaaaauuccagauuguuggaga

SEQ ID NO: 326848 - RNA, 64 nt, Human
agagacucuaagcucaaguucugguuuauuucauggauggaauguuaauuuuauuaugauauua

SEQ ID NO: 326849 - RNA, 64 nt, Human
uuuuuaaauaaaucagaaugcuuaaaaucugaauggauggaacuuaaaacuacuuuguugaaac

SEQ ID NO: 326850 - RNA, 64 nt, Human
aaaguuggaaaggaugaugugaagauuuuuaaugggauggaauagguguuuaaugaacagccau

SEQ ID NO: 326851 - RNA, 64 nt, Human
uuuuucccccuuucuagcuccaagaggaaaacgaggauggaaaaccuuuuaugcuguacugaag

SEQ ID NO: 326852 - RNA, 64 nt, Human
guggauucuuggcucggaaaauucaugcagauauggauggaaagaagaguaaguaucaugcguu

SEQ ID NO: 326853 - RNA, 64 nt, Human
ugugaaagaucaauccaucugccagaaucuagugggauggaaguuuuugcuacauguuauccac

SEQ ID NO: 326854 - RNA, 64 nt, Human
cuggaagaaacucucccauccaacaucacccaguggauggaacauccuguaacuuuucacugca

SEQ ID NO: 326855 - RNA, 64 nt, Human
augccuucauuuugcuauggggggcaggcaggggggauggaaaauaaguagaaacaaaaaagca

SEQ ID NO: 326856 - RNA, 64 nt, Human
guaaagugggggccucaacugugccuccucagguggauggaagguucugggugcccgcaggggc

SEQ ID NO: 326857 - RNA, 64 nt, Human
ggauaagccucuuuauacucacuuaaaccaacugggauggaauucagaauaccuaagcugcuuc

SEQ ID NO: 326858 - RNA, 64 nt, Human
ucugacagcuugauaacauuccuguuauaaccaaggauggaaguguacaccaguccguagguau

SEQ ID NO: 326859 - RNA, 64 nt, Human
aaauaaagucauuggggauuuuuaccucuaauuuggauggaaagcacaagaagccacacauuca

SEQ ID NO: 326860 - RNA, 64 nt, Human
uagcuuuuaugugauauguuuuaaaguuaaaacuggauggaaauagccauuuggaagcuuuggu

SEQ ID NO: 326861 - RNA, 64 nt, Human
aacuaaagauguuuuaagcuaaagccugaauuugggauggaagcaggacagacaccguggacag

SEQ ID NO: 326862 - RNA, 64 nt, Human
aguuuaacuuaacuuguuguguaugugaauuuagggauggaaacuuuuuuuccccuauuuauuc

SEQ ID NO: 326863 - RNA, 64 nt, Human
ugcuuuuucuggugggggcaaggggagcugguauggauggaaugacaagaauuaguccaaaugg

SEQ ID NO: 326864 - RNA, 64 nt, Human
uagcagccucgguacugaagccacaccaguguccggauggaagucugcaucugagguugcucag

SEQ ID NO: 326865 - RNA, 64 nt, Human
aaauguguaaaaagagaaaucagcucauggcuuaggauggaauuagagacaggugagggacacu

SEQ ID NO: 326866 - RNA, 64 nt, Human
uauuggcccagcaaggcaaagaacugaaguuccaggauggaagaaccuguguucuccucauaau

SEQ ID NO: 326867 - RNA, 64 nt, Human
aaggagccuggacucugaucccucuguacaggcuggauggaaggggcccuccacacuuccuggg

SEQ ID NO: 326868 - RNA, 64 nt, Human
ccaccucccucugccagucgggagagccaggcuuggauggaacaugcccacaacuugucaccca

SEQ ID NO: 326869 - RNA, 64 nt, Human
acugcuggaggcauaauguacaaggcaggaaaagggauggaauugauggugacagcuaagucug

SEQ ID NO: 326870 - RNA, 64 nt, Human
gggaggugguuuucugacugagauguugccugauggauggaaagaaauguauuuuuaaguucaa

SEQ ID NO: 326871 - RNA, 64 nt, Human
caacugauuaaaggacaccagacucuggaugcuuggauggaaagggaaaaauggacccugugau

SEQ ID NO: 326872 - RNA, 64 nt, Human
ucgaguuuuucaaauugugagggggaccauaaaaggauggaaacuuuuagaugacauucuacaa

SEQ ID NO: 326873 - RNA, 64 nt, Human
aaacuuugaaaauggaucuucauauagaaucaguggauggaaacaaggguuuaaacuugauaca

SEQ ID NO: 326874 - RNA, 64 nt, Human
ggucacuugaucaugcugcaguggguaguucuaaggauggaaaggugacaguauuacucucgag

SEQ ID NO: 326875 - RNA, 64 nt, Human
gaauacauacucuuuccaugcauauauggaacauggauggaaacugaccaccuacuuuguccag

SEQ ID NO: 326876 - RNA, 64 nt, Human
gagagagagugaagugaaugcaagauaaaaagugggauggaagaauuaaauccagaguuccagg

SEQ ID NO: 326877 - RNA, 64 nt, Human
guuaggaucaguguguguggaugggauagcccugggauggaaaggacuagccucuacugaugca

SEQ ID NO: 326878 - RNA, 64 nt, Human
auugcaugguguccugauugcaucuagguggagcggauggaaugugcugggccacuguugggug

SEQ ID NO: 326879 - RNA, 64 nt, Human
aucaguggcuaguccaaauaaaauaugggcuuggggauggaauggguggugguaaguucacaga

SEQ ID NO: 326880 - RNA, 64 nt, Human
aacuuggugugcaauuugaaaggaugugaaucauggauggaaggccauuuguacaugucccuug

SEQ ID NO: 326881 - RNA, 64 nt, Human
uccuuggaucauagaacugagugcugagaauccaggauggaaagaaaugcagaacuaucauagu

SEQ ID NO: 326882 - RNA, 64 nt, Human
auguuguaacauagguguguagauaguggauccuggauggaacuggcuucuuuaucgagaagaa

SEQ ID NO: 326883 - RNA, 64 nt, Human
uaguggaaacccaucuguaaauuagauggauguuggauggaaaaugacauugcuaaauuugaga

SEQ ID NO: 326884 - RNA, 64 nt, Human
gaagauguucgcccaauugcuugggggguuggggggauggaaaaggggagcaccucuaggcugc

SEQ ID NO: 326885 - RNA, 64 nt, Human
auaacaaaaagcaaguuauggaagauugugaagaggauggaaaaacugaauacaagauaccaaa

SEQ ID NO: 326886 - RNA, 64 nt, Human
agaaaucagaagggggaacagucaguuuaguuaaggauggaaccugggaaaggccaccauuccu

SEQ ID NO: 326887 - RNA, 64 nt, Human
ucaucugccggcauuauuaagggugggcuagguuggauggaaggugaaagggaugaacugccuu

SEQ ID NO: 326888 - RNA, 64 nt, Human
gccucugacacguggcucaccgcugucauuugggggauggaaugaacagucacuguucuauagc

SEQ ID NO: 326889 - RNA, 56 nt, Human
ugcucucagcgcaguuuuaguccugaggauggaagaccaggcucgugugucuugug

SEQ ID NO: 326890 - RNA, 64 nt, Human
cuucagacacauacaucacuuucacaccacuuggggauggaaauaccuacaagagugaagguca

SEQ ID NO: 326891 - RNA, 64 nt, Human
gaaaccucuggaacauuucaccuuuagagauggaggauggaaggauugguaccagaagagggcu

SEQ ID NO: 326892 - RNA, 64 nt, Human
cguaaguuugauuagugaugucugccacgggcagggauggaaggagcagugugaugucugcucu

SEQ ID NO: 326893 - RNA, 64 nt, Human
cccuucuuuuuaaaaggaaaaaggauggagagaaggauggaaagccuggacuuaaaccuuuaga

SEQ ID NO: 326894 - RNA, 64 nt, Human
cagccuggagucagccauggcucucugagccugaggauggaaaugggagaugggagcuguuuug

SEQ ID NO: 326895 - RNA, 64 nt, Human
ugaaccagacguggauggugcugaauuguugcuuggauggaaaaagggcugcccauguugugcu

SEQ ID NO: 326896 - RNA, 64 nt, Human
gaccagcugggggagcauugaaaggacagcuuggggauggaauuuuuuuuuuuuuaucuccauu

SEQ ID NO: 326897 - RNA, 64 nt, Human
gggccugaggcaucacaucuugcagaucagaaugggauggaauccaccaggcuccagcucaucc

SEQ ID NO: 326898 - RNA, 64 nt, Human
ccuucccuucuuuuuuuaugcucguuuucgcuggggauggaauuauuguaccauuuucuaucau

SEQ ID NO: 326899 - RNA, 64 nt, Human
uuccucaggcggagagcuucugagaacacaggcaggauggaaaaagacuacuagccacuuuugc

SEQ ID NO: 326900 - RNA, 64 nt, Human
acgcaucccucaccacguccggauuuccuucuuuggauggaauguaacgcgaucucuauuuaau

SEQ ID NO: 326901 - RNA, 64 nt, Human
guuccugggccuggcgggggaggcaggggugagaggauggaauugugugcacaagaacuguggc

SEQ ID NO: 326902 - RNA, 64 nt, Human
uuuuccuucagaaaagaaaaaccucuuuuuaauuggauggaaacuuucuaccugcuuggccugg

SEQ ID NO: 326903 - RNA, 64 nt, Human
uccuaaaaaucgauaaguagcuccaccugaagagggauggaaccucugggucaggaaacagcug

SEQ ID NO: 326904 - RNA, 64 nt, Human
augaugccaucauuuaaggaaauccauggaccaaggauggaauacagauugaugcugcccuauc

SEQ ID NO: 326905 - RNA, 64 nt, Human
ugcuguuuccaggaaauuacauaacguucaguugggauggaaaucuuccggaggacgaauagag

SEQ ID NO: 326906 - RNA, 64 nt, Human
ucagugcaccuccccuccagucuccacucccugaggauggaaucggggaaacagcauccugccg

SEQ ID NO: 326907 - RNA, 64 nt, Human
ccuagaagggcccaaaugagagaaugguacuuagggauggaaaacgggccuggcuagagcuucg

SEQ ID NO: 326908 - RNA, 64 nt, Human
ucagcauucuccaucacuuccccuccagaaaaacggauggaaggaagcccucugugacacugcu

SEQ ID NO: 326909 - RNA, 64 nt, Human
uuccaggcuuugguggcccaagagcagucuggguggauggaaguggcuguccccuccucuccag

SEQ ID NO: 326910 - RNA, 64 nt, Human
acuuacaauaucucaaggaacagcaaugucaacaggauggaaaccagcccuaucugagucuucg

SEQ ID NO: 326911 - RNA, 64 nt, Human
auagccucaaaauagguuauucguuucuaaacuuggauggaauuagagaauacaaucaaacuuu

SEQ ID NO: 326912 - RNA, 64 nt, Human
auaaaauccuaguggaauuggagaccauuggaagggauggaauauaagucagugugaaacugag

SEQ ID NO: 326913 - RNA, 64 nt, Human
gcugugagaaccaugugucuaaggcguaagauaaggauggaaggcuguccaaguuauuuggaag

SEQ ID NO: 326914 - RNA, 64 nt, Human
guuucauuuuacaagaacuauccugaguuucuguggauggaaacauuacauguaaugcagauau

SEQ ID NO: 326915 - RNA, 50 nt, Human
uguccaaguacaaugaaugaggauggaaaaaaugauuauuaaagagaaca

SEQ ID NO: 326916 - RNA, 64 nt, Human
acacucagcucugcuguguuaacuuugugaaacuggauggaacaaacuuuaacuuaccaagcac

SEQ ID NO: 326917 - RNA, 64 nt, Human
gggcuaaaagcagaaaaaaaauuccauuucaucgggauggaacugaaggauuuuauucuauaaa

SEQ ID NO: 326918 - RNA, 64 nt, Human
acuuuugggggcuucccggucuagccacacccucggauggaaagacuugacugcauaaagaugu

SEQ ID NO: 326919 - RNA, 64 nt, Human
cucccugccuucuggacuccugaaggucguggauggauggaaggcacacagcccgugccggcug

SEQ ID NO: 326920 - RNA, 64 nt, Human
ccuaucucauggaugugauaguggaaggaauuguggauggaagacaagcagaaaagcugaagac

SEQ ID NO: 326921 - RNA, 64 nt, Human
cuuuguacugcucucugggagccucccugcuugaggauggaaggaugaaauuugacgaauauau

SEQ ID NO: 326922 - RNA, 64 nt, Human
aaaguaaucauguuuuaauguagaaccucaaacaggauggaacaucaguggauggcaggagguu

SEQ ID NO: 326923 - RNA, 64 nt, Human
gcaaaaucuccuuagauaucugaaaagucauacuggauggaaucuguaggaaacgguucuauuu

SEQ ID NO: 326924 - RNA, 64 nt, Human
ugcuuuuucagucuguucagcuuuuuacuugcuaggauggaauugcaauuugcaagcuucuucg

SEQ ID NO: 326925 - RNA, 64 nt, Human
ccugggcugguggccccuggcuccggagaaugcuggauggaacaggaaaccaaucaccuggcac

SEQ ID NO: 326926 - RNA, 64 nt, Human
gaagaguaacauggcuccacuggacacaaaagagggauggaaucaacaggcagggggccuuuua

SEQ ID NO: 326927 - RNA, 64 nt, Human
gcuguuaucuauucagcaugucacuaaauuccugggauggaaguaaaagacaaugcuggcaacu

SEQ ID NO: 326928 - RNA, 50 nt, Human
ggaucuauguggacaucuaaggauggaacucggugucucuuaauucauuu

SEQ ID NO: 326929 - RNA, 64 nt, Human
uugcccaaaaggcuggagagggcagggagcggcaggauggaaggagacacggggcagggagaac

SEQ ID NO: 326930 - RNA, 64 nt, Human
aacaacaggggcuccuguuccauacccucuguguggauggaaagggucauuagugcuccugccu

SEQ ID NO: 326931 - RNA, 64 nt, Human
aacuguuagacaucagaaaagggauugagaaaagggauggaacugauuugaggcuaaacuggau

SEQ ID NO: 326932 - RNA, 64 nt, Human
uacaaaucgggagaaaaauccauuuuaguucuauggauggaaauauuucaugcuuuuaaaaaga

SEQ ID NO: 326933 - RNA, 64 nt, Human
auccuaguggccucccagacugcaggguccccaaggauggaaagggaauguucugcugguucua

SEQ ID NO: 326934 - RNA, 64 nt, Human
gauggaauaaugggaaaggagggaaaugggaaauggauggaaaugggaaaggagggaaaauaau

SEQ ID NO: 326935 - RNA, 64 nt, Human
ccuugcugcaguucuccuucccauuaauucauugggauggaagccaaaaauaaaagaggugccu

SEQ ID NO: 326936 - RNA, 64 nt, Human
aucuuguucacugcugugcuacuuuacaugaguaggauggaaguguauauuuuauaugaaauac

SEQ ID NO: 326937 - RNA, 64 nt, Human
aaggaccaaauccuggaguucucccaacuuuagaggauggaaaggggcagaguaaucuagcaaa

SEQ ID NO: 326938 - RNA, 64 nt, Human
uuucagauguuuaaauaauggugugaaucauucaggauggaaauaaaagucauccuuucuguaa

SEQ ID NO: 326939 - RNA, 64 nt, Human
uauguguuacaacaguaguuuaaaaacuuguacuggauggaacccauuuuauaaacagucuuau

SEQ ID NO: 326940 - RNA, 64 nt, Human
cauggacuucacuuucggcaacaaaacuaaauaaggauggaacauuuauugaaugaaaaaugca

SEQ ID NO: 326941 - RNA, 64 nt, Human
uugaccucuuuugaagguagaguuuuagaaggcuggauggaagauucugagccuggaauuagga

SEQ ID NO: 326942 - RNA, 64 nt, Human
auauugugugggauuucacagguaaaagucaguaggauggaacauuuuaguguauuuuuacucc

SEQ ID NO: 326943 - RNA, 64 nt, Human
auugggauaagaucuuuugaucccaaggucagguggauggaauuuuuggauuuauauuuguucc

SEQ ID NO: 326944 - RNA, 64 nt, Human
uuaccuucaaggagcaagugaagaacucugugaaggauggaacuuucagauaucaacuauuuag

SEQ ID NO: 326945 - RNA, 64 nt, Human
gaaaagccaugaguugcaaccaaaacgcggcugaggauggaacucagaaugaaacugcaaccca

SEQ ID NO: 326946 - RNA, 64 nt, Human
uucuugcacugauaaugcacuuugaagauggaagggauggaaacagggccacuucagagggucu

SEQ ID NO: 326947 - RNA, 64 nt, Human
cucugaugucaugaucuaaaugagggguagugggggauggaagagaguaccaggugguccaccg

SEQ ID NO: 326948 - RNA, 64 nt, Human
agcauaucguaaagcuguucaaacccagucuuguggauggaaauguagugcucgagucacauuc

SEQ ID NO: 326949 - RNA, 64 nt, Human
uuuccaguucugagguaacuaguucaguuuguugggauggaagcaugaaggaaagggcuagaga

SEQ ID NO: 326950 - RNA, 64 nt, Human
ccaacuuaguuccuacuguucugugcccuucaguggauggaacgugagugucugaucaucucuc

SEQ ID NO: 326951 - RNA, 64 nt, Human
auauaaccagguuuauccuuagucuaacugcaagggauggaaccugccccaggucacaaucauu

SEQ ID NO: 326952 - RNA, 64 nt, Human
uccuuggaaugugggagccuagaaauaacccuguggauggaauuggggcagcggcugcuggaga

SEQ ID NO: 326953 - RNA, 64 nt, Human
ucggguccuuuccguugcuauggugaaaauuccuggauggaauggaucacaugaggguuucuug

SEQ ID NO: 326954 - RNA, 64 nt, Human
agcagggguaaauguaggggggguggggauugcuggauggaaacccuggaauaggcuacuugau

SEQ ID NO: 326955 - RNA, 64 nt, Human
ggaggcagguucuugggcugcuacuccagggaguggauggaauccuugguccccuaggccagac

SEQ ID NO: 326956 - RNA, 64 nt, Human
aggucaaagacugagacucagaacuuucaaaucuggauggaauaccuugccuaacuguugcgug

SEQ ID NO: 326957 - RNA, 64 nt, Human
uugguugcuccuccuugguuugauuuuguguaauggauggaaaacgcagcauacuuggccuccc

SEQ ID NO: 326958 - RNA, 64 nt, Human
aacaaucaaaacaagcauugggggauuggggcaaggauggaaggagcaguggggcagcugccag

SEQ ID NO: 326959 - RNA, 64 nt, Human
uccccaagaacacaagaagacccauccugaacugggauggaauggcagcaugcaaacuuggauc

SEQ ID NO: 326960 - RNA, 64 nt, Human
cuucccccuugaucgacuucuugguuuucucucuggauggaacgggcaugggccucucuggggg

SEQ ID NO: 326961 - RNA, 64 nt, Human
cucccuacuccccugggcaucuucuggcuugacuggauggaaggagacuuaggaaccuaccagu

SEQ ID NO: 326962 - RNA, 64 nt, Human
aaaaauuuuuaauuggauguguuugggggcggggggauggaagugacuuggagaauguguuugg

SEQ ID NO: 326963 - RNA, 64 nt, Human
auuauucccaugaguuggcugggaauaagugccaggauggaaugaugggucaguuguaucagca

SEQ ID NO: 326964 - RNA, 64 nt, Human
ccuauugagaagacauuucgucucugagaaaaaaggauggaacuauggguucucuucgcaaagc

SEQ ID NO: 326965 - RNA, 64 nt, Human
agcaggacccuaacuaccuggccaccauggccauggauggaauggaggugagcacuccucucag

SEQ ID NO: 326966 - RNA, 64 nt, Human
gguggccugccguggccaagagcaucuucuggguggauggaacccugccuggucacauuuggcc

SEQ ID NO: 326967 - RNA, 64 nt, Human
cccagcacagcccaagauuauuuggcagccaaguggauggaacuaacuuuccuggacuguguuu

SEQ ID NO: 326968 - RNA, 64 nt, Human
aauauaaaccaccgucgugaggcauuuaccuguuggauggaagguagacagcaacaagauuuua

SEQ ID NO: 326969 - RNA, 64 nt, Human
ucaagaccucauccagcucguccaaaggcuucagggauggaaacaaaccagcucgucucagagg

SEQ ID NO: 326970 - RNA, 64 nt, Human
ugucuucccagacccaccaugccuggagaggucaggauggaacuaccucauucggcaaauuagc

SEQ ID NO: 326971 - RNA, 64 nt, Human
uagaaugccucugcugugggcuuuggguuugucaggauggaauccuacagccuccucgggggaa

SEQ ID NO: 326972 - RNA, 64 nt, Human
uccauguaguucccaccaguugccuuccccucagggauggaaggaagaggguuucuugggcugg

SEQ ID NO: 326973 - RNA, 64 nt, Human
ggguuggggggaugacggggggugggaacaagauggauggaaagggagggaaagacaagaugca

SEQ ID NO: 326974 - RNA, 64 nt, Human
ccaugcucccuuuuacauucuguguguaucuaaaggauggaaaaauaaaacgcaauuaaaaaua

SEQ ID NO: 326975 - RNA, 64 nt, Human
uagcagugcaucgcugaagcuuuuggagacuuuuggauggaagauaagauagggaagauuaagu

SEQ ID NO: 326976 - RNA, 64 nt, Human
uaucuuaguaggcucaaauguucaggaagcacagggauggaaaccucuuccuggacaugcuguc

SEQ ID NO: 326977 - RNA, 64 nt, Human
cugacagauucaccucccccacaucccuagacagggauggaauguaaauauccagagaauuugg

SEQ ID NO: 326978 - RNA, 64 nt, Human
agaugggcucccucgguuagcuccaucaacauguggauggaacccucugcuauugaugacuaca

SEQ ID NO: 326979 - RNA, 64 nt, Human
cgagaaaagaaagugaaaguuuuacaaguuagagggauggaagguaauguuuaauguugauguc

SEQ ID NO: 326980 - RNA, 64 nt, Human
gaugcuauuuguggggguuuuucucucauuauuuggauggaaucucuuuggucaaaugcacauu

SEQ ID NO: 326981 - RNA, 64 nt, Human
auuggucaguguaguugauguaaaaccguuuuguggauggaaaauauuuuuauuuuauugcucu

SEQ ID NO: 326982 - RNA, 64 nt, Human
uguuguuggccggaucaccaucugaagagcagacggauggaaaaaggaccugaucauuggggaa

SEQ ID NO: 326983 - RNA, 64 nt, Human
uuuuucauuguuaaauaggcaacaugaccagaaaggauggaauggcuuaaguaaacuaaggguu

SEQ ID NO: 326984 - RNA, 64 nt, Human
agugaccggggguguccagaaauauccugucccuggauggaaacuaggucucguuuggauuuuu

SEQ ID NO: 326985 - RNA, 58 nt, Human
cagcggcgcucccagccugaaucugccuggauggaacugaggaccaaucaugcugcaa

SEQ ID NO: 326986 - RNA, 64 nt, Human
auagagaagggcuuggcccccauggggaagacacggauggaagguggagcaaaggaaaauacau

SEQ ID NO: 326987 - RNA, 64 nt, Human
ugaggacagggccagccgcgggacugacacccugggauggaaccucaggaugggccaaacccag

SEQ ID NO: 326988 - RNA, 64 nt, Human
cagguccugucucugcacagaaacuugaacuccaggauggaauucuuccuccucugcugggacu

SEQ ID NO: 326989 - RNA, 64 nt, Human
ggacagggcaguggguguugggaguuuggggccgggauggaaguuguuucuagccacugaaaga

SEQ ID NO: 326990 - RNA, 64 nt, Human
ggugggaagguaaggauggucguggaagaaggcaggauggaacucggccucauccccgaggccc

SEQ ID NO: 326991 - RNA, 64 nt, Human
ggggcagcuucugagguugccaaaggcccccacuggauggaaccuguuagcugcuccucuccgc

SEQ ID NO: 326992 - RNA, 64 nt, Human
cccacccacauuucccuccuuagagauccaggagggauggaauguucuuuaaaauucaacaccc

SEQ ID NO: 326993 - RNA, 64 nt, Human
cagcuaaaggccaccaaggcagaacaggcagaagggauggaauuuggcuucaagaugcccaaga

SEQ ID NO: 326994 - RNA, 64 nt, Human
acagaaccaacauugugacgcccagguugcaacaggauggaauucagggacggacccagccugg

SEQ ID NO: 326995 - RNA, 59 nt, Human
ugccugcguccaagaaauaggagcuugcuggauggaaccugaauuuggacauggccuau

SEQ ID NO: 326996 - RNA, 64 nt, Human
gucugcagaacuagauuaagaaggaagagucuguggauggaaauaggaagcgugggagggucca

SEQ ID NO: 326997 - RNA, 64 nt, Human
caccuuccauggugcuuucuuggaaagaucauugggauggaaggaucauugauugggugaagau

SEQ ID NO: 326998 - RNA, 64 nt, Human
cgccuaacaugguguuguucgggaaagaaucaaaggauggaagggcucacucacuucauuaggu

SEQ ID NO: 326999 - RNA, 64 nt, Human
gucugccucucugucugagggcacccuccauuugggauggaaggaaucuguggagaccccaucc

SEQ ID NO: 327000 - RNA, 64 nt, Human
ggaaauacacuguuuugcaucaagcuggaguacuggauggaaaacucuacaauaacauuuugug

SEQ ID NO: 327001 - RNA, 64 nt, Human
acugcucagaacuugcugcugucuuguugcggauggauggaagguuggauggauggguggaugg

SEQ ID NO: 327002 - RNA, 64 nt, Human
aguaccugcuacauaccagaucuauuacaugauaggauggaaauaucaugagucacagguaacg

SEQ ID NO: 327003 - RNA, 64 nt, Human
aagggggcuuagaauuugugggguauucccaaaaggauggaaguuaagacucagagucucauua

SEQ ID NO: 327004 - RNA, 64 nt, Human
guuccuggaaucaaccaaaucauguuuuccucuuggauggaagugucaaaggcagaagggugug

SEQ ID NO: 327005 - RNA, 64 nt, Human
ugcagguuugggagaggaggccuauugggcucuuggauggaacccuuucccguauuaaacaaac

SEQ ID NO: 327006 - RNA, 64 nt, Human
uaacgugcggucauaccuuucuucguugugguggggauggaagagcagagggagcauggcccag

SEQ ID NO: 327007 - RNA, 64 nt, Human
gcagggucaccaacccagaucuccaggcccaugaggauggaacaugaaaggagccgacaaaagu

SEQ ID NO: 327008 - RNA, 64 nt, Human
uguauauauauuuauauaagaucuaccuaucuuaggauggaaccuuggggaaaaauaaaauuga

SEQ ID NO: 327009 - RNA, 64 nt, Human
ggccuuggucauggauaggggaagagggaugaugggauggaaugggagggugggaucuagauga

SEQ ID NO: 327010 - RNA, 64 nt, Human
guggcucucccguugcagaggccacaggaagauaggauggaacgugacuggucuccuaaccaag

SEQ ID NO: 327011 - RNA, 64 nt, Human
aauggaugugggugaccgcccgaaggccuucacaggauggaaguagaaugauuucaguagauac

SEQ ID NO: 327012 - RNA, 64 nt, Human
guggcucagccagcacuuguccagcugagcgccaggauggaacacggccacaucaaagaggcug

SEQ ID NO: 327013 - RNA, 64 nt, Human
uucuaaugaguaacaucuacuuaguuagccuuagggauggaaaaacagggccacuuaccaaacu

SEQ ID NO: 327014 - RNA, 64 nt, Human
guggggcucuuguccuguccuguguuccucguggggauggaacgauccugcguggggcccuguu

SEQ ID NO: 327015 - RNA, 64 nt, Human
caggcuggaggaccagccgcccuccuucccuccuggauggaaguaaaaagccaagcuuucuccc

SEQ ID NO: 327016 - RNA, 64 nt, Human
ggggagagaagcagagggagagagaaggugacacggauggaagagugggaaggagcuggccugg

SEQ ID NO: 327017 - RNA, 64 nt, Human
gaguucaaauagucuugaaggggaaucagcuucaggauggaaggacccaggagaggccccgagg

SEQ ID NO: 327018 - RNA, 64 nt, Human
aaugacuuucccugcuguuaccuaauuacaaauuggauggaacuguguuuuuuucugcuuuguu

SEQ ID NO: 327019 - RNA, 64 nt, Human
cugggcccaccuagccuuucccugcugcccaacuggauggaaaauaaaagguucuuguauucuc

SEQ ID NO: 327020 - RNA, 64 nt, Human; identical to SEQ ID NO: 327019

SEQ ID NO: 327021 - RNA, 64 nt, Human
cacaccugucuccuccugccugggguggccauggggauggaaggggguggaauaaaaccuguca

SEQ ID NO: 327022 - RNA, 64 nt, Human
ccuuucugggaccucaaugggucacaaucccauuggauggaaaggacuuggcuaugaacuugac

SEQ ID NO: 327023 - RNA, 64 nt, Human
aguuugaugaguggaagauagagaggggccucugggauggaaggcugucuucuuuugaggauga

SEQ ID NO: 327024 - RNA, 64 nt, Human
acuggggcccauccaaguuuguucugccaccacuggauggaaaauuggaaauggacugggcgug

SEQ ID NO: 327025 - RNA, 64 nt, Human
auugaaaaaauauauuuaguuuuuaaaauauuugggauggaacucccuacugaccucugagaac

SEQ ID NO: 327026 - RNA, 64 nt, Human
cccccuccucucccuucacccagacacgugguagggauggaaaaggauucuucacagagcacuc

SEQ ID NO: 327027 - RNA, 64 nt, Human
ggauggcaagagauccagcuagagagguauucagggauggaaagaggacuuugaguuuuaucca

SEQ ID NO: 327028 - RNA, 64 nt, Human
cauacuucucaccucuacuuagcccauucuuguaggauggaaauauuugagaacuacugaguua

SEQ ID NO: 327029 - RNA, 64 nt, Human
caaagaccaaggagaaacaaggacauaugcuguaggauggaacagguuauugcugaagcucccu

SEQ ID NO: 327030 - RNA, 64 nt, Human
aguguuuuuccugaccucuguucuuuggagaggaggauggaagggagggguccggcacgcugcu

SEQ ID NO: 327031 - RNA, 64 nt, Human
accuugggaggggaaggggcagugguggcuggggggauggaauugagagggagacaacuguauc

SEQ ID NO: 327032 - RNA, 64 nt, Human
agugucaaaaauucaggggcaguuaaggagucauggauggaacuagaggucacuauauuaagug

SEQ ID NO: 327033 - RNA, 64 nt, Human
uaaaaagaaacuaaagaucacauuuuaccuguauggauggaauaucccuuuucuucaagugcag

SEQ ID NO: 327034 - RNA, 63 nt, Human
ggucagccggguaucaaaagccaugaaacugugucucuguagcaaugagugauacugugacaa

SEQ ID NO: 327035 - RNA, 63 nt, Human
acucucgcugucccugugcugcugguauuucauucucuguaacuucaguucugguguuuuccu

SEQ ID NO: 327036 - RNA, 63 nt, Human
cuauugugauuuugaugaagacagaauuauuuuucucuguagaaacacagauaccacuuuauc

SEQ ID NO: 327037 - RNA, 63 nt, Human
gauaucgccccucuuggugcgaugcuguacaggucucuguaaaaaguccuugcugucucagca

SEQ ID NO: 327038 - RNA, 63 nt, Human
guccuggcuagggcaaauuuuagacaacuauuuucucuguaagugaagauugucguauuccaa

SEQ ID NO: 327039 - RNA, 63 nt, Human
uaagcccccgggaggccuggacugucuuccucaucucuguagcaccaagccugauagaucugu

SEQ ID NO: 327040 - RNA, 60 nt, Human
aacacaggcccaggcucugagugggccugcucucuguagacugaauucagcaccagugaa

SEQ ID NO: 327041 - RNA, 63 nt, Human
ugaggccaggaguuugagaccagugugaccuugucucuguaaaaaauaaaauuaaaagaaaaa

SEQ ID NO: 327042 - RNA, 63 nt, Human
accaucuuugaauauauuucauagaaaucuagcucucuguacccugaaaucuuccacuagccu

SEQ ID NO: 327043 - RNA, 63 nt, Human
ucuaauaacugagagcgauggggcuauauugaaucucuguaugcacugagaacugagcuauga

SEQ ID NO: 327044 - RNA, 63 nt, Human
uuuugugauauucuaucacaaacacuuauuguaucucuguaaaauacaauguauguaugcaug

SEQ ID NO: 327045 - RNA, 63 nt, Human
uggagauuuuuccucugcguagagccauccagaucucuguauccuguuuugacuaagucuuag

SEQ ID NO: 327046 - RNA, 63 nt, Human
cugcuuuguguuagaauaggacaccccgcagcuucucuguaguggcucugucacagucaaaaa

SEQ ID NO: 327047 - RNA, 63 nt, Human
gagaaaaaacugaaaaagaugcugcuaaguaguucucuguauuaaaggagauauuuuuaaaac

SEQ ID NO: 327048 - RNA, 63 nt, Human
accucaaccuaugguauaaugguugacuggguuucucuguauaguacuggcaugguacggaga

SEQ ID NO: 327049 - RNA, 63 nt, Human
uuucguucuguuuuguuucacugugcagagauuucucuguaagggcaacgaacgugcuggcau

SEQ ID NO: 327050 - RNA, 63 nt, Human
cuuuuccaagcuucaacuuaacuuaacuacauuucucuguaugaugaugucucuuacuucuac

SEQ ID NO: 327051 - RNA, 63 nt, Human
uugagaauugccaucggucauguguugcaccguucucuguauguuuacguccuuuggacuggc

SEQ ID NO: 327052 - RNA, 63 nt, Human
ugccucuugcugccauucuuucucuccucugcuucucuguauuuuucuucuguuaucccuggg

SEQ ID NO: 327053 - RNA, 63 nt, Human
uucucucugacuccuggaagaauacuccuguaaucucuguaaagguuuuugggggauaagggu

SEQ ID NO: 327054 - RNA, 63 nt, Human
gggcaauaucuauauuccuacagugacuauuuuucucuguagagagccucccuucuguuguag

SEQ ID NO: 327055 - RNA, 63 nt, Human
acuagguguuguaauucaguuaugaagcuauuuucucuguaacaauaaagcuuuuuauuccug

SEQ ID NO: 327056 - RNA, 63 nt, Human
agacaggguucuuuucagcagagucuaguaguuucucuguaaggcaaaauaaucuaaaaagac

SEQ ID NO: 327057 - RNA, 63 nt, Human
ucuauucauuugcuccuuuauucuuuccuguauucucuguauguccagcacuuuguagccaug

SEQ ID NO: 327058 - RNA, 63 nt, Human
cucagggacguagaacaauggaaugucagucagucucuguaguuaaaacuuuuucuuuaaaau

SEQ ID NO: 327059 - RNA, 63 nt, Human; identical to SEQ ID NO: 327058

SEQ ID NO: 327060 - RNA, 63 nt, Human
aauguacgugcuggugcacucugcuaguuguuaucucuguagggcucaggaagcuggaaggag

SEQ ID NO: 327061 - RNA, 63 nt, Human
ccaaacuguccauuccagcagcuccugcccccuucucuguacuugcuucugucugacaccuuc

SEQ ID NO: 327062 - RNA, 63 nt, Human
cuucugcugucucuccuaccugucuucuggcucucucuguacccuuccuggugcugccgugcc

SEQ ID NO: 327063 - RNA, 63 nt, Human
ugaauauuucaaauugcacacgucacuccagcaucucuguaaaauaauuggaaugaaaauacu

SEQ ID NO: 327064 - RNA, 63 nt, Human
caagagacuauuaaagcccauugcuuuaucugcucucuguaggguucagguacacuggcuaag

SEQ ID NO: 327065 - RNA, 63 nt, Human
uguucugcuuauaauuaaacugaauguagaguaucucuguauguuaauugcaauuacugguug

SEQ ID NO: 327066 - RNA, 63 nt, Human
acucugucccugcugaaaauagcugggccagugucucuguagcccugacauaaggaacagaac

SEQ ID NO: 327067 - RNA, 63 nt, Human
uuuaauguuaugggcagcuaccaauuuguggugucucuguauauuuuuguaaagauucucauu

SEQ ID NO: 327068 - RNA, 63 nt, Human
gcuugucugcaguauauacauuuaauuuaucugucucuguauaugaggcuucccccugggguc

SEQ ID NO: 327069 - RNA, 63 nt, Human
agcacuauggugguggguccagcacuauggugcucucuguaaugccucuuacugccuuaaguc

SEQ ID NO: 327070 - RNA, 63 nt, Human
aaugcauuggcuuuuugugcagauacaaccugcucucuguacugcuguuggacagucaguguu

SEQ ID NO: 327071 - RNA, 63 nt, Human
caucaaaaagcuuuaagugccuaacccugcuugucucuguacauagaagccugcacagaucca

SEQ ID NO: 327072 - RNA, 63 nt, Human
uucauuuucagaaaacucuuaagcucucuucagucucuguaauguuucugauugcauguuucu

SEQ ID NO: 327073 - RNA, 63 nt, Human
caccuagccugaugagauuuuuaaaaaauauuuucucuguacuuuucauucucuuuuaaugag

SEQ ID NO: 327074 - RNA, 63 nt, Human
cuuccuagccuaagcugggaucugaauaccccuucucuguagcugcuagugagccuucccauu

SEQ ID NO: 327075 - RNA, 63 nt, Human
uguucagacugauugccccucaccugaauccacucucuguauucaugcucuuggcaauuucuu

SEQ ID NO: 327076 - RNA, 63 nt, Human
gaaaagccuugccuuccccagggauuggccuggucucuguauucacuggauccauaauggguu

SEQ ID NO: 327077 - RNA, 63 nt, Human
agagacauucacaucuuugcuuuuauucuaugcucucuguacuuuugaccaaaaauugaccaa

SEQ ID NO: 327078 - RNA, 63 nt, Human
ugauccaagugugaucgaaagcuguuaaugugcucucuguauaaacaauuugcuccaaauauu

SEQ ID NO: 327079 - RNA, 63 nt, Human
cacacucuucacuuuccuuuccaccuuauucauucucuguacuuaccacaguauuuugcacuu

SEQ ID NO: 327080 - RNA, 63 nt, Human
accuucccccugcagcuacucuucagaucuggcucucuguacccuaaaaccuaguaucuuuuu

SEQ ID NO: 327081 - RNA, 63 nt, Human
gggagugauggagaugcauacagaucagcaccuucucuguaccugcuggacccccaugugcac

SEQ ID NO: 327082 - RNA, 63 nt, Human
ccccuuuguggcccaggauaaucaacacuguucucucuguaccaugagcuccuccaggagauu

SEQ ID NO: 327083 - RNA, 63 nt, Human
ucacugaugaacuagugauguagaaaagagacuucucuguaaguaauugccacagcuguauuu

SEQ ID NO: 327084 - RNA, 63 nt, Human
guguccccgggcugcaccccuuccucuucucuuucucuguacagucucaguugcuugcucuug

SEQ ID NO: 327085 - RNA, 63 nt, Human
aagacucuguacugcucauauuacacuccauccucucuguaguuugcuggguaguggaggggg

SEQ ID NO: 327086 - RNA, 63 nt, Human
acugcuuuauguacucuuugggcauuaaugccuucucuguaauuauaucucguuuuugcuuga

SEQ ID NO: 327087 - RNA, 63 nt, Human
uuuuaaaguagugguuugauauugauuuuauaaucucuguaaaaaugaagauaaaaagccaga

SEQ ID NO: 327088 - RNA, 63 nt, Human
gaaaaauuaaggccucacaggaugagucuccauucucuguaaaugcuuauuuuaucauagucu

SEQ ID NO: 327089 - RNA, 63 nt, Human
guuggcaccagaacuuaaagcgaugacuggaugucucuguacuguauguaucugguuaucaag

SEQ ID NO: 327090 - RNA, 63 nt, Human
ucgaccucuuguugaacugaaaacuuaauuuuuucucuguauuuuuguuacaaagccacugau

SEQ ID NO: 327091 - RNA, 63 nt, Human
caaaaaagaaaaccccagucacgauuugcauguucucuguaagcuucauccaugcugguuauu

SEQ ID NO: 327092 - RNA, 63 nt, Human
uagccacaugacuguggcauugcacaaauacagucucuguagggauuuuaaaagauuucagac

SEQ ID NO: 327093 - RNA, 63 nt, Human
cuucagcuccaugcagagcuacagcaugauaugucucuguaaagugaucagcaguugcagcgu

SEQ ID NO: 327094 - RNA, 63 nt, Human
cuucuggaaagcuaucaguuucaaauaauauuuucucuguaguaugagaugaaauuaaaagug

SEQ ID NO: 327095 - RNA, 63 nt, Human
agugguuucuuaacucuccaaaauaagauuucuucucuguagccuacuugucugguuuauccc

SEQ ID NO: 327096 - RNA, 63 nt, Human
uauucaugugugugugucuuugcugcuuugaguucucuguaucuacuguguaugugaaugguc

SEQ ID NO: 327097 - RNA, 63 nt, Human
gaauccuuaagggcauggacuguaucuuaugcaucucuguauuucugcgccuagcacggugcc

SEQ ID NO: 327098 - RNA, 63 nt, Human
aaauuaaugcugauucuuugugugugugggaaaucucuguagagcaccuuuucuuucuuagac

SEQ ID NO: 327099 - RNA, 63 nt, Human
acgauguaauuauuucggggcucugcggaaccuucucuguacagcgcccccuuucuguugugc

SEQ ID NO: 327100 - RNA, 63 nt, Human
caggggagaucucagggccucuguugggaggaaucucuguaauuccugcuugggcuccaaauu

SEQ ID NO: 327101 - RNA, 63 nt, Human
cuguguguuucaggcauucacagauaaacucauucucuguacuucuaggguagcaucuuuaug

SEQ ID NO: 327102 - RNA, 63 nt, Human
guaaggaaugaacuccuacccuucuugggucauucucuguacugaugcguuagucuuauaaua

SEQ ID NO: 327103 - RNA, 63 nt, Human
aucuuugcaguacaacaccucuaugcacuucuuucucuguagcacauguuaccuuucuuugug

SEQ ID NO: 327104 - RNA, 63 nt, Human
gcuugucucauaauacccacagcuaggacauucucucuguaauuaugaauuguccuuguuuua

SEQ ID NO: 327105 - RNA, 63 nt, Human
uguucagugccauuuuauacuuucucucuguguucucuguauuguacuaaccaaccucccaaa

SEQ ID NO: 327106 - RNA, 63 nt, Human
uuguuuguacaguaauauguuuaauguucauuuucucuguaugaaugugauugguaacuagga

SEQ ID NO: 327107 - RNA, 63 nt, Human
guaaauguuaggaagcaaaguagcuuugaauuuucucuguaagagaauaaaagauaaaauaau

SEQ ID NO: 327108 - RNA, 63 nt, Human
cggacuccacuuuuaauuugcucuuagguucuaucucuguagaaugucuccaagauugaagaa

SEQ ID NO: 327109 - RNA, 63 nt, Human
guuauagaaaucuggaaauaagaaaggaagagcucucuguauucuauaauuggaagagaaaaa

SEQ ID NO: 327110 - RNA, 63 nt, Human
ugauugauuuuaagaggauggauaacacaguuaucucuguaauguucugucccaguaugucuu

SEQ ID NO: 327111 - RNA, 63 nt, Human
cuaucaaacccccaagaugcugaugauaggccuucucuguaagaauccuucucauagugaagc

SEQ ID NO: 327112 - RNA, 63 nt, Human
uugaagaagaaggagucagccaucgccaacuugucucuguagaagcuccggguguagauuccc

SEQ ID NO: 327113 - RNA, 63 nt, Human
ucuuuacaaaauuucuuauauauaauauguguaucucuguaauaauagagcccuucuuuugaa

SEQ ID NO: 327114 - RNA, 63 nt, Human
cucugggaaaacuuacggaaauacacaaaugcuucucuguaaugugcaauaugcuuugcaacu

SEQ ID NO: 327115 - RNA, 63 nt, Human
uccuguucgugcuuguaaugcucacuuauguuuucucuguauaacuugugauuccagggcugu

SEQ ID NO: 327116 - RNA, 63 nt, Human
aagaccuuuaagacaauaaaagauuguaggcuaucucuguaaucaugcaauagcuguucggau

SEQ ID NO: 327117 - RNA, 63 nt, Human
guuggguccuugucuugugagccuggggugagcucucuguacauguuguuguuccacguaugg

SEQ ID NO: 327118 - RNA, 63 nt, Human
gguuauuuaugcacugugggauguguucuucuuucucuguauuccgauacaaaguguuguauc

SEQ ID NO: 327119 - RNA, 63 nt, Human
ugcccuggcuuccucacuuggggagaccaugggucucuguagaaauuccaauauaaaggcagg

SEQ ID NO: 327120 - RNA, 63 nt, Human
uaaaauaaacacugacauuuuucuugcuuguucucucuguacucaaaccuguggcaaauucau

SEQ ID NO: 327121 - RNA, 63 nt, Human
uccccagaggcaaucacugcuacugguuguguaucucuguagauacucuuuguauacaagugu

SEQ ID NO: 327122 - RNA, 63 nt, Human
aggcaggguuuccuccuuagacacugacagcauucucuguaccccuucaaauccuuacucucc

SEQ ID NO: 327123 - RNA, 63 nt, Human
uuuuuuaacauuuuaagcagacugcuaaacuguucucuguauaaguuaugguaugcaugagcu

SEQ ID NO: 327124 - RNA, 63 nt, Human
uucuucuuauugguguugauaguaugucuguaaucucuguauaaacuuugucaacauuuuuac

SEQ ID NO: 327125 - RNA, 63 nt, Human
gaagacaacuggagugguacuuacugaagaaacucucuguauguccuagaauaagaagcaaug

SEQ ID NO: 327126 - RNA, 63 nt, Human
aaccuuccagaaucaauaauccguggcaacauaucucuguaaaaacaaacacuguaacuucua

SEQ ID NO: 327127 - RNA, 63 nt, Human
caaggaaaccgaagaaaccaucauccacuuuucucucuguaucauucugauuuuaguauaugu

SEQ ID NO: 327128 - RNA, 62 nt, Human
cugaagacaguacagauuagugugcacagagaucucuguagaaggaguagcugcccuuucuc

SEQ ID NO: 327129 - RNA, 63 nt, Human
uaaccuguccugugcccuacccuuaaggaauacucucuguaguaggcuguuguuauauuagac

SEQ ID NO: 327130 - RNA, 63 nt, Human
aaugcuguggaacaaauacaaagugaaaaaaguucucuguagauuucugaagugcauauucau

SEQ ID NO: 327131 - RNA, 63 nt, Human
agugaaugaguggccuucugaugcucugacucuucucuguaugucaaacucaucccuggcaca

SEQ ID NO: 327132 - RNA, 63 nt, Human
auuguauucauuacuagauaaaauguauaaagcucucuguacuaaggagaaaugacuuuuaua

SEQ ID NO: 327133 - RNA, 63 nt, Human
ugccacuguuauuagauugacaagauguuaauuucucuguagguuguaacuuuaaaaauaaau

SEQ ID NO: 327134 - RNA, 63 nt, Human
caaaacgccauugccuuccgcagagaccagagaucucuguacuucaaggacagccuuggcugg

SEQ ID NO: 327135 - RNA, 63 nt, Human
uuaguuuaaugacugaaaaaguagguugaaagcucucuguauuuuaguuaacaccuugaauaa

SEQ ID NO: 327136 - RNA, 63 nt, Human
caauauuuaucaaauccaaauagcaugaaugcuucucuguaguaauacuaauuuugugccuuu

SEQ ID NO: 327137 - RNA, 63 nt, Human
cagggagaacaugaaaccagagguuucuuucuuucucuguaaucugcuaugaaagaaaauaac

SEQ ID NO: 327138 - RNA, 63 nt, Human
uggcacugagaaagccaaugaccgaaucucuuuucucuguaaaaauguagacugaaaagccau

SEQ ID NO: 327139 - RNA, 63 nt, Human
uuguauuuguguguugagaugggccuugugguuucucuguacucagagcacauuucuuguaau

SEQ ID NO: 327140 - RNA, 63 nt, Human
auugaugaaugaggaacaaucacaaaagcugugucucuguauauagcucuacacaacauguau

SEQ ID NO: 327141 - RNA, 63 nt, Human
cuguucuaugaaauacugugaaacaauaagguaucucuguauguacugauaucaaaacaucuc

SEQ ID NO: 327142 - RNA, 63 nt, Human
auuuuaaaaauacuuuuuaccaaaggugcuauuucucuguaaaacacuuuuuuuuggcaaguu

SEQ ID NO: 327143 - RNA, 63 nt, Human
uauucuaccucucucucaauuuucuuuuucuuuucucuguauccucaucguuagccacacaca

SEQ ID NO: 327144 - RNA, 63 nt, Human
cagauuaugaguucuguggaaucaggaaguaugucucuguauucuuguauucuuuggcuuuuu

SEQ ID NO: 327145 - RNA, 63 nt, Human
ucagccgagaugacgcugccgggagagcagucuucucuguaguccccggaggggacuccucgg

SEQ ID NO: 327146 - RNA, 63 nt, Human
agcguugacagcuuggaagcguuuauuuauacaucucuguaaaaggauauuuuagaauugagu

SEQ ID NO: 327147 - RNA, 63 nt, Human
auuguuacuugccuuucucacccaguuaaucagucucuguacuuguuucccuuuuugaaacaa

SEQ ID NO: 327148 - RNA, 63 nt, Human
uuuaguacugcuuuuaucuaucaucugucaauuucucuguauucuuaauaaaauaaauauuga

SEQ ID NO: 327149 - RNA, 63 nt, Human
agcucuugacucuguuucccuuaaugauacaagucucuguaccagcgcuuuauguuaauuacc

SEQ ID NO: 327150 - RNA, 63 nt, Human
gcaaaaugcacacccuuuuucuguggcaaaucgucucuguacauguguguacauauuagaaag

SEQ ID NO: 327151 - RNA, 63 nt, Human
cuuucuggagugauaaucuggugacaaauauucucucuguagcuguaagcaagucacuuaauc

SEQ ID NO: 327152 - RNA, 63 nt, Human
gaaauuacacacacaguauauuguaaauucuuaucucuguauacuguacuucuacauacaaau

SEQ ID NO: 327153 - RNA, 63 nt, Human
auaguuuugcuguugcuccuagugaaagaaaaaucucuguacaaaggagaaaaagaaccccac

SEQ ID NO: 327154 - RNA, 63 nt, Human
caccccccaccccacugucgugguggccccagaucucuguaauuuuauguagaguuugagcug

SEQ ID NO: 327155 - RNA, 63 nt, Human
gccuuaauuugcauaaaucauaaauguauguccucucuguaauuguuuuaaugugugcuugaa

SEQ ID NO: 327156 - RNA, 63 nt, Human
ugccacacacagcuaauauucuaaugguaaauuucucuguaucagguggggaaaugugcugaa

SEQ ID NO: 327157 - RNA, 63 nt, Human
agacuucuuugaaaauauacaugcuguugacccucucuguagaaaaccgcacacauaaaacuu

SEQ ID NO: 327158 - RNA, 63 nt, Human
ucuguauuuagcuuucuaauccucaucuuuuucucucuguauaucacuucuuacauauuaaau

SEQ ID NO: 327159 - RNA, 63 nt, Human
ugccccuaccuguucuccccuccaggccaccugucucuguaaaggaugucugcucuguucaaa

SEQ ID NO: 327160 - RNA, 63 nt, Human
auguuucuaaguauauugauuacauuuucaacgucucuguaaaagcaguuuaugaggaauuuc

SEQ ID NO: 327161 - RNA, 63 nt, Human
auguuucuuauucauuaaaugaauucaacauuuucucuguaaaaacaauagaguuucaguaca

SEQ ID NO: 327162 - RNA, 63 nt, Human
ucuuccacagucaggucaauuuugucaaacccuucucuguacccauacagcagcagccuagca

SEQ ID NO: 327163 - RNA, 63 nt, Human
cuguuuuccaaacaccaccuuuuugccucaaggucucuguaaaugaaauaaacuguaauuuac

SEQ ID NO: 327164 - RNA, 63 nt, Human
cauucacaggaaaaugugagcuuaucaguucuuucucuguauuuuaaaucuaagucugugggc

SEQ ID NO: 327165 - RNA, 63 nt, Human
aagucauacuuaggaauuucuccuacuuuacacucucuguacaaaaacaaaacaaaacaacaa

SEQ ID NO: 327166 - RNA, 63 nt, Human
uauauuauagaacaugauauauauuuacauucaucucuguauucucucagcuguuguuagaag

SEQ ID NO: 327167 - RNA, 63 nt, Human
aauuaaauccacuaaaauguaauggcaugaaaaucucuguagucugaaucacuaauauuccug

SEQ ID NO: 327168 - RNA, 63 nt, Human
auauguaauuaaaguacaacauaauauguuguuucucuguagcccguugagcauaugaguaag

SEQ ID NO: 327169 - RNA, 63 nt, Human
cauauucuuuaaaaaaaaaaagcuggauaauauucucuguaauauuucaguccuuuacaagcc

SEQ ID NO: 327170 - RNA, 63 nt, Human
cuuuucaaaagacuugacaagaaaucuucauauucucuguagccuuugucaagugaggaaauc

SEQ ID NO: 327171 - RNA, 63 nt, Human
ugcuuugaccuccuugaacuuuuccaagcaauuucucuguacuucuauauaugaaugucuuag

SEQ ID NO: 327172 - RNA, 63 nt, Human
ucuauuuucuuaccacuugguuggcucccuuugucucuguaccuuuaccaacauuaggaucuc

SEQ ID NO: 327173 - RNA, 63 nt, Human
aaacuguacagauuuuuguauagcugauaagauucucuguagagaaaauacuuuuaaaaaaug

SEQ ID NO: 327174 - RNA, 63 nt, Human
uagcuugguuuguuucccuaacuucugauuaacucucuguaugacaacucuacagaaguugug

SEQ ID NO: 327175 - RNA, 63 nt, Human
ucacauccucuuuugccaggcuggaugcugucgucucuguacacaaauacuuucugcauuccc

SEQ ID NO: 327176 - RNA, 63 nt, Human
ggcuccccagucuccucuccugaucuccuccaaucucuguagcccaagaugugaaagccagac

SEQ ID NO: 327177 - RNA, 63 nt, Human
aaaaauguugucaccaaguuauauaaauccacaucucuguaaacaaccuuuuuuaaguaauuu

SEQ ID NO: 327178 - RNA, 63 nt, Human
uucuuaaccucaacuuuuguagaaguauuuuuuucucuguaauauuuuuauuggcucauaaag

SEQ ID NO: 327179 - RNA, 63 nt, Human
aaauuuaaaauaagcuauauuauacaaauacuaucucuguauuguucugacccugguaaauau

SEQ ID NO: 327180 - RNA, 63 nt, Human
cucagauuuuucauuguggguuaaaaaugggugucucuguacuaguauuguauuuauucaauu

SEQ ID NO: 327181 - RNA, 63 nt, Human
acauguucaucugcugucuugugauuaaaaucaucucuguagugaccacguauauuuucaagg

SEQ ID NO: 327182 - RNA, 63 nt, Human
agaagccuaagcuuggcuuuaauuuucuuguacucucuguacuccucaagcacuggaacacga

SEQ ID NO: 327183 - RNA, 63 nt, Human
aauugaaaacgccauguggcaccacaaaagagcucucuguacuuuccccaugcugccucaaaa

SEQ ID NO: 327184 - RNA, 63 nt, Human
caucauaguauacauuggcgguaucuagcccuuucucuguaaaauaucccuauguuuaaucug

SEQ ID NO: 327185 - RNA, 63 nt, Human
cauaguuguguuaagcuugcguagaauugcaggucucuguacgggccaguuucucugccuucu

SEQ ID NO: 327186 - RNA, 63 nt, Human
aagggcguguggccaucgugucagcagagagagucucuguacacagccccgugaacccugagg

SEQ ID NO: 327187 - RNA, 63 nt, Human
aaggccauauggccaucgugucagcagagagagucucuguacacagccccgugaacccugagg

SEQ ID NO: 327188 - RNA, 63 nt, Human
guguacuuuacugggcucucccugcacgcauuuucucuguaguuacauuuaggauaaucuuua

SEQ ID NO: 327189 - RNA, 63 nt, Human
accuaaaccagacuggauggaaacuuccugcccucucuguaccuuccuacuggagcuugaugu

SEQ ID NO: 327190 - RNA, 63 nt, Human
agcaaauuuauucuuucgaagauuucauuuaaaucucuguacuaugcauuuuuguuucaguuu

SEQ ID NO: 327191 - RNA, 63 nt, Human
aaauuaccaaucaggcacauuuuauaauguuugucucuguaaagguaauauuagcaguuaaag

SEQ ID NO: 327192 - RNA, 63 nt, Human
ucuuucuucccaaaggcaugugcucacuucaugucucuguaucaauugucauaauuuucgcaa

SEQ ID NO: 327193 - RNA, 63 nt, Human
aauucaguuccuugguccuuggaagaccuauauucucuguaguuacugaaaaccgaaagucaa

SEQ ID NO: 327194 - RNA, 63 nt, Human
uuuuaaaacagugcuuaguacaauauccugccaucucuguaaaaacgcuaauugauaaccgag

SEQ ID NO: 327195 - RNA, 63 nt, Human
gacguccugagccucccugugacgcucuggccuucucuguaccucagagugcagaaccacaga

SEQ ID NO: 327196 - RNA, 63 nt, Human
aaggagcucucugugaccuagcggccauuuauuucucuguagcccuaugauggcuacugugag

SEQ ID NO: 327197 - RNA, 63 nt, Human
aaagaagaaagaaugaauaauacgagcagacauucucuguagaagguaauggucugagaauga

SEQ ID NO: 327198 - RNA, 63 nt, Human
cuguaaaacuucacugcaguggccacuucugaaucucuguaagguuuauuuaucuucacccuc

SEQ ID NO: 327199 - RNA, 63 nt, Human
ucccucccgccagcuccacgauuuuucgguguuucucuguacauaguuuucuggcgggauagg

SEQ ID NO: 327200 - RNA, 63 nt, Human
cugaacuguaaugaaaauguuauuuaaucuuugucucuguauuuugauacuugaaugacuuuc

SEQ ID NO: 327201 - RNA, 63 nt, Human
aagacaaaauauaaaggcuagaauuugguuccuucucuguaacacuaaauauuuuagugugaa

SEQ ID NO: 327202 - RNA, 63 nt, Human
cauuuguguguuacaauguaacuuugguuaaaaucucuguagauaaugaaaaaaaacaaaaaa

SEQ ID NO: 327203 - RNA, 63 nt, Human
uagguaaaagauaccuuuuguaaaguugucaucucucuguaauagauaauggcugacuggacc

SEQ ID NO: 327204 - RNA, 63 nt, Human
uauccucugcagaaauuccuagacgccuucacuucucuguauucuuccucauacuugccuacc

SEQ ID NO: 327205 - RNA, 63 nt, Human
cuucuuucgugguaguucuuuuauuuuuauuaaucucuguauccuuagauaguccuccaacaa

SEQ ID NO: 327206 - RNA, 63 nt, Human
gaaaggucccucugugguuaucuguuagaacagucucuguacacaauuccuccuaaaaacauc

SEQ ID NO: 327207 - RNA, 63 nt, Human
cuggaagcaucuuuagcuuugacuuugggcaagucucuguacuuuucuggccagcuuuuccag

SEQ ID NO: 327208 - RNA, 63 nt, Human
gacccccagggccgcucggucacgcugcgcagcucucuguaccgggcggggggcgccuacggg

SEQ ID NO: 327209 - RNA, 63 nt, Human
ccaccugccuuggccugagccucucucccugugucucuguauccccuggcuuuacagaaucgu

SEQ ID NO: 327210 - RNA, 63 nt, Human
gugucugugucugugugugccugugagccagcaucucuguaucaguguugcucaugcuguguc

SEQ ID NO: 327211 - RNA, 63 nt, Human
gaaacugaaacugggugagggcuaucuaggaauucucuguacuaucuuaccaaauuuucggua

SEQ ID NO: 327212 - RNA, 63 nt, Human
uuugguuguaauuaaauuuuuaaaaucugcugaucucuguagaaucuuagaggcuugaugaug

SEQ ID NO: 327213 - RNA, 63 nt, Human
uuuauuuauacugucuuguuuuguacacacauuucucuguagugggcucugaauacauugaaa

SEQ ID NO: 327214 - RNA, 63 nt, Human
aauguauuuagaaacaggaauccucagagcaauucucuguauucucauauaauuucaauguaa

SEQ ID NO: 327215 - RNA, 63 nt, Human
augcaugugugggggcagagguuaugugggaaaucucuguaccuuccucuccauuuugcugug

SEQ ID NO: 327216 - RNA, 63 nt, Human
uaaacaccaugaagaugccauugacaagguguuucucuguaaaaugaacugcaguggguucuc

SEQ ID NO: 327217 - RNA, 63 nt, Human
guguggcauuccuuuagcuggggauuagcuuaaucucuguacauuuuucucauuucuaauuga

SEQ ID NO: 327218 - RNA, 63 nt, Human
ucaauauaaaauaugacuucuucacauacagauucucuguaguguuugcauguuucuuggugu

SEQ ID NO: 327219 - RNA, 63 nt, Human
cauuuucaaaccaaaugaguacuuauauauggaucucuguagacuagagucuugcagcaacac

SEQ ID NO: 327220 - RNA, 63 nt, Human
aaauugcugagaucccacggagucuuucaaaaaucucuguagaguuagucuucuccuuuucuc

SEQ ID NO: 327221 - RNA, 63 nt, Human
ugauuuuguuugauuucccucugcagcacagcgucucuguaaagguuuuuaugcuuucaccag

SEQ ID NO: 327222 - RNA, 63 nt, Human
caagcauauaucugcuuuuuuuuauuuugcaauucucuguauucuaugucuuuaaaaauuuga

SEQ ID NO: 327223 - RNA, 63 nt, Human
uauugaaacuggugaguucugauuauuaaauauucucuguaaaucaguaaacauguauaaagu

SEQ ID NO: 327224 - RNA, 63 nt, Human
gagcuccuugagagcagaacggugucuucauuaucucuguauccccaaggcuuugcacagugc

SEQ ID NO: 327225 - RNA, 63 nt, Human
caggagaacaggaguuugaugaugcaaaguugaucucuguacauuuaagugaaaagucuuuau

SEQ ID NO: 327226 - RNA, 63 nt, Human
gaugaguuauuugccucugaguuucagaugaccucucuguagggacacuguguuaucaaccau

SEQ ID NO: 327227 - RNA, 63 nt, Human
ugcagaaccagggcucccguuuaucuugugcuaucucuguaguauuuucauuugagagaggag

SEQ ID NO: 327228 - RNA, 63 nt, Human
uuggccuuuccugaaagugacuuaucugacacaucucuguagccacaugcuuuuuggguagaa

SEQ ID NO: 327229 - RNA, 63 nt, Human
uggaaaguaagugggauacuuggaaucaaggcaucucuguaguacagucuucuuuauuuuuua

SEQ ID NO: 327230 - RNA, 63 nt, Human
uaaaugagaagccaagcucuucaagcaccucuaucucuguacuccuauaugaagagaacagua

SEQ ID NO: 327231 - RNA, 63 nt, Human
gccacauauacauuuuuaaggaaaaaagauuuuucucuguaagaaaguucugguuaugcuguu

SEQ ID NO: 327232 - RNA, 63 nt, Human
acuuuaagaaaaaacaaauaauuguugcagaggucucuguauuuugcagcugcccuuuuguaa

SEQ ID NO: 327233 - RNA, 63 nt, Human
aaauugcugggauuacuccccgugcccggccacucucuguacuuuaaacauuucgcuauacuc

SEQ ID NO: 327234 - RNA, 63 nt, Human
guaguuuauaauucuaguugaugaauuuuuuucucucuguacuuuauuuaauuuauuauuauu

SEQ ID NO: 327235 - RNA, 63 nt, Human
agguaaccacaauuacaaaauggcaaaacauuuucucuguauucauuguuguauuuuucuaca

SEQ ID NO: 327236 - RNA, 63 nt, Human
aucuccaacugcagguggugucuuuugccaaggucucuguauuuuucuuucaguugucuuugg

SEQ ID NO: 327237 - RNA, 63 nt, Human
caaucagacaguucagcuucacgaacugaugucucucuguauugacauuaaguauucacuuuu

SEQ ID NO: 327238 - RNA, 63 nt, Human
gaucuaauaugaaagcauagauuucacauuugaucucuguaauaaucaucuuuccuauaaaag

SEQ ID NO: 327239 - RNA, 63 nt, Human
aacuuagcaaaugugccauuuucacacaacuucucucuguauaggccucugaaauaucaauaa

SEQ ID NO: 327240 - RNA, 63 nt, Human
acauguggcagcaggcauggcuuccccuuggccucucuguacacugccccaggacugucauuu

SEQ ID NO: 327241 - RNA, 63 nt, Human
guuuuuaaaaaauuuuaagauuuacacaauguuucucuguaaauauugccauuaaauguaaau

SEQ ID NO: 327242 - RNA, 63 nt, Human
aggaagagcuuugacuugucccugucuauacauucucuguaucuuuuggggguaacuucuugg

SEQ ID NO: 327243 - RNA, 63 nt, Human
cugccugccaaaguaguccuggcagcuggaccaucucuguaggaucguaaaaaaauagaaaaa

SEQ ID NO: 327244 - RNA, 63 nt, Human
aggugaggugggagguuggagagccaggugaggucucuguaagucaggcugggguugaaguuu

SEQ ID NO: 327245 - RNA, 63 nt, Human
ucacaucagcaauuucagaaccaaaagggaggcucucuguaggcacagagcugcacuaucacg

SEQ ID NO: 327246 - RNA, 63 nt, Human
gugaacuauugcauccuugauuucuugugcaugucucuguaauguaacucacccuccucagca

SEQ ID NO: 327247 - RNA, 63 nt, Human
gcuguuaaccuacuuccuggaaaaaguaguagcucucuguagcauuauggaguuucaguggaa

SEQ ID NO: 327248 - RNA, 63 nt, Human
caauuaauggcuuguaauaauaaaaagaauauuucucuguaaugcauuguugaaagacaacca

SEQ ID NO: 327249 - RNA, 63 nt, Human
ucuauaauauuuccuuuuuuuccccucuuugaaucucuguauauuugauucuuaacuaaaauu

SEQ ID NO: 327250 - RNA, 63 nt, Human
gcuguacacuuuauugaccaguacuugauaaucucucuguauaugaugaauacauuuuuacac

SEQ ID NO: 327251 - RNA, 63 nt, Human
aaaugcucauguagguaaaaugaaaaugcaaacucucuguaauaaguuaguaaauauuaaaca

SEQ ID NO: 327252 - RNA, 63 nt, Human
uuucauguaaaccacuggucacaaaugaacugaucucuguaucccauuauuacuauaagaggu

SEQ ID NO: 327253 - RNA, 63 nt, Human
gcggccugcccagcugccgcccccggacucugaucucuguaguggcccccuccuccccggccc

SEQ ID NO: 327254 - RNA, 63 nt, Human
auuuggcucgcugugguuucucguacuuucacaucucuguagauacaggggcaaaagucauug

SEQ ID NO: 327255 - RNA, 63 nt, Human
uuggguaggaagaggccauguuucaguucguuuucucuguagggucgauugaauuggaccuuu

SEQ ID NO: 327256 - RNA, 63 nt, Human
aauuaugaaucuuaaguauuugcuccaucuuuuucucuguaaugguggagaggcugcccauaa

SEQ ID NO: 327257 - RNA, 63 nt, Human
uauaguuaugaguugcuuugggagacuuggagcucucuguagcuauuguucauaacacuuugc

SEQ ID NO: 327258 - RNA, 63 nt, Human
uggaugacuuguucauuuuucucucccucuuuuucucuguauauuuaugaccagagcaaaaau

SEQ ID NO: 327259 - RNA, 63 nt, Human
caucguguuuguaagagaagauggucauuuuauucucuguauaaaacuuagcucuaaagcaga

SEQ ID NO: 327260 - RNA, 63 nt, Human
uguuugaaaguacugaagcacaaacauauaucaucucuguaccauucuguacuaaagcacuug

SEQ ID NO: 327261 - RNA, 63 nt, Human
guagugcauagaauucuagcuuuuuuccuccuuucucuguauauugggcucagagaguacacu

SEQ ID NO: 327262 - RNA, 63 nt, Human
agccucaaguaggaguuuuauauacuguguauaucucuguaaucucugucaagguaaauguaa

SEQ ID NO: 327263 - RNA, 63 nt, Human
cugauuucuaaaaguuaaaaaaaauauaugaaaucucuguagccuuuaguuaucaguacagau

SEQ ID NO: 327264 - RNA, 63 nt, Human
augaauauggaaaaaaauggcuuaagaccagcgucucuguaugacauugugugguugacccuc

SEQ ID NO: 327265 - RNA, 63 nt, Human
gggacuuuuaucagcaaauggaguuacaggaauucucuguaaugagugauucugaagagguac

SEQ ID NO: 327266 - RNA, 63 nt, Human
uaccuaaagguugggguggggcggaguugugugucucuguagaaaggcgaaggggcaguuccu

SEQ ID NO: 327267 - RNA, 63 nt, Human
gaagcuuuguauuuauuggcuucaaggcccaccucucuguacucugggcucuaaaguuggagg

SEQ ID NO: 327268 - RNA, 63 nt, Human
cacguugggauccaguuggucuugguuugcuucucucuguaccacgugcacaugagguccauu

SEQ ID NO: 327269 - RNA, 63 nt, Human
uuuuuuuuuuuuaauuauuaccugauuuaaaaaucucuguaaaaacguguaguguuucauaaa

SEQ ID NO: 327270 - RNA, 63 nt, Human
ucaaauuaccguugaguauauauaaagaaugagucucuguauggaagaacaaaugugugcauu

SEQ ID NO: 327271 - RNA, 63 nt, Human
aaaaggguauguuuguuuaaccucugucucuuaucucuguauguguauguaucuuuguaugca

SEQ ID NO: 327272 - RNA, 63 nt, Human
gaaaagacuguaaauagauccauccaaaugauuucucuguacaaaugaaugauacuauuaaaa

SEQ ID NO: 327273 - RNA, 63 nt, Human
uaagauuccaguauuaauuucugggcaguuuguucucuguauacaauugcaaaugauaagcau

SEQ ID NO: 327274 - RNA, 63 nt, Human
cacugaauuguuaaugcacauuuguacuugguuucucuguaucuauucacaggcaacaaauac

SEQ ID NO: 327275 - RNA, 63 nt, Human
cuguugaugaugauuuuuuuuuuuuuacacaauucucuguagacuaggagaagaaugcuugug

SEQ ID NO: 327276 - RNA, 63 nt, Human
aaauauaugucuguguguguuauuccagacguaucucuguaaauucuucuacagucacuuaga

SEQ ID NO: 327277 - RNA, 63 nt, Human
uaggagccagaaggggacccaggugugcauagcucucuguagacauuuuuacccaaaccuguu

SEQ ID NO: 327278 - RNA, 63 nt, Human
gagacauucuagcaagugcagcagccccuucuuucucuguaacagagauaucauuuaugugga

SEQ ID NO: 327279 - RNA, 63 nt, Human
uuucuccuugguuugcuaguaucuuggguguauucucuguaaguguagcucaaauaggucauc

SEQ ID NO: 327280 - RNA, 63 nt, Human
uguggacuccucuggccuguuuuguuggcucuuucucuguaauuccguguuuucgcuuuuucc

SEQ ID NO: 327281 - RNA, 63 nt, Human
cuuagaugucguuuccuucuugcccccucuuccucucuguaaucuaagugcauuaaacaucuu

SEQ ID NO: 327282 - RNA, 63 nt, Human
uuuuauuuaugagaaccuuuucuuuguccacuuucucuguaaugaccuucuaucccuccguuu

SEQ ID NO: 327283 - RNA, 63 nt, Human
uaaaaacuuuauucuuuagcauuuauuuauauuucucuguaggguguucccugugacauuguc

SEQ ID NO: 327284 - RNA, 63 nt, Human
ggagaauaacuguggcacaugcucuuucugcuuucucuguacuguauaggcaacauguuguac

SEQ ID NO: 327285 - RNA, 63 nt, Human
ggcugcacacugcugaacgugcuccucucuccuucucuguacaaugauucagcaucucggcgg

SEQ ID NO: 327286 - RNA, 63 nt, Human
gucucuucugucauguguucuauuuuucauuccucucuguacaucaggcuagaugccuccugu

SEQ ID NO: 327287 - RNA, 63 nt, Human
agcuuuauccaagccuccaaggucaggaugggaucucuguaucauguuuuucuuuuuaaauca

SEQ ID NO: 327288 - RNA, 63 nt, Human
ggugaacacaauuauuuuaaggcaguuaaauuaucucuguauugugaacuaagacuuucuaga

SEQ ID NO: 327289 - RNA, 63 nt, Human
gaggaugggaggguuaaagguuuauaugagaauucucuguacuuuuugcucaauuuuucugua

SEQ ID NO: 327290 - RNA, 63 nt, Human
cagaaacagacuuauuucagaggcuuauuguuuucucuguauuuaccuaauauuuuauaacuu

SEQ ID NO: 327291 - RNA, 63 nt, Human
aggggagcuuucgugaggcagucagucauugcuucucuguaaauuaaaauguuacagcacaca

SEQ ID NO: 327292 - RNA, 63 nt, Human
uaauacuacuuauagaaauccauuaaaaagcaaucucuguacaguguauuuaaauauuucauu

SEQ ID NO: 327293 - RNA, 63 nt, Human
ggauuuuaaagcaggggaggagaguagggggcaucucuguacacucuggggguaaaacaggga

SEQ ID NO: 327294 - RNA, 63 nt, Human
cugccucugacuugguauuuccagguccguauuucucuguagcccagggucugggguagagcu

SEQ ID NO: 327295 - RNA, 63 nt, Human
cauagauugauaacaguauuuuguuaucuugcuucucuguaguuuugcaucagcuguuuaacu

SEQ ID NO: 327296 - RNA, 63 nt, Human
cacuuggcagcugucagauaccauucaucuacuucucuguaaaaugucuguucuacuucacac

SEQ ID NO: 327297 - RNA, 63 nt, Human
guauugggcaguugggagugaguuuaggcagcuucucuguaaccgcuucuggggccacacccc

SEQ ID NO: 327298 - RNA, 63 nt, Human
auuaccuccuguguggaagaaggaaacaccgagucucuguauaaucuauuuacauaaaauggg

SEQ ID NO: 327299 - RNA, 63 nt, Human
gcccccccaaugcauuccuucaacaaaauacaaucucuguacuuuaaaguuauuuuagucaug

SEQ ID NO: 327300 - RNA, 63 nt, Human
uuacuuuguuguuugaugcuuaaacuucaaaauucucuguauucaaauuugauuguggcgaau

SEQ ID NO: 327301 - RNA, 63 nt, Human
gcagaggaauagcuacauauuuggcaauucuccucucuguagucacccugacauccucacaag

SEQ ID NO: 327302 - RNA, 63 nt, Human
uugugaaugagacauauucccaaaaaauucuuaucucuguaugugauuggaaaagaaaagauc

SEQ ID NO: 327303 - RNA, 63 nt, Human
uuaagaaaaaauuuuauuuuacagaauuuaccuucucuguauauaugugcauaaaguguggug

SEQ ID NO: 327304 - RNA, 63 nt, Human
cccuaguguuaagagugggcauggaggcccugcucucuguacaggaggccucucgcugcccuc

SEQ ID NO: 327305 - RNA, 63 nt, Human
uguugcugaugccugguguggguccuaaugauaucucuguauaacaaagcaguuacgaagccu

SEQ ID NO: 327306 - RNA, 63 nt, Human
gacuuauuccagagugccucaguuaggggaacuucucuguaaagaacccuggguauugagcaa

SEQ ID NO: 327307 - RNA, 63 nt, Human
ugauaaagcacagcuguagugggguucuaggcaucucuguacuuugcuugcucauaugcaugu

SEQ ID NO: 327308 - RNA, 63 nt, Human
cugcccuggcuggauccuaggagcccacgggauucucuguaucaucagaggcugggcuuggca

SEQ ID NO: 327309 - RNA, 63 nt, Human
ccacacuucuguccccuaaccuccugaggcuguucucuguaagucuuuuaaguuuugguugga

SEQ ID NO: 327310 - RNA, 63 nt, Human
ugcaguucucugaaucauaaagcaaguuuuaccucucuguacauguuuuugcagacauacuug

SEQ ID NO: 327311 - RNA, 63 nt, Human
auauuucauacuuaguuuguuuuuaaaaaguuuucucuguagaaaauuuuaaucauucauacc

SEQ ID NO: 327312 - RNA, 63 nt, Human
ucccuuuuccucuucaccugagguccuaaauacucucuguaauuacuguguucuucacgguaa

SEQ ID NO: 327313 - RNA, 63 nt, Human
gaaucugauaucuccaccaaagccuugauguuuucucuguacagcuaaguuuucugauggaau

SEQ ID NO: 327314 - RNA, 63 nt, Human
aaauguuuaacucaggugugauuuuugaaaaugucucuguaauauuuuaucuucuuuaaaaaa

SEQ ID NO: 327315 - RNA, 63 nt, Human
ugggcuuccucccgcccugaggcaagcaccucuucucuguagcugggaucaaccacaauuaau

SEQ ID NO: 327316 - RNA, 63 nt, Human
aagccauggagauucucauaacuugagaccuaaucucuguaaagcuaaaauaaagaaauagaa

SEQ ID NO: 327317 - RNA, 63 nt, Human
agggggcaguaaaaaacuuacucucuuuuuuccucucuguaauugguuaucaggaagaauuug

SEQ ID NO: 327318 - RNA, 63 nt, Human
gugaagaaauuguauuacucuacuucugucuucucucuguauauuauccuuucuuuaaagugc

SEQ ID NO: 327319 - RNA, 63 nt, Human
gggugucaucugugaagacugccaggccuaggcucucuguagagagucuucaagaucccggag

SEQ ID NO: 327320 - RNA, 63 nt, Human
cauuggguuugaaguaguuuaguuaugucuuuuucucuguauguaaguaguauaauuuguuac

SEQ ID NO: 327321 - RNA, 63 nt, Human
ccuuaaggagagugagagaugagagaggugccuucucuguauuagacucacacacaucagucc

SEQ ID NO: 327322 - RNA, 63 nt, Human
uucuuguuuugagagagucucugcuauuuucuaucucuguaaauguucuuagccugccuuucc

SEQ ID NO: 327323 - RNA, 63 nt, Human
ucucagcaacaguggaauucaccuugguguuucucucuguaauuugugugggguuuaccccuc

SEQ ID NO: 327324 - RNA, 63 nt, Human
ccaaccaaaccgugcgcugugacccauugcuguucucuguaucgugaucuauccucaacaaca

SEQ ID NO: 327325 - RNA, 63 nt, Human
ccccuuaccagauguuaagcagcuaugaaacauucucuguacuaguucuggucuccuuuugac

SEQ ID NO: 327326 - RNA, 63 nt, Human
uauaaaugaccucuagccauuuuaugauuauguucucuguaaaacucuucaagacuucaauga

SEQ ID NO: 327327 - RNA, 63 nt, Human
uguggucaacuugaaaaacuaauugaaucuaggucucuguauuguuccuguuucuacccugac

SEQ ID NO: 327328 - RNA, 63 nt, Human
uggcuccauuuacuaccuacugcucaguagucaucucuguaaaucugcaauuucuaccaaaau

SEQ ID NO: 327329 - RNA, 63 nt, Human
ugaauggacagaaaauucaauccuuuauuuuuuucucuguaaauauguacagugcacgggcua

SEQ ID NO: 327330 - RNA, 63 nt, Human
uuuccuuccuuagauggacgaggugggucgcauucucuguaaccugugcggugugguuccugg

SEQ ID NO: 327331 - RNA, 63 nt, Human
gauuaaacuauuggcagauuauugcuguguuaaucucuguagucuaaugaguucuuuguucug

SEQ ID NO: 327332 - RNA, 63 nt, Human
cucccauccaagaaagacaguguauaaggaacaucucuguaauuguguccccucucaucuaug

SEQ ID NO: 327333 - RNA, 63 nt, Human
gguagaaucugggagugaauuugucccauucccucucuguagggcuuccccaccucucggugg

SEQ ID NO: 327334 - RNA, 63 nt, Human
auuucuauaugauacagacucuauauugcuauaucucuguauauacuuucccagcccugucug

SEQ ID NO: 327335 - RNA, 63 nt, Human
aguccggggagggccgggaggcgccauggucucucucuguagccuuuccugguagucaauuug

SEQ ID NO: 327336 - RNA, 63 nt, Human
uuucugugugaagauuuuuagcuguauuuguggucucuguauuuauauuuauguuuagcaccg

SEQ ID NO: 327337 - RNA, 63 nt, Human
cucaacucucaauauugcuuuaucagcaucuuuucucuguagcuccaggggaaucuuuucucu

SEQ ID NO: 327338 - RNA, 63 nt, Human
acgucagagaauuuacuauuaaucccagaguuuucucuguauucucagaagauguuaauaguu

SEQ ID NO: 327339 - RNA, 63 nt, Human
acacacacacacccuuucauucccuguguugugucucuguauauccccaguugucagcagacc

SEQ ID NO: 327340 - RNA, 63 nt, Human
guuugaaccuuuguuguguuuuguacagggcauucucuguacuaguuugucgugguuauaaaa

SEQ ID NO: 327341 - RNA, 63 nt, Human
gaccauauuuauuacaguuuuuaaauuguacaaucucuguauuauagcuauuugucuaacauu

SEQ ID NO: 327342 - RNA, 63 nt, Human
ugcaggacaaaugguccuuauggagugccgcguucucuguacuacguggcucauggaaaaagu

SEQ ID NO: 327343 - RNA, 63 nt, Human
acagcuuagaauagugccugacauauauuauguucucuguaguuacuggcugugauuauuaau

SEQ ID NO: 327344 - RNA, 63 nt, Human
uacuuuucccugugaggaaacggcuuuguauuuucucuguaauaaaauggggcuucuuuggaa

SEQ ID NO: 327345 - RNA, 63 nt, Human
uugucuucgacugcuauguguauaggaaagcagucucuguaucaauguuuacauguuacuacu

SEQ ID NO: 327346 - RNA, 63 nt, Human
auucauuggccauuuaauacaguguugagugguucucuguaaaaguauaagugcuaacacuac

SEQ ID NO: 327347 - RNA, 63 nt, Human
cacuauugucugggggacucagaacaagauuguucucuguauuuauuguuuguccauuuaggu

SEQ ID NO: 327348 - RNA, 63 nt, Human
ccagacucucccacuccagaauguagaagccugucucuguaccucuaacuggcagcaaguuaa

SEQ ID NO: 327349 - RNA, 63 nt, Human
ucccagaccucucuagucccuccugccuucuguucucuguagcugugagcccuuugugagaau

SEQ ID NO: 327350 - RNA, 63 nt, Human
ccauuucugcuaaggaaauucuagucaaaugcaucucuguauagacaaaauguuaguggagaa

SEQ ID NO: 327351 - RNA, 63 nt, Human
agaauccuuucucccugccuucuugcccugcccucucuguagcccccacccuccugccaagcu

SEQ ID NO: 327352 - RNA, 58 nt, Human
uagguugucuaccuucauaacaacaauaucucuguaguuggaucaagugacuucugcc

SEQ ID NO: 327353 - RNA, 63 nt, Human
acugucucaacugugguguuagcaccagccagcucucuguacauuugcuagcuuguaguuuuc

SEQ ID NO: 327354 - RNA, 63 nt, Human
uguguggggaccccauuccccaguuaaagugugucucuguaccuuacaacagcgauucaggac

SEQ ID NO: 327355 - RNA, 63 nt, Human
augacguggccauuggagggcugcaggucguccucucuguaugugccccgcgcauuuccuugg

SEQ ID NO: 327356 - RNA, 63 nt, Human
gcagagaaauaacuuguaaauggauaauuuuguucucuguaccaccaguugaaggggggguug

SEQ ID NO: 327357 - RNA, 63 nt, Human
guuauuugaaaauuugauuuugauuuuauuuuuucucuguaaacuuccaagcuggcuuuuccc

SEQ ID NO: 327358 - RNA, 63 nt, Human
uguuuccagccaguuaguuuucucugggagacuucucuguacauuucugccauguacuccaga

SEQ ID NO: 327359 - RNA, 63 nt, Human
agccuuucguguuuuuccacagguguuuaagcuucucuguacaguugaaauaaacagacagca

SEQ ID NO: 327360 - RNA, 63 nt, Human
uacguaauucuuguaagaguaucguaugcaagcucucuguaugccacccacuguuaguucaaa

SEQ ID NO: 327361 - RNA, 63 nt, Human
cuuacaccaugucuguagcuauuuuccucccuuucucuguaccucuaagaagaaagaaucuaa

SEQ ID NO: 327362 - RNA, 63 nt, Human
ggcauaaauguaacaccuguagcgggggcagauucucuguauguucaguuaacaaauuauuug

SEQ ID NO: 327363 - RNA, 63 nt, Human
agaacucuuucauuacuugcaucguguaaaucaucucuguagacauguguucauauuaaugaa

SEQ ID NO: 327364 - RNA, 63 nt, Human
auuuuauuaugauguuuguauguguuuuguauuucucuguaaaccaugcuccagucuuuguuu

SEQ ID NO: 327365 - RNA, 63 nt, Human
uccggcuacugacagugguagaguccuaggacaucucuguaaaaagcaggugacuuuccuaug

SEQ ID NO: 327366 - RNA, 63 nt, Human
cuuccagagaugaaaacucuucaagaacaaggaucucuguagcguuaccuacugauguugaaa

SEQ ID NO: 327367 - RNA, 63 nt, Human
aagcucaggccuuugaaggauuucagcuccuccucucuguaauuugugcuuuaagcauuuuuu

SEQ ID NO: 327368 - RNA, 63 nt, Human
cauuugcccuggguguccuugguccugccuggcucucuguaguggaggcuccccuuggccuca

SEQ ID NO: 327369 - RNA, 63 nt, Human
uuaacucucugacuugaugcaaguuacuuaaccucucuguauagaauuuucacaucuuuaaaa

SEQ ID NO: 327370 - RNA, 63 nt, Human
aagaagaaaaguuagaagagcaauauguuuccuucucuguaacaguguccuaacagugaaaau

SEQ ID NO: 327371 - RNA, 63 nt, Human
accacacuccaugcaacuaugagucucuaaaucucucuguaagaaaaaaauuucaaaguaaag

SEQ ID NO: 327372 - RNA, 63 nt, Human
gauguuucuuuuuagcugagaugacagauugcuucucuguauuaaauagucuagaaguuaagg

SEQ ID NO: 327373 - RNA, 63 nt, Human
auuuacuuauuuaagagaccgccaugguagguuucucuguagcuuggggaacuugcuguuucu

SEQ ID NO: 327374 - RNA, 63 nt, Human
caaggcugggcuuugggucccaccaagaugaguucucuguaagacugugguggaguugcacca

SEQ ID NO: 327375 - RNA, 63 nt, Human
guuuagccucaacggcagccaguuaccagcuucucucuguagccuucagcaguguuugcaucu

SEQ ID NO: 327376 - RNA, 63 nt, Human
caagcacagcagaagccucacugggcugcuaugucucuguauuuguggcuugugugguagccu

SEQ ID NO: 327377 - RNA, 63 nt, Human
uauucagcccauuaagaaaguacuaaaguuuuaucucuguaguuccucaaauuggcaucuggu

SEQ ID NO: 327378 - RNA, 63 nt, Human
acuuucaaggaaacaaaagacuuuagaguccucucucuguaauucugccccacucauuuguuu

SEQ ID NO: 327379 - RNA, 63 nt, Human
uucuuucagauuaucucauuucuucuggaucugucucuguauuccucacucccuuccccaucc

SEQ ID NO: 327380 - RNA, 63 nt, Human
caguucuagaccuuugugauagaacuaaaaugcucucuguacucuagucuccugccuccucag

SEQ ID NO: 327381 - RNA, 63 nt, Human
uaauuguucauacgugcuuuaucuuucaugcuuucucuguacacacacacacacacacaaauu

SEQ ID NO: 327382 - RNA, 63 nt, Human
agcauguuaacuuuauuacaauuuguauuacuuucucuguaguuccuaauggauucaauuacg

SEQ ID NO: 327383 - RNA, 63 nt, Human
caugucauccuugcgcagggaccauucugaucuucucuguaccauuccaguuuuuuaguauau

SEQ ID NO: 327384 - RNA, 63 nt, Human
cuguccuccuccuucacugugaugugguugcggucucuguaggugugugugccacccuugucc

SEQ ID NO: 327385 - RNA, 63 nt, Human
cccagugucccugagcagcuuagacagcagggcucucuguaucagucuuucuugagcagauga

SEQ ID NO: 327386 - RNA, 63 nt, Human
cccaaccuguggcuaccacuguucuguccuccaucucuguaauuuugucauuucaagaauguu

SEQ ID NO: 327387 - RNA, 63 nt, Human
uacaugugagagucuuaccacuaagccauucugucucuguacuguugggaaguuuuggaaacc

SEQ ID NO: 327388 - RNA, 63 nt, Human
auuuucgagccaucaguuuauguucagaugccaucucuguaaucgcacauuuaaaacauaacu

SEQ ID NO: 327389 - RNA, 63 nt, Human
ugauggaauuuuuuugcacuuguacauuuauuuucucuguauugauuuuauaucaguauguua

SEQ ID NO: 327390 - RNA, 63 nt, Human
uuuagugagauuuuuagggacuauuuuucaguaucucuguaccuguuaaagggggugcuuuuc

SEQ ID NO: 327391 - RNA, 63 nt, Human
uuuuguuuggcuaauaguauugcauacauacuuucucuguauacuacuuucuauuguaugugu

SEQ ID NO: 327392 - RNA, 63 nt, Human
gaauucugggauuuguaaugguauugauggguaucucuguauguauaucaagagugggcagaa

SEQ ID NO: 327393 - RNA, 63 nt, Human
uucuuccaauucauugucuuuuuuuuccucuuuucucuguaauuuguuacuaaacaaauucca

SEQ ID NO: 327394 - RNA, 63 nt, Human
ggcucuaaguucuggcucuucuuucuuugggguucucuguaccugaggaaaccaggcccuggg

SEQ ID NO: 327395 - RNA, 63 nt, Human
gucagauuguugcugcacauaguugccuuuguaucucuguaugaaauaaaaggucauuuguuc

SEQ ID NO: 327396 - RNA, 63 nt, Human
augaagugucccugugaaauugaagugaaacuaucucuguaggacuuaagagaauagcuaaaa

SEQ ID NO: 327397 - RNA, 63 nt, Human
augguuauauacuccuggauuauagauuaaaagucucuguagacaucucugugaagagcaagc

SEQ ID NO: 327398 - RNA, 63 nt, Human
ugacaaguccuuacagacaccacuucuaguaaaucucuguaaauguggauagaaagcucagug

SEQ ID NO: 327399 - RNA, 53 nt, Human
acauggaagaugcuccuuaaaaaucucuguaaccauuucuuuuauguacauuu

SEQ ID NO: 327400 - RNA, 63 nt, Human
aagcccagccugcacgucugucccucucugcuuucucuguagggcccagcucucaggaauaca

SEQ ID NO: 327401 - RNA, 63 nt, Human
aauaggcagaaacaaaaugacuguagaacuuauucucuguaggccaaauuucauuucagccac

SEQ ID NO: 327402 - RNA, 63 nt, Human
ggcucucuggacacuugcgacaccucaagguguucucuguagcucaaucugcaaacaugccag

SEQ ID NO: 327403 - RNA, 63 nt, Human
gagucaauaauucaauaaaaaaguuacgaacuuucucuguaacuuggguuucaauaauuaugg

SEQ ID NO: 327404 - RNA, 63 nt, Human
cugcgaauggguugcagugcucagcauugcgggucucuguagaagucccaaagcuucaggaug

SEQ ID NO: 327405 - RNA, 63 nt, Human
cucacccucuaagcugcauugagaaaugacucgucucuguauuuguauuaagccuuaacacuu

SEQ ID NO: 327406 - RNA, 63 nt, Human
uggucacaccucacuauguccccucagcuccuaucucuguauggccugguuuuucccagguua

SEQ ID NO: 327407 - RNA, 63 nt, Human
cucucugugugaccuugggcagcuccgugccucucucuguacucccucaguuuccuucucugu

SEQ ID NO: 327408 - RNA, 63 nt, Human
uccgugccucucucuguacucccucaguuuccuucucuguacaauguggcuggggagggagag

SEQ ID NO: 327409 - RNA, 63 nt, Human
caaucagcacccugucaaaacagaccacuugacucucuguaaaauggaccaaucagcaggaug

SEQ ID NO: 327410 - RNA, 63 nt, Human
cucaugggcccaagucaucaaauaaccuguuccucucuguaagggcagugugagggacugcug

SEQ ID NO: 327411 - RNA, 63 nt, Human
caggccagagaacucaauucugaugucguaaguucucuguaagugaaaugggguagacuguau

SEQ ID NO: 327412 - RNA, 63 nt, Human
ucccaugguuacugaucuccacggguuuucacaucucuguacugugccugccucaacuucccc

SEQ ID NO: 327413 - RNA, 63 nt, Human
aacaguugauuauucaccacgccaauaucugggucucuguaucucauguagaacauaagaaaa

SEQ ID NO: 327414 - RNA, 63 nt, Human
aauuuuauuuuauugaggcuguucaguuuggcuucucuguaucuauugacugcccuuuuugag

SEQ ID NO: 327415 - RNA, 63 nt, Human
uuguauuucacccaucuguuucuucuuggcuaaucucuguacuucugccuuuuaauuacuggg

SEQ ID NO: 327416 - RNA, 63 nt, Human
uagggccacaccgucccucuccucgcuguccccucucuguagugacuggcccugaccuucagg

SEQ ID NO: 327417 - RNA, 63 nt, Human
ccuguccagguuuccuucccuuucccaagccucucucuguaauacucccuuugggcgaagcua

SEQ ID NO: 327418 - RNA, 63 nt, Human
ccguggguuaguaugaggaccggguucguguacucucuguaucuccucuuaagcuucguccag

SEQ ID NO: 327419 - RNA, 63 nt, Human
aucauucaacucuccaauguucuauuaaucaccucucuguaguuuauggcagaagggaauugc

SEQ ID NO: 327420 - RNA, 63 nt, Human
gcucccccugucuccucuccugauuuccuccaaucucuguagccccagaagugaacgccagac

SEQ ID NO: 327421 - RNA, 63 nt, Human
gcucuuucucugaaggccacuuuccugacguacucucuguacauaacucagcguccgugacug

SEQ ID NO: 327422 - RNA, 63 nt, Human
acaugcauaugcacaagcacauaacuguggucaucucuguaguuuacuaacugccuuaaaauu

SEQ ID NO: 327423 - RNA, 63 nt, Human
gcuccaugagggcagggaccgugucuuguccguucucuguauccccagugcuuggaacagagc

SEQ ID NO: 327424 - RNA, 63 nt, Human
ucuucaggacucuucagagcuaauccucuaaguucucuguacucaguugguucucaguuagcu

SEQ ID NO: 327425 - RNA, 63 nt, Human
caguuccucccccugccuuaaaacaccccacuaucucuguaaagucucucucucucuuuuuuu

SEQ ID NO: 327426 - RNA, 63 nt, Human
cugacuccggucauuugugccuuucucuugucaucucuguacacuacuuauauucacuguggg

SEQ ID NO: 327427 - RNA, 63 nt, Human
cacaaacguuuuagccauugugaauuuucuucaucucuguaaauaguucaucugugcuucucc

SEQ ID NO: 327428 - RNA, 63 nt, Human
gagucucaaaaucaacucucuuaugguauuauaucucuguaugccauuaaaaaacagcuuguu

SEQ ID NO: 327429 - RNA, 63 nt, Human
uuuuuauauguauacuuguauauuccuauuuauucucuguauaggcauuaccuacguuccugu

SEQ ID NO: 327430 - RNA, 63 nt, Human
uaacuuuucccuaggacccucagucuccuuguuucucuguaucuguagcauagcauagaaccc

SEQ ID NO: 327431 - RNA, 63 nt, Human
cagcaucccagccuugagaugcuucacuuuccuucucuguaaccagacuuugaaaaauuguuc

SEQ ID NO: 327432 - RNA, 63 nt, Human
aggacggggucucagcccgccucccucucuacgucucuguaccgagccucuggggccagauau

SEQ ID NO: 327433 - RNA, 63 nt, Human
agccaccaccaucugcgacuccugccugccgccucucuguacaguaacgccacuuccacacuc

SEQ ID NO: 327434 - RNA, 63 nt, Human
ugacccacuggaaaggcaaauccacuuaaaagaucucuguaucuuguucugugacugaaguga

SEQ ID NO: 327435 - RNA, 63 nt, Human
ccagaagagacaucuuggguuccuuggccucacucucuguaagcauauaaaccacaggcgaaa

SEQ ID NO: 327436 - RNA, 63 nt, Human
aggaggcccagguagcggcaaaacucagguaugucucuguauggcagcaaauguggcccaugg

SEQ ID NO: 327437 - RNA, 63 nt, Human
caggcugucuuagccccuggaguucagaaguccucucuguaaagccugccucccacuagguca

SEQ ID NO: 327438 - RNA, 63 nt, Human
caaagauucugggcagcugccaccucagucucuucucuguauuaucauagucugguuuaaaua

SEQ ID NO: 327439 - RNA, 63 nt, Human
gcagaaagcugugaaaugucuugugucuuauguucucuguauuuaugcagcugauuugucugu

SEQ ID NO: 327440 - RNA, 63 nt, Human
caugugcuuuuuauuucuuagcaagauauuuuaucucuguacauaaaguagaaaccaaaagcu

SEQ ID NO: 327441 - RNA, 63 nt, Human
cauuucuggacuaaaauauuuucaauacuauuuucucuguaaaguuuucaaaguucuccaucc

SEQ ID NO: 327442 - RNA, 63 nt, Human
uacugaggaugauacauuauaguauuguauuauucucuguaguaagauuaguaauaagugaaa

SEQ ID NO: 327443 - RNA, 63 nt, Human
ucugauuacaucauuauuguuccaaauucauuaucucuguaggaacuuuuaguuccauuauau

SEQ ID NO: 327444 - RNA, 63 nt, Human
ggaggaaguagggguggggcuuugggggugcuuucucuguaccccccagcccaugucccaagu

SEQ ID NO: 327445 - RNA, 63 nt, Human
ccugcucccaucugucccugaggaagccccacuucucuguaggagcccggacucucucaggca

SEQ ID NO: 327446 - RNA, 63 nt, Human
acuuaaugaaaaagugugaacuuuauagaauccucucuguacuggaugugcggcagaggggug

SEQ ID NO: 327447 - RNA, 63 nt, Human
agaucagaauucacccaaaggaagacauuuucaucucuguauuauuugcaccuacucgauuau

SEQ ID NO: 327448 - RNA, 63 nt, Human
aaaauacaaaaauuagccgggugugguggcacuucucuguaaucucagcuucucaggaggcug

SEQ ID NO: 327449 - RNA, 63 nt, Human
auccgagaggaaagugccgucuuucauagcuggucucuguauaaagaguauguagcaacaacu

SEQ ID NO: 327450 - RNA, 63 nt, Human
auaaguucaaaucagcuguaauuuuucuauaauucucuguaugacagaaauuuaaccaagugc

SEQ ID NO: 327451 - RNA, 63 nt, Human
ucagggcacaaaauauuggucugagaauggaauucucuguaagccuaguugcugaaauuuccu

SEQ ID NO: 327452 - RNA, 63 nt, Human
cuauaucaaaacuuaaaauguaagcccaguucuucucuguauagaaaggaaacauuguguuac

SEQ ID NO: 327453 - RNA, 63 nt, Human
uuauuguuggcaguuccucagggauuucccuuuucucuguauuggucaguguaguugauguaa

SEQ ID NO: 327454 - RNA, 63 nt, Human
aaaacauaaggcaguguggagacuugaugaaaaucucuguacagauugcagucuucuuccuga

SEQ ID NO: 327455 - RNA, 63 nt, Human
ccgcugcuccagcugcggagcuggucgacauaaucucuguauuauauacuuugcaguugcaga

SEQ ID NO: 327456 - RNA, 63 nt, Human
guuuuuuucuuguugcuuugggaaauuuuuuuuucucuguaggguuuuuaagagguuucgggg

SEQ ID NO: 327457 - RNA, 63 nt, Human
gcccaugaguaauaaugagcacacuagggagcaucucuguaaacacaguggcuggggaaaccc

SEQ ID NO: 327458 - RNA, 63 nt, Human
ggcucacaaagucacacuagaccacagugacgaucucuguaagcacaaagggacuccgaugug

SEQ ID NO: 327459 - RNA, 63 nt, Human
guucagauguguuccuuaaaaagaagauggaauucucuguagagcgucucaauccacuuuuaa

SEQ ID NO: 327460 - RNA, 63 nt, Human
uaaaaauuuggccucuggccuugagcuucuaaaucucuguauccgucagaucucugugguuac

SEQ ID NO: 327461 - RNA, 63 nt, Human
uguccuaucccauuuuuauaacaaugcagagcuucucuguaaauaccccuuguuucuauguuc

SEQ ID NO: 327462 - RNA, 63 nt, Human
aaguagagccuuagaccuacagggaaagugcugucucuguaguauuguagcaguagagagccu

SEQ ID NO: 327463 - RNA, 63 nt, Human
cagugagagagagagagagauugcacacaugugucucuguagucauguggccaggugggacua

SEQ ID NO: 327464 - RNA, 63 nt, Human
auuucuacagaucaggaauucaagaacagcuuaucucuguaguuacacugcaggaucucucau

SEQ ID NO: 327465 - RNA, 63 nt, Human
gccagagcuacuggcaccuaccccgagcaucucucucuguaagcagcuucaggggcaguccgu

SEQ ID NO: 327466 - RNA, 63 nt, Human
guacacucaaaaccuguccccggcagccagugcucucuguauagggccauaauggaauucuga

SEQ ID NO: 327467 - RNA, 63 nt, Human
acccucccccacaagccuuuaauugagagccgcucucuguaaguguuugcuugugcaaaaggg

SEQ ID NO: 327468 - RNA, 63 nt, Human
cugcaucuuuuauuucuuaauuaucuucagauuucucuguauuuauuauguguauccccagcu

SEQ ID NO: 327469 - RNA, 63 nt, Human
aacacauaaugaaauaauggaucuaggcaugauucucuguacagguugacaccauucagugaa

SEQ ID NO: 327470 - RNA, 63 nt, Human
cuugggcagggauggggguguuggaugccuggaucucuguaagggccagaagugagggcccag

SEQ ID NO: 327471 - RNA, 63 nt, Human
uagauuuuuuuuuaguccccaguagaaaaauacucucuguaugaagaacauucaaaagugugc

SEQ ID NO: 327472 - RNA, 63 nt, Human
ccgccacccugccuuuccuugggggcagcugucucucuguacaugagcaaaugggcaaaaaca

SEQ ID NO: 327473 - RNA, 63 nt, Human
ccuguguacuucccgggccagggcugccccuaaucucuguaggaaccgugguaugucugccau

SEQ ID NO: 327474 - RNA, 63 nt, Human
auuucuuucaagacagccuaaugaaggccaucaucucuguaaaccacuugucacuacaaaaau

SEQ ID NO: 327475 - RNA, 63 nt, Human
auucccauugcaucaccucuguaauuuuucagcucucuguauaaacauuaaaugucuuauaua

SEQ ID NO: 327476 - RNA, 63 nt, Human
uuauaaauagauuccccacgcagugugguggcaucucuguacagguacaguuuuaaacgguuu

SEQ ID NO: 327477 - RNA, 63 nt, Human
uuuguaaguugugugcaacaaacauacccuuuaucucuguaaaauuuauacacacaaaaauua

SEQ ID NO: 327478 - RNA, 63 nt, Human
aucuugccaguuuuguuucguuucuccuuuuauucucuguauugagcaagucuuagacaucau

SEQ ID NO: 327479 - RNA, 63 nt, Human
ucagccagaguuguuucucuccacucugccucaucucuguacgaauuugggucccagccuugu

SEQ ID NO: 327480 - RNA, 63 nt, Human
caagccacacccccaccugcggauggauggguuucucuguaggccaugcaggccuuugucgca

SEQ ID NO: 327481 - RNA, 63 nt, Human
uaccuuuaggagacagagaagauccuguguguuucucuguacccagcugacagccugucucua

SEQ ID NO: 327482 - RNA, 63 nt, Human
acaauuuaguucacaaaacuuuguugaccucuuucucuguagaaaugaaaacuaaauauauau

SEQ ID NO: 327483 - RNA, 63 nt, Human
aagccuauaaaaaguggcuaaucuuaucccuuuucucuguaugcaguuggacucgucagagau

SEQ ID NO: 327484 - RNA, 63 nt, Human
uuuuuaagagagugugucuacagacaagcauuuucucuguagagcagccacacguuguauaaa

SEQ ID NO: 327485 - RNA, 63 nt, Human
aguuuuuaucaccauacuuuaucuaauuauuauucucuguauauaacugaggaaauaagaaua

SEQ ID NO: 327486 - RNA, 63 nt, Human
uucucugcauucacaauucugauuucauguauuucucuguacauguuugaucauuaucaggcc

SEQ ID NO: 327487 - RNA, 63 nt, Human
cuaggaaaagcuuuugcauguguccugaaugugucucuguaaacauagcuguuauuuauuauu

SEQ ID NO: 327488 - RNA, 63 nt, Human
auuuuaaaugaauagugagucagaucuauugcuucucuguauuacccacaugacaacugucua

SEQ ID NO: 327489 - RNA, 63 nt, Human
uugcgagagguggggaacugcucacugacagcuucucuguaaccugcaguaccaguggaucgu

SEQ ID NO: 327490 - RNA, 63 nt, Human
ccucagaaucgcuccaccuugcagcucuccccuucucuguauuccuagaaacugacacaugcu

SEQ ID NO: 327491 - RNA, 63 nt, Human
ugugugugcguccugucggagcccugucuccucucucuguaauaaacucauuucuagcagaca

SEQ ID NO: 327492 - RNA, 63 nt, Human
agaaacauguugcugagaugcaauccucaguguucucuguauguaaaucuguguauacaccac

SEQ ID NO: 327493 - RNA, 63 nt, Human
auuuaacaucucagaauuucaggcaauuuuuuuucucuguauacccacaucucuauaauaauc

SEQ ID NO: 327494 - RNA, 63 nt, Human
auguuguauuugcaggcaaaugagauggagcccucucuguaaagaagagucauuugugcaagu

SEQ ID NO: 327495 - RNA, 63 nt, Human
gccaucuccugcugggccucccugacuguaaaaucucuguacuguuuguuagguuuuuggugg

SEQ ID NO: 327496 - RNA, 63 nt, Human
cucuuuaacucucuccucuuuauuucucuucucucucuguacacuuuuccuggguggucucau

SEQ ID NO: 327497 - RNA, 63 nt, Human
uggaagcuucugauauuugaagaaacacgaaugucucuguagcuuccucuucacugccccagu

SEQ ID NO: 327498 - RNA, 63 nt, Human
gggugcgccuccuguuuggguuucuucgggguuucucuguagugucugcugcccuccuccugg

SEQ ID NO: 327499 - RNA, 63 nt, Human
ggugcaaauggcgcugggagguguacacggaggucucuguaaaagcagacccaccucccagcg

SEQ ID NO: 327500 - RNA, 63 nt, Human
cccuuguaccugcuccgugcccaacacaugcccucucuguacaucuuuuguaaaugaugagaa

SEQ ID NO: 327501 - RNA, 63 nt, Human
ggccauggugcacuguagguggcugcaauggucucucuguaaggaaaaucacugacagcagcu

SEQ ID NO: 327502 - RNA, 63 nt, Human
caucucuaccccacccaaauaaaaaugcacucaucucuguagaacaucugcugucaaaggcca

SEQ ID NO: 327503 - RNA, 63 nt, Human
uacuaaauugauucuaaaucuguuccauuaucuucucuguaggaugcaaaacauccaguugua

SEQ ID NO: 327504 - RNA, 63 nt, Human
gguuguuuagcuuuuuguuuucuuuguacucugucucuguagucucuccauucuaaaguuuaa

SEQ ID NO: 327505 - RNA, 63 nt, Human
uguguguaugaugaacagaugucuccuuucuucucucuguauauuuuguuauuuuauauaaaa

SEQ ID NO: 327506 - RNA, 63 nt, Human
gcauaauguaauuuagcuaguuuuuaauaguguucucuguauugucuauuauuuagaaaugaa

SEQ ID NO: 327507 - RNA, 63 nt, Human
caauuaauugcuauuguguuauuuuacuacuucucucuguauuuuuucuugcauugacauuau

SEQ ID NO: 327508 - RNA, 63 nt, Human
uaaaugagauuuuuguuuuuuuuaaaugcaauaucucuguauacagacuggcugggccccacc

SEQ ID NO: 327509 - RNA, 63 nt, Human
ccggauaaggguuuuccccuuuuggggaucaccucucuguaucccccacccacuaucccauuu

SEQ ID NO: 327510 - RNA, 63 nt, Human
cccucuuacccugccucuguguuucggugagagucucuguauauguacugcuuucuguuuugu

SEQ ID NO: 327511 - RNA, 63 nt, Human
acccuucggugggugggggccauauccuagaccucucuguaucccccagacuaucuguaacag

SEQ ID NO: 327512 - RNA, 63 nt, Human
uggucucugggggcaaaaaacuaaugaaaacaaucucuguaauggcagauaggaggagaugaa

SEQ ID NO: 327513 - RNA, 63 nt, Human
uuugugcauuucuacuacaauggcaucuuuaugucucuguaacauuggccuuuucauggcucc

SEQ ID NO: 327514 - RNA, 63 nt, Human
ugaccuuguaauguaacugcucuugggcaauauucucuguacauauuagcgacaacagauugg

SEQ ID NO: 327515 - RNA, 63 nt, Human
gucuucuucacggcauaaggacaucuccacuuuucucuguaccuguguguauagaaauagauu

SEQ ID NO: 327516 - RNA, 63 nt, Human
uauugcuuaucuuggguuaaauuugagagugauucucuguauauaaauaugugaaauauuauu

SEQ ID NO: 327517 - RNA, 63 nt, Human
aauagccauauaaauuauuuuccuuuuauuauuucucuguauguuguauuugaucauauuuaa

SEQ ID NO: 327518 - RNA, 63 nt, Human
caccccaagcccucugcaaccacgaaucgacugucucuguagauuggccuucuggacguucua

SEQ ID NO: 327519 - RNA, 63 nt, Human
aaggauuggaugauuguucauaauacauaaaguucucuguaauuacaacuaaauuauuaugcc

SEQ ID NO: 327520 - RNA, 63 nt, Human
aauugaaaugguguuaaucugaaaauuaaugauucucuguaagcacuguaguugaaaagagag

SEQ ID NO: 327521 - RNA, 63 nt, Human
ccaaaagcuacgggagaaaaagcagaaguguaaucucuguaucugacaaaauuaggagacagc

SEQ ID NO: 327522 - RNA, 63 nt, Human
gaauaugcauaucaaugaguuggaggugauuauucucuguaacucccuaaugauuguuuucua

SEQ ID NO: 327523 - RNA, 63 nt, Human
cccgagccccuggcaaccacuaaucuauuucucucucuguagauuugcuuauucuggucauuu

SEQ ID NO: 327524 - RNA, 63 nt, Human
ggauuaaaggguuuagcugaaacccuagauucuucucuguagucuaauagaacuccaaacauu

SEQ ID NO: 327525 - RNA, 63 nt, Human
gucuucuucacggccugaggacauuuccaguuuucucuguaccuguguguauagaaauagauc

SEQ ID NO: 327526 - RNA, 63 nt, Human
aagggccaaccuaggcaacacagugagaacucaucucuguaaaaaauaaaaauaaaacauuaa

SEQ ID NO: 327527 - RNA, 64 nt, Human; identical to SEQ ID NO: 190304

SEQ ID NO: 327528 - RNA, 64 nt, Human; identical to SEQ ID NO: 190305

SEQ ID NO: 327529 - RNA, 64 nt, Human; identical to SEQ ID NO: 190306

SEQ ID NO: 327530 - RNA, 64 nt, Human; identical to SEQ ID NO: 190307

SEQ ID NO: 327531 - RNA, 64 nt, Human; identical to SEQ ID NO: 190308

SEQ ID NO: 327532 - RNA, 58 nt, Human; identical to SEQ ID NO: 190312

SEQ ID NO: 327533 - RNA, 64 nt, Human; identical to SEQ ID NO: 190313

SEQ ID NO: 327534 - RNA, 64 nt, Human; identical to SEQ ID NO: 190314

SEQ ID NO: 327535 - RNA, 53 nt, Human; identical to SEQ ID NO: 190404

SEQ ID NO: 327536 - RNA, 51 nt, Human; identical to SEQ ID NO: 190434

SEQ ID NO: 327537 - RNA, 64 nt, Human
cagugaaugucucuuggcaugggaggaguuaaagagguuggaagggaagaggcauuuguggaau

SEQ ID NO: 327538 - RNA, 64 nt, Human; identical to SEQ ID NO: 190315

SEQ ID NO: 327539 - RNA, 64 nt, Human; identical to SEQ ID NO: 190316

SEQ ID NO: 327540 - RNA, 64 nt, Human; identical to SEQ ID NO: 190317

SEQ ID NO: 327541 - RNA, 64 nt, Human; identical to SEQ ID NO: 190318

SEQ ID NO: 327542 - RNA, 64 nt, Human; identical to SEQ ID NO: 190319

SEQ ID NO: 327543 - RNA, 64 nt, Human; identical to SEQ ID NO: 190320

SEQ ID NO: 327544 - RNA, 64 nt, Human; identical to SEQ ID NO: 190321

SEQ ID NO: 327545 - RNA, 64 nt, Human; identical to SEQ ID NO: 190322

SEQ ID NO: 327546 - RNA, 64 nt, Human; identical to SEQ ID NO: 190323

SEQ ID NO: 327547 - RNA, 64 nt, Human; identical to SEQ ID NO: 190324

SEQ ID NO: 327548 - RNA, 64 nt, Human; identical to SEQ ID NO: 190325

SEQ ID NO: 327549 - RNA, 64 nt, Human; identical to SEQ ID NO: 190326

SEQ ID NO: 327550 - RNA, 64 nt, Human; identical to SEQ ID NO: 190330

SEQ ID NO: 327551 - RNA, 64 nt, Human; identical to SEQ ID NO: 190331

SEQ ID NO: 327552 - RNA, 64 nt, Human; identical to SEQ ID NO: 190332

SEQ ID NO: 327553 - RNA, 64 nt, Human; identical to SEQ ID NO: 190333

SEQ ID NO: 327554 - RNA, 61 nt, Human
aaaaaaauuauucuguaccaucacaacuuuucacaacgauggcaagccuuaugucuuggga

SEQ ID NO: 327555 - RNA, 61 nt, Human
caucaagagagcuguguguucucucuggucccacaacgaugacucugccucuugucagccc

SEQ ID NO: 327556 - RNA, 64 nt, Human
acucaagaaaguucagaggaggcauaagcuauggagguuggaaaggaagaaagagaagagcuga

SEQ ID NO: 327557 - RNA, 64 nt, Human
caugcaaguagcuggcuguacugccaagguaccuagguuggaguccagccuaaucaagucaaau

SEQ ID NO: 327558 - RNA, 64 nt, Human; identical to SEQ ID NO: 190334

SEQ ID NO: 327559 - RNA, 64 nt, Human; identical to SEQ ID NO: 190335

SEQ ID NO: 327560 - RNA, 64 nt, Human; identical to SEQ ID NO: 190336

SEQ ID NO: 327561 - RNA, 64 nt, Human; identical to SEQ ID NO: 190337

SEQ ID NO: 327562 - RNA, 64 nt, Human; identical to SEQ ID NO: 190338

SEQ ID NO: 327563 - RNA, 64 nt, Human; identical to SEQ ID NO: 190339

SEQ ID NO: 327564 - RNA, 64 nt, Human; identical to SEQ ID NO: 190340

SEQ ID NO: 327565 - RNA, 64 nt, Human; identical to SEQ ID NO: 190341

SEQ ID NO: 327566 - RNA, 64 nt, Human; identical to SEQ ID NO: 190342

SEQ ID NO: 327567 - RNA, 64 nt, Human; identical to SEQ ID NO: 190343

SEQ ID NO: 327568 - RNA, 64 nt, Human; identical to SEQ ID NO: 190344

SEQ ID NO: 327569 - RNA, 64 nt, Human; identical to SEQ ID NO: 190348

SEQ ID NO: 327570 - RNA, 64 nt, Human; identical to SEQ ID NO: 190349

SEQ ID NO: 327571 - RNA, 64 nt, Human; identical to SEQ ID NO: 190350

SEQ ID NO: 327572 - RNA, 64 nt, Human; identical to SEQ ID NO: 190351

SEQ ID NO: 327573 - RNA, 64 nt, Human; identical to SEQ ID NO: 190352

SEQ ID NO: 327574 - RNA, 64 nt, Human
uuggagaggcacauucccuugggacagaggcuacagguuggagcuuuuuuuccccuguccccca

SEQ ID NO: 327575 - RNA, 64 nt, Human
gcccugugugggguggguacacuggaaaacaagaagguuggaguuggucuaggacauugguuuu

SEQ ID NO: 327576 - RNA, 64 nt, Human
cucuccacuucuuagaggcauucaguuagcaaagagguuggagcaacaacuuuuuuuuuuuuuu

SEQ ID NO: 327577 - RNA, 64 nt, Human; identical to SEQ ID NO: 190353

SEQ ID NO: 327578 - RNA, 64 nt, Human; identical to SEQ ID NO: 190354

SEQ ID NO: 327579 - RNA, 64 nt, Human; identical to SEQ ID NO: 190355

SEQ ID NO: 327580 - RNA, 64 nt, Human; identical to SEQ ID NO: 190356

SEQ ID NO: 327581 - RNA, 64 nt, Human; identical to SEQ ID NO: 190357

SEQ ID NO: 327582 - RNA, 64 nt, Human; identical to SEQ ID NO: 190358

SEQ ID NO: 327583 - RNA, 64 nt, Human; identical to SEQ ID NO: 190359

SEQ ID NO: 327584 - RNA, 64 nt, Human; identical to SEQ ID NO: 190360

SEQ ID NO: 327585 - RNA, 64 nt, Human; identical to SEQ ID NO: 190361

SEQ ID NO: 327586 - RNA, 64 nt, Human; identical to SEQ ID NO: 190362

SEQ ID NO: 327587 - RNA, 64 nt, Human; identical to SEQ ID NO: 190367

SEQ ID NO: 327588 - RNA, 64 nt, Human; identical to SEQ ID NO: 190368

SEQ ID NO: 327589 - RNA, 64 nt, Human; identical to SEQ ID NO: 190369

SEQ ID NO: 327590 - RNA, 64 nt, Human; identical to SEQ ID NO: 190370

SEQ ID NO: 327591 - RNA, 64 nt, Human; identical to SEQ ID NO: 190371

SEQ ID NO: 327592 - RNA, 64 nt, Human; identical to SEQ ID NO: 190372

SEQ ID NO: 327593 - RNA, 64 nt, Human
gaagauggaucccauccuaauuuuuaucaccugaagguuggaaccagugagggacugggagaga

SEQ ID NO: 327594 - RNA, 64 nt, Human
gggaugaaauaauggaagcugguuaaaguggaugagguuggaaagaguugccauaaugaggucc

SEQ ID NO: 327595 - RNA, 64 nt, Human
cuccaguggagugggacuucucuggcucugcccuagguuggaaagaguuggauuggacccuacu

SEQ ID NO: 327596 - RNA, 64 nt, Human
agucuaaagugggugccauucacggaggagagggagguuggagacuucaaccgggcaaaggagc

SEQ ID NO: 327597 - RNA, 64 nt, Human; identical to SEQ ID NO: 190373

SEQ ID NO: 327598 - RNA, 64 nt, Human; identical to SEQ ID NO: 190374

SEQ ID NO: 327599 - RNA, 64 nt, Human; identical to SEQ ID NO: 190375

SEQ ID NO: 327600 - RNA, 64 nt, Human; identical to SEQ ID NO: 190376

SEQ ID NO: 327601 - RNA, 64 nt, Human; identical to SEQ ID NO: 190377

SEQ ID NO: 327602 - RNA, 64 nt, Human; identical to SEQ ID NO: 190378

SEQ ID NO: 327603 - RNA, 64 nt, Human; identical to SEQ ID NO: 190379

SEQ ID NO: 327604 - RNA, 64 nt, Human; identical to SEQ ID NO: 190380

SEQ ID NO: 327605 - RNA, 64 nt, Human; identical to SEQ ID NO: 190381

SEQ ID NO: 327606 - RNA, 64 nt, Human; identical to SEQ ID NO: 190386

SEQ ID NO: 327607 - RNA, 64 nt, Human; identical to SEQ ID NO: 190387

SEQ ID NO: 327608 - RNA, 64 nt, Human; identical to SEQ ID NO: 190388

SEQ ID NO: 327609 - RNA, 64 nt, Human; identical to SEQ ID NO: 190389

SEQ ID NO: 327610 - RNA, 64 nt, Human; identical to SEQ ID NO: 190390

SEQ ID NO: 327611 - RNA, 64 nt, Human; identical to SEQ ID NO: 190391

SEQ ID NO: 327612 - RNA, 64 nt, Human; identical to SEQ ID NO: 190392

SEQ ID NO: 327613 - RNA, 64 nt, Human
guucccaguggauucaaggaaggaagugggaacaagguuggaugccuacuuaugagcuugacca

SEQ ID NO: 327614 - RNA, 64 nt, Human
ucagcggggaguggaacucaucaggcuugccaagagguuggaagggaaauggcucugggcugga

SEQ ID NO: 327615 - RNA, 64 nt, Human
aucugacuuuucccucuucaguugccugguauuaagguuggauaaaugaagcaugcacagcuac

SEQ ID NO: 327616 - RNA, 64 nt, Human; identical to SEQ ID NO: 190393

SEQ ID NO: 327617 - RNA, 64 nt, Human; identical to SEQ ID NO: 190394

SEQ ID NO: 327618 - RNA, 64 nt, Human; identical to SEQ ID NO: 190395

SEQ ID NO: 327619 - RNA, 64 nt, Human; identical to SEQ ID NO: 190396

SEQ ID NO: 327620 - RNA, 64 nt, Human; identical to SEQ ID NO: 190397

SEQ ID NO: 327621 - RNA, 64 nt, Human; identical to SEQ ID NO: 190398

SEQ ID NO: 327622 - RNA, 64 nt, Human; identical to SEQ ID NO: 190399

SEQ ID NO: 327623 - RNA, 64 nt, Human; identical to SEQ ID NO: 190400

SEQ ID NO: 327624 - RNA, 64 nt, Human; identical to SEQ ID NO: 190405

SEQ ID NO: 327625 - RNA, 64 nt, Human; identical to SEQ ID NO: 190406

SEQ ID NO: 327626 - RNA, 64 nt, Human; identical to SEQ ID NO: 190407

SEQ ID NO: 327627 - RNA, 64 nt, Human; identical to SEQ ID NO: 190408

SEQ ID NO: 327628 - RNA, 64 nt, Human; identical to SEQ ID NO: 190409

SEQ ID NO: 327629 - RNA, 64 nt, Human; identical to SEQ ID NO: 190410

SEQ ID NO: 327630 - RNA, 64 nt, Human; identical to SEQ ID NO: 190411

SEQ ID NO: 327631 - RNA, 64 nt, Human; identical to SEQ ID NO: 190412

SEQ ID NO: 327632 - RNA, 64 nt, Human
cagcauguggccagcagcagugugcugggagcagagguuggaaucagggcucagggccuucacu

SEQ ID NO: 327633 - RNA, 64 nt, Human
cuauguaauuuuugguguauguauguaauauuuaagguuggaaaaaaaacucaaaagcaaagau

SEQ ID NO: 327634 - RNA, 64 nt, Human
ccagccgcaucgagaugccaugcauuggguuccuagguuggacucauacccgaggguggcagug

SEQ ID NO: 327635 - RNA, 64 nt, Human
ggacaguucaaggaggaggagaccccuauuacacagguuggaauaaaauauuuaaaucucguaa

SEQ ID NO: 327636 - RNA, 64 nt, Human; identical to SEQ ID NO: 190413

SEQ ID NO: 327637 - RNA, 64 nt, Human; identical to SEQ ID NO: 190414

SEQ ID NO: 327638 - RNA, 64 nt, Human; identical to SEQ ID NO: 190415

SEQ ID NO: 327639 - RNA, 64 nt, Human; identical to SEQ ID NO: 190416

SEQ ID NO: 327640 - RNA, 64 nt, Human; identical to SEQ ID NO: 190417

SEQ ID NO: 327641 - RNA, 64 nt, Human; identical to SEQ ID NO: 190418

SEQ ID NO: 327642 - RNA, 64 nt, Human; identical to SEQ ID NO: 190422

SEQ ID NO: 327643 - RNA, 64 nt, Human; identical to SEQ ID NO: 190423

SEQ ID NO: 327644 - RNA, 64 nt, Human; identical to SEQ ID NO: 190424

SEQ ID NO: 327645 - RNA, 64 nt, Human; identical to SEQ ID NO: 190425

SEQ ID NO: 327646 - RNA, 64 nt, Human; identical to SEQ ID NO: 190426

SEQ ID NO: 327647 - RNA, 64 nt, Human; identical to SEQ ID NO: 190427

SEQ ID NO: 327648 - RNA, 64 nt, Human; identical to SEQ ID NO: 190428

SEQ ID NO: 327649 - RNA, 64 nt, Human; identical to SEQ ID NO: 190429

SEQ ID NO: 327650 - RNA, 64 nt, Human; identical to SEQ ID NO: 190430

SEQ ID NO: 327651 - RNA, 64 nt, Human; identical to SEQ ID NO: 190431

SEQ ID NO: 327652 - RNA, 62 nt, Human
aagcguccuguuuggagagagccagagagcaccgccgggaggcgcucgcgcaaggccacggu

SEQ ID NO: 327653 - RNA, 64 nt, Human; identical to SEQ ID NO: 190432

SEQ ID NO: 327654 - RNA, 64 nt, Human; identical to SEQ ID NO: 190433

SEQ ID NO: 327655 - RNA, 64 nt, Human; identical to SEQ ID NO: 190435

SEQ ID NO: 327656 - RNA, 64 nt, Human; identical to SEQ ID NO: 190436

SEQ ID NO: 327657 - RNA, 64 nt, Human; identical to SEQ ID NO: 190072

SEQ ID NO: 327658 - RNA, 64 nt, Human; identical to SEQ ID NO: 190073

SEQ ID NO: 327659 - RNA, 64 nt, Human; identical to SEQ ID NO: 190074

SEQ ID NO: 327660 - RNA, 64 nt, Human; identical to SEQ ID NO: 190075

SEQ ID NO: 327661 - RNA, 64 nt, Human; identical to SEQ ID NO: 190076

SEQ ID NO: 327662 - RNA, 64 nt, Human; identical to SEQ ID NO: 190077

SEQ ID NO: 327663 - RNA, 64 nt, Human; identical to SEQ ID NO: 190078

SEQ ID NO: 327664 - RNA, 64 nt, Human; identical to SEQ ID NO: 190079

SEQ ID NO: 327665 - RNA, 64 nt, Human; identical to SEQ ID NO: 190080

SEQ ID NO: 327666 - RNA, 64 nt, Human; identical to SEQ ID NO: 190081

SEQ ID NO: 327667 - RNA, 64 nt, Human; identical to SEQ ID NO: 190082

SEQ ID NO: 327668 - RNA, 64 nt, Human; identical to SEQ ID NO: 190083

SEQ ID NO: 327669 - RNA, 64 nt, Human
auucaagacccuucucuugcuugucacccgcuccagguuggagccacagacacccaccgccacc

SEQ ID NO: 327670 - RNA, 64 nt, Human
uuuuuuuuugagauggagucucgcucugucgcccagguuggagugcaguggcgcaaucucggcu

SEQ ID NO: 327671 - RNA, 64 nt, Human
uguuuuugagauggagucucuugcucugucauccagguuggagugcaguggcaugaucuugacu

SEQ ID NO: 327672 - RNA, 64 nt, Human; identical to SEQ ID NO: 190464

SEQ ID NO: 327673 - RNA, 64 nt, Human
ggaaagccccuauaaugaauucagaaaucacuacaagcagcauuaagacugaaguuggaauauu

SEQ ID NO: 327674 - RNA, 64 nt, Human
uaacugaugagaaccuucuuacugcaugauaacaaagcagcaaggcaagcaaaagcguaagaug

SEQ ID NO: 327675 - RNA, 64 nt, Human
aaagcuguagcuggagaagcccauggccacgaggaagcagcaauuaauuagaucaacacuuuuc

SEQ ID NO: 327676 - RNA, 64 nt, Human
cauuuuaguguguuacaauaguaacaguaugcaaaagcagcauucaggagccgaaagauagucu

SEQ ID NO: 327677 - RNA, 64 nt, Human
aacccgacccggcucucggggcgcuagugacggaaagcagcacgcauaucuuugcgggaagaau

SEQ ID NO: 327678 - RNA, 64 nt, Human
uucgcgguuugcuauuuucauuuccuguucgucaaagcagcagaggagaucaaaccccguucgu

SEQ ID NO: 327679 - RNA, 64 nt, Human
uguuuuccagaauggcuguaccauuuugcauuccaagcagcaaagacuuccauuuucugugcgu

SEQ ID NO: 327680 - RNA, 64 nt, Human
gcuccauuuaaaucuaauuuauaauuuuuauuuuaagcagcaaaugaaacaaaaauggccaguu

SEQ ID NO: 327681 - RNA, 64 nt, Human
aauguuagcccaagucugaauuuacauuugacuaaagcagcacauaagauaauuugcuaaaaug

SEQ ID NO: 327682 - RNA, 64 nt, Human
uaugcuaacguauacauuuuaaucauaguuaccuaagcagcaugcauuaauugaaccuuaaaau

SEQ ID NO: 327683 - RNA, 64 nt, Human
uaagaaucucaagcugaagggcuuuggggagccaaagcagcauauuagagcauaggcuugaacu

SEQ ID NO: 327684 - RNA, 64 nt, Human
gcauccuauccccagccucuuccugucuucagaaaagcagcaggagggacuuuggggcauggac

SEQ ID NO: 327685 - RNA, 64 nt, Human
ugaggcccagcaguaccugcuucccuguauguggaagcagcaccucauucccgccaucagcuac

SEQ ID NO: 327686 - RNA, 64 nt, Human
cuggccuguggcaucagucccugagucaccauggaagcagcauccugaccacagcuggcaguca

SEQ ID NO: 327687 - RNA, 64 nt, Human
ccaccacuaggucaucuuauuugaugcaucaguaaagcagcauauucaaauguggauuuuuaaa

SEQ ID NO: 327688 - RNA, 62 nt, Human
aguggaccggcccgugugagccgcacccacagcgccgggauccuaggaccuugccggauggg

SEQ ID NO: 327689 - RNA, 62 nt, Human
acugauccaccugccucagccucccaaagugccgccgggauuacaggcgugagccaccaugc

SEQ ID NO: 327690 - RNA, 62 nt, Human
cccucgggcccacccguacagaggcugguggucgccgggauaauuaaugaccaccgccaauu

SEQ ID NO: 327691 - RNA, 62 nt, Human
cacggggugagacagcaggaaggggcccugcacgccgggacgccaccuccgccagccgccuc

SEQ ID NO: 327692 - RNA, 64 nt, Human; identical to SEQ ID NO: 190465

SEQ ID NO: 327693 - RNA, 64 nt, Human; identical to SEQ ID NO: 190466

SEQ ID NO: 327694 - RNA, 64 nt, Human; identical to SEQ ID NO: 190467

SEQ ID NO: 327695 - RNA, 64 nt, Human; identical to SEQ ID NO: 190468

SEQ ID NO: 327696 - RNA, 64 nt, Human; identical to SEQ ID NO: 190469

SEQ ID NO: 327697 - RNA, 64 nt, Human; identical to SEQ ID NO: 190470

SEQ ID NO: 327698 - RNA, 64 nt, Human; identical to SEQ ID NO: 190471

SEQ ID NO: 327699 - RNA, 64 nt, Human; identical to SEQ ID NO: 190472

SEQ ID NO: 327700 - RNA, 64 nt, Human; identical to SEQ ID NO: 190473

SEQ ID NO: 327701 - RNA, 64 nt, Human; identical to SEQ ID NO: 190477

SEQ ID NO: 327702 - RNA, 64 nt, Human; identical to SEQ ID NO: 190478

SEQ ID NO: 327703 - RNA, 64 nt, Human; identical to SEQ ID NO: 190479

SEQ ID NO: 327704 - RNA, 64 nt, Human; identical to SEQ ID NO: 190480

SEQ ID NO: 327705 - RNA, 64 nt, Human; identical to SEQ ID NO: 190481

SEQ ID NO: 327706 - RNA, 64 nt, Human; identical to SEQ ID NO: 190482

SEQ ID NO: 327707 - RNA, 64 nt, Human; identical to SEQ ID NO: 190483

SEQ ID NO: 327708 - RNA, 64 nt, Human
uuuuuuuuugagauggagucuugcucugucgcccagguuggagugcaguggcacgaucucagcu

SEQ ID NO: 327709 - RNA, 64 nt, Human
agaacuugcugcugucuuguugcggauggauggaagguuggauggauggguggauggccgugga

SEQ ID NO: 327710 - RNA, 64 nt, Human
ucaaagaauagggagacaaucuaaaaaauaucuuagguuggagaugacagaaauaugauugauu

SEQ ID NO: 327711 - RNA, 64 nt, Human; identical to SEQ ID NO: 190484

SEQ ID NO: 327712 - RNA, 64 nt, Human; identical to SEQ ID NO: 190485

SEQ ID NO: 327713 - RNA, 64 nt, Human; identical to SEQ ID NO: 190486

SEQ ID NO: 327714 - RNA, 64 nt, Human; identical to SEQ ID NO: 190487

SEQ ID NO: 327715 - RNA, 56 nt, Human; identical to SEQ ID NO: 190488

SEQ ID NO: 327716 - RNA, 64 nt, Human; identical to SEQ ID NO: 190489

SEQ ID NO: 327717 - RNA, 64 nt, Human; identical to SEQ ID NO: 190490

SEQ ID NO: 327718 - RNA, 64 nt, Human; identical to SEQ ID NO: 190491

SEQ ID NO: 327719 - RNA, 64 nt, Human; identical to SEQ ID NO: 190495

SEQ ID NO: 327720 - RNA, 64 nt, Human; identical to SEQ ID NO: 190496

SEQ ID NO: 327721 - RNA, 64 nt, Human; identical to SEQ ID NO: 190497

SEQ ID NO: 327722 - RNA, 64 nt, Human; identical to SEQ ID NO: 190498

SEQ ID NO: 327723 - RNA, 64 nt, Human; identical to SEQ ID NO: 190499

SEQ ID NO: 327724 - RNA, 64 nt, Human; identical to SEQ ID NO: 190500

SEQ ID NO: 327725 - RNA, 64 nt, Human; identical to SEQ ID NO: 190501

SEQ ID NO: 327726 - RNA, 64 nt, Human; identical to SEQ ID NO: 190502

SEQ ID NO: 327727 - RNA, 64 nt, Human
aggaccucauggaagaagagggggagagaguuacagguuggacaugaugcacacuauggggccc

SEQ ID NO: 327728 - RNA, 64 nt, Human
ggagcgagagagggagaaacaggcgcggggucucagguuggauuauuuguuggccuuaaguccc

SEQ ID NO: 327729 - RNA, 64 nt, Human
aaaaaaaauacacagugcaaggacuuuauuauaaagguuggauguaguuuuccuuagaaauuua

SEQ ID NO: 327730 - RNA, 64 nt, Human
ucugggccuuaguuuccucaguuacaaccuaaggagguuggauuggaugcuugcuaauuuccuu

SEQ ID NO: 327731 - RNA, 64 nt, Human; identical to SEQ ID NO: 190503

SEQ ID NO: 327732 - RNA, 64 nt, Human; identical to SEQ ID NO: 190504

SEQ ID NO: 327733 - RNA, 64 nt, Human; identical to SEQ ID NO: 190505

SEQ ID NO: 327734 - RNA, 64 nt, Human; identical to SEQ ID NO: 190506

SEQ ID NO: 327735 - RNA, 64 nt, Human; identical to SEQ ID NO: 190507

SEQ ID NO: 327736 - RNA, 62 nt, Human; identical to SEQ ID NO: 190508

SEQ ID NO: 327737 - RNA, 64 nt, Human; identical to SEQ ID NO: 190509

SEQ ID NO: 327738 - RNA, 64 nt, Human; identical to SEQ ID NO: 190513

SEQ ID NO: 327739 - RNA, 64 nt, Human; identical to SEQ ID NO: 190514

SEQ ID NO: 327740 - RNA, 64 nt, Human; identical to SEQ ID NO: 190515

SEQ ID NO: 327741 - RNA, 64 nt, Human; identical to SEQ ID NO: 190516

SEQ ID NO: 327742 - RNA, 64 nt, Human; identical to SEQ ID NO: 190517

SEQ ID NO: 327743 - RNA, 64 nt, Human; identical to SEQ ID NO: 190518

SEQ ID NO: 327744 - RNA, 64 nt, Human; identical to SEQ ID NO: 190519

SEQ ID NO: 327745 - RNA, 50 nt, Human; identical to SEQ ID NO: 190520

SEQ ID NO: 327746 - RNA, 64 nt, Human; identical to SEQ ID NO: 190521

SEQ ID NO: 327747 - RNA, 64 nt, Human
cugcucucagcuugugccuuguaaauaaauguacagguuggauguggccuccuucccucugugu

SEQ ID NO: 327748 - RNA, 64 nt, Human
cuucagccacaguuuccucaucuguccaguggguagguuggacuggaaaaucucuuuuugacuc

SEQ ID NO: 327749 - RNA, 64 nt, Human
ucugaaggaccucucuagcuggccagugcugaggagguuggagagagaaagggugaaagcagag

SEQ ID NO: 327750 - RNA, 64 nt, Human
uugcauagacuaaauaacucgaacuggcauuuuuagguuggaaagacagcugaauuaguaguua

SEQ ID NO: 327751 - RNA, 64 nt, Human; identical to SEQ ID NO: 190522

SEQ ID NO: 327752 - RNA, 64 nt, Human; identical to SEQ ID NO: 190523

SEQ ID NO: 327753 - RNA, 64 nt, Human; identical to SEQ ID NO: 190524

SEQ ID NO: 327754 - RNA, 64 nt, Human; identical to SEQ ID NO: 190525

SEQ ID NO: 327755 - RNA, 64 nt, Human; identical to SEQ ID NO: 190526

SEQ ID NO: 327756 - RNA, 64 nt, Human; identical to SEQ ID NO: 190527

SEQ ID NO: 327757 - RNA, 64 nt, Human; identical to SEQ ID NO: 190532

SEQ ID NO: 327758 - RNA, 64 nt, Human; identical to SEQ ID NO: 190533

SEQ ID NO: 327759 - RNA, 64 nt, Human; identical to SEQ ID NO: 190534

SEQ ID NO: 327760 - RNA, 64 nt, Human; identical to SEQ ID NO: 190535

SEQ ID NO: 327761 - RNA, 64 nt, Human; identical to SEQ ID NO: 190536

SEQ ID NO: 327762 - RNA, 64 nt, Human; identical to SEQ ID NO: 190537

SEQ ID NO: 327763 - RNA, 64 nt, Human; identical to SEQ ID NO: 190538

SEQ ID NO: 327764 - RNA, 64 nt, Human; identical to SEQ ID NO: 190539

SEQ ID NO: 327765 - RNA, 64 nt, Human; identical to SEQ ID NO: 190540

SEQ ID NO: 327766 - RNA, 64 nt, Human; identical to SEQ ID NO: 190541

SEQ ID NO: 327767 - RNA, 64 nt, Human
augacaugaugaaaggaacagaaacaguguuauuagguuggaggacaccgacuaauuugggaaa

SEQ ID NO: 327768 - RNA, 64 nt, Human
guuaagguuggcucuggccaggauuccaggcagcagguuggagugacuggugggccuagaucac

SEQ ID NO: 327769 - RNA, 64 nt, Human
gaguagagucaggagaaaccccugacaccuuuucagguuggagugcauucauucauccucuuau

SEQ ID NO: 327770 - RNA, 64 nt, Human
caguccuuggaccauucugauccaguucaccaguagguuggacagcauauaauuugcaucauuu

SEQ ID NO: 327771 - RNA, 64 nt, Human; identical to SEQ ID NO: 190542

SEQ ID NO: 327772 - RNA, 64 nt, Human; identical to SEQ ID NO: 190543

SEQ ID NO: 327773 - RNA, 64 nt, Human; identical to SEQ ID NO: 190544

SEQ ID NO: 327774 - RNA, 64 nt, Human; identical to SEQ ID NO: 190545

SEQ ID NO: 327775 - RNA, 64 nt, Human; identical to SEQ ID NO: 190546

SEQ ID NO: 327776 - RNA, 64 nt, Human; identical to SEQ ID NO: 190550

SEQ ID NO: 327777 - RNA, 64 nt, Human; identical to SEQ ID NO: 190551

SEQ ID NO: 327778 - RNA, 64 nt, Human; identical to SEQ ID NO: 190552

SEQ ID NO: 327779 - RNA, 64 nt, Human; identical to SEQ ID NO: 190553

SEQ ID NO: 327780 - RNA, 64 nt, Human; identical to SEQ ID NO: 190554

SEQ ID NO: 327781 - RNA, 64 nt, Human; identical to SEQ ID NO: 190555

SEQ ID NO: 327782 - RNA, 64 nt, Human; identical to SEQ ID NO: 190556

SEQ ID NO: 327783 - RNA, 64 nt, Human; identical to SEQ ID NO: 190557

SEQ ID NO: 327784 - RNA, 64 nt, Human; identical to SEQ ID NO: 190558

SEQ ID NO: 327785 - RNA, 64 nt, Human; identical to SEQ ID NO: 190559

SEQ ID NO: 327786 - RNA, 64 nt, Human; identical to SEQ ID NO: 190560

SEQ ID NO: 327787 - RNA, 64 nt, Human
ccuuuuuuuuuuugaaaugggaucucugucgcccagguuggagugccauggcaccaucucggcu

SEQ ID NO: 327788 - RNA, 64 nt, Human
acacuuccuugcuuuggccagaagccaucagguaagguuggaaagagccucugaccucccuugu

SEQ ID NO: 327789 - RNA, 64 nt, Human
ugauaucucugagggccugcaaggaggcaaagugagguuggagcagagagcuggaaagguaaga

SEQ ID NO: 327790 - RNA, 64 nt, Human
ugagaagaaucagaaaaagaagacccaucagcacagguuggauagggguuaguguaggagacca

SEQ ID NO: 327791 - RNA, 64 nt, Human; identical to SEQ ID NO: 190561

SEQ ID NO: 327792 - RNA, 64 nt, Human; identical to SEQ ID NO: 190562

SEQ ID NO: 327793 - RNA, 64 nt, Human; identical to SEQ ID NO: 190563

SEQ ID NO: 327794 - RNA, 64 nt, Human; identical to SEQ ID NO: 190564

SEQ ID NO: 327795 - RNA, 64 nt, Human; identical to SEQ ID NO: 190568

SEQ ID NO: 327796 - RNA, 64 nt, Human; identical to SEQ ID NO: 190569

SEQ ID NO: 327797 - RNA, 64 nt, Human; identical to SEQ ID NO: 190570

SEQ ID NO: 327798 - RNA, 64 nt, Human; identical to SEQ ID NO: 190571

SEQ ID NO: 327799 - RNA, 64 nt, Human; identical to SEQ ID NO: 190572

SEQ ID NO: 327800 - RNA, 64 nt, Human; identical to SEQ ID NO: 190573

SEQ ID NO: 327801 - RNA, 64 nt, Human; identical to SEQ ID NO: 190574

SEQ ID NO: 327802 - RNA, 64 nt, Human; identical to SEQ ID NO: 190575

SEQ ID NO: 327803 - RNA, 64 nt, Human; identical to SEQ ID NO: 190576

SEQ ID NO: 327804 - RNA, 64 nt, Human; identical to SEQ ID NO: 190577

SEQ ID NO: 327805 - RNA, 64 nt, Human; identical to SEQ ID NO: 190578

SEQ ID NO: 327806 - RNA, 64 nt, Human; identical to SEQ ID NO: 190579

SEQ ID NO: 327807 - RNA, 64 nt, Human
ccagcgccacacaacaucaagaaggccgacaaccagguuggaaaccaagacggagcucagaccc

SEQ ID NO: 327808 - RNA, 64 nt, Human
aagaaacaaaauauuuuuuaaacaagaauaauaaagguuggagauuguuacgcuugaaauuaag

SEQ ID NO: 327809 - RNA, 64 nt, Human
gaggcuuuucagaagagaaagacagaaggauguaagguuggaguuguauuggcuggaauuugaa

SEQ ID NO: 327810 - RNA, 64 nt, Human; identical to SEQ ID NO: 190580

SEQ ID NO: 327811 - RNA, 64 nt, Human; identical to SEQ ID NO: 190581

SEQ ID NO: 327812 - RNA, 64 nt, Human; identical to SEQ ID NO: 190582

SEQ ID NO: 327813 - RNA, 64 nt, Human; identical to SEQ ID NO: 190586

SEQ ID NO: 327814 - RNA, 64 nt, Human; identical to SEQ ID NO: 190587

SEQ ID NO: 327815 - RNA, 64 nt, Human; identical to SEQ ID NO: 190588

SEQ ID NO: 327816 - RNA, 64 nt, Human; identical to SEQ ID NO: 190589

SEQ ID NO: 327817 - RNA, 59 nt, Human; identical to SEQ ID NO: 190590

SEQ ID NO: 327818 - RNA, 64 nt, Human; identical to SEQ ID NO: 190591

SEQ ID NO: 327819 - RNA, 64 nt, Human; identical to SEQ ID NO: 190592

SEQ ID NO: 327820 - RNA, 64 nt, Human; identical to SEQ ID NO: 190593

SEQ ID NO: 327821 - RNA, 64 nt, Human; identical to SEQ ID NO: 190594

SEQ ID NO: 327822 - RNA, 64 nt, Human; identical to SEQ ID NO: 190595

SEQ ID NO: 327823 - RNA, 64 nt, Human; identical to SEQ ID NO: 190596

SEQ ID NO: 327824 - RNA, 64 nt, Human; identical to SEQ ID NO: 190597

SEQ ID NO: 327825 - RNA, 64 nt, Human; identical to SEQ ID NO: 190598

SEQ ID NO: 327826 - RNA, 64 nt, Human
ggaccuuccccuacucugccucuuccuccauacuagguuggaaaaaucugguuuagcccacuuu

SEQ ID NO: 327827 - RNA, 64 nt, Human
uuaaacuuuggaacagcgaauuuggauguuccagagguuggacuuguauuagguaauaaagcug

SEQ ID NO: 327828 - RNA, 62 nt, Human
gaucuugucaaacccagccugaccgcuucugacgccgggauggccucguuacuagacuuuuc

SEQ ID NO: 327829 - RNA, 62 nt, Human
ccccaagaacgugacguucgugauguccugcccgccgggagucuuuccccacaccccagcca

SEQ ID NO: 327830 - RNA, 64 nt, Human; identical to SEQ ID NO: 190599

SEQ ID NO: 327831 - RNA, 64 nt, Human; identical to SEQ ID NO: 190600

SEQ ID NO: 327832 - RNA, 64 nt, Human; identical to SEQ ID NO: 190604

SEQ ID NO: 327833 - RNA, 64 nt, Human; identical to SEQ ID NO: 190605

SEQ ID NO: 327834 - RNA, 64 nt, Human; identical to SEQ ID NO: 190606

SEQ ID NO: 327835 - RNA, 64 nt, Human; identical to SEQ ID NO: 190607

SEQ ID NO: 327836 - RNA, 64 nt, Human; identical to SEQ ID NO: 190608

SEQ ID NO: 327837 - RNA, 64 nt, Human; identical to SEQ ID NO: 190609

SEQ ID NO: 327838 - RNA, 64 nt, Human; identical to SEQ ID NO: 190610

SEQ ID NO: 327839 - RNA, 64 nt, Human; identical to SEQ ID NO: 190611

SEQ ID NO: 327840 - RNA, 64 nt, Human; identical to SEQ ID NO: 190612

SEQ ID NO: 327841 - RNA, 64 nt, Human; identical to SEQ ID NO: 190613

SEQ ID NO: 327842 - RNA, 64 nt, Human; identical to SEQ ID NO: 190614

SEQ ID NO: 327843 - RNA, 64 nt, Human; identical to SEQ ID NO: 190615

SEQ ID NO: 327844 - RNA, 64 nt, Human; identical to SEQ ID NO: 190616

SEQ ID NO: 327845 - RNA, 64 nt, Human; identical to SEQ ID NO: 190617

SEQ ID NO: 327846 - RNA, 64 nt, Human
ggucugagcuugugaaaagaaagugguuggucugagguuggaggaagcugaauggaaucugacg

SEQ ID NO: 327847 - RNA, 64 nt, Human
cgcugccucaacacuuguccagacaccucuggccagguuggacccgcacacuuacuuucaucua

SEQ ID NO: 327848 - RNA, 62 nt, Human
agucgaguugacucucggcuccacuagggaggcgccgggagguugccugcgucuccuuggag

SEQ ID NO: 327849 - RNA, 62 nt, Human
ccugcgggaggcagcgacggcccccacgcagacgccgggaacgcaggccgcuuuauuccucu

SEQ ID NO: 327850 - RNA, 64 nt, Human; identical to SEQ ID NO: 190618

SEQ ID NO: 327851 - RNA, 64 nt, Human; identical to SEQ ID NO: 190622

SEQ ID NO: 327852 - RNA, 64 nt, Human; identical to SEQ ID NO: 190623

SEQ ID NO: 327853 - RNA, 64 nt, Human; identical to SEQ ID NO: 190624

SEQ ID NO: 327854 - RNA, 64 nt, Human; identical to SEQ ID NO: 190625

SEQ ID NO: 327855 - RNA, 64 nt, Human; identical to SEQ ID NO: 190626

SEQ ID NO: 327856 - RNA, 64 nt, Human; identical to SEQ ID NO: 190627

SEQ ID NO: 327857 - RNA, 64 nt, Human; identical to SEQ ID NO: 190628

SEQ ID NO: 327858 - RNA, 64 nt, Human; identical to SEQ ID NO: 190629

SEQ ID NO: 327859 - RNA, 64 nt, Human; identical to SEQ ID NO: 190630

SEQ ID NO: 327860 - RNA, 64 nt, Human; identical to SEQ ID NO: 190631

SEQ ID NO: 327861 - RNA, 64 nt, Human; identical to SEQ ID NO: 190632

SEQ ID NO: 327862 - RNA, 64 nt, Human; identical to SEQ ID NO: 190633

SEQ ID NO: 327863 - RNA, 64 nt, Human; identical to SEQ ID NO: 190634

SEQ ID NO: 327864 - RNA, 64 nt, Human; identical to SEQ ID NO: 190635

SEQ ID NO: 327865 - RNA, 64 nt, Human; identical to SEQ ID NO: 190636

SEQ ID NO: 327866 - RNA, 64 nt, Human; identical to SEQ ID NO: 190640

SEQ ID NO: 327867 - RNA, 64 nt, Human; identical to SEQ ID NO: 190641

SEQ ID NO: 327868 - RNA, 64 nt, Human; identical to SEQ ID NO: 190642

SEQ ID NO: 327869 - RNA, 64 nt, Human; identical to SEQ ID NO: 190643

SEQ ID NO: 327870 - RNA, 64 nt, Human; identical to SEQ ID NO: 190644

SEQ ID NO: 327871 - RNA, 64 nt, Human; identical to SEQ ID NO: 190645

SEQ ID NO: 327872 - RNA, 64 nt, Human; identical to SEQ ID NO: 190646

SEQ ID NO: 327873 - RNA, 64 nt, Human; identical to SEQ ID NO: 190647

SEQ ID NO: 327874 - RNA, 64 nt, Human; identical to SEQ ID NO: 190648

SEQ ID NO: 327875 - RNA, 64 nt, Human; identical to SEQ ID NO: 190649

SEQ ID NO: 327876 - RNA, 64 nt, Human; identical to SEQ ID NO: 190650

SEQ ID NO: 327877 - RNA, 55 nt, Human; identical to SEQ ID NO: 190651

SEQ ID NO: 327878 - RNA, 64 nt, Human; identical to SEQ ID NO: 190652

SEQ ID NO: 327879 - RNA, 64 nt, Human; identical to SEQ ID NO: 190653

SEQ ID NO: 327880 - RNA, 64 nt, Human; identical to SEQ ID NO: 190654

SEQ ID NO: 327881 - RNA, 64 nt, Human; identical to SEQ ID NO: 190658

SEQ ID NO: 327882 - RNA, 64 nt, Human
caccagagagcuuucagcugagggagaguucucuagguuggagugggcaucacagccagggugg

SEQ ID NO: 327883 - RNA, 64 nt, Human
cagaaguugucauaaauggucagaaagaacgaucagguuggagacuugggaaacccagggccua

SEQ ID NO: 327884 - RNA, 64 nt, Human
auaaaccaagauagauccauuuggacaaaauggaagguuggagacguguauccccgugaaaucu

SEQ ID NO: 327885 - RNA, 64 nt, Human
cuuaaguccuugaucugccugucuguggaaugggagguuggauuagcugcgcugaggucccauc

SEQ ID NO: 327886 - RNA, 64 nt, Human; identical to SEQ ID NO: 190659

SEQ ID NO: 327887 - RNA, 61 nt, Human; identical to SEQ ID NO: 190660

SEQ ID NO: 327888 - RNA, 64 nt, Human; identical to SEQ ID NO: 190661

SEQ ID NO: 327889 - RNA, 64 nt, Human; identical to SEQ ID NO: 190662

SEQ ID NO: 327890 - RNA, 64 nt, Human; identical to SEQ ID NO: 190663

SEQ ID NO: 327891 - RNA, 64 nt, Human; identical to SEQ ID NO: 190664

SEQ ID NO: 327892 - RNA, 64 nt, Human; identical to SEQ ID NO: 190665

SEQ ID NO: 327893 - RNA, 64 nt, Human; identical to SEQ ID NO: 190666

SEQ ID NO: 327894 - RNA, 64 nt, Human; identical to SEQ ID NO: 190667

SEQ ID NO: 327895 - RNA, 64 nt, Human; identical to SEQ ID NO: 190668

SEQ ID NO: 327896 - RNA, 64 nt, Human; identical to SEQ ID NO: 190669

SEQ ID NO: 327897 - RNA, 64 nt, Human; identical to SEQ ID NO: 190670

SEQ ID NO: 327898 - RNA, 64 nt, Human; identical to SEQ ID NO: 190671

SEQ ID NO: 327899 - RNA, 64 nt, Human; identical to SEQ ID NO: 190672

SEQ ID NO: 327900 - RNA, 64 nt, Human; identical to SEQ ID NO: 190677

SEQ ID NO: 327901 - RNA, 64 nt, Human; identical to SEQ ID NO: 190678

SEQ ID NO: 327902 - RNA, 64 nt, Human
uuuuuuuuugagauggaaucucgcucugucacccagguuggaguucaguggcacaaucucggcu

SEQ ID NO: 327903 - RNA, 64 nt, Human
caguccugggagacccauguaaauaccagacugcagguuggaccccagagauucccaagccaaa

SEQ ID NO: 327904 - RNA, 64 nt, Human
cucacccuccuuccacauaaugcucuauccucuaagguuggaacucugaaguuggagaaggugg

SEQ ID NO: 327905 - RNA, 64 nt, Human
aaauccuauaacuugcuuuacuuuacuuugucccagguuggagucccuacccucccaccuccca

SEQ ID NO: 327906 - RNA, 64 nt, Human; identical to SEQ ID NO: 190679

SEQ ID NO: 327907 - RNA, 62 nt, Human; identical to SEQ ID NO: 190680

SEQ ID NO: 327908 - RNA, 64 nt, Human; identical to SEQ ID NO: 190681

SEQ ID NO: 327909 - RNA, 64 nt, Human; identical to SEQ ID NO: 190682

SEQ ID NO: 327910 - RNA, 64 nt, Human; identical to SEQ ID NO: 190683

SEQ ID NO: 327911 - RNA, 58 nt, Human; identical to SEQ ID NO: 190684

SEQ ID NO: 327912 - RNA, 64 nt, Human; identical to SEQ ID NO: 190685

SEQ ID NO: 327913 - RNA, 64 nt, Human; identical to SEQ ID NO: 190686

SEQ ID NO: 327914 - RNA, 64 nt, Human; identical to SEQ ID NO: 190687

SEQ ID NO: 327915 - RNA, 64 nt, Human; identical to SEQ ID NO: 190688

SEQ ID NO: 327916 - RNA, 64 nt, Human; identical to SEQ ID NO: 190689

SEQ ID NO: 327917 - RNA, 64 nt, Human; identical to SEQ ID NO: 190690

SEQ ID NO: 327918 - RNA, 64 nt, Human; identical to SEQ ID NO: 190691

SEQ ID NO: 327919 - RNA, 64 nt, Human; identical to SEQ ID NO: 190696

SEQ ID NO: 327920 - RNA, 64 nt, Human; identical to SEQ ID NO: 190697

SEQ ID NO: 327921 - RNA, 64 nt, Human; identical to SEQ ID NO: 190698

SEQ ID NO: 327922 - RNA, 64 nt, Human
uuuaaugaaggaaacguucaauaagugagucaugagguuggaaauucguuccccugacagucau

SEQ ID NO: 327923 - RNA, 64 nt, Human
cuuuuuuuuaagauggagucuugcucugucacccagguuggagugccauggcaugaucuuggcu

SEQ ID NO: 327924 - RNA, 64 nt, Human
aaugugggggaacucagaggaacuggggccaccaagguuggaaaaggguuugguucuugacuuu

SEQ ID NO: 327925 - RNA, 64 nt, Human
cuucauaggguuggaauaaggauaaaugagggacagguuggaugccguugcagagaaaaucagc

SEQ ID NO: 327926 - RNA, 64 nt, Human; identical to SEQ ID NO: 190699

SEQ ID NO: 327927 - RNA, 64 nt, Human; identical to SEQ ID NO: 190700

SEQ ID NO: 327928 - RNA, 64 nt, Human; identical to SEQ ID NO: 190701

SEQ ID NO: 327929 - RNA, 64 nt, Human; identical to SEQ ID NO: 190702

SEQ ID NO: 327930 - RNA, 64 nt, Human; identical to SEQ ID NO: 190703

SEQ ID NO: 327931 - RNA, 64 nt, Human; identical to SEQ ID NO: 190704

SEQ ID NO: 327932 - RNA, 64 nt, Human; identical to SEQ ID NO: 190705

SEQ ID NO: 327933 - RNA, 64 nt, Human; identical to SEQ ID NO: 190706

SEQ ID NO: 327934 - RNA, 64 nt, Human; identical to SEQ ID NO: 190707

SEQ ID NO: 327935 - RNA, 64 nt, Human; identical to SEQ ID NO: 190708

SEQ ID NO: 327936 - RNA, 64 nt, Human; identical to SEQ ID NO: 190709

SEQ ID NO: 327937 - RNA, 64 nt, Human; identical to SEQ ID NO: 190710

SEQ ID NO: 327938 - RNA, 64 nt, Human; identical to SEQ ID NO: 190714

SEQ ID NO: 327939 - RNA, 64 nt, Human; identical to SEQ ID NO: 190715

SEQ ID NO: 327940 - RNA, 64 nt, Human; identical to SEQ ID NO: 190716

SEQ ID NO: 327941 - RNA, 64 nt, Human; identical to SEQ ID NO: 190717

SEQ ID NO: 327942 - RNA, 64 nt, Human
cauaugcacuuucuugguugugugugcuauagagagguuggaaggggugguuggaaggggagag

SEQ ID NO: 327943 - RNA, 64 nt, Human
gacuucauucaguccagugugaguauuuuggaguagguuggauguagauuuuguuuuuaucauu

SEQ ID NO: 327944 - RNA, 64 nt, Human
gcuccgcguccuaggaccgccggcgccuccccacggacgccaggcaggccaggccgcucuccgg

SEQ ID NO: 327945 - RNA, 64 nt, Human; identical to SEQ ID NO: 190718

SEQ ID NO: 327946 - RNA, 64 nt, Human; identical to SEQ ID NO: 190719

SEQ ID NO: 327947 - RNA, 64 nt, Human; identical to SEQ ID NO: 190720

SEQ ID NO: 327948 - RNA, 64 nt, Human; identical to SEQ ID NO: 190721

SEQ ID NO: 327949 - RNA, 64 nt, Human; identical to SEQ ID NO: 190722

SEQ ID NO: 327950 - RNA, 64 nt, Human; identical to SEQ ID NO: 190723

SEQ ID NO: 327951 - RNA, 64 nt, Human; identical to SEQ ID NO: 190724

SEQ ID NO: 327952 - RNA, 64 nt, Human; identical to SEQ ID NO: 190725

SEQ ID NO: 327953 - RNA, 64 nt, Human; identical to SEQ ID NO: 190726

SEQ ID NO: 327954 - RNA, 64 nt, Human; identical to SEQ ID NO: 190727

SEQ ID NO: 327955 - RNA, 64 nt, Human; identical to SEQ ID NO: 190728

SEQ ID NO: 327956 - RNA, 64 nt, Human; identical to SEQ ID NO: 190732

SEQ ID NO: 327957 - RNA, 64 nt, Human; identical to SEQ ID NO: 190733

SEQ ID NO: 327958 - RNA, 64 nt, Human; identical to SEQ ID NO: 190734

SEQ ID NO: 327959 - RNA, 64 nt, Human; identical to SEQ ID NO: 190735

SEQ ID NO: 327960 - RNA, 64 nt, Human; identical to SEQ ID NO: 190736

SEQ ID NO: 327961 - RNA, 64 nt, Human
auccggcuccaagcacacugugcccugcucuuugagguuggagauuuacaguaugccuccccug

SEQ ID NO: 327962 - RNA, 64 nt, Human
ugaucagguuaguggugucugucagcugucuaagagguuggaaaaugaacuacucaagauaguc

SEQ ID NO: 327963 - RNA, 64 nt, Human
cagacuguuuuuaaagcaccuggcgggaagcagaagguuggauccaagcccuuguucagauuug

SEQ ID NO: 327964 - RNA, 64 nt, Human
cccacauuaagcacuguggaucacgacaggaaaaagguuggagcagugcuuuucacuacuuugu

SEQ ID NO: 327965 - RNA, 64 nt, Human; identical to SEQ ID NO: 190737

SEQ ID NO: 327966 - RNA, 64 nt, Human; identical to SEQ ID NO: 190738

SEQ ID NO: 327967 - RNA, 64 nt, Human; identical to SEQ ID NO: 190739

SEQ ID NO: 327968 - RNA, 64 nt, Human; identical to SEQ ID NO: 190740

SEQ ID NO: 327969 - RNA, 64 nt, Human; identical to SEQ ID NO: 190741

SEQ ID NO: 327970 - RNA, 64 nt, Human; identical to SEQ ID NO: 190742

SEQ ID NO: 327971 - RNA, 64 nt, Human; identical to SEQ ID NO: 190743

SEQ ID NO: 327972 - RNA, 64 nt, Human; identical to SEQ ID NO: 190744

SEQ ID NO: 327973 - RNA, 64 nt, Human; identical to SEQ ID NO: 190745

SEQ ID NO: 327974 - RNA, 64 nt, Human; identical to SEQ ID NO: 190746

SEQ ID NO: 327975 - RNA, 64 nt, Human; identical to SEQ ID NO: 190750

SEQ ID NO: 327976 - RNA, 64 nt, Human; identical to SEQ ID NO: 190751

SEQ ID NO: 327977 - RNA, 64 nt, Human; identical to SEQ ID NO: 190752

SEQ ID NO: 327978 - RNA, 64 nt, Human; identical to SEQ ID NO: 190753

SEQ ID NO: 327979 - RNA, 64 nt, Human; identical to SEQ ID NO: 190754

SEQ ID NO: 327980 - RNA, 64 nt, Human; identical to SEQ ID NO: 190755

SEQ ID NO: 327981 - RNA, 64 nt, Human
uaucaacaucauuuuucuauaucauacucuugugagguuggauuuaaccacagaggcagaaagu

SEQ ID NO: 327982 - RNA, 64 nt, Human
uacucugcccucuagagccuucagccuuaauggaagguuggauccaaggaggguguaauggagc

SEQ ID NO: 327983 - RNA, 64 nt, Human
aggaagccuggcugcagcuucccauuugguuacgagguuggagaaaaagucaaaguccccuccu

SEQ ID NO: 327984 - RNA, 64 nt, Human
aaugacuuucagguuuguugaacaaugccuuuucagguuggaagaagaaaaauagccucaaucu

SEQ ID NO: 327985 - RNA, 64 nt, Human; identical to SEQ ID NO: 190756

SEQ ID NO: 327986 - RNA, 64 nt, Human; identical to SEQ ID NO: 190757

SEQ ID NO: 327987 - RNA, 64 nt, Human; identical to SEQ ID NO: 190758

SEQ ID NO: 327988 - RNA, 64 nt, Human; identical to SEQ ID NO: 190759

SEQ ID NO: 327989 - RNA, 64 nt, Human; identical to SEQ ID NO: 190760

SEQ ID NO: 327990 - RNA, 64 nt, Human; identical to SEQ ID NO: 190761

SEQ ID NO: 327991 - RNA, 64 nt, Human; identical to SEQ ID NO: 190762

SEQ ID NO: 327992 - RNA, 64 nt, Human; identical to SEQ ID NO: 190763

SEQ ID NO: 327993 - RNA, 64 nt, Human; identical to SEQ ID NO: 190764

SEQ ID NO: 327994 - RNA, 64 nt, Human; identical to SEQ ID NO: 190769

SEQ ID NO: 327995 - RNA, 64 nt, Human; identical to SEQ ID NO: 190770

SEQ ID NO: 327996 - RNA, 64 nt, Human; identical to SEQ ID NO: 190771

SEQ ID NO: 327997 - RNA, 64 nt, Human; identical to SEQ ID NO: 190772

SEQ ID NO: 327998 - RNA, 64 nt, Human; identical to SEQ ID NO: 190773

SEQ ID NO: 327999 - RNA, 64 nt, Human; identical to SEQ ID NO: 190774

SEQ ID NO: 328000 - RNA, 64 nt, Human; identical to SEQ ID NO: 190775

SEQ ID NO: 328001 - RNA, 64 nt, Human
gccuugaggccuuugcacagacccaccuaagauaagguuggagugauguuuuaaugagacuguu

SEQ ID NO: 328002 - RNA, 64 nt, Human
auugggcucuggccaucugcaacccugaacgugcagguuggagaacgaaugaauacaaauuuua

SEQ ID NO: 328003 - RNA, 64 nt, Human
ggucagggccagacuggaagacacuucagaucugagguuggauuugcucauugcuguaccacau

SEQ ID NO: 328004 - RNA, 64 nt, Human
ucccagguuuuuauuuuuuuuuuccuaucucauuagguuggaagguacuaaauauugaacuguu

SEQ ID NO: 328005 - RNA, 64 nt, Human; identical to SEQ ID NO: 190776

SEQ ID NO: 328006 - RNA, 64 nt, Human; identical to SEQ ID NO: 190777

SEQ ID NO: 328007 - RNA, 64 nt, Human; identical to SEQ ID NO: 190778

SEQ ID NO: 328008 - RNA, 64 nt, Human; identical to SEQ ID NO: 190779

SEQ ID NO: 328009 - RNA, 64 nt, Human; identical to SEQ ID NO: 190780

SEQ ID NO: 328010 - RNA, 64 nt, Human; identical to SEQ ID NO: 190781

SEQ ID NO: 328011 - RNA, 64 nt, Human; identical to SEQ ID NO: 190782

SEQ ID NO: 328012 - RNA, 64 nt, Human; identical to SEQ ID NO: 190783

SEQ ID NO: 328013 - RNA, 64 nt, Human; identical to SEQ ID NO: 190787

SEQ ID NO: 328014 - RNA, 64 nt, Human; identical to SEQ ID NO: 190788

SEQ ID NO: 328015 - RNA, 64 nt, Human; identical to SEQ ID NO: 190789

SEQ ID NO: 328016 - RNA, 64 nt, Human; identical to SEQ ID NO: 190790

SEQ ID NO: 328017 - RNA, 64 nt, Human; identical to SEQ ID NO: 190791

SEQ ID NO: 328018 - RNA, 64 nt, Human; identical to SEQ ID NO: 190792

SEQ ID NO: 328019 - RNA, 64 nt, Human; identical to SEQ ID NO: 190793

SEQ ID NO: 328020 - RNA, 64 nt, Human; identical to SEQ ID NO: 190794

SEQ ID NO: 328021 - RNA, 64 nt, Human
aggugagaugggcaaauaggcuuaacuauuuugaagguuggaugaaaagagaugggucaguauu

SEQ ID NO: 328022 - RNA, 64 nt, Human
uuugaugucaccuugguaggcugggcccucugagagguuggaagcucuaggcauuguucucuuu

SEQ ID NO: 328023 - RNA, 64 nt, Human
ucuccaccugcacccugcuuccuggcccagucccagguuggagucccucugcauagcugacuac

SEQ ID NO: 328024 - RNA, 64 nt, Human
agugcugcucuccaggaucuccacuacauguuccagguuggagugaggacgcgcuaugugcuca

SEQ ID NO: 328025 - RNA, 64 nt, Human; identical to SEQ ID NO: 190795

SEQ ID NO: 328026 - RNA, 64 nt, Human; identical to SEQ ID NO: 190796

SEQ ID NO: 328027 - RNA, 64 nt, Human; identical to SEQ ID NO: 190797

SEQ ID NO: 328028 - RNA, 64 nt, Human; identical to SEQ ID NO: 190798

SEQ ID NO: 328029 - RNA, 64 nt, Human; identical to SEQ ID NO: 190799

SEQ ID NO: 328030 - RNA, 64 nt, Human; identical to SEQ ID NO: 190800

SEQ ID NO: 328031 - RNA, 64 nt, Human; identical to SEQ ID NO: 190801

SEQ ID NO: 328032 - RNA, 64 nt, Human; identical to SEQ ID NO: 190805

SEQ ID NO: 328033 - RNA, 64 nt, Human; identical to SEQ ID NO: 190806

SEQ ID NO: 328034 - RNA, 56 nt, Human; identical to SEQ ID NO: 190807

SEQ ID NO: 328035 - RNA, 64 nt, Human; identical to SEQ ID NO: 190808

SEQ ID NO: 328036 - RNA, 64 nt, Human; identical to SEQ ID NO: 190809

SEQ ID NO: 328037 - RNA, 64 nt, Human; identical to SEQ ID NO: 190810

SEQ ID NO: 328038 - RNA, 64 nt, Human; identical to SEQ ID NO: 190811

SEQ ID NO: 328039 - RNA, 64 nt, Human; identical to SEQ ID NO: 190812

SEQ ID NO: 328040 - RNA, 64 nt, Human; identical to SEQ ID NO: 190813

SEQ ID NO: 328041 - RNA, 64 nt, Human
acccaccccccguggcacucauggagggggcugcagguuggaacuaugcagugugcuccggcca

SEQ ID NO: 328042 - RNA, 64 nt, Human
guacaauguggcuggggagggagaggaugggaccagguuggaccacguggcaucagagguccca

SEQ ID NO: 328043 - RNA, 64 nt, Human
gccccgacuccagccagcgccucccuccaccccaggacgccacucauuucaucucauuuaaggg

SEQ ID NO: 328044 - RNA, 64 nt, Human; identical to SEQ ID NO: 190814

SEQ ID NO: 328045 - RNA, 64 nt, Human; identical to SEQ ID NO: 190815

SEQ ID NO: 328046 - RNA, 64 nt, Human; identical to SEQ ID NO: 190816

SEQ ID NO: 328047 - RNA, 64 nt, Human; identical to SEQ ID NO: 190817

SEQ ID NO: 328048 - RNA, 64 nt, Human; identical to SEQ ID NO: 190818

SEQ ID NO: 328049 - RNA, 64 nt, Human; identical to SEQ ID NO: 190819

SEQ ID NO: 328050 - RNA, 64 nt, Human; identical to SEQ ID NO: 190823

SEQ ID NO: 328051 - RNA, 64 nt, Human; identical to SEQ ID NO: 190824

SEQ ID NO: 328052 - RNA, 64 nt, Human; identical to SEQ ID NO: 190825

SEQ ID NO: 328053 - RNA, 64 nt, Human; identical to SEQ ID NO: 190826

SEQ ID NO: 328054 - RNA, 64 nt, Human; identical to SEQ ID NO: 190827

SEQ ID NO: 328055 - RNA, 64 nt, Human; identical to SEQ ID NO: 190828

SEQ ID NO: 328056 - RNA, 64 nt, Human; identical to SEQ ID NO: 190829

SEQ ID NO: 328057 - RNA, 64 nt, Human; identical to SEQ ID NO: 190830

SEQ ID NO: 328058 - RNA, 64 nt, Human; identical to SEQ ID NO: 190831

SEQ ID NO: 328059 - RNA, 64 nt, Human; identical to SEQ ID NO: 190832

SEQ ID NO: 328060 - RNA, 64 nt, Human
ugcuugucuuaugcagaaauauaaagcgauggccagguuggacuucaucucucuccuuugguau

SEQ ID NO: 328061 - RNA, 64 nt, Human
cucuggacucauugcugauuggaacaccaggaggagguuggauuucugccagugggggauguuu

SEQ ID NO: 328062 - RNA, 64 nt, Human
ccccagacacacucucugccugguggucagaugcagguuggaaggggccuugcugaguggcgca

SEQ ID NO: 328063 - RNA, 64 nt, Human; identical to SEQ ID NO: 190833

SEQ ID NO: 328064 - RNA, 64 nt, Human; identical to SEQ ID NO: 190834

SEQ ID NO: 328065 - RNA, 64 nt, Human; identical to SEQ ID NO: 190835

SEQ ID NO: 328066 - RNA, 64 nt, Human; identical to SEQ ID NO: 190836

SEQ ID NO: 328067 - RNA, 64 nt, Human; identical to SEQ ID NO: 190837

SEQ ID NO: 328068 - RNA, 64 nt, Human; identical to SEQ ID NO: 190841

SEQ ID NO: 328069 - RNA, 64 nt, Human; identical to SEQ ID NO: 190842

SEQ ID NO: 328070 - RNA, 64 nt, Human; identical to SEQ ID NO: 190843

SEQ ID NO: 328071 - RNA, 64 nt, Human; identical to SEQ ID NO: 190844

SEQ ID NO: 328072 - RNA, 64 nt, Human; identical to SEQ ID NO: 190845

SEQ ID NO: 328073 - RNA, 64 nt, Human; identical to SEQ ID NO: 190846

SEQ ID NO: 328074 - RNA, 64 nt, Human; identical to SEQ ID NO: 190847

SEQ ID NO: 328075 - RNA, 64 nt, Human; identical to SEQ ID NO: 190848

SEQ ID NO: 328076 - RNA, 58 nt, Human; identical to SEQ ID NO: 190849

SEQ ID NO: 328077 - RNA, 64 nt, Human; identical to SEQ ID NO: 190850

SEQ ID NO: 328078 - RNA, 64 nt, Human; identical to SEQ ID NO: 190851

SEQ ID NO: 328079 - RNA, 64 nt, Human
gaacaugucggaguccuucagagaaugugaugugagguuggaucaacaguguggguuccugucc

SEQ ID NO: 328080 - RNA, 64 nt, Human
agaaggguaggcgagggguucggaguguauuuucagguuggaaugugaagguuccuggcuucca

SEQ ID NO: 328081 - RNA, 64 nt, Human
auggggucuccagcugaaagccccuccgggaggcagguuggaaggcaggcaccacggcagguuu

SEQ ID NO: 328082 - RNA, 64 nt, Human
ucugcaugucagcgagcgacacugucccugccucagguuggagguuuuaucagccaaaguguuu

SEQ ID NO: 328083 - RNA, 64 nt, Human; identical to SEQ ID NO: 190852

SEQ ID NO: 328084 - RNA, 64 nt, Human; identical to SEQ ID NO: 190853

SEQ ID NO: 328085 - RNA, 64 nt, Human; identical to SEQ ID NO: 190854

SEQ ID NO: 328086 - RNA, 64 nt, Human; identical to SEQ ID NO: 190855

SEQ ID NO: 328087 - RNA, 64 nt, Human; identical to SEQ ID NO: 190860

SEQ ID NO: 328088 - RNA, 64 nt, Human; identical to SEQ ID NO: 190861

SEQ ID NO: 328089 - RNA, 64 nt, Human; identical to SEQ ID NO: 190862

SEQ ID NO: 328090 - RNA, 64 nt, Human; identical to SEQ ID NO: 190863

SEQ ID NO: 328091 - RNA, 64 nt, Human; identical to SEQ ID NO: 190864

SEQ ID NO: 328092 - RNA, 64 nt, Human; identical to SEQ ID NO: 190865

SEQ ID NO: 328093 - RNA, 64 nt, Human; identical to SEQ ID NO: 190866

SEQ ID NO: 328094 - RNA, 64 nt, Human; identical to SEQ ID NO: 190867

SEQ ID NO: 328095 - RNA, 64 nt, Human; identical to SEQ ID NO: 190868

SEQ ID NO: 328096 - RNA, 64 nt, Human; identical to SEQ ID NO: 190869

SEQ ID NO: 328097 - RNA, 64 nt, Human; identical to SEQ ID NO: 190870

SEQ ID NO: 328098 - RNA, 64 nt, Human; identical to SEQ ID NO: 190871

SEQ ID NO: 328099 - RNA, 64 nt, Human
uugauggacaaaaugagauucucaccaggacuucagguuggauaacaugucaaaaagagaagag

SEQ ID NO: 328100 - RNA, 64 nt, Human
cuauggaagaaagaauuuuuuagauacuaucauuagguuggauaugguaauagauauauuucag

SEQ ID NO: 328101 - RNA, 64 nt, Human
ucugugcccaacguauauaguuuugacaaugaccagguuggacuguuuaaugucuuucaacuua

SEQ ID NO: 328102 - RNA, 64 nt, Human
ccugccagugugaugaguacggaaaagucuucagagguuggaacuugggaaaaaucagugagug

SEQ ID NO: 328103 - RNA, 64 nt, Human; identical to SEQ ID NO: 190872

SEQ ID NO: 328104 - RNA, 64 nt, Human; identical to SEQ ID NO: 190873

SEQ ID NO: 328105 - RNA, 64 nt, Human; identical to SEQ ID NO: 190874

SEQ ID NO: 328106 - RNA, 64 nt, Human; identical to SEQ ID NO: 190878

SEQ ID NO: 328107 - RNA, 64 nt, Human; identical to SEQ ID NO: 190879

SEQ ID NO: 328108 - RNA, 64 nt, Human; identical to SEQ ID NO: 190880

SEQ ID NO: 328109 - RNA, 64 nt, Human; identical to SEQ ID NO: 190881

SEQ ID NO: 328110 - RNA, 64 nt, Human; identical to SEQ ID NO: 190882

SEQ ID NO: 328111 - RNA, 64 nt, Human; identical to SEQ ID NO: 190883

SEQ ID NO: 328112 - RNA, 64 nt, Human; identical to SEQ ID NO: 190884

SEQ ID NO: 328113 - RNA, 64 nt, Human; identical to SEQ ID NO: 190885

SEQ ID NO: 328114 - RNA, 64 nt, Human; identical to SEQ ID NO: 190886

SEQ ID NO: 328115 - RNA, 64 nt, Human; identical to SEQ ID NO: 190887

SEQ ID NO: 328116 - RNA, 64 nt, Human; identical to SEQ ID NO: 190888

SEQ ID NO: 328117 - RNA, 64 nt, Human; identical to SEQ ID NO: 190889

SEQ ID NO: 328118 - RNA, 64 nt, Human; identical to SEQ ID NO: 190890

SEQ ID NO: 328119 - RNA, 64 nt, Human
cccucccauuaaagauccgggcaggacuggggacagguuggaagugugaugggugggggggugg

SEQ ID NO: 328120 - RNA, 64 nt, Human
gugcagagggccagagaauggcuuaugggggcccagguuggauggggaaaggcuaaugggguca

SEQ ID NO: 328121 - RNA, 64 nt, Human
uuaaugaggucuuuaaaccuuucauaauuuuuaaagguuggaaucuuuuauaaugauucauaag

SEQ ID NO: 328122 - RNA, 64 nt, Human
uucuuuuuugagauggagucuugcucugucgcccagguuggagugcaguggcgugaucucggcu

SEQ ID NO: 328123 - RNA, 64 nt, Human; identical to SEQ ID NO: 190891

SEQ ID NO: 328124 - RNA, 64 nt, Human; identical to SEQ ID NO: 190892

SEQ ID NO: 328125 - RNA, 64 nt, Human; identical to SEQ ID NO: 190896

SEQ ID NO: 328126 - RNA, 64 nt, Human; identical to SEQ ID NO: 190897

SEQ ID NO: 328127 - RNA, 53 nt, Human; identical to SEQ ID NO: 190898

SEQ ID NO: 328128 - RNA, 64 nt, Human; identical to SEQ ID NO: 190899

SEQ ID NO: 328129 - RNA, 64 nt, Human; identical to SEQ ID NO: 190900

SEQ ID NO: 328130 - RNA, 64 nt, Human; identical to SEQ ID NO: 190901

SEQ ID NO: 328131 - RNA, 64 nt, Human; identical to SEQ ID NO: 190902

SEQ ID NO: 328132 - RNA, 64 nt, Human; identical to SEQ ID NO: 190903

SEQ ID NO: 328133 - RNA, 64 nt, Human; identical to SEQ ID NO: 190904

SEQ ID NO: 328134 - RNA, 64 nt, Human; identical to SEQ ID NO: 190905

SEQ ID NO: 328135 - RNA, 64 nt, Human; identical to SEQ ID NO: 190906

SEQ ID NO: 328136 - RNA, 64 nt, Human; identical to SEQ ID NO: 190907

SEQ ID NO: 328137 - RNA, 64 nt, Human; identical to SEQ ID NO: 190908

SEQ ID NO: 328138 - RNA, 64 nt, Human; identical to SEQ ID NO: 190909

SEQ ID NO: 328139 - RNA, 64 nt, Human; identical to SEQ ID NO: 328122

SEQ ID NO: 328140 - RNA, 64 nt, Human
caugcccacagaagucaucagaccuuaccaaaguagguuggagaauuagauugccuuuucaugc

SEQ ID NO: 328141 - RNA, 64 nt, Human
agaagugcuguauuccacaagguuuaagucagugagguuggaagauacccuaucuuuuuuauuc

SEQ ID NO: 328142 - RNA, 64 nt, Human; identical to SEQ ID NO: 190910

SEQ ID NO: 328143 - RNA, 64 nt, Human; identical to SEQ ID NO: 190914

SEQ ID NO: 328144 - RNA, 64 nt, Human; identical to SEQ ID NO: 190915

SEQ ID NO: 328145 - RNA, 64 nt, Human; identical to SEQ ID NO: 190916

SEQ ID NO: 328146 - RNA, 64 nt, Human; identical to SEQ ID NO: 190917

SEQ ID NO: 328147 - RNA, 64 nt, Human; identical to SEQ ID NO: 190918

SEQ ID NO: 328148 - RNA, 64 nt, Human; identical to SEQ ID NO: 190919

SEQ ID NO: 328149 - RNA, 64 nt, Human; identical to SEQ ID NO: 190920

SEQ ID NO: 328150 - RNA, 64 nt, Human; identical to SEQ ID NO: 190921

SEQ ID NO: 328151 - RNA, 64 nt, Human; identical to SEQ ID NO: 190922

SEQ ID NO: 328152 - RNA, 64 nt, Human; identical to SEQ ID NO: 190923

SEQ ID NO: 328153 - RNA, 64 nt, Human; identical to SEQ ID NO: 190924

SEQ ID NO: 328154 - RNA, 64 nt, Human; identical to SEQ ID NO: 190925

SEQ ID NO: 328155 - RNA, 64 nt, Human; identical to SEQ ID NO: 190926

SEQ ID NO: 328156 - RNA, 64 nt, Human; identical to SEQ ID NO: 190927

SEQ ID NO: 328157 - RNA, 64 nt, Human; identical to SEQ ID NO: 190928

SEQ ID NO: 328158 - RNA, 64 nt, Human
uuuucaagccacauagcaugacuguuuuuugaauagguuggaauugaaaaaacaauuaucaaac

SEQ ID NO: 328159 - RNA, 64 nt, Human
caacaaaagcagaaguuacaagaauauugcggagagguuggaaagcaggauuuaaccucuaguu

SEQ ID NO: 328160 - RNA, 64 nt, Human
gcagggccuguaaucccagcauuuuaggaggccaagguuggaggaucauuugagcccaggaauu

SEQ ID NO: 328161 - RNA, 64 nt, Human
uuuuugucugagacagaaucucagucugucacccagguuggagugcaguggcgugaucucagcu

SEQ ID NO: 328162 - RNA, 64 nt, Human; identical to SEQ ID NO: 190932

SEQ ID NO: 328163 - RNA, 64 nt, Human; identical to SEQ ID NO: 190933

SEQ ID NO: 328164 - RNA, 64 nt, Human; identical to SEQ ID NO: 190934

SEQ ID NO: 328165 - RNA, 64 nt, Human; identical to SEQ ID NO: 190935

SEQ ID NO: 328166 - RNA, 64 nt, Human; identical to SEQ ID NO: 190936

SEQ ID NO: 328167 - RNA, 64 nt, Human; identical to SEQ ID NO: 190937

SEQ ID NO: 328168 - RNA, 64 nt, Human; identical to SEQ ID NO: 190938

SEQ ID NO: 328169 - RNA, 64 nt, Human; identical to SEQ ID NO: 190939

SEQ ID NO: 328170 - RNA, 64 nt, Human; identical to SEQ ID NO: 190940

SEQ ID NO: 328171 - RNA, 64 nt, Human; identical to SEQ ID NO: 190941

SEQ ID NO: 328172 - RNA, 64 nt, Human; identical to SEQ ID NO: 190942

SEQ ID NO: 328173 - RNA, 64 nt, Human; identical to SEQ ID NO: 190943

SEQ ID NO: 328174 - RNA, 64 nt, Human; identical to SEQ ID NO: 190944

SEQ ID NO: 328175 - RNA, 64 nt, Human; identical to SEQ ID NO: 190945

SEQ ID NO: 328176 - RNA, 64 nt, Human; identical to SEQ ID NO: 190946

SEQ ID NO: 328177 - RNA, 64 nt, Human; identical to SEQ ID NO: 190950

SEQ ID NO: 328178 - RNA, 64 nt, Human
uguggagcaaaucagaguucaugcccaaguccccagguuggaauggcugugccaaaauccauuc

SEQ ID NO: 328179 - RNA, 64 nt, Human
ccucggggcccuccaaggugucuccguagucagcagguuggaggcagaggagccgauggcugga

SEQ ID NO: 328180 - RNA, 64 nt, Human
auuccccccguggcugcccagauagucacagucaagguuggagagucuccuuccagccagugac

SEQ ID NO: 328181 - RNA, 64 nt, Human; identical to SEQ ID NO: 190951

SEQ ID NO: 328182 - RNA, 64 nt, Human; identical to SEQ ID NO: 190952

SEQ ID NO: 328183 - RNA, 64 nt, Human; identical to SEQ ID NO: 190953

SEQ ID NO: 328184 - RNA, 64 nt, Human; identical to SEQ ID NO: 190954

SEQ ID NO: 328185 - RNA, 64 nt, Human; identical to SEQ ID NO: 190955

SEQ ID NO: 328186 - RNA, 64 nt, Human; identical to SEQ ID NO: 190956

SEQ ID NO: 328187 - RNA, 64 nt, Human; identical to SEQ ID NO: 190957

SEQ ID NO: 328188 - RNA, 64 nt, Human; identical to SEQ ID NO: 190958

SEQ ID NO: 328189 - RNA, 64 nt, Human; identical to SEQ ID NO: 190959

SEQ ID NO: 328190 - RNA, 64 nt, Human; identical to SEQ ID NO: 190960

SEQ ID NO: 328191 - RNA, 64 nt, Human; identical to SEQ ID NO: 190961

SEQ ID NO: 328192 - RNA, 64 nt, Human; identical to SEQ ID NO: 190962

SEQ ID NO: 328193 - RNA, 64 nt, Human; identical to SEQ ID NO: 190963

SEQ ID NO: 328194 - RNA, 64 nt, Human; identical to SEQ ID NO: 190964

SEQ ID NO: 328195 - RNA, 64 nt, Human; identical to SEQ ID NO: 190968

SEQ ID NO: 328196 - RNA, 64 nt, Human; identical to SEQ ID NO: 190969

SEQ ID NO: 328197 - RNA, 64 nt, Human
cuuuaaagcauuuuuuaggaaauacucaaaagcaagguuggaaaauguuuuaucuuucuauaga

SEQ ID NO: 328198 - RNA, 64 nt, Human
cgcaaaggagaggcuucccagccccgccagugagagguuggacucucugcccugugcuccgggg

SEQ ID NO: 328199 - RNA, 64 nt, Human
acaaugcuccuucauuuuacuacuucuuaaaacaagguuggauucuaaagauaaagauuuugga

SEQ ID NO: 328200 - RNA, 64 nt, Human
aucauuuguauuaauugcacaacuccaaugcuaaagguuggauuguguuagaggaaucggcucu

SEQ ID NO: 328201 - RNA, 64 nt, Human; identical to SEQ ID NO: 190970

SEQ ID NO: 328202 - RNA, 64 nt, Human; identical to SEQ ID NO: 190971

SEQ ID NO: 328203 - RNA, 64 nt, Human; identical to SEQ ID NO: 190972

SEQ ID NO: 328204 - RNA, 64 nt, Human; identical to SEQ ID NO: 190973

SEQ ID NO: 328205 - RNA, 64 nt, Human; identical to SEQ ID NO: 190974

SEQ ID NO: 328206 - RNA, 64 nt, Human; identical to SEQ ID NO: 190975

SEQ ID NO: 328207 - RNA, 64 nt, Human; identical to SEQ ID NO: 190976

SEQ ID NO: 328208 - RNA, 64 nt, Human; identical to SEQ ID NO: 190977

SEQ ID NO: 328209 - RNA, 64 nt, Human; identical to SEQ ID NO: 190978

SEQ ID NO: 328210 - RNA, 64 nt, Human; identical to SEQ ID NO: 190979

SEQ ID NO: 328211 - RNA, 64 nt, Human; identical to SEQ ID NO: 190980

SEQ ID NO: 328212 - RNA, 64 nt, Human; identical to SEQ ID NO: 190981

SEQ ID NO: 328213 - RNA, 64 nt, Human; identical to SEQ ID NO: 190982

SEQ ID NO: 328214 - RNA, 64 nt, Human; identical to SEQ ID NO: 190986

SEQ ID NO: 328215 - RNA, 64 nt, Human; identical to SEQ ID NO: 190987

SEQ ID NO: 328216 - RNA, 64 nt, Human; identical to SEQ ID NO: 190988

SEQ ID NO: 328217 - RNA, 64 nt, Human
uagaauuggugugcacucaccugagagaucuggcagguuggauauauuuauguguauuucucca

SEQ ID NO: 328218 - RNA, 64 nt, Human
ccuccccagcaaagucacagcuccauuucaguaaagguuggagucaauaugcucugguuggcag

SEQ ID NO: 328219 - RNA, 64 nt, Human
gggagggguguggcucccuccuucccugucugggagguuggagggaagaaucuaggccuuagcu

SEQ ID NO: 328220 - RNA, 64 nt, Human
aagagagaaaaaggcaaagcaagguuguggccuuagguuggaccuggaauaucccuuauugccu

SEQ ID NO: 328221 - RNA, 64 nt, Human; identical to SEQ ID NO: 190989

SEQ ID NO: 328222 - RNA, 64 nt, Human; identical to SEQ ID NO: 190990

SEQ ID NO: 328223 - RNA, 64 nt, Human; identical to SEQ ID NO: 190991

SEQ ID NO: 328224 - RNA, 64 nt, Human; identical to SEQ ID NO: 190992

SEQ ID NO: 328225 - RNA, 64 nt, Human; identical to SEQ ID NO: 190993

SEQ ID NO: 328226 - RNA, 64 nt, Human; identical to SEQ ID NO: 190994

SEQ ID NO: 328227 - RNA, 64 nt, Human; identical to SEQ ID NO: 190995

SEQ ID NO: 328228 - RNA, 64 nt, Human; identical to SEQ ID NO: 190996

SEQ ID NO: 328229 - RNA, 64 nt, Human; identical to SEQ ID NO: 190997

SEQ ID NO: 328230 - RNA, 63 nt, Human; identical to SEQ ID NO: 190998

SEQ ID NO: 328231 - RNA, 64 nt, Human; identical to SEQ ID NO: 190999

SEQ ID NO: 328232 - RNA, 57 nt, Human; identical to SEQ ID NO: 315356

SEQ ID NO: 328233 - RNA, 64 nt, Human
ccaauuuuucaugcaguugucuagucgggaaguaagguuggaaacuaagucucauuuacugauu

SEQ ID NO: 328234 - RNA, 55 nt, Human
gcccggccaaggcucuaugaagcuaagguuggaugcaugguugcauggauuuggg

SEQ ID NO: 328235 - RNA, 64 nt, Human
ugcuccacagaaacccuguuuuauugaguucugaagguuggaacugcugccaugauuuuggcca

SEQ ID NO: 328236 - RNA, 64 nt, Human; identical to SEQ ID NO: 315357

SEQ ID NO: 328237 - RNA, 64 nt, Human; identical to SEQ ID NO: 315361

SEQ ID NO: 328238 - RNA, 64 nt, Human; identical to SEQ ID NO: 315362

SEQ ID NO: 328239 - RNA, 64 nt, Human; identical to SEQ ID NO: 315363

SEQ ID NO: 328240 - RNA, 64 nt, Human; identical to SEQ ID NO: 315364

SEQ ID NO: 328241 - RNA, 64 nt, Human; identical to SEQ ID NO: 315365

SEQ ID NO: 328242 - RNA, 64 nt, Human; identical to SEQ ID NO: 315366

SEQ ID NO: 328243 - RNA, 64 nt, Human; identical to SEQ ID NO: 315367

SEQ ID NO: 328244 - RNA, 64 nt, Human; identical to SEQ ID NO: 315368

SEQ ID NO: 328245 - RNA, 64 nt, Human; identical to SEQ ID NO: 315369

SEQ ID NO: 328246 - RNA, 64 nt, Human; identical to SEQ ID NO: 315370

SEQ ID NO: 328247 - RNA, 64 nt, Human; identical to SEQ ID NO: 315371

SEQ ID NO: 328248 - RNA, 64 nt, Human; identical to SEQ ID NO: 315372

SEQ ID NO: 328249 - RNA, 64 nt, Human; identical to SEQ ID NO: 315373

SEQ ID NO: 328250 - RNA, 64 nt, Human; identical to SEQ ID NO: 315374

SEQ ID NO: 328251 - RNA, 64 nt, Human; identical to SEQ ID NO: 315375

SEQ ID NO: 328252 - RNA, 64 nt, Human
uggccagcuggaggcaggggcuuccuggugcuggagguuggaucuugauguaaggaugggcaug

SEQ ID NO: 328253 - RNA, 64 nt, Human
auuucucaucugccggcauuauuaagggugggcuagguuggauggaaggugaaagggaugaacu

SEQ ID NO: 328254 - RNA, 64 nt, Human
gaagugcuaugcuauuuccugguuaugaauauuaagguuggaauuacauuuuuauugauuguuu

SEQ ID NO: 328255 - RNA, 64 nt, Human
auauaauagauugaucaugcaccauauccacaggagguuggaaaaaccaugccauuuucuggaa

SEQ ID NO: 328256 - RNA, 64 nt, Human; identical to SEQ ID NO: 315376

SEQ ID NO: 328257 - RNA, 64 nt, Human; identical to SEQ ID NO: 315380

SEQ ID NO: 328258 - RNA, 64 nt, Human; identical to SEQ ID NO: 315381

SEQ ID NO: 328259 - RNA, 64 nt, Human; identical to SEQ ID NO: 315382

SEQ ID NO: 328260 - RNA, 64 nt, Human; identical to SEQ ID NO: 315383

SEQ ID NO: 328261 - RNA, 64 nt, Human; identical to SEQ ID NO: 315384

SEQ ID NO: 328262 - RNA, 64 nt, Human; identical to SEQ ID NO: 315385

SEQ ID NO: 328263 - RNA, 64 nt, Human; identical to SEQ ID NO: 315386

SEQ ID NO: 328264 - RNA, 64 nt, Human; identical to SEQ ID NO: 315387

SEQ ID NO: 328265 - RNA, 64 nt, Human; identical to SEQ ID NO: 315388

SEQ ID NO: 328266 - RNA, 64 nt, Human; identical to SEQ ID NO: 315389

SEQ ID NO: 328267 - RNA, 55 nt, Human; identical to SEQ ID NO: 315390

SEQ ID NO: 328268 - RNA, 64 nt, Human; identical to SEQ ID NO: 315391

SEQ ID NO: 328269 - RNA, 64 nt, Human; identical to SEQ ID NO: 315392

SEQ ID NO: 328270 - RNA, 64 nt, Human; identical to SEQ ID NO: 315393

SEQ ID NO: 328271 - RNA, 64 nt, Human; identical to SEQ ID NO: 315394

SEQ ID NO: 328272 - RNA, 64 nt, Human
gccaaggcugggucugacaucccugccaggaagcagguuggacagaaaccacuugcuaaaagcg

SEQ ID NO: 328273 - RNA, 64 nt, Human
ugugucgcccagggcaaggaugcccaaagacaccagguuggagaggcaccugccaacuacuugc

SEQ ID NO: 328274 - RNA, 64 nt, Human
ugagugacugccggugaauguguccacaguugagagguuggagcaggaugagggaauccuguca

SEQ ID NO: 328275 - RNA, 64 nt, Human
cucuccuguagucagucugaguucugauggucagagguuggagcugugacaguggcauacgagg

SEQ ID NO: 328276 - RNA, 64 nt, Human; identical to SEQ ID NO: 315395

SEQ ID NO: 328277 - RNA, 64 nt, Human; identical to SEQ ID NO: 315399

SEQ ID NO: 328278 - RNA, 64 nt, Human; identical to SEQ ID NO: 315400

SEQ ID NO: 328279 - RNA, 64 nt, Human; identical to SEQ ID NO: 315401

SEQ ID NO: 328280 - RNA, 64 nt, Human; identical to SEQ ID NO: 315402

SEQ ID NO: 328281 - RNA, 64 nt, Human; identical to SEQ ID NO: 315403

SEQ ID NO: 328282 - RNA, 64 nt, Human; identical to SEQ ID NO: 315404

SEQ ID NO: 328283 - RNA, 64 nt, Human; identical to SEQ ID NO: 315405

SEQ ID NO: 328284 - RNA, 64 nt, Human; identical to SEQ ID NO: 315406

SEQ ID NO: 328285 - RNA, 64 nt, Human; identical to SEQ ID NO: 315407

SEQ ID NO: 328286 - RNA, 64 nt, Human; identical to SEQ ID NO: 315408

SEQ ID NO: 328287 - RNA, 64 nt, Human; identical to SEQ ID NO: 315409

SEQ ID NO: 328288 - RNA, 64 nt, Human; identical to SEQ ID NO: 315410

SEQ ID NO: 328289 - RNA, 64 nt, Human; identical to SEQ ID NO: 315411

SEQ ID NO: 328290 - RNA, 64 nt, Human; identical to SEQ ID NO: 315412

SEQ ID NO: 328291 - RNA, 64 nt, Human; identical to SEQ ID NO: 315413

SEQ ID NO: 328292 - RNA, 64 nt, Human
ggcuggguccugagcagcugguuuuccugcaggaagguuggagcaagcaaaguccuucucugcc

SEQ ID NO: 328293 - RNA, 64 nt, Human
gggguagggccgcccccuguaucauaccuagcagagguuggagcuggcacauggggaggagguu

SEQ ID NO: 328294 - RNA, 64 nt, Human
caagacugucuccuuuuggccaauaucauaagauggacgccauaauccugaggccuccuagagg

SEQ ID NO: 328295 - RNA, 64 nt, Human; identical to SEQ ID NO: 315414

SEQ ID NO: 328296 - RNA, 64 nt, Human; identical to SEQ ID NO: 315418

SEQ ID NO: 328297 - RNA, 64 nt, Human; identical to SEQ ID NO: 315419

SEQ ID NO: 328298 - RNA, 64 nt, Human; identical to SEQ ID NO: 315420

SEQ ID NO: 328299 - RNA, 64 nt, Human; identical to SEQ ID NO: 315421

SEQ ID NO: 328300 - RNA, 64 nt, Human; identical to SEQ ID NO: 315422

SEQ ID NO: 328301 - RNA, 64 nt, Human; identical to SEQ ID NO: 315423

SEQ ID NO: 328302 - RNA, 64 nt, Human; identical to SEQ ID NO: 315424

SEQ ID NO: 328303 - RNA, 64 nt, Human; identical to SEQ ID NO: 315425

SEQ ID NO: 328304 - RNA, 64 nt, Human; identical to SEQ ID NO: 315426

SEQ ID NO: 328305 - RNA, 64 nt, Human; identical to SEQ ID NO: 315427

SEQ ID NO: 328306 - RNA, 64 nt, Human; identical to SEQ ID NO: 315428

SEQ ID NO: 328307 - RNA, 64 nt, Human; identical to SEQ ID NO: 315429

SEQ ID NO: 328308 - RNA, 64 nt, Human; identical to SEQ ID NO: 315430

SEQ ID NO: 328309 - RNA, 64 nt, Human; identical to SEQ ID NO: 315431

SEQ ID NO: 328310 - RNA, 64 nt, Human; identical to SEQ ID NO: 315432

SEQ ID NO: 328311 - RNA, 64 nt, Human
ccacuccuugcagauaauacaaauucaguuugucagguuggauggugaguugggagcugugaug

SEQ ID NO: 328312 - RNA, 64 nt, Human
agcccgggcaccuucccacuuucuagcucuggagagguuggauuuugcuuuuguaaacacauga

SEQ ID NO: 328313 - RNA, 64 nt, Human
ucucacucuccucuuaguaacagagacacuccugagguuggacuuccuugcuuuucucuacuuc

SEQ ID NO: 328314 - RNA, 64 nt, Human; identical to SEQ ID NO: 315433

SEQ ID NO: 328315 - RNA, 64 nt, Human; identical to SEQ ID NO: 315437

SEQ ID NO: 328316 - RNA, 64 nt, Human; identical to SEQ ID NO: 315438

SEQ ID NO: 328317 - RNA, 64 nt, Human; identical to SEQ ID NO: 315439

SEQ ID NO: 328318 - RNA, 64 nt, Human; identical to SEQ ID NO: 315440

SEQ ID NO: 328319 - RNA, 64 nt, Human; identical to SEQ ID NO: 315441

SEQ ID NO: 328320 - RNA, 64 nt, Human; identical to SEQ ID NO: 315442

SEQ ID NO: 328321 - RNA, 64 nt, Human; identical to SEQ ID NO: 315443

SEQ ID NO: 328322 - RNA, 64 nt, Human; identical to SEQ ID NO: 315444

SEQ ID NO: 328323 - RNA, 64 nt, Human; identical to SEQ ID NO: 315445

SEQ ID NO: 328324 - RNA, 64 nt, Human; identical to SEQ ID NO: 315446

SEQ ID NO: 328325 - RNA, 64 nt, Human; identical to SEQ ID NO: 315447

SEQ ID NO: 328326 - RNA, 64 nt, Human; identical to SEQ ID NO: 315448

SEQ ID NO: 328327 - RNA, 64 nt, Human; identical to SEQ ID NO: 315449

SEQ ID NO: 328328 - RNA, 64 nt, Human; identical to SEQ ID NO: 315450

SEQ ID NO: 328329 - RNA, 64 nt, Human; identical to SEQ ID NO: 315451

SEQ ID NO: 328330 - RNA, 64 nt, Human
uaacgggccaugggguauguacauguaggggcugagguuggaggccuacuaauuucccuguagg

SEQ ID NO: 328331 - RNA, 64 nt, Human
ccuggcuuaccaagggcuaccucagugggagaugagguuggaggaacgaaggcgagguuccucc

SEQ ID NO: 328332 - RNA, 64 nt, Human
uuuaaaaauuuguguuggacuucaugcgggccacagguuggacaagcuugcccuagggcauugu

SEQ ID NO: 328333 - RNA, 64 nt, Human
acucucacaccagucuuagcccuaguaguuuuuuagguuggaccagaggaagcagguuaaauga

SEQ ID NO: 328334 - RNA, 64 nt, Human; identical to SEQ ID NO: 315452

SEQ ID NO: 328335 - RNA, 64 nt, Human; identical to SEQ ID NO: 315456

SEQ ID NO: 328336 - RNA, 64 nt, Human; identical to SEQ ID NO: 315457

SEQ ID NO: 328337 - RNA, 64 nt, Human; identical to SEQ ID NO: 315458

SEQ ID NO: 328338 - RNA, 62 nt, Human; identical to SEQ ID NO: 315459

SEQ ID NO: 328339 - RNA, 64 nt, Human; identical to SEQ ID NO: 315460

SEQ ID NO: 328340 - RNA, 64 nt, Human; identical to SEQ ID NO: 315461

SEQ ID NO: 328341 - RNA, 64 nt, Human; identical to SEQ ID NO: 315462

SEQ ID NO: 328342 - RNA, 64 nt, Human; identical to SEQ ID NO: 315463

SEQ ID NO: 328343 - RNA, 64 nt, Human; identical to SEQ ID NO: 315464

SEQ ID NO: 328344 - RNA, 64 nt, Human; identical to SEQ ID NO: 315465

SEQ ID NO: 328345 - RNA, 64 nt, Human; identical to SEQ ID NO: 315466

SEQ ID NO: 328346 - RNA, 64 nt, Human; identical to SEQ ID NO: 315467

SEQ ID NO: 328347 - RNA, 64 nt, Human; identical to SEQ ID NO: 315468

SEQ ID NO: 328348 - RNA, 64 nt, Human; identical to SEQ ID NO: 315469

SEQ ID NO: 328349 - RNA, 64 nt, Human; identical to SEQ ID NO: 315470

SEQ ID NO: 328350 - RNA, 64 nt, Human
agguaggauuucugaaacucaggccuuaaccaauagguuggaagacaagaccaauugaagaguu

SEQ ID NO: 328351 - RNA, 64 nt, Human
augaacauuuauaguugaaacuguagaaagggucagguuggagguguguaauaaaaaagaauua

SEQ ID NO: 328352 - RNA, 64 nt, Human
uuuuuuguggagacagggucucaguauguuacccagguuggacuggaaacccuuggcucaagca

SEQ ID NO: 328353 - RNA, 64 nt, Human
aauucuggagagacauaaggaguccuacccguugagguuggagagggaaaauaaagaagcugcc

SEQ ID NO: 328354 - RNA, 59 nt, Human; identical to SEQ ID NO: 315471

SEQ ID NO: 328355 - RNA, 64 nt, Human; identical to SEQ ID NO: 315475

SEQ ID NO: 328356 - RNA, 64 nt, Human; identical to SEQ ID NO: 315476

SEQ ID NO: 328357 - RNA, 64 nt, Human; identical to SEQ ID NO: 315477

SEQ ID NO: 328358 - RNA, 64 nt, Human; identical to SEQ ID NO: 315478

SEQ ID NO: 328359 - RNA, 64 nt, Human; identical to SEQ ID NO: 315479

SEQ ID NO: 328360 - RNA, 64 nt, Human; identical to SEQ ID NO: 315480

SEQ ID NO: 328361 - RNA, 64 nt, Human; identical to SEQ ID NO: 315481

SEQ ID NO: 328362 - RNA, 64 nt, Human; identical to SEQ ID NO: 315482

SEQ ID NO: 328363 - RNA, 64 nt, Human; identical to SEQ ID NO: 315483

SEQ ID NO: 328364 - RNA, 64 nt, Human; identical to SEQ ID NO: 315484

SEQ ID NO: 328365 - RNA, 64 nt, Human; identical to SEQ ID NO: 315485

SEQ ID NO: 328366 - RNA, 64 nt, Human; identical to SEQ ID NO: 315486

SEQ ID NO: 328367 - RNA, 64 nt, Human; identical to SEQ ID NO: 315487

SEQ ID NO: 328368 - RNA, 64 nt, Human; identical to SEQ ID NO: 315488

SEQ ID NO: 328369 - RNA, 64 nt, Human; identical to SEQ ID NO: 315489

SEQ ID NO: 328370 - RNA, 64 nt, Human
ugacuaauuuugggacugaaugaauaaguacaagagguuggauuuucuauguuggcugauuacc

SEQ ID NO: 328371 - RNA, 64 nt, Human
auugaacacucuggcaaagaugcugugguggaugagguuggaguucgaaagaagaagcaagcgc

SEQ ID NO: 328372 - RNA, 64 nt, Human
ucucugaacacugcaguuuguuagacuagagcugagguuggaggauuccauagugcuuuaaacg

SEQ ID NO: 328373 - RNA, 64 nt, Human
uaaaaugauggauucaacuucugccucggaugagagguuggaaauguagcugcuuuucuuuaga

SEQ ID NO: 328374 - RNA, 64 nt, Human; identical to SEQ ID NO: 315490

SEQ ID NO: 328375 - RNA, 64 nt, Human; identical to SEQ ID NO: 315494

SEQ ID NO: 328376 - RNA, 64 nt, Human; identical to SEQ ID NO: 315495

SEQ ID NO: 328377 - RNA, 64 nt, Human; identical to SEQ ID NO: 315496

SEQ ID NO: 328378 - RNA, 64 nt, Human; identical to SEQ ID NO: 315497

SEQ ID NO: 328379 - RNA, 64 nt, Human; identical to SEQ ID NO: 315498

SEQ ID NO: 328380 - RNA, 64 nt, Human; identical to SEQ ID NO: 315499

SEQ ID NO: 328381 - RNA, 64 nt, Human; identical to SEQ ID NO: 315500

SEQ ID NO: 328382 - RNA, 64 nt, Human; identical to SEQ ID NO: 315501

SEQ ID NO: 328383 - RNA, 64 nt, Human; identical to SEQ ID NO: 315502

SEQ ID NO: 328384 - RNA, 64 nt, Human; identical to SEQ ID NO: 315503

SEQ ID NO: 328385 - RNA, 64 nt, Human; identical to SEQ ID NO: 315504

SEQ ID NO: 328386 - RNA, 64 nt, Human; identical to SEQ ID NO: 315505

SEQ ID NO: 328387 - RNA, 64 nt, Human; identical to SEQ ID NO: 315506

SEQ ID NO: 328388 - RNA, 64 nt, Human; identical to SEQ ID NO: 315507

SEQ ID NO: 328389 - RNA, 64 nt, Human; identical to SEQ ID NO: 315508

SEQ ID NO: 328390 - RNA, 64 nt, Human
ggaaauuuucuaccuaggaugcaugacaauugucagguuggaguguaagugcuucauuugggaa

SEQ ID NO: 328391 - RNA, 64 nt, Human
uucuuuuagcuguuuaacuuuguaagaugcaaagagguuggaucaaguuuaaaugacugugcug

SEQ ID NO: 328392 - RNA, 64 nt, Human
gcuguguauggggcuucaccauccaagaggugguagguuggaguaagaugcuacagaugcucuc

SEQ ID NO: 328393 - RNA, 64 nt, Human
aaggauaugacaauggggaggacaguucuuuuggagguuggaggggccaagccaaggacaggag

SEQ ID NO: 328394 - RNA, 64 nt, Human; identical to SEQ ID NO: 315509

SEQ ID NO: 328395 - RNA, 64 nt, Human; identical to SEQ ID NO: 315513

SEQ ID NO: 328396 - RNA, 64 nt, Human; identical to SEQ ID NO: 315514

SEQ ID NO: 328397 - RNA, 64 nt, Human; identical to SEQ ID NO: 315515

SEQ ID NO: 328398 - RNA, 64 nt, Human; identical to SEQ ID NO: 315516

SEQ ID NO: 328399 - RNA, 64 nt, Human; identical to SEQ ID NO: 315517

SEQ ID NO: 328400 - RNA, 64 nt, Human; identical to SEQ ID NO: 315518

SEQ ID NO: 328401 - RNA, 64 nt, Human; identical to SEQ ID NO: 315519

SEQ ID NO: 328402 - RNA, 64 nt, Human; identical to SEQ ID NO: 315520

SEQ ID NO: 328403 - RNA, 64 nt, Human; identical to SEQ ID NO: 315521

SEQ ID NO: 328404 - RNA, 64 nt, Human; identical to SEQ ID NO: 315522

SEQ ID NO: 328405 - RNA, 64 nt, Human; identical to SEQ ID NO: 315523

SEQ ID NO: 328406 - RNA, 64 nt, Human; identical to SEQ ID NO: 315524

SEQ ID NO: 328407 - RNA, 64 nt, Human; identical to SEQ ID NO: 315525

SEQ ID NO: 328408 - RNA, 64 nt, Human; identical to SEQ ID NO: 315526

SEQ ID NO: 328409 - RNA, 64 nt, Human; identical to SEQ ID NO: 315527

SEQ ID NO: 328410 - RNA, 64 nt, Human
aacacacuucccuacaucaagaaggaguaacuucagguuggauccuguguggaugaucuuggug

SEQ ID NO: 328411 - RNA, 64 nt, Human
aagugccugcaaaaacagagguggauacgaggacagguuggagcugcagggacuggcgagucug

SEQ ID NO: 328412 - RNA, 64 nt, Human
agcccugcuaugaaaggaauaaaaccuacacacaagguuggagcuuugcaauucuuuuuggaaa

SEQ ID NO: 328413 - RNA, 64 nt, Human; identical to SEQ ID NO: 315528

SEQ ID NO: 328414 - RNA, 64 nt, Human; identical to SEQ ID NO: 315532

SEQ ID NO: 328415 - RNA, 64 nt, Human; identical to SEQ ID NO: 315533

SEQ ID NO: 328416 - RNA, 64 nt, Human; identical to SEQ ID NO: 315534

SEQ ID NO: 328417 - RNA, 64 nt, Human; identical to SEQ ID NO: 315535

SEQ ID NO: 328418 - RNA, 64 nt, Human; identical to SEQ ID NO: 315536

SEQ ID NO: 328419 - RNA, 64 nt, Human; identical to SEQ ID NO: 315537

SEQ ID NO: 328420 - RNA, 64 nt, Human; identical to SEQ ID NO: 315538

SEQ ID NO: 328421 - RNA, 64 nt, Human; identical to SEQ ID NO: 315539

SEQ ID NO: 328422 - RNA, 64 nt, Human; identical to SEQ ID NO: 315540

SEQ ID NO: 328423 - RNA, 64 nt, Human; identical to SEQ ID NO: 315541

SEQ ID NO: 328424 - RNA, 64 nt, Human; identical to SEQ ID NO: 315542

SEQ ID NO: 328425 - RNA, 64 nt, Human; identical to SEQ ID NO: 315543

SEQ ID NO: 328426 - RNA, 64 nt, Human; identical to SEQ ID NO: 315544

SEQ ID NO: 328427 - RNA, 64 nt, Human; identical to SEQ ID NO: 315545

SEQ ID NO: 328428 - RNA, 64 nt, Human; identical to SEQ ID NO: 315546

SEQ ID NO: 328429 - RNA, 64 nt, Human
uuucuuuuugagauggagucucgcucuguugcccagguuggagugcaguggcacgaucucggcu

SEQ ID NO: 328430 - RNA, 64 nt, Human
gcauccuugauccucucacagauagaggucuuaaagguuggaucauguaacauugcuuaguaga

SEQ ID NO: 328431 - RNA, 64 nt, Human
guaucaaaaauauccucuccuuuucaaaaaugacagguuggaaaauguuugucagacuuauuaa

SEQ ID NO: 328432 - RNA, 64 nt, Human
caguuugauuuuuauuuuuaacacacuugaaaaaagguuggaguagccagacuuucauauauaa

SEQ ID NO: 328433 - RNA, 64 nt, Human; identical to SEQ ID NO: 315547

SEQ ID NO: 328434 - RNA, 64 nt, Human; identical to SEQ ID NO: 315551

SEQ ID NO: 328435 - RNA, 64 nt, Human; identical to SEQ ID NO: 315552

SEQ ID NO: 328436 - RNA, 64 nt, Human; identical to SEQ ID NO: 315553

SEQ ID NO: 328437 - RNA, 64 nt, Human; identical to SEQ ID NO: 315554

SEQ ID NO: 328438 - RNA, 64 nt, Human; identical to SEQ ID NO: 315555

SEQ ID NO: 328439 - RNA, 64 nt, Human; identical to SEQ ID NO: 315556

SEQ ID NO: 328440 - RNA, 64 nt, Human; identical to SEQ ID NO: 315557

SEQ ID NO: 328441 - RNA, 64 nt, Human; identical to SEQ ID NO: 315558

SEQ ID NO: 328442 - RNA, 64 nt, Human; identical to SEQ ID NO: 315559

SEQ ID NO: 328443 - RNA, 64 nt, Human; identical to SEQ ID NO: 315560

SEQ ID NO: 328444 - RNA, 64 nt, Human; identical to SEQ ID NO: 315561

SEQ ID NO: 328445 - RNA, 64 nt, Human; identical to SEQ ID NO: 315562

SEQ ID NO: 328446 - RNA, 64 nt, Human; identical to SEQ ID NO: 315563

SEQ ID NO: 328447 - RNA, 64 nt, Human; identical to SEQ ID NO: 315564

SEQ ID NO: 328448 - RNA, 64 nt, Human; identical to SEQ ID NO: 315565

SEQ ID NO: 328449 - RNA, 64 nt, Human
cuuccaugccuuaaaccuaccucccacacucccaagguuggagcccagggcaucuugcuggcua

SEQ ID NO: 328450 - RNA, 64 nt, Human
uuuugaggguguaaccaguagucaccucugggccagguuggaaaagaaaucaauuuuuuaaacc

SEQ ID NO: 328451 - RNA, 64 nt, Human
acccaaaaaggggaaaauguaaugaaaaaucucaagguuggaaauacagccuuacucucucuag

SEQ ID NO: 328452 - RNA, 64 nt, Human; identical to SEQ ID NO: 315566

SEQ ID NO: 328453 - RNA, 64 nt, Human; identical to SEQ ID NO: 315570

SEQ ID NO: 328454 - RNA, 64 nt, Human; identical to SEQ ID NO: 315571

SEQ ID NO: 328455 - RNA, 64 nt, Human; identical to SEQ ID NO: 315572

SEQ ID NO: 328456 - RNA, 64 nt, Human; identical to SEQ ID NO: 315573

SEQ ID NO: 328457 - RNA, 64 nt, Human; identical to SEQ ID NO: 315574

SEQ ID NO: 328458 - RNA, 64 nt, Human; identical to SEQ ID NO: 315575

SEQ ID NO: 328459 - RNA, 64 nt, Human; identical to SEQ ID NO: 315576

SEQ ID NO: 328460 - RNA, 64 nt, Human; identical to SEQ ID NO: 315577

SEQ ID NO: 328461 - RNA, 64 nt, Human; identical to SEQ ID NO: 315578

SEQ ID NO: 328462 - RNA, 64 nt, Human; identical to SEQ ID NO: 315579

SEQ ID NO: 328463 - RNA, 64 nt, Human; identical to SEQ ID NO: 315580

SEQ ID NO: 328464 - RNA, 64 nt, Human; identical to SEQ ID NO: 315581

SEQ ID NO: 328465 - RNA, 64 nt, Human; identical to SEQ ID NO: 315582

SEQ ID NO: 328466 - RNA, 64 nt, Human; identical to SEQ ID NO: 315583

SEQ ID NO: 328467 - RNA, 64 nt, Human; identical to SEQ ID NO: 315584

SEQ ID NO: 328468 - RNA, 64 nt, Human
caccacacaaguguuuguaaacugggcugcuauaagguuggaguuccagggcugggcccuggug

SEQ ID NO: 328469 - RNA, 64 nt, Human
aacacuggguauucucaugagcucauccaagccaagguuggaccccuccccaagaggccaaccc

SEQ ID NO: 328470 - RNA, 64 nt, Human
aacuucagaugggaggaaagagagcaggacucacagguuggaagagaaucaccugggaaaauac

SEQ ID NO: 328471 - RNA, 64 nt, Human; identical to SEQ ID NO: 315585

SEQ ID NO: 328472 - RNA, 64 nt, Human; identical to SEQ ID NO: 315589

SEQ ID NO: 328473 - RNA, 64 nt, Human; identical to SEQ ID NO: 315590

SEQ ID NO: 328474 - RNA, 64 nt, Human; identical to SEQ ID NO: 315591

SEQ ID NO: 328475 - RNA, 64 nt, Human; identical to SEQ ID NO: 315592

SEQ ID NO: 328476 - RNA, 64 nt, Human; identical to SEQ ID NO: 315593

SEQ ID NO: 328477 - RNA, 64 nt, Human; identical to SEQ ID NO: 315594

SEQ ID NO: 328478 - RNA, 64 nt, Human; identical to SEQ ID NO: 315595

SEQ ID NO: 328479 - RNA, 64 nt, Human; identical to SEQ ID NO: 315596

SEQ ID NO: 328480 - RNA, 64 nt, Human; identical to SEQ ID NO: 315597

SEQ ID NO: 328481 - RNA, 64 nt, Human; identical to SEQ ID NO: 315598

SEQ ID NO: 328482 - RNA, 64 nt, Human; identical to SEQ ID NO: 315599

SEQ ID NO: 328483 - RNA, 64 nt, Human; identical to SEQ ID NO: 315600

SEQ ID NO: 328484 - RNA, 64 nt, Human; identical to SEQ ID NO: 315601

SEQ ID NO: 328485 - RNA, 64 nt, Human; identical to SEQ ID NO: 315602

SEQ ID NO: 328486 - RNA, 64 nt, Human; identical to SEQ ID NO: 315603

SEQ ID NO: 328487 - RNA, 64 nt, Human
uuuuuuuuuuagacagggucuugcuccguugcccagguuggagugcaguggcccaucagggcuc

SEQ ID NO: 328488 - RNA, 64 nt, Human
gaaaucaacgugguuguccccgccaggccggggaagguuggagcagcccccagggaggggggca

SEQ ID NO: 328489 - RNA, 64 nt, Human
uuggaauuugggaagcagacagcuuuacuuuguaagguuggaacagcagcacuauacaugaaau

SEQ ID NO: 328490 - RNA, 64 nt, Human; identical to SEQ ID NO: 315604

SEQ ID NO: 328491 - RNA, 64 nt, Human; identical to SEQ ID NO: 315608

SEQ ID NO: 328492 - RNA, 64 nt, Human; identical to SEQ ID NO: 315609

SEQ ID NO: 328493 - RNA, 64 nt, Human; identical to SEQ ID NO: 315610

SEQ ID NO: 328494 - RNA, 64 nt, Human; identical to SEQ ID NO: 315611

SEQ ID NO: 328495 - RNA, 64 nt, Human; identical to SEQ ID NO: 315612

SEQ ID NO: 328496 - RNA, 64 nt, Human; identical to SEQ ID NO: 315613

SEQ ID NO: 328497 - RNA, 64 nt, Human; identical to SEQ ID NO: 315614

SEQ ID NO: 328498 - RNA, 64 nt, Human; identical to SEQ ID NO: 315615

SEQ ID NO: 328499 - RNA, 64 nt, Human; identical to SEQ ID NO: 315616

SEQ ID NO: 328500 - RNA, 64 nt, Human; identical to SEQ ID NO: 315617

SEQ ID NO: 328501 - RNA, 64 nt, Human; identical to SEQ ID NO: 315618

SEQ ID NO: 328502 - RNA, 64 nt, Human; identical to SEQ ID NO: 315619

SEQ ID NO: 328503 - RNA, 64 nt, Human; identical to SEQ ID NO: 315620

SEQ ID NO: 328504 - RNA, 64 nt, Human; identical to SEQ ID NO: 315621

SEQ ID NO: 328505 - RNA, 64 nt, Human; identical to SEQ ID NO: 315622

SEQ ID NO: 328506 - RNA, 64 nt, Human
gagcuggagauggcugaaucuuccaagagaaacaagguuggauaagcgcuuccuuuuuuuuagc

SEQ ID NO: 328507 - RNA, 64 nt, Human
gccacacaccccuccguuugcaccaguugccugcagguuggauggaacacagugccccacuuuu

SEQ ID NO: 328508 - RNA, 64 nt, Human
uaauccauuucacuguagccuaaacuccaguccgagguuggauauuguucaaaugagcagggcc

SEQ ID NO: 328509 - RNA, 64 nt, Human; identical to SEQ ID NO: 315623

SEQ ID NO: 328510 - RNA, 64 nt, Human; identical to SEQ ID NO: 315627

SEQ ID NO: 328511 - RNA, 64 nt, Human; identical to SEQ ID NO: 315628

SEQ ID NO: 328512 - RNA, 64 nt, Human; identical to SEQ ID NO: 315629

SEQ ID NO: 328513 - RNA, 64 nt, Human; identical to SEQ ID NO: 315630

SEQ ID NO: 328514 - RNA, 64 nt, Human; identical to SEQ ID NO: 315631

SEQ ID NO: 328515 - RNA, 64 nt, Human; identical to SEQ ID NO: 315632

SEQ ID NO: 328516 - RNA, 64 nt, Human; identical to SEQ ID NO: 315633

SEQ ID NO: 328517 - RNA, 64 nt, Human; identical to SEQ ID NO: 315634

SEQ ID NO: 328518 - RNA, 64 nt, Human; identical to SEQ ID NO: 315635

SEQ ID NO: 328519 - RNA, 64 nt, Human; identical to SEQ ID NO: 315636

SEQ ID NO: 328520 - RNA, 64 nt, Human; identical to SEQ ID NO: 315637

SEQ ID NO: 328521 - RNA, 64 nt, Human; identical to SEQ ID NO: 315638

SEQ ID NO: 328522 - RNA, 64 nt, Human; identical to SEQ ID NO: 315639

SEQ ID NO: 328523 - RNA, 64 nt, Human; identical to SEQ ID NO: 315640

SEQ ID NO: 328524 - RNA, 64 nt, Human; identical to SEQ ID NO: 315641

SEQ ID NO: 328525 - RNA, 64 nt, Human
cccauccggcuggcaggagggggcucugacgugcagguuggaaaucagaagucugugagagcgc

SEQ ID NO: 328526 - RNA, 64 nt, Human
cgguuuuucauuuuacccuuuuguuuuucaguccagguuggagaucguagcugcugcugcuugc

SEQ ID NO: 328527 - RNA, 64 nt, Human
cggcuuguagucaugaggacaacccuuuuuggugagguuggaagauggauggaagccaagugcu

SEQ ID NO: 328528 - RNA, 64 nt, Human
uuauaucuuuaugagacgaucucacucugucaccagguuggaguacagugguacaaucacaacu

SEQ ID NO: 328529 - RNA, 64 nt, Human; identical to SEQ ID NO: 315642

SEQ ID NO: 328530 - RNA, 64 nt, Human; identical to SEQ ID NO: 315646

SEQ ID NO: 328531 - RNA, 64 nt, Human; identical to SEQ ID NO: 315647

SEQ ID NO: 328532 - RNA, 64 nt, Human; identical to SEQ ID NO: 315648

SEQ ID NO: 328533 - RNA, 64 nt, Human; identical to SEQ ID NO: 315649

SEQ ID NO: 328534 - RNA, 64 nt, Human; identical to SEQ ID NO: 315650

SEQ ID NO: 328535 - RNA, 64 nt, Human; identical to SEQ ID NO: 315651

SEQ ID NO: 328536 - RNA, 64 nt, Human; identical to SEQ ID NO: 315652

SEQ ID NO: 328537 - RNA, 64 nt, Human; identical to SEQ ID NO: 315653

SEQ ID NO: 328538 - RNA, 64 nt, Human; identical to SEQ ID NO: 315654

SEQ ID NO: 328539 - RNA, 64 nt, Human; identical to SEQ ID NO: 315655

SEQ ID NO: 328540 - RNA, 64 nt, Human; identical to SEQ ID NO: 315656

SEQ ID NO: 328541 - RNA, 64 nt, Human; identical to SEQ ID NO: 315657

SEQ ID NO: 328542 - RNA, 64 nt, Human; identical to SEQ ID NO: 315658

SEQ ID NO: 328543 - RNA, 64 nt, Human; identical to SEQ ID NO: 315659

SEQ ID NO: 328544 - RNA, 64 nt, Human; identical to SEQ ID NO: 315660

SEQ ID NO: 328545 - RNA, 61 nt, Human
gcuaagucggcuccagcacacaggagccccccacaacgaagaguuagugcccccaaacguc

SEQ ID NO: 328546 - RNA, 61 nt, Human
accagauggcuuaaauaauagucuggcuuggcacaacgauguuuuuuuucuuugagacaga

SEQ ID NO: 328547 - RNA, 61 nt, Human
agauugaccaagcgccagagacaaaauguggcacaacgagaaccccagcccuguccaggug

SEQ ID NO: 328548 - RNA, 61 nt, Human
cuucgggguggccaagcaggccauccucauccacaacgagcgccggguggacuggcuguuc

SEQ ID NO: 328549 - RNA, 64 nt, Human; identical to SEQ ID NO: 315661

SEQ ID NO: 328550 - RNA, 64 nt, Human; identical to SEQ ID NO: 315665

SEQ ID NO: 328551 - RNA, 64 nt, Human; identical to SEQ ID NO: 315666

SEQ ID NO: 328552 - RNA, 64 nt, Human; identical to SEQ ID NO: 315667

SEQ ID NO: 328553 - RNA, 64 nt, Human; identical to SEQ ID NO: 315668

SEQ ID NO: 328554 - RNA, 64 nt, Human; identical to SEQ ID NO: 315669

SEQ ID NO: 328555 - RNA, 64 nt, Human; identical to SEQ ID NO: 315670

SEQ ID NO: 328556 - RNA, 64 nt, Human; identical to SEQ ID NO: 315671

SEQ ID NO: 328557 - RNA, 54 nt, Human; identical to SEQ ID NO: 315672

SEQ ID NO: 328558 - RNA, 64 nt, Human; identical to SEQ ID NO: 315673

SEQ ID NO: 328559 - RNA, 64 nt, Human; identical to SEQ ID NO: 315674

SEQ ID NO: 328560 - RNA, 64 nt, Human; identical to SEQ ID NO: 315675

SEQ ID NO: 328561 - RNA, 64 nt, Human; identical to SEQ ID NO: 315676

SEQ ID NO: 328562 - RNA, 64 nt, Human; identical to SEQ ID NO: 315677

SEQ ID NO: 328563 - RNA, 64 nt, Human; identical to SEQ ID NO: 315678

SEQ ID NO: 328564 - RNA, 64 nt, Human; identical to SEQ ID NO: 315679

SEQ ID NO: 328565 - RNA, 64 nt, Human
acccucuuuaauucuuauucaauuccaugacuuaagguuggagagcuaaacacugggauuuuug

SEQ ID NO: 328566 - RNA, 64 nt, Human
cucacaccuguauucccaacacuuuuggaggcugagguuggaggauugcuugagcccaggaauu

SEQ ID NO: 328567 - RNA, 64 nt, Human
auauuuguugauuuuaaucaccuaauaguacugaagguuggaaaguugcauguggcuggaugcu

SEQ ID NO: 328568 - RNA, 64 nt, Human
auaaacacaaaaucaguguuuauucaccaguaggagguuggacuagaugaacucuauuauuucu

SEQ ID NO: 328569 - RNA, 64 nt, Human; identical to SEQ ID NO: 315680

SEQ ID NO: 328570 - RNA, 64 nt, Human; identical to SEQ ID NO: 315684

SEQ ID NO: 328571 - RNA, 64 nt, Human; identical to SEQ ID NO: 315685

SEQ ID NO: 328572 - RNA, 64 nt, Human; identical to SEQ ID NO: 315686

SEQ ID NO: 328573 - RNA, 64 nt, Human; identical to SEQ ID NO: 315687

SEQ ID NO: 328574 - RNA, 64 nt, Human; identical to SEQ ID NO: 315688

SEQ ID NO: 328575 - RNA, 64 nt, Human; identical to SEQ ID NO: 315689

SEQ ID NO: 328576 - RNA, 64 nt, Human; identical to SEQ ID NO: 315690

SEQ ID NO: 328577 - RNA, 64 nt, Human; identical to SEQ ID NO: 315691

SEQ ID NO: 328578 - RNA, 64 nt, Human; identical to SEQ ID NO: 315692

SEQ ID NO: 328579 - RNA, 64 nt, Human; identical to SEQ ID NO: 315693

SEQ ID NO: 328580 - RNA, 64 nt, Human; identical to SEQ ID NO: 315694

SEQ ID NO: 328581 - RNA, 64 nt, Human; identical to SEQ ID NO: 315695

SEQ ID NO: 328582 - RNA, 64 nt, Human; identical to SEQ ID NO: 315696

SEQ ID NO: 328583 - RNA, 64 nt, Human; identical to SEQ ID NO: 315697

SEQ ID NO: 328584 - RNA, 64 nt, Human; identical to SEQ ID NO: 315698

SEQ ID NO: 328585 - RNA, 64 nt, Human
ugacccugccccacuuccagggaaaagcugggggagguuggaccccucucacugacuagcuguc

SEQ ID NO: 328586 - RNA, 64 nt, Human
gacuagcauuuaucuucuuuuccuuccaugccaaagguuggagucugcuggugcgguguuuaca

SEQ ID NO: 328587 - RNA, 64 nt, Human
agugcuuuuuuuuucuucaccugggacccucuagagguuggaaagagaagagaggcugggagcg

SEQ ID NO: 328588 - RNA, 64 nt, Human
ccugccuuggacaugaccuggacucuccagggacagguuggaagccaacuuaacccaggggucu

SEQ ID NO: 328589 - RNA, 64 nt, Human; identical to SEQ ID NO: 315699

SEQ ID NO: 328590 - RNA, 64 nt, Human; identical to SEQ ID NO: 315703

SEQ ID NO: 328591 - RNA, 64 nt, Human; identical to SEQ ID NO: 315704

SEQ ID NO: 328592 - RNA, 64 nt, Human; identical to SEQ ID NO: 315705

SEQ ID NO: 328593 - RNA, 64 nt, Human; identical to SEQ ID NO: 315706

SEQ ID NO: 328594 - RNA, 64 nt, Human; identical to SEQ ID NO: 315707

SEQ ID NO: 328595 - RNA, 64 nt, Human; identical to SEQ ID NO: 315708

SEQ ID NO: 328596 - RNA, 64 nt, Human; identical to SEQ ID NO: 315709

SEQ ID NO: 328597 - RNA, 58 nt, Human; identical to SEQ ID NO: 315710

SEQ ID NO: 328598 - RNA, 64 nt, Human; identical to SEQ ID NO: 315711

SEQ ID NO: 328599 - RNA, 64 nt, Human; identical to SEQ ID NO: 315712

SEQ ID NO: 328600 - RNA, 64 nt, Human; identical to SEQ ID NO: 315713

SEQ ID NO: 328601 - RNA, 64 nt, Human; identical to SEQ ID NO: 315714

SEQ ID NO: 328602 - RNA, 64 nt, Human; identical to SEQ ID NO: 315715

SEQ ID NO: 328603 - RNA, 64 nt, Human; identical to SEQ ID NO: 315716

SEQ ID NO: 328604 - RNA, 64 nt, Human; identical to SEQ ID NO: 315717

SEQ ID NO: 328605 - RNA, 64 nt, Human
aauacuugaguauuuguguagcaaacagccucuuagguuggagaguauugauuucaaauaggaa

SEQ ID NO: 328606 - RNA, 64 nt, Human
aggggggaggguagggauaauuuauuuuuaaauaagguuggagaugucaaguuggguucacuug

SEQ ID NO: 328607 - RNA, 64 nt, Human
caggaccagaguuaagcugauaccuuaggcacacagguuggacuuacauagaggaaagaaagca

SEQ ID NO: 328608 - RNA, 64 nt, Human
uuuuuuuuuuucccagagucuugcucugucgcccagguuggagugcaguggcacgaucucggcu

SEQ ID NO: 328609 - RNA, 64 nt, Human; identical to SEQ ID NO: 315718

SEQ ID NO: 328610 - RNA, 64 nt, Human; identical to SEQ ID NO: 315722

SEQ ID NO: 328611 - RNA, 64 nt, Human; identical to SEQ ID NO: 315723

SEQ ID NO: 328612 - RNA, 64 nt, Human; identical to SEQ ID NO: 315724

SEQ ID NO: 328613 - RNA, 64 nt, Human; identical to SEQ ID NO: 315725

SEQ ID NO: 328614 - RNA, 64 nt, Human; identical to SEQ ID NO: 315726

SEQ ID NO: 328615 - RNA, 64 nt, Human; identical to SEQ ID NO: 315727

SEQ ID NO: 328616 - RNA, 64 nt, Human; identical to SEQ ID NO: 315728

SEQ ID NO: 328617 - RNA, 64 nt, Human; identical to SEQ ID NO: 315729

SEQ ID NO: 328618 - RNA, 64 nt, Human; identical to SEQ ID NO: 315730

SEQ ID NO: 328619 - RNA, 64 nt, Human; identical to SEQ ID NO: 315731

SEQ ID NO: 328620 - RNA, 64 nt, Human; identical to SEQ ID NO: 315732

SEQ ID NO: 328621 - RNA, 64 nt, Human; identical to SEQ ID NO: 315733

SEQ ID NO: 328622 - RNA, 64 nt, Human; identical to SEQ ID NO: 315734

SEQ ID NO: 328623 - RNA, 64 nt, Human; identical to SEQ ID NO: 315735

SEQ ID NO: 328624 - RNA, 64 nt, Human; identical to SEQ ID NO: 315736

SEQ ID NO: 328625 - RNA, 64 nt, Human
uaacuagacuucucagauuauugugagaagggucagguuggaagggguguaggaagagggguga

SEQ ID NO: 328626 - RNA, 64 nt, Human
gaaagaauugccuugaagaauuguauuaaugaagagguuggauucugcuacagagaguaaucug

SEQ ID NO: 328627 - RNA, 64 nt, Human
ucggcuaccccccgucuccugccgggcaggucccagguuggaggcccuaggcgcgguucagguc

SEQ ID NO: 328628 - RNA, 64 nt, Human; identical to SEQ ID NO: 315737

SEQ ID NO: 328629 - RNA, 64 nt, Human; identical to SEQ ID NO: 315741

SEQ ID NO: 328630 - RNA, 64 nt, Human; identical to SEQ ID NO: 315742

SEQ ID NO: 328631 - RNA, 64 nt, Human; identical to SEQ ID NO: 315743

SEQ ID NO: 328632 - RNA, 64 nt, Human; identical to SEQ ID NO: 315744

SEQ ID NO: 328633 - RNA, 64 nt, Human; identical to SEQ ID NO: 315745

SEQ ID NO: 328634 - RNA, 64 nt, Human; identical to SEQ ID NO: 315746

SEQ ID NO: 328635 - RNA, 64 nt, Human; identical to SEQ ID NO: 315747

SEQ ID NO: 328636 - RNA, 64 nt, Human; identical to SEQ ID NO: 315748

SEQ ID NO: 328637 - RNA, 64 nt, Human; identical to SEQ ID NO: 315749

SEQ ID NO: 328638 - RNA, 64 nt, Human; identical to SEQ ID NO: 315750

SEQ ID NO: 328639 - RNA, 64 nt, Human; identical to SEQ ID NO: 315751

SEQ ID NO: 328640 - RNA, 64 nt, Human; identical to SEQ ID NO: 315752

SEQ ID NO: 328641 - RNA, 64 nt, Human; identical to SEQ ID NO: 315753

SEQ ID NO: 328642 - RNA, 64 nt, Human; identical to SEQ ID NO: 315754

SEQ ID NO: 328643 - RNA, 64 nt, Human; identical to SEQ ID NO: 315755

SEQ ID NO: 328644 - RNA, 64 nt, Human
agcugggcaaagccacaaggcuggccagcaaggcagguuggaugggagugggcaccucagaaag

SEQ ID NO: 328645 - RNA, 64 nt, Human
aaaguuguugagagagguuguauuuaccuucccaagguuggaaagcaggggaauuucccagugu

SEQ ID NO: 328646 - RNA, 64 nt, Human
ccggcccuacccgcccuugaaguauagccagccaagguuggagcucagaccgugucuagguugg

SEQ ID NO: 328647 - RNA, 64 nt, Human
uguuuuugguacuacuuggugggaaguaaggggaagguuggaucuuggguuuggucuacccacc

SEQ ID NO: 328648 - RNA, 64 nt, Human; identical to SEQ ID NO: 315756

SEQ ID NO: 328649 - RNA, 64 nt, Human; identical to SEQ ID NO: 315760

SEQ ID NO: 328650 - RNA, 64 nt, Human; identical to SEQ ID NO: 315761

SEQ ID NO: 328651 - RNA, 64 nt, Human; identical to SEQ ID NO: 315762

SEQ ID NO: 328652 - RNA, 64 nt, Human; identical to SEQ ID NO: 315763

SEQ ID NO: 328653 - RNA, 64 nt, Human; identical to SEQ ID NO: 315764

SEQ ID NO: 328654 - RNA, 64 nt, Human; identical to SEQ ID NO: 315765

SEQ ID NO: 328655 - RNA, 64 nt, Human; identical to SEQ ID NO: 315766

SEQ ID NO: 328656 - RNA, 64 nt, Human; identical to SEQ ID NO: 315767

SEQ ID NO: 328657 - RNA, 64 nt, Human; identical to SEQ ID NO: 315768

SEQ ID NO: 328658 - RNA, 64 nt, Human; identical to SEQ ID NO: 315769

SEQ ID NO: 328659 - RNA, 64 nt, Human; identical to SEQ ID NO: 315770

SEQ ID NO: 328660 - RNA, 64 nt, Human; identical to SEQ ID NO: 315771

SEQ ID NO: 328661 - RNA, 64 nt, Human; identical to SEQ ID NO: 315772

SEQ ID NO: 328662 - RNA, 64 nt, Human; identical to SEQ ID NO: 315773

SEQ ID NO: 328663 - RNA, 64 nt, Human; identical to SEQ ID NO: 315774

SEQ ID NO: 328664 - RNA, 64 nt, Human
aagaaggccugagcaagggggaggaagaggaggaagguuggaccuucaucagaccacucccuuc

SEQ ID NO: 328665 - RNA, 64 nt, Human
aaagccaaaccagcacccuccuuugugcucugagagguuggagacaucugguccaccccauugc

SEQ ID NO: 328666 - RNA, 64 nt, Human
ggauagacuuuauucuugaagaucaucagaaaugagguuggaauuucgagguuuugagcagggg

SEQ ID NO: 328667 - RNA, 64 nt, Human
uuucccuuugagaugaagugcuguucuuuugccuagguuggaguacagcggugaaaucauagcg

SEQ ID NO: 328668 - RNA, 64 nt, Human; identical to SEQ ID NO: 315775

SEQ ID NO: 328669 - RNA, 64 nt, Human; identical to SEQ ID NO: 315779

SEQ ID NO: 328670 - RNA, 64 nt, Human; identical to SEQ ID NO: 315780

SEQ ID NO: 328671 - RNA, 64 nt, Human; identical to SEQ ID NO: 315781

SEQ ID NO: 328672 - RNA, 64 nt, Human; identical to SEQ ID NO: 315782

SEQ ID NO: 328673 - RNA, 64 nt, Human; identical to SEQ ID NO: 315783

SEQ ID NO: 328674 - RNA, 64 nt, Human; identical to SEQ ID NO: 315784

SEQ ID NO: 328675 - RNA, 64 nt, Human; identical to SEQ ID NO: 315785

SEQ ID NO: 328676 - RNA, 64 nt, Human; identical to SEQ ID NO: 315786

SEQ ID NO: 328677 - RNA, 64 nt, Human; identical to SEQ ID NO: 315787

SEQ ID NO: 328678 - RNA, 64 nt, Human; identical to SEQ ID NO: 315788

SEQ ID NO: 328679 - RNA, 64 nt, Human; identical to SEQ ID NO: 315789

SEQ ID NO: 328680 - RNA, 64 nt, Human; identical to SEQ ID NO: 315790

SEQ ID NO: 328681 - RNA, 64 nt, Human; identical to SEQ ID NO: 315791

SEQ ID NO: 328682 - RNA, 64 nt, Human; identical to SEQ ID NO: 315792

SEQ ID NO: 328683 - RNA, 64 nt, Human; identical to SEQ ID NO: 315793

SEQ ID NO: 328684 - RNA, 61 nt, Human
uggcuucucacagcuguggucuccccugccucacaacgacuccuuucucuuguguggcggg

SEQ ID NO: 328685 - RNA, 61 nt, Human
agaaaacgagccuguuucagaggaacaucgucacaacgaauacuucuggaagcuuaacaaa

SEQ ID NO: 328686 - RNA, 64 nt, Human
gugccaggagaugagaggcuggggguacacaaucagguuggaguccuguccuuacucugcugca

SEQ ID NO: 328687 - RNA, 64 nt, Human
aggauuggggaagacacuugacugcuagaaucagagguuggacacuauacauaaggacaggcuc

SEQ ID NO: 328688 - RNA, 64 nt, Human; identical to SEQ ID NO: 315794

SEQ ID NO: 328689 - RNA, 64 nt, Human; identical to SEQ ID NO: 315798

SEQ ID NO: 328690 - RNA, 64 nt, Human; identical to SEQ ID NO: 315799

SEQ ID NO: 328691 - RNA, 64 nt, Human; identical to SEQ ID NO: 315800

SEQ ID NO: 328692 - RNA, 64 nt, Human; identical to SEQ ID NO: 315801

SEQ ID NO: 328693 - RNA, 64 nt, Human; identical to SEQ ID NO: 315802

SEQ ID NO: 328694 - RNA, 64 nt, Human; identical to SEQ ID NO: 315803

SEQ ID NO: 328695 - RNA, 64 nt, Human; identical to SEQ ID NO: 315804

SEQ ID NO: 328696 - RNA, 64 nt, Human; identical to SEQ ID NO: 315805

SEQ ID NO: 328697 - RNA, 64 nt, Human; identical to SEQ ID NO: 315806

SEQ ID NO: 328698 - RNA, 64 nt, Human; identical to SEQ ID NO: 315807

SEQ ID NO: 328699 - RNA, 64 nt, Human; identical to SEQ ID NO: 315808

SEQ ID NO: 328700 - RNA, 64 nt, Human; identical to SEQ ID NO: 315809

SEQ ID NO: 328701 - RNA, 64 nt, Human; identical to SEQ ID NO: 315810

SEQ ID NO: 328702 - RNA, 64 nt, Human; identical to SEQ ID NO: 315811

SEQ ID NO: 328703 - RNA, 64 nt, Human; identical to SEQ ID NO: 315812

SEQ ID NO: 328704 - RNA, 64 nt, Human
acugaaccugucuugcugugccucgaaacucuggagguuggagcaucaaguuccagccggcccc

SEQ ID NO: 328705 - RNA, 64 nt, Human
uuucucagaccccagagcaguauuaaugaugcagagguuggaggagagagguggagacuguggc

SEQ ID NO: 328706 - RNA, 64 nt, Human
gcacaggucuaugucgagggaauggguuccuugcagguuggaggcggggcugcaucuggcuugg

SEQ ID NO: 328707 - RNA, 64 nt, Human; identical to SEQ ID NO: 315813

SEQ ID NO: 328708 - RNA, 64 nt, Human; identical to SEQ ID NO: 315817

SEQ ID NO: 328709 - RNA, 64 nt, Human; identical to SEQ ID NO: 315818

SEQ ID NO: 328710 - RNA, 64 nt, Human; identical to SEQ ID NO: 315819

SEQ ID NO: 328711 - RNA, 64 nt, Human; identical to SEQ ID NO: 315820

SEQ ID NO: 328712 - RNA, 64 nt, Human; identical to SEQ ID NO: 315821

SEQ ID NO: 328713 - RNA, 64 nt, Human; identical to SEQ ID NO: 315822

SEQ ID NO: 328714 - RNA, 64 nt, Human; identical to SEQ ID NO: 315823

SEQ ID NO: 328715 - RNA, 64 nt, Human; identical to SEQ ID NO: 315824

SEQ ID NO: 328716 - RNA, 64 nt, Human; identical to SEQ ID NO: 315825

SEQ ID NO: 328717 - RNA, 64 nt, Human; identical to SEQ ID NO: 315826

SEQ ID NO: 328718 - RNA, 64 nt, Human; identical to SEQ ID NO: 315827

SEQ ID NO: 328719 - RNA, 64 nt, Human; identical to SEQ ID NO: 315828

SEQ ID NO: 328720 - RNA, 64 nt, Human; identical to SEQ ID NO: 315829

SEQ ID NO: 328721 - RNA, 64 nt, Human; identical to SEQ ID NO: 315830

SEQ ID NO: 328722 - RNA, 64 nt, Human; identical to SEQ ID NO: 315831

SEQ ID NO: 328723 - RNA, 64 nt, Human
uguguaauucaccaauuaagugcaguuuauauucagguuggauuaugcauguuuagguaaacga

SEQ ID NO: 328724 - RNA, 64 nt, Human
aaaauugcaugcgggauuguguaaagacaaugccagguuggacugccagaaugagccaacagca

SEQ ID NO: 328725 - RNA, 64 nt, Human
uaaggcaggagaaucacuugaacccaggaggcagagguuggagugagcugagaucgcgccaccg

SEQ ID NO: 328726 - RNA, 64 nt, Human
gaagaaccugcuguguuuagaugucucugaaaacagguuggaaagacuuccugaagaaaucagu

SEQ ID NO: 328727 - RNA, 64 nt, Human; identical to SEQ ID NO: 315832

SEQ ID NO: 328728 - RNA, 64 nt, Human; identical to SEQ ID NO: 315836

SEQ ID NO: 328729 - RNA, 64 nt, Human; identical to SEQ ID NO: 315837

SEQ ID NO: 328730 - RNA, 64 nt, Human; identical to SEQ ID NO: 315838

SEQ ID NO: 328731 - RNA, 64 nt, Human; identical to SEQ ID NO: 315839

SEQ ID NO: 328732 - RNA, 64 nt, Human; identical to SEQ ID NO: 315840

SEQ ID NO: 328733 - RNA, 64 nt, Human; identical to SEQ ID NO: 315841

SEQ ID NO: 328734 - RNA, 64 nt, Human; identical to SEQ ID NO: 315842

SEQ ID NO: 328735 - RNA, 64 nt, Human; identical to SEQ ID NO: 315843

SEQ ID NO: 328736 - RNA, 64 nt, Human; identical to SEQ ID NO: 315844

SEQ ID NO: 328737 - RNA, 64 nt, Human; identical to SEQ ID NO: 315845

SEQ ID NO: 328738 - RNA, 64 nt, Human; identical to SEQ ID NO: 315846

SEQ ID NO: 328739 - RNA, 64 nt, Human; identical to SEQ ID NO: 315847

SEQ ID NO: 328740 - RNA, 64 nt, Human; identical to SEQ ID NO: 315848

SEQ ID NO: 328741 - RNA, 64 nt, Human; identical to SEQ ID NO: 315849

SEQ ID NO: 328742 - RNA, 64 nt, Human; identical to SEQ ID NO: 315850

SEQ ID NO: 328743 - RNA, 64 nt, Human
gagagcuauguacagggagagcauuuuagauugaagguuggaaugguguacuaaaccaaaaaag

SEQ ID NO: 328744 - RNA, 64 nt, Human
ugugugccggcauccuugauggguucaaagagaaagguuggagaugauagugggugagaagcag

SEQ ID NO: 328745 - RNA, 64 nt, Human
agugggugagaagcaggcuggugagacugggcugagguuggagaaggggcagccgggggcacug

SEQ ID NO: 328746 - RNA, 64 nt, Human; identical to SEQ ID NO: 315851

SEQ ID NO: 328747 - RNA, 61 nt, Human
agugaaagggauuccucccacgccagaucugcacaacgaggcaagacaggacccaccugug

SEQ ID NO: 328748 - RNA, 61 nt, Human
agugcuggaauacauuaucucauugaauuaucacaacgaccuuuucaaguaggcauuauca

SEQ ID NO: 328749 - RNA, 61 nt, Human
uaaacauccuauaaugcacagggcaguaccccacaacgaaaaauaaucuggcccaaaaugu

SEQ ID NO: 328750 - RNA, 61 nt, Human
agauggaaggaauccaggcaacauucuucaccacaacgaagaaacagauaaaagauaccca

SEQ ID NO: 328751 - RNA, 61 nt, Human
aaaaaacuguucuggacugcaaaucugcacacacaacgaacaguugcauuucagagaguuc

SEQ ID NO: 328752 - RNA, 61 nt, Human
uuaauguaauuucauuccauucuauuguuuacacaacgauuacucgaagaugacugcaaag

SEQ ID NO: 328753 - RNA, 61 nt, Human
ggcaacauagcaagaccccgucucuacaaagcacaacgaaaaacaacaaauggaguugugc

SEQ ID NO: 328754 - RNA, 61 nt, Human
uacccagccagagucuacucacugucacaagcacaacgaguuuauaugagaaagcacugag

SEQ ID NO: 328755 - RNA, 61 nt, Human
gaauucgcauuuugccagcucagcgcaccuccacaacgaaugaaaugcuccguaugauuug

SEQ ID NO: 328756 - RNA, 61 nt, Human
aaugauccuggaaauugcaguaacaaaagcacacaacgauuauaguaacuauaagauacaa

SEQ ID NO: 328757 - RNA, 61 nt, Human
cgggggacugacgccagguuccccagccgcccacaacgacuuuauuuucuuacccaauuuc

SEQ ID NO: 328758 - RNA, 61 nt, Human
caagccagggaaugcauugcagaggcaccugcacaacgacaaacuugaguguuucccugcc

SEQ ID NO: 328759 - RNA, 61 nt, Human
gaguugauuauuucaacaguauugguuaagucacaacgacgaagugcugagaagguuaugg

SEQ ID NO: 328760 - RNA, 61 nt, Human
gcuucagcccgccgcagacuucacagcuggccacaacgagccuguagccaacggcagucac

SEQ ID NO: 328761 - RNA, 61 nt, Human
cuucaggccacaaagcaaaaaguugcauagccacaacgaagaucuaguuggauauaguuuu

SEQ ID NO: 328762 - RNA, 64 nt, Human
ugcccuccuguccucccacuucucuacgcccucaagguuggagaccccgcucccaugccccagc

SEQ ID NO: 328763 - RNA, 64 nt, Human
aaaucaagaauauuuguggagguagguguggggaagguuggagaagaguuagguuugugcuuug

SEQ ID NO: 328764 - RNA, 64 nt, Human
ggcagaggccccauuagcuuuaaaauguagccccagguuggagcugggaacacuguacuggcca

SEQ ID NO: 328765 - RNA, 64 nt, Human
ggccaaaggaagagguuuuccugucuggcuucugagguuggagggggcacuuagcagugaaccu

SEQ ID NO: 328766 - RNA, 64 nt, Human
gccaggcagggucguguguggguguggggcugccagguuggacgcagcugcugcugcccugacu

SEQ ID NO: 328767 - RNA, 64 nt, Human
gugacagacccagcagauagcuucucucugggaaagguuggaugcugccuuacauccccuucua

SEQ ID NO: 328768 - RNA, 64 nt, Human
uacauguuuuaacaguguaaugggaggaucugaaagguuggacccgggagggguagcugccgau

SEQ ID NO: 328769 - RNA, 64 nt, Human
ugaucuuuuccaaguucccaaggccuacagcugaagguuggagaaaugccagcugcccuuucgu

SEQ ID NO: 328770 - RNA, 64 nt, Human; identical to SEQ ID NO: 328391

SEQ ID NO: 328771 - RNA, 64 nt, Human
aauggcaugaaucacucauuuauuaaaauauaucagguuggagagugagaauuuuugcauuaug

SEQ ID NO: 328772 - RNA, 64 nt, Human
gaagaguaacaaacugaaaucuuugagaucacacagguuggaaauauguacauaacugcacaag

SEQ ID NO: 328773 - RNA, 64 nt, Human
cuuacuguuguccuaugggagucaaguguggaguagguuggaagcuagcuccccuccucucccc

SEQ ID NO: 328774 - RNA, 64 nt, Human
gcaagccgucuuguuugcugcaaggaugcuuuugagguuggacaggagguucugguccugccuu

SEQ ID NO: 328775 - RNA, 64 nt, Human
cuaguacuaaacugugcuaguacuaaaagaaaacagguuggaacauacauauagccuagcauuu

SEQ ID NO: 328776 - RNA, 64 nt, Human
ugcggugaggcacucuggaauaugacccuaccagagguuggagaacaaacuugggcagccggaa

SEQ ID NO: 328777 - RNA, 64 nt, Human
aaauuugcaucccggagguugaaguuggaguuugagguuggaaaauaucuuugaaggcagaauc

SEQ ID NO: 328778 - RNA, 64 nt, Human
aaauaccugagacuggguaauuuauaaagaaaagagguuggauuggcucacgguucugcaggcu

SEQ ID NO: 328779 - RNA, 64 nt, Human
uuuuuuuuugagauggagucucucucugucacccagguuggagugcaguggugugaucuuggcu

SEQ ID NO: 328780 - RNA, 64 nt, Human
caugcugccccugccuuggggucagguugacaggagguuggagggaaagccuuaagcugcagga

SEQ ID NO: 328781 - RNA, 54 nt, Human
ucacauuagauaugauuuaaccauaagcagcagcacgauccagagauccauugc

SEQ ID NO: 328782 - RNA, 52 nt, Human
aacauacuacccaaaucugaaaaagcagcauguugagaagauggccccuugu

SEQ ID NO: 328783 - RNA, 64 nt, Human
agcggcccagggugggccagaccagcagcccaggaagcagcacacgcggccguggggaggcagg

SEQ ID NO: 328784 - RNA, 64 nt, Human
uaaaacucuuguucacaugcuauuaugacuuauaaagcagcaacagcugaggcgcaccaggaca

SEQ ID NO: 328785 - RNA, 64 nt, Human
gcaaguguaaugacagaccugaauaaaauguauuaagcagcagugaucuuuccucuccuccuuc

SEQ ID NO: 328786 - RNA, 64 nt, Human
gauucagcaaacaaugaguaccuacuguguguagaagcagcaggacagccugucaucacuggga

SEQ ID NO: 328787 - RNA, 64 nt, Human
gcuagauagcuucucuguggccuccuauuuagcuaagcagcaguguuuuuggauacuuuuuuuu

SEQ ID NO: 328788 - RNA, 64 nt, Human
agaggaggcagcaccgagggugccuguuugaagcaagcagcauuugggauaugugcccuuccuc

SEQ ID NO: 328789 - RNA, 64 nt, Human
cugccacaugggaacugugaagaggcacccuggcaagcagcagugauugggggaggggacagga

SEQ ID NO: 328790 - RNA, 64 nt, Human
uucuuacaggaagaccgucucuuucgaaugaaucaagcagcagaauuguacuugauucaaauua

SEQ ID NO: 328791 - RNA, 64 nt, Human
gucacagcuagucaacccugccauuuuaccacaaaagcagcaauagacauuauguaaacaaaug

SEQ ID NO: 328792 - RNA, 64 nt, Human
uuaaucaaauaagauacaugauauugaaagaauaaagcagcauuuuuaguuuuuacuaccuuag

SEQ ID NO: 328793 - RNA, 64 nt, Human
cuuugcacaaauacaauugcuuucaggaauccuaaagcagcauuuuauugaguuugaauuauua

SEQ ID NO: 328794 - RNA, 64 nt, Human
cugucuccucccaauucauccuuaauuccaagugaagcagcacagugcugagaaacaguucauc

SEQ ID NO: 328795 - RNA, 64 nt, Human
ugaugggaaaugcuuucacuuuaccagcuuugggaagcagcagccccaugggaucuaaaagugu

SEQ ID NO: 328796 - RNA, 64 nt, Human
ggaguccucuuaaagagggacgagggccagacugaagcagcacaaggccggggacacccaugcc

SEQ ID NO: 328797 - RNA, 64 nt, Human
cacuggaugcucucaguaauguuaaguaauugucaagcagcaguuaccuacuguguucuuaaca

SEQ ID NO: 328798 - RNA, 64 nt, Human
ccucccacaaaaaaagaaaagaagaaaaaauuccaagcagcaaaacuuacuuuguuuguaaggu

SEQ ID NO: 328799 - RNA, 64 nt, Human
ccugccccgcuacagaagccagacugggucccgcggacgccagcaggggcagccccagccuagg

SEQ ID NO: 328800 - RNA, 64 nt, Human
aguuggggcccaaaagacagucugaagaggaaggaagcagcaguaucugcguagcccacagagg

SEQ ID NO: 328801 - RNA, 64 nt, Human
guucaaacaaaagucuaguugggauuuuuuaccaaagcagcauaauauguguuauauaaacaua

SEQ ID NO: 328802 - RNA, 64 nt, Human
gccagcauuaccuuccacugccuuucucccugggaagcagcacagcugagacugggcaccaggc

SEQ ID NO: 328803 - RNA, 64 nt, Human
ugaccuccuucaucacauccugcaguaucuccagaagcagcacuaggguuugaguuucauacuu

SEQ ID NO: 328804 - RNA, 64 nt, Human
acugaaggcucagauugaggagcucaagaacgagaagcagcauuugauauacaugcucaaccuu

SEQ ID NO: 328805 - RNA, 64 nt, Human
agcaaugacuuugaaucuaguuuucagugaucagaagcagcaguuauuugaguguaugaaugga

SEQ ID NO: 328806 - RNA, 64 nt, Human
caacuccaguguugauaauuaaaaugaaaugguaaagcagcagacuguaaggucuuuagagauu

SEQ ID NO: 328807 - RNA, 64 nt, Human
cuggggcagaggggcagccgcuaggagagacugaaagcagcagcuaggacugaggaguggguuu

SEQ ID NO: 328808 - RNA, 64 nt, Human
agccugaggacccuccccuaccaaggaccaggaaaagcagcagcugccugcucuccagccucug

SEQ ID NO: 328809 - RNA, 64 nt, Human
ggccccugccaugggugcgcuccucaccggagcaaagcagcaugauaaggacugcagcggggga

SEQ ID NO: 328810 - RNA, 64 nt, Human
uugcuuugugugcgacagggaggaaguuucaauaaagcagcaacaagcuucugucuggcugaug

SEQ ID NO: 328811 - RNA, 64 nt, Human
uuuuuucuuugaaccuuaaagguucuauuauuaaaagcagcacagauuccacauuuuuauacau

SEQ ID NO: 328812 - RNA, 64 nt, Human
gagcagcccuuggguuuguaucugguaggggagaaagcagcaggacaguggagguguguggaag

SEQ ID NO: 328813 - RNA, 64 nt, Human
cccuucuuucaucagaguuaguguucuggaaggaaagcagcagggaagggaauauugaggaauc

SEQ ID NO: 328814 - RNA, 64 nt, Human
caaauauuauauuucaugacaauggaguucuagaaagcagcaucuguuuuuuguugcguguuuc

SEQ ID NO: 328815 - RNA, 64 nt, Human
agcaugggcucaaaugagcacccuggcuggcugcaagcagcagcuacacaacacuacagagggc

SEQ ID NO: 328816 - RNA, 64 nt, Human
uccuuugugcccacccguucuggccacccugccuggacgccagcuguucuucucagccugagcc

SEQ ID NO: 328817 - RNA, 64 nt, Human
gccggggaaggccaggguggaagggcggcuugagggacgccaggagaagacugaaugccaggcu

SEQ ID NO: 328818 - RNA, 64 nt, Human
cuucgccucccuccaggacuccaccccggcucccggacgccagcugggcgucagaccccaccgg

SEQ ID NO: 328819 - RNA, 64 nt, Human
auguguuuccuugaugcaggagguguucuucccuggacgccaugguguucccugcacuugggug

SEQ ID NO: 328820 - RNA, 64 nt, Human
ugaaagauuccguuuauccugccauugcuuugaaaagcagcaggaaacgaaauccuuugacuug

SEQ ID NO: 328821 - RNA, 64 nt, Human
uaucaagauauuaguaagaaaggaucauguuuugaagcagcagguccaggucacuuuguauaua

SEQ ID NO: 328822 - RNA, 64 nt, Human
uuuguaaaacauuccaaauaauuccacaguccugaagcagcaaucgaaucccuuucucacuuuu

SEQ ID NO: 328823 - RNA, 64 nt, Human
gagcagcagugucagcaucagggcggaagccuuaaagcagcagcgggugugcccaggcacccag

SEQ ID NO: 328824 - RNA, 64 nt, Human
cuagggaagcagagagcagagcacacacuggcucaagcagcagagguaagaggaagaggcagca

SEQ ID NO: 328825 - RNA, 64 nt, Human
cagccucugcaccccaaaguuccccuugggggagaagcagcauugaagugggaagauuuaggcu

SEQ ID NO: 328826 - RNA, 64 nt, Human
gaaguaaaaaggaccaauucaagccaacuggucuaagcagcauuuaauugaagaauaugugaua

SEQ ID NO: 328827 - RNA, 64 nt, Human
ugauccagaagacaaccacuucucuccuuuuagaaagcagcaggauugacuuauugagaaauaa

SEQ ID NO: 328828 - RNA, 64 nt, Human
gauuugcaaccccaucauccucaggccucucuacaagcagcaggaaacauagaacucagagcca

SEQ ID NO: 328829 - RNA, 64 nt, Human
gaacuugauuuuaaaaaccagucaagagcaaucaaagcagcacaugguguuguauacuucauua

SEQ ID NO: 328830 - RNA, 64 nt, Human
uaguauagaacuuaaagacagaguuccauucuggaagcagcaugucauugugguaagagaauag

SEQ ID NO: 328831 - RNA, 64 nt, Human
acuccucauuguaaacaaacuguguaacugcccaaagcagcacuuauaaaucagccuaacauaa

SEQ ID NO: 328832 - RNA, 64 nt, Human
aaaaaaaaaaaugcgcuccagcagccuguuugggaagcagcagucucuccuucagauacugugg

SEQ ID NO: 328833 - RNA, 64 nt, Human
caagaagaaaccucaaguguauugacacguaaagaagcagcaguccugccccaguucuccuaag

SEQ ID NO: 328834 - RNA, 64 nt, Human
cagugggaaccagcaacuugggcuaccuuaggggaagcagcacucugcccaggguucuugcuau

SEQ ID NO: 328835 - RNA, 64 nt, Human
ggagugccuccuuaguggugcuugcagucacaggaagcagcagcaguaaggacaaggggccgga

SEQ ID NO: 328836 - RNA, 64 nt, Human
cugguaaacauuccuccagccuccccuccccuggggacgccaaggaggugggccacacccagga

SEQ ID NO: 328837 - RNA, 64 nt, Human
gcugauaacaccaccacugggacgugccauguugggacgccacucccugugggaaggcaccauc

SEQ ID NO: 328838 - RNA, 64 nt, Human
gauaaauuuguuguauucaaaaacuugaaaugcaggacgccauuaagugucuguuuauauuuuu

SEQ ID NO: 328839 - RNA, 64 nt, Human
gagagagagagauccucagaguggaaggagggggaagcagcaggacacauuggcaagucaagca

SEQ ID NO: 328840 - RNA, 64 nt, Human
uaugcaaggaguaaaguaaaaccauccagaaucaaagcagcaaccacauaguucaaaucaaaga

SEQ ID NO: 328841 - RNA, 64 nt, Human
uuuuuaccuuuuuaaaaaucuguuagaagaaaaaaagcagcagacgaaagagaaaaacccuccu

SEQ ID NO: 328842 - RNA, 64 nt, Human
gagagaaucaguauucuuauauggcaaucuggggaagcagcaauaugccacuguacaaaacuga

SEQ ID NO: 328843 - RNA, 64 nt, Human
aaaucauuaccuguggaauggcuaggaauauuggaagcagcauaguguugauguacgcaaaaca

SEQ ID NO: 328844 - RNA, 64 nt, Human
acccauacauaagaaacagccuccaagaacauucaagcagcagucagagagaaaaauguuucga

SEQ ID NO: 328845 - RNA, 64 nt, Human
agucuuaaaacucuaaaacaguuguacugcuuccaagcagcaguauuuauaguaacguaagcua

SEQ ID NO: 328846 - RNA, 64 nt, Human
acacuugacuuuaucauuguuuacuacuaguaaaaagcagcauugccaaauaaucccuaauuuu

SEQ ID NO: 328847 - RNA, 64 nt, Human
cccaaacauuaaaaugacaggaaagagaaaguagaagcagcaauaaauacugccccaacuuucc

SEQ ID NO: 328848 - RNA, 64 nt, Human
uugggcaguuggguuucuggcuugagaugaauccaagcagcagaaugagccaggaguagcagga

SEQ ID NO: 328849 - RNA, 64 nt, Human
cuuaggauuucuuauuguagcuaagagccaucugaagcagcagguugcaggacaaaugcuucag

SEQ ID NO: 328850 - RNA, 64 nt, Human
auuaagaauguuccuuaaagguuuaagaagcaguaagcagcaucugaagccacaaucuauuaua

SEQ ID NO: 328851 - RNA, 64 nt, Human
gagucucuuaacugauggaugcccacuugccuuaaagcagcauacuuauuuuuuguuuauuuau

SEQ ID NO: 328852 - RNA, 64 nt, Human
cucuguuugguaagaauacaucauuagcuuaaauaagcagcagaagguuaguuuuaauuaugua

SEQ ID NO: 328853 - RNA, 64 nt, Human
aaaguuaagcauuguuuacuugaagugggcagggaagcagcacugaguaaaguucaauugagug

SEQ ID NO: 328854 - RNA, 62 nt, Human
ggacagagcucucuucaauaaauucgucaggucaaagcagcagcuuugcuucugcuguuugu

SEQ ID NO: 328855 - RNA, 54 nt, Human
uggagaacacaguugucuaaggcugccugucaccacuguggccucuccaagcgu

SEQ ID NO: 328856 - RNA, 64 nt, Human
cugggauuaugcuuuauaggauguggucccacaggccugucacagggccaaauugggucugucc

SEQ ID NO: 328857 - RNA, 64 nt, Human
uaucauuuagauauuauuuccuagaaaacaggaugccugucacugauaaguuagagaaaacacc

SEQ ID NO: 328858 - RNA, 64 nt, Human
auggccucuugaugcucauaucuguucuucagcagccugucauaggaacuggauccuaccuaug

SEQ ID NO: 328859 - RNA, 64 nt, Human
uuugcuguguugaagcuauuaaacauggaucuauaagcagcaggaagauuuuuuccaaggacug

SEQ ID NO: 328860 - RNA, 64 nt, Human
ccccccacuuccucaaaacaaacaagagauggcaaagcagcaguccgaccaagcccacuggaau

SEQ ID NO: 328861 - RNA, 64 nt, Human
uguuuacugagcaucuguuaaguguugggggaaaaagcagcaggauccagagcuauagguacag

SEQ ID NO: 328862 - RNA, 64 nt, Human
cucggagggaagccacugccaccugagacagcccaagcagcaagauaaacccgcuccacccgac

SEQ ID NO: 328863 - RNA, 64 nt, Human
cauacacauauucuucaggucucuaagccccuggaagcagcauugugugauauucucagaggca

SEQ ID NO: 328864 - RNA, 64 nt, Human
ucuaaucugugcuguuucaaaguucucuguggcaaagcagcaacuauucacaaaauaucaccaa

SEQ ID NO: 328865 - RNA, 64 nt, Human
ugcaggagguggcucaguuauugaaccuuuugggaagcagcaccugggaaugcugccucguggg

SEQ ID NO: 328866 - RNA, 64 nt, Human
ccucucccacugaccucuuucucguuuguggacaaagcagcacguaucaccucauucaucacuu

SEQ ID NO: 328867 - RNA, 64 nt, Human
ccagcgccuccaggcccagcugaggagcugugagaagcagcagaggggacuccccaucccgggc

SEQ ID NO: 328868 - RNA, 63 nt, Human
gggacauggugagcucuugaggaccccugccagaagcagcaagggccaugggguggugcuucc

SEQ ID NO: 328869 - RNA, 64 nt, Human
agugugaaucuuuauaguauuugaaaaugagaagaagcagcagauuguaauuugguuuauugga

SEQ ID NO: 328870 - RNA, 64 nt, Human
aacauuucauaaaugcaucugugguagagguagaaagcagcaccuuuccuaauuggcaaaugau

SEQ ID NO: 328871 - RNA, 64 nt, Human
augccuaggccagcuccuuagacaccuaucagagaagcagcaucaaccuaggagcagugggccc

SEQ ID NO: 328872 - RNA, 64 nt, Human
uaggaacgaacgugaugguuaagcuaccuucauuaagcagcaugaccgcuuccugagcuccugc

SEQ ID NO: 328873 - RNA, 64 nt, Human
agggggcugacuguuccauucuagcuuuggcacaaagcagcagaaagggggaaaagccaauaga

SEQ ID NO: 328874 - RNA, 64 nt, Human
gcgggcucugcccuggugcgcuucacacagcaccaagcagcaacaagaacagcagaaggggaac

SEQ ID NO: 328875 - RNA, 64 nt, Human
acucuaccucugaaugugcugggaaccucuuggagccugucaggaacuccucacuguuuaaaua

SEQ ID NO: 328876 - RNA, 64 nt, Human
auauucacuguguccuuuucugaaucccauuguagccugucaacuaaauuugaguguuaacggu

SEQ ID NO: 328877 - RNA, 64 nt, Human
gcugcuucuacacccaccccaccgaggugcugaagccugucagccagcaccccagggacuucuu

SEQ ID NO: 328878 - RNA, 64 nt, Human
ggaugcggugacaaauggcagcuuagcuacaaaugccugucagucggagagaauggggugagca

SEQ ID NO: 328879 - RNA, 64 nt, Human
cauuuguaaaugccauugucacagccucauuuguaagcagcacugccucucuguuuggggagau

SEQ ID NO: 328880 - RNA, 64 nt, Human
acuuuguccuccaaaaagcuaacauacgguuuugaagcagcauugaaacuuuuguagcaaucug

SEQ ID NO: 328881 - RNA, 64 nt, Human
gccucacacugugugugauuuuguuucuuuuguuaagcagcacuuauguagacugcauuuccaa

SEQ ID NO: 328882 - RNA, 64 nt, Human
ggagguggguggugugcuugcuagcugggcaagaaagcagcaguggaccugccccaaggccaca

SEQ ID NO: 328883 - RNA, 64 nt, Human
ggaauccucaccaguuuguucucuucccucugacaagcagcaccugagcagaugcugaggcagu

SEQ ID NO: 328884 - RNA, 64 nt, Human
ccugacauaagaaauguuuuaaugccuuuugaugaagcagcagauuuuggaacaaucuuuuaac

SEQ ID NO: 328885 - RNA, 64 nt, Human
ugacuggucuuaagcuguucuugcauaggcucuuaagcagcauggaaaaaugguugauggaaaa

SEQ ID NO: 328886 - RNA, 64 nt, Human
guguaagccuugcaaacaaaaaacaacaaaaaagaagcagcagcagcagccugcuguguggcau

SEQ ID NO: 328887 - RNA, 64 nt, Human
cggaacauccucaagcagagguaguaaaacaggaaagcagcauguccgaaaguaaaguguuggg

SEQ ID NO: 328888 - RNA, 64 nt, Human
ccauguuuugacucauuugguaaccauugccuguaagcagcacagaauuggugccauggauuau

SEQ ID NO: 328889 - RNA, 64 nt, Human
ugugcaaaacagcguuuaagacuguaaugaaucuaagcagcauuucugaaguggacucuuuggu

SEQ ID NO: 328890 - RNA, 64 nt, Human
ugccacugcuuucugugcagaacuucuccaugucaagcagcaggugucagcaggaaaaagauca

SEQ ID NO: 328891 - RNA, 64 nt, Human
gauuucuuacaaaagaaaaaggacgaugucagucaagcagcacuuuuucagaauauacagaaca

SEQ ID NO: 328892 - RNA, 64 nt, Human
gauuuggaucaaaaggagaaaugauaagugacaaaagcagcacaaggaauuucccuguguggau

SEQ ID NO: 328893 - RNA, 64 nt, Human
uccgggcgggcacccucagccgggcucuuugcagaagcagcaccgcugacugugggcccggccc

SEQ ID NO: 328894 - RNA, 64 nt, Human
ccugggauggcuggauugagcaaugagcagagccaagcagcacagaguccccuggggcuagagg

SEQ ID NO: 328895 - RNA, 64 nt, Human
ccugucaccccaccccaggccacccucucccagaggacgccaucucccuuacuguugcugggag

SEQ ID NO: 328896 - RNA, 64 nt, Human
gccacaccaggucgcagcaaauggcuucagccugggacgccaguguuuuaugcucuuaguucag

SEQ ID NO: 328897 - RNA, 64 nt, Human
gagaaaacugaacuguuacaaaccccugcacagugccugucaaacagaugcaaaccuuccugaa

SEQ ID NO: 328898 - RNA, 64 nt, Human
gcaggaggggcgagcugggaggcaggaggcagcggccugucagucugcagaauggucgcacugg

SEQ ID NO: 328899 - RNA, 64 nt, Human
cucucaaagagacaaggaagccaccuguaagcagaagcagcauccaagugccccuggccccccc

SEQ ID NO: 328900 - RNA, 64 nt, Human
uaggauaagaggugagaacugggcaaaaguugugaagcagcaauucuguuauauggacaguguu

SEQ ID NO: 328901 - RNA, 64 nt, Human
ucacauucaaaauagugacucuaaacaaagaagaaagcagcacugucaucagaugcaugauaaa

SEQ ID NO: 328902 - RNA, 64 nt, Human
gaccuaacagcagagcugaaaagucuugaggacaaagcagcagaggucguaaagaauacaaaug

SEQ ID NO: 328903 - RNA, 64 nt, Human
caagugguuuucaagugucaggcaguguucugagaagcagcagccuauaacuguauguguguuc

SEQ ID NO: 328904 - RNA, 64 nt, Human
aagauuaauaccuuaaaagaagaaaacacucaagaagcagcaguccugaaugguguuucauaaa

SEQ ID NO: 328905 - RNA, 64 nt, Human
gcaggagcccuggugcuacccccugugaagagccaagcagcagggcacgccuggcuuuccuugg

SEQ ID NO: 328906 - RNA, 64 nt, Human
uauacuguuugauaagaaaaguagguccagccuuaagcagcacagaugcgcugguagaugcaua

SEQ ID NO: 328907 - RNA, 64 nt, Human
cgggcacccauccauccaggcacccaacucacccaagcagcaacgagcaacaaucggaaaccaa

SEQ ID NO: 328908 - RNA, 64 nt, Human
uggccuguggccaugccuauucuguugacuuuaaaagcagcagcaucaagaacuccuagccuuc

SEQ ID NO: 328909 - RNA, 64 nt, Human
gaguuagcaccccacucucccaagccaccccugcaagcagcacagcagggcauauaccagucag

SEQ ID NO: 328910 - RNA, 64 nt, Human
acuuucuaggcuaggauuucuaaauuggugaaaaaagcagcauuagagugccagaauuagcacu

SEQ ID NO: 328911 - RNA, 64 nt, Human
cuacaaaacauuguauauuucaaaagacaaaaagaagcagcagcaguaucuuguucucuaauuc

SEQ ID NO: 328912 - RNA, 64 nt, Human
ggacuucuuagcucaguaucaucucccuucauguaagcagcacguuuuaacucuuaggaagcug

SEQ ID NO: 328913 - RNA, 64 nt, Human
guuagaaggcaaaagugggguagggggaugugggaagcagcauuguccucugggcauguggcuc

SEQ ID NO: 328914 - RNA, 64 nt, Human
cuggcuccucaagcuacccaugcccagcgcccuaaagcagcaccagaugcuuuggaauuggggu

SEQ ID NO: 328915 - RNA, 64 nt, Human
gcacagacuaugaaaagcugaguuagugcgcccgggacgccaggcaagcagcuuuuacaguuug

SEQ ID NO: 328916 - RNA, 64 nt, Human
cccagugggcuccuaagggggcaggcgugugaguggacgccauccgaagacagcacuugaccuc

SEQ ID NO: 328917 - RNA, 64 nt, Human
ccagggcucccuguccagaauucgguucuccucaggacgccaacucccagagcuaaggaccaag

SEQ ID NO: 328918 - RNA, 64 nt, Human
aggugauagcaguugucauucaguaauuuccuacaagcagcaccccaaaggaaauauaguccua

SEQ ID NO: 328919 - RNA, 64 nt, Human
ugucaucagaaacaugguuaaaguuuaaaacuagaagcagcagaaaacuagcuuguaaaauuua

SEQ ID NO: 328920 - RNA, 64 nt, Human
uuuuuuuccuaaagugaauuaaagugaaucauggaagcagcauuacuuuauaugaauauuauua

SEQ ID NO: 328921 - RNA, 64 nt, Human
aguagaugaugauuucagaggaguaaggcaugccaagcagcaugcucagugggguuuuaggcug

SEQ ID NO: 328922 - RNA, 64 nt, Human
uaugacaguuauacugucgguuuuuuuuaaauaaaagcagcaucugcuaauaaaacccaacaga

SEQ ID NO: 328923 - RNA, 64 nt, Human
acacaggcuccaguaggggcuguugccuccaauaaagcagcagugagcuuugccuugguggcug

SEQ ID NO: 328924 - RNA, 64 nt, Human
gacccagugcccaugguuccucacuccuaccagcaagcagcaccaucccgcaggcuucucccac

SEQ ID NO: 328925 - RNA, 64 nt, Human
gccuuggugacuuuugaaaaaaaaagaaaagaaaaagcagcauccuuauauuucuuuaaaauac

SEQ ID NO: 328926 - RNA, 64 nt, Human
acaacucugucuucuuguaacagcugauauuagcaagcagcaucuuauguccugauuucauaua

SEQ ID NO: 328927 - RNA, 64 nt, Human
uaacugcuccaagugccagaaugcuuacacguuaaagcagcaccuuuccauuugcccacauauu

SEQ ID NO: 328928 - RNA, 64 nt, Human
acugaagaucugacuguacuaaauaugaaaaauaaagcagcacauacuuucucuacuguuuucc

SEQ ID NO: 328929 - RNA, 64 nt, Human
aggauaugcuagucaauucuacaggacuuaccugaagcagcaugauuugcacaaagucgaccaa

SEQ ID NO: 328930 - RNA, 64 nt, Human
acuccgagaacaacaguugggcugucaacauucaaagcagcagagagggaacuuugcacuauug

SEQ ID NO: 328931 - RNA, 64 nt, Human
cuugugaugucuugacuguugcaccaggcugagaaagcagcaauauugauauuauaaagauaaa

SEQ ID NO: 328932 - RNA, 64 nt, Human
ucaaaguuuaauuaauauaauuaaaagcaacagcaagcagcagccugugaagauuuugcucauc

SEQ ID NO: 328933 - RNA, 64 nt, Human
ugucaccaaacuguaauucuucauggaaacuucaaagcagcauuuaaacaaauggaaaacuuug

SEQ ID NO: 328934 - RNA, 64 nt, Human
augggcccaccaauugggcuucccccugcucgagggacgccaauaggcaugccgccuccgggaa

SEQ ID NO: 328935 - RNA, 64 nt, Human
gggagcgaacguggaugaaaaccacagggauuccggacgccagaccccauuuuauacuucacuu

SEQ ID NO: 328936 - RNA, 64 nt, Human
ucccaguggcugcugcccaggcccagaccuucuaggacgccacccagcaaaagguuguuccuaa

SEQ ID NO: 328937 - RNA, 64 nt, Human
cacagccucugccugccuuggcuaagcaugaguuaagcagcaaaacgcuccuccaugucuggau

SEQ ID NO: 328938 - RNA, 64 nt, Human
ggggccaugaggccuucccugguccccacugaacccaccuuaguuccacauuuggcugcaucuu

SEQ ID NO: 328939 - RNA, 64 nt, Human
uggaccucugugccaagcaguaucccuguucagcccaccuuaaagguguaggcacccacugggu

SEQ ID NO: 328940 - RNA, 64 nt, Human
cacuggugugcaauuaauuggauugauuauaauaccaccuuaagcacuugcugaaaaaagugug

SEQ ID NO: 328941 - RNA, 64 nt, Human
gaugcucccgggaugccuucuagaagggggccucccaccuuaaguucaggcgccaucugauagc

SEQ ID NO: 328942 - RNA, 64 nt, Human
acuuuauugccccugaucuuuuccauuuuuguuuccaccuuaaccuauagcagcuccuccaaau

SEQ ID NO: 328943 - RNA, 64 nt, Human
cccuggcaguugaauggggcggcaauugcggggcccaccuuagaccgaaggggaaaacccgcuc

SEQ ID NO: 328944 - RNA, 64 nt, Human
gaugaggcaccugcuuuuucuuuucucucauuguccaccuuacuaaaagucaguagaaucuucu

SEQ ID NO: 328945 - RNA, 64 nt, Human
agucagcugaaauagccaaugccaggugcuccaaccaccuuauuuccuuguuuuguugauuaga

SEQ ID NO: 328946 - RNA, 64 nt, Human
ugaaaaguauucuuaaaaagaaaagucaggcaccccaccuuagaccucguaugcuugauccugu

SEQ ID NO: 328947 - RNA, 64 nt, Human
gagggggagggugcucuggguuuccgugagguaaccaccuuaaaugggagggaaguuggggugu

SEQ ID NO: 328948 - RNA, 64 nt, Human
aggucgucuuucuauuuucaggucagcugauuagccaccuuaguuccaucugcaacuuuaguuc

SEQ ID NO: 328949 - RNA, 64 nt, Human
ugaauuuuuuaaauuuuguuuuuaaaagcauauaccaccuuaguucauucauguauccugguaa

SEQ ID NO: 328950 - RNA, 64 nt, Human
aggagacaagcagcccagcagugaucagcaguagccaccuuagcacgaacauaggguuaacccu

SEQ ID NO: 328951 - RNA, 64 nt, Human
uugcuacuuuuuuaaauacuguaucauaaguucagccugucauacuuuuugcauugaucguuau

SEQ ID NO: 328952 - RNA, 64 nt, Human
ggaacugcuacaacuaacaaacauuuguuuccaagccugucauuaagagucugcaucaagagau

SEQ ID NO: 328953 - RNA, 64 nt, Human
uauguuuuaagaaguugagaucuugugaauauaugccugucagugucuucuuuauauauuuauu

SEQ ID NO: 328954 - RNA, 64 nt, Human
gagugccuagaaucuuaauaaugaauaaaauaaaaagcagcaauaugucauuaacaaauccaga

SEQ ID NO: 328955 - RNA, 64 nt, Human
uuuaagaauuuguugccuuucuacuauuacagcaaagcagcauuuuguuacugacugccuaaaa

SEQ ID NO: 328956 - RNA, 64 nt, Human
ccaucugggcacucauuuaaaguauaucuuaaaaaagcagcagcaagguaccuugccauuuuua

SEQ ID NO: 328957 - RNA, 64 nt, Human
gugaaauucaaggagaaggaaugaggaguuagggaagcagcauacuugaauauuagagaaggag

SEQ ID NO: 328958 - RNA, 64 nt, Human
uuugcauucucuauagccucugcagagagauacuaagcagcaaaaucuugguguugugauguac

SEQ ID NO: 328959 - RNA, 64 nt, Human
ugggcccaggaguugcaagucucugcuucuuaccaagcagcagcucuguaccuugggaagucgc

SEQ ID NO: 328960 - RNA, 64 nt, Human
uucucccauacauuccaaaaggaaguucaacaguaagcagcaccuccaagacugucuccuuuug

SEQ ID NO: 328961 - RNA, 64 nt, Human
cgggcaauaacucuguggcacgugggcaucacguaagcagcacacuaggaggcccaggcgcagg

SEQ ID NO: 328962 - RNA, 64 nt, Human
cucaccugaaucccccucuaucaaacaaacaaaaaagcagcaguaaagagcuagaaguugcagu

SEQ ID NO: 328963 - RNA, 64 nt, Human
agaacaaccuucucaaccaaaacugcaaucaggaaagcagcagcccacuccuucccauggaauc

SEQ ID NO: 328964 - RNA, 64 nt, Human
cucaucaugagccucaacugccuacaucuggggcaagcagcacaccggcugcagaugggacagc

SEQ ID NO: 328965 - RNA, 64 nt, Human
uugggcauuuaguuuacuagaaauucuuuaccuuaagcagcacacacauuuacuacacacacag

SEQ ID NO: 328966 - RNA, 64 nt, Human
ugauuuuacucuugccugugaaccucaugcaugaaagcagcacauuaaauuguaaaaauacaaa

SEQ ID NO: 328967 - RNA, 64 nt, Human
aucucuacucucaaguaugaggggaauagaaacaaagcagcaguuuuagccaggguucaaugau

SEQ ID NO: 328968 - RNA, 64 nt, Human
uauggcuuuuaauuuucgauuugacagauguaagaagcagcaugaauaguuuauacugugguuu

SEQ ID NO: 328969 - RNA, 64 nt, Human
aaucuggugguaacugugguaacauugcagcccuaagcagcauguguauauuagauaauugugu

SEQ ID NO: 328970 - RNA, 64 nt, Human
augccaggagggcucgagcuggacacuccuggcuggacgccaggccagugccgccuacguggag

SEQ ID NO: 328971 - RNA, 64 nt, Human
ggggugagacagcaggaaggggcccugcacgccgggacgccaccuccgccagccgccuccaccc

SEQ ID NO: 328972 - RNA, 64 nt, Human
cacucaccuggguguccuggagcugggaacugagggacgccacguccuuggccagcuuaauggc

SEQ ID NO: 328973 - RNA, 64 nt, Human
uuuuuugcccugauuguuuagggugauaggucuuaagcagcauauaucuauauaucuguaugug

SEQ ID NO: 328974 - RNA, 64 nt, Human
ugagcagcuuuagcaaagaacucuuacccuggcaaagcagcaacacacaugcuccgucugacaa

SEQ ID NO: 328975 - RNA, 64 nt, Human
ugaaauguaguuugcuuucuugugauuugaagagaagcagcagucuuuacuuuuccagccaaau

SEQ ID NO: 328976 - RNA, 64 nt, Human
gcuccugagaacucuuacuugagacaucaaaaagaagcagcaagagcuucugggacagagacug

SEQ ID NO: 328977 - RNA, 64 nt, Human
gaagccagcaucuaggggcuaaagaugcaaaggaaagcagcaugcauugucuguacaaaugugc

SEQ ID NO: 328978 - RNA, 64 nt, Human
ugaaaauacucaauauggaccauuuaggaauuauaagcagcaacugugaaagacuugccacuca

SEQ ID NO: 328979 - RNA, 64 nt, Human
uuuaucuaucagaauguuuauuguugcugguuauaagcagcaggauuggccggcuaguguuucc

SEQ ID NO: 328980 - RNA, 64 nt, Human
uuggggguuggucagcaacuuugagugccauugcaagcagcaucauuuaaguaguuuuauaaag

SEQ ID NO: 328981 - RNA, 64 nt, Human
caugcccagcuguucuuacugcuuaguagccuugaagcagcacaucuccacugucccuggcagg

SEQ ID NO: 328982 - RNA, 64 nt, Human
acccagaacagugguaaagugugcauacuagaaaaagcagcaaaauaacucuuugugguaacag

SEQ ID NO: 328983 - RNA, 64 nt, Human
aaucuacuccuagaucaagaccuauguaauggacaagcagcaggccaucaggaacucuuaauau

SEQ ID NO: 328984 - RNA, 64 nt, Human
cugccaagaugcauggccaaaaaacuaaguaucaaagcagcagaagguuuuugauuauaguaac

SEQ ID NO: 328985 - RNA, 64 nt, Human
acugacucaauaugucagguuuaacucugcccaaaagcagcagacauguaagcagaugugcaau

SEQ ID NO: 328986 - RNA, 64 nt, Human
uuugccugggcugagguuuuuauaccaaaccuggaagcagcagcaggugccugaacucguaacu

SEQ ID NO: 328987 - RNA, 64 nt, Human
guaaaccaaaauacuaugccccuuaauacuuuauaagcagcauuguuaaauaguucuuacgcuu

SEQ ID NO: 328988 - RNA, 64 nt, Human
aacaucaauagauuuuuaggcugaauuaauuugaaagcagcaauuugcuguucucaaccauucu

SEQ ID NO: 328989 - RNA, 64 nt, Human
uuagcuguacugugugauauuuuucauuauuuuaggacgccaacaugagaccuguaauaaaaua

SEQ ID NO: 328990 - RNA, 64 nt, Human
gccgggggcuucugcccagggcuccccuggaccaggacgccagguagggcagggaaccucagua

SEQ ID NO: 328991 - RNA, 64 nt, Human
gggaauacacuugcauguacagagccuggggccuggacgccacggccucucaucuuaggaccua

SEQ ID NO: 328992 - RNA, 64 nt, Human
ggcuucaggcuaagaagagauuucucccuguuauaagcagcaagacaaauuagccauuucacuc

SEQ ID NO: 328993 - RNA, 64 nt, Human
guuguuccaguuccaagcauggaggcucauucugaagcagcaccaacugagcaaaccccugugg

SEQ ID NO: 328994 - RNA, 64 nt, Human
aaaaaccuuagugaaauagcaagugacugcuuucaagcagcagucgacauguaaaugaaggugu

SEQ ID NO: 328995 - RNA, 64 nt, Human
guaagaaguagugguucauccaucagggggccagaagcagcaacuguuuuucauauuuugagac

SEQ ID NO: 328996 - RNA, 64 nt, Human
cuggcucuuccaguggucacuacuuuuugguugcaagcagcagagauucccuggagggcuuguu

SEQ ID NO: 328997 - RNA, 64 nt, Human
caaauacacugauguaugaaacuauucauacaucaagcagcauuuuuuucacucuccuuagaau

SEQ ID NO: 328998 - RNA, 64 nt, Human
ggggcggggggagggcaccucagccccugaagacaagcagcacugcaguggcaaaaauggaaac

SEQ ID NO: 328999 - RNA, 64 nt, Human
ggugucugugugugugcacgcacgccugccaucaaagcagcagggcugagggggugcagcuugc

SEQ ID NO: 329000 - RNA, 64 nt, Human
ggagaccaagauuuuuuaaaauucccaauuacaaaagcagcaucacacuugcuucugagaacag

SEQ ID NO: 329001 - RNA, 64 nt, Human
aaauuauuagcccuuaaacucuuucaaaauauaaaagcagcaggccccaggugaguccugaagg

SEQ ID NO: 329002 - RNA, 64 nt, Human
aagcaucgaaaugggaugucugagccuugaggaaaagcagcaggguuagcauuaaagucaagag

SEQ ID NO: 329003 - RNA, 64 nt, Human
auucugaguugucuucuuggagcuguaggucuugaagcagcaacgucuuucagggguuggagac

SEQ ID NO: 329004 - RNA, 64 nt, Human
ugccacgugguggcauuucucgccucacaccaagaagcagcaaguggaaaauuucaggauacaa

SEQ ID NO: 329005 - RNA, 64 nt, Human
cuugacuugcaacuugccuugaacaucacgaucaaagcagcaggugcuguggucucucaaaauu

SEQ ID NO: 329006 - RNA, 64 nt, Human
cuggaugagggaacagaaguggaggaaacaaaagaagcagcagcacgcacaguccugucgcugg

SEQ ID NO: 329007 - RNA, 64 nt, Human
cucuaguguuaaacuaccugauuaauuucuuauaaagcagcauaaccuuggcuugauuaaggaa

SEQ ID NO: 329008 - RNA, 51 nt, Human
uaucaaacagcaagcacugacaagcagcacauucucaagagcacacaggua

SEQ ID NO: 329009 - RNA, 62 nt, Human
ccguccccaccuucuagcgacuucgggccucccgccgggaucugaugccgcggggugggggc

SEQ ID NO: 329010 - RNA, 62 nt, Human
cuguaaccacaagauguuauuuauugagcuggcgccgggacuugggcggggccugcccuaca

SEQ ID NO: 329011 - RNA, 53 nt, Human; identical to SEQ ID NO: 50542

SEQ ID NO: 329012 - RNA, 64 nt, Human
uggucagucuuuguucucugagaaauuauguuggaagcagcauacuuucaaauuauuaccauga

SEQ ID NO: 329013 - RNA, 64 nt, Human
ugcccuccgaagagaguucuggaugucuggcucaaagcagcaggacugugggaaagagccuaac

SEQ ID NO: 329014 - RNA, 64 nt, Human
acauuuaguagaauuccucuuuggccacaagaauaagcagcaaauaaacaacuauggcuguuga

SEQ ID NO: 329015 - RNA, 64 nt, Human
uaaggcuccguccugacugcccugugcccuggaaaagcagcaauagcauccgccccuuagagcc

SEQ ID NO: 329016 - RNA, 64 nt, Human
gggcuguguuuaaaaaaaaaaaacaaaacaagaaaagcagcagugauuauagagaggucacacu

SEQ ID NO: 329017 - RNA, 64 nt, Human
gcaacaugaacaacugaauacagaaaguaacugaaagcagcacagagacugugucgucccuaca

SEQ ID NO: 329018 - RNA, 64 nt, Human
ucuggugaacaauauagcaauucacgcauucuucaagcagcaaaaguucccggaacaauuaggg

SEQ ID NO: 329019 - RNA, 64 nt, Human
uuugaguuuaauuguacugacccuggacccagauaagcagcaacuuugugucuuuggggucaca

SEQ ID NO: 329020 - RNA, 64 nt, Human
gggaugcagagcuuucuguuuuggguguugggagaagcagcaggaaggagucgccagaugauca

SEQ ID NO: 329021 - RNA, 64 nt, Human
aaaaucauaacuuauaugugaauaaaauacauauaagcagcauuuacgguaguggcauucuacu

SEQ ID NO: 329022 - RNA, 64 nt, Human
cugaccaaggaacagaggaagaugcagucagagaaagcagcaggauagagacgccgagagagga

SEQ ID NO: 329023 - RNA, 64 nt, Human
ucaugaucaugaugcuucuugucaacacccucuuaagcagcaccagaaacagugaguuugucug

SEQ ID NO: 329024 - RNA, 64 nt, Human
cagcucccauagcgcuggcucaggaagaaaccccaagcagcauucagcacaccccaagggacaa

SEQ ID NO: 329025 - RNA, 64 nt, Human
cucuagagcaguuggguuggaggcucauugaggcaagcagcaacauuggagggggagcagggca

SEQ ID NO: 329026 - RNA, 64 nt, Human
uguuccagaacaaccuagagaacaccugaguacuaagcagcaguuuugcaaggaugggagacug

SEQ ID NO: 329027 - RNA, 64 nt, Human
uugcuacccuuaguauuuauuacuaaccucccuuaagcagcaacagccuacaaagagaugcuug

SEQ ID NO: 329028 - RNA, 62 nt, Human
cgggcgcgcgggccuccuguucgcgacaagcccgccgggaucccgggcccugggcccggcca

SEQ ID NO: 329029 - RNA, 62 nt, Human
cccacacccagcuggccauauccaccccucgacgccgggaugagccggcucugccuguguca

SEQ ID NO: 329030 - RNA, 62 nt, Human
gaggucucuguaaaagcagacccaccucccagcgccgggaagcccgucuuggguccucgcug

SEQ ID NO: 329031 - RNA, 62 nt, Human
uugaaagacacugucggaggugagcaucugggcgccgggacgcugcagugauccccgccaga

SEQ ID NO: 329032 - RNA, 64 nt, Human
ucauucucagaugcacaacagccagaacagucucaagcagcauucuagagcuuggaauuuaaga

SEQ ID NO: 329033 - RNA, 64 nt, Human
gcaggcagggacccuuccaggccacaguaggcugaagcagcaccaggauccuggccuggccugg

SEQ ID NO: 329034 - RNA, 64 nt, Human
ggcucacaccaaugacuugguccugggguggcagaagcagcaggugacaggagcagggccccug

SEQ ID NO: 329035 - RNA, 64 nt, Human
cagcauaagaaauagcucuuuauugauguuuuaaaagcagcaacuuggugguguacuacuggaa

SEQ ID NO: 329036 - RNA, 62 nt, Human
ugguugugcgcaacaccuaggagcccaaaaauaagcagcacgacggaacuuucagccguguc

SEQ ID NO: 329037 - RNA, 64 nt, Human
caggucuguugaaagucuucugucauaaucuauaaagcagcagcacucauggaaauuguagcau

SEQ ID NO: 329038 - RNA, 64 nt, Human
aaugaggccggacagaggggcuguuaggacagcaaagcagcaguguccagagaccccucaaucc

SEQ ID NO: 329039 - RNA, 64 nt, Human
ugacccagggugcauuaacuuaaaagauucacuaaagcagcacauagcacugggaacucuggcu

SEQ ID NO: 329040 - RNA, 64 nt, Human
uuacauagaaaaacuguccgcucucaguaaucacaagcagcauccguuuuguuuucucuucuug

SEQ ID NO: 329041 - RNA, 64 nt, Human
agcuguugcuacuugguggaggaacaccuccuagaagcagcaggccucgguggugggggagggg

SEQ ID NO: 329042 - RNA, 64 nt, Human
cucaggucagaacauaacauuucucauuuguuaaaagcagcaagaagccugguaaaacugugac

SEQ ID NO: 329043 - RNA, 64 nt, Human
aaauuacauaacccaucaaauuucuuuaucuauaaagcagcaacaauaaugucacgaaggauua

SEQ ID NO: 329044 - RNA, 64 nt, Human
ggaugagcagcuggauuuucgugaugaaggacggaagcagcagcgggccggcaaggccauaccu

SEQ ID NO: 329045 - RNA, 64 nt, Human
uccucccggccgcugcacagcaacaccacagaacaagcagcaccccacagugggugccuuccag

SEQ ID NO: 329046 - RNA, 64 nt, Human
caaugacagcugaucugucggaaccaggacacaaaagcagcaagaagcggggagagagagggau

SEQ ID NO: 329047 - RNA, 64 nt, Human
uuuuauauuaauuuuuacaguauuuguaagaauaaagcagcauuugaaaucgccccugcuuccu

SEQ ID NO: 329048 - RNA, 64 nt, Human
cugccugggugucgggccaccagaaggcucugccggacgccaagaagacggucucugggcucuu

SEQ ID NO: 329049 - RNA, 64 nt, Human
uucaauuccagaaagaccuuacucuucucucugaggacgccaaaauacaaauuugacccaagaa

SEQ ID NO: 329050 - RNA, 64 nt, Human
agcugcagcagcugugccgccgcggguccaccgaggacgccaaucaaucaacccaacaccacaa

SEQ ID NO: 329051 - RNA, 64 nt, Human
aguaaagcuaaguauaguugauguaacauuguagaagcagcauaggaacaauaagaacaauagg

SEQ ID NO: 329052 - RNA, 64 nt, Human
uuucuuauugcauaucauuuuguuguaauacagaaagcagcauuuuuaaauguccguguuaaga

SEQ ID NO: 329053 - RNA, 64 nt, Human
ugaguacaggucuacaaaauguuuucaaggagaaaagcagcauauccuuaagugaaguauuaua

SEQ ID NO: 329054 - RNA, 64 nt, Human
cccgagggccucuaggaccaggguuugccaggcuaagcagcaaugccagggcacagcuggggaa

SEQ ID NO: 329055 - RNA, 64 nt, Human
auaucaaaaugaguguuuuaaaguuuaacccuugaagcagcaugucuuugccauagcagcacuu

SEQ ID NO: 329056 - RNA, 64 nt, Human
ggaacaccaaugcagagguaacucucaggcagcuaagcagcaccucaagaaaacauguuaaauu

SEQ ID NO: 329057 - RNA, 64 nt, Human
guuuaaaaagaagaagaagaaaaaaaacaagaacaagcagcaacagcuguuuuguuggggcuau

SEQ ID NO: 329058 - RNA, 64 nt, Human
uugauucuauguugaguuuguuucuauauuagaaaagcagcaagucaguaaucccccguggcau

SEQ ID NO: 329059 - RNA, 64 nt, Human
uuuguuuuucuuuuuuugggggaggaggggaaaaaagcagcaauacuguguuuggaaauuauac

SEQ ID NO: 329060 - RNA, 64 nt, Human
aaaaaguaguaaauaguucuuuguaaccugugugaagcagcagccagccuuaaaguaguccauu

SEQ ID NO: 329061 - RNA, 64 nt, Human
aaaguuauugccuacuaaguaaugacugucaugaaagcagcauugaaauaauuuguuuaaaggg

SEQ ID NO: 329062 - RNA, 59 nt, Human
gaccauccacagagcucugaggggcaggaaagcagcauucuggaggggagagcuuugug

SEQ ID NO: 329063 - RNA, 64 nt, Human
gugagaauaggcugauuuuuaaaaguuaaggggcaagcagcauugcauucugggggaacgaucc

SEQ ID NO: 329064 - RNA, 64 nt, Human
uccauuuacuucagccuuugauucaguaaauguuaagcagcagaagacuucgaaugguugaaau

SEQ ID NO: 329065 - RNA, 64 nt, Human
cucuguauaaaacuuagcucuaaagcagaaacuaaagcagcaaaugcaggaaggcugucucgcc

SEQ ID NO: 329066 - RNA, 64 nt, Human
uuguccuuagcuacuagcucuagaaaagucccaaaagcagcagaaggugaagcaggaagcacuu

SEQ ID NO: 329067 - RNA, 62 nt, Human
caggugauccgcgggaggggccuccacgccagcgccgggaaggcugcuggggccuccacacc

SEQ ID NO: 329068 - RNA, 62 nt, Human
gucgggacaggagcacguggcucagacaccgacgccgggaggccgcagaccccggacguguc

SEQ ID NO: 329069 - RNA, 64 nt, Human
ggagcaggccugagcgaggccggcccagcacagcaagcagcaggaccgcugcccaguccucagg

SEQ ID NO: 329070 - RNA, 64 nt, Human
augacucucccguuugucucagugucccugcaacaagcagcaccgcagacuguaauaaaaggug

SEQ ID NO: 329071 - RNA, 64 nt, Human
aaaaugggcugaagcccccaauagccaaauaauaaagcagcauuggauaauaauuucugaguau

SEQ ID NO: 329072 - RNA, 64 nt, Human
cacagccugggaugcugccguaccaagaggaaagaagcagcaaaaugccuuuacguuguucuaa

SEQ ID NO: 329073 - RNA, 64 nt, Human
aacuaccuggccaaaacacuggccaggaugcagcaagcagcagcaggggcugacagcaggcuua

SEQ ID NO: 329074 - RNA, 64 nt, Human
auccuccuugaaagaggaggacagaccucucuggaagcagcaagaggaaccaguagcuguggga

SEQ ID NO: 329075 - RNA, 64 nt, Human
accugaaaguucuaaggggccgaggacaucagugaagcagcagugaaaccaggggcucugcagg

SEQ ID NO: 329076 - RNA, 64 nt, Human
cgacugcuuuuuugauucugaaguucagcaucuaaagcagcaggucuagaagaacaacgguuua

SEQ ID NO: 329077 - RNA, 64 nt, Human
ggagccccacccccgcccuucccagguggagccaaagcagcaggcgccuuugccccuggaguca

SEQ ID NO: 329078 - RNA, 64 nt, Human
ugcaauuucuacacccccgaaacaauucaaagggaagcagcauuucuuguuaacuaguuaagca

SEQ ID NO: 329079 - RNA, 64 nt, Human
aaauucagacgacccaucucagaaugguggaucaaagcagcaagucaauuugccuuguaugcaa

SEQ ID NO: 329080 - RNA, 64 nt, Human
guccuguccacacccagcucagcauuuccacaccaagcagcaacagcaaaucacgaccacugau

SEQ ID NO: 329081 - RNA, 64 nt, Human
ccgacuuuggccucugauacagacagcagucuagaagcagcagcugggccucugggcugcugua

SEQ ID NO: 329082 - RNA, 64 nt, Human
uggacaucugacucuccugcaaggauuagaagaaaagcagcaacacugauacuugugugcaccu

SEQ ID NO: 329083 - RNA, 64 nt, Human
caggcguggacagggcaucucucuccaucaagcaaagcagcaugggggccugcccguaacggga

SEQ ID NO: 329084 - RNA, 64 nt, Human
agguucuacugggaucucaucaucauccuuagucaagcagcagggcccuggccacguggagcaa

SEQ ID NO: 329085 - RNA, 64 nt, Human
uuccuaccuuuggaucugugagaaggugaauacaaagcagcaggcagaguaaaaucugcuggga

SEQ ID NO: 329086 - RNA, 64 nt, Human
uaagaaacuaauuccacugaaccuaaaaucaucaaagcagcaguggccucuacguuuuacuccu

SEQ ID NO: 329087 - RNA, 64 nt, Human
caucaguagcauuuugaaugcaagggaugauggaaagcagcacaugcguuucuguggcagcugu

SEQ ID NO: 329088 - RNA, 64 nt, Human
guggagagagaaucugggaagagaaauggagaauaagcagcacaguguuauucauuucuguaaa

SEQ ID NO: 329089 - RNA, 64 nt, Human
ugauuauauuaugccaaauaagauuacaaagaauaagcagcaauauugaagcaucuacaguaug

SEQ ID NO: 329090 - RNA, 64 nt, Human
gcuugacaggguguuucagaaacuuggaaaccugaagcagcaggcagaacaggagcgggacaag

SEQ ID NO: 329091 - RNA, 64 nt, Human
gugauucaauguuauaaaacaagcagaauuuuaaaagcagcacuauauagcuguuuuguauuau

SEQ ID NO: 329092 - RNA, 64 nt, Human
cccuccccgcuuuccugggccucucaguugaacaaagcagcaaaacaaaggcaguuuuauauga

SEQ ID NO: 329093 - RNA, 64 nt, Human
uccaguccaguccuaucugggcuuccuggagcagaagcagcaacuuguccuagcacagauggcc

SEQ ID NO: 329094 - RNA, 64 nt, Human
cgacccucuccagaccagaccuggaguccucuucaagcagcaauccaacccagagcaggggccc

SEQ ID NO: 329095 - RNA, 64 nt, Human
ugaguacacccuggcaaggcuucucuucagacugaagcagcaauucugccacuaccagcagcaa

SEQ ID NO: 329096 - RNA, 64 nt, Human
gcugugaucgacuuagaauccaaauuugaggaguaagcagcauaaccuucuaccuuguaauaug

SEQ ID NO: 329097 - RNA, 64 nt, Human
uccugagaggaaguuaggaucagaaagaagaagcaagcagcaaccucugcagggcugacaggau

SEQ ID NO: 329098 - RNA, 64 nt, Human
cacaccuggccaaucccaacuacucuggaagcugaagcagcaagaucacuugagcccaggaguu

SEQ ID NO: 329099 - RNA, 64 nt, Human
ugucgggacaugguugggggaaugcaccuccccaaagcagcaggccucugguugccucccccgc

SEQ ID NO: 329100 - RNA, 64 nt, Human
aacuguggcagaugucucaucuucuuuauauguuaagcagcauacucuucugauuuuuauugca

SEQ ID NO: 329101 - RNA, 64 nt, Human
ugcuuuuguuucaacugcaggcaggggagcaaaaggacgccaugugagcauuaggaaaaaaaau

SEQ ID NO: 329102 - RNA, 56 nt, Human
ugagagaggagaaugaauaaggcacgggacgccaugggcacugcagggacagucag

SEQ ID NO: 329103 - RNA, 64 nt, Human
acaaaagguaaagacgcaacguuuccaacucucgggacgccaaggccgcaggacuggagggcca

SEQ ID NO: 329104 - RNA, 64 nt, Human
uggcuaaaucaacacucuaaucaguauagugaggaagcagcaggugaucugccuuacuucacuu

SEQ ID NO: 329105 - RNA, 64 nt, Human
gauguugucuuuaccagaaagguagacaaaaaagaagcagcagcagcucuuaaagugaggguua

SEQ ID NO: 329106 - RNA, 64 nt, Human
cucucugaagagacuguccuugggccuccucuggaagcagcacccccagaggacagggcuccuc

SEQ ID NO: 329107 - RNA, 64 nt, Human
gaaaggucuguggccaucugugagguagaugaagaagcagcauaguggucuccuuacaucuagg

SEQ ID NO: 329108 - RNA, 64 nt, Human
ugugcuaauuuauuguauuguuccuuugugcucuaagcagcacacuugccuucuauuuauuuaa

SEQ ID NO: 329109 - RNA, 64 nt, Human
aacauacaugcauugacuugacaaguuacugaguaagcagcauauucagcaggugccacuacau

SEQ ID NO: 329110 - RNA, 64 nt, Human
gggccggaagaucccacgauuccgaucgacugccaagcagcagccgcugccaggggcugcgucu

SEQ ID NO: 329111 - RNA, 64 nt, Human
uugacagaaggaacccagccagccggcggaaugcaagcagcaguaggaagcggaggcgggugcc

SEQ ID NO: 329112 - RNA, 64 nt, Human
ggcuguggcaucuacccucccucccugcugccagaagcagcauccuccacuuguucagggcuuu

SEQ ID NO: 329113 - RNA, 64 nt, Human
ugcaccagcuuaaaauugaagcugcuuaucuccaaagcagcauaagcugcacauggcauuaaag

SEQ ID NO: 329114 - RNA, 64 nt, Human
uuucuauauuuauaagaagagaagaucuugagugaagcagcacgcgacccaggugugugugaau

SEQ ID NO: 329115 - RNA, 64 nt, Human
ugacccagcacugcccaaagugcuuccaaggcagaagcagcaggggauggcguggucaagcacu

SEQ ID NO: 329116 - RNA, 64 nt, Human
cccccgacuuccucaaaacaaacaagagauggcaaagcagcaguucuaccaagcccauuggaau

SEQ ID NO: 329117 - RNA, 64 nt, Human
guccccucagaggcccccgccagccccaccuugaaagcagcauacaggggaaggcuuggaccaa

SEQ ID NO: 329118 - RNA, 64 nt, Human
auaugauuguuuuucuuauaacuuuacuauaugaaagcagcauaagaguagucacaaacauguu

SEQ ID NO: 329119 - RNA, 64 nt, Human
agaaaauggaauuacuccaaaaagacaagugcucaagcagcaaaauccuuacuuccagcaaaau

SEQ ID NO: 329120 - RNA, 64 nt, Human
ugcagguggaguacaugucauucagcgcacacgcggacgccaagggcaucaugcagcugguggg

SEQ ID NO: 329121 - RNA, 64 nt, Human
gggagagguggggccccugcugggguagagcuggggacgccacgugccauucccaugggccagu

SEQ ID NO: 329122 - RNA, 64 nt, Human
ugugaccuggaucugaggucucugauagaaaucuggacgccaccggguccaggccuggccucag

SEQ ID NO: 329123 - RNA, 64 nt, Human
gagauugugucucuuucauugcuuuguugagaacaagcagcaaaauuucuguauuaugucaggc

SEQ ID NO: 329124 - RNA, 64 nt, Human
gagagguaggagcuggagaugaagaggcugcuagaagcagcaggaagccugcccuucugcccuc

SEQ ID NO: 329125 - RNA, 64 nt, Human
agguagaggggagugguauguguuuucucaguggaagcagcacaugagugggugacaggauguu

SEQ ID NO: 329126 - RNA, 64 nt, Human
cauuucauggugacugacccuugagcuuaaacagaagcagcaaaugaaagaaccggacaaauaa

SEQ ID NO: 329127 - RNA, 64 nt, Human
caaacuauauuugcauucuuacauuaguuaagcuaagcagcaaaaagaaaacacacacacacac

SEQ ID NO: 329128 - RNA, 64 nt, Human
gcaugaguaaguuuacaaauauguaucgucuguaaagcagcaugugcagauuauucauaauaua

SEQ ID NO: 329129 - RNA, 64 nt, Human
acaggacuuucuucuucaucuucaaacucuucagaagcagcaacagggcuaguuaauucaacuc

SEQ ID NO: 329130 - RNA, 64 nt, Human
ccauccaauuuucugucaaucacacuguuguauaaagcagcagaacugaaggggaaaaaugauu

SEQ ID NO: 329131 - RNA, 64 nt, Human
gcaccucagcucagaaaagguagcagcaaucccaaagcagcagaaggcagggguuaaaucagga

SEQ ID NO: 329132 - RNA, 64 nt, Human
gcagcugcagcagcaguuccgggagcggauggagaagcagcagguucgagucuccacgccguca

SEQ ID NO: 329133 - RNA, 64 nt, Human
cucugguagaacccaaggacuucuggguacugagaagcagcagcagaaugaggccaaaugcaga

SEQ ID NO: 329134 - RNA, 64 nt, Human
ccucaguucaccaucugcuuuccaccaugaguugaagcagcaugaggcccucaucagaugggcu

SEQ ID NO: 329135 - RNA, 64 nt, Human
ccagggaaucagagcagucaggccuguugacucuaagcagcagacauccugaagaaaugguaag

SEQ ID NO: 329136 - RNA, 64 nt, Human
cagaccugcucuggacacuugcucaugcccugccaagcagcagauggggagggugcccuccuau

SEQ ID NO: 329137 - RNA, 64 nt, Human
gguuucaugccugccccccacaaauuauguuuagaagcagcacugcaucuuagcacaugcugcc

SEQ ID NO: 329138 - RNA, 64 nt, Human
gggagaaaaaugugggagugaaaugguauuuagaaagcagcagucaggcacgguggcucaugcc

SEQ ID NO: 329139 - RNA, 64 nt, Human
uggucugggcagccccuggaaaagcaccuuugcugccugucauuguugccugaagaaggcugga

SEQ ID NO: 329140 - RNA, 64 nt, Human
uucucauuuuguaguauuuaauaaucuggauggagccugucaguauuacaguuaguuuucuagu

SEQ ID NO: 329141 - RNA, 64 nt, Human
gaccugguucuagccuagauucuuaccuccccaaaagcagcauauuaggcccaggacauaccug

SEQ ID NO: 329142 - RNA, 64 nt, Human
caaaaagacagggaaaaccagauauuuagagucgaagcagcaugcaaaaaauaauaauguuuuu

SEQ ID NO: 329143 - RNA, 59 nt, Human
uaagcaaacuuuccaaauaaaaaaaaaaaaagcagcaaguaauggaauugcacauauua

SEQ ID NO: 329144 - RNA, 64 nt, Human
ucuccccagugacagaaguagagaagagaauggaaagcagcacacuccguccccucuagucugg

SEQ ID NO: 329145 - RNA, 64 nt, Human
aaagaaggaaaagggugugugagaaagccuacugaagcagcagcacugccacuacauguggaca

SEQ ID NO: 329146 - RNA, 64 nt, Human
uaaccuuuauauuugccgaauuuggccuccucaaaagcagcagcaagucgucaagaagcacacc

SEQ ID NO: 329147 - RNA, 64 nt, Human
aauuauuauuuuuuugguaaaacauuaauaguuuaagcagcaucauuuuuuuaaaaaauguaau

SEQ ID NO: 329148 - RNA, 64 nt, Human
aaaguuucggcaggugccuggagggcaaauaaaaaagcagcagucagucaguagucagugaugg

SEQ ID NO: 329149 - RNA, 64 nt, Human
gcagcagauugaagaccagcaggggcuuccuaaaaagcagcagcagcuggaauuccaaggccaa

SEQ ID NO: 329150 - RNA, 64 nt, Human
ugccaucaaccccaacagcuucauccugggucugaagcagcagauugaagaccagcaggggcuu

SEQ ID NO: 329151 - RNA, 64 nt, Human
agaaagaagaauagaagaaaaucaaccugaguaaaagcagcacugguuuugaguuuucuaagcu

SEQ ID NO: 329152 - RNA, 64 nt, Human
uucaacuguugucuugcucuugauagaaacugagaagcagcaaucuguauuuguggaggaaagu

SEQ ID NO: 329153 - RNA, 64 nt, Human
gacuugcacugaggccaggaaaagaagcacuggaaagcagcaggcugaacaauuccuggaacuc

SEQ ID NO: 329154 - RNA, 64 nt, Human
acucuaggcucaauaugaagggauuuaguucuguaagcagcaaaaaagcuucuuuaucaaguca

SEQ ID NO: 329155 - RNA, 64 nt, Human
agguggaaagauguauuugccccaguucacuucaaagcagcaaacguuguuuaagcauuuuagu

SEQ ID NO: 329156 - RNA, 64 nt, Human
gucaucagacauugaagagauuuggagaaauguaaagcagcaguacucuucucacuaauuuuug

SEQ ID NO: 329157 - RNA, 64 nt, Human
agugauggccaagcugcaucagccgcacucuccuggacgccauauagcuuuaagaucgggggag

SEQ ID NO: 329158 - RNA, 64 nt, Human
gggcugaccccagcuuccaggggacugucacuguggacgccaaaauggcauaacugagauaagg

SEQ ID NO: 329159 - RNA, 64 nt, Human
ucuagucccuguguucugcacauccccacgguggggacgccaccaagccucagacucuuaccau

SEQ ID NO: 329160 - RNA, 64 nt, Human
gcuucccacuaggacauccaggcaggucgggcggggacgccacacaccucagggccguccgcug

SEQ ID NO: 329161 - RNA, 64 nt, Human
gacuaacugugaaaaggaaggcuguccuauaacaaagcagcaucaagucccaaguaaggacagu

SEQ ID NO: 329162 - RNA, 64 nt, Human
uguagauuguucgaagacacauuuguaaauuuucaagcagcaauagagaaaaaaauucaugcau

SEQ ID NO: 329163 - RNA, 64 nt, Human
gauacaucuccaagccaucugucaucagaucaaaaagcagcaaacagagggucagucacaggau

SEQ ID NO: 329164 - RNA, 64 nt, Human
uuuccagaaaggcacugcuggcuucgacuccuauaagcagcacgugggcuuguucaucucacug

SEQ ID NO: 329165 - RNA, 64 nt, Human
caacauuuauuuaaaaagguaaaucuuuuuguugaagcagcaaguuaucugguagaacuuaacu

SEQ ID NO: 329166 - RNA, 64 nt, Human
acaugggcuuccucccucauaucauuucauucuaaagcagcaagcuugucauacccaugggguc

SEQ ID NO: 329167 - RNA, 64 nt, Human
acaguacgaauaucuggcauuuuuaaguucauuaaagcagcaaauuccuucucgccuuuaaggg

SEQ ID NO: 329168 - RNA, 64 nt, Human
caacaccauugcccggaggcuuccgaaucuagcaaagcagcauauuaaaugacuccaccugcgc

SEQ ID NO: 329169 - RNA, 64 nt, Human
cucccugaccauuuguggaaucguuccugcuuccaagcagcaugcuacaggccagccuucaaag

SEQ ID NO: 329170 - RNA, 64 nt, Human
auguguucaugaccuccgaaggcccaaauucaugaagcagcaaacccagcagaucuccaccccc

SEQ ID NO: 329171 - RNA, 64 nt, Human
aauuggaaaagcaggacuuuggugccugugcuauaagcagcagauuuugugggaggaaacacuu

SEQ ID NO: 329172 - RNA, 64 nt, Human
guaagcuagaacacacauccaaucuguuaccagcaagcagcaugaaaguagaaacgaagaagca

SEQ ID NO: 329173 - RNA, 64 nt, Human
gcauucugcaauauguaaccaacaugucacaaacaagcagcauguaacagacuggcacaugugc

SEQ ID NO: 329174 - RNA, 64 nt, Human
cagagcaaauguagugauagaagcgcaaugagagaagcagcaguggguacaaggaggaagaaaa

SEQ ID NO: 329175 - RNA, 64 nt, Human
agucuggcuggaacacuuucaguuucaggagugcaagcagcacucaaaccuggagcugaggaau

SEQ ID NO: 329176 - RNA, 64 nt, Human
ccaggauggcgagcuccaguaagaugauaauggaaagcagcagcuuguugguugucacucuaca

SEQ ID NO: 329177 - RNA, 62 nt, Human
uagugaugugugugugucuccaugcacaugcacgccgggauuccucugcugccauuugaauu

SEQ ID NO: 329178 - RNA, 62 nt, Human
auggcacugaucacugagcaggagaggagugucgccgggaggccuucagggugggggggaag

SEQ ID NO: 329179 - RNA, 62 nt, Human
gacggcggagccaccggagcgagcgcgagcggcgccgggaccgggaucgugaccgugaccgu

SEQ ID NO: 329180 - RNA, 62 nt, Human
aucuaacugcaggaacccagagugucccagcacgccgggaggggcaaccaggccucccagcg

SEQ ID NO: 329181 - RNA, 64 nt, Human
ucuuaacauguuucuaucuauuguuuauuguuuuaagcagcaaauaaagcuacauccuucccuc

SEQ ID NO: 329182 - RNA, 64 nt, Human
ccacuaucaauccucacugcugaguggcagggagaagcagcaccacucucagcucuuuucuaau

SEQ ID NO: 329183 - RNA, 64 nt, Human
gugcugaucccacaggaaaggcuugaaacacgagaagcagcaaagacagagcacacaagugcau

SEQ ID NO: 329184 - RNA, 64 nt, Human
ucugauuguuccuuagaccacauauguucuuaugaagcagcauuaugcaaggggaaaaaagcac

SEQ ID NO: 329185 - RNA, 64 nt, Human
agucuaaauucagucuuuucaaaacaaaucacaaaagcagcauuagacauugccuuguuucauu

SEQ ID NO: 329186 - RNA, 64 nt, Human
gagucaccuguaaauugauucaagugagccaggaaagcagcaaaggaaagagaaaccugaguga

SEQ ID NO: 329187 - RNA, 64 nt, Human
uuucuaaucgacuugcagaguaguugaaguggguaagcagcaggguaccuuguauaaugcacga

SEQ ID NO: 329188 - RNA, 64 nt, Human
gaccacgagcuaguucugaauugcaggggccucaaagcagcaccuaaaccuugagggggagggu

SEQ ID NO: 329189 - RNA, 64 nt, Human
ggaccacccagucagaaagcucuuccagaaguucaagcagcagaaggagcugcggaaucagggc

SEQ ID NO: 329190 - RNA, 64 nt, Human
acucucgugguauguaugggagauggcagcagugaagcagcagccaccagggaguggccauuug

SEQ ID NO: 329191 - RNA, 64 nt, Human
gagacacaaaugaagaagaacaaagagccugagaaagcagcaagaggacaugaugaaaaauacg

SEQ ID NO: 329192 - RNA, 57 nt, Human
auguucaaugucggaagugagagcuccaagcagcaggauaaguaguagacacucccg

SEQ ID NO: 329193 - RNA, 64 nt, Human
aggagaugucaaaagcccauaugaggaguggaccaagcagcaguggcgguuucuccucgcaucu

SEQ ID NO: 329194 - RNA, 64 nt, Human
uuguucgguugacuuucagcuuucuggagugacaaagcagcagugaugggugcuauuccugguu

SEQ ID NO: 329195 - RNA, 64 nt, Human
gcuccucuuguuagugcaauguugacuguugaaaaagcagcaguaugcuuacagguuugcuuag

SEQ ID NO: 329196 - RNA, 64 nt, Human
ucuucucaagguucccaaagagaugcacgggaacaagcagcaccugcagaaggacuucuuccug

SEQ ID NO: 329197 - RNA, 62 nt, Human
ggauagcuacuuccaucccccggggacucccgcgccgggacgcggggugggaccaggcgcgg

SEQ ID NO: 329198 - RNA, 62 nt, Human
agcgcaacgcacuggugaccagacuguccccacgccgggaaccaagcaggagacgacaggcg

SEQ ID NO: 329199 - RNA, 64 nt, Human
agcaaaagguggcaacccauggaggcagaaagaaggacgccagccugacccuuaucugaaacgu

SEQ ID NO: 329200 - RNA, 64 nt, Human
aagaaaucccuaccuauguaaauguuugaauggaggacgccaguaaaaaaacaaaaacaaaaac

SEQ ID NO: 329201 - RNA, 64 nt, Human
cuucagccaccagguuuuucugucucacauacauaagcagcauuucauugcagauaugggacug

SEQ ID NO: 329202 - RNA, 64 nt, Human
acccaugaaaguucagccaaugcccagagugaccaagcagcaccagcaggccugcccaggaugc

SEQ ID NO: 329203 - RNA, 64 nt, Human
agacuucaaccgggcaaaggagcacaaggaaaccaagcagcagaggccccaucagcacagaggg

SEQ ID NO: 329204 - RNA, 64 nt, Human
gcugcgcagcaugaaggagcgaaagcuggagaagaagcagcagaaggagcaggagcaaggugag

SEQ ID NO: 329205 - RNA, 64 nt, Human
cauaauuauaguggcauacugucacuuagguuucaagcagcaaaauaaacagugcagcucagaa

SEQ ID NO: 329206 - RNA, 64 nt, Human
cauccgaucgauggaugggaugcacucucagaccaagcagcaggaauucaaagcugcuugcugu

SEQ ID NO: 329207 - RNA, 64 nt, Human
auguacaauaacugcugccuggcaaacugcaaacaagcagcaucacucaaguuugaaguuucgc

SEQ ID NO: 329208 - RNA, 64 nt, Human
aagauuuuccaagaugaagccagugcuagcugagaagcagcaaugaacagaaagcuguaacacu

SEQ ID NO: 329209 - RNA, 64 nt, Human
auugugugauugccucacauuugcagguaauaucaagcagcaaacuaaauucugagaaauaaac

SEQ ID NO: 329210 - RNA, 64 nt, Human
uggugcugaccuagcuagggaugcaagagugagcaagcagcacccccaccugcuggcuuggccu

SEQ ID NO: 329211 - RNA, 64 nt, Human
ucauuacuuaauuuuaacuaaccaacaaccacaaaagcagcagcuacugcuaaauauuggauua

SEQ ID NO: 329212 - RNA, 64 nt, Human
cgggauggagggugugguccuguggucagagcccaagcagcacucaggagaggggagaaaggag

SEQ ID NO: 329213 - RNA, 64 nt, Human
gugcuagaaacaucaucauuauuaaacuucagaaaagcagcagccauguucagucaggcucaug

SEQ ID NO: 329214 - RNA, 64 nt, Human
cagucagggacaauaaaaacuuggugcacucugaaagcagcacuuggacagccuucaaaguccu

SEQ ID NO: 329215 - RNA, 64 nt, Human
cucaggaaaaagauccacuggaaacuaggccgggaagcagcagccccuccaagggccagggcac

SEQ ID NO: 329216 - RNA, 64 nt, Human
ccccgaggcgggagaaguagggagcuguucguuuaagcagcauacaccuaaauuggggguuuaa

SEQ ID NO: 329217 - RNA, 64 nt, Human
uaaaaaccaaacccagacaaccaaaacauauucaaagcagcagccaccgccauccgguccccug

SEQ ID NO: 329218 - RNA, 64 nt, Human
auuguguuguucuuguguugguucccauguaaagaagcagcagagaaaugcgaugguucaacag

SEQ ID NO: 329219 - RNA, 64 nt, Human
cggcagccucacggcagcaaccccagccuucccaaagcagcaggcgccuccaggcuggggccca

SEQ ID NO: 329220 - RNA, 64 nt, Human
caaagggagucugccagggccccucuccccagggaagcagcagccucgccccuggcagagaugc

SEQ ID NO: 329221 - RNA, 64 nt, Human
cuuggcuguggcugucuuuuuuaauccuuguguaaagcagcaaaaaagaccuaaagggaauugu

SEQ ID NO: 329222 - RNA, 64 nt, Human
aagagguuuauugauguaaaauuaucggcuagggaagcagcagcgggccaggugugguggcuua

SEQ ID NO: 329223 - RNA, 64 nt, Human
gguuuuuuuuuuccuuuuggaauauggcuguaagaagcagcauuuugucuuauuaacacaugua

SEQ ID NO: 329224 - RNA, 64 nt, Human
ucugaguucaaacuagugccuguguuguuacggaaagcagcaguguaccagugucacucuggag

SEQ ID NO: 329225 - RNA, 64 nt, Human
uuacgaggcugugguccggggcaagccaaguacgaagcagcagccaucgcgggcugcaucaucc

SEQ ID NO: 329226 - RNA, 64 nt, Human
gagugagaaagaggcugaaauuaagagggcgagaaagcagcacgacuugaaacuuccuacaugu

SEQ ID NO: 329227 - RNA, 64 nt, Human
gaugcuggcugccgccgcggaacggaggcuucagaagcagcagaccuccuagcgcucccuugcc

SEQ ID NO: 329228 - RNA, 64 nt, Human
uccugggcauuaagucuaagagagaggagccuggaagcagcagggagcagccugggucucuguc

SEQ ID NO: 329229 - RNA, 64 nt, Human
ucaugccacauugacgugaacuuugauguauaauaagcagcagcaacuucaugugaaaauaugg

SEQ ID NO: 329230 - RNA, 64 nt, Human
ggcucuggggcucugaacucugaccugugaauagaagcagcaugcacuuuggaaauccggccuu

SEQ ID NO: 329231 - RNA, 64 nt, Human
ccuggcacugaaccuuaggcuuuguaugacagugaagcagcacugugagugguucaagcacacu

SEQ ID NO: 329232 - RNA, 64 nt, Human
ccuaguacucugaccagccagggccagggcagagaagcagcacucuuaggcuugcuuacucuac

SEQ ID NO: 329233 - RNA, 64 nt, Human
cccgcucccaggcgccccauguccucacaggccaggacgccauggcaggauggagaggacuugg

SEQ ID NO: 329234 - RNA, 64 nt, Human
cucacugacaucuuugaauaacugccacuucuaaggacgccauucagagcagagcauuagcaga

SEQ ID NO: 329235 - RNA, 64 nt, Human
agccucgcuccucgcuccucgcuccucgccccuaggacgccaagggggaaaggagagggcggaa

SEQ ID NO: 329236 - RNA, 64 nt, Human
accuccccguuucuguuucaguuuuaagacaaugaagcagcauucacugcgucauuguaacaug

SEQ ID NO: 329237 - RNA, 64 nt, Human
gggcuggaggcccaaggucggggaggggagggaaaagcagcacccacagggagcgccugcgagg

SEQ ID NO: 329238 - RNA, 64 nt, Human
uuucugaauauuuuaaaucuuaacaucauauaaaaagcagcagaggugagaacucagaagagaa

SEQ ID NO: 329239 - RNA, 64 nt, Human
uuccucuaagaucuugccucuuuccuccucaugaaagcagcacacauuguguuaacuuaugucu

SEQ ID NO: 329240 - RNA, 64 nt, Human
gcugcuggcuuugaagaaagagcugauggugcagaagcagcaggaggcacuugaggagcaggcg

SEQ ID NO: 329241 - RNA, 64 nt, Human
cagcccccaaccuccaacccaccagcugaccuagaagcagcaucuucccauuuccucaguaccc

SEQ ID NO: 329242 - RNA, 64 nt, Human
gguaccugcaagcagaacuuccaaagagaguuaaaagcagcagccccggcaacucuggcuccag

SEQ ID NO: 329243 - RNA, 64 nt, Human
uguaggaauagucacucacuggcugauacauuuaaagcagcagugugaauagcaaggacagaca

SEQ ID NO: 329244 - RNA, 64 nt, Human
ugguaugguguugaaaaauaacuguuacuucuuaaagcagcauuuuaucuucuauuuugaagac

SEQ ID NO: 329245 - RNA, 64 nt, Human
accgaugaggcagaagaaaaguuaacaguauuuaaagcagcauuucucucuuaacguuccuggg

SEQ ID NO: 329246 - RNA, 64 nt, Human
acuugacacuguccaugggguuuuauuaguagcuaagcagcagcucucgcauccacuucagggu

SEQ ID NO: 329247 - RNA, 64 nt, Human
ggggccuuggcuucuguuuuuuauaaaacaccucaagcagcacugcagucucccaucuccucgu

SEQ ID NO: 329248 - RNA, 64 nt, Human
cuucaggcugggguagcaggucaguccaggcaggaagcagcaccugccccccgcgccagcccag

SEQ ID NO: 329249 - RNA, 64 nt, Human
ggguauuaucccugccuccugcccccgaugcccaaagcagcaucuuccagcacuuuccaucgag

SEQ ID NO: 329250 - RNA, 64 nt, Human
uuccaucagaauuccagggucacagccccaacagaagcagcagugccucuguaggaggggugcu

SEQ ID NO: 329251 - RNA, 64 nt, Human
cuuuucaccuuuuccuugagacucaggaggaccaaagcagcagccuuuugcuuuuucuuuuuuc

SEQ ID NO: 329252 - RNA, 64 nt, Human
agucucacuuuuggaaucuguccguuagaaauaaaagcagcaucaaugcauaagaauguaaaua

SEQ ID NO: 329253 - RNA, 64 nt, Human
agccacguccagugccacaguccccaguagccucaagcagcaccaauggggaugacccugacag

SEQ ID NO: 329254 - RNA, 64 nt, Human
ucuuucccuuuucuuuuguucaugaccugaccugaagcagcagauuugauagacuggcaaagau

SEQ ID NO: 329255 - RNA, 64 nt, Human
ccucccaacugaaaacaacagugacauguuugaaaagcagcaaucgaaagucaguguguucuug

SEQ ID NO: 329256 - RNA, 64 nt, Human
ggucuguggugagaguccuguaggaucccugcucaagcagcacagaggaaggggcaagacgugg

SEQ ID NO: 329257 - RNA, 64 nt, Human
aagaaucugcuuucaaaacgaaagcugaaccuauaagcagcaguauaagcaauauggaacucga

SEQ ID NO: 329258 - RNA, 64 nt, Human
acagucuguggauggacaugaucagugcuaaggaaagcagcagagagagacgcuccggcgcccc

SEQ ID NO: 329259 - RNA, 64 nt, Human
uccugcuuguuguaagacuccguuuaauuuccagaagcagcagccacuguugcugccacugacc

SEQ ID NO: 329260 - RNA, 64 nt, Human
uuguuucucaugaaaaguuugauuaaaauucaggaagcagcaaaaccuucaaaacaagacaugu

SEQ ID NO: 329261 - RNA, 64 nt, Human
gucaagccgacuaaggccccucaacccugucacuaagcagcacgugacacuggcaggaccuuca

SEQ ID NO: 329262 - RNA, 64 nt, Human
auuuuaauucuuacuguacuuggcaugcgcaauaaagcagcacauguaaaaaaaaaauacacag

SEQ ID NO: 329263 - RNA, 64 nt, Human
gacuaguauguaaaauaaaucauuccuguguauaaagcagcaaaaccuaauguggacuuuuugg

SEQ ID NO: 329264 - RNA, 64 nt, Human
gaugcauuucuuggccaaaguggcuuccucaagaaagcagcacuuaccuuugaaaaaugcuggg

SEQ ID NO: 329265 - RNA, 64 nt, Human
uuuacauaggccgagcuguggacaaaaaaaaaagaagcagcagcuuguaguaugcuuaagcuuu

SEQ ID NO: 329266 - RNA, 64 nt, Human
uagaacaauaguucucaaaguguguuccccggacaagcagcaucugcaacacuuaggaaggucu

SEQ ID NO: 329267 - RNA, 64 nt, Human
gcuggagggugagacccagccaauccuugggagcaagcagcacuaaaucacaucagggagugau

SEQ ID NO: 329268 - RNA, 62 nt, Human
ccaguaucaaugcuacacaguguugucccgagcgccgggaggcguugggcagaaacccucgg

SEQ ID NO: 329269 - RNA, 62 nt, Human
cugcauguacauauuuucuguaaauauacaugcgccgggagcuucuugcaggaauacugcuc

SEQ ID NO: 329270 - RNA, 62 nt, Human
ccccaccgacccagaccaagaccgcgccgagccgccgggacucagcgccuucggguggcggc

SEQ ID NO: 329271 - RNA, 62 nt, Human
aaaucuucucaguucuccuugcagaggacuggcgccgggacgcgaagagcaacgggcgcugc

SEQ ID NO: 329272 - RNA, 64 nt, Human
agcauggagaccucaugacaaaggaagggacucaaagcagcaaugccccucauaguguaggcua

SEQ ID NO: 329273 - RNA, 64 nt, Human
guaucuuucauccuugacuaaauucgugauuuucaagcagcaucuucugguuuaaacuuguuug

SEQ ID NO: 329274 - RNA, 64 nt, Human
ucuuuuuauuaaaacugugauagauuuuguuaccaagcagcauuugauaagagguccacugguu

SEQ ID NO: 329275 - RNA, 64 nt, Human
ugggguagauuaugauuuaggaagcaaaaguaagaagcagcauuuuaugauucauaauuucagu

SEQ ID NO: 329276 - RNA, 64 nt, Human
aauuuaauuuauuuacaugcugucuguuaucuucaagcagcacaaaauaugcauauaaaaguga

SEQ ID NO: 329277 - RNA, 64 nt, Human
gcacaugugaaauggaaauguucucuuuccucugaagcagcaaauuaauguugaaaacuuacau

SEQ ID NO: 329278 - RNA, 64 nt, Human
gcccauucagccucaaggggaaauccaggguaggaagcagcagcucugcuggacugggcucagc

SEQ ID NO: 329279 - RNA, 64 nt, Human
gagguugguguuccuguuacguguuucaggugagaagcagcaaagcgucuuaauguucaaaacg

SEQ ID NO: 329280 - RNA, 64 nt, Human
gcauccuugcagccaccucugcugucacugcucgaagcagcagucucucuggaagcaucugugu

SEQ ID NO: 329281 - RNA, 64 nt, Human
ccucuuuacacccacagaggugcugcgccaccggaagcagcacgugugagcugggccaggagcc

SEQ ID NO: 329282 - RNA, 64 nt, Human
acacuguuguuaggccugcaccugcccauccagaaagcagcagcugccuuguuaguccucccca

SEQ ID NO: 329283 - RNA, 64 nt, Human
gcacgggauggggcuucccagggucucagcugagaagcagcaguuccacagcacagccugguca

SEQ ID NO: 329284 - RNA, 64 nt, Human
ucccuuugaccccugcagacccucuacuugcgaaaagcagcauugaagcagccuuuucccauug

SEQ ID NO: 329285 - RNA, 64 nt, Human
gccaccacccuccgacccccuagcccuccacaagaagcagcauugagagagcuguggacucagg

SEQ ID NO: 329286 - RNA, 64 nt, Human
agaaccagccccaagccagcaccuuugguaaauaaagcagcaucugagauuuuaaaaagcccug

SEQ ID NO: 329287 - RNA, 64 nt, Human
gaggccaggcugaaaugucauaucugaaggaagaaagcagcagcuggacaauguuucuuugcaa

SEQ ID NO: 329288 - RNA, 62 nt, Human
cggcgacuggaggcuggauucgaggccggaaacgccgggaccccuggacccggccugguggg

SEQ ID NO: 329289 - RNA, 62 nt, Human
cuggaggggguuugcuggggaacuggcgccaucgccgggacuccagaaccgcagaagccucc

SEQ ID NO: 329290 - RNA, 64 nt, Human
gcuuccccccagcgccggcuucucuccucagagcgccugucacuccauccccggcagggaggga

SEQ ID NO: 329291 - RNA, 64 nt, Human
ugcugugccccuguagccucagcacccagcacaggccugucagacagcagguccucaauaaaua

SEQ ID NO: 329292 - RNA, 64 nt, Human
ugugugguuugguagcuccuguggguaccuccugaagcagcagcgaauggcaauggguuguguu

SEQ ID NO: 329293 - RNA, 64 nt, Human
cuugugaaagcuaaccaugcuaaccaccaaggcaaagcagcacagugugaauagaacagagcgg

SEQ ID NO: 329294 - RNA, 64 nt, Human
gcaacaguaguaugaaacuccaaaaugcaaacugaagcagcaaacccacaaagcaucaaaagac

SEQ ID NO: 329295 - RNA, 64 nt, Human
gcauagcaugaacaaguaauauuaagccaagaauaagcagcagaacccuguuccauauggaaaa

SEQ ID NO: 329296 - RNA, 64 nt, Human
agaggaaucagaaaccccacuuuggcauagagacaagcagcacuguuccaguccagggaugcug

SEQ ID NO: 329297 - RNA, 64 nt, Human
ccaugcgcucggcaaccauucaaaugcaggaauuaagcagcaauggcugcaguguccuucucag

SEQ ID NO: 329298 - RNA, 64 nt, Human
acauacgcacugggcauuggguaagggacuccagaagcagcagcuagaaagagaaaaagcccuc

SEQ ID NO: 329299 - RNA, 64 nt, Human
cagaagccucauuccagaacccaucuggccagagaagcagcagcauccugggggauggccgugc

SEQ ID NO: 329300 - RNA, 64 nt, Human
ccugccgcuacccucggccugcccaccaccaagcaagcagcaagcaagaugggguucucaucag

SEQ ID NO: 329301 - RNA, 64 nt, Human
ucuccauguuuaggaacugagaaagaaacugccuaagcagcacuuccccauguccuuucaccuu

SEQ ID NO: 329302 - RNA, 64 nt, Human
ucugggucuccagauuggaacagaggauggagcuaagcagcaaagggccucccuugaauucacc

SEQ ID NO: 329303 - RNA, 64 nt, Human
uuuuaauuuaguauuuguguaaaaccaccuuuugaagcagcaacuaucaagucugaaaagcaau

SEQ ID NO: 329304 - RNA, 64 nt, Human
ucauguuuuggauguacauaauauauuuauaacaaagcagcaagagucuacuuaaccuuggcug

SEQ ID NO: 329305 - RNA, 64 nt, Human
accuuuuagaucuguauaaaaguguguuguguugaagcagcaaaccaaugagugcugcauuuug

SEQ ID NO: 329306 - RNA, 64 nt, Human
aaaacaugagauauaaaucaagcuuaaaaaaaaaaagcagcaccugugggccauacuaaaagau

SEQ ID NO: 329307 - RNA, 64 nt, Human
ucagaacucuccuaucugaaccuacugaggagcaaagcagcaauuacaugggauccuguggcuc

SEQ ID NO: 329308 - RNA, 62 nt, Human
gaauuuggccgauggcagauguuuugggggaacgccgggacugagagacuccacgcaggcga

SEQ ID NO: 329309 - RNA, 62 nt, Human
uuuaaaggcaaaucauucccaccaucacuuaacgccgggauuauacacauucuagaaaugau

SEQ ID NO: 329310 - RNA, 62 nt, Human
gcccgcuccugugguuuuucugagcgugcgggcgccgggaggggaugcugaggcugauggag

SEQ ID NO: 329311 - RNA, 62 nt, Human
uugcagaggcgccucucaaggccccaucagcucgccgggaccucugugaagccucucuguca

SEQ ID NO: 329312 - RNA, 64 nt, Human
uauuuugguuuuuaaucagauuugguuucaucagaagcagcaagaauggaccugaugucuuuaa

SEQ ID NO: 329313 - RNA, 64 nt, Human
gcgucagccccucgcaagacacagaucgagcaagaagcagcauggucuccacagaaagugccuc

SEQ ID NO: 329314 - RNA, 64 nt, Human
caaucuucuccugacauuaggaggaaucuacaaaaagcagcaaugggaccuucaaguccuauga

SEQ ID NO: 329315 - RNA, 64 nt, Human
cacgcuccuuucugaucuucacuaagaacaaaagaagcagcaacuugcaagggcggccuuuccc

SEQ ID NO: 329316 - RNA, 64 nt, Human
gcugaggcgcaugcaggagaugcugcagaggaugaagcagcagaugcaggaccagugacgcucg

SEQ ID NO: 329317 - RNA, 64 nt, Human
gcugccaauugaaacagaagaagaaaaaaaaaaaaagcagcagacaacacacuguagagucuug

SEQ ID NO: 329318 - RNA, 64 nt, Human
ccccagccuuggccccugccugcgucugugcucaaagcagcagcuccaacccugccucuguccc

SEQ ID NO: 329319 - RNA, 64 nt, Human
accucuggccagcuggcuuccgcccuugguggggaagcagcagaacuagguucugagccacggg

SEQ ID NO: 329320 - RNA, 64 nt, Human
aagucuagauguauccaaaggugaaguauguaaaaagcagcaaaauauuuauuucaaagacuuc

SEQ ID NO: 329321 - RNA, 64 nt, Human
acaccuaaauuuuuguaagaaaauuuaaaaauuaaagcagcaaaggaacuuuuugcuuucugcc

SEQ ID NO: 329322 - RNA, 64 nt, Human
ccacaaggcccagcccugggcaaggaagcuuuggaagcagcaaggugggggucaggcuacaggu

SEQ ID NO: 329323 - RNA, 64 nt, Human
gggaacccaaggcacaggccccgccccugcccccaagcagcacugggcuacuggcucacagaag

SEQ ID NO: 329324 - RNA, 64 nt, Human
uugucaguuguaacauucuauuucaacuucaggaaagcagcaguuuucuuuuaauuuuuccuau

SEQ ID NO: 329325 - RNA, 64 nt, Human
ugugcuccgggccaaugcagaggccucccgaaccaagcagcaggauugaagcuucggccucccu

SEQ ID NO: 329326 - RNA, 64 nt, Human
uaugaaaugauuuacccaaaaucacacagcucagaagcagcagaacugacauugggacccaggu

SEQ ID NO: 329327 - RNA, 64 nt, Human
cuugugugcuuuuggagagaauguugauuggcaaaagcagcacaguauuaauauuuagaguagg

SEQ ID NO: 329328 - RNA, 62 nt, Human
gcauggcaucagacuagccacuccugccaggccgccgggaugguucuucuccaguuagaaug

SEQ ID NO: 329329 - RNA, 62 nt, Human
gcagugggcagguggccgccccugaggcuucacgccgggagaagccaccuucccaccccuuc

SEQ ID NO: 329330 - RNA, 57 nt, Human; identical to SEQ ID NO: 50516

SEQ ID NO: 329331 - RNA, 62 nt, Human
acuguccuguugucgaagcuucuccccugggccgccgggagccccguggagcgcggccugca

SEQ ID NO: 329332 - RNA, 63 nt, Human
uaagacuuguguuucaucaauaaaguuguguuuuaagcagcagaaaaaaaaaagacguugucc

SEQ ID NO: 329333 - RNA, 64 nt, Human
ucuucacccuuucagaugugaccucuuuuggacuaagcagcaaucuguucucuugcucaaauaa

SEQ ID NO: 329334 - RNA, 64 nt, Human
gucacaucuacucaacucugcuguugacaugcaaaagcagcaauagacaauaugcguguaaaug

SEQ ID NO: 329335 - RNA, 64 nt, Human
ucaucuaacguuucaguguauccuuacagaaauaaagcagcauaugaauaaccugccuccuguc

SEQ ID NO: 329336 - RNA, 64 nt, Human
aacgggcccugcuccauaagagcuuauauaucugaagcagcaaccccacugaugcagacaucca

SEQ ID NO: 329337 - RNA, 64 nt, Human
cugcagcacacccgugggugaccccucaccccagaagcagcaguggcagcuugggaaaugugag

SEQ ID NO: 329338 - RNA, 64 nt, Human
aucuguugaaugaacccuagacaguucugugagaaagcagcaauugcacaguuacauacacagu

SEQ ID NO: 329339 - RNA, 64 nt, Human
uaauuauuauucagaaaugacuuuuugaaaguaaaagcagcauaaagaauuugucacaggaagg

SEQ ID NO: 329340 - RNA, 64 nt, Human
auacugaagcaugaagauuccugggguggggggaaagcagcaagaaaagguagagaggaaccag

SEQ ID NO: 329341 - RNA, 64 nt, Human
aaaaauaaaauaguacagaagggcuuauaaugagaagcagcaguucccugcuugcacccccaca

SEQ ID NO: 329342 - RNA, 64 nt, Human
agaagacuucaucaugacaggacuucagcuuaccaagcagcagccauagcuguguggaggcuuc

SEQ ID NO: 329343 - RNA, 64 nt, Human
uuuuucuuugaauuuauaggguuuagauuucugaaagcagcaugaauauaucaccuaacauccu

SEQ ID NO: 329344 - RNA, 64 nt, Human
uacuugauagaaggacuguuugagaaauguuagaaagcagcagcaauuauaaggcaaaauaggu

SEQ ID NO: 329345 - RNA, 64 nt, Human
ccuaucauauuaaaaacaaaaagugguccacuugaagcagcaaggacaaagggcaguuuaggga

SEQ ID NO: 329346 - RNA, 64 nt, Human
cauguuguaaaguaaaacauaacagguuauggcaaagcagcauauuuaauaucagcucacauau

SEQ ID NO: 329347 - RNA, 64 nt, Human
uagucauaaggagaaaaaaacacucaaauaguagaagcagcaaguagcaaacuucaggagagcu

SEQ ID NO: 329348 - RNA, 62 nt, Human
gcugcucccgccgccgccucagcgccacacaucgccgggacacccgcgccgggcagccccgc

SEQ ID NO: 329349 - RNA, 62 nt, Human
ugacucggacugaauuccccauacuguuuccacgccgggacaccauguucuccaucaagcua

SEQ ID NO: 329350 - RNA, 64 nt, Human
acugucagugacaccaucuuggaauaccuuugggaagcagcaggaaaugugcauguggguagag

SEQ ID NO: 329351 - RNA, 64 nt, Human
agaaguagcuuaaauucacuaauauuaauuuaaaaagcagcaugaacccucuacuuauaaacaa

SEQ ID NO: 329352 - RNA, 64 nt, Human
gagguccaagccccuugccaagggaguugggggaaagcagcagcagcagcaggagcgacuagag

SEQ ID NO: 329353 - RNA, 64 nt, Human
caacuggccugacccaugagaccguuuggagaccaagcagcagaugcagguguggaccccagga

SEQ ID NO: 329354 - RNA, 64 nt, Human
cugccuuucacggcugcugacuucucagggcugcaagcagcacagaauguuauccuuacguccu

SEQ ID NO: 329355 - RNA, 64 nt, Human
gauacacuggggauccagcugcacaacuuuucggaagcagcauucacuguggauuugguauauu

SEQ ID NO: 329356 - RNA, 64 nt, Human
agaaggagggggacaaccccccaagaccaucccugaagacgagcaucccccuccucucccuguu

SEQ ID NO: 329357 - RNA, 64 nt, Human
gaugagggugcccgggcuggacggcuaagggcacgaagacgauaucugguagagagggccagag

SEQ ID NO: 329358 - RNA, 64 nt, Human
cugggucagacgccagugacagaagcugugaguggaagacgagggauugccaucgccuaugagg

SEQ ID NO: 329359 - RNA, 64 nt, Human
gaucugguauuuccuggacuaaauuccccuuggggaagacgaagggaugcugcaguuccaaaag

SEQ ID NO: 329360 - RNA, 64 nt, Human
gguaacauuggaguccugguuugauucgaaggaugaagacgaagaagcaagggaggaacaaaug

SEQ ID NO: 329361 - RNA, 64 nt, Human
gcaacagucugaaaguacguggaggacgggaccggaagacgagagagggcuggacauccugccc

SEQ ID NO: 329362 - RNA, 64 nt, Human
aagaaaggcaacuaggaugagguuucaaaagacggaagacgacuaaaucugcucuaaaaaguaa

SEQ ID NO: 329363 - RNA, 64 nt, Human
cucacccaacagaucuuuccagagguccaugguggaagacgauaacccugugaaauacuuuaua

SEQ ID NO: 329364 - RNA, 64 nt, Human
auuucuggcaucagaacuuugccauuugucuacagaagacgaaccagagacaaaauuacuaagu

SEQ ID NO: 329365 - RNA, 64 nt, Human
uuaucaggcucggagggaagguuucccuuuauaugaagacgacgaaggaagagcaaggccaucu

SEQ ID NO: 329366 - RNA, 62 nt, Human
uguccuacugcccgggcagccccagcccagcccgccgggagcaaggauggugcuaggucauu

SEQ ID NO: 329367 - RNA, 62 nt, Human
agaaaggguccgcccgguggccuggaggcaggcgccgggagcgcaguagcacguggacuggg

SEQ ID NO: 329368 - RNA, 62 nt, Human
aggucgcauaacgccccauggcucaaggaagccgccgggagcugcccgcaggcccugggccg

SEQ ID NO: 329369 - RNA, 64 nt, Human
uuucaacuucuaauaagcuuaaccuaagugucacgaagacgagaugucacagagguccacucag

SEQ ID NO: 329370 - RNA, 64 nt, Human
guuuauaaguaaucaacugcacacaagagauacagaagacgagggcaagaaucaucucguccug

SEQ ID NO: 329371 - RNA, 64 nt, Human
ccugucuucuccagggagcucccauguuggggcugaagacgagcaggggcaaccugccagcauc

SEQ ID NO: 329372 - RNA, 64 nt, Human
cauuucacuuguuuauacauuuuuauaacauuaugaagacgauauaaaaauccuagaacugaag

SEQ ID NO: 329373 - RNA, 64 nt, Human
acaucagaacaugacagaaucuucagacuaugaggaagacgacaaugaagauacugacaguagu

SEQ ID NO: 329374 - RNA, 64 nt, Human
cucuggaggugcugaaggagcugcauuaauucuggaagacgacuccaugcagcaacuacugaag

SEQ ID NO: 329375 - RNA, 64 nt, Human
cucucagaaugaggauuuuuuuguaaauaggucagaagacgauggaacuguccuggguuaguau

SEQ ID NO: 329376 - RNA, 64 nt, Human
uucuucuucacaaggcugagagugcuuccuucuugaagacgagugacauucaucacuucaguga

SEQ ID NO: 329377 - RNA, 64 nt, Human
cuuggaauguucacaacuugcgugcguggcagcggaagacgauucccauauucuacauugcuac

SEQ ID NO: 329378 - RNA, 64 nt, Human
uuucacagaguagaaccuggguuagaggauugcagaagacgagcgggagcggggagggcaggga

SEQ ID NO: 329379 - RNA, 64 nt, Human
aaaugaagaagaaguuugcagauguauuugcagagaagacgaaggcagaguggugucaaaucuu

SEQ ID NO: 329380 - RNA, 64 nt, Human
uuaaagaaauucuuaucauggguguuguaauaaugaagacgaauuugacuuuaugcaguguucu

SEQ ID NO: 329381 - RNA, 64 nt, Human
cagugugauuuagaaaagggacagaucagccccugaagacgaggugaaaagucaauuuuacaau

SEQ ID NO: 329382 - RNA, 64 nt, Human
gggaguugaggcaguaggagugugggguucuugggaagacgauggggccuuguauuaaggagaa

SEQ ID NO: 329383 - RNA, 64 nt, Human
aaguuuucuucuggauauauaacauugcacaagggaagacgaguguggaggauagguuaagaaa

SEQ ID NO: 329384 - RNA, 64 nt, Human
uuaaaaaaaaugcugaaaauacacauucuccugggaagacgauaaacagcuagcuaagaagccg

SEQ ID NO: 329385 - RNA, 62 nt, Human
uccaaguacucacaggggcucugggugcccaucgccgggaguaugguucagcugccaccggc

SEQ ID NO: 329386 - RNA, 62 nt, Human
gccacuacuuccagaagcaucuccucauuccccgccgggagcaacaucucucuucucgagac

SEQ ID NO: 329387 - RNA, 64 nt, Human
ugccuucgguuaccucauuaucuacugcagaaaagaagacgagaaugcaaccauaccuagaugg

SEQ ID NO: 329388 - RNA, 64 nt, Human
aaacauggaagaauaucuggcaggcuuacuuuuagaagacgacaaaucgguaaggcuuauucau

SEQ ID NO: 329389 - RNA, 64 nt, Human
cuauuuacaaguauaaaugcugaguaugucuguugaagacgagcagagauauuaaauuauaacc

SEQ ID NO: 329390 - RNA, 64 nt, Human
uauaaaaucauuaaccacacauugugggugaugggaagacgauuucagcugacagaguuaaugg

SEQ ID NO: 329391 - RNA, 64 nt, Human
cucucacaggcgccuaaagucauugccaugggaggaagacgauuuggggggggagggggggggg

SEQ ID NO: 329392 - RNA, 64 nt, Human
cucuacauaaaaucacuacagagauacuaguggggaagacgauuaacacaccucuuacaguaau

SEQ ID NO: 329393 - RNA, 64 nt, Human
cuuggacaagccgcucauggaccauuagacuugagaagacgacccacguggugacugcaaagcc

SEQ ID NO: 329394 - RNA, 64 nt, Human
gcaaacaaacacaacacaacagaauuccuggaaagaagacgacugcuaagacacggcagggggg

SEQ ID NO: 329395 - RNA, 64 nt, Human
ggaggaagacaagaaggaagaggaggaggagaaggaagacgaggagcuggacugggccuuggcu

SEQ ID NO: 329396 - RNA, 64 nt, Human
ucccagucuacccagagaagccccuuccccaugggaagacgaggcccucgggcccagcccccac

SEQ ID NO: 329397 - RNA, 64 nt, Human
gccggacaaaugagcgacuucugugcuuccagaggaagacgagggagcaggagcuuggcugacu

SEQ ID NO: 329398 - RNA, 64 nt, Human
uccuccugcccuuucaaagaauaaccacagcucagaagacgaugacguggucaucugugucgcc

SEQ ID NO: 329399 - RNA, 64 nt, Human
ccaggcugugcuggacagcaccaccuucuucccugaagacgagcagcucuucuccuccaacggc

SEQ ID NO: 329400 - RNA, 64 nt, Human
cuuugagaggcucuguucccacccaggcugcacggaagacgagagccaugcggaccuccugcgc

SEQ ID NO: 329401 - RNA, 64 nt, Human
accauucacacacuccguucaugcauggacaccagaagacgauucagaacacaagaggagaaug

SEQ ID NO: 329402 - RNA, 64 nt, Human
ugccuacugccugggggcucuagucauuccaguggaagacgaauguaaccugcguggugaugug

SEQ ID NO: 329403 - RNA, 62 nt, Human
guguaagcacacaugcacgauuaaagaggagacgccgggacccccugcccgaucgcgcgcgg

SEQ ID NO: 329404 - RNA, 62 nt, Human
gaccggguggaggcgguggggacccagccgcgcgccgggagcgcuccccggaaugagccgcc

SEQ ID NO: 329405 - RNA, 62 nt, Human
gccuccccuuccccguccccuccucccgaagacgccgggacagucggguguccgcccucagc

SEQ ID NO: 329406 - RNA, 64 nt, Human
caugcaguuggguucaaaugccaaauagugauuagaagacgaccauucugaucugugugugauc

SEQ ID NO: 329407 - RNA, 64 nt, Human
cagauaaggagccccucucugcugggggagaagggaagacgaggaaccccacaugccacucgcu

SEQ ID NO: 329408 - RNA, 64 nt, Human
aaaccaaccugcuuggucucuauuagucaguaaugaagacgacagccuggccaaccaagggaaa

SEQ ID NO: 329409 - RNA, 64 nt, Human
ccugucccacuccuacgauacgcuacuauaaagagaagacgaaauagugacauaauauauucua

SEQ ID NO: 329410 - RNA, 64 nt, Human
ucaauuaauaaaagcaacuucagaaaaaagagaugaagacgaguuggggauuguuuaaucacaa

SEQ ID NO: 329411 - RNA, 64 nt, Human
uugaaagaauaaguuuugguucaaagucaauaaugaagacgagauuuguuuuucucuucucugg

SEQ ID NO: 329412 - RNA, 64 nt, Human
uagauguacaauuggauuaauguccaucguuuuggaagacgagagaaaguugagaagaacacga

SEQ ID NO: 329413 - RNA, 56 nt, Human
accgccuuuacuaccucuaaccugcagaagacgaugcagccgcuuuucuuuuugaa

SEQ ID NO: 329414 - RNA, 64 nt, Human
uagcccagugcugaaggacuugcuuuuccaugaagaagacgaaaacagcaaacaagggcaagaa

SEQ ID NO: 329415 - RNA, 64 nt, Human
cagucuacucuaccuaaagugcacuaccaucuaagaagacgagcagugaaaaccuuugugaaaa

SEQ ID NO: 329416 - RNA, 64 nt, Human
uuaaggaucacaugcuacaacuagaaugaaccuugaagacgacacugcuaagugaaauaaacua

SEQ ID NO: 329417 - RNA, 64 nt, Human
guguuucuguccucaagaucugcccccuggaggagaagacgagcgucuuaccgaauucccuuca

SEQ ID NO: 329418 - RNA, 55 nt, Human
accggaccuccaccaucuagaagcugaagacgagagugaccgcgcuggccgugaa

SEQ ID NO: 329419 - RNA, 64 nt, Human
caaaauacaaacacaauauuuaaucuugccaaccgaagacgaugugacugcaugaagugaguau

SEQ ID NO: 329420 - RNA, 64 nt, Human
ggcugcaccaggcguccuggggaaugugcucagugaagacgacacugggcuuugcacagccugg

SEQ ID NO: 329421 - RNA, 64 nt, Human
uguuuuaacuauugucaggagauugggcuaaagagaagacgacgagaguaaggaaauaaaggga

SEQ ID NO: 329422 - RNA, 62 nt, Human
cgccuugcacugcgccugccccacgguguccccgccgggaagcagccccggcuccugaauca

SEQ ID NO: 329423 - RNA, 64 nt, Human
uaaaggaauaauaaaugcauaauaugaggucaguggacgccauuuucuguuauaaucauuuuug

SEQ ID NO: 329424 - RNA, 64 nt, Human
cguuuugaaaggcugcgacgagcaauggaacuucgaagacgaagagagauugcagagagagagc

SEQ ID NO: 329425 - RNA, 64 nt, Human
gaauuaauuccuaaauacauaacguugguauauugaagacgaaauuaaaauuguccuucaguuu

SEQ ID NO: 329426 - RNA, 64 nt, Human
uuucagagauuagaaacuggguuagaggauugcagaagacgaguggggggagggcagggaagau

SEQ ID NO: 329427 - RNA, 64 nt, Human
ucgacugucaaaucuucuucggaggaucacccgggaagacgacagagacugaagauuggucacu

SEQ ID NO: 329428 - RNA, 64 nt, Human
auggccaagucacccagcuguggaagcagagguagaagacgaggccagccaggagggcgacuuc

SEQ ID NO: 329429 - RNA, 64 nt, Human
gauugacccaagcgcgaugcagcaggcaggcucagaagacgaugcggggcugugugccggccuu

SEQ ID NO: 329430 - RNA, 64 nt, Human
aaguuggaauuccacgcccgggagugggguagaggaagacgagacaggacgaggcagaaaagca

SEQ ID NO: 329431 - RNA, 64 nt, Human
aacuugggagaaguccaguuccuguaaaaacugggaagacgaggcguucucaucccauaggagg

SEQ ID NO: 329432 - RNA, 64 nt, Human
ugucucaaaaauaaacaaacuaaaauuaaaaaaagaagacgagagauagugggugugguggcuc

SEQ ID NO: 329433 - RNA, 64 nt, Human
ucuccccacucccgccccccccuuaucccccucugaagacgaugggcagaggagugacagccgc

SEQ ID NO: 329434 - RNA, 64 nt, Human
agaucaccuucccuauccuccaccuucccgcagggaagacgaagccaggugccagggcuggggu

SEQ ID NO: 329435 - RNA, 64 nt, Human
ucugcuccagcucucccuggaccucuucuacacggaagacgagaucuaugagcuuucuuaugcc

SEQ ID NO: 329436 - RNA, 64 nt, Human
gggaaauuuggucacagaggcagauguacagagggaagacgaugugaagacacaggaagaacau

SEQ ID NO: 329437 - RNA, 64 nt, Human
gugaauagggggcaccccuucaaaacuguacaaagaagacgacuguuuuccauuuccauuuaaa

SEQ ID NO: 329438 - RNA, 50 nt, Human
ccauuaugaacuccucuuaagaagacgacggcuucaggcccggcuaacuc

SEQ ID NO: 329439 - RNA, 64 nt, Human
cuguguggaaccaccugaugacaugguuaacgaggaagacgauguguugaccggcugccguuug

SEQ ID NO: 329440 - RNA, 62 nt, Human
gcccagagugggcgguggccugucuagaaugccgccgggaguccgggcauggugggcacagu

SEQ ID NO: 329441 - RNA, 62 nt, Human
caggccaggcugccacuccgggaacgccuuugcgccgggacuuuuuguuucugaaggcaguc

SEQ ID NO: 329442 - RNA, 62 nt, Human
cgguucccccggucauguggcgccuguuucgacgccgggacccccaggagaccaggucuggc

SEQ ID NO: 329443 - RNA, 64 nt, Human
cacauccgacaccucccagcgugggaccccaagugaagacgaggccaaggcugaaaccauccgc

SEQ ID NO: 329444 - RNA, 64 nt, Human
aagucacucuuuugggaucuaacuguuguuacuggaagacgaaguguaaacuaaggggcuuugc

SEQ ID NO: 329445 - RNA, 64 nt, Human
ugcagccugccacaggcuccucauccggacugaggaagacgaggacagggaggaggaaaaggag

SEQ ID NO: 329446 - RNA, 64 nt, Human
gaucaaagacaaacugaaugauaaccaugagguggaagacgagaucaucugggaggaauucacc

SEQ ID NO: 329447 - RNA, 64 nt, Human; identical to SEQ ID NO: 118169

SEQ ID NO: 329448 - RNA, 64 nt, Human; identical to SEQ ID NO: 118170

SEQ ID NO: 329449 - RNA, 64 nt, Human; identical to SEQ ID NO: 118171

SEQ ID NO: 329450 - RNA, 64 nt, Human; identical to SEQ ID NO: 118172

SEQ ID NO: 329451 - RNA, 64 nt, Human; identical to SEQ ID NO: 118173

SEQ ID NO: 329452 - RNA, 64 nt, Human; identical to SEQ ID NO: 118174

SEQ ID NO: 329453 - RNA, 64 nt, Human; identical to SEQ ID NO: 118175

SEQ ID NO: 329454 - RNA, 58 nt, Human; identical to SEQ ID NO: 118176

SEQ ID NO: 329455 - RNA, 64 nt, Human; identical to SEQ ID NO: 118177

SEQ ID NO: 329456 - RNA, 63 nt, Human
cccucaccaucucaaacucugauucccacuccacucuucgagguuucucucagcuuuuugacc

SEQ ID NO: 329457 - RNA, 63 nt, Human
gguguuucaguagaguggggcaggaaaagagaucucuucgauuucuuucaggccugaggcuuu

SEQ ID NO: 329458 - RNA, 63 nt, Human
uaucugaccucagaggcagaggaacaccaccagcucuucgaucugauugaaagcaugcuagag

SEQ ID NO: 329459 - RNA, 63 nt, Human
uaagaacuuacagaaugcaaacacgagcacacucucuucgaacccaauuguggguguagcaau

SEQ ID NO: 329460 - RNA, 63 nt, Human
aacugcucuggcugggcauuccugaggcucugacucuucgauccucccucuuuguguccauuc

SEQ ID NO: 329461 - RNA, 63 nt, Human
uccuaagauccuggaggauuuccuacccccguccucuucgagaccccagucgugauguggagg

SEQ ID NO: 329462 - RNA, 63 nt, Human
ccaccacugcccaccccacccccacaucacacacucuucgaugcuuucccacagccccugcuc

SEQ ID NO: 329463 - RNA, 63 nt, Human
aacaaacaaaaaaugcacaguucauaauaauuucucuucgaaauaauauguuugagauuucgg

SEQ ID NO: 329464 - RNA, 63 nt, Human
cggccuggugguggguucgagcccaacuucaugcucuucgagaagugcgaggugaacggugcg

SEQ ID NO: 329465 - RNA, 63 nt, Human
uaggguucuguauaugaagcugccagucuguagcucuucgagaaagaaaguucaagucauuug

SEQ ID NO: 329466 - RNA, 63 nt, Human
uacuaguuugcagugcugggcaggugacuucaucucuucgaacuucaguuucuucauaagaug

SEQ ID NO: 329467 - RNA, 63 nt, Human
guuuuauguaccauguuuucacacgugucucuucucuucgacuuccugaaagcgaaagcuuua

SEQ ID NO: 329468 - RNA, 63 nt, Human
cuguacuugaaauugauucuuagacauugcagucucuucgaggcuuuacaguguaaacugucu

SEQ ID NO: 329469 - RNA, 63 nt, Human
uucuuuucagaaauacggcugcuuugcuugggucucuucgagccauauuuauaguugguccca

SEQ ID NO: 329470 - RNA, 63 nt, Human
gauuugguaguauuaauuuuguggucauuguuucucuucgauaaauuuauuuucauuaaauac

SEQ ID NO: 329471 - RNA, 63 nt, Human
uauuuauguagagauauuucuggaccacucaagcucuucgauaccaaaaucaggagcaucuug

SEQ ID NO: 329472 - RNA, 64 nt, Human
caacaucucagcaccuggugccgaaggaggacuuggacgccauaguggcccgggaccgagaccu

SEQ ID NO: 329473 - RNA, 64 nt, Human
agggcaagacagcucacagagaccucuuuuauaaggacgccaguuccauucaagagggcacugc

SEQ ID NO: 329474 - RNA, 64 nt, Human
caucaaucaaaaagcauuuccuaggcagcuccucgccugucagugugcauauggaaacagggac

SEQ ID NO: 329475 - RNA, 63 nt, Human
uuuaggaaaagaaaacaauggugagucccggcccucuucgaauucacuggcaccucaugcaag

SEQ ID NO: 329476 - RNA, 63 nt, Human
uaguuucagaguguggauuguauaacccauauacucuucgauguacuuguuugguuugguauu

SEQ ID NO: 329477 - RNA, 63 nt, Human
ccagcccuauagccaccccaaguguggauaugccucuucgauugcuccguacucuaacaucua

SEQ ID NO: 329478 - RNA, 63 nt, Human
gccagcaccacuuugccuuacuugagucgucuucucuucgaguggccaccugguagccuagaa

SEQ ID NO: 329479 - RNA, 63 nt, Human
aaaagggggccuuucugcuucuuagccagcuaccucuucgaguuuuucaaauugugaggggga

SEQ ID NO: 329480 - RNA, 63 nt, Human
guccagaucuccggauugucgggggacgcaggacucuucgaggaaaaccagccgaaugagauc

SEQ ID NO: 329481 - RNA, 63 nt, Human
agacuccaucccaggaccagguuccccugcgugcucuucgagagggugucagugagcagacug

SEQ ID NO: 329482 - RNA, 55 nt, Human
agggcaagccaagaagcugaagaagcucuucgaggcucaggagaagcucuacaag

SEQ ID NO: 329483 - RNA, 63 nt, Human
ggcuauaaaucuguuuauaaagagcauuuccugcucuucgaagacagcaaugaggaguuggaa

SEQ ID NO: 329484 - RNA, 63 nt, Human
auuuuacaaaaacguuuuuuaaauacacgccagcucuucgagaagcacuuuuuuccuuccguc

SEQ ID NO: 329485 - RNA, 63 nt, Human
cacagcgcgcagccgggcgcucaaccuaagguccucuucgaaggugguuugcauucuuaaucu

SEQ ID NO: 329486 - RNA, 63 nt, Human
cccacauccuacauccaugagaauuaccugcagcucuucgaguuuguggggaagaugcugggg

SEQ ID NO: 329487 - RNA, 63 nt, Human
uauaaugaaagcaacaccaaaaugaacuugguucucuucgacgaugcucuggagcauuuaacc

SEQ ID NO: 329488 - RNA, 63 nt, Human
ucuguggucucuagggcucugcagcagcaguggcucuucgauuaguuaaaacucuccuaggcu

SEQ ID NO: 329489 - RNA, 63 nt, Human
cucuauaauuguuuugcuacgauuccacugaaacucuucgaucaagcuacuuuauguaaauca

SEQ ID NO: 329490 - RNA, 63 nt, Human
uguuauuugcugccuauaguggcgaugucucagcucuucgaagguaaugcuacugugaccaaa

SEQ ID NO: 329491 - RNA, 64 nt, Human
gacuacaauccauagugaaacuguaaacaguaauggacgccaaauuauagguagcugauuuugc

SEQ ID NO: 329492 - RNA, 64 nt, Human
caagaguugauuacaaccuccaugcuucauaagcggacgccacguuaggguuggacgugggcac

SEQ ID NO: 329493 - RNA, 64 nt, Human
agugaaaccaggggcucugcaggucacuugggacggacgccaccagacuugucuccaaaaauca

SEQ ID NO: 329494 - RNA, 63 nt, Human
accgggaaaauauuggaaacaugccaccaagcccucuucgauagaagucuccuuauuuggaaa

SEQ ID NO: 329495 - RNA, 63 nt, Human
agaacaaaugugauuguauuucugauucucccucucuucgaauuaucugacuuuuuuguuuuu

SEQ ID NO: 329496 - RNA, 63 nt, Human
ggaggaggagggcaaacccgagggcccagcgaacucuucgaaaaccugcuggugcugaguccu

SEQ ID NO: 329497 - RNA, 63 nt, Human
ccuguagaagcagggggguagcaaauuuaggcucucuucgaaauuacuuguacaauacgagug

SEQ ID NO: 329498 - RNA, 63 nt, Human
caagagucuagaucaguuagcacaugcuuucuacucuucgauuauuaguauuauuagcuaaug

SEQ ID NO: 329499 - RNA, 63 nt, Human
cauugaauuguuuuuaauccucugacaaguugacucuucgacccccacccccacccaagacau

SEQ ID NO: 329500 - RNA, 63 nt, Human
cagugaccacacguccugguggcggaugaagcccucuucgagcuagagaaaaauagauaagcc

SEQ ID NO: 329501 - RNA, 63 nt, Human
ggaucacuggucaguccccauggggagcaucaucucuucgacccuaaagaugucaaaggugug

SEQ ID NO: 329502 - RNA, 63 nt, Human
gcucacucugaagauguuagagacaaacacaaacucuucgaguuaaaguugauccugacacug

SEQ ID NO: 329503 - RNA, 63 nt, Human
cccauccgguuugccauguugccagaugaucaacucuucgaagccuugccuaaauuuaaugcu

SEQ ID NO: 329504 - RNA, 63 nt, Human
guauuuuacaauauuucaacagcagaccuucugcucuucgaguaguuugauuugguuuaguaa

SEQ ID NO: 329505 - RNA, 63 nt, Human
acggccccucccucugaugcagauucagggcuucucuucgaucauguuggguuuugauucugu

SEQ ID NO: 329506 - RNA, 63 nt, Human
uuuuaagcaugcaaaaauaccaaggaagaacuucucuucgaugauaaugucgaguggaaauca

SEQ ID NO: 329507 - RNA, 63 nt, Human
cccugccacuccaggcggcccggagagaggagccucuucgauuuguuuccuguuuauucuucu

SEQ ID NO: 329508 - RNA, 63 nt, Human
cucacugguaucacauggucuugcaguuuugaacucuucgaccgauuugugggaguuuaugua

SEQ ID NO: 329509 - RNA, 63 nt, Human
gaaacaaagucuuuaauagaguggccucuuucgcucuucgauuaugacugcugcaguuuuacc

SEQ ID NO: 329510 - RNA, 64 nt, Human
ugucuugcuagacaagguugcuguugugcagugugccugucacuacuggucuguacuccuugga

SEQ ID NO: 329511 - RNA, 64 nt, Human
uaagcacuccaguguucucuuaaugaggcacuuugccugucacucgagcaagccuggguguucc

SEQ ID NO: 329512 - RNA, 63 nt, Human
uucccccugcagugcccugacccuugcugcccugccugucacguggcccugccuauccgcccc

SEQ ID NO: 329513 - RNA, 63 nt, Human
aacccagggaggaacuggccccuccuagggagccucuucgacuuuuuuagaaaaaugaucucc

SEQ ID NO: 329514 - RNA, 64 nt, Human
cagccggaagugccagaccggaggugcgucauucaccggcgacgccgauacgguuccuccaccg

SEQ ID NO: 329515 - RNA, 64 nt, Human
ugugggagcagcuggacaccaggcuucuuggugaaccggcgaggggccgagucccgccuggugg

SEQ ID NO: 329516 - RNA, 64 nt, Human
gcagggccagauggggacuccauggagacagccgaccggcgacagccuucagcuccgacaaaga

SEQ ID NO: 329517 - RNA, 64 nt, Human
acacacauggccacacgcaugugcgggugccauaaccggcgaggcugggccagccgcuccacca

SEQ ID NO: 329518 - RNA, 64 nt, Human
ggccuuccgggcugcucucuucccugagcccggaaccggcgacgcacaugugucuuuuguuggu

SEQ ID NO: 329519 - RNA, 64 nt, Human
acccucagaagaggagagccggcacagcagaggcaccggcgaugaaguggcacagccccagucg

SEQ ID NO: 329520 - RNA, 64 nt, Human
uugugggggagggcaaggcucuccucccagccagggacgccaggacauagcugcuccuggucag

SEQ ID NO: 329521 - RNA, 64 nt, Human
acugauguggacucaguaugauaacugagaugggggacgccagacaugugaggacgcuguccuc

SEQ ID NO: 329522 - RNA, 64 nt, Human
cugauccuggaaccccucccucugcgccgcagcuggacgccaccuccgacggacacagccagcc

SEQ ID NO: 329523 - RNA, 64 nt, Human
ugacugacgcuguccgacgaaggcggccacggacggacgccagcacacgaagucacgugcaagu

SEQ ID NO: 329524 - RNA, 64 nt, Human
gccagggagacuugaauguggcugucacucuuccggacgccaagggcugcaggaggcugcuuuu

SEQ ID NO: 329525 - RNA, 64 nt, Human
uuucuuuaaggucccccgaccaauccccagccuaggacgccaacuucucccaccccuuggcccc

SEQ ID NO: 329526 - RNA, 64 nt, Human
ucugugcagggcucucacuggcggugcccaggacggacgccagauggcugcgcgcuuugucagc

SEQ ID NO: 329527 - RNA, 64 nt, Human
cgcgccagccaggcugugggcagggcggggccagggacgccaaagagagguugcagucagaacc

SEQ ID NO: 329528 - RNA, 64 nt, Human
aacuucguggaagccaggguccccugcagcugagggacgccaagcagacacaccugcccucccc

SEQ ID NO: 329529 - RNA, 64 nt, Human
gcagcuggcucugcucugagaaacucuggcaaguggacgccauucucuugcccuuaggauucac

SEQ ID NO: 329530 - RNA, 64 nt, Human
uuggcgggucacugaggugcauucugggcuccagggacgccacugcggggcaaaggcgccguua

SEQ ID NO: 329531 - RNA, 64 nt, Human
ucgcuauaggcauaggcccggcauggcugucgcuggacgccagcugugcacacccagccacacc

SEQ ID NO: 329532 - RNA, 64 nt, Human
aaggaaacccuguggaggcugcccuuugaccuuuggacgccaccuguaaucacucuggauggug

SEQ ID NO: 329533 - RNA, 64 nt, Human
ggucugugggggccgugcucucagggcgugugcgggacgccaccugugcacaccugcucagagc

SEQ ID NO: 329534 - RNA, 64 nt, Human
ccccggucaccuuccuccgcacggaagaggggccggacgccaccuuccccaggaccauuccccu

SEQ ID NO: 329535 - RNA, 64 nt, Human
gaaugccgagcagcacuuccagucuccacccacaggacgccaguagcacccucuaaguugugag

SEQ ID NO: 329536 - RNA, 64 nt, Human
cccucuuccaucacggagguaaaguugaggccguggacgccaccagccugaugaaauaaagauu

SEQ ID NO: 329537 - RNA, 64 nt, Human
ccuggggagacuugaaaggccccugucccagccuggacgccacgcacugccgcacgucacuggc

SEQ ID NO: 329538 - RNA, 64 nt, Human
gggugguagaggcuggaaggaagccacaucaggaggacgccacuccggcccuucacccuugcca

SEQ ID NO: 329539 - RNA, 64 nt, Human
uuaaaagcgagaaaaaagaauauacacauaauuucugacggaaaaccuguacccugaugcugua

SEQ ID NO: 329540 - RNA, 64 nt, Human
gcccaggaaugagcaaggcauggucugccaccagcugacggaaagcagccuucuguacaacaga

SEQ ID NO: 329541 - RNA, 64 nt, Human
cugagcacagggccaaagcagccauggcagacaccugacggagggcacggggcuggcugacacu

SEQ ID NO: 329542 - RNA, 64 nt, Human
agaaucuaccaggcacagaugaggccgcccuugccugacggagcuugaugagcagcccuugguc

SEQ ID NO: 329543 - RNA, 64 nt, Human
aaggcccuccccaccgacccgccaccugccaccucugacggagugggagaaguuagucugugcu

SEQ ID NO: 329544 - RNA, 64 nt, Human
ugucccuuacugccagacccagccagacuuugcccugacggaguggcccggaagcagaggcuga

SEQ ID NO: 329545 - RNA, 64 nt, Human
uccgggggcggcuuuuuccuuccuuggagcgucccugacggacaaguggaggccucuugcugcg

SEQ ID NO: 329546 - RNA, 64 nt, Human
agcucuaaacaacacacagagcacaaauaugcuccugacggacucaggaaaaugccaacagcag

SEQ ID NO: 329547 - RNA, 64 nt, Human
cuuccuccuuccuccccggauuggcuugcugugccugacggaugggcuguagaauggggucugg

SEQ ID NO: 329548 - RNA, 64 nt, Human
agcagugaucauuauaacuucacaaaaaaagaugcugacggauuuacuuacagggccuuaaugu

SEQ ID NO: 329549 - RNA, 64 nt, Human
ucuucuagaccaaagucuagaaaggccuauguuacugacggaagaaguauugguuccagacuuc

SEQ ID NO: 329550 - RNA, 64 nt, Human
cgcccagggccggcggggcccuuuucaccuugggcugacggagguggcggggcuagagguguag

SEQ ID NO: 329551 - RNA, 64 nt, Human
uuuugcuucaguuuaacuuaugagaaaagauuaucugacggauuuuguguugacuuccccuuua

SEQ ID NO: 329552 - RNA, 64 nt, Human
aggcaccaccccucaccccagcugccugcugcuucugacggaucuuggugcucaggcugccugg

SEQ ID NO: 329553 - RNA, 64 nt, Human
gaaauuucagagugaaggaauuuuaaaaaucuggcugacggaauaucauucugguugccaucuu

SEQ ID NO: 329554 - RNA, 64 nt, Human
gcaggaccaagugcagaggcucaugcgggagaagcugacggacuggaaggacuucuugcuggug

SEQ ID NO: 329555 - RNA, 64 nt, Human
gcuguggccagccaggcaggaagagaccuuuccucugacggaccacuaagcuggggacaggaac

SEQ ID NO: 329556 - RNA, 64 nt, Human
ccugcuuggugccgcccagggaaggggcucaggccugacggaaggccuguucugugugugccgc

SEQ ID NO: 329557 - RNA, 64 nt, Human
ucagaggaaaaugagauuuacuaaguugacuuaccugacggaccccagagaccuauugcauuga

SEQ ID NO: 329558 - RNA, 64 nt, Human
gcauguuaaagggaugacugugcauuccagggcacugacggaaagccagggcugcaggcaaagc

SEQ ID NO: 329559 - RNA, 64 nt, Human
cuugacaaaguuucaguaaauucuuaccgucaaacugacggauuauuauuuauaaaucaaguuu

SEQ ID NO: 329560 - RNA, 64 nt, Human
ugugcaucucuuuucagagguguguuaguaaaaccugacggauuaacuaagcacacugggaugu

SEQ ID NO: 329561 - RNA, 64 nt, Human
gacaauguagucuggccaacaucuucacuggacucugacggacucugugucugggacccagcug

SEQ ID NO: 329562 - RNA, 64 nt, Human
aaacuuuuguuuguacuaccuguuuucugcggaacugacggaucacaaagaacugaaucuccau

SEQ ID NO: 329563 - RNA, 64 nt, Human
aggcugccuguccauaaaauggggacauggccagcugacggacaacugagucuccggcccaccu

SEQ ID NO: 329564 - RNA, 64 nt, Human
gcuuguggaggcagcaggugaagaggcagggccccugacggaggcuuugcuggcuguggugaug

SEQ ID NO: 329565 - RNA, 64 nt, Human
guccaacaaauuccgagaccucuugcaggaagggcugacggagcucaacagcacagccaucaag

SEQ ID NO: 329566 - RNA, 63 nt, Human
caaagcagucagcauuggaaggaaaauuagauuucugacggacauccugauguugguuuuacu

SEQ ID NO: 329567 - RNA, 64 nt, Human
gcuggacguucacuuggugacuggugccucugcacugacggaggacucuggggguccuucuuac

SEQ ID NO: 329568 - RNA, 64 nt, Human
guguacagggaagagagggguacauuucccugugcugacggaagccaacuuggcuuucccggac

SEQ ID NO: 329569 - RNA, 64 nt, Human
gcggcggcgcaucgagaucgcgcacgcccugugccugacggagaggcagaucaagauaugguuc

SEQ ID NO: 329570 - RNA, 64 nt, Human
cccugugcccgauccucaugugucacaugugaaccugacggacauggacgcccugagcugugag

SEQ ID NO: 329571 - RNA, 64 nt, Human
aggacugagcccagccagaggcgggcagggcagacugacggacggacgacggacaggcggaugu

SEQ ID NO: 329572 - RNA, 64 nt, Human
cucuccuuauggacucuguucuguuuguacauggcugacggaaaucucuuugguacaaccgaau

SEQ ID NO: 329573 - RNA, 64 nt, Human
auguguagcaucaaaacacaaaggcccacacuuccugacggaugccagcuugggcacugcuguc

SEQ ID NO: 329574 - RNA, 64 nt, Human
cacaaugcccuggucacuuggcaagcggcugggccugacggaggccgaggggcagaccggggcu

SEQ ID NO: 329575 - RNA, 64 nt, Human
ccuggggaaacggcccaccaaggacagcuacacgcugacggaggagcuagcugaguaugcugaa

SEQ ID NO: 329576 - RNA, 64 nt, Human
auccaagcacuuuaauuccaauguaccaggugaacugacggagcucagaaguuuuccuuuacac

SEQ ID NO: 329577 - RNA, 64 nt, Human
acaagauacgagugacaugguucuccucccacugcugacggaggaauuaacacaaaagcagaca

SEQ ID NO: 329578 - RNA, 64 nt, Human
cagccacuccagccccagcccagccuggggugcacugacggagaugcggacuccugggucccug

SEQ ID NO: 329579 - RNA, 64 nt, Human
ugcuuaagguugaaaagagaaauuuaagaaauugcugacggaauaaaaacauaauagaacuaca

SEQ ID NO: 329580 - RNA, 64 nt, Human
aauguggcucaugcucugaguacuguuccuguaccugacggaugcuccagacuggcuuccaguu

SEQ ID NO: 329581 - RNA, 64 nt, Human
gguggaugguggaaggcaggacacguaucucugucugacggaaaacagaccucggggcuggcgu

SEQ ID NO: 329582 - RNA, 64 nt, Human
augaggccacuggagacgcauaugaguaagggcacugacggacucaugauuucuucuuaccaga

SEQ ID NO: 329583 - RNA, 64 nt, Human
caggggcugggggcccuuccuggcacccuuuugccugacggacccuguugccugcuccugggca

SEQ ID NO: 329584 - RNA, 64 nt, Human
aagcaagcuacuggcauggcaagagcccagcuuccugacggagcgcaacauuucuccacugcac

SEQ ID NO: 329585 - RNA, 64 nt, Human
cccacuggaccuugaugcugcgaggagugguguccugacggacucagcacucccgccugaugua

SEQ ID NO: 329586 - RNA, 64 nt, Human
ggucuguuggggggaaucuggacacuuguuuauucugacggaguucacuucuucagaaccuucc

SEQ ID NO: 329587 - RNA, 64 nt, Human
cucugcuacuuaggcacagggacuccgccgcacgcugacggaccacgagggcugaccccuucca

SEQ ID NO: 329588 - RNA, 64 nt, Human
cggccccauccccccacaggagggaagcuguggucugacggaaugggcaacuuucgccccugug

SEQ ID NO: 329589 - RNA, 64 nt, Human
ugguccuuucccucagguggagaugcggaaagcccugacggacuucauucaagaggaauuccag

SEQ ID NO: 329590 - RNA, 64 nt, Human; identical to SEQ ID NO: 329539

SEQ ID NO: 329591 - RNA, 64 nt, Human; identical to SEQ ID NO: 329540

SEQ ID NO: 329592 - RNA, 64 nt, Human; identical to SEQ ID NO: 329541

SEQ ID NO: 329593 - RNA, 64 nt, Human; identical to SEQ ID NO: 329542

SEQ ID NO: 329594 - RNA, 64 nt, Human; identical to SEQ ID NO: 329543

SEQ ID NO: 329595 - RNA, 64 nt, Human; identical to SEQ ID NO: 329544

SEQ ID NO: 329596 - RNA, 64 nt, Human; identical to SEQ ID NO: 329545

SEQ ID NO: 329597 - RNA, 64 nt, Human; identical to SEQ ID NO: 329546

SEQ ID NO: 329598 - RNA, 64 nt, Human; identical to SEQ ID NO: 329547

SEQ ID NO: 329599 - RNA, 64 nt, Human; identical to SEQ ID NO: 329548

SEQ ID NO: 329600 - RNA, 64 nt, Human; identical to SEQ ID NO: 329549

SEQ ID NO: 329601 - RNA, 64 nt, Human; identical to SEQ ID NO: 329550

SEQ ID NO: 329602 - RNA, 64 nt, Human; identical to SEQ ID NO: 329551

SEQ ID NO: 329603 - RNA, 64 nt, Human; identical to SEQ ID NO: 329552

SEQ ID NO: 329604 - RNA, 64 nt, Human; identical to SEQ ID NO: 329553

SEQ ID NO: 329605 - RNA, 64 nt, Human; identical to SEQ ID NO: 329554

SEQ ID NO: 329606 - RNA, 64 nt, Human; identical to SEQ ID NO: 329555

SEQ ID NO: 329607 - RNA, 64 nt, Human; identical to SEQ ID NO: 329556

SEQ ID NO: 329608 - RNA, 64 nt, Human; identical to SEQ ID NO: 329557

SEQ ID NO: 329609 - RNA, 64 nt, Human; identical to SEQ ID NO: 329558

SEQ ID NO: 329610 - RNA, 64 nt, Human; identical to SEQ ID NO: 329559

SEQ ID NO: 329611 - RNA, 64 nt, Human; identical to SEQ ID NO: 329560

SEQ ID NO: 329612 - RNA, 64 nt, Human; identical to SEQ ID NO: 329561

SEQ ID NO: 329613 - RNA, 64 nt, Human; identical to SEQ ID NO: 329562

SEQ ID NO: 329614 - RNA, 64 nt, Human; identical to SEQ ID NO: 329563

SEQ ID NO: 329615 - RNA, 64 nt, Human; identical to SEQ ID NO: 329564

SEQ ID NO: 329616 - RNA, 64 nt, Human; identical to SEQ ID NO: 329565

SEQ ID NO: 329617 - RNA, 63 nt, Human; identical to SEQ ID NO: 329566

SEQ ID NO: 329618 - RNA, 64 nt, Human; identical to SEQ ID NO: 329567

SEQ ID NO: 329619 - RNA, 64 nt, Human; identical to SEQ ID NO: 329568

SEQ ID NO: 329620 - RNA, 64 nt, Human; identical to SEQ ID NO: 329569

SEQ ID NO: 329621 - RNA, 64 nt, Human; identical to SEQ ID NO: 329570

SEQ ID NO: 329622 - RNA, 64 nt, Human; identical to SEQ ID NO: 329571

SEQ ID NO: 329623 - RNA, 64 nt, Human; identical to SEQ ID NO: 329572

SEQ ID NO: 329624 - RNA, 64 nt, Human; identical to SEQ ID NO: 329573

SEQ ID NO: 329625 - RNA, 64 nt, Human; identical to SEQ ID NO: 329574

SEQ ID NO: 329626 - RNA, 64 nt, Human; identical to SEQ ID NO: 329575

SEQ ID NO: 329627 - RNA, 64 nt, Human; identical to SEQ ID NO: 329576

SEQ ID NO: 329628 - RNA, 64 nt, Human; identical to SEQ ID NO: 329577

SEQ ID NO: 329629 - RNA, 64 nt, Human; identical to SEQ ID NO: 329578

SEQ ID NO: 329630 - RNA, 64 nt, Human; identical to SEQ ID NO: 329579

SEQ ID NO: 329631 - RNA, 64 nt, Human; identical to SEQ ID NO: 329580

SEQ ID NO: 329632 - RNA, 64 nt, Human; identical to SEQ ID NO: 329581

SEQ ID NO: 329633 - RNA, 64 nt, Human; identical to SEQ ID NO: 329582

SEQ ID NO: 329634 - RNA, 64 nt, Human; identical to SEQ ID NO: 329583

SEQ ID NO: 329635 - RNA, 64 nt, Human; identical to SEQ ID NO: 329584

SEQ ID NO: 329636 - RNA, 64 nt, Human; identical to SEQ ID NO: 329585

SEQ ID NO: 329637 - RNA, 64 nt, Human; identical to SEQ ID NO: 329586

SEQ ID NO: 329638 - RNA, 64 nt, Human; identical to SEQ ID NO: 329587

SEQ ID NO: 329639 - RNA, 64 nt, Human; identical to SEQ ID NO: 329588

SEQ ID NO: 329640 - RNA, 64 nt, Human; identical to SEQ ID NO: 329589

SEQ ID NO: 329641 - RNA, 64 nt, Human
gggccuuccaccucccucagcuuccugcauggacccaccuuacuggccagucugcauccuugcc

SEQ ID NO: 329642 - RNA, 64 nt, Human
cuaaguguuuuucuucgugguccccuucuucuccccaccuuauuccauucuuaacucugcauuc

SEQ ID NO: 329643 - RNA, 64 nt, Human
ugguuuugguugcuccucccccagcugccaccccccaccuuacccuuauuccucucuguccaca

SEQ ID NO: 329644 - RNA, 64 nt, Human
uuacccuuauuccucucuguccacauuuucugccccaccuuacuucuccucccugacagacauc

SEQ ID NO: 329645 - RNA, 64 nt, Human
agaaaauauauuaacgcagucuuguaggcagcugccaccuuaugcagugcaucgaaaccuuuug

SEQ ID NO: 329646 - RNA, 64 nt, Human; identical to SEQ ID NO: 305637

SEQ ID NO: 329647 - RNA, 64 nt, Human; identical to SEQ ID NO: 308109

SEQ ID NO: 329648 - RNA, 64 nt, Human; identical to SEQ ID NO: 308127

SEQ ID NO: 329649 - RNA, 64 nt, Human
ugaugacauuccaccauugugauuuguuccugccccaccuuaacugagcgauuaaccugugaac

SEQ ID NO: 329650 - RNA, 64 nt, Human
uacaauuuggcucuccacugagcaccuuaucuugccaccuuagccuuaagaaugaauaugaaga

SEQ ID NO: 329651 - RNA, 64 nt, Human
agagacucaacagucucugcaauggaguguggguccaccuuagccucugacuuccuaauguagg

SEQ ID NO: 329652 - RNA, 64 nt, Human
uuugaggagcuauuuuuguuauucuuguaacgcuccaccuuacaugccacaucugugugaguca

SEQ ID NO: 329653 - RNA, 64 nt, Human
ugaagguugcuguagagcaucugaccccuuauuaccaccuuaagcaauguauaugccaugcauu

SEQ ID NO: 329654 - RNA, 64 nt, Human
gauuacacuggaacuacaggaaugauuccuuugaccaccuuaaaaacuuucacagugguuccgc

SEQ ID NO: 329655 - RNA, 64 nt, Human
ugucaaauagucauaaaguccccuauccuuuaccccaccuuauacacacgaggcuuucucagga

SEQ ID NO: 329656 - RNA, 64 nt, Human
auaauccucacugaugauuucaagcuaaagcaaaccaccuuauacagagaucuagaaucucuuu

SEQ ID NO: 329657 - RNA, 64 nt, Human
guacccuccugugagacagugugugcaggcaccaccaccuuaauccugcuguugccugacaugc

SEQ ID NO: 329658 - RNA, 64 nt, Human
ugcccugagcugaguccuuucccugggagccaggccaccuuagaaugggguuuggaaguaagau

SEQ ID NO: 329659 - RNA, 64 nt, Human
gccccuaaccaucccacacucuucacuuuccuuuccaccuuauucauucucuguacuuaccaca

SEQ ID NO: 329660 - RNA, 64 nt, Human
caaaagcacaggccaguauuaagcagaaguucuaccaccuuauuagaacugcuauaaacaaaag

SEQ ID NO: 329661 - RNA, 64 nt, Human
cugauucauuggguucuguugggcaucuuuaaauccaccuuaaccugaggaauguaugugggca

SEQ ID NO: 329662 - RNA, 64 nt, Human
uguucuugaagcugggcugucucucuccauguuggccugucaccagacccgagucaauuaaaca

SEQ ID NO: 329663 - RNA, 64 nt, Human
gaaaggaagacguuuugauauaguguuacugugagccugucaguaguggguaccaaucuuuugu

SEQ ID NO: 329664 - RNA, 64 nt, Human
accgcgagacugagaggcagaagucagcccgaaugccugucaguuucauggaggggaaacgcaa

SEQ ID NO: 329665 - RNA, 64 nt, Human
cuggggagcuuuugcccacacacuuuccaucucugccugucaauaucguaccugucccuccagg

SEQ ID NO: 329666 - RNA, 64 nt, Human
aggcuggucuugaacuccugaccucaugauccacccaccuuagccucccaaagugcugggauua

SEQ ID NO: 329667 - RNA, 64 nt, Human
aaacaaaaaaggccuugcgacccagcugccauaaccaccuuagaacuaccagacgagcacauca

SEQ ID NO: 329668 - RNA, 64 nt, Human
cacaucaagcaucauuguccccaugcaacaaccaccaccuuauacaucacuuccuguuuuaagc

SEQ ID NO: 329669 - RNA, 64 nt, Human
cugcaugaacucaggcagacccuucauuuaaugaccaccuuagggcugaugauucucaaaucug

SEQ ID NO: 329670 - RNA, 64 nt, Human
ggcaauguuugaacaucugcguuugggucuacugccaccuuagcaagccucauuaaccauuuua

SEQ ID NO: 329671 - RNA, 64 nt, Human
cugcauagaacucucccugcccuaccccuuaacuccaccuuagugccagggccgagggcugguc

SEQ ID NO: 329672 - RNA, 64 nt, Human
auuucuuccagugcaaugaaauucauauggugucccaccuuauuuaaugaugguacaauuuaaa

SEQ ID NO: 329673 - RNA, 64 nt, Human
gaagaguaacuauucuuaagguuuuuacagauacccaccuuaguuguaaauuggauaguuuaua

SEQ ID NO: 329674 - RNA, 64 nt, Human
uuuggugaaagccaaagcacagagucagaagcugccaccuuagagaacugaaauaaaaauagaa

SEQ ID NO: 329675 - RNA, 64 nt, Human
uggggaacacuuacuguacccucucauccuuuuuccaccuuacuguguuaacuuagugacauuu

SEQ ID NO: 329676 - RNA, 64 nt, Human
gggugaaccacuucauucugcaggguucucccucccaccuuaaagaaguuccccuuaugugggu

SEQ ID NO: 329677 - RNA, 64 nt, Human
gcuuucuccuccucuccucccaccaaggauucuuccaccuuaaucuuguuuucauaugccucuu

SEQ ID NO: 329678 - RNA, 64 nt, Human
uauuuucauuguguucuucucuuaaguacaccacccaccuuaacucuuucuugucaggaguaua

SEQ ID NO: 329679 - RNA, 64 nt, Human
gagcugccacaccagucacaugaccugaucacuagccugucauccuuggucuuuguaucuucca

SEQ ID NO: 329680 - RNA, 64 nt, Human
cucggccuuuacuuccgccucccucagagcagcagccugucaaaacaccagauuacaacaaauu

SEQ ID NO: 329681 - RNA, 64 nt, Human
uggcuggcagguugagauguuuuucuuaaacacugccugucagugugaaguggcacagcucuga

SEQ ID NO: 329682 - RNA, 64 nt, Human
caguacagugagaguuaacaauccuaggaauccugccugucacaagcucccaguucccugucau

SEQ ID NO: 329683 - RNA, 64 nt, Human
acagcacugccucuuccuccccaccccacugcccccaccuuaaugugaauuugacugaugaaug

SEQ ID NO: 329684 - RNA, 64 nt, Human
cucugaaagaugaauucacauaugaaaaagggggccaccuuaucuuaguuccagaauuuagucu

SEQ ID NO: 329685 - RNA, 64 nt, Human
cuaggaaguugguuuaaaaugcacacuagugagcccaccuuagacuucuuuuggggccuucgac

SEQ ID NO: 329686 - RNA, 64 nt, Human
cuuauauuuucccgucauucucucugcuaaccuuccaccuuaugcacacacuuucccuauauuu

SEQ ID NO: 329687 - RNA, 64 nt, Human
gaagguuaaucuuacaggcuaccuauguuucucuccaccuuacuaaaaucuaaauaaugauaga

SEQ ID NO: 329688 - RNA, 64 nt, Human
uuauggauggaugaaggauaguaaugcaauaccuccaccuuaauuugggugcauguguaugugu

SEQ ID NO: 329689 - RNA, 64 nt, Human
agaauuagaaaauuuauucauugguggaaccaaaccaccuuagugaguaacccuaagaauugac

SEQ ID NO: 329690 - RNA, 64 nt, Human
uuaacauuaugauuuaaccauuguauuuaauuucccaccuuaugaaacacaacagcagcucccu

SEQ ID NO: 329691 - RNA, 64 nt, Human
cuccaaagguccacgaugggcuuucccaacagcuccaccuuacuucuucucauacuauuuaaga

SEQ ID NO: 329692 - RNA, 64 nt, Human
cgaaauauuuaggauaaacaaaauucuauuuaauccaccuuaaaaccuaaauguauuuucaugg

SEQ ID NO: 329693 - RNA, 64 nt, Human
gcacugcccagcagcccgguuagggcuccuggagccaccuuaggaaagggcuucucaugagcuc

SEQ ID NO: 329694 - RNA, 64 nt, Human
ccagagagguggaggagcuaaaaaagcaauugcuccaccuuacaaauuuggauagaaaggagau

SEQ ID NO: 329695 - RNA, 64 nt, Human
auaaagcucaugaugaacuuuaucacuaguuaugccaccuuaacuagucagauuuccuagaauu

SEQ ID NO: 329696 - RNA, 64 nt, Human
cgacucucuugagaauuucucaacgauugcucaugccugucaguaucagugcuuccaucguucc

SEQ ID NO: 329697 - RNA, 64 nt, Human
gcuuagucaggauugacagauacauucucagcuggccugucauauaaaacauacugucauugag

SEQ ID NO: 329698 - RNA, 64 nt, Human
gauccuuugggcagaugucccauugcucccuggagccugucaugccuguuggggaucaggcagc

SEQ ID NO: 329699 - RNA, 64 nt, Human
ucuucuccagcuuacccuagggugaccaaguagggccugucacaccaggguggcgcagcuuucu

SEQ ID NO: 329700 - RNA, 64 nt, Human
gcagccucaauguccccaggcucagauuguccuuccaccuuagccucuggagcagcugggacua

SEQ ID NO: 329701 - RNA, 64 nt, Human
uuuuucucuucuuguugguauuuguugugauaaaccaccuuaauaaaaucaaguauuaauuuua

SEQ ID NO: 329702 - RNA, 64 nt, Human
ugcucaggcuacaccuccaagggugggaccaggcccaccuuaucuuccuguacuccagaggccc

SEQ ID NO: 329703 - RNA, 64 nt, Human
ggaaaacuugucaucuggcuuugcggagaagguuccaccuuacgcucguaguacauuaucuuua

SEQ ID NO: 329704 - RNA, 64 nt, Human
gccauucagcucucagagacauuguacuaaacaaccaccuuaacacccugaucugcccuuguuc

SEQ ID NO: 329705 - RNA, 64 nt, Human
uacugcauucuguggaucaguuugaacagcuucuccaccuuauuuggacagugauaaauugaac

SEQ ID NO: 329706 - RNA, 64 nt, Human
ugucuaaugacagauaaauccuuaacauuucucuccaccuuaguacuuuagacuaauuguguuu

SEQ ID NO: 329707 - RNA, 64 nt, Human
acgacuugagcccaagaguuccagaccagccuggccaccuuagugagaucccuucucuuaaaaa

SEQ ID NO: 329708 - RNA, 64 nt, Human
ggcuggucuugaacuccuggccucaagucauuccccaccuuagccucccaaaguguugggauua

SEQ ID NO: 329709 - RNA, 64 nt, Human
cauggaauguuguuguguuagccagucugaaagcccaccuuaauuuuuauauaacugucuuuag

SEQ ID NO: 329710 - RNA, 64 nt, Human
uggguaagaaauccccuucuuuggcugggaaucuccaccuuaauccuuaaaggaccauaacugg

SEQ ID NO: 329711 - RNA, 56 nt, Human
gucgcuuugcaaugccauagauccaaccaccuuauuuuugagcuugguguuuuguc

SEQ ID NO: 329712 - RNA, 64 nt, Human
gcccgagccuggggcucccugggcccugccccacccaccuuauccucccaccccacucccucca

SEQ ID NO: 329713 - RNA, 64 nt, Human
cugagaccaugaugcuugggcuuaggaucuugaggccugucacaugggcagcaugugcacaggg

SEQ ID NO: 329714 - RNA, 64 nt, Human
uccgcuucuccuggggcagccaguuuuaaccccagccugucaccgugagcgccccagaagagcg

SEQ ID NO: 329715 - RNA, 64 nt, Human
ucaggaagaaggugccugucggggcucacuugaagccugucagggaugcuuuguaucuaacaca

SEQ ID NO: 329716 - RNA, 64 nt, Human
auuggacuucauuaugcuuuugaaaugcuuaucugccugucacauaaguuaaacuauuuaauuu

SEQ ID NO: 329717 - RNA, 64 nt, Human
augugcuauuuccuuggcgaguugagggaauuugccaccuuacagaguuuguaucacugaauua

SEQ ID NO: 329718 - RNA, 64 nt, Human
ugagaaaaauggaugguauuuucuuaaaauugugccaccuuagagcccccccccuuuuuuuuuu

SEQ ID NO: 329719 - RNA, 64 nt, Human
auuauuccauaugacaguuguuuugaguuucguaccaccuuauuguccccuuauacagauaagg

SEQ ID NO: 329720 - RNA, 64 nt, Human
uauccugaucuuagagccccccucccccugccacccaccuuacuguuuaaccuggauuuuuuuu

SEQ ID NO: 329721 - RNA, 64 nt, Human
auccuuggcaucccccuaaacaaacaagaggugaccaccuuauugugagguuccauccagccaa

SEQ ID NO: 329722 - RNA, 64 nt, Human
aaugacaauaaacaaaccccugugugccuaccacccaccuuauugccuuuccuuugagguaccg

SEQ ID NO: 329723 - RNA, 64 nt, Human
ucuguacauauggggacaucgguccaagcccaacccaccuuagcauguaucacucuguggagaa

SEQ ID NO: 329724 - RNA, 64 nt, Human
uguaaccucgaauuccugggcucaagcaacccucccaccuuagccucccuaguagcugggacua

SEQ ID NO: 329725 - RNA, 64 nt, Human
uccacacuggauuaugagauacuuaacaauuuuuccaccuuauauuucuuuuacacauuuugcu

SEQ ID NO: 329726 - RNA, 64 nt, Human
acggucaccuucaacgcccagacacucccuucucccaccuuaguugguuacagggugagugaga

SEQ ID NO: 329727 - RNA, 64 nt, Human
guagugaauguaaggaaagcuuaauggaucucucccaccuuaauaaaugggagagcaucccuaa

SEQ ID NO: 329728 - RNA, 64 nt, Human
guagcaguugugaaagagucuucagucguaguguccaccuuacucaacaucagaaaauucacaa

SEQ ID NO: 329729 - RNA, 64 nt, Human
aagcacugauaaauuaaaaaaaaaaaauuagacuccaccuuaaguaguaaaguauaacaggauu

SEQ ID NO: 329730 - RNA, 64 nt, Human; identical to SEQ ID NO: 308163

SEQ ID NO: 329731 - RNA, 64 nt, Human; identical to SEQ ID NO: 307932

SEQ ID NO: 329732 - RNA, 54 nt, Human; identical to SEQ ID NO: 308073

SEQ ID NO: 329733 - RNA, 64 nt, Human; identical to SEQ ID NO: 308181

SEQ ID NO: 329734 - RNA, 64 nt, Human
guguucucggggaugcauagauucaucauuuucuccaccuuaaaaaugcgggcauuuaagucug

SEQ ID NO: 329735 - RNA, 64 nt, Human
aagcguucccuuuccccuucuuauuuaagacuucccaccuuacuaaauuaccagcaaaacaaac

SEQ ID NO: 329736 - RNA, 64 nt, Human
gccuucaccccucugcucuuccgcaucaccccauccaccuuacagggaccagggggcccacgua

SEQ ID NO: 329737 - RNA, 64 nt, Human
ugacaaaggacucgcgcaacgcagaaggccuuucccaccuuaagcuuccggggaucugggaauu

SEQ ID NO: 329738 - RNA, 64 nt, Human
caugaucaguucuggaccgcuauggauuccagauccaccuuacguagccgugugagcuccggua

SEQ ID NO: 329739 - RNA, 64 nt, Human
caauauccugugcacauccacgcccuccugugugccaccuuacagcucaugcagaacugucuac

SEQ ID NO: 329740 - RNA, 64 nt, Human
ugcagccuccagcucccaggcucaagcguuucucccaccuuagccuccugaguagcugggacua

SEQ ID NO: 329741 - RNA, 64 nt, Human
aaagaaagaaaaagggaaguaccaauggguuuuuccaccuuauuuuuaccuuugaucuacccuu

SEQ ID NO: 329742 - RNA, 64 nt, Human
uugagcuuuaagauaggauuauuggggcuuacccccaccuuaauuagagaaacauuuauauugc

SEQ ID NO: 329743 - RNA, 64 nt, Human
cuuccaacugcccuuucuucugauggcuauuccuccaccuuauucccagccccuggaaacuuug

SEQ ID NO: 329744 - RNA, 64 nt, Human
cuggaagccacccugcuuuagaucacucggguccccaccuuagaaggguccccgccuuagauca

SEQ ID NO: 329745 - RNA, 64 nt, Human
caaccuuuauuugcacuuggguuccaguucaaagccaccuuagacaguguggcaaagugggaaa

SEQ ID NO: 329746 - RNA, 64 nt, Human
uguauuaacugcuccugggccuggagcaguauucccaccuuaagauucccagcaucccugugcu

SEQ ID NO: 329747 - RNA, 64 nt, Human; identical to SEQ ID NO: 307967

SEQ ID NO: 329748 - RNA, 64 nt, Human; identical to SEQ ID NO: 308146

SEQ ID NO: 329749 - RNA, 64 nt, Human; identical to SEQ ID NO: 304152

SEQ ID NO: 329750 - RNA, 64 nt, Human; identical to SEQ ID NO: 308200

SEQ ID NO: 329751 - RNA, 64 nt, Human
uccacugacauuucuuagacauucagcaaaacccccaccuuaaccucuuuucuuucuugagggu

SEQ ID NO: 329752 - RNA, 64 nt, Human
augaagccaauucauuuugaaggaagcacaauuuccaccuuauuuuuugaacuuuggcaguuuc

SEQ ID NO: 329753 - RNA, 64 nt, Human
uuuauuuuucuuuucacucucuuucuaaugcuucccaccuuaccuuuuagauucuuuugcuagg

SEQ ID NO: 329754 - RNA, 64 nt, Human
uggaaccagauggcacugagaaaaagaaugagaaccaccuuauucuucugaaaaagacuuucuu

SEQ ID NO: 329755 - RNA, 64 nt, Human
ccugauaagaauauuuuguuucugcugcuucuguccaccuuaauauucuccuucuauuuguaga

SEQ ID NO: 329756 - RNA, 64 nt, Human
cucacuccucuucucccugcccugaucagauuccccaccuuacccgggcccuacaggagccugu

SEQ ID NO: 329757 - RNA, 64 nt, Human
gguuuuguaauguuacaugugaugauaugagcucccaccuuauaugggggaacaucuugggaau

SEQ ID NO: 329758 - RNA, 64 nt, Human
uuuugguaaaaucuucauuuccugguuuuuuuuaccaccuuauuuaaaucucgauuaucugcuc

SEQ ID NO: 329759 - RNA, 64 nt, Human
aucagauuucaaggcccacaacuuggggacuagaccaccuuauguugagggaacucugccaccu

SEQ ID NO: 329760 - RNA, 64 nt, Human
augccuccccauggauuggggccucccaggccccccaccuuaugucaaccugcacuucuuguuc

SEQ ID NO: 329761 - RNA, 64 nt, Human
cugugauuuuuaucaguaauggccaugccuccacccaccuuaguuaggagcuacuuccaaaaag

SEQ ID NO: 329762 - RNA, 64 nt, Human
cuucccucauaugagcagugauuuuauuuguuacccaccuuagauagacuaagaaaguucuagu

SEQ ID NO: 329763 - RNA, 64 nt, Human
ggccuccguucaccccaccccaccccaccucuccccaccuuacccccgccccgcuuggcuucuu

SEQ ID NO: 329764 - RNA, 64 nt, Human; identical to SEQ ID NO: 307792

SEQ ID NO: 329765 - RNA, 64 nt, Human; identical to SEQ ID NO: 307827

SEQ ID NO: 329766 - RNA, 64 nt, Human; identical to SEQ ID NO: 307860

SEQ ID NO: 329767 - RNA, 64 nt, Human; identical to SEQ ID NO: 307915

SEQ ID NO: 329768 - RNA, 64 nt, Human
aacucagaauuauuuaaagcauucauguuucuccccaccuuauccccaucccaccuuuauuauu

SEQ ID NO: 329769 - RNA, 64 nt, Human
cugaguuauuaggaaacagaaggcaaaaagauugucaaaauaaaaacaauaauucaaguaacaa

SEQ ID NO: 329770 - RNA, 64 nt, Human
gaaugcaaguguacugucauucauaguguuuauaucaaaauaccaggaaucuucacuuuugcua

SEQ ID NO: 329771 - RNA, 64 nt, Human
guggccacaggcuagauccccggugguuuugugcucaaaauaaaaagccucagugacccaugag

SEQ ID NO: 329772 - RNA, 64 nt, Human
gccaaggcauuugcaaaaaucucauuaaucuaaaucaaaauagcuuuaaagaaaaaugcauaca

SEQ ID NO: 329773 - RNA, 64 nt, Human
cuucugcagcaggguucugggauguuuucaguggucaaaauacucuguuuagagcaagggcuca

SEQ ID NO: 329774 - RNA, 64 nt, Human
gccuguccucacuggaaaaacagucuccaucuccucaaaauaguugcugacucccugcacccaa

SEQ ID NO: 329775 - RNA, 64 nt, Human
auuauuuugaaaucuccugucuuuuuaaacuuuuucaaaauaggucucuaaggaaaaccagcag

SEQ ID NO: 329776 - RNA, 64 nt, Human
aacguuucuuuaaauauuuauaauguagcuucuuucaaaauauuuucaugaaaaauuacuuuua

SEQ ID NO: 329777 - RNA, 64 nt, Human
aaaaagcaaauaauauugccuucagauuauuucuucaaaauauaacacauaucuagauuuuucu

SEQ ID NO: 329778 - RNA, 64 nt, Human
auuaauuccauaccuuugauuaaaacaugcuaguucaaaauaagacugcucaguuuccaagggu

SEQ ID NO: 329779 - RNA, 64 nt, Human
acuuaaguauauuugguagggugaguguuuccacucaaaauaugucaacuuaaaaaaaaauagg

SEQ ID NO: 329780 - RNA, 64 nt, Human
cucaaccuagggaaaaagaacuaugguuccauauucaaaauaaauauuauagacccuuuuccua

SEQ ID NO: 329781 - RNA, 64 nt, Human
caaauauacauuuucuaaauaaaaauauguaauuucaaaauacauuuguaaguguaaaaaaugu

SEQ ID NO: 329782 - RNA, 64 nt, Human
auuuuuauagccauaaaagaaaaucuuuaggcuuucaaaauaaggaugacuuuagaauaauauu

SEQ ID NO: 329783 - RNA, 64 nt, Human
uuguuuuugcacauuugaaaaugccacccauggaucaaaauauacccaaacguuuuuuacuuuc

SEQ ID NO: 329784 - RNA, 64 nt, Human; identical to SEQ ID NO: 304205

SEQ ID NO: 329785 - RNA, 64 nt, Human; identical to SEQ ID NO: 307773

SEQ ID NO: 329786 - RNA, 64 nt, Human; identical to SEQ ID NO: 31718

SEQ ID NO: 329787 - RNA, 64 nt, Human
ccagagucucccaaauccugucccgcacucucucccaccuuauuaauggccagcucaucuuuca

SEQ ID NO: 329788 - RNA, 64 nt, Human
aaauugaaacauaauuucacaauuauuccuuuuuccaccuuaaauaauaagaguagaauacuuu

SEQ ID NO: 329789 - RNA, 64 nt, Human
aucauaccuaagagguuaggaaauggugccauucccaccuuagagugcuacauaggugcuuugg

SEQ ID NO: 329790 - RNA, 64 nt, Human
cagcugcugcuuaaugcccugcucucucccuggcccaccuuauagagagcccaaagagcuccug

SEQ ID NO: 329791 - RNA, 64 nt, Human
ugcccagcccugcuggcaaucucuccaucagaauccaccuuaggccucagcuggagggcugcag

SEQ ID NO: 329792 - RNA, 64 nt, Human
agcuggguacaguuucuuggcacucuguaaggggccaccuuaaucauaccaaauauuggggaaa

SEQ ID NO: 329793 - RNA, 64 nt, Human
gucgcaugggcuagaucucaggugugguguugagccaccuuaagaugagggcugcuucgcagua

SEQ ID NO: 329794 - RNA, 64 nt, Human
ccugauguguagacgcucacuuccaguagcagaaccaccuuaguugugucuuacagauucugaa

SEQ ID NO: 329795 - RNA, 64 nt, Human
agaauugaagcaaaucccuaagauuuauuuuuuuccaccuuauuuaucuucuaaaacuugagga

SEQ ID NO: 329796 - RNA, 64 nt, Human
caggucuggggccugaggcagggagaaugagaggccaccuuacuggcaggaaggaucaggaugg

SEQ ID NO: 329797 - RNA, 64 nt, Human
cucaccuggggcucuacgagauguugcuggggcuccaccuuaaauugugacuaaaaacaguuuu

SEQ ID NO: 329798 - RNA, 64 nt, Human
cuaaaauucuuauaggugaggaucauuuuuccccccaccuuaggauggugaauguugcaacaca

SEQ ID NO: 329799 - RNA, 64 nt, Human
aaguuugaguuuaggaguaagaacauaucucagaccaccuuagucagcuuugcugaugggauuu

SEQ ID NO: 329800 - RNA, 64 nt, Human; identical to SEQ ID NO: 31722

SEQ ID NO: 329801 - RNA, 64 nt, Human; identical to SEQ ID NO: 31729

SEQ ID NO: 329802 - RNA, 64 nt, Human; identical to SEQ ID NO: 31736

SEQ ID NO: 329803 - RNA, 64 nt, Human; identical to SEQ ID NO: 31741

SEQ ID NO: 329804 - RNA, 64 nt, Human
gaggaaggaaauguucauuuucauuuguccaaaaccaccuuaaguuuuaaguauauuaaucuug

SEQ ID NO: 329805 - RNA, 64 nt, Human
uccaccacucuauucagguaaaacaaugaaugagccaccuuagcaggagcagauuuuucccaga

SEQ ID NO: 329806 - RNA, 64 nt, Human
acaacugaucauuugcagcugcugguuuugguuuccaccuuacccuacuggcuguaaaaacaca

SEQ ID NO: 329807 - RNA, 64 nt, Human
uaucuuguauauacaacuuuguauccugccuuuuccaccuuaucguuccaucacuuuauuccag

SEQ ID NO: 329808 - RNA, 64 nt, Human
gggccaccagccaagggcccuggccacgugugcgccaccuuacuuuggaagucucuggcuugug

SEQ ID NO: 329809 - RNA, 64 nt, Human
gggccaggaggaguaacagaaccaggucugcuccccaccuuacucggauggccucccugccccu

SEQ ID NO: 329810 - RNA, 61 nt, Human
caaguacagaaccugccugaguaugaccucuccaccuuauaguuuaugaaugucuuguuug

SEQ ID NO: 329811 - RNA, 64 nt, Human
gcggcugugggcaccacagcucuuguggggcagcccaccuuagaaccugacuagcgagggaccu

SEQ ID NO: 329812 - RNA, 64 nt, Human
ggccugggcguggucuugcaaaaugcuuccaaagccaccuuagccuguucuauucagcggcaac

SEQ ID NO: 329813 - RNA, 64 nt, Human
uccgccaaguaaaccaugauauaugucuucccuuccaccuuaacuuugccccaacuccucuuuu

SEQ ID NO: 329814 - RNA, 64 nt, Human
ccaguuugugaauucuaguacagcagccaugcagccaccuuauuucauagaugccaucugugug

SEQ ID NO: 329815 - RNA, 64 nt, Human
cucaccagcucugcaccccucuggggagccuuccccaccuuagcugucuccugccccagggagg

SEQ ID NO: 329816 - RNA, 64 nt, Human
uugcaaagagauccaguaccuaguauuggaagauccaccuuaacgaccgugcauaugaaaacca

SEQ ID NO: 329817 - RNA, 64 nt, Human; identical to SEQ ID NO: 31748

SEQ ID NO: 329818 - RNA, 64 nt, Human; identical to SEQ ID NO: 31752

SEQ ID NO: 329819 - RNA, 54 nt, Human; identical to SEQ ID NO: 31758

SEQ ID NO: 329820 - RNA, 64 nt, Human; identical to SEQ ID NO: 31763

SEQ ID NO: 329821 - RNA, 64 nt, Human
gccccagaacacccacaggucuugguaacaaacgccaccuuacacucugcaggcugcagcggca

SEQ ID NO: 329822 - RNA, 64 nt, Human
gcuggucucgaacuccugaacucaagugauucacccaccuuagccucccaaagugcugggauua

SEQ ID NO: 329823 - RNA, 64 nt, Human
ugaaguguuauuaugccacagacauuaaccuauuccaccuuacucaaggguguacguaaaacau

SEQ ID NO: 329824 - RNA, 64 nt, Human
ucaguaauuuugcagcagagaaauauggccaacuccaccuuaaccaaguggcugaaagucacug

SEQ ID NO: 329825 - RNA, 64 nt, Human
aaugcaauccaugccauaagcaggaguugauacaccaccuuauuagcuaaaaauauauauaaca

SEQ ID NO: 329826 - RNA, 64 nt, Human
uccuguccccuccuuccagccugagauguaggcuccaccuuaacugugcucagauacacaagug

SEQ ID NO: 329827 - RNA, 64 nt, Human
gugccauggagaccuccuauggaaaaaugaucagccaccuuaccuucuacuggguaccugcugu

SEQ ID NO: 329828 - RNA, 64 nt, Human
gucccugaucuggcucauuccccaccuucaacucccaccuuacaugucucacacuaucccaugg

SEQ ID NO: 329829 - RNA, 64 nt, Human
auugcuacuguuuucuuaaaguuaacuucaggguccaccuuauguugcacacauaucacaucgu

SEQ ID NO: 329830 - RNA, 64 nt, Human
uugucccagcagguggccuugaucucuccaugccccaccuuaagugguaagcauguuuaauuau

SEQ ID NO: 329831 - RNA, 64 nt, Human
ugucugcgugaaugagcguggccaaggaccagugccaccuuauggcaaagagcucccgcagugu

SEQ ID NO: 329832 - RNA, 64 nt, Human
auugaaugguuuuauuuaauucuccuuuacauugccaccuuaacaauccuuccagcuacguauc

SEQ ID NO: 329833 - RNA, 64 nt, Human
ggucuguuugccaccaagggguaaagcuccauucccaccuuaggagggcuaggaggcagcaucg

SEQ ID NO: 329834 - RNA, 64 nt, Human; identical to SEQ ID NO: 31768

SEQ ID NO: 329835 - RNA, 64 nt, Human; identical to SEQ ID NO: 31771

SEQ ID NO: 329836 - RNA, 64 nt, Human; identical to SEQ ID NO: 31777

SEQ ID NO: 329837 - RNA, 64 nt, Human; identical to SEQ ID NO: 31781

SEQ ID NO: 329838 - RNA, 64 nt, Human
cacucaacgacguuugugcgacauaguauuguauccaccuuaguauuguaucgagccuuuucug

SEQ ID NO: 329839 - RNA, 64 nt, Human
cacccacccccggcccguccucguccuggguaccccaccuuaguaaauggcgccaccaucugcc

SEQ ID NO: 329840 - RNA, 64 nt, Human
agugccucacacaaaaaacguagaguauagaaauccaccuuaaagccccucgccccaacuucuc

SEQ ID NO: 329841 - RNA, 64 nt, Human
auucuuuuggaauguaaaccgauuuaaugccaaaccaccuuaaccuuuguuucucaguguuccu

SEQ ID NO: 329842 - RNA, 64 nt, Human
aaauugauugucaaauacagcauuucuuuggaaaccaccuuaaaacauuagugcuaugguuaug

SEQ ID NO: 329843 - RNA, 64 nt, Human
auuaaauuuauaaaugcaguugucuuguuacaagccaccuuacgcaaccgcgcugcagggguga

SEQ ID NO: 329844 - RNA, 64 nt, Human
uuccuggcugucacuuggagccaacaguaacuugccaccuuaaggcagggucauccccgggcca

SEQ ID NO: 329845 - RNA, 64 nt, Human
ccuucacccuucagccucccgcuccaggcacaucccaccuuaccucucacuuggcugauuugac

SEQ ID NO: 329846 - RNA, 64 nt, Human
cuuugugcuuuugaagauggauugaagagaacguccaccuuaaggcuuuaaaagacagugaagc

SEQ ID NO: 329847 - RNA, 64 nt, Human
agaccuugucuggaaggcccuggaaggagaagcaccaccuuacccauucgggccaguuucuccc

SEQ ID NO: 329848 - RNA, 64 nt, Human
cuuuucagcuuucagaugccacuacauuguuauuccaccuuaucuuugcgucagguuaacauau

SEQ ID NO: 329849 - RNA, 64 nt, Human
gcaagguugugcuuucaaacacauauuaguccuaccaccuuaguuccucuacagcaaaagaggc

SEQ ID NO: 329850 - RNA, 64 nt, Human
cuucgaagggcaggacuggggauaaucagaaccugccugucaccucagggcaucacugaacaaa

SEQ ID NO: 329851 - RNA, 64 nt, Human
aggguacacucuucuccauucccuccacccacuugccugucaccccagucaccuaagcaaucac

SEQ ID NO: 329852 - RNA, 64 nt, Human
caaaaauacaaauuaacugggcauccugucaugcgccugucaucccagcuacuugagaggcuga

SEQ ID NO: 329853 - RNA, 64 nt, Human
caccagucuuuuguguuugcuuuuuaaaauaaagugcucguauuuguauucuccauauuuugga

SEQ ID NO: 329854 - RNA, 64 nt, Human
agaguuauaugacuucuuguucauguuuugcuaaugcucguaucuccuugauuacauaauguua

SEQ ID NO: 329855 - RNA, 64 nt, Human
uuauuuuuaaaaaucauguuugacaucuuucuauugcucguaaccagucccuguagcugucuaa

SEQ ID NO: 329856 - RNA, 64 nt, Human
ggagagucuggcuacucucucguuuccuuucuguugcucguagcugcugaaauuccucuccgcc

SEQ ID NO: 329857 - RNA, 64 nt, Human
cucuucuaucucuguuauacgccggggcauagaaugcucguauacaucucuuuaacaaccacaa

SEQ ID NO: 329858 - RNA, 64 nt, Human
augagcagugaucuccaaggccagcugcagggccugcucguacacuugcucaaccuggaccagc

SEQ ID NO: 329859 - RNA, 64 nt, Human
uuggcgggaggcaccggccacaggcccauucaucugcucguagaaucuccuuucugcgucguca

SEQ ID NO: 329860 - RNA, 64 nt, Human
gagcgcucaguaucucaagagacucuguucauucugcucguaucccaaggccugguuggucaaa

SEQ ID NO: 329861 - RNA, 64 nt, Human
uuuccuucgugaaccauagugggcucuucacuccugcucguaauaaccaccuccaaauuuguua

SEQ ID NO: 329862 - RNA, 64 nt, Human
gagcuucacccacaaacucaggagaacauaagccugcucguaaagcucaauccuucuaucaugg

SEQ ID NO: 329863 - RNA, 64 nt, Human
uaauuauuuugagauucauaugucuccaucuugaugcucguaugaauucauucuuuuaaauguu

SEQ ID NO: 329864 - RNA, 64 nt, Human
cugagcacagggggccuccaggagacccuagaugugcucguacucccucggccugggauuucag

SEQ ID NO: 329865 - RNA, 64 nt, Human
uuucugaauauagacuuucugggaaaagguuuacugcucguaaggaaacauuuuauguauuaaa

SEQ ID NO: 329866 - RNA, 64 nt, Human
cagacuauucacaaaacagauucuaaaauuuguuugcucguaugcuguucccuucaaugugaua

SEQ ID NO: 329867 - RNA, 64 nt, Human
uauaggccugggacccccgcccagcuuggggggcugcucguacgaguguagacacugggcccau

SEQ ID NO: 329868 - RNA, 64 nt, Human
caagugugaagaauguggcaaaacuuuuaauuaaugcucguaccuuauugcacaggaaagaauu

SEQ ID NO: 329869 - RNA, 64 nt, Human
uugaaaauccgggaagcaggugugauuacuuuuuugcucguagauauuguccuaaguuggaauu

SEQ ID NO: 329870 - RNA, 64 nt, Human
aauaguagauggguucauugggccucagaaguucugcucguauuuuaggugggugugaagugaa

SEQ ID NO: 329871 - RNA, 64 nt, Human
ugguuaggaaggauguucaaacggucccacccaagccugucaccucugcucauccuccaagacc

SEQ ID NO: 329872 - RNA, 64 nt, Human
uuugggauuguuacugguugaagugggggcagaugccugucaccaagguguugacugugugaga

SEQ ID NO: 329873 - RNA, 64 nt, Human
caagugacguccacugccuugucaccagcgaccugccugucaugcccacccccugaggaagcau

SEQ ID NO: 329874 - RNA, 64 nt, Human
augaguaccuacuguguguagaagcagcaggacagccugucaucacugggaaagaggccagaag

SEQ ID NO: 329875 - RNA, 64 nt, Human
aagcgcugcgucuguguguccaauaccauucgaagccugucauuugugccaggcaaugacuuug

SEQ ID NO: 329876 - RNA, 64 nt, Human
ucuggcauuccugaauccuucuucccugccaggugccugucaccugucuucacugccuccuuuu

SEQ ID NO: 329877 - RNA, 64 nt, Human
acuaacaugcccuguucagcuacucccacucccggccugucauucagaaaaaaauaaauguucu

SEQ ID NO: 329878 - RNA, 64 nt, Human
gccuaggacccaagcccugaggccugaggccugugccugucaggcucuggcccuugccuuugug

SEQ ID NO: 329879 - RNA, 64 nt, Human
uggcuucaguguagacagauuaaacaaagcccaagccugucagccacagaaacaggcucuccuc

SEQ ID NO: 329880 - RNA, 64 nt, Human
cgguuuacucagagucagggguguagcucuggcugccugucagcucccuuggauacuauauugu

SEQ ID NO: 329881 - RNA, 64 nt, Human
guggugcugggggguauagccccccauccuugaggccugucacccacacaguaggugcugagag

SEQ ID NO: 329882 - RNA, 64 nt, Human
gccaguggaaauguuccauaagggagaguucaaggccugucagaaggcucugguaggccuuccu

SEQ ID NO: 329883 - RNA, 64 nt, Human
aguuugccaaacauuugucgugguuaccagugcagccugucaaauucugcuauuugacacagcu

SEQ ID NO: 329884 - RNA, 64 nt, Human
aggccagcucaggucacccgggccucugacccaggccugucacuuugagaggggcaaaacugag

SEQ ID NO: 329885 - RNA, 64 nt, Human
cuugauuuuuguugcuguuuccugaccuguucuugccugucaccugggccuacacaggucccga

SEQ ID NO: 329886 - RNA, 64 nt, Human
gugcccuugcaauauuuccauugccccccaaggagccugucacuagcuaagaaauuucuacaug

SEQ ID NO: 329887 - RNA, 64 nt, Human
augcccgcugcagcccugggaucagcuggaagcugccugucaucuccugcccaauccccagaaa

SEQ ID NO: 329888 - RNA, 64 nt, Human
ggcacccaugggacacccucugcccccagccgcagccugucagagcucugccuggcuguuccag

SEQ ID NO: 329889 - RNA, 64 nt, Human
ggggccucccuuguuccgaccugucaauucugcugccugucacgcgggugguucugcccaucgc

SEQ ID NO: 329890 - RNA, 64 nt, Human
ccuggaagguucaggggccgcucuucccccaugugccugucacgcucuggugcagucaaaggaa

SEQ ID NO: 329891 - RNA, 64 nt, Human
uccccuuuccugggggaugugcacggcagcuugagccugucacguggucaaggcccggccccau

SEQ ID NO: 329892 - RNA, 64 nt, Human
caggguauagacaugaaugaugauauucugccuggccugucauuucuuaccuggaaacauuuac

SEQ ID NO: 329893 - RNA, 64 nt, Human
uagcauuuccauucagugaauggagcugauguuugccugucauuuuaagaugauaccauaccuu

SEQ ID NO: 329894 - RNA, 64 nt, Human
ucaaaaagcugccugggaggcagauggaacuugagccugucaagaggcaaaggaauccauguag

SEQ ID NO: 329895 - RNA, 64 nt, Human
uuuaacucuuuauuaaaucuuucuuuaaauuucugccugucagucuauauugcuguuuuuauua

SEQ ID NO: 329896 - RNA, 64 nt, Human
gguugacguuagaaccucccuucugcagacuguugccugucaucuaagcgaauuggaaaugcug

SEQ ID NO: 329897 - RNA, 64 nt, Human
aucuuuccuuuuuuuuuaauguaucuuaacuguugccugucaguguuuacaaacuagugcguug

SEQ ID NO: 329898 - RNA, 64 nt, Human
agugaaggaaaaaagccugcucuccaguagccuggccugucagccuggaggaaucaggaaagac

SEQ ID NO: 329899 - RNA, 64 nt, Human
accuuucggcaaggacgguaacuuggcugcauuugccugucaugcgcaacuggagccagcaacc

SEQ ID NO: 329900 - RNA, 64 nt, Human
caaggcuccaggcagguuguuacugguguuugcagccugucaguacuugcaguacuggaauagg

SEQ ID NO: 329901 - RNA, 64 nt, Human
ccugaauaggaguaguaaagccucaaggacaucugccugucacaauauauucucaaagugaucu

SEQ ID NO: 329902 - RNA, 64 nt, Human
uguauguguaauaaauauguuucacacaaacaaggccugucagcuaaagaaguuugaacauuug

SEQ ID NO: 329903 - RNA, 64 nt, Human
ucacagggauccagagaugguaaaauucaaaacagccugucaaguucaaaacagagaggugaaa

SEQ ID NO: 329904 - RNA, 64 nt, Human
auccaaucucucaccaucucuaaagcagccguuggccugucaucagugagauacaauccagucu

SEQ ID NO: 329905 - RNA, 64 nt, Human
uuaauagcaaccagggccgggugucguggcucacgccugucaucccagcacuuugggaggccga

SEQ ID NO: 329906 - RNA, 64 nt, Human
agaguaaggaagguagcagauauaggugcagggugccugucauucacuguguuauuugguuuaa

SEQ ID NO: 329907 - RNA, 64 nt, Human
cucuccuaggcuggagcucuccugcuugccaccugccugucaagaccauaguuguacugcugcu

SEQ ID NO: 329908 - RNA, 64 nt, Human
cccguccccagggcuggcuggugccccacgcggggccugucaugugaagcucguguccugacuu

SEQ ID NO: 329909 - RNA, 64 nt, Human
cuaacuuaggguuuugagcagguugggguauggugccugucauacccaccugccacccugggaa

SEQ ID NO: 329910 - RNA, 64 nt, Human
ccagaugccuugaucacagccuccauggccaggggccugucaagccaggggcccacacaccugg

SEQ ID NO: 329911 - RNA, 64 nt, Human
aacauuuuuucagacugaacagacuguuggaccagccugucaugauauguuuuagauaaaguuu

SEQ ID NO: 329912 - RNA, 64 nt, Human
aacaguauaaaguucacaauauucuaugucccuagccugucauuuuucagcugcauguaaaagg

SEQ ID NO: 329913 - RNA, 64 nt, Human
uaacucuguaccguuuuauuccucaaggccuauagccugucacuccuugaagccuucucugccu

SEQ ID NO: 329914 - RNA, 64 nt, Human
ggaagacauggcuaguucuuuucagccuuguggagccugucagucgccaucauaccucgaguga

SEQ ID NO: 329915 - RNA, 64 nt, Human
ccucccccaccugccccugauuccccucgucggugccugucaacugcuuuucagcaguggacug

SEQ ID NO: 329916 - RNA, 64 nt, Human
ucagcuauauaauagauaugaggaaaguguuugugccugucagacacuuaaaaaaauaaccuga

SEQ ID NO: 329917 - RNA, 64 nt, Human
aaaaaucaugccagcuaaucaugucaaguucacugccugucagauuguugauauauaccuucug

SEQ ID NO: 329918 - RNA, 64 nt, Human
uguguggauggggucagguugugggccaugccaggccugucagcugcguugacugacugcagca

SEQ ID NO: 329919 - RNA, 64 nt, Human
ggugugcgcugggucucuggugcucuucacuguugccugucacuuuuuuuuuccuuuuuuguaa

SEQ ID NO: 329920 - RNA, 64 nt, Human
aggaugugaggccauuuaauaaaaagggcacaaagccugucagaguuuucaacggugcuuauag

SEQ ID NO: 329921 - RNA, 64 nt, Human
gauuugaagucagaagaccuggguucuugaaccagccugucaaccaguuguaugacuuuaaaca

SEQ ID NO: 329922 - RNA, 64 nt, Human
ugaagagagguuuaccuaaacuuuccuccugggagccugucaucauuugaaaguaacagaagaa

SEQ ID NO: 329923 - RNA, 64 nt, Human
guaacuguucaucuuuguuguuuuaucacuguaagccugucaaaucauaguauccuaagcaucu

SEQ ID NO: 329924 - RNA, 64 nt, Human
acauuuugccuacacuugcuauguaaauauguaugccugucauuuuuguuuccuuuguuccuuu

SEQ ID NO: 329925 - RNA, 64 nt, Human
uguccagagagccaugguguuggccccugaggcagccugucacccauccuaaucugggagagaa

SEQ ID NO: 329926 - RNA, 64 nt, Human
ucgccccgcaggguccaaaggccagcggugaccagccugucacccagcuccuccccgccaaccc

SEQ ID NO: 329927 - RNA, 64 nt, Human
ccagccccccaggagagcugggcacaugucccaagccugucaguggcccucccuggugcacugu

SEQ ID NO: 329928 - RNA, 64 nt, Human
aggccucagggcucccuccggcuuggcagacucagccugucaccccaaaugcagcaauggccug

SEQ ID NO: 329929 - RNA, 64 nt, Human
caguguccaaacugagacauucuggagcuggaaagccugucacacuagagugugugugacaugu

SEQ ID NO: 329930 - RNA, 64 nt, Human
gagggcauagguggccucugcagaggggaccucagccugucacuggcccugaagacuggcccca

SEQ ID NO: 329931 - RNA, 64 nt, Human
gaucgguuggcagcucugcucugugccguccugugccugucacugaguaagaugcaggagaagu

SEQ ID NO: 329932 - RNA, 64 nt, Human
gcuccacccuggacucuggacuucgcagguuccugccugucacgccacccccuuccugggagca

SEQ ID NO: 329933 - RNA, 64 nt, Human
acaauuuauauuuagagagagaacacuuagucuugccugucaaaaaguccaacauuucauaggu

SEQ ID NO: 329934 - RNA, 64 nt, Human
acacucuuggcucguuugggcucaaggcaccgcagccugucagccaacauugccuugcauuugu

SEQ ID NO: 329935 - RNA, 64 nt, Human
ucccucaguggaugucuucccucccccgaccccagccugucaguccgagcacagugcagguuug

SEQ ID NO: 329936 - RNA, 64 nt, Human
cucaaauccuaggggaggccauucccaugagacugccugucacuggaggauggccugcucuuga

SEQ ID NO: 329937 - RNA, 64 nt, Human
ccaccccagaggacuucccuaaaaagcacaaggcgccugucaucgacauuggcauugcuaacac

SEQ ID NO: 329938 - RNA, 64 nt, Human
ggcuguacccccguccacuuacugcgugaccucagccugucaucgacuguugugagcccaauuc

SEQ ID NO: 329939 - RNA, 64 nt, Human
ggauccccagaagugcagagcugagcaggcuugggccugucauggcuggccggaagugucccca

SEQ ID NO: 329940 - RNA, 64 nt, Human
gauauuggucugggaggcaacauuaaugguaccagccugucacaacugagcaguucuaauaaug

SEQ ID NO: 329941 - RNA, 64 nt, Human
cauggguaggagacugcccuggucauggccgccugccugucauuccugacucaccaccgucccc

SEQ ID NO: 329942 - RNA, 64 nt, Human
cagguuguuucgauagcucacacuccugcacugugccugucacccaggugaggauacauaguuc

SEQ ID NO: 329943 - RNA, 64 nt, Human
aauucagccaacguacacauagcuuuaaugaggagccugucauguuuccccauaaauuuauugc

SEQ ID NO: 329944 - RNA, 64 nt, Human
cuaucauaaaccauguuucauguggccuguuagggccugucacuuugggagccggaaggaggug

SEQ ID NO: 329945 - RNA, 64 nt, Human
aagaauauguaauggaccaggcgcagugccucacgccugucaucccagcacuuugggaggcuga

SEQ ID NO: 329946 - RNA, 64 nt, Human
acugugaccuaaauuuaguccuauuguaauaugugccugucacaacacaaauaccccucuugaa

SEQ ID NO: 329947 - RNA, 64 nt, Human
ccuuggauggggaagggccagaugcugggugggugccugucaccuugaggugaccaucuagggc

SEQ ID NO: 329948 - RNA, 64 nt, Human
ccggacugguggccucagcccgccuggcucuggggccugucauugguauuuggccaaggccugc

SEQ ID NO: 329949 - RNA, 64 nt, Human
gaagcugauuugucuguucguaggaugaugugcagccugucacaguggcagccacaggcauuca

SEQ ID NO: 329950 - RNA, 64 nt, Human
cccgggaacccggugggucacacacacgcacugcgccugucaguaguggacauuguaauccagu

SEQ ID NO: 329951 - RNA, 64 nt, Human
cugagugccaagaaugugagaaacacuguaccaugccugucaugcgaaauauuuaaauaaacag

SEQ ID NO: 329952 - RNA, 64 nt, Human
ucuccucauucaaacaguuauuuuggaagguaaagccugucacuuucagcccgggacugcccag

SEQ ID NO: 329953 - RNA, 64 nt, Human
gacagugauuuaccuguccauuuccaacccaaaagccugucagaaagcauucuuuagagaaaac

SEQ ID NO: 329954 - RNA, 64 nt, Human
agaaaaggagagguagcauuuuugcugaaaucgggccugucacucuccaauaaagguucuggca

SEQ ID NO: 329955 - RNA, 64 nt, Human
gccugccagggacccggcgcguccucgguuucucgccugucaucaucgacagacaugucagccg

SEQ ID NO: 329956 - RNA, 64 nt, Human
ccaggcgcuggucagugcguguucuuugccaccagccugucacuccaguggcagcuccagaaac

SEQ ID NO: 329957 - RNA, 64 nt, Human
ucugauguaauuucucaacaaaauguggcuuuuagccugucagugaucuauuggaccaaaccuu

SEQ ID NO: 329958 - RNA, 64 nt, Human
ucugcacgaagucaggccagcguccuccuccacagccugucacugcccccuccccagccugugu

SEQ ID NO: 329959 - RNA, 64 nt, Human
cuuuuugauauuccaugacccagugcacgcuguggccugucaccgccaccguggccccgccagc

SEQ ID NO: 329960 - RNA, 64 nt, Human
uucucugccuggccuguuuggacuuuggggcacagccugucacugcucugccuaagagaugugu

SEQ ID NO: 329961 - RNA, 64 nt, Human
gcgugggcaguggccgcccuggggcggggggcgugccugucacugccuggggaggcauuugccu

SEQ ID NO: 329962 - RNA, 64 nt, Human
agcuccacugccgucaacuccuguucuccucagagccugucauccguccuuggcucaggauuug

SEQ ID NO: 329963 - RNA, 64 nt, Human
gggacccuggccaccccccugcugcugucuuggugccugucacccacauggucugccauccuaa

SEQ ID NO: 329964 - RNA, 64 nt, Human
cagacuggagagagaagccugggcaauacugcccgccugucauggccuggugguggcccacacc

SEQ ID NO: 329965 - RNA, 64 nt, Human
gggacauguuugcaauaaaggaaagguuuguggcgccugucauggcaggcaucucauggagcuc

SEQ ID NO: 329966 - RNA, 64 nt, Human
cccgugaacgucuccuuccucccccguaucugccgccugucacuucgccaccgugcuagaauac

SEQ ID NO: 329967 - RNA, 64 nt, Human
accagcuauuuaugagccucugcccccaggcugggccugucacuggcauaggaaggccagcccc

SEQ ID NO: 329968 - RNA, 64 nt, Human
cauuacacccaucccuuugcaaaaucccuauggagccugucaccacuccccucccuauauaccc

SEQ ID NO: 329969 - RNA, 64 nt, Human
gguuccuaguggaggaaagcccauuccagcuguugccugucaaacaaauagaagauggaucucu

SEQ ID NO: 329970 - RNA, 64 nt, Human
gcucccuguagugaaguccaggagggugggacaggccugucaggccucugggaaucucccaaau

SEQ ID NO: 329971 - RNA, 64 nt, Human
augggaccacuucuagaaaucuuucagcugucaggccugucagucucaugacaguuuguugguu

SEQ ID NO: 329972 - RNA, 64 nt, Human
auugggacucgcuucccagucgacacucugcccugccugucauugcugcaaagagcugcugcuu

SEQ ID NO: 329973 - RNA, 64 nt, Human
gaugaaauuuguuuuuguauggugcaauaugacagccugucauugaaucuaaacaacuuaauuu

SEQ ID NO: 329974 - RNA, 64 nt, Human
ugcuucacaccucugcuuggagaggacaagugcagccugucaguuuuagaagcaaguaaaucau

SEQ ID NO: 329975 - RNA, 64 nt, Human
cauggugucucccaacaugggagggaucagccccgccugucacaauaaaguuuauuaugaaaac

SEQ ID NO: 329976 - RNA, 64 nt, Human
gccuugcccucaagaacgucguaccugacgcugagccugucaugagaaugcaacaggagcaaac

SEQ ID NO: 329977 - RNA, 64 nt, Human
cugaagaacaaauggcuguccaguuuauuaaaaugccugucaacugcacuuccagucacccagg

SEQ ID NO: 329978 - RNA, 64 nt, Human
cucugaccggaagagaagucccuaucccacaccugccugucacguucccuccccuuuccccagc

SEQ ID NO: 329979 - RNA, 64 nt, Human
ucgcaagcauuugacaaagacuugcuugucuugggccugucaccuccugaaaggcugcuuuagc

SEQ ID NO: 329980 - RNA, 64 nt, Human
ggaucuuucugacacacuuagggcagaagugaaugccugucacggagggauugaucuucagggc

SEQ ID NO: 329981 - RNA, 64 nt, Human
agaugagcgaguggggcucagcguggcccauggugccugucacucagcauucccaugccugaug

SEQ ID NO: 329982 - RNA, 64 nt, Human
gaaguguaucgauugagggaauuauuuuauucuagccugucaugagucugucugagcaugauac

SEQ ID NO: 329983 - RNA, 64 nt, Human
aguugaagaagaggugagaagaucccaaggugaagccugucaccacgcagacagaacugccccc

SEQ ID NO: 329984 - RNA, 64 nt, Human
gugaaugggaaagggugaggacuucacaauguuggccugucagagcuugauuagaagccaagac

SEQ ID NO: 329985 - RNA, 64 nt, Human
gggcagcagaggcaacucccgcauccuuugcucugccugucaguggucagagcggugagcgagg

SEQ ID NO: 329986 - RNA, 64 nt, Human
aacacgguuuugaaagcaacuccucuguucaaaugccugucauuucacaggucuccucaaccca

SEQ ID NO: 329987 - RNA, 64 nt, Human
guuuccacauuagcacucccuaaggacgcugggagccugucaguuuaugaucugaccuaggucc

SEQ ID NO: 329988 - RNA, 64 nt, Human
ccggcacucuggugaugacagcucagguuucccugccugucacugcucgggcagaggcugcugc

SEQ ID NO: 329989 - RNA, 64 nt, Human
acuuggacacaggguggggaacaucacacaccgggccugucaugggguggggggaggggggagg

SEQ ID NO: 329990 - RNA, 64 nt, Human
ucaggucuugauaguccgucuuggugugaggcaugccugucacgaugaccuagcuaacacugug

SEQ ID NO: 329991 - RNA, 64 nt, Human
cucagggcuugcagccaggacacugcccacuggagccugucaucugccccuuccguguugguga

SEQ ID NO: 329992 - RNA, 64 nt, Human
cuccuggugguacccaaugucaugggaaugaugugccugucacccccauuggacaagcugggga

SEQ ID NO: 329993 - RNA, 64 nt, Human
cuuuuguauucucuuccucauccaccgccacugggccugucacugaugguggcucuggugugaa

SEQ ID NO: 329994 - RNA, 64 nt, Human
gaggacugguuuggggacuggagggcuggcagcagccugucaccgugcgaccgugaccaccugg

SEQ ID NO: 329995 - RNA, 64 nt, Human
agcugguacacucuggccugggucucugaauucagccugucaccgauggcugacugaugaaaug

SEQ ID NO: 329996 - RNA, 64 nt, Human
ugcucugcugaauaauuucauuaccucugcacaugccugucaaauaugaaauuggaagggcccu

SEQ ID NO: 329997 - RNA, 64 nt, Human
uauguagaugauuucagaaugugaaggcugguuugccugucagucauggaaauucacugguaaa

SEQ ID NO: 329998 - RNA, 64 nt, Human
guacauauuuagcaaauuuugguuucuuacaugugccugucaugacuguaauucauuaugacug

SEQ ID NO: 329999 - RNA, 64 nt, Human
cuccaggaagggcuaauggggccaauauauuauugccugucauguggcacauccauguuaaggg

SEQ ID NO: 330000 - RNA, 64 nt, Human
gaccagggggcccgaacagggacuuguuuagagagccugucaccagagcuucucugggcugaau

SEQ ID NO: 330001 - RNA, 64 nt, Human
ugugugcuugucaguggggaccccucgcaacccugccugucaccugggagggugggaccaaugu

SEQ ID NO: 330002 - RNA, 64 nt, Human
auauuugaacaugggcuuguuauuucacugaagugccugucauuuguuuguuuuuaggguuaaa

SEQ ID NO: 330003 - RNA, 64 nt, Human
aaauauuuuuuucuuucuuuguuuuauuuuaauagccugucauagguuuuaaaucugcuuuagu

SEQ ID NO: 330004 - RNA, 64 nt, Human
cuucacuuuaccccuggauaaaggcacuuucacugccugucacugaucagcagauacugacuug

SEQ ID NO: 330005 - RNA, 64 nt, Human
cucccauaguuacagccacuacauccccaccgccgccugucaucccucacgucucuguggccac

SEQ ID NO: 330006 - RNA, 64 nt, Human
aauucuaguuuuuauaagucuuuuuauauauuuagccugucacaacagugcucaagauuguauu

SEQ ID NO: 330007 - RNA, 64 nt, Human
ggaagccucuccuguccuuggcucuucccuccaugccugucagcugccuggggagugagccucc

SEQ ID NO: 330008 - RNA, 64 nt, Human
gaauucaguucccgucucagcuguacuuuugugggccugucaucuugaugaccagaaugaaagc

SEQ ID NO: 330009 - RNA, 64 nt, Human
gccucagcauauacucuucuccuccgaucucacagccugucaugcugcucagugugguucucac

SEQ ID NO: 330010 - RNA, 64 nt, Human
uagaaauaaaagcacaaggcagggcagugcucacgccugucaucccagcacuuugggaggccga

SEQ ID NO: 330011 - RNA, 64 nt, Human
gggacugguuucaacgccagcuuucugugcuucugccugucauucggagaaacucuggcucugg

SEQ ID NO: 330012 - RNA, 64 nt, Human
auuccucaguuauuguuuacuuuucaucauggaagccugucacuguauguaggacauaauagaa

SEQ ID NO: 330013 - RNA, 64 nt, Human
ugucacaaagcuucucucaagagcucucguaguggccugucaaccacuuucggagaaugagcca

SEQ ID NO: 330014 - RNA, 64 nt, Human
cuugagcccagauggggcucagggcccuuccagagccugucauguccuugugcaguggccuuug

SEQ ID NO: 330015 - RNA, 64 nt, Human
agacuucauuuaacacugagugaaauauuacucugccugucaaguuuuuauaccuguacacaca

SEQ ID NO: 330016 - RNA, 64 nt, Human
accucccugacaccugggcuauggagagguuggcgccugucagugaccauccuaaugccucucg

SEQ ID NO: 330017 - RNA, 64 nt, Human
ucuugcuggccaguguuuggaggggaggaugagugccugucacugaggccucacuaugguuggc

SEQ ID NO: 330018 - RNA, 64 nt, Human
cugggaugagucuacucgagcaucuccgggaccugccugucagaucugaggugucuccuugcug

SEQ ID NO: 330019 - RNA, 64 nt, Human
augucaccuucacucacagucugaguucuuguccgccugucacgcccucaccacccuccccuuc

SEQ ID NO: 330020 - RNA, 64 nt, Human
ugcacugugccagggacaggaggguuugugaacugccugucaggguaccuguuagccccugaca

SEQ ID NO: 330021 - RNA, 64 nt, Human
aauuaaacuuagcaaucacgugcucagagcuuuugccugucaguugugugugucccuuauaguc

SEQ ID NO: 330022 - RNA, 64 nt, Human
ggcccucccuccugcacuggccuuggacgguauugccugucagugaaauaaauaaaguccugac

SEQ ID NO: 330023 - RNA, 64 nt, Human
auggcuggccucccagcccccggguggggaccuggccugucaugcagggagagcugugcuccug

SEQ ID NO: 330024 - RNA, 64 nt, Human
ccaugguggcucucaccccagggaccuaggaacagccugucaccacacaauuacuuuuauaacc

SEQ ID NO: 330025 - RNA, 64 nt, Human
cuggacugcaaggaggcugggcacgggggcucacgccugucaccccagagcuuugggaggccaa

SEQ ID NO: 330026 - RNA, 64 nt, Human
ccaagugccccaccacuccccaaccccucuccaggccugucaagagggaggaaggggccccaug

SEQ ID NO: 330027 - RNA, 64 nt, Human
cagccccaaaugucggagaggaagaauucggucagccugucaggucgugaguccaguuaccacc

SEQ ID NO: 330028 - RNA, 64 nt, Human
agcaggcagaaugcccaaaaccaggagcacgaaggccugucauccauggggccauugcaggcac

SEQ ID NO: 330029 - RNA, 64 nt, Human
ggcugcagaagugcuguugguuuggaugcugugugccugucaagauucccuccgguuuucuggc

SEQ ID NO: 330030 - RNA, 64 nt, Human
aauaaaaaucaggagccugcuaaggaacaaugccgccugucaauaaauguugaaaagucauccc

SEQ ID NO: 330031 - RNA, 64 nt, Human
cugaguuucuccuccaucaguacuucauccaaaggccugucauugucauacaucauccagguaa

SEQ ID NO: 330032 - RNA, 64 nt, Human
ggucgucacgcccucccgaggagcucaaggaccugccugucaggaccagggcugggccugccaa

SEQ ID NO: 330033 - RNA, 64 nt, Human
aaauaucuuaauugcucaguagucaaaaggaggagccugucaaaaaguagaaucauaaggacug

SEQ ID NO: 330034 - RNA, 64 nt, Human
ugcccuuuccccccugcugcugccaccgcuuccugccugucauuugaauaaacaguguuucuau

SEQ ID NO: 330035 - RNA, 64 nt, Human
cuugaaugauguuucagugugcaaaaacuauagagccugucagcaccaaagcugacagaaguua

SEQ ID NO: 330036 - RNA, 64 nt, Human
uggggaggaccagggcccugggcagggcagggcagccugucacccgugugaagaugaaggggcu

SEQ ID NO: 330037 - RNA, 64 nt, Human
caacagggagggggagauuucaucaguguggacagccugucaacuuaggauggauggcugagag

SEQ ID NO: 330038 - RNA, 64 nt, Human
gggguggcugcagccucaggacugggagcccccagccugucagauccaggagcuccaguguccu

SEQ ID NO: 330039 - RNA, 64 nt, Human
cggagagcagcaggaagcacucccagccaccagugccugucaccucuuuccccuuugccccugc

SEQ ID NO: 330040 - RNA, 64 nt, Human
ggaggucaucucggcuguuccugagaaauaaaaagccugucauuucaaacacugcuguggaccc

SEQ ID NO: 330041 - RNA, 64 nt, Human
aguugugauugggcaaaguuuauuuucuaugucagccugucaguccacugccccauuuugcaag

SEQ ID NO: 330042 - RNA, 64 nt, Human
caugcccuaccauaccaauuucaauaacaaucuugccugucauugcacucagaaucuuaagauc

SEQ ID NO: 330043 - RNA, 64 nt, Human
uguucagcugccacaggccuggaggaguuuccuggccugucacgugagguuugaucaguaaacc

SEQ ID NO: 330044 - RNA, 64 nt, Human
uugcuacuguuguggagauccuuaacgcagcagcgccugucauaaacaagccucuuguagcuuc

SEQ ID NO: 330045 - RNA, 64 nt, Human
uaaacacaccaaaacagaucaugccaaaugaguugccugucaaaggcuggagggcaggaggagg

SEQ ID NO: 330046 - RNA, 64 nt, Human
cuuucugcaaauacaugcccuaaaguuucucagagccugucacaaaggccggcugcccccaaag

SEQ ID NO: 330047 - RNA, 64 nt, Human
uaugacaacaaccccuccaucacaaguguuugaagccugucagauucuaacaacaaaagcugaa

SEQ ID NO: 330048 - RNA, 64 nt, Human
uacuguucugauuuuucguuguguaggccgaucugccugucagaguccacguguccuggucacu

SEQ ID NO: 330049 - RNA, 64 nt, Human
gggagcucucugugugggcucugcugcgcugggagccugucacgguaggagcucucccgguacc

SEQ ID NO: 330050 - RNA, 64 nt, Human
aauaaacaaaccccuacaguuaaaaugcaaagaugccugucaucuaaguauugaaagaauuuuu

SEQ ID NO: 330051 - RNA, 64 nt, Human
gucacuccaacuccuuccuuuaggcugugcucuugccugucacaaagaggcaacguagccacug

SEQ ID NO: 330052 - RNA, 64 nt, Human
cuuccaauuguagcuagcgcacagagcuuuggaagccugucauuaugagauacagucgguuuac

SEQ ID NO: 330053 - RNA, 64 nt, Human
cucuauaggagaccacguugcuacaucuguuaaugccugucagugaucaaaagaaacuuaaaaa

SEQ ID NO: 330054 - RNA, 64 nt, Human
cucacauaagaaccauggccuuggauuauucacugccugucacaagccucaguguggccugaga

SEQ ID NO: 330055 - RNA, 64 nt, Human
cugucaagaaagagcaguagagggguguggcugggccugucacccuggggcccuccagguaggc

SEQ ID NO: 330056 - RNA, 64 nt, Human
ggcccagguguagcgguccgaggggcccgguccugccugucagcuccagguccuggagccacgu

SEQ ID NO: 330057 - RNA, 64 nt, Human
cugugagcagcuccggcucagcccugcugcccuggccugucacuccccaccccugccggagacc

SEQ ID NO: 330058 - RNA, 64 nt, Human
cccagaagacccgcuucuccuuuccgcacacccggccugucacccugcuuucccugccucuacu

SEQ ID NO: 330059 - RNA, 64 nt, Human
ggguggcugucuuuguuccagcacuguucaggcugccugucaucccgggccugccagcuccccu

SEQ ID NO: 330060 - RNA, 64 nt, Human
uucagguuuuugcccaagucucagcuuggccaaggccugucacugacugguuuaccaaagucga

SEQ ID NO: 330061 - RNA, 64 nt, Human
gcauuccgcccaccccuuucccccaucacuucucgccugucagugauuccauguuucguaacgg

SEQ ID NO: 330062 - RNA, 64 nt, Human
guuuugguucccuucccuucccacccccccuuaagccugucagcccccuccaaaugucucagga

SEQ ID NO: 330063 - RNA, 64 nt, Human
cucccuggcccaccuagaggcuuucuuggucagugccugucaaggcuccaguccugcugagcca

SEQ ID NO: 330064 - RNA, 64 nt, Human
guccugagcaccugucccggcccccuccucuccagccugucaggccagccuccccagcccccuu

SEQ ID NO: 330065 - RNA, 64 nt, Human
ucugacggccuccacuuguuucuccugcaccccagccugucacgcuaucagcaguucaaggauu

SEQ ID NO: 330066 - RNA, 64 nt, Human
caucuucuucacuuacccacagcagcaacaccaggccugucacacagaugaauguguugaggga

SEQ ID NO: 330067 - RNA, 64 nt, Human
ucugugccugccuuuuucucuguccuuguuuccugccugucauguucuucugaauaguaacaac

SEQ ID NO: 330068 - RNA, 64 nt, Human
uauuccauagaaucacagaacaauccugaaccaggccugucaccuacccucccugcagcucagg

SEQ ID NO: 330069 - RNA, 64 nt, Human
gucucuugguuggcuuguccuugugcaagacccagccugucacgacagagccugggcacuucag

SEQ ID NO: 330070 - RNA, 64 nt, Human
ucuaacucaagacuguucuggaaugaggguccaggccugucaaccauggggcuucugaccugag

SEQ ID NO: 330071 - RNA, 64 nt, Human
gugcaugucccugcgaugggagucuugucucccagccugucaguuuccuccccagggcagagcu

SEQ ID NO: 330072 - RNA, 64 nt, Human
cuguauugaggcuagcccugaucaugcuuuuugugccugucaccaggucucccaagugcacuca

SEQ ID NO: 330073 - RNA, 64 nt, Human
ugaagucucuguugguuugggagagauagugagggccugucaaagaaggcagguagcagucagc

SEQ ID NO: 330074 - RNA, 64 nt, Human
auaaaguaagauuaugauuaaguguccaucaccugccugucagccguggucagaauaaguuuua

SEQ ID NO: 330075 - RNA, 64 nt, Human
ggcccgcaugacuaggcguggaccugcccauggugccugucagcccgcagagcccaucuacgcc

SEQ ID NO: 330076 - RNA, 63 nt, Human
acaagugccggaaagucuaggggucugugcaaggccugucacacugaccaccuccuacuccca

SEQ ID NO: 330077 - RNA, 64 nt, Human
cuccccaccccaccccauuuacagggugagcucagccugucaugagcagaggaaaauauuauua

SEQ ID NO: 330078 - RNA, 64 nt, Human
agagaaauuuauuuuuguuuggguggacccacuggccugucagucucaauaaagggaccggagu

SEQ ID NO: 330079 - RNA, 64 nt, Human
ggaaaggucacagcuggggaggaagcggggggacgccugucaccccuggcagguggugaguuca

SEQ ID NO: 330080 - RNA, 64 nt, Human
gcguggcuuucucuagccuugucacugucucccugccugucaaucaccaccuuuccuccagagg

SEQ ID NO: 330081 - RNA, 64 nt, Human
acaaagccaguaguuaaaccaaacuacagucucagccugucauucucuagaacacauccaggug

SEQ ID NO: 330082 - RNA, 64 nt, Human
cacagcccgaaccagaucgacuggucugguagcagccugucacuccagacuguccuccacccca

SEQ ID NO: 330083 - RNA, 64 nt, Human
cuacauucuuuuccauguguaaaaucaugaaaaagccugucaccggacuugcauuggaugagau

SEQ ID NO: 330084 - RNA, 64 nt, Human
acaaaacuugagccaagaguaaagaauucagaaggccugucaggugaagucuucagccucccac

SEQ ID NO: 330085 - RNA, 64 nt, Human
uccguggggguacaggagcccagacaaagcccaggccugucaagagacgcagagggccccugcc

SEQ ID NO: 330086 - RNA, 64 nt, Human
ugccugucauacuugcuaaacaagagcacagcgggccugucagaugaagucaggagccauacgu

SEQ ID NO: 330087 - RNA, 64 nt, Human
aguggagcaguugacauccaggguuuuuuuuccugccugucauacuugcuaaacaagagcacag

SEQ ID NO: 330088 - RNA, 64 nt, Human
cccugcuggucccugaagcccccucagaagcccugccugucacgucggcauuugugagaccuac

SEQ ID NO: 330089 - RNA, 64 nt, Human
ccccugcugaggagagaccagguggaccccagcugccugucacccuucaucugggacuugcugu

SEQ ID NO: 330090 - RNA, 64 nt, Human
guggccugggcguguuguggacucaggcacuggggccugucaccaaggcuccuccaacaugcgg

SEQ ID NO: 330091 - RNA, 64 nt, Human
ugccaccuagcagacguggggagccugaccccaugccugucauggaacccuccuugccuggugu

SEQ ID NO: 330092 - RNA, 64 nt, Human
auugcuucguauuucugccaacguagcucugccugccugucaaccccucacugcacucugcuca

SEQ ID NO: 330093 - RNA, 64 nt, Human
uggcuccuucucuucuccagcccaucccucugcagccugucaucccugucugugaccauugguc

SEQ ID NO: 330094 - RNA, 64 nt, Human
gcuaccgugaaaccuuuaccuagaucagccaucagccugucaacucaguuaacaaguuaaggac

SEQ ID NO: 330095 - RNA, 64 nt, Human
ggaaggggugcaguucguccccaagaacgacacugccugucagguggucugcaaagaugauaac

SEQ ID NO: 330096 - RNA, 64 nt, Human
aauugacccucacugccuccaaagcccagagccugccugucagcccagcuggagggcccgaggc

SEQ ID NO: 330097 - RNA, 64 nt, Human; identical to SEQ ID NO: 330089

SEQ ID NO: 330098 - RNA, 64 nt, Human
caaagcugcaggugccagggcccaccccagccucgccugucacccccacucccgccucagggcc

SEQ ID NO: 330099 - RNA, 64 nt, Human
acccugcagcuuggagcccguuccuuggggcgcagccugucagcauguccccggucacugugua

SEQ ID NO: 330100 - RNA, 64 nt, Human
gacacaaaggucuugguucucccaggagcucagggccugucagaccuggugacaagugccaaag

SEQ ID NO: 330101 - RNA, 64 nt, Human
uucuuaccaucuuacuccugccuccccauuccuugccugucaggaccauuuuagaagaguuacc

SEQ ID NO: 330102 - RNA, 64 nt, Human
guccccugcugccugcccaaacaccccaccauuggccugucaacccacccauuggccugucugc

SEQ ID NO: 330103 - RNA, 64 nt, Human
cacacacacacacacaaaaucacaccauuuucaugccugucaauccccaccccaccacaaggca

SEQ ID NO: 330104 - RNA, 64 nt, Human
gucaacguacaguuugcuugaguuauagaaaccagccugucaucaaaugauucuaguucuagga

SEQ ID NO: 330105 - RNA, 64 nt, Human
cagcaaagcuaaugguauuuuaaucauuauuuuugccugucauaagaaaacucuuagcugaaau

SEQ ID NO: 330106 - RNA, 64 nt, Human
gacaaucuuaugaguauaaugaacacucagccaggccugucaugauuggcuuuauuucuuucau

SEQ ID NO: 330107 - RNA, 64 nt, Human
gaauggucugaagaaggaaggccugagccccuuugccugucaaguuguacauuggagucucauu

SEQ ID NO: 330108 - RNA, 64 nt, Human
acucagccaguagcucagagagaugcugaguuaggccugucaggucuccuugggaaaggcuuca

SEQ ID NO: 330109 - RNA, 64 nt, Human
cccucaaccccggcccaggccgcccuggccgcccgccugucacugcagccgccccugcccugug

SEQ ID NO: 330110 - RNA, 64 nt, Human
gaugaagaacaggcauugcaaggacccucugaugggacgguacugagauaucucggcuuccgcu

SEQ ID NO: 330111 - RNA, 64 nt, Human
augaauucuggugguuuaccccaagucacaguuaggacgguagauggugagaucgcagaugcgc

SEQ ID NO: 330112 - RNA, 64 nt, Human
ccuguuuuauguguaaaaucagaugcuugcaggaggacgguaaacagcaaaggcuuuacuucuu

SEQ ID NO: 330113 - RNA, 64 nt, Human
gcaucuugcauccaaaccuguaaccuuucggcaaggacgguaacuuggcugcauuugccuguca

SEQ ID NO: 330114 - RNA, 64 nt, Human
agaggucuuacugcaauaagaaguaaugccugggggacgguaauccuaauaggacgucccgcac

SEQ ID NO: 330115 - RNA, 64 nt, Human
cuuuuuaaaaaauucagaaauccaauaaaggaaaggacgguaaccuuaugauagaagguguggc

SEQ ID NO: 330116 - RNA, 64 nt, Human
ucccagccagaguuuucaucuauagucaauggcaggacgguaccaacucagaguuaagucuaca

SEQ ID NO: 330117 - RNA, 64 nt, Human; identical to SEQ ID NO: 330115

SEQ ID NO: 330118 - RNA, 64 nt, Human
uguugcuucuggucucuccaggcuuggcugagacggacgguagacuuccaccauguaccgauca

SEQ ID NO: 330119 - RNA, 64 nt, Human
uccaaccaugcaguuccuggugagggucagaaggggacgguaccaagaguagcgcuuagcccuu

SEQ ID NO: 330120 - RNA, 64 nt, Human
ggggagaaugagaagggaaggccgggugcgaaagggacgguauccagggcgccagggugcuguc

SEQ ID NO: 330121 - RNA, 64 nt, Human
uccaugugccucccgucugggugggugugagaguggacgguaugugugugaagugguguauaug

SEQ ID NO: 330122 - RNA, 64 nt, Human
uguuuaguuguuuucacuggggcucgcuuuucugggacgguauuuauuaucagacuggcaagcc

SEQ ID NO: 330123 - RNA, 64 nt, Human
augagaagccugaacugaagaccauuuucaagagggacgguauuuaugaaucaggguuaggcuc

SEQ ID NO: 330124 - RNA, 64 nt, Human
gugaggccggggcccucccuccugcacuggccuuggacgguauugccugucagugaaauaaaua

SEQ ID NO: 330125 - RNA, 64 nt, Human
gcggcucaagaauaaaauaugaauugagggcccgggacgguaggucaugucuguaaucccagca

SEQ ID NO: 330126 - RNA, 64 nt, Human
gggaggggguggggcugggcgugaaggggacaggggacgguagaaaccuaaggaaaaugcuuuu

SEQ ID NO: 330127 - RNA, 64 nt, Human
accacuaaaagugacaguugaaagugguggcauaggacgguaggguagaaauuugggagggaaa

SEQ ID NO: 330128 - RNA, 64 nt, Human
cagaccuggugccuugacgcccccaccccagcugggacgguacagagaagggucuugguuuccu

SEQ ID NO: 330129 - RNA, 64 nt, Human
aagagggaagagucacaaaaaguccagaccccagggacgguacuuucccucucuaccuggugcu

SEQ ID NO: 330130 - RNA, 64 nt, Human
ccagggccaacccuguaggcuuccccucugcuggggacgguaguugcuuuucucucuccugaug

SEQ ID NO: 330131 - RNA, 63 nt, Human
ucaacaaagaaaauuuuugaguuauaggaauaaggacgguaaucugcauuuugucucuuugua

SEQ ID NO: 330132 - RNA, 64 nt, Human
aucgaggccuguugcucauuaagcugagugcagacguccuuaaucccugcagauagugggauga

SEQ ID NO: 330133 - RNA, 64 nt, Human
gcacgccaugauucgggccuggauagacugccugcguccuuaccacugaucuggccaagaauga

SEQ ID NO: 330134 - RNA, 64 nt, Human
acuagaucuguaaagucuggaacuagaucuguaacguccuuauaggugucacuaggggguucca

SEQ ID NO: 330135 - RNA, 64 nt, Human
cugcccaucgcaugagcccacacaguagcacccccguccuuaggaugagagucagagccuuugg

SEQ ID NO: 330136 - RNA, 64 nt, Human
auuucaaacaagcagguccucuucucucaucucacguccuuagucucuguuaaugaacauacug

SEQ ID NO: 330137 - RNA, 64 nt, Human
ucucucaacucugcuuuucuccaguuccagauaacguccuuaagaccaucuguucagggguuca

SEQ ID NO: 330138 - RNA, 64 nt, Human
cuuuuauaaggguacuaaucccaucaugaggccccguccuuaugaccucaucaccucccaaagg

SEQ ID NO: 330139 - RNA, 64 nt, Human
gcuuggcuguaggugugcacugucuauuuacauccguccuuacaaccauccuuguccuccuugg

SEQ ID NO: 330140 - RNA, 64 nt, Human
acaaacaaaaaagauauugcaguuguguuguaagcguccuuaucuuucagagcuacauagugga

SEQ ID NO: 330141 - RNA, 64 nt, Human
acuuuugaucauaaugcuuuugcccauacugucucguccuuagccccagugacaugugcugauc

SEQ ID NO: 330142 - RNA, 64 nt, Human
uguaaaaagccagcaaacuaucuucaaacucuuccguccuuaaugucuuccauggcuauugccc

SEQ ID NO: 330143 - RNA, 64 nt, Human
accaaagucugauaacaguuaauguugcugcuugcguccuuaaaugacuuaagguuucaucuuc

SEQ ID NO: 330144 - RNA, 64 nt, Human
cacuuuuuauacagaggacaccgccucggccccacguccuuagaggccagagcacaucugaaaa

SEQ ID NO: 330145 - RNA, 64 nt, Human
cuguucacucagaggucaucaauuucuuucucuccguccuuaauuggauuauuuuucuuuuggc

SEQ ID NO: 330146 - RNA, 64 nt, Human
ucacacuggugcuguugagaucucccaaaccucacguccuuaacugugcucucccuccuuuccu

SEQ ID NO: 330147 - RNA, 64 nt, Human
uugccugugaggacugcggcuuuucgcuguggcucguccuuaacguuucugaaccaccuuggug

SEQ ID NO: 330148 - RNA, 64 nt, Human
cuggaaggagaaaauacaacaugucauuuaucaacguccuuagaaagaauucuucuagagaaaa

SEQ ID NO: 330149 - RNA, 64 nt, Human
cucuacugggaaggcuacuucggggcugggaagucguccuuacuccugugggagccucgcaacc

SEQ ID NO: 330150 - RNA, 64 nt, Human
gaugacaaccugugugagagaauuuaucacaccacguccuuauuggaauaauaagcuacuugcc

SEQ ID NO: 330151 - RNA, 64 nt, Human
ggcacucuuccuaggacgggacuaaagaggacgccguccuuaaaaccugacgugccaccaaagc

SEQ ID NO: 330152 - RNA, 64 nt, Human
ccacagggccggagcucagguuacaccacuccuucguccuuacaggagauguagggagaagaau

SEQ ID NO: 330153 - RNA, 64 nt, Human
uaaacuggcuuaacagagaacaagcuuuuacagacguccuuaaggcaacagugcagagauguaa

SEQ ID NO: 330154 - RNA, 64 nt, Human
agaggauuccauuucagaugucagucaccggcuucguccuuaguuuucccaacuugggacguga

SEQ ID NO: 330155 - RNA, 64 nt, Human
ccggcccggggcgcuggugguggcugucuggacacguccuuagcgccugggaaccaggacauaa

SEQ ID NO: 330156 - RNA, 64 nt, Human
gagagccgcguugccaguuccucucccacucgcucguccuuauccaccacgcuauuauaguuuc

SEQ ID NO: 330157 - RNA, 64 nt, Human
ccagcuuuguugcagccucagcugguggugucuccguccuuauccuagccuagcucgcagggug

SEQ ID NO: 330158 - RNA, 64 nt, Human
agcccuccgccucaccgccccccacccccgaccccguccuuagaaucuucuggaggagccuccc

SEQ ID NO: 330159 - RNA, 64 nt, Human
uccaacagcggcaacccccacccccauugugguccguccuuaacccauccacucuucuucggag

SEQ ID NO: 330160 - RNA, 64 nt, Human
ggaaugggcauuuugguagguaaagugugguggacguccuuauuauuauuuuugagacaguguc

SEQ ID NO: 330161 - RNA, 64 nt, Human
gaguccaaaagacaaaggggcaucggcaugucagcguccuuauuuauugguucuugaaguuuug

SEQ ID NO: 330162 - RNA, 64 nt, Human
uguaauagccucaccuucccuaguucuuugcauucguccuuagaauacuguauuguuacagcug

SEQ ID NO: 330163 - RNA, 64 nt, Human
aggcaccugagagaggaacucuguggggugggggccguugcagguguacugggcugucagggau

SEQ ID NO: 330164 - RNA, 64 nt, Human
cuaaugaauuaugcgaaagcaacauauuugauaaccguugcaguaaaucaugaguagucgcaug

SEQ ID NO: 330165 - RNA, 64 nt, Human
uccucgacccuagugggggaucaagaaggaaacuccguugcaaaaggguauuuuaaucuccugu

SEQ ID NO: 330166 - RNA, 64 nt, Human
cucaguagugauggguuucccacuucuccucaauccguugcaugaaauaauuacuaugugcccu

SEQ ID NO: 330167 - RNA, 64 nt, Human
uggcgcgcgcgacgucacacaccauuuucagaugccguugcaauuaaaucuugccacacugucc

SEQ ID NO: 330168 - RNA, 64 nt, Human
aggaagggacaaguuagauaaggacugagugcuuccguugcaggcaguuugcacaauaccuaau

SEQ ID NO: 330169 - RNA, 64 nt, Human
aaacauuuaggcaggagacuuucuauugugugccccguugcagacagggccagggagaaauuag

SEQ ID NO: 330170 - RNA, 64 nt, Human
ugaggccauggcucguccccggaguuggggguacccguugcagagccagggacaugaugcaggc

SEQ ID NO: 330171 - RNA, 64 nt, Human
ucaacucuuauaaaauucaugcugaucuucauuaccguugcaugauuggaaauguuuaaaacau

SEQ ID NO: 330172 - RNA, 64 nt, Human
gguuucugcauucaacuaccuuguaaauggugguccguugcaguuucaccaaauguauugaugu

SEQ ID NO: 330173 - RNA, 64 nt, Human
uggagagaggccucauccggcuuugacccaccauccguugcagaagccuccaggagcagcaauc

SEQ ID NO: 330174 - RNA, 64 nt, Human
ccggccgccugcggcacugccuuccgugacgucgccguugcacuauggacaguugcucuuaaga

SEQ ID NO: 330175 - RNA, 64 nt, Human
auggugugucggcagcuccguccuuccagcugucccguugcagugcccgugauccgcgucugcc

SEQ ID NO: 330176 - RNA, 64 nt, Human
ccuuaauuuaugaaggcaucaugucacugcaaagccguugcagauaaacuuuguauuuuaauuu

SEQ ID NO: 330177 - RNA, 64 nt, Human
aaaaggccucucuucucaucuggugccaaagguuccguugcagcuuuuuacaaccauccggugu

SEQ ID NO: 330178 - RNA, 64 nt, Human
ggcuuucccuuuccacggguaacgcugccugaacccguugcagccggaacccgcgccucgucgg

SEQ ID NO: 330179 - RNA, 64 nt, Human
uagagggccaggagcagcaggucaugugcacaugccguugcagcacaagcuuaugcuucccgua

SEQ ID NO: 330180 - RNA, 64 nt, Human
agauuuuuuuaaagcuuuucuuuuaaauuuuucuccguugcaaagaauguuuccuaaauuguau

SEQ ID NO: 330181 - RNA, 64 nt, Human
cauuucagaguucuuuuugaaguauuuaagguucccguugcauuuguuuuguuuacagauaauu

SEQ ID NO: 330182 - RNA, 64 nt, Human
gaucauuguucucucacgguauccuucugucuucccguugcaaauucacuuuucuuucuuccug

SEQ ID NO: 330183 - RNA, 64 nt, Human
gauuuucaugcugaaccauucaagcccuccccgcccguugcacccacuuuggcuggcgucugcu

SEQ ID NO: 330184 - RNA, 64 nt, Human
ccuaggaggcuucggcagcggcggcagcgcacagccguugcaccaggguacugcagccggggcc

SEQ ID NO: 330185 - RNA, 64 nt, Human
cugaaucauccgaggcaaagagaaaagccacggaccguugcacaaaaaggaaaguuugggaagg

SEQ ID NO: 330186 - RNA, 64 nt, Human
ccgccucccccaaggcucaugguccuuggaggacccguugcagggugaggucaagagaguucug

SEQ ID NO: 330187 - RNA, 64 nt, Human
ugccuuagcauugcgggaggguggugcuuggucaccguugcauuuguuauagaaauggccauuc

SEQ ID NO: 330188 - RNA, 64 nt, Human
gcagaagaacuucccgugcgcgcggauccucgcuccguugcacgggcgccuuaaguuauuggac

SEQ ID NO: 330189 - RNA, 64 nt, Human
uguauuuaauguuucuguuguuuacuggugccucccguugcaucagguagagauugccugccuc

SEQ ID NO: 330190 - RNA, 64 nt, Human
aaacagaagagaggcugccgggaccagcauauuuccguugcagccaaauggauuuuauuuuuuc

SEQ ID NO: 330191 - RNA, 64 nt, Human
uuggaauaaggauaaaugagggacagguuggaugccguugcagagaaaaucagcaaugacauaa

SEQ ID NO: 330192 - RNA, 64 nt, Human
gcccauccuuccucagcacagggaacccggaagcccguugcacugacagaggcucacacccucu

SEQ ID NO: 330193 - RNA, 64 nt, Human
caggagguggagguugcaguaagcugagaucgugccguugcacuccagccugggcgacaagagc

SEQ ID NO: 330194 - RNA, 64 nt, Human
ucuuguaaaaaccugaacccagaaacaacacaauccguugcaaacccaaaggacccaaguacuu

SEQ ID NO: 330195 - RNA, 64 nt, Human
acuugcgaggcaaucucaggagcuguggacuuaaccguugcaaagcacacugucuuucucagcg

SEQ ID NO: 330196 - RNA, 64 nt, Human
ugguuuacugugugaacauagccaaaaguaugugccguugcacagacuguguuuaugacucaac

SEQ ID NO: 330197 - RNA, 64 nt, Human
agggcagggaccguaucuuauuuacuguuaguauccguugcaucuaguguggugcaccuggcac

SEQ ID NO: 330198 - RNA, 64 nt, Human
gagcauaugcaacucgcuacugaagaagugacuuccguugcauaccaaagccgacuacacugaa

SEQ ID NO: 330199 - RNA, 64 nt, Human
uugcaacuuaucgcaaaggggaaugaaccugaauccguugcauuuauuucaguuaaaaauaaug

SEQ ID NO: 330200 - RNA, 64 nt, Human
agaaaugagauugccagaaagugauuaacuuuggccguugcaaucugcucaaaccuaacaccaa

SEQ ID NO: 330201 - RNA, 64 nt, Human
guccauccugaacaugcacagugauuuuccucucccguugcacacaaaccuuuaaaaguucccc

SEQ ID NO: 330202 - RNA, 64 nt, Human
aaguaaaccuccagcuuccacaguauauuaccugccguugcaugcauuugaaaguuagccuccu

SEQ ID NO: 330203 - RNA, 64 nt, Human
aagccuaggauaugagggcugaggaggacucaaaccguugcagucagagagacaccuauuuugg

SEQ ID NO: 330204 - RNA, 64 nt, Human
agcugggcccaggggcugugcacucaggccugacccguugcacugaacaagaccaaaucgcugg

SEQ ID NO: 330205 - RNA, 64 nt, Human
ucugacccuugucaccgcacgcucugcccccaccccguugcaagaggucacaccaugucagcag

SEQ ID NO: 330206 - RNA, 64 nt, Human
cugaaguggacauauucagccuuggcgagaagcuccguugcacggguuuccccuugagcccauu

SEQ ID NO: 330207 - RNA, 64 nt, Human
aggcccucccccaggcagaagagcaugcccuuugccguugcaugcaaccagcccugugauucca

SEQ ID NO: 330208 - RNA, 64 nt, Human
cggguggagacccucagggcagugugccgggccuccguugcaccucugaccugcagccacguca

SEQ ID NO: 330209 - RNA, 64 nt, Human
ucaacuugaacguccaaaugaacucaauggacauccguugcagugacaucauccagggagacac

SEQ ID NO: 330210 - RNA, 64 nt, Human
aucuaagaaguugugaauguuguuaaucauuuagccguugcaauaaauguagaggaaaugcagu

SEQ ID NO: 330211 - RNA, 64 nt, Human
caaagcagcaauuacaugggauccuguggcucucccguugcagaggccacaggaagauaggaug

SEQ ID NO: 330212 - RNA, 64 nt, Human
auguuuccuggcuccgaggacacggguggcaggcccguugcagcccagagccacuggucccuac

SEQ ID NO: 330213 - RNA, 64 nt, Human
cucugucucguuuugggaaaccaaggucaggaggccguugcagacauaaaucucggcgacucgg

SEQ ID NO: 330214 - RNA, 64 nt, Human
ccaccgggcucagcuccagggcacagucacuuguccguugcagguugggcacuagaaaaggccc

SEQ ID NO: 330215 - RNA, 64 nt, Human; identical to SEQ ID NO: 267104

SEQ ID NO: 330216 - RNA, 64 nt, Human; identical to SEQ ID NO: 267105

SEQ ID NO: 330217 - RNA, 64 nt, Human; identical to SEQ ID NO: 267106

SEQ ID NO: 330218 - RNA, 64 nt, Human; identical to SEQ ID NO: 267107

SEQ ID NO: 330219 - RNA, 64 nt, Human; identical to SEQ ID NO: 267108

SEQ ID NO: 330220 - RNA, 64 nt, Human; identical to SEQ ID NO: 267109

SEQ ID NO: 330221 - RNA, 64 nt, Human; identical to SEQ ID NO: 267110

SEQ ID NO: 330222 - RNA, 64 nt, Human; identical to SEQ ID NO: 267111

SEQ ID NO: 330223 - RNA, 64 nt, Human; identical to SEQ ID NO: 267112

SEQ ID NO: 330224 - RNA, 64 nt, Human; identical to SEQ ID NO: 267113

SEQ ID NO: 330225 - RNA, 64 nt, Human; identical to SEQ ID NO: 267114

SEQ ID NO: 330226 - RNA, 64 nt, Human; identical to SEQ ID NO: 267115

SEQ ID NO: 330227 - RNA, 64 nt, Human; identical to SEQ ID NO: 267116

SEQ ID NO: 330228 - RNA, 64 nt, Human; identical to SEQ ID NO: 267117

SEQ ID NO: 330229 - RNA, 64 nt, Human; identical to SEQ ID NO: 267118

SEQ ID NO: 330230 - RNA, 64 nt, Human; identical to SEQ ID NO: 267119

SEQ ID NO: 330231 - RNA, 64 nt, Human; identical to SEQ ID NO: 267121

SEQ ID NO: 330232 - RNA, 64 nt, Human; identical to SEQ ID NO: 267114

SEQ ID NO: 330233 - RNA, 64 nt, Human; identical to SEQ ID NO: 267116

SEQ ID NO: 330234 - RNA, 64 nt, Human; identical to SEQ ID NO: 267120

SEQ ID NO: 330235 - RNA, 64 nt, Human; identical to SEQ ID NO: 267122

SEQ ID NO: 330236 - RNA, 64 nt, Human; identical to SEQ ID NO: 267123

SEQ ID NO: 330237 - RNA, 64 nt, Human; identical to SEQ ID NO: 267124

SEQ ID NO: 330238 - RNA, 64 nt, Human; identical to SEQ ID NO: 267125

SEQ ID NO: 330239 - RNA, 64 nt, Human; identical to SEQ ID NO: 267126

SEQ ID NO: 330240 - RNA, 64 nt, Human; identical to SEQ ID NO: 267127

SEQ ID NO: 330241 - RNA, 64 nt, Human; identical to SEQ ID NO: 267104

SEQ ID NO: 330242 - RNA, 64 nt, Human; identical to SEQ ID NO: 267105

SEQ ID NO: 330243 - RNA, 64 nt, Human; identical to SEQ ID NO: 267106

SEQ ID NO: 330244 - RNA, 64 nt, Human; identical to SEQ ID NO: 267107

SEQ ID NO: 330245 - RNA, 64 nt, Human; identical to SEQ ID NO: 267118

SEQ ID NO: 330246 - RNA, 64 nt, Human; identical to SEQ ID NO: 267119

SEQ ID NO: 330247 - RNA, 64 nt, Human; identical to SEQ ID NO: 267121

SEQ ID NO: 330248 - RNA, 64 nt, Human; identical to SEQ ID NO: 267108

SEQ ID NO: 330249 - RNA, 64 nt, Human; identical to SEQ ID NO: 267109

SEQ ID NO: 330250 - RNA, 64 nt, Human; identical to SEQ ID NO: 267110

SEQ ID NO: 330251 - RNA, 64 nt, Human; identical to SEQ ID NO: 267111

SEQ ID NO: 330252 - RNA, 64 nt, Human; identical to SEQ ID NO: 267112

SEQ ID NO: 330253 - RNA, 64 nt, Human; identical to SEQ ID NO: 267113

SEQ ID NO: 330254 - RNA, 64 nt, Human; identical to SEQ ID NO: 267115

SEQ ID NO: 330255 - RNA, 64 nt, Human; identical to SEQ ID NO: 267117

SEQ ID NO: 330256 - RNA, 64 nt, Human; identical to SEQ ID NO: 267120

SEQ ID NO: 330257 - RNA, 64 nt, Human; identical to SEQ ID NO: 267122

SEQ ID NO: 330258 - RNA, 64 nt, Human; identical to SEQ ID NO: 267123

SEQ ID NO: 330259 - RNA, 64 nt, Human; identical to SEQ ID NO: 267124

SEQ ID NO: 330260 - RNA, 64 nt, Human; identical to SEQ ID NO: 267125

SEQ ID NO: 330261 - RNA, 64 nt, Human; identical to SEQ ID NO: 267126

SEQ ID NO: 330262 - RNA, 64 nt, Human; identical to SEQ ID NO: 267127

SEQ ID NO: 330263 - RNA, 64 nt, Human; identical to SEQ ID NO: 31785

SEQ ID NO: 330264 - RNA, 51 nt, Human; identical to SEQ ID NO: 31789

SEQ ID NO: 330265 - RNA, 64 nt, Human; identical to SEQ ID NO: 31795

SEQ ID NO: 330266 - RNA, 64 nt, Human; identical to SEQ ID NO: 31799

SEQ ID NO: 330267 - RNA, 64 nt, Human
caggccccucugucuggccaccccucuguccuggccccggaaggcccuguggucaugugcuccu

SEQ ID NO: 330268 - RNA, 64 nt, Human
cagcccccuccaggaugcagcccccucccccgcaccccggaaccggcgucgcuggcgcauccug

SEQ ID NO: 330269 - RNA, 64 nt, Human
gaggaaggauggagguggacucucaccccauuccccccggaaaugaacaaagccgggcccuuuc

SEQ ID NO: 330270 - RNA, 64 nt, Human
uucaaacacuccggggggagguagucccagccucccccggaacccucuaccaaugccuucugac

SEQ ID NO: 330271 - RNA, 64 nt, Human
cauacuucuguggggaaucagccuccugccacccccccggaaggaccucacugucuccagcuau

SEQ ID NO: 330272 - RNA, 64 nt, Human
cucccugggcugaggacccuuucuugccuccccaccccggaagcugaaccugagggagacaacg

SEQ ID NO: 330273 - RNA, 64 nt, Human
accacgcccuccccgcgcgccggcucaggggcugccccggaaucagcuccccggggccgccgca

SEQ ID NO: 330274 - RNA, 64 nt, Human
ggagaaauguauuauacuugagacauugcaccuaccccggaaggcuggaaauacagaaacagca

SEQ ID NO: 330275 - RNA, 64 nt, Human
ugccauguuguaugccccagaagguaccuuggucccccggaaggagagaaaaaagagagaugga

SEQ ID NO: 330276 - RNA, 64 nt, Human
augagugccucuguuuuccagaagauuucacaauccccggaaaacugguauggcuauucuugaa

SEQ ID NO: 330277 - RNA, 64 nt, Human
ccuuuacaugcccuuccccagucuccucuuccucccccggaaguguccauucugcugaauucag

SEQ ID NO: 330278 - RNA, 64 nt, Human; identical to SEQ ID NO: 31803

SEQ ID NO: 330279 - RNA, 64 nt, Human; identical to SEQ ID NO: 31808

SEQ ID NO: 330280 - RNA, 64 nt, Human; identical to SEQ ID NO: 31814

SEQ ID NO: 330281 - RNA, 64 nt, Human
ucugggaggcacucucucagcccucuccuggagcccccggaauuucucagcagcccaggcccuc

SEQ ID NO: 330282 - RNA, 64 nt, Human
ucugcggccgcaacgcaacggacacuggcuggaaccccggaaugagccuucgacccugaaaucc

SEQ ID NO: 330283 - RNA, 64 nt, Human
aagcugcuguuaaacgaaacugagaaaaacuuugccccggaauagcacuuuaauagucaaaaau

SEQ ID NO: 330284 - RNA, 64 nt, Human
aucuucucagaaggcaaaugacuuuggaccauaaccccggaagccaaaccucugugagcaucac

SEQ ID NO: 330285 - RNA, 54 nt, Human
ggaggaacagcgggcccugagcagccccggaagcaagugccgcauucuucagga

SEQ ID NO: 330286 - RNA, 64 nt, Human
gcaagcccucucuauguguuuuuauccccaccuuccccggaaucuggggagggcuuuuguuuuu

SEQ ID NO: 330287 - RNA, 64 nt, Human
ccccaaagaaaaaucagaggaggagaaauggaaaccccggaacaaugccaauguauaaaacccc

SEQ ID NO: 330288 - RNA, 64 nt, Human
ccuuucaugccugaugccguagaguagaacacagccccggaaugcuuccaguugcuugcaaggg

SEQ ID NO: 330289 - RNA, 64 nt, Human
acuggccccacuucuggucucugucccucugccuccccggaagaagaugaggaaucugaggauu

SEQ ID NO: 330290 - RNA, 64 nt, Human
cuucaaucagcuugccugggaccaguggcagggaccccggaaccugaaggugcugacaaagaug

SEQ ID NO: 330291 - RNA, 64 nt, Human
gcucucaaugucaugcagccgcuccugccagaauccccggaagggggcaaugccagugccugga

SEQ ID NO: 330292 - RNA, 64 nt, Human
cgacccaggccugcaccccacccccaacucccagccccggaauaaaaccauuuuccugcaaaug

SEQ ID NO: 330293 - RNA, 64 nt, Human
gggccgugcgcacuguguuccgugcccuggggacccccggaaaagcagcccagucagauguggg

SEQ ID NO: 330294 - RNA, 64 nt, Human
gcuggagugccagucccugagcucagacccccguccccggaacugggccacaccacgugcccuc

SEQ ID NO: 330295 - RNA, 64 nt, Human
agggggcccccucugcucacccccagcgugccccccccggaacugauaaggaugagaauggugg

SEQ ID NO: 330296 - RNA, 64 nt, Human; identical to SEQ ID NO: 308249

SEQ ID NO: 330297 - RNA, 64 nt, Human; identical to SEQ ID NO: 308250

SEQ ID NO: 330298 - RNA, 64 nt, Human; identical to SEQ ID NO: 31818

SEQ ID NO: 330299 - RNA, 64 nt, Human
agccaagaguaaccccaacccccgacucccgguaccccggaaucccugccgcggccccucgggc

SEQ ID NO: 330300 - RNA, 64 nt, Human
ugauauugcuccagaccgaguccuacccaccuucccccggaagugucccaagaggcuccgaagg

SEQ ID NO: 330301 - RNA, 64 nt, Human
cccuuuccuuucccagaaaaacugaggaaacuggccccggaaaagcaugucuuugggguugguu

SEQ ID NO: 330302 - RNA, 64 nt, Human
cggccgggccggccgccaccagcggccuccgccgccccggaagcccucgccgugcaauucugua

SEQ ID NO: 330303 - RNA, 64 nt, Human
aacucccucaccaccacgccucccugccuaccauccccggaagggugcuuauucuuuaacaaag

SEQ ID NO: 330304 - RNA, 64 nt, Human
ugggaggagggagggagggacaggugccuggagcccccggaacccuguuucuggaaggcccuag

SEQ ID NO: 330305 - RNA, 64 nt, Human
ccagaggggcucugaugaucagcccagccaguggccccggaaggugaauggccugcucucccug

SEQ ID NO: 330306 - RNA, 63 nt, Human
aguggccccuucguuccuuguaaauaaaucccgcccccggaaaugacgucuccaccuucgugg

SEQ ID NO: 330307 - RNA, 64 nt, Human
aaacaggucaauacaguacaggcagcacagagacccccggaacaagccuaaaaauuguuucaaa

SEQ ID NO: 330308 - RNA, 64 nt, Human
cagacacucaguugacacuuguuauaucaugggaccccggaaauuggagugaagcuagaaacag

SEQ ID NO: 330309 - RNA, 64 nt, Human
gggcuacugagcgcccucgaccuaugagccucagccccggaagccgagcgagcggccggcgcgc

SEQ ID NO: 330310 - RNA, 64 nt, Human
aacaaaugugucugagucuuggaaaacaccccaaccccggaaaugugugggaaaaagaaaacaa

SEQ ID NO: 330311 - RNA, 64 nt, Human
caacuccuccaucuaaccagcaggcucccagaguccccggaagagccugcgcagcugaagcaga

SEQ ID NO: 330312 - RNA, 64 nt, Human
uugcacaaaaagugacuguaggaucaggugauagccccggaauguacagugucuuggugcacca

SEQ ID NO: 330313 - RNA, 64 nt, Human
ccugucuguaaggagacuuuguugcuuccccugcccccggaauccacagugcucugcuucucug

SEQ ID NO: 330314 - RNA, 64 nt, Human; identical to SEQ ID NO: 31821

SEQ ID NO: 330315 - RNA, 64 nt, Human; identical to SEQ ID NO: 31826

SEQ ID NO: 330316 - RNA, 64 nt, Human; identical to SEQ ID NO: 31832

SEQ ID NO: 330317 - RNA, 64 nt, Human
uggggaaagggaggaagauauggcacuucuccaaccccggaaaacauugcuuuugaaaacugcu

SEQ ID NO: 330318 - RNA, 64 nt, Human
acuucuggcucacacagacccccacgcucuccauccccggaaucuagucacaacccuggauccu

SEQ ID NO: 330319 - RNA, 64 nt, Human
acaccuauggcuccuucgguaucaccuggggaagccccggaaucuuaguucuuccauucccuac

SEQ ID NO: 330320 - RNA, 64 nt, Human
ucacccuguguaacaggaccccaaggaccugccuccccggaagugccuuaaccuagagggucgg

SEQ ID NO: 330321 - RNA, 64 nt, Human
acuugccugugcugugcuuccaggucacagagccccccggaaacucacaggggcccucuuccca

SEQ ID NO: 330322 - RNA, 64 nt, Human
aaagcagaaggaacacuggcccaaacccccagcaccccggaagcagaggugagaugggagcagc

SEQ ID NO: 330323 - RNA, 64 nt, Human
cccucuuucgucccacccccucuucccucagcagccccggaagccugccucacccgacgaggac

SEQ ID NO: 330324 - RNA, 64 nt, Human
acagugaagguggcuuccggcacacuccccgcugccccggaagagacauccuuugacccucuca

SEQ ID NO: 330325 - RNA, 64 nt, Human
cugcaugcaguggcggcuacugggcccugcccagccccggaacucugcgcgauaucaauacugg

SEQ ID NO: 330326 - RNA, 64 nt, Human
cgcacccgaauuucuguccguucccaaagaucggccccggaaaaagucugccccagaaacucuc

SEQ ID NO: 330327 - RNA, 64 nt, Human
gucgccuaaccugguuucuagcuuugcccucacuccccggaaaaacugacacugacacaggggc

SEQ ID NO: 330328 - RNA, 64 nt, Human
gguggggggacaggagggggcccuggggccugggccccggaaaaaucuaucugcccucccccac

SEQ ID NO: 330329 - RNA, 64 nt, Human
cgugggagaggccagccgccgccugcucacucccccccggaaucaccccucuucccaugccccu

SEQ ID NO: 330330 - RNA, 64 nt, Human
cgcccucuccugcccuuccccgcuggagauggacccccggaacggacagggcagcucugcgccc

SEQ ID NO: 330331 - RNA, 64 nt, Human
acagauccuguugaagaaagagcuuaccccuuucccccggaaaacuugcaauccuguaguuccc

SEQ ID NO: 330332 - RNA, 64 nt, Human; identical to SEQ ID NO: 31836

SEQ ID NO: 330333 - RNA, 64 nt, Human; identical to SEQ ID NO: 31842

SEQ ID NO: 330334 - RNA, 64 nt, Human; identical to SEQ ID NO: 31848

SEQ ID NO: 330335 - RNA, 64 nt, Human
cagaagacgcuuuuccccagcaggucacccacggccccggaaccgcggcgacuggaggcuggau

SEQ ID NO: 330336 - RNA, 64 nt, Human
ggcgguggggacccagccgcgcgccgggagcgcuccccggaaugagccgccccacccaccccaa

SEQ ID NO: 330337 - RNA, 64 nt, Human
ccucugagcgggagagucuguguguaugugucuuccccggaauccacaccaccccacccuccuc

SEQ ID NO: 330338 - RNA, 64 nt, Human
ccguguaaaccugagcccccccguccccccccccccccggaagccacugcacacagacagaacg

SEQ ID NO: 330339 - RNA, 64 nt, Human
ccauguucugggcggcuugaccccaaaucccagaccccggaagcuccaggcucgggaugugucc

SEQ ID NO: 330340 - RNA, 58 nt, Human
cccgcgagacgcuguacuaggcugugcgccccggaacguguccaggaggagccuggcc

SEQ ID NO: 330341 - RNA, 64 nt, Human
cucucagcuggaugagacuguccuggaggauccaccccggaacagacagaauggugucucucag

SEQ ID NO: 330342 - RNA, 64 nt, Human
cguaucacuagcuugcggccaggucaugauguggccccggaagcuggcccugcgugccaugagu

SEQ ID NO: 330343 - RNA, 64 nt, Human
ccacaaguguaguuagccguccacaccgaggagcccccggaaguccccacugggcuucaguguc

SEQ ID NO: 330344 - RNA, 64 nt, Human
aggcccguccacaggcccggcucugggccacgugccccggaagcagguguguccagagucagcu

SEQ ID NO: 330345 - RNA, 64 nt, Human
aaugccccacaucauuggcacaggaguggggcagccccggaaggaaccagggauuaggcuguag

SEQ ID NO: 330346 - RNA, 64 nt, Human
uucacagggugggaaacgaaauucgagggaaauuccccggaaauaugagggaaaucucugcauu

SEQ ID NO: 330347 - RNA, 64 nt, Human
acaaaacaaaacaaaacaaaugacaguaacccuuccccggaaagaaauagaacaaucauggagc

SEQ ID NO: 330348 - RNA, 64 nt, Human
aagccggauccaccaacaccgcagcgccuuaugaccccggaaccgagccagccacugaggggag

SEQ ID NO: 330349 - RNA, 64 nt, Human
aagcccgcggcagcggcagccuggauccaggggcccccggaaggcguggagacacccacggacc

SEQ ID NO: 330350 - RNA, 64 nt, Human
ccuauguaacaaaccugcacauccugcacauguaccccggaacuuacuuaaaaaauaaaagaaa

SEQ ID NO: 330351 - RNA, 64 nt, Human
cagggccacuuuguuuguaaguaugaucugggccucaaaauaccauaguagcugcuugauaaaa

SEQ ID NO: 330352 - RNA, 64 nt, Human
auagaaacaguauuuaauggucacucaauagcuuucaaaauacauuuuuguauuacagcacugc

SEQ ID NO: 330353 - RNA, 64 nt, Human
cagaaauuaaccuaaggaaugaaggguggguuugucaaaauaucaaguaaauuuuuguuucuaa

SEQ ID NO: 330354 - RNA, 64 nt, Human
aucuuuauaaagcacuagaauuuuuggucaaaagucaaaauaguauuagaauauugaaauuauu

SEQ ID NO: 330355 - RNA, 64 nt, Human
auguuucuccucugcugggagcuguaguuucuuaucaaaauagauauuguuccaccaucccccu

SEQ ID NO: 330356 - RNA, 64 nt, Human
aucauguuguagguacuuaaaugcauuccgcaaaucaaaauaucuugauggauaaauuauagag

SEQ ID NO: 330357 - RNA, 64 nt, Human
ggaacuguacacuuguuuggugcuaauuaauacaucaaaauauacuggggcuuccuuuuucaaa

SEQ ID NO: 330358 - RNA, 64 nt, Human
uucaugcuaucagaaacaguauuuucuucccaaaucaaaauaaaagaaauaugaucagagcuug

SEQ ID NO: 330359 - RNA, 64 nt, Human
uauuuuuuuguagaguuuuuggaaagauauuuacucaaaauaacuaugcuuuagaacuuuuuuu

SEQ ID NO: 330360 - RNA, 64 nt, Human
cuggaacaucuaccaauaacuuucacauaaauguucaaaauagaaguguauuuuuucagguuuc

SEQ ID NO: 330361 - RNA, 64 nt, Human
ugcaucaagaaauuaaaaucaucuaucugaguagucaaaauacaaguaaaggagagcaaauaaa

SEQ ID NO: 330362 - RNA, 64 nt, Human
ccacacucccaguaauugcaacugcucacaugagucaaaauacagcucauuacccuagcccagu

SEQ ID NO: 330363 - RNA, 64 nt, Human
accuugcauuguaauauucaguuuuaauaaaucuucaaaauauuuuguauuuaggaauagaucu

SEQ ID NO: 330364 - RNA, 64 nt, Human
aguaucucacgguacaaauuaagaaugacuuucuucaaaauaucugaauaggugcaguuuuagu

SEQ ID NO: 330365 - RNA, 64 nt, Human
ccgaagugagggccaggcccuucccggcugcgaggacgcccagagaccgcgggcgcugagcgcg

SEQ ID NO: 330366 - RNA, 64 nt, Human
uucacagagcccuccauuccaaguuuaguuuuugucaaaauaugaaucauuuuauuugacugua

SEQ ID NO: 330367 - RNA, 64 nt, Human
ccugcagcauggccccugccuuaggccuaccugaucaaaauaaagccucagccacauuugcuau

SEQ ID NO: 330368 - RNA, 64 nt, Human
aauauuuauagaauuccaaagaaucagaauaguuucaaaauaauuuucagugauaaaagagugu

SEQ ID NO: 330369 - RNA, 64 nt, Human
uccuguagacauccucuuaggacauucucaaauuucaaaauaaaaaauauucaucuauguaguu

SEQ ID NO: 330370 - RNA, 64 nt, Human
acaacuggaguuuuuuuauacaauguucuuugucucaaaauaaagcaauguguuuuuucggaca

SEQ ID NO: 330371 - RNA, 64 nt, Human
guggaguggacauucaaaaaccugguuccuguccucaaaauaaggggcaccugggaaaacagag

SEQ ID NO: 330372 - RNA, 64 nt, Human
ugcacuccagccugggugacagcgagacccugucucaaaauauguauauauuuaauauauauau

SEQ ID NO: 330373 - RNA, 64 nt, Human
acuaucccaggaaaaccaucuagaguaguuuguuucaaaauauuagccacagaccaccuacauc

SEQ ID NO: 330374 - RNA, 64 nt, Human
uaccaaacuguaacaugucucaacuguauacaacucaaaauacaccagcucauuuggcugcuca

SEQ ID NO: 330375 - RNA, 64 nt, Human
cuuucagaauguuguccuuuuuaagaaaugauucucaaaauaccaguuuuuauuccaaaaauuu

SEQ ID NO: 330376 - RNA, 64 nt, Human
cguuuauuuauucacacuugaauugcauuugugaucaaaauaaauguuuaaaucgcuaaaggaa

SEQ ID NO: 330377 - RNA, 64 nt, Human
cagccuggccaacauagugaaaccccuuguuuacucaaaauacaaaaauuggcugggugcggug

SEQ ID NO: 330378 - RNA, 64 nt, Human
agauguuggauuggggaaaauccaaagcacaacuucaaaauaaaauacauuuuuagguuucgau

SEQ ID NO: 330379 - RNA, 64 nt, Human
uuaacuuuuuaaaacacaacuuuuaaaaaauguaucaaaauaauaaacguguucugauauuuuu

SEQ ID NO: 330380 - RNA, 64 nt, Human
uuuaguaaccaacacugcguaaagcagguagcauucaaaauaagaaacuguucucucucuaaau

SEQ ID NO: 330381 - RNA, 64 nt, Human
cagaugaugguaucugugaguauguuuugcaaauucaaaauauaguuugguaauuuuuuuuucc

SEQ ID NO: 330382 - RNA, 64 nt, Human
gauuuugugaaccgugaaguacgugagacuagaagacgcccaaacaagucagauaauaguaacu

SEQ ID NO: 330383 - RNA, 64 nt, Human
ccccucccaucugugccucuguaaggggcucugggacgcccagacccugcccgccgcccaccug

SEQ ID NO: 330384 - RNA, 64 nt, Human
uaaaaucgagugagagguuccgggcagcaggaucgacgcccaguccagccggcagagggaacac

SEQ ID NO: 330385 - RNA, 64 nt, Human
gcccucuugcaaaguagccucuuucaucccauacucaaaauacccaguuuagcaagcaacugag

SEQ ID NO: 330386 - RNA, 64 nt, Human
cgcccggcauguguguucagggacugagccuggggacgcccacccacacccacugcuuccucuc

SEQ ID NO: 330387 - RNA, 64 nt, Human
guaggccgcccaccgcccgcuucucugccaaaaggacgcccacggggagauggccgcacccaca

SEQ ID NO: 330388 - RNA, 64 nt, Human
gcuguuaugagcagcucuuccagugggcaaagaggacgcccauaauuucuuccauugcuagcuc

SEQ ID NO: 330389 - RNA, 64 nt, Human
cugcuguccccgcgugcacaagucucuuacacuggacgcccacugcuccucagcguccaguccu

SEQ ID NO: 330390 - RNA, 59 nt, Human
cagggcccccucccagcugagagcacugggacgcccaccgccccuuucccuccgcugcc

SEQ ID NO: 330391 - RNA, 64 nt, Human
ucgcuuccuggggcgacccuggcagugguugggagacgcccagauggagggggaggcugaccaa

SEQ ID NO: 330392 - RNA, 64 nt, Human
ccugucuccaggacggccuccucuccuacuuugggacgcccacguggcagaccgugaccaucuu

SEQ ID NO: 330393 - RNA, 64 nt, Human
cgcugagcggcugcccgaggaggagcucuaggccgacgcccaccgcaggccuuacagucuucuc

SEQ ID NO: 330394 - RNA, 64 nt, Human
uuuagucuucugcuugaggaacugacugugaagcgacgcccagugaaaaacauguucuugcagc

SEQ ID NO: 330395 - RNA, 64 nt, Human
acaggccauucacgagcccaaguugaagagaagagacgcccauccgugaaggagcagaccaucc

SEQ ID NO: 330396 - RNA, 64 nt, Human
aucacaagaagauuaaaguggcagacaccccuuccagcggaaguuacuaauucggaccugacug

SEQ ID NO: 330397 - RNA, 55 nt, Human
cuuggcuugaagaacaguaaaaucacagcggaaaauaaaaagaaagucgcguugu

SEQ ID NO: 330398 - RNA, 64 nt, Human
guacaaggaaggcaagaaaacaaagacaaauaaacagcggaaguuaucaguauggaggggaagu

SEQ ID NO: 330399 - RNA, 64 nt, Human
gccgccacuccugcgccugccauuggccuccucacagcggaaacacagcuugugagugcauguc

SEQ ID NO: 330400 - RNA, 64 nt, Human
ugaccacaacuauacuguggaggauacaaugcaccagcggaaaaggauucaucagcuagaacag

SEQ ID NO: 330401 - RNA, 64 nt, Human
ggguguuuucuaccacagauugauuuggcucagccagcggaauuggccacauuuccaguguaug

SEQ ID NO: 330402 - RNA, 64 nt, Human
caugugaaaagauccgcuaagacagcaugucugccagcggaaacuucucgagcuccccccucua

SEQ ID NO: 330403 - RNA, 64 nt, Human
gaaguuuaaauucuaguguccauaaauaaaguuucagcggaacacagccgugcuuaugugcgua

SEQ ID NO: 330404 - RNA, 64 nt, Human
aucuacacacaaauuauauaucuaucuaucuauacagcggaaccacaagagagacugaggaagg

SEQ ID NO: 330405 - RNA, 64 nt, Human
gaaguauuucaaguucauccuaaaauuuuauccuucaaaauaauuuuagacaaugccauaacuu

SEQ ID NO: 330406 - RNA, 64 nt, Human
caucccuuuuggggcaugcacuuucuuuccuuucucaaaauaauguuauauguggccacacuga

SEQ ID NO: 330407 - RNA, 64 nt, Human
ucacacuucuggggaacuggguauaauccaaccaucaaaauagaagaccuugcaagaagcagag

SEQ ID NO: 330408 - RNA, 64 nt, Human
agucuaugggguacugcauugcuuuuuauaaaguucaaaauaaagauuuauuuucaaacaagug

SEQ ID NO: 330409 - RNA, 64 nt, Human
aucaacaugaccaauguuuuucaucugccacaucucaaaauaaaacuucuggugaaacaaauua

SEQ ID NO: 330410 - RNA, 64 nt, Human
ucucaggcucaaguuuuuauaguuauuaaauguuucaaaauagacaaguuuuguuuccucauug

SEQ ID NO: 330411 - RNA, 64 nt, Human
aaugcuaaauaagccuauuuuuuacacuacacuaucaaaauaauuuuugccuucgaauuuuuuu

SEQ ID NO: 330412 - RNA, 64 nt, Human
cgugcaguuacucugggcucccauuuguugcuucucaaaauauaccucuugcccagcugccucu

SEQ ID NO: 330413 - RNA, 64 nt, Human
guuucuuauuuauuucuuuacaaaucauuccaguucaaaauauauaucagauuaauacacuggc

SEQ ID NO: 330414 - RNA, 64 nt, Human
uuucauuuacuuagcuaggagaaagacuugguucucaaaauaauacauuuuaagauuaauuggg

SEQ ID NO: 330415 - RNA, 64 nt, Human
aaauugaaaaguaccaauacuuuuugcacauagaucaaaauagaguggagaauuugggcuccaa

SEQ ID NO: 330416 - RNA, 64 nt, Human
aagaaguuuggaugagggauuuuuuuuuucuuugucaaaauaguuccuguuucuguagaaauuu

SEQ ID NO: 330417 - RNA, 64 nt, Human
ggaauuuucuucguuuuaauagaauauuauaaacucaaaauauaaauuuuuuucaaauuuggag

SEQ ID NO: 330418 - RNA, 64 nt, Human
aaacugaauugagaaaaaauuacaguauuauuccucaaaauaacaucaaucuauuuuuguaaac

SEQ ID NO: 330419 - RNA, 64 nt, Human
uguauuuugagauaaugucaaaaucaugaauauuucaaaauaaacuggggaguuauaaaaauac

SEQ ID NO: 330420 - RNA, 64 nt, Human
cugggaagcuuuaggacaucugcuacguuauuuaucaaaauauugggaucucugccuugugccu

SEQ ID NO: 330421 - RNA, 64 nt, Human
ccccacuccuggggcccccuaaccccaccccaggcagcggaaggggcugacugggucugguccu

SEQ ID NO: 330422 - RNA, 62 nt, Human
uggccucucccucgugcuccucaagagcccaguccauacacuguggaugucauugcugucgg

SEQ ID NO: 330423 - RNA, 62 nt, Human
aguugggcaaaagcuuggguaggacaagaacuuccauacaaauuugagauagaucucgccug

SEQ ID NO: 330424 - RNA, 64 nt, Human
aguuuguggggaggaaagacaucuguguaucacuucaaaauauugauuuacugcuaaacaucac

SEQ ID NO: 330425 - RNA, 64 nt, Human
cagagagaaaaauguuucgacagccaaguuuucuucaaaauauuaugugacagaauacgacuca

SEQ ID NO: 330426 - RNA, 64 nt, Human
uuuuuguaguuucuuuguagagagauaauaaaaaucaaaauauuuaaugaaaauggacuuacug

SEQ ID NO: 330427 - RNA, 64 nt, Human
acuauggggaaucaugguucuuuuaaagcaauuuucaaaauaaguaccaauuaaagcuuuaggu

SEQ ID NO: 330428 - RNA, 64 nt, Human
gggugcuggagauuuuacauuuugacaauuguuuucaaaauaaauguucggaauacagugcagc

SEQ ID NO: 330429 - RNA, 64 nt, Human
cuuggacauuuuacccuucagucggcccaagaaaucaaaauaaaggaaacacauuucauauacu

SEQ ID NO: 330430 - RNA, 64 nt, Human
uaucuuuccuuuuguuuacaacuguuaaaaaaccucaaaauaguucucuucaaaagaagagaga

SEQ ID NO: 330431 - RNA, 64 nt, Human
ugauaaugacaaaaagaauauuuuuuaaaccccaucaaaauagauuucaauugacuguuucccc

SEQ ID NO: 330432 - RNA, 64 nt, Human
uaacaucauauauuuguaauagugaaaccuguacucaaaauauaagcagcuugaaacuggcuuu

SEQ ID NO: 330433 - RNA, 64 nt, Human
uaaccuggauagccacauuaaugaauuggugcugucaaaauauaguaauuuuuaaauuuguuaa

SEQ ID NO: 330434 - RNA, 64 nt, Human
ucugauuaggaugaacuuaaugacuauuuacaccucaaaauauauucagcaaaggguucacuua

SEQ ID NO: 330435 - RNA, 64 nt, Human
cauggaggccuuugaaaugcaucuuuauuaaaaaucaaaauauaaccaggauacugaaagucag

SEQ ID NO: 330436 - RNA, 64 nt, Human
cacagguucccagguccccuggcuuuggcugauuucaaaauauagagcccuuucuugccaguac

SEQ ID NO: 330437 - RNA, 64 nt, Human
gguaucuaauauaccauuguauucacuaacuaacucaaaauaaacacauuuaaucuugacaucu

SEQ ID NO: 330438 - RNA, 64 nt, Human
uuaugugugaaaacauguuagugaacauauauaaucaaaauagauuucauugcuauugcauagu

SEQ ID NO: 330439 - RNA, 64 nt, Human
cugcaauaucaacaacaaguuguuucaaacagcaucaaaauacaacuucauugcuacacuuaca

SEQ ID NO: 330440 - RNA, 62 nt, Human
gcagcaaacguuugccugggcauugaggcauuuccauacaucuucugaaaacuaggcggagg

SEQ ID NO: 330441 - RNA, 62 nt, Human
aaugcugacauaaugagauguuguagacuguuuccauacaugggcuuaagaaguuggacaga

SEQ ID NO: 330442 - RNA, 62 nt, Human
agaucuuggcuuccuuuagaagccacuuaacuuccauacacuauaauaaacugugaacauau

SEQ ID NO: 330443 - RNA, 64 nt, Human
uucuguuaucuuuguucaaaaaguucaugucuucucaaaauaugaaauauugauaaauggaaga

SEQ ID NO: 330444 - RNA, 64 nt, Human
acauuuucuuuucucaucuuaaaacccuuuauguucaaaauacauuagcagaggccaugaaagu

SEQ ID NO: 330445 - RNA, 64 nt, Human
uggaguuucauaugcagcauuaauuaagcucacaucaaaauagaccagccauuugcacauaguu

SEQ ID NO: 330446 - RNA, 64 nt, Human
uauuggacaagugacagaaacugaucauccauauucaaaauauuuacagaaaaaagugucagug

SEQ ID NO: 330447 - RNA, 64 nt, Human
cacuuaguuuguuggucuuauguaaaacauuggcucaaaauaaaguacacacugauuuauuuua

SEQ ID NO: 330448 - RNA, 64 nt, Human
agagguucauuucaaauacaucuuugauacuuguucaaaauauguucuuuaaaaauauaauuuu

SEQ ID NO: 330449 - RNA, 64 nt, Human
uuuuaggacauacagcaaaugcugcucaucagcgucaaaauaguucaaauaauuuuacgaaaaa

SEQ ID NO: 330450 - RNA, 64 nt, Human
cuguaauucugaaucugaaagguaaaacaauuagucaaaauauuauugccaucauucuaccugu

SEQ ID NO: 330451 - RNA, 64 nt, Human
cacagaguuauauguguguguaucaaaaguggucucaaaauauuuuuuuaagaaaaaaagcaaa

SEQ ID NO: 330452 - RNA, 64 nt, Human
uauucuuuucaaauauuuguaggacaacuuugaaucaaaauaaauuauguuccuucuccaauuu

SEQ ID NO: 330453 - RNA, 64 nt, Human
ugugaaaauagaguuuugguaaucacuuucuuccucaaaauaaguccuucuguuaauuuguaaa

SEQ ID NO: 330454 - RNA, 64 nt, Human
uggggguauaucuauuucugaagagguaagcugaucaaaauaaauagaguguaaauucuuuuua

SEQ ID NO: 330455 - RNA, 64 nt, Human
ggcacacacugaguugcuuaugccacuuccuuguucaaaauaaaguaacugccuuaaucuuaua

SEQ ID NO: 330456 - RNA, 64 nt, Human
uacaguucaaggcuuucuauguuguuaaugaaccucaaaauagccguuaagacaugaaauacag

SEQ ID NO: 330457 - RNA, 64 nt, Human
ggaacagaaagccuuauaaaccaaauaaaaauucucaaaauacauugguuuauugaaccaauuu

SEQ ID NO: 330458 - RNA, 64 nt, Human
aaccuuauuaaaaauucuucagccaguuaggauuucaaaauacauuagugagaguaacagcuag

SEQ ID NO: 330459 - RNA, 62 nt, Human
uuuuuuugccuccuguucuaauaaauuuugucuccauacaaaucugaaccccaaguguguac

SEQ ID NO: 330460 - RNA, 62 nt, Human
gucccugcgcuuugguauaauauauauacuucuccauacacagaccucugcagaaugcaaaa

SEQ ID NO: 330461 - RNA, 62 nt, Human
cacuaucuuuucaaugaaaaaagcaauaaugauccauacauacuauaaggcacuuuuaacag

SEQ ID NO: 330462 - RNA, 64 nt, Human
agaugacaguaacugacuugaagauggaaaaauaucaaaauagaacuuuauauugaaaaucacu

SEQ ID NO: 330463 - RNA, 64 nt, Human
uuuauaguuuagggcaguggaaggaaggcuggcaucaaaauauuuugaucaaaaaagaugacaa

SEQ ID NO: 330464 - RNA, 64 nt, Human
cagauugucuuuaacuuuguuuuuaaaaugaccuucaaaauaaacugucaaaacaccauuauuu

SEQ ID NO: 330465 - RNA, 64 nt, Human
ccccugagaaaucuuguuaaaacacauuaaguagucaaaauaguaaucuuuaucauaucugcca

SEQ ID NO: 330466 - RNA, 64 nt, Human
uugaaaaacaagcagauuuuaaauuuugaaguaaucaaaauaauggaaagugucuguuuugugg

SEQ ID NO: 330467 - RNA, 64 nt, Human
aguucugcccaguuucugagcaaaaacuucaauuucaaaauaaagguuuucagggguucacuua

SEQ ID NO: 330468 - RNA, 62 nt, Human
ugcaauuaauuuauuuaaacuaaguaaauacuuuucaaaauacauaauugaauucgucucug

SEQ ID NO: 330469 - RNA, 64 nt, Human
uaaaauaugaauuuugcucuauuguaaacaugguucaaaauauuaauauguuuuuaucacaguc

SEQ ID NO: 330470 - RNA, 64 nt, Human
uauaaacuauuauaaguacuauuuuuguuauaauucaaaauagauauuuaguauaaaguuuuug

SEQ ID NO: 330471 - RNA, 64 nt, Human
uuuggagcaagagugucauaauguuucaggguagucaaaauaaacauaaauuaucuccucuaga

SEQ ID NO: 330472 - RNA, 64 nt, Human
acugcacuccugggcaacagagcaagacuucgucucaaaauaaauaaauaaaguggcucuuggg

SEQ ID NO: 330473 - RNA, 64 nt, Human
uuucagguuuuacugaugaggcuugugaggccaaucaaaauaauguuugugaucucuacuacug

SEQ ID NO: 330474 - RNA, 64 nt, Human
ucaucaaggaggcaaauugucuccccaagacagcucaaaauauccacaccucggcaacagucua

SEQ ID NO: 330475 - RNA, 64 nt, Human
uuaacaaaauaacauacgacgagagcuugaguugucaaaauauauuuuaauuaucuauugcuaa

SEQ ID NO: 330476 - RNA, 64 nt, Human
uucaagggguuggguauuacugacgagcuuuggcucaaaauauagcaggaccaggucuuuuguu

SEQ ID NO: 330477 - RNA, 64 nt, Human
cuuuuuuucaauugccagcuacugcuuuuauucaucaaaauaaaauaacuuguucugaaguugu

SEQ ID NO: 330478 - RNA, 62 nt, Human
caagucagguaaaauaaaaucgauucccagauuccauacauuaggagugcaaagacaggauc

SEQ ID NO: 330479 - RNA, 62 nt, Human
ugggccagaugguaaauauuuaugcuucacgguccauacagucucugucacaacuauucagu

SEQ ID NO: 330480 - RNA, 62 nt, Human
uuuaccaaucaacagcaugucuacugcuuggauccauacaaaacuaucgguucaaguugaug

SEQ ID NO: 330481 - RNA, 64 nt, Human
uuuuaauuuuuuucccagcguaaaaauagaaaaaucaaaauacuccuaacaaaaccagugauuu

SEQ ID NO: 330482 - RNA, 64 nt, Human
uaaaaauugaacuguaaacucuaucagcauuguuucaaaauagucauuuuuagcacuggggaaa

SEQ ID NO: 330483 - RNA, 54 nt, Human
aauguuucucuuuaccuuagcaccucaaaauaccaugccauuuaaagcuuauua

SEQ ID NO: 330484 - RNA, 64 nt, Human
uguagccaaaaauuacaaauggaauaaaguuuuaucaaaauauugcuaaaauaucagcuuuaaa

SEQ ID NO: 330485 - RNA, 64 nt, Human
ucuuuugaggaagucuaugccaaaauccuuuuuaucaaaauauucucgaaggcagugcagucac

SEQ ID NO: 330486 - RNA, 64 nt, Human
aggcagucaaaugguguuuguuuuuaucaaaaugucaaaauaacauacuuggagaaguauguaa

SEQ ID NO: 330487 - RNA, 64 nt, Human
agaaguucguauauccuggaauaacaugucaucuucaaaauauuuuuauuuucuaauauuuuua

SEQ ID NO: 330488 - RNA, 64 nt, Human
cagaguuugcgauauuuagauacugaaauuuaugucaaaauaacggcuaggaauaauucuguca

SEQ ID NO: 330489 - RNA, 64 nt, Human
uuuaaagugaaagaaaaaucuguaauacaaggauucaaaauaugugagggugcauagguauuuu

SEQ ID NO: 330490 - RNA, 64 nt, Human
aauuagaugaaucaacuagaaacaaacucaguggucaaaauaauuuuuaagaguauuccguaac

SEQ ID NO: 330491 - RNA, 64 nt, Human
uccugcaauuauguugaaaagaguaguacuuucuucaaaauauaaaaugccaagcacuucaggc

SEQ ID NO: 330492 - RNA, 64 nt, Human
gguuuuguucuuguauugcuuucuuucaacaguuucaaaauaaaauaucauauaaauauugagg

SEQ ID NO: 330493 - RNA, 64 nt, Human
cauauaaauauugagggaaauguuuucauauuuuucaaaauagguuuuuauuguugaauguaca

SEQ ID NO: 330494 - RNA, 64 nt, Human
uguauguuuggugcuuuccuuuugucuugcauacucaaaauaaccaugacaccaagguuaugaa

SEQ ID NO: 330495 - RNA, 64 nt, Human
uauuuuaacccuugaaucugcuuuauguacauaaucaaaauaucuauaucuauaucuauaucua

SEQ ID NO: 330496 - RNA, 64 nt, Human
caaggccuuuacugagcucaggacuccagcuaaaucaaaauacgcauguucucacccagaguga

SEQ ID NO: 330497 - RNA, 62 nt, Human
aacagagcggcuguguaugcagccugcagguuuccauacacugaagcuuuuaccucaacuuu

SEQ ID NO: 330498 - RNA, 62 nt, Human
uagcuaugugcugcugcugcucaagagcuggauccauacagguugugugucaucuguccucu

SEQ ID NO: 330499 - RNA, 62 nt, Human
uuaaguuuauuuuuccuuggauauaccuagauuccauacagugacaauacaaauacaaagga

SEQ ID NO: 330500 - RNA, 64 nt, Human
agaaaaaaauucggaaagugaucagagcacuuauucaaaauacagugauagaaguucagaaagc

SEQ ID NO: 330501 - RNA, 64 nt, Human
gaucuuuuaagcccaucaauuauagaaagccaaaucaaaauauguugaugaaaaauagcaaccu

SEQ ID NO: 330502 - RNA, 64 nt, Human
cacagaaaagaaggggagagauguucauguaaccucaaaauacuuaggcuugguuuugaugcua

SEQ ID NO: 330503 - RNA, 64 nt, Human
aguucugcauuagaaauggcaucuguuuuaggucucaaaauauaacucagcuguuucacacugu

SEQ ID NO: 330504 - RNA, 64 nt, Human
uacaaaguuauauucacaguuuuuuaaaaaugugucaaaauaaaggauaacucuguauuacagc

SEQ ID NO: 330505 - RNA, 64 nt, Human
auuggcaauauguguuuacuuuaaacuugucuuuucaaaauauuacucaguuuauguuguacaa

SEQ ID NO: 330506 - RNA, 64 nt, Human
aauaccuuuuguaccuaaauguuuuuuaaauuaaucaaaauacauucugugagauacuauuaaa

SEQ ID NO: 330507 - RNA, 64 nt, Human
gaauggggugauuuacagggauuucuguuuacugucaaaauauuucucaucugcacuauguuuc

SEQ ID NO: 330508 - RNA, 64 nt, Human
ucaaacucauccauagauaauucaagauuuguauucaaaauaaacauaguuuucacaguuacaa

SEQ ID NO: 330509 - RNA, 64 nt, Human
caucuuuguaacuuccugugaauuuauaauaauuucaaaauaaaacaaguuaaaaaaaaaccca

SEQ ID NO: 330510 - RNA, 64 nt, Human
uugcccacuacuacuaacuugaucaacaaugaauucaaaauaguuaaccuaugaaauaacaucc

SEQ ID NO: 330511 - RNA, 64 nt, Human
ucuuguuauaacuuuuuaaaagauugugaaaauaucaaaauauaaaugaaucaaguuuuaauau

SEQ ID NO: 330512 - RNA, 64 nt, Human
guaguggguguaaaaccagagauuauuuguaugcucaaaauaguuauauauucauuaaugaauu

SEQ ID NO: 330513 - RNA, 64 nt, Human
auuaaugacaggagucaaucagccuuuacagcuaucaaaauauaaugagaucccaaugaugauu

SEQ ID NO: 330514 - RNA, 64 nt, Human
ucacguuugcuuaaaugcuucaucacagucacauucaaaauagugacucuaaacaaagaagaaa

SEQ ID NO: 330515 - RNA, 64 nt, Human
agacuuguuuuauuagauuuuaccaaugaauuuuucaaaauacaaaaaaaaguaguuuuuccuu

SEQ ID NO: 330516 - RNA, 62 nt, Human
caagaguucggaaaccacaguuuugucucucauccauacacugggguuuauuuugccaaggu

SEQ ID NO: 330517 - RNA, 62 nt, Human
gaggguguuuauguaagagcaccuuccucacuuccauacagcucuacgcggcaaauuaacuu

SEQ ID NO: 330518 - RNA, 62 nt, Human
aacaaaucuuucuucauuuaugaauuucuuacuccauacaagcaguuuauggaugucugggc

SEQ ID NO: 330519 - RNA, 64 nt, Human
agccugcauauauuaucguacugguaaaaugcauucaaaauaauuaaagugcauguauuuuccu

SEQ ID NO: 330520 - RNA, 64 nt, Human
augccaauuguucuuauauucuauagaaguucgcucaaaauacucaacaggggaauaggcagcg

SEQ ID NO: 330521 - RNA, 64 nt, Human
ucauuaacaagaauaacauuuaaaggagauuguuucaaaauauuuuugcaaauugagauaagga

SEQ ID NO: 330522 - RNA, 64 nt, Human
aaaguugcuggcuauaggaaauguuauuuuguuuucaaaauauggcagagaugggggguggugg

SEQ ID NO: 330523 - RNA, 64 nt, Human
aaauaguaaaaauaauaauuuggugccuuucuccucaaaauaucaaucuuucaaacuauaauaa

SEQ ID NO: 330524 - RNA, 64 nt, Human
aaaauccacuauaucaugggcucugcagaacauaucaaaauaggauuucuuaaauuuuucaacc

SEQ ID NO: 330525 - RNA, 64 nt, Human
uauacugagauccacaucuagugaaaugucagugucaaaauauuauagauuauagcuaaaaucc

SEQ ID NO: 330526 - RNA, 64 nt, Human
aagaguucaucacggaaauucaagaaacuuuacuucaaaauauucacaaggcuaaauaacucuu

SEQ ID NO: 330527 - RNA, 64 nt, Human
uggggaggggaggugcuccgccucccagcuuuucucaaaauaguccuauagauacugguaaucu

SEQ ID NO: 330528 - RNA, 64 nt, Human
agcgaacaguccaaucagugggucauauguuuauucaaaauauuuuaucuuuuagcuagaaucc

SEQ ID NO: 330529 - RNA, 64 nt, Human
agguucuauuaauaaauuaauaaacuguuggucuucaaaauagaaaugcauguaauauccauau

SEQ ID NO: 330530 - RNA, 64 nt, Human
ucauugucucaaucacugauccuguaaguugucaucaaaauaugauuuagaaauauuggccaag

SEQ ID NO: 330531 - RNA, 64 nt, Human
uaugaccuuuggauauguuuguaaucauuucgaaucaaaauauugauuuaauuuugaccucugg

SEQ ID NO: 330532 - RNA, 64 nt, Human
auaggucaagagagagagacccagacaagcaaacucaaaauaaagagaaaaggaaacgaagaag

SEQ ID NO: 330533 - RNA, 64 nt, Human
aauuuauauauaggcagcagcaaaagagccauguucaaaauagucauuaugggcucaaauagaa

SEQ ID NO: 330534 - RNA, 64 nt, Human
ggcugcaccaguuggcuuuucuucuguuuuauucucaaaauauagagauucugugauuuauuug

SEQ ID NO: 330535 - RNA, 62 nt, Human
uaaaaaugaaucucguacuguaucuuacuauguccauacagauguuacaaaucgacaguuuu

SEQ ID NO: 330536 - RNA, 62 nt, Human
aaaccacuaaguuagaucucuaccucacaguguccauacaaauuaguuccagagggaagaua

SEQ ID NO: 330537 - RNA, 62 nt, Human
uguuucucugugccagaucuucagugccccuuuccauacagggauuuuuuucucauagagua

SEQ ID NO: 330538 - RNA, 64 nt, Human
gaaugcagcagccuuuuuguaaacuucccagauaucaaaauagacuuugauauauaaaugguuu

SEQ ID NO: 330539 - RNA, 64 nt, Human
guuguauucauaaaauacugaucuguguugcauuucaaaauaaacuggugugugcucugccugg

SEQ ID NO: 330540 - RNA, 64 nt, Human
uuauuuaaaaaaagcaugggaagauuuuuauuuaucaaaauauagaggaaauguagacaaaaug

SEQ ID NO: 330541 - RNA, 64 nt, Human
uagauuuuugcaugaaaaaaaucauaaauuucccucaaaauagacuguguugcaguacacaagu

SEQ ID NO: 330542 - RNA, 64 nt, Human
acuuuguuaaaaauauuuucugaauuauuaugucucaaaauaaguugaaaagguaggguuugag

SEQ ID NO: 330543 - RNA, 64 nt, Human
auuggagaaucaugcauuugggucacuaauuaucucaaaauauuucauacuaauaaaguugaau

SEQ ID NO: 330544 - RNA, 64 nt, Human
ucauuagcuuacuaacuugaaaguuagauuaauaucaaaauaagaauagcagcacuaugaagag

SEQ ID NO: 330545 - RNA, 64 nt, Human
gucauaaguagguaauugauaggguaugaacuagucaaaauaugaaccauuaugauucaaguua

SEQ ID NO: 330546 - RNA, 64 nt, Human
guagcuguguaugaauaaauauuaccugucuaccucaaaauacacauacugcugaagcauucug

SEQ ID NO: 330547 - RNA, 64 nt, Human
auuuaacguggaauuccuucauuucauaagaaccucaaaauaauggugauacauucuagccuua

SEQ ID NO: 330548 - RNA, 64 nt, Human
agcuuuuccgugccucuccuccaccucucccuucucaaaauacuucaugaaaggcaguguauuc

SEQ ID NO: 330549 - RNA, 64 nt, Human
guuuguugcauuucaguaaaagcagaauaaccuuucaaaauaauaacaggcugggugcaauggc

SEQ ID NO: 330550 - RNA, 64 nt, Human
cagccuggccugggcaacagagcaagacccugucucaaaauaauaauaauauauaauuuuacac

SEQ ID NO: 330551 - RNA, 64 nt, Human
ccucuaucccacaagccagaugcaggucugggguucaaaauaacucuuuggauccuacagagau

SEQ ID NO: 330552 - RNA, 64 nt, Human
uucuguauaaaacugucuuuuaagaauuauccuuucaaaauaaaaauguuauuguuucacuagu

SEQ ID NO: 330553 - RNA, 64 nt, Human
ugaacaauuugaauauaaauucaucauuuaguccucaaaauauauauagcauugcuaagauuuu

SEQ ID NO: 330554 - RNA, 62 nt, Human
auugggacucguauguaggaaucaaauaucccuccauacaguguacucuuauucuuggcaag

SEQ ID NO: 330555 - RNA, 62 nt, Human
aggcaauuugcuaggcucgggggcggguaguauccauacacuaugcacuacugcucugaagc

SEQ ID NO: 330556 - RNA, 62 nt, Human
aaauggccucaucucauaccauggcuccaccuuccauacaccagccacacggaacuacugug

SEQ ID NO: 330557 - RNA, 64 nt, Human
aguuauuucuguuuccuauuuaauacagcugaagucaaaauauguaagaacacauuuuaaauac

SEQ ID NO: 330558 - RNA, 64 nt, Human
cuucaaaaacaagaaaaacaacaacuaugaguuaucaaaauauugacuccauuuaugacuagac

SEQ ID NO: 330559 - RNA, 64 nt, Human
uuggcaugaacaaaagaaacaagagagaaaaaaaucaaaauaauuaaaauaaauuguuagagaa

SEQ ID NO: 330560 - RNA, 64 nt, Human
acuuccaccuggacauacgauaggaaauucaaacucaaaauaugaaaauugaucuuaauaacuc

SEQ ID NO: 330561 - RNA, 64 nt, Human
ugcauggaaauaggucauuaacuugaaacucuuaucaaaauauauuuuaccaguuuccagaauu

SEQ ID NO: 330562 - RNA, 64 nt, Human
acauagauauuauucacuaaaauuuucagcagacucaaaauagagaggagacuuuaaacuuaca

SEQ ID NO: 330563 - RNA, 64 nt, Human
auuacaguguaaguuuuucaaguggaaucuagaaucaaaauacagggagagauaugaagaccua

SEQ ID NO: 330564 - RNA, 64 nt, Human
auuuuuuuaaagaagggaaucuguuuaucgcuuuucaaaauauuuucuaaagugggggaagaaa

SEQ ID NO: 330565 - RNA, 64 nt, Human
aaaaaccacacacacacauaaaaaacccaacaggucaaaauaaaaguugaacuugaguuacauu

SEQ ID NO: 330566 - RNA, 64 nt, Human
caaaccaguuucacauaaguuauuugucuucuuuucaaaauaauuagcuauauuuuuauauaau

SEQ ID NO: 330567 - RNA, 64 nt, Human
uuauaauuauacaggcucuguggagaaauaaaguucaaaauauauuaauuuguaaaaucagcuc

SEQ ID NO: 330568 - RNA, 64 nt, Human
uaacuuuaaacauguuuuagaauucaccuaaagaucaaaauaucauggauugaaccucaucaau

SEQ ID NO: 330569 - RNA, 64 nt, Human
ggugggaaauagcagugaauuuuagucauuaacuucaaaauauauauauauauauaauuuaaag

SEQ ID NO: 330570 - RNA, 64 nt, Human
uaaguuuaguaaauauuaauaaauggauacacauucaaaauacuuuuaaaaaaaagaaaauguu

SEQ ID NO: 330571 - RNA, 64 nt, Human
aguuaguaacuaggugguucacaaaauuacaacaucaaaauaguuacaucuugugaaaauauau

SEQ ID NO: 330572 - RNA, 64 nt, Human
ccucaaguuguauucccuggcaaaauggacuuucucaaaauaggacugcacgcuugguguacuu

SEQ ID NO: 330573 - RNA, 62 nt, Human
uugcaugauacacaagcaccaauaaagacuaauccauacacaguuaaccuaaugccaaauaa

SEQ ID NO: 330574 - RNA, 62 nt, Human
ccagaagaaucugauaucaucauagugaagacuccauacagacacaugaaugaauuauauug

SEQ ID NO: 330575 - RNA, 62 nt, Human
cagauguuucuauguggauucuguaauguuccuccauacaguuaaaacauccuaacuuguuu

SEQ ID NO: 330576 - RNA, 64 nt, Human
auguuuuuuugaauauaauuaacuugcccccaacucaaaauagcugucuguguugcaaucauug

SEQ ID NO: 330577 - RNA, 64 nt, Human
guuuucacuguaggaaucacaaaauaaguuuuugucaaaauaacuguuguugaacguuauacug

SEQ ID NO: 330578 - RNA, 64 nt, Human
acuuugaugucaguacaacuucagcaauugguuuucaaaauagaugagaauaugguacagauug

SEQ ID NO: 330579 - RNA, 64 nt, Human
gugaaggacauuuauuuagagucugacaacauauucaaaauauuuuucagccucuacugauagu

SEQ ID NO: 330580 - RNA, 64 nt, Human
guaaauuauauuuauacaucuucugaaauauauuucaaaauauguguguacguguguauaugug

SEQ ID NO: 330581 - RNA, 64 nt, Human
ggcacuccagccugggugacagagugagacugucucaaaauaaaauaaaaauaacauauuggug

SEQ ID NO: 330582 - RNA, 64 nt, Human
cuuguuauuuaaauauuggacaaaauggcuggcuucaaaauauagucauuaauaaacuaacuuu

SEQ ID NO: 330583 - RNA, 64 nt, Human
aucuucauacaaugacaaguaugaugauuugcuaucaaaauaaauugaaauauaaugcaaacca

SEQ ID NO: 330584 - RNA, 64 nt, Human
acauguuaaauuucccuuuuauuuuggucaugcaucaaaauaaauuuacuaaguacuaaagagc

SEQ ID NO: 330585 - RNA, 64 nt, Human
gcauguuacauaagauaaaugugcugaaugguuuucaaaauaaaaaugagguacucuccuggaa

SEQ ID NO: 330586 - RNA, 64 nt, Human
uuagguguggagccauuuuuauuauaaaacuuucucaaaauaaaaaaacauugaaucauuucaa

SEQ ID NO: 330587 - RNA, 64 nt, Human
aacaggcugauuuucuggccuuuggagaagugauucaaaauaguguagauuuucugcauagauc

SEQ ID NO: 330588 - RNA, 64 nt, Human
cugauuuauucuauuaaauuguaagcuugcaaacucaaaauaaauuggcagauuuaccucucau

SEQ ID NO: 330589 - RNA, 64 nt, Human
uacaaaaaguauccuuugagaugaagucguguucucaaaauaagguuauauuauuuucuuuuuc

SEQ ID NO: 330590 - RNA, 64 nt, Human
acacauauggagguuugcugccauauauauugcaucaaaauaucauuaauuaauauaaaaauau

SEQ ID NO: 330591 - RNA, 64 nt, Human
gguugagacuaaauuacucaucgucaaaauaaugucaaaauaguuuuggggaucaccacuauau

SEQ ID NO: 330592 - RNA, 64 nt, Human
agccugagggccugcggagccucaagaagccagaccgcaagaagcgcuacaccguggugggcaa

SEQ ID NO: 330593 - RNA, 64 nt, Human
uuaccaagcugagcaaccucuucagcugggaaggccgcaagaggcauagagggagaggaagcac

SEQ ID NO: 330594 - RNA, 64 nt, Human
gguagagucuccaggaggagcccagggcccucugccgcaagaaacagugugagcuacugccacg

SEQ ID NO: 330595 - RNA, 64 nt, Human
aaaaagauuuugguugagacuaaauuacucaucgucaaaauaaugucaaaauaguuuuggggau

SEQ ID NO: 330596 - RNA, 64 nt, Human
ugucaucguuauccucucuuaugaacaacuguagucaaaauaagguggcacaauuuaauuguuu

SEQ ID NO: 330597 - RNA, 64 nt, Human
ucucuaagaguuuuuuuccuucugagcuuccuuuucaaaauaaaagugacaauuguagcauuga

SEQ ID NO: 330598 - RNA, 64 nt, Human
ucaacaugagagaaaucaccaacaaagaagauguucaaaauaauagucccauaucuguaaucau

SEQ ID NO: 330599 - RNA, 64 nt, Human
uauacuauagaauaauauuuuguucucuaguauaucaaaauaccaaaauauuaucucauauuuu

SEQ ID NO: 330600 - RNA, 64 nt, Human
aaaguggggaggaagggaggaaaaauaauuacagucaaaauauuugcaaucuaucuacucauuu

SEQ ID NO: 330601 - RNA, 64 nt, Human
auaaaagguguuguggaaacuuaaaauucuuaauucaaaauauucgguccuguccacuguuuau

SEQ ID NO: 330602 - RNA, 64 nt, Human
auuuuguacaaauuuguuauuuuccauuuuuauuucaaaauauacauucaaacuuaaaauuacc

SEQ ID NO: 330603 - RNA, 64 nt, Human
cuuaauugaagggguuuggguggauuuuuuuuucucaaaauaagcuguagggacuauuuuaaca

SEQ ID NO: 330604 - RNA, 64 nt, Human
aggccauuaauacagagaagaauacauuuuaaugucaaaauagugcucuuuaaaauucuggcac

SEQ ID NO: 330605 - RNA, 64 nt, Human
guucccuacaauggcuauuuagacuuucccugcuucaaaauaagagcaguauccuuagcucuag

SEQ ID NO: 330606 - RNA, 64 nt, Human
uaauugccauucagaaugcuauuuuugugugaaaucaaaauaucauugggccaugagcuaguau

SEQ ID NO: 330607 - RNA, 64 nt, Human
uuagcuuuuuagaacuuugaucugcuagggauugucaaaauaaucuccuugaggcaucuuuauu

SEQ ID NO: 330608 - RNA, 64 nt, Human
aauuuuuaauuuuuuuguuuccauuuauaguggaucaaaauauuuaaacaugcaguugcugggu

SEQ ID NO: 330609 - RNA, 64 nt, Human
ugaagcguuauagaagauaacuggccucauuucuucaaaauaucaaguguugggaaagaaaaaa

SEQ ID NO: 330610 - RNA, 64 nt, Human; identical to SEQ ID NO: 330609

SEQ ID NO: 330611 - RNA, 62 nt, Human
ucuucauuuuuagaaaugccugugaagaccuuggcagcgacguggcucgagaagcauucauc

SEQ ID NO: 330612 - RNA, 62 nt, Human
cagcugucgaggagggggccgccgcggacccuggcagcgaugggucuccaggcaaguccccg

SEQ ID NO: 330613 - RNA, 64 nt, Human
uucacccauauuaaauauuuuggccccuuuaaggucaaaauacagaucaucuagaaguuagauu

SEQ ID NO: 330614 - RNA, 64 nt, Human
aaaugcuaugacuguaucuugauaucucgaacuuucaaaauauauuuucaguacacccaguugc

SEQ ID NO: 330615 - RNA, 64 nt, Human
cugugcaauuauguaaaauuuucaacugucuuccucaaaauaaagaaguaugguaaucuuuacc

SEQ ID NO: 330616 - RNA, 64 nt, Human
acugaauugcaaucuauauuuuuaaaaagaaaaaucaaaauacauuaggguuuacuugguugug

SEQ ID NO: 330617 - RNA, 64 nt, Human
gcaagaagucuugagaaaaagauuauuguaguguucaaaauauuuuuguauuguuaaugcauca

SEQ ID NO: 330618 - RNA, 64 nt, Human
guacuccagccugggcaauaagagcaaaacuccaucaaaauaaaauaaaauaaaauauaaaaua

SEQ ID NO: 330619 - RNA, 64 nt, Human
ugcauauuuauuaauguacagucacugcuaguguucaaaauaaaaauguuacaaauaccuguua

SEQ ID NO: 330620 - RNA, 64 nt, Human
gcaugugugggcaaaaaagcaauaauccuacuccucaaaauagaaaguugaagauugcugaaaa

SEQ ID NO: 330621 - RNA, 64 nt, Human
caucaagaaaacuaguuucuauuguauuaguaacucaaaauaaauuaucacuucgaaaacuugc

SEQ ID NO: 330622 - RNA, 64 nt, Human
agaauucuauguuuaauaaugaauauuguugaguucaaaauauucucauauacccagauuuaca

SEQ ID NO: 330623 - RNA, 64 nt, Human
gugcuuuuuuuuuuuuuuuuggcuuugggaaaagucaaaauaaaacaaccagaaaaccccugaa

SEQ ID NO: 330624 - RNA, 64 nt, Human
caaaaaacagucuaauaucuuauuuuacaugauuucaaaauaaaguugauuguaguacagauug

SEQ ID NO: 330625 - RNA, 64 nt, Human
cuauuuuuauaacuucuugugagucuuaaguauuucaaaauaaaagugguuuuaaaguaaauuc

SEQ ID NO: 330626 - RNA, 64 nt, Human
aaagcauaauaauaacauaucuuuaaaaagcuuuucaaaauauauuuucacccugacagugacc

SEQ ID NO: 330627 - RNA, 64 nt, Human
cccugauuaaaucaagagauuccuuuuuuaaaaaucaaaauaaaauuguuacaacauagccaua

SEQ ID NO: 330628 - RNA, 64 nt, Human
uauccaacuacuguauauuuagguaacuagaauuucaaaauagaaaaaaaaaaacuguguccug

SEQ ID NO: 330629 - RNA, 62 nt, Human
uaugauuuauaguuuguacaugcauucauacaggcagcgauggucucagaaaccaaacaguu

SEQ ID NO: 330630 - RNA, 62 nt, Human
uuucaaaacguugggaauaagggccugcaaaaggcagcgaggaggcaccucgggucuugagg

SEQ ID NO: 330631 - RNA, 62 nt, Human
ccccugcagcuggggaagacuuaugccaucccggcagcgaggcugggcuggccagccaccac

SEQ ID NO: 330632 - RNA, 64 nt, Human
cauaccuguaaaucgaaggccaauggucagaucuucaaaauaaaaagucaucuuaaaaaccugg

SEQ ID NO: 330633 - RNA, 64 nt, Human
uugcacuccuguuggaaagucuaaaaugcuuacuucaaaauaagaaauguauguaauuauauac

SEQ ID NO: 330634 - RNA, 60 nt, Human
gccguggucgccgucugugaacaagauuccucaaaauauuuucuguuaauaaauugccuu

SEQ ID NO: 330635 - RNA, 64 nt, Human
cucucaccaugaugugaagaguuucacaaauccuucaaaauaaaaaguaaugacuuagaaacug

SEQ ID NO: 330636 - RNA, 64 nt, Human
guuagauugaggaugggggcaugacacuccagugucaaaauaagucuuaguagauuuccuuguu

SEQ ID NO: 330637 - RNA, 64 nt, Human
auuaauuguuuuacccucaagcugggaauauuuuucaaaauaaauacuauaauauagauaucaa

SEQ ID NO: 330638 - RNA, 64 nt, Human
aauucauuuuuuaaaagauuauuuaaugcccauuucaaaauacaguaguuuacacagcuacaga

SEQ ID NO: 330639 - RNA, 64 nt, Human
uaauuuuaguacaaaauuucauaaaccguguuuuucaaaauaaguuuaugucaaauccagcuuc

SEQ ID NO: 330640 - RNA, 64 nt, Human
uaaagaagggacuaaauaugacuuuaaagagacuucaaaauauugaguauuuuaaaaauuuaaa

SEQ ID NO: 330641 - RNA, 64 nt, Human
auuuuaagagagaauacuuugacaccuguaaaaaucaaaauacuacucuuuauaagacauuuca

SEQ ID NO: 330642 - RNA, 64 nt, Human
ccaacugcauuuaaaacaaaacaaaacagaaaaaucaaaauaacauugacucuuccaaccacug

SEQ ID NO: 330643 - RNA, 64 nt, Human
cuauauuugucuuauauacaaguauuugcuuuuaucaaaauaauuccaauaaagcauuuuaaag

SEQ ID NO: 330644 - RNA, 64 nt, Human
ucuucauuuccauucuucugcccaugauuacugaucaaaauacugguagagucauggaggaagu

SEQ ID NO: 330645 - RNA, 64 nt, Human
caagacauuuaccuauuugucuuuccuuacguucucaaaauauuaacucgaauuguaaauuaag

SEQ ID NO: 330646 - RNA, 64 nt, Human
cucacccaugcauauaguaagaacuaaugaauaaucaaaauaauuucaucaacuuuuagaauau

SEQ ID NO: 330647 - RNA, 64 nt, Human
auauacaaccacaauaaagcaaaauaaccuacuaucaaaauagaaauguugcuaucuuuauaag

SEQ ID NO: 330648 - RNA, 62 nt, Human
uguguggcagauuuagugaaagcuagagauauggcagcgaaaggauguaaacagugccugcu

SEQ ID NO: 330649 - RNA, 62 nt, Human
cgggcuccuaaugaggugggaaagccacggcaggcagcgagcagcccaggccagcuuucugc

SEQ ID NO: 330650 - RNA, 62 nt, Human
ccccuuugaaacucaagcacagcugcgaggagggcagcgaggagggaccccucucucauggu

SEQ ID NO: 330651 - RNA, 64 nt, Human
uuguucucuaggaaaagagaacuuuuuucaaaauucaaaauacuuuuuaaggauggcacaguac

SEQ ID NO: 330652 - RNA, 64 nt, Human
uccuauaaacugccugcagacguuagcaggcucuucaaaauaacuccauggugcacaggagcac

SEQ ID NO: 330653 - RNA, 64 nt, Human
auuuuaagaucucaaguuuuuauuuaacuaauacucaaaauauggacuuuucauguaugcauag

SEQ ID NO: 330654 - RNA, 64 nt, Human
uagucaucauucugauuugcuuaucuguuuuuggucaaaauauuuauuuuuaaacauguuagaa

SEQ ID NO: 330655 - RNA, 64 nt, Human
cacuccagccugggugacaaagcaagacugugucucaaaauaaauaaauaaaauaaaauaaaau

SEQ ID NO: 330656 - RNA, 64 nt, Human
guagauagcagagcaugguauuagugaaaaagguucaaaauacacaaguaacauacacucugaa

SEQ ID NO: 330657 - RNA, 64 nt, Human
aacaugaaaagggcuuuauuuucaaaaauuaacuucaaaauaaguguauaaaaugcaacuguug

SEQ ID NO: 330658 - RNA, 64 nt, Human
uaucaaaguaauaacacaaaugaagugucauuauucaaaauaguccacugacuccucacaucug

SEQ ID NO: 330659 - RNA, 64 nt, Human
ugcaggcccccaggcacuuuuuuuuuuggauggcucaaaauauggugcugcuuuauauaaaccu

SEQ ID NO: 330660 - RNA, 64 nt, Human
uucuugacaguucuauaguuauacacauaaauuuucaaaauaaagaauaccauacuacacaaug

SEQ ID NO: 330661 - RNA, 64 nt, Human
aauuuaauguaugaauagaugugaauuugggauuucaaaauagaugaauaacaacuauuuuaua

SEQ ID NO: 330662 - RNA, 64 nt, Human
auucacauuaugauauuuuucuaucuuaaauuugucaaaauaaaguaugagucuaacuauuaaa

SEQ ID NO: 330663 - RNA, 64 nt, Human
auaugaagugagacauaugggugagucauaauaaucaaaauaauuuaugaagagcugggucugc

SEQ ID NO: 330664 - RNA, 64 nt, Human
acagaagugaaucagacuuuucuccagcuaccuuucaaaauaauaaauuauuugucucaaauau

SEQ ID NO: 330665 - RNA, 64 nt, Human
gggugcuguagacaggcuucuucucuuccugcucucaaaauaccucggcuugacauuuggacag

SEQ ID NO: 330666 - RNA, 64 nt, Human
auuagcuuagcaauuuuuuuuucucuuuuaagaaucaaaauauggauuugauacuaggaacaga

SEQ ID NO: 330667 - RNA, 62 nt, Human
aggugcagccucgaggaaucugagggcgucggggcagcgaaccuuugcauccacggacuccu

SEQ ID NO: 330668 - RNA, 64 nt, Human
gugcccaggccagcuucgagcuacaugcaucuagggcggagaggcugcacuugugagagaaaau

SEQ ID NO: 330669 - RNA, 64 nt, Human
cuuuauaagcuuuugagaaugugaaauagcaccaucaaaauauaaugucagaggaugcucacac

SEQ ID NO: 330670 - RNA, 64 nt, Human
cauaugggauugccacuagcuucuucugccaauaucaaaauaccuucucagaugcuuuagaaac

SEQ ID NO: 330671 - RNA, 64 nt, Human
uaaauugcuauggcaauguuucuuuuauaaaucaucaaaauaaaccuuugugaauugauuuuug

SEQ ID NO: 330672 - RNA, 64 nt, Human
uuucuguuaccucaacaagaagaauuugaagacuucaaaauauugagcagaauucauucauacu

SEQ ID NO: 330673 - RNA, 64 nt, Human
aaccucaagaaugacuuuauucuuguaucucaucucaaaauauuaauaauuuuuuucccaaaag

SEQ ID NO: 330674 - RNA, 64 nt, Human
uaauguauuguauuauaaaauauuuuaaguguacucaaaauaucauaauuguacaguuuaugcc

SEQ ID NO: 330675 - RNA, 64 nt, Human
uguaauaauucuuuccuaucaaaaucuccauaggucaaaauauuguuggaauacuaaaauuugc

SEQ ID NO: 330676 - RNA, 64 nt, Human
ugucuaauagcccauaaagucugagaaauagguaucaaaauaguuuaggaaaaugagaggagaa

SEQ ID NO: 330677 - RNA, 64 nt, Human
agcauucucucugacauuuaaaaauaauuucuauucaaaauacaugcauaauugauuuuacacc

SEQ ID NO: 330678 - RNA, 64 nt, Human
cugcuauaaauuucuugugauacucuuuuagagcucaaaauaucucugagcuuuagacauggua

SEQ ID NO: 330679 - RNA, 64 nt, Human
uuaauuugauaugcucuaaauacauaaaggugcuucaaaauauguagaaacauuacuaugaaau

SEQ ID NO: 330680 - RNA, 64 nt, Human
aaagguuuggauuucuccaaaucugggagaauuuucaaaauaagaaaauaaccuuuauaugaua

SEQ ID NO: 330681 - RNA, 64 nt, Human
caaaggguuuaauucggguggggaauauaacauaucaaaauacaugaacaaauggaaaguuacu

SEQ ID NO: 330682 - RNA, 64 nt, Human
auuaaauauuuuacuucuuuccauaaagaguagcucaaaauaugcaauuaauuuaauaauuucu

SEQ ID NO: 330683 - RNA, 64 nt, Human
aggacuuugugcaauguauuuuuguaaaugcuuuucaaaauaucugucuuugguagugcuucug

SEQ ID NO: 330684 - RNA, 64 nt, Human
acuucuucacaugacacaggggaauccugauuagucaaaauaauaaugauuucauucucuuugc

SEQ ID NO: 330685 - RNA, 64 nt, Human
cuugaacagggaccaccccugcagagccagccagggcggagagccauacccuggccccagcgcg

SEQ ID NO: 330686 - RNA, 64 nt, Human
gagggaccgcgcaggcuccuuuguucuguauucuggcggagauggguccuggccuugugucacu

SEQ ID NO: 330687 - RNA, 64 nt, Human
aaagcgauaaaauaaaagcgauuuucauuugguaggcggagagugaauuaccaacagggaauug

SEQ ID NO: 330688 - RNA, 64 nt, Human
aacaacaaauuaaauuauuagcccuuaaacucuuucaaaauauaaaagcagcaggccccaggug

SEQ ID NO: 330689 - RNA, 64 nt, Human
gaaacauaacaccccaaaggcacguugauuuguaucaaaauaaauauccaguuucuuuuagcau

SEQ ID NO: 330690 - RNA, 64 nt, Human
cauuuacaaccuaaugacuuuuguauuuuauuuuucaaaauaaaagcuuucaaugugaagcauu

SEQ ID NO: 330691 - RNA, 64 nt, Human
uuaauauuugaacucaagugggauuagaagacuaucaaaauacauguauguuucaggauauuug

SEQ ID NO: 330692 - RNA, 64 nt, Human
uggaaauggcagagcugaaacuuauuccaagcuuucaaaauaaucuuuuaagaagccaggauuc

SEQ ID NO: 330693 - RNA, 64 nt, Human
aaugccacacauagguuguauuguaauggcauuaucaaaauauuugaugauguuucagauauau

SEQ ID NO: 330694 - RNA, 64 nt, Human
aaaacacaguguucuuuuaaaaaucuauaauaugucaaaauacaaguuuuuuuuuuuuacaucg

SEQ ID NO: 330695 - RNA, 64 nt, Human
gaaaauuaaauggaaugaaugauauguauauuacucaaaauaaaguuucuuucacuuuaauaau

SEQ ID NO: 330696 - RNA, 64 nt, Human
uggaagaauauuuauaggcaauacagucaaaguuucaaaauagcaucacacaaaacauguuuau

SEQ ID NO: 330697 - RNA, 64 nt, Human
uagauguuuuguguguauuuuuuuaaaugaaaacucaaaauaagacaaguaauuuguugauaaa

SEQ ID NO: 330698 - RNA, 64 nt, Human
uauuagaauaccacaggaaccacaagacugcacaucaaaauaugccccauucaacaucuaguga

SEQ ID NO: 330699 - RNA, 64 nt, Human
ugaaugaaugcaagguuagugagauccuaagcucucaaaauagcauauucccuagagcucaaga

SEQ ID NO: 330700 - RNA, 64 nt, Human
cucaauuauugcaaaaauguaacaauaaaguuccucaaaauaagaucuguuccucauagcuaua

SEQ ID NO: 330701 - RNA, 64 nt, Human
auugaauggauauuccuauggaaaauuuuuuguuucaaaauacaggaaaaacauuccuauuacc

SEQ ID NO: 330702 - RNA, 64 nt, Human
aauacuguugugucugcaccagucuuuuagugucucaaaauagauuauuaauacauccauaagu

SEQ ID NO: 330703 - RNA, 64 nt, Human
cuuuuuuuuuaagcuuggcaaacaucccagcuaaucaaaauagucauauuccugagaaguagga

SEQ ID NO: 330704 - RNA, 64 nt, Human
acagggguccugcuccugauggggccucaggaggggcggagagggguggaagggagggagcugc

SEQ ID NO: 330705 - RNA, 64 nt, Human
ugcacccuccucuugcccaaguggggagcacagaggcggagaggaaucccuuaccacacccacg

SEQ ID NO: 330706 - RNA, 64 nt, Human
ucucggaaagaccggagggcuucuccccacagaaggcggagagagcuggggcucagacaugggu

SEQ ID NO: 330707 - RNA, 64 nt, Human
caaagagcaguuugaauuuucuugucgcuuccuaucaaaauauucagagacucgagcacagcac

SEQ ID NO: 330708 - RNA, 64 nt, Human
cucacauacuauaaaauaaaucuucacugcccuaucaaaauacaaauaaaucaaucuaugcugu

SEQ ID NO: 330709 - RNA, 64 nt, Human
aauuuccaaauauuuguggguccgacaguaaugaucaaaauaugaaugacuuuggaaaauuuac

SEQ ID NO: 330710 - RNA, 64 nt, Human
uaaaauguagcuuugguauaacuucauguguauuucaaaauauacugaacgucaacaugauuug

SEQ ID NO: 330711 - RNA, 64 nt, Human
gaaaagugaguucugccuuuccuuugaucgagggucaaaauacaaagacauuuuugcuagggcc

SEQ ID NO: 330712 - RNA, 64 nt, Human
aauccagucucagcacuuuauucauacaaaauaaucaaaauagguuuucuacaccaaaugcuac

SEQ ID NO: 330713 - RNA, 64 nt, Human
gagguucuuaauuuuagcucagaauauaaauuagucaaaauacacuucaggugcuuaaaucaga

SEQ ID NO: 330714 - RNA, 64 nt, Human
aacaacuacauuuuaaaaacugacuuaaugcucuucaaaauaaaacaucaccuauuuaauguuu

SEQ ID NO: 330715 - RNA, 64 nt, Human
cuuuucugaccaaagagaagcaaaaucuaccaggucaaaauagugccacuaacgguugaguuuu

SEQ ID NO: 330716 - RNA, 64 nt, Human
guuucugcccauuaugaaagaugaaauaaaguauucaaaauauuaacauuuucauaaauauaag

SEQ ID NO: 330717 - RNA, 64 nt, Human
uguuuacagaacccaaaugaugucuuccucucucucaaaauaaacuaaccuauucauauugcug

SEQ ID NO: 330718 - RNA, 64 nt, Human
cugccggccuuugcuccuucacuuccaacaucucucaaaauaaaaaucccucuucccgcucuga

SEQ ID NO: 330719 - RNA, 64 nt, Human
uuuuuuuauuuauucauuagaaauuuuccucauuucaaaauaauuuaugacucauggaauguug

SEQ ID NO: 330720 - RNA, 64 nt, Human
aaauuuuuaaaaacuuuaaaauuuuaaauauuagucaaaauacuuuuuaaguccugagugcuua

SEQ ID NO: 330721 - RNA, 64 nt, Human
aaguugcauguuugaggcauguuuccaaauauuaucaaaauauccugaauuguauugugaauau

SEQ ID NO: 330722 - RNA, 64 nt, Human
aaguaauggcugcuauuuauaaauggaacaucuaucaaaauaaguaacuguuuauaaaauucag

SEQ ID NO: 330723 - RNA, 64 nt, Human
uucggagcuugucaggaaguggccguagcaacuuggcggagacaggcuaugagucugacguuag

SEQ ID NO: 330724 - RNA, 64 nt, Human
gguuacuacgguaggugccuggcggaagggagugggcggagauauguaaauagaaagugcguac

SEQ ID NO: 330725 - RNA, 64 nt, Human
agagagacucugugaaaguaaagaagguagucauggcggagaagguuucagccagauugcaaau

SEQ ID NO: 330726 - RNA, 64 nt, Human
gcaauguuuuaccaauaaugcaauacaaaagaccucaaaauaccugugcauuucuuguaggaaa

SEQ ID NO: 330727 - RNA, 64 nt, Human
ugcagcagugcgaggacaaaagaucauggaguggucaaaauauucagaugagacauuuggcaug

SEQ ID NO: 330728 - RNA, 64 nt, Human
aucuuacucuuucaucugauaccuuguucagauuucaaaauaguuguagccuuauccugguuuu

SEQ ID NO: 330729 - RNA, 64 nt, Human
aguguaguuauaucaguguuuacugaagggaacaucaaaauauuaaugguauauuauaaaauaa

SEQ ID NO: 330730 - RNA, 64 nt, Human
cuggaaaaaaggaacugauguuuucagcauauuuucaaaauauugauaagggaaguuauuacuu

SEQ ID NO: 330731 - RNA, 64 nt, Human
augaaaaauacauauuugcauguaaacaaugauuucaaaauacuugaaaaauaaaauuuuaacc

SEQ ID NO: 330732 - RNA, 64 nt, Human
cuuagugucucuauuuaugagaucacugaacuuuucaaaauaaagcuuuugcauagaauaauga

SEQ ID NO: 330733 - RNA, 64 nt, Human
ugacauggaaaccuggugguauggaagcauguacucaaaauauagacgugcacgaugguggugu

SEQ ID NO: 330734 - RNA, 64 nt, Human
uggaagccaaauuuuaucuuuaaagacuguauuuucaaaauaaaacuuuuucuuguuuguuuca

SEQ ID NO: 330735 - RNA, 64 nt, Human
cccuuuagaaaauuagccuccaaaaucuuuuguuucaaaauauuauauuauuucauaaauaauu

SEQ ID NO: 330736 - RNA, 64 nt, Human
acuaauuagcuuuaaacacuaaaaucagauuucuucaaaauauaaauuuguuuugauucuuuau

SEQ ID NO: 330737 - RNA, 64 nt, Human
aauaaccucagcugggaugaggagugacagaauaucaaaauaauuuguggcuguggauuuuuuu

SEQ ID NO: 330738 - RNA, 64 nt, Human
guucccaucauaaaauaaugacccaaggagacguucaaaauauuaaagucuauuuucuacugag

SEQ ID NO: 330739 - RNA, 64 nt, Human
uucucagguaggaagcaacagcuucagaaagagcucaaaauaaauuggaaaugugaaucgcagc

SEQ ID NO: 330740 - RNA, 55 nt, Human
aaaaaauagaaaagcuauaaauauuucaaaauaaagaagaauccacauugcauuu

SEQ ID NO: 330741 - RNA, 64 nt, Human
auuuuuaaaacaacugacugauaguucuauauuuucaaaauauuugaaaauaaaaaguauuccc

SEQ ID NO: 330742 - RNA, 64 nt, Human
cacaccaccaugcccagcuaacuuuuguauuuuuggcggagacaggguuucaccauguuggcca

SEQ ID NO: 330743 - RNA, 64 nt, Human
cggaccuuccuuccagggcuuuuccuuugggggaggcggagaggggagaagaaggaagggaagg

SEQ ID NO: 330744 - RNA, 64 nt, Human
uggcauuauacugaacuauacauugagaaaucaaucaaaauaaaaauuuuuacuuucacaaguu

SEQ ID NO: 330745 - RNA, 64 nt, Human
aaaaauauuuuagcuuagacuaagcuaccugccuucaaaauaguuuagggaccaccaccauauu

SEQ ID NO: 330746 - RNA, 64 nt, Human
guuucaaagauucaaaauugacauugcuuuacugucaaaauaauuuuauggcucacuaugaauc

SEQ ID NO: 330747 - RNA, 64 nt, Human
gauagccuugauuuuaaaagcugauucauuaauaucaaaauacuuuaauaagugucacaguuau

SEQ ID NO: 330748 - RNA, 64 nt, Human
cuguggauucuauauuucauauugagaucagcauucaaaauaguucuauuucuaucugcaaaua

SEQ ID NO: 330749 - RNA, 64 nt, Human
aaaauauccauuuuauuaccauuuucuaucuuuuucaaaauaugcaaguuuuuaccuauauguc

SEQ ID NO: 330750 - RNA, 64 nt, Human
aauugaauauacuuuaaauauauauauuaaaguaucaaaauauagagagacauuugaacuguau

SEQ ID NO: 330751 - RNA, 64 nt, Human
agcaaagguucuuguauagagggaauagggaauuucaaaauaaaaaauuaaguauguucugugu

SEQ ID NO: 330752 - RNA, 64 nt, Human
agacguaagcguuucacuauguauaaauuuuacuucaaaauaauaaaaacaaauacugacucua

SEQ ID NO: 330753 - RNA, 64 nt, Human
uucuuuucuguggccuagacucuuuucacugaucucaaaauaaacugguuuuuuucaaaaaaaa

SEQ ID NO: 330754 - RNA, 64 nt, Human
aauguuugaagugccuuagacucuugccauauuuucaaaauaaaauuccauuaagcucuuuucc

SEQ ID NO: 330755 - RNA, 64 nt, Human
uguuaauuguacacugaauaaugccuuuuaaaaaucaaaauaaaauuaacaaauaauggugaau

SEQ ID NO: 330756 - RNA, 64 nt, Human
guguauuagagacuccugaaugauuuagacaacuucaaaauacagaagaaaagcaaaugacuag

SEQ ID NO: 330757 - RNA, 64 nt, Human
cuaaaagucuuuauauuauauacucuguaucaagucaaaauaucuuuggccauuuugcuaagaa

SEQ ID NO: 330758 - RNA, 64 nt, Human
uguauuauuugauacuaaauuuucaauuauuacuucaaaauaagagucugaggauuucuucuua

SEQ ID NO: 330759 - RNA, 64 nt, Human
cugaaaacuaaucaaauauagugccuauuuagucucaaaauaagguaacuauuaacuugauuau

SEQ ID NO: 330760 - RNA, 64 nt, Human
ggaauugugaaauauuaaaugcaaauuuacaacugcagaugacguaugugccuugaacugaaua

SEQ ID NO: 330761 - RNA, 64 nt, Human
auugggcuauugucuguguauucugcucucuuuagcagaugaucuguaauuuggucauuguucu

SEQ ID NO: 330762 - RNA, 64 nt, Human
ugaacaugauauuuuauagcuugggaagaaacuugcagaugauaugugcugccuuugcuucuua

SEQ ID NO: 330763 - RNA, 64 nt, Human
ugcauauucagggaaaaagugugaggaauugauuucaaaauaguucguucuuguguuugaccua

SEQ ID NO: 330764 - RNA, 64 nt, Human
uguaauauuauguguacuuuuacauuguguuauaucaaaauauguuauuuauauuuagucaaua

SEQ ID NO: 330765 - RNA, 64 nt, Human
uuauauauucuauccauuuuaaauuguuuguaugucaaaauaaauucauuaauaugguugauuc

SEQ ID NO: 330766 - RNA, 64 nt, Human
gacaucugcaucauuucauaggauuagaacuuacucaaaauaauguaaaucuuuaaaaauauaa

SEQ ID NO: 330767 - RNA, 64 nt, Human
uagaaacuuuuuggauaugccacugcaauucuuuucaaaauagcauuccccagguuuuuaaugg

SEQ ID NO: 330768 - RNA, 64 nt, Human
cgggcgacaccuuaccuguggaaagcaaaucuuuucaaaauaagccacugggacucgguaggug

SEQ ID NO: 330769 - RNA, 64 nt, Human
auuuuuaaaugauugguuaagugaaaaccagaacucaaaauauuccaggagagaagauaacauu

SEQ ID NO: 330770 - RNA, 64 nt, Human
gaacauacagcuuaauaguuuaugcgugauuuucucaaaauauuguaaaacuuuugacaaugcu

SEQ ID NO: 330771 - RNA, 64 nt, Human
augcaugauuuauccaaaguuuccauaguuuuauucaaaauaauaaauguuaauaaggugauaa

SEQ ID NO: 330772 - RNA, 64 nt, Human
cuguggaauguaccuaugugaguuucagaaauucucaaaauacguguucaaaaauuucugcuuu

SEQ ID NO: 330773 - RNA, 64 nt, Human
uguguuugaaaacguuuugauuuuuggaaacacaucaaaauaaauaauggcguuuguuguaugc

SEQ ID NO: 330774 - RNA, 64 nt, Human
gccccugcagccuacaaacugggccucgggcgacucaaaauaagugcucuuggggguggcucua

SEQ ID NO: 330775 - RNA, 64 nt, Human
acacuacugaauuauaaaaauucaaucauaaaagucaaaauauauuacauaauauaguuuaaug

SEQ ID NO: 330776 - RNA, 64 nt, Human
uuuuaacuguuuuugcuacuccauauauugucauucaaaauauauuuuaacccaaaauaaguua

SEQ ID NO: 330777 - RNA, 64 nt, Human
uaauuuugauaaaaaagauacaaaguucauaauaucaaaauauguguucaaaauugguauuuua

SEQ ID NO: 330778 - RNA, 64 nt, Human
cagagcuaauguuuauccauuuaaaagguauaaaucaaaauaacaaauuaucuaaaaaaaaucu

SEQ ID NO: 330779 - RNA, 64 nt, Human
ccgccacugcuggccucacaagccccugguuacugcagaugaagcugggauggaggcucugacc

SEQ ID NO: 330780 - RNA, 64 nt, Human
cucugaguaggaugcucugcuuuugcauuugauugcagaugagagcuuuaugaguucacggaau

SEQ ID NO: 330781 - RNA, 64 nt, Human
gucauucuccagaaggaacuugggagaugauggugcagaugaugaaacuggguucaucccaguu

SEQ ID NO: 330782 - RNA, 64 nt, Human
ucaauauuuccauugaacacagaugcagaaauccucaaaauauuagcaaaucaggaaugcaagg

SEQ ID NO: 330783 - RNA, 64 nt, Human
accuggagauucugaagugccuuugcugugguuuucaaaauaauaaagauuuguauucaacuca

SEQ ID NO: 330784 - RNA, 64 nt, Human
guuucuugaggccaaacacacuguauuuuacaagucaaaauauaauuuacauuaaucacuaugu

SEQ ID NO: 330785 - RNA, 64 nt, Human
uuaagaacuuuauaaugacugaaggaauguguuuucaaaauauuauuugguaaagcaacagauu

SEQ ID NO: 330786 - RNA, 64 nt, Human
aaagggagcugaaauuccuccaccaaguugguauucaaaauauguaaugacugguauggcaaaa

SEQ ID NO: 330787 - RNA, 64 nt, Human
ucagacauuuaaaaggcauggguuucgagcugucucaaaauauugcccaauagccauaauuuua

SEQ ID NO: 330788 - RNA, 64 nt, Human
aaaugaguugaucacuaucucugcucugugcuccucaaaauauaauuucaaauggauccgaucu

SEQ ID NO: 330789 - RNA, 64 nt, Human
cuuuccuucuuuucaacagugauaccuacgaaaaucaaaauaaaugcaagcugagguuuugugc

SEQ ID NO: 330790 - RNA, 64 nt, Human
uuggaacauuaucuacaauuuuacucucaaauagucaaaauaaaaacaucucaauuucuaauac

SEQ ID NO: 330791 - RNA, 64 nt, Human
auguauucauucacuuucaagauuuguuuuggugucaaaauaacaugaaaagguagauggaguu

SEQ ID NO: 330792 - RNA, 64 nt, Human
cagagcuaauguuuauccauuuaaaaguuauaaaucaaaauaacagauuaucugaaaaaaaauc

SEQ ID NO: 330793 - RNA, 64 nt, Human
uuuagauauguucccucacugaaaaaucacucauucaaaauauuuaaguaucaagcacuuuguu

SEQ ID NO: 330794 - RNA, 64 nt, Human
aucaguguuuacuuauugaucuugcuagacaauaucaaaauaacuucccacauuuuccagugaa

SEQ ID NO: 330795 - RNA, 64 nt, Human
ccuagauuguaggagaugacagacauaagguauuucaaaauaaaucucaggugcuauaacaugu

SEQ ID NO: 330796 - RNA, 64 nt, Human
gcucuuccgucuaaggcaugaauaagaggggaggucaaaauaaagacccaaucugaggccgggc

SEQ ID NO: 330797 - RNA, 64 nt, Human
aaaguuuuauuuucuaaaguuuaaaucauguuuuucaaaauauuuuucaagguggcugguucca

SEQ ID NO: 330798 - RNA, 64 nt, Human
ugccauccggaucccugugcucuaucucagugcagcagaugaccccuucucccccgucuguggu

SEQ ID NO: 330799 - RNA, 64 nt, Human
gaggcccgcccgcccaccgugggcagugccacccgcagaugacacgcgcucuccaccacccaac

SEQ ID NO: 330800 - RNA, 64 nt, Human
uguuaacacuguaauaucuuuaaaugauguacaggcagaugaaaccaggucacuggggagucug

SEQ ID NO: 330801 - RNA, 64 nt, Human
ucagguuuuaucaguagaagugucacagccauagucaaaauaccccuaacauacugcauuucac

SEQ ID NO: 330802 - RNA, 64 nt, Human
gcuccaaguuccacaggucugcuaccacaggccaucaaaauauaaguuuccaggcuuugcagaa

SEQ ID NO: 330803 - RNA, 64 nt, Human
aaugugucuuguucuuuuuaccaauaauaauuuaucaaaauaagagggaaagugcaaucaaauc

SEQ ID NO: 330804 - RNA, 64 nt, Human
cuagaguaaacuuauugcauauuuucauaaucagucaaaauaauaaaacuaaaaacaaaaagua

SEQ ID NO: 330805 - RNA, 64 nt, Human
uuuauuuucaacauguaaaaagugagaaauuacuucaaaauauaugcaauuuaaauuuuuuaga

SEQ ID NO: 330806 - RNA, 64 nt, Human
caggcgggcgagccgcgggcgcucgcucaggugaucaaaauaaaggcgcuaauuuauaccgccg

SEQ ID NO: 330807 - RNA, 64 nt, Human
aaauggaauauuuucagauacuauauuggcuguuucaaaauaguacuauucuuuaaacuuguaa

SEQ ID NO: 330808 - RNA, 64 nt, Human
ccuaaaauuaugauaauacauuucccaauucaacucaaaauauuauugguguauuuugucuauu

SEQ ID NO: 330809 - RNA, 64 nt, Human
cuuauuagaaucuuguauuuuuuaauugagcuaaucaaaauaauucagccaagucuauuugaaa

SEQ ID NO: 330810 - RNA, 64 nt, Human
ccugugcuagaugugcaaaugcaagcuaguggcuucaaaauagagaaucccacuuucuauagca

SEQ ID NO: 330811 - RNA, 64 nt, Human
auuccagcccggccuacaagaacaaaacuccaucucaaaauaaauaaaaaaauaaauaaaaaua

SEQ ID NO: 330812 - RNA, 64 nt, Human
gagugguuuuuacuuuuuuuaaugauuaaaaaaaucaaaauaauauucugugacaaugacaggu

SEQ ID NO: 330813 - RNA, 64 nt, Human
agacuaacagaugucuacaauacaauaccuguauucaaaauaacaaaaauaaagccugauucuu

SEQ ID NO: 330814 - RNA, 64 nt, Human
agcaaugaaauuccuuucuuaaaguucuguguugucaaaauaaaagaagcuuucugucauaaaa

SEQ ID NO: 330815 - RNA, 64 nt, Human
uucuuuauauauaauuaaaauuagguuuaaauuuucaaaauaugagacuaugcuauaggcagug

SEQ ID NO: 330816 - RNA, 64 nt, Human
guuccauuuaagggcaaguuucccuguagauguaucaaaauacuaccaacuguaaauugagauu

SEQ ID NO: 330817 - RNA, 64 nt, Human
ccagaaucugccccucacgaggaugugaccuugggcagaugacuucaccucacucagccuuggc

SEQ ID NO: 330818 - RNA, 64 nt, Human
ucuuacugcaaaugucaucagaacuuuuugguuugcagaugacaaaaauucaacucagacuagu

SEQ ID NO: 330819 - RNA, 64 nt, Human
cuuagucuucuccacucugcacccuaccucgugggcagaugauaacauguuuuggaugcuguca

SEQ ID NO: 330820 - RNA, 64 nt, Human
caaagcaugaugggugaagagaaccgagcaaagaucaaaauaaaaagugacacagcagcuucac

SEQ ID NO: 330821 - RNA, 64 nt, Human
cacagagacccccggaacaagccuaaaaauuguuucaaaauaaaaaccaagaagaugucuucac

SEQ ID NO: 330822 - RNA, 64 nt, Human
agagggcaccacugagaacugcgugcauaggaccucaaaauacaaaauuagcagggccucacag

SEQ ID NO: 330823 - RNA, 64 nt, Human
cacuccagccuggguuauagagugagacucugucucaaaauaaauaaauaaaaauaaaaaaaga

SEQ ID NO: 330824 - RNA, 64 nt, Human
gucauuuugagagacuaaauguggggggcagaugucaaaauaccuguacaauuuuaaaauguca

SEQ ID NO: 330825 - RNA, 64 nt, Human
cuuauguaucuucugcuuccugacagcuucuuuuucaaaauaacaugcaaaaaaagcugaaugc

SEQ ID NO: 330826 - RNA, 64 nt, Human
augaucugauuacacuggacacucuuaggaaguaucaaaauagaacaguucaauuugcagcuac

SEQ ID NO: 330827 - RNA, 64 nt, Human
gucucagaugauuauuccaguuuucaaugauuuuucaaaauaaaagucaaucagcauuguuauu

SEQ ID NO: 330828 - RNA, 64 nt, Human
gaugugaaguauucaugagaaucuguagauuccaucaaaauaaguaggaacucauacuaaaauu

SEQ ID NO: 330829 - RNA, 64 nt, Human
cuuucuggacuguuuguauugaaacaaaguggugucaaaauaaagccccugcagggccuggcuc

SEQ ID NO: 330830 - RNA, 64 nt, Human
aaugaagucucaggguauaugaaaguagcuggcuucaaaauaaaauuuuugagugcauauuuug

SEQ ID NO: 330831 - RNA, 64 nt, Human
gugaaaaaaaaaaccccagugcuugugagggaacucaaaauaguuaccagaaaaauaauauuug

SEQ ID NO: 330832 - RNA, 64 nt, Human
aaaccucaacaggucuuuuaauauaaauucugcuucaaaauagaauaaaaccauucuuuaacaa

SEQ ID NO: 330833 - RNA, 64 nt, Human
ucagaagucacacauuacaaaguuaaaauuguuaucaaaauagucuaaggccauggcaucccuu

SEQ ID NO: 330834 - RNA, 64 nt, Human
cagaaaaagggcagacucccuaaucacacuaacaucaaaauaaagaggcugggccgcuguguag

SEQ ID NO: 330835 - RNA, 64 nt, Human
ugaucuuuuggaugcaggugccuuaaugaagcucucaaaauauuuuaggagcugcucagggagu

SEQ ID NO: 330836 - RNA, 64 nt, Human
augggcugugauuacugcaaucacugugcuaucggcagaugaugcuuuggaagaugcagaagca

SEQ ID NO: 330837 - RNA, 64 nt, Human
ccauuacaaaugggauauaagaggcagcgugaaagcagaugagcuguggacuagcaauauaggg

SEQ ID NO: 330838 - RNA, 62 nt, Human
cagcuagcagccuaagauagaaaauaccaaaagcagaugaaaaggugaauccuuaaaaaacu

SEQ ID NO: 330839 - RNA, 64 nt, Human
cgagaaggacucauccagcaaaguugccugggauucaaaauaaaggcauugcagaccgcacagg

SEQ ID NO: 330840 - RNA, 64 nt, Human
gaugacccuugguagagucuuuauuugcauagccucaaaauagguuauucguuucuaaacuugg

SEQ ID NO: 330841 - RNA, 64 nt, Human
acacucuggccgaagggaguccuuauguuuaguuucaaaauauauuacuuuccuggauucucuu

SEQ ID NO: 330842 - RNA, 64 nt, Human
cucagaaaggacccauuuguggcucuuuuucaccucaaaauaagaucgaugguaucuuguaaaa

SEQ ID NO: 330843 - RNA, 64 nt, Human
cauuuucuuuucacuucgggcuguguaaacacagucaaaauaauucuaaaucccucgauauuuu

SEQ ID NO: 330844 - RNA, 64 nt, Human
ucucuuacugucagaaucucucuugcaguacagcucaaaauaguggaugcauuucaaacuugac

SEQ ID NO: 330845 - RNA, 64 nt, Human
aaaacaaagaaauaaaauccugcuccugacucggucaaaauauuuuuuaaagucuauuguuugu

SEQ ID NO: 330846 - RNA, 64 nt, Human
auuauuaauucguaugcuuagucaaccuaggaaaucaaaauaauguuuugaaguucuuauuuga

SEQ ID NO: 330847 - RNA, 64 nt, Human
acauucuccuuugaauuguuaaaauucagaacauucaaaauaacuguuuugcuacaacccauga

SEQ ID NO: 330848 - RNA, 64 nt, Human
ucuuaccacuucgaugguugugauuaauuuaaaaucaaaauaaaggaauuacugaguuuauuug

SEQ ID NO: 330849 - RNA, 64 nt, Human
cuuaacauuucaguaauauaauuuuaauucuaagucaaaauacaaaugcauagauaguaaauga

SEQ ID NO: 330850 - RNA, 64 nt, Human
augcauaauuuuaacagauucuauaaugggugccucaaaauauguauugugccauuccgcaaau

SEQ ID NO: 330851 - RNA, 64 nt, Human
aggcugaugcuugaaguaacuguggagggaguguucaaaauacuacugacgcaggcaccuucuu

SEQ ID NO: 330852 - RNA, 64 nt, Human
uaaaaaagcacuaugaacuacagguguuugacuuucaaaauauauuuuguauuguuaauaucuu

SEQ ID NO: 330853 - RNA, 64 nt, Human
gcacguuccagccaccaggaggccaccuauuguuucaaaauaaagacuggguuccucucuuggu

SEQ ID NO: 330854 - RNA, 64 nt, Human
uuauuugaaaaauuucuagauggucucaugaguuucaaaauaauaauuuuuguguaugaacaaa

SEQ ID NO: 330855 - RNA, 64 nt, Human
ugacgcacaauuugaaauggacaucuaauccagugcagaugaccuggcauguggaguuacagag

SEQ ID NO: 330856 - RNA, 64 nt, Human
caucuuaaaagcugauagacaagccaaauggcuggcagaugauguggauuucaaagagcccaga

SEQ ID NO: 330857 - RNA, 64 nt, Human
aggaaaggacagcagcaggaaggaggugcagugcgcagaugagggcacaggagaagcuaagggu

SEQ ID NO: 330858 - RNA, 64 nt, Human
ugcuaggccccuuccaucaauucuuauuaaauucucaaaauaauccuuugaaaagggaguauaa

SEQ ID NO: 330859 - RNA, 64 nt, Human
auggcauuuuaauagacuaguaaaucacagugguucaaaauauauauccauauauauauauauc

SEQ ID NO: 330860 - RNA, 64 nt, Human
aagcaagagagccaaauuuuuagaaaucugauggucaaaauagcugaaagcaguaaacaagaga

SEQ ID NO: 330861 - RNA, 64 nt, Human
ucuaccuguauuucucaguugcagcacugaguggucaaaauacauuucugggccaccucaggga

SEQ ID NO: 330862 - RNA, 64 nt, Human
gaagaaaaugacagacaauuauuuuuccuuuaggucaaaauaaugucacugcuaucuggauaaa

SEQ ID NO: 330863 - RNA, 64 nt, Human
aaauaauuguuaauauggaauaagcucaaauaugucaaaauaaauguaaaaaaugaguguugcc

SEQ ID NO: 330864 - RNA, 64 nt, Human
aaaccccaucuccaaaaauauaauaauaauucucucaaaauacuaaacagaggugguuuuauug

SEQ ID NO: 330865 - RNA, 64 nt, Human
aaacauuuuaaaauauuuuuuuccaauuuauuucucaaaauaaaaugucuuuuguucugguucu

SEQ ID NO: 330866 - RNA, 64 nt, Human
ggggaaaaaggcacucagggcacacagcauugcuucaaaauauaauucucuacaaaccuaguug

SEQ ID NO: 330867 - RNA, 64 nt, Human
gguuuaacugguuuugcuuuuguuuaucuauaugucaaaauacuuguaaauugggaacaaacuu

SEQ ID NO: 330868 - RNA, 64 nt, Human
uucuugucuuuaagaaccuaaaaaaccucuuaacucaaaauaauaaaauguucacuaaugauau

SEQ ID NO: 330869 - RNA, 64 nt, Human
ccagggccucugcccugaacaucugggcuucuguucaaaauaaaccuacucuguucauggauua

SEQ ID NO: 330870 - RNA, 64 nt, Human
auuuggugacuuaggcuagugcuuucuaugggagucaaaauaccccauucccucagcagacaga

SEQ ID NO: 330871 - RNA, 64 nt, Human
gggcuguggagaccuucacuucuagauuauugauucaaaauaaaaagaagccacaaagaguaau

SEQ ID NO: 330872 - RNA, 64 nt, Human
ugccaaaucuguugcuuaugucuugccaugaauuucaaaauauaagacauuggcaaagccuccu

SEQ ID NO: 330873 - RNA, 64 nt, Human
uauaagggaaaaugauaugaauguguauuuuuacucaaaauaaaaguaacuguuuacguuggug

SEQ ID NO: 330874 - RNA, 64 nt, Human
gaacgccuguuccccuuacccgugugggggacacgcagaugagugaauuggaauguccagcaga

SEQ ID NO: 330875 - RNA, 64 nt, Human
gugccuguguagcuggggauggggauuccuaggggcagaugaaggacaagccccacuggagugg

SEQ ID NO: 330876 - RNA, 64 nt, Human
guuuacacauggagagaugccccauggugggcaggcagaugaugaaguacuggcagguaggcag

SEQ ID NO: 330877 - RNA, 64 nt, Human
cuaaaaggaaaucaguaguuaaggauaccugauuucaaaauauuuaaagcauaaccuaacugau

SEQ ID NO: 330878 - RNA, 64 nt, Human
aguauauuuauuucuagcaaacagauguuuguuuucaaaauacuucuuuuucauuauugguuuu

SEQ ID NO: 330879 - RNA, 64 nt, Human
aguuauugaucugacuaguuguaugucuuucuguucaaaauagaaauuauccuuucuuacuaau

SEQ ID NO: 330880 - RNA, 64 nt, Human
aaaaaaaucuagucaccaggaggaucccuaugacucaaaauaacuuguuuguaaaagaaaauuu

SEQ ID NO: 330881 - RNA, 64 nt, Human
aacucuuaaauaaaauuaugcuaauuaguuacauucaaaauaauguuuauaaauuuauuugucu

SEQ ID NO: 330882 - RNA, 64 nt, Human
uaaaagcuaacagcucaaucucuuaaaacacuuuucaaaauaugugggaagcauuugauuuuca

SEQ ID NO: 330883 - RNA, 64 nt, Human
aaauccuuuacaagauggagaaacaacaaauaagucaaaauaaucugaaaugacaggauaugag

SEQ ID NO: 330884 - RNA, 64 nt, Human
uuuaccuuaugaaaaguguuaaaacauugccaacucaaaauaacauuauuuaaugcaugugcaa

SEQ ID NO: 330885 - RNA, 64 nt, Human
caaggaaauuuuaaacaauuacuacauuaccuguucaaaauaaggcuuguuggaaauccuaguc

SEQ ID NO: 330886 - RNA, 64 nt, Human
ccuuauuuggggggaggucugaggcaaguauauuucaaaauauguacuugcgggauucccuuca

SEQ ID NO: 330887 - RNA, 64 nt, Human
acauauuguuguuuaucuuguuuggaaguguguuucaaaauaaacaugucuagaauuuaaaguu

SEQ ID NO: 330888 - RNA, 64 nt, Human
caaaguaucuacuggccuugucaacauacagacuucaaaauaccccuuaugagaauccaaagaa

SEQ ID NO: 330889 - RNA, 64 nt, Human
acucgguguauauaguucauacuuuuguaaucugucaaaauacuaccuucauuuauucuucuau

SEQ ID NO: 330890 - RNA, 64 nt, Human
uauuguaaauuauauuugugcuauaguauuugauucaaaauauuuaaaaaugucuugcuguuga

SEQ ID NO: 330891 - RNA, 64 nt, Human
cacaagugccgcaaauuguaccuuuuuuguuuuuucaaaauagaaaaguuauuagugguuuauc

SEQ ID NO: 330892 - RNA, 64 nt, Human
ccucaggccuguaacuucuggaaaagaugauuauucaaaauaauguuuugggguaaccagugga

SEQ ID NO: 330893 - RNA, 64 nt, Human
ugugugaagacaggcagaugcugcacagugaauugcagaugauauuacagaagugaugucugua

SEQ ID NO: 330894 - RNA, 53 nt, Human
cugcaggacucgugagcugaagugcagaugaccacauucaagggggaaccuuc

SEQ ID NO: 330895 - RNA, 64 nt, Human
cucugagauguggucagagagguuucuguggacugcagaugaggccugagcccugccuaugcuc

SEQ ID NO: 330896 - RNA, 64 nt, Human
ugguauccuguuacagccuuggcucuuaaacaacucaaaauauugggauaggcugucaguaugu

SEQ ID NO: 330897 - RNA, 64 nt, Human
gauucuaggaacugagaacuguauuggaauagguucaaaauauguaagaaaugcuaauguggga

SEQ ID NO: 330898 - RNA, 64 nt, Human
aaauuacagagcuauaugauccauaauugauuagucaaaauaacuuauugaugaaauauacaaa

SEQ ID NO: 330899 - RNA, 64 nt, Human
uagaauucccauucagcuguuuuaacacagaaauucaaaauagugacuuaacauggaagcuauu

SEQ ID NO: 330900 - RNA, 64 nt, Human
uauaaauuuaugcaauugguggugcuuccuuucuucaaaauacagauuuuaaaaaaucauuucu

SEQ ID NO: 330901 - RNA, 64 nt, Human
guccauuuuucuucugguucaacacgucuuuuauucaaaauaacagguaugaauauaauagaaa

SEQ ID NO: 330902 - RNA, 64 nt, Human
aauugggccagcuuuucaaacaaagaugccacauucaaaauaggguauauuuuccuauauuacg

SEQ ID NO: 330903 - RNA, 64 nt, Human
cccugauguaauuauuauaaaucgcauaccuguaucaaaauaucucauguaucccauaaauaua

SEQ ID NO: 330904 - RNA, 64 nt, Human
gauauuaacaaccguacauacugcugaauuuaacucaaaauauuucagguaagugaaaguggug

SEQ ID NO: 330905 - RNA, 64 nt, Human
uguuagcgggguuuugaaggauguguacuuuccuucaaaauaaagugguagauuuucaaaauuu

SEQ ID NO: 330906 - RNA, 64 nt, Human
acaguacuccauuuugggguccaaacuguaaugcucaaaauaauaaaugcuuacacgaaaauua

SEQ ID NO: 330907 - RNA, 64 nt, Human
acagcgaggccuacaagggaugggaacuuuuauuucaaaauaaauacuaccgaggcugugauca

SEQ ID NO: 330908 - RNA, 64 nt, Human
uccucuuaugucgaagaucuaguuuuagacaauuucaaaauaagcuuuucccacucauagaacu

SEQ ID NO: 330909 - RNA, 64 nt, Human
guaguggaaaucacuauuuguagaaacugucaggucaaaauauuuaacugacuguugacaugua

SEQ ID NO: 330910 - RNA, 64 nt, Human
gagauuuaaaguucuaagggauugucaauagauaucaaaauauuaaucauuggacaaaggcuuu

SEQ ID NO: 330911 - RNA, 64 nt, Human
cacuccagccuggacgacagagugagauucugucucaaaauaaauacauacauacauacaauaa

SEQ ID NO: 330912 - RNA, 64 nt, Human
ccucgggcuggcccaggugcugaccuugccacaggcagaugaaugucuugaaagcucccgggcc

SEQ ID NO: 330913 - RNA, 64 nt, Human
agcguguuccccuguaccuguccaaggccccccagcagaugaugggcucccugaaacugcugcc

SEQ ID NO: 330914 - RNA, 64 nt, Human
cuaugggaaauggcugugcucccaacauagcuuugcagaugauguggguuuuuuuuuuuuuuuu

SEQ ID NO: 330915 - RNA, 64 nt, Human
uuacacaguagguaaauuagggaugacugcauuaucaaaauacucucaggguuccuauaaaugg

SEQ ID NO: 330916 - RNA, 64 nt, Human
ucuaaauguuuggcauguaaauguaaacucagcaucaaaauauuucagugaauuugcacuguuu

SEQ ID NO: 330917 - RNA, 64 nt, Human
gcagacaugacuguucucuuuguacaagugugaaucaaaauauguaucucuuuuucagagucug

SEQ ID NO: 330918 - RNA, 64 nt, Human
cagucgguuuucccauuugaaagugggaaaccauucaaaauacaaguacugguugaaccugacc

SEQ ID NO: 330919 - RNA, 64 nt, Human
gaaaucguagacaagcaagugcacaugauaaacaucaaaauauuacccagcugaauaguuacug

SEQ ID NO: 330920 - RNA, 64 nt, Human
auucuuagcaaaauugccuaguauguuaauuugcucaaaauacaauguuugauuuuaugcacuu

SEQ ID NO: 330921 - RNA, 64 nt, Human
uaaaagaauauuaccaauaauuaaaggugccagaucaaaauaguaauaaaucaacaaauaauuu

SEQ ID NO: 330922 - RNA, 64 nt, Human
caaguuuagaaagcuggcaacaugaagaaugcauucaaaauauaacaggugcuucuuuguugua

SEQ ID NO: 330923 - RNA, 64 nt, Human
cccuugcuccuugguuuauucccucauguuuuacucaaaauaaacauggccaugaacucagggg

SEQ ID NO: 330924 - RNA, 64 nt, Human
uaaauaggcaacuauguuucuaaauaguaaaguuucaaaauauucucucaauuuaaaauuucau

SEQ ID NO: 330925 - RNA, 64 nt, Human
ucuugucaaaccuugccugaugcucuuucuaaagucaaaauaugaaugcuaagaaggcauaacc

SEQ ID NO: 330926 - RNA, 64 nt, Human
uuuuauaaugugaaauaaugaauaaugaauuuacucaaaauaaaacauagguuaaugagauacc

SEQ ID NO: 330927 - RNA, 64 nt, Human
uugugaacagccugauguuugggaccuuuuuuccucaaaauaaacaaguccuuauuaaaccagg

SEQ ID NO: 330928 - RNA, 64 nt, Human
uguguacagauuauuuguuaugacaauaaaacacucaaaauaaauggucuuuagcaucucaaau

SEQ ID NO: 330929 - RNA, 64 nt, Human
agaaguagaucaaaauagaacacaauagagaacuucaaaauaaaacaggugugagaauugugug

SEQ ID NO: 330930 - RNA, 64 nt, Human
augacccaggaauagcuaaugacacagaaguagaucaaaauagaacacaauagagaacuucaaa

SEQ ID NO: 330931 - RNA, 64 nt, Human
agaccuguguaucacguaagugugugagugcagugcagaugagcaccauuuaguuauaugugcu

SEQ ID NO: 330932 - RNA, 64 nt, Human
ucccauccaaauccuacuaggaagagagugggcugcagaugaaucugugacucauguuucccug

SEQ ID NO: 330933 - RNA, 64 nt, Human
aagaggccacacuauucgcggaauggcuuuagaggcagaugaaguggucuuugaccacaguuga

SEQ ID NO: 330934 - RNA, 64 nt, Human
uuagaucuuguuucaaacuuuacaauagcauucuucaaaauauuaaguuauauauuuuauaggc

SEQ ID NO: 330935 - RNA, 64 nt, Human
agaguuaauuuuaauccuucccuauaauuauacuucaaaauauuugacaucugcuauuaugccu

SEQ ID NO: 330936 - RNA, 64 nt, Human
uuggcccugcauaaguucugcauagcaucuaaugucaaaauagaaccaacugguaaucacagua

SEQ ID NO: 330937 - RNA, 64 nt, Human
uuuggugucuccaccacugucccuucuccccgcuucaaaauaaguguaauccacgguagcagcc

SEQ ID NO: 330938 - RNA, 64 nt, Human
ccagaaucaucaaaauagugaaagacugaucuguucaaaauauuugcuauaugcacuggguaua

SEQ ID NO: 330939 - RNA, 64 nt, Human
ccaagacuguaacagggagaaaugcccagaaucaucaaaauagugaaagacugaucuguucaaa

SEQ ID NO: 330940 - RNA, 64 nt, Human
uguuuguaaagauacguuuucuuuuaaacgauuuucaaaauaugucuaaauuuugguguugugu

SEQ ID NO: 330941 - RNA, 64 nt, Human
caagagugcuuuaaugaugacauuuagcaagugcucaaaauaauugacagguuuuguuuuuuuu

SEQ ID NO: 330942 - RNA, 64 nt, Human
uuauaucauauuuugaaaauguaauuacugauauucaaaauaaauuaaaggacuuaaaaucauu

SEQ ID NO: 330943 - RNA, 64 nt, Human
cuccauacccacaaucugagcacgcuaccaaaucucaaaauauccuaagacuaacaaaggcagc

SEQ ID NO: 330944 - RNA, 64 nt, Human
agauuuuugcugcaaucuguuugccuucccugaaucaaaauaaucuuucauucgucaccauuau

SEQ ID NO: 330945 - RNA, 64 nt, Human
uauguacuuuggguuuuuaacaccgcauguaaagucaaaauaaaauauacaaaucauuauaucc

SEQ ID NO: 330946 - RNA, 64 nt, Human
uuuaaaagguaugcuaaccacugugguuuuaauuucaaaauauuugucauucaagucccuuuac

SEQ ID NO: 330947 - RNA, 64 nt, Human
acuccagccugggcaacaagagugaaacuccgucucaaaauaaauaaauaauaaaggaagaagu

SEQ ID NO: 330948 - RNA, 64 nt, Human
gauaggaaaguccuugggaaacauuuccaaucuuucaaaauauuauuguguaucuuaagaagua

SEQ ID NO: 330949 - RNA, 64 nt, Human
ggucuccccuaauuuuuauucccagugccgauguucaaaauaaacuuucuccagucugggaacc

SEQ ID NO: 330950 - RNA, 64 nt, Human
ugggugggcugggggacagcugaggaugggccuagcagaugaagcuugccagcaaggccaaagc

SEQ ID NO: 330951 - RNA, 64 nt, Human
caugaccucuggcuucagugguggguggggcagggcagaugaaagggcuucagugggaaccucu

SEQ ID NO: 330952 - RNA, 64 nt, Human
cuccuagcacguccauuuccaggaggagaagcaagcagaugagagguuuuccauuuugucaucc

SEQ ID NO: 330953 - RNA, 64 nt, Human
aaugcacuuuagaacuauuugacaauucagacuuucaaaauaaagauguaaaugacuggccaau

SEQ ID NO: 330954 - RNA, 64 nt, Human
uuaugagugaagaauaaacuuacuaacaaauuagucaaaauaaaguauguuugccuccuuaauu

SEQ ID NO: 330955 - RNA, 64 nt, Human
augauucauagaucuagauagguggaaauaucauucaaaauagucacuugagcucacaaaaaaa

SEQ ID NO: 330956 - RNA, 64 nt, Human
ucaaaacugaauugagaaaaaauuacaguauuucucaaaauaacgucaaucuauuuuuguaaac

SEQ ID NO: 330957 - RNA, 64 nt, Human
gccccuccucccugucuucucugauucuuuucccucaaaauaguccugagaacuaauugucaca

SEQ ID NO: 330958 - RNA, 64 nt, Human
aauggaaguaaauauauguauaccuaagagaaugucaaaauaaacaccaaaccaaaagaaggua

SEQ ID NO: 330959 - RNA, 64 nt, Human
gcuggauaugcagggagaugagacucuuuuaaucucaaaauaaacagauucuuucaagaacgaa

SEQ ID NO: 330960 - RNA, 64 nt, Human
gauuuuuuuuuucucccagcuagugcuaucuuucucaaaauaauuuaaaaguaggcgagaggcu

SEQ ID NO: 330961 - RNA, 64 nt, Human
cucagaaauuucaggagcauauaaacuauuuaaaucaaaauauucuuacauauagaaaccaagu

SEQ ID NO: 330962 - RNA, 64 nt, Human
ugcacuccagcuugggcaauagcaagacuccaucucaaaauaaaauaaaauaaaacuuagagca

SEQ ID NO: 330963 - RNA, 64 nt, Human
uuuuagagauagaucuauaguugcauuguugcaaucaaaauauguugucacagaaagaauaggu

SEQ ID NO: 330964 - RNA, 64 nt, Human
uuuuauaacccuggagaugaaaaucuccuuguccucaaaauacuuccagaagaacaaccagaug

SEQ ID NO: 330965 - RNA, 64 nt, Human
guucuggaggcaccagaccuugaaaagaacaugcucaaaauaaaauguuaucuguuauuuuugu

SEQ ID NO: 330966 - RNA, 64 nt, Human
acaagcaagacccucccuccaaagaaaauaaagcucaaaauaaaauaugauuuguguucaugua

SEQ ID NO: 330967 - RNA, 64 nt, Human
aacacuauagauguaaaaaugugaaaaguuuuauucaaaauaucaaacuuaugagucaccuagg

SEQ ID NO: 330968 - RNA, 64 nt, Human
uuuuaaaaagagacuguauacacuugauuugcuuucaaaauaaauaaggucagcuagucuagga

SEQ ID NO: 330969 - RNA, 64 nt, Human
acggccucgggagacgggagcugcgagcaggugggcagaugagggcccuaugcgcacucagggg

SEQ ID NO: 330970 - RNA, 64 nt, Human
aguuggaaccguguccagcacagaaggaaucugugcagaugagcagucacacuguuacuccaca

SEQ ID NO: 330971 - RNA, 64 nt, Human
ccugccucggccucacccgcacuucucccaaaaggcagaugacggggaguuaggcauggggagc

SEQ ID NO: 330972 - RNA, 64 nt, Human
uuucaggucaaguuuuuuauacugcacuuauuugucaaaauaaagauucucacauaugccgguu

SEQ ID NO: 330973 - RNA, 64 nt, Human
gaucacuuuggugaaugcuaguuucaaauuugauucaaaauauuucuuaggugaaagaacuagc

SEQ ID NO: 330974 - RNA, 64 nt, Human
cagugucuuucaaaugacuuucaucaaaugacuuucaaaauaaaaccuuauuuuggcaaaggca

SEQ ID NO: 330975 - RNA, 64 nt, Human
guucagaaacugccaggggccucauacagggauaucaaaauacccuuugugcuagcccaggccc

SEQ ID NO: 330976 - RNA, 64 nt, Human
cauacuucaguauaggcauuuguucuugagugugucaaaauacagcuaguuacugugccaauua

SEQ ID NO: 330977 - RNA, 64 nt, Human
cguugaucucuuaaauuguaaacacuacaaaaugucaaaauaaugagaacugacacaacuuugc

SEQ ID NO: 330978 - RNA, 64 nt, Human
acccucaacaaaccaggcgucgaaggaacauaccucaaaauaauaagagccaucuaugacaaaa

SEQ ID NO: 330979 - RNA, 64 nt, Human
gccagguggggucauggcacaaguucuguaaucuucaaaauaaaacuuuuuuuuuguacaaugu

SEQ ID NO: 330980 - RNA, 64 nt, Human
uuugaauuuugaaccaugugacuguauuaccuauucaaaauaaacaauaaaugggcccaaacag

SEQ ID NO: 330981 - RNA, 64 nt, Human
guaacauaguuucagugugauuucuagagcuaauucaaaauaguauugauauauuuuaugugac

SEQ ID NO: 330982 - RNA, 64 nt, Human
gcccaaguugacucauccuuacucacucauucccucaaaauauuuauugagcaccaacaauguc

SEQ ID NO: 330983 - RNA, 64 nt, Human
accuaagauuuuuuaaaaaauugauuuguuuugaucaaaauaaaggaugauaauagauauuauu

SEQ ID NO: 330984 - RNA, 64 nt, Human
cggagaugaugucagguacaaauacacuauagagucaaaauaccauuuacaaagaaaaucaaaa

SEQ ID NO: 330985 - RNA, 64 nt, Human
agugagcagggagggauugggggugggggaggccucaaaauaccgacugcguccauucucugcc

SEQ ID NO: 330986 - RNA, 64 nt, Human
gguaaugcacgacauugauugcugcauuuuaccuucaaaauauuuguccuuauugacugggucu

SEQ ID NO: 330987 - RNA, 64 nt, Human
ggugggcuuugggguauccccaccaacuuucccuucaaaauagcaccuuacaccccaucuuuga

SEQ ID NO: 330988 - RNA, 64 nt, Human
ucauuucauccuugcaacagcucugcagggccccgcagaugaggaaauccguaggcaggagcgg

SEQ ID NO: 330989 - RNA, 64 nt, Human
ggaauauacauggaauauuguaaaaccuacaugagcagaugaaauagaagcauuaaauauuuuu

SEQ ID NO: 330990 - RNA, 64 nt, Human
uuuuuuuugcaucagugauaaggcauacauuugcgcagaugagcuaggaaguuuugagaaguac

SEQ ID NO: 330991 - RNA, 64 nt, Human
uggauaaccauauaauuuaaaaagaaaaaaaaaaucaaaauauaauauauuuuuuuaccaaucg

SEQ ID NO: 330992 - RNA, 64 nt, Human
ucuagaauguagauaccuuguccagccauaggaaucaaaauaaaaaacuaaaaaaguucagugu

SEQ ID NO: 330993 - RNA, 64 nt, Human
cuagccagucacauugagagaagcagaacaaugaucaaaauaaaggagaaguauuucgaauauu

SEQ ID NO: 330994 - RNA, 64 nt, Human
augguguuggagacuauuagcuauuagauuuuucucaaaauaugaguuuuguacaauggaauga

SEQ ID NO: 330995 - RNA, 64 nt, Human
augaaugcuguggagaggcaucuggaacagaaauucaaaauaaagccuugacauuaaauacccc

SEQ ID NO: 330996 - RNA, 64 nt, Human
gcggaagauaaauugggggaaaagcuaaaaugacucaaaauaggggccugaaaaugcuuuaagg

SEQ ID NO: 330997 - RNA, 64 nt, Human
uuuccauuuauacccuacugugucaguucaagcaucaaaauaccuugcaucugagacagacuuc

SEQ ID NO: 330998 - RNA, 64 nt, Human
ccagaauuaaaaccaaucauaaguagaacccacuucaaaauaaaaaaacagcauuacuauuucu

SEQ ID NO: 330999 - RNA, 64 nt, Human
cuacaucaccgccuugguaaacaguauuauaaaaucaaaauauggguaaaaguaaauauuuacc

SEQ ID NO: 331000 - RNA, 64 nt, Human
uugcugaaugcugugacucauaguuuacuuuuguucaaaauaguuugcacuuuuuguuaauaaa

SEQ ID NO: 331001 - RNA, 64 nt, Human
ucauggagaaugcuuaauuuucuuucucugaacuucaaaauauuaaauauuuucuuauuuauuu

SEQ ID NO: 331002 - RNA, 64 nt, Human
caaauauugaagauuuuauaaaaucacugaagcaucaaaauauacuuuuggaaguagaugacuu

SEQ ID NO: 331003 - RNA, 64 nt, Human
uagauuauuuuguauuuguuuaaaagaaguuuugucaaaauacaaaaauauaaagaaaugacug

SEQ ID NO: 331004 - RNA, 64 nt, Human
agcucucuucuccuauuuucauccugcaagcaacucaaaauauuuaaaauaaaguuuacauugu

SEQ ID NO: 331005 - RNA, 64 nt, Human
cuucucaauacagccugcccuugcagucccuauuucaaaauaaaauuaguguguccuugccugu

SEQ ID NO: 331006 - RNA, 64 nt, Human
aaaaccaaguaugcaaaucaaagauauuugguagucaaaauaaguaaaagaaauauaggaauau

SEQ ID NO: 331007 - RNA, 64 nt, Human
ucugaggaccuuuaaugggcuuugucaugaaguagcagaugagagggcagucaguuuagcacaa

SEQ ID NO: 331008 - RNA, 64 nt, Human
ggugggggugggggggaacccuaugauuuacuaugcagaugaagaggguaggaacuaaauaaag

SEQ ID NO: 331009 - RNA, 64 nt, Human
guuugugaauaguacuugcaaaacuuguaaauuagcagaugacuuuuuuccauuguuuucucca

SEQ ID NO: 331010 - RNA, 64 nt, Human
aaaguagguguuuuuuucgugcucaauuuggcacucaaaauaauguucauuauggaaguuuggu

SEQ ID NO: 331011 - RNA, 64 nt, Human
gcccuccccccggaguacuucagaaugcaauaaaucaaaauaauggcccuguguguaucuguuu

SEQ ID NO: 331012 - RNA, 64 nt, Human
cacugaccaaaucuggaucuuuggacuaaaguauucaaaauagcauagcaaagcucacuguauu

SEQ ID NO: 331013 - RNA, 64 nt, Human
aauaagacuaauuuuuaagaguaacucaguaauuucaaaauacagauuugaauagcagcauuag

SEQ ID NO: 331014 - RNA, 64 nt, Human
acuaauuuuucuuacacacuaaauggguauuuguucaaaauaaugaaguuauggcuucacauuc

SEQ ID NO: 331015 - RNA, 64 nt, Human
caugaaaggcauggcggcugcauuucauaccacaucaaaauacaguaacauuucuauacuaaau

SEQ ID NO: 331016 - RNA, 64 nt, Human
uuuaaacuauuuuuguuacugacucacuuacuugucaaaauaauugguuuuucuguccugcuuu

SEQ ID NO: 331017 - RNA, 64 nt, Human
uauuuaugaucugcuaaaguggugauuuauccauucaaaauauauauuuuuuuccauuuaaaac

SEQ ID NO: 331018 - RNA, 64 nt, Human
gaucauaaaaccuuuaggaaauguauuugaaagcucaaaauagaaauuagguuaaaaugccauu

SEQ ID NO: 331019 - RNA, 64 nt, Human
acuccagccugggcaacaagagcaaaacuccgucucaaaauaaaaagaaaagaaaagaauggac

SEQ ID NO: 331020 - RNA, 64 nt, Human
ccagaacaguggcccauagcagggaccugcccuaucaaaauaucagguguauggagguggaguc

SEQ ID NO: 331021 - RNA, 64 nt, Human
uuccacaguccuguauuccauccuagauaucuacucaaaauaauugagacaaguguucaaacag

SEQ ID NO: 331022 - RNA, 64 nt, Human
cacuccagccugggagacagagugagacuccaucucaaaauauauauauauuuccaaauauuca

SEQ ID NO: 331023 - RNA, 64 nt, Human
gaaacccaucucacgugcagagacacacauaggcucaaaauaaaaggauggaggaagaucuacg

SEQ ID NO: 331024 - RNA, 64 nt, Human
ggaauauuaauucagaagguaguuucucuuguguucaaaauagcugccauggggcuguuacuuu

SEQ ID NO: 331025 - RNA, 64 nt, Human
uuaauguaaauacccguagguaucauuaauaguuucaaaauauugugguuuaguaaaguugaua

SEQ ID NO: 331026 - RNA, 64 nt, Human
ucauaugcagauuuuauucucaccugggccauuugcagaugagacuguaguuugcagaugagac

SEQ ID NO: 331027 - RNA, 64 nt, Human
gaacuguggccaaaaagaacaguuuuuuggagaggcagaugacauuauaccugauuuuagaaaa

SEQ ID NO: 331028 - RNA, 64 nt, Human
gaggagcgguccuuccacaccagccgcaacccaagcagaugacaggcacaggccaccgcaugag

SEQ ID NO: 331029 - RNA, 64 nt, Human
uauuuuuuguacuuuucuguauuuuuaaaauuucucaaaauaggaaugggagugaggaugggaa

SEQ ID NO: 331030 - RNA, 64 nt, Human
cauggauaguuaaaacaauguugaaugaaaaaaaucaaaauacaaaugaaacauuguguaauaa

SEQ ID NO: 331031 - RNA, 64 nt, Human
aaagguuuccaugucaugcucuauuuauagaauaucaaaauauuuauggccagaaguucuguca

SEQ ID NO: 331032 - RNA, 64 nt, Human
ucuaugauauugcaugaugcagaauaaugcuaagucaaaauauguugaaucucaugaccugaug

SEQ ID NO: 331033 - RNA, 64 nt, Human
ugauucugcaaagauaaauaauaucccugcauuaucaaaauaaaguagcagaccucucaauuca

SEQ ID NO: 331034 - RNA, 64 nt, Human
caucccaugguuuuuaaguuaaagcacacauucuucaaaauagccuaaaaaccuagccucuaac

SEQ ID NO: 331035 - RNA, 64 nt, Human
acuccagccugggcaacaagagcgaaacucugucucaaaauaaauaaaaaauaaaagacagaaa

SEQ ID NO: 331036 - RNA, 64 nt, Human; identical to SEQ ID NO: 331021

SEQ ID NO: 331037 - RNA, 64 nt, Human
ugguaggagaaugagagaaaccucagucagugucucaaaauaaaauccugcuacaaacauugau

SEQ ID NO: 331038 - RNA, 64 nt, Human
uucauacucaauaaaaacauaagugcaacuacugucaaaauaucuuuaagaaaauauaagcuuu

SEQ ID NO: 331039 - RNA, 64 nt, Human
uuuuuaaagguauuuauuagaaaucaaagaacacucaaaauaaacucagugcucaaaggguuaa

SEQ ID NO: 331040 - RNA, 64 nt, Human
aaaaaaugaauauagaaaagcugcuucuugccauucaaaauauguuaaauuucugacaauuccu

SEQ ID NO: 331041 - RNA, 64 nt, Human
aggccuuuaagcagagagcccaucuuagucaacaucaaaauauucauacuggugagaaacccua

SEQ ID NO: 331042 - RNA, 64 nt, Human
cagacuuuggagcgggugggaguuguaagacaaaucaaaauacggaugacaaagaggauauagc

SEQ ID NO: 331043 - RNA, 64 nt, Human
acguuuauccuggagugcagaaagaaugguucucucaaaauaaccaguggccuggccgaccugc

SEQ ID NO: 331044 - RNA, 64 nt, Human
acaaguuccaauagcuuauaugcccagaaggccuucaaaauaagaauuuugaaagaauacagaa

SEQ ID NO: 331045 - RNA, 62 nt, Human
gcagugucucugaggacuagcaaagucuggaggcagaugaaugguuucugacccucaccagg

SEQ ID NO: 331046 - RNA, 64 nt, Human
ucuguaguuuucccagauuuuaguuccucauuuugcagaugaaaagcggggaaaaaaaaaaaaa

SEQ ID NO: 331047 - RNA, 64 nt, Human
ucucuuaggugcauguccucuuguugcugagucugcagaugaggacuagggcuuauccaugccu

SEQ ID NO: 331048 - RNA, 64 nt, Human
gguuagucaccugccccagcacucacacccuaacucaaaauaaauguuaaauaagugcgaucac

SEQ ID NO: 331049 - RNA, 64 nt, Human
uuuuaguuacagcugugauuuggaagggaaacuuucaaaauagugaaaugaauauuuaaauaaa

SEQ ID NO: 331050 - RNA, 64 nt, Human
ugccuuaagaguauuuaaaauaugcuuccacauuucaaaauauaaaauguaacaugacaagaga

SEQ ID NO: 331051 - RNA, 64 nt, Human
aaaagauauaaccaaauaaacaagucauccacaaucaaaauacaacauucaauacuuccaggug

SEQ ID NO: 331052 - RNA, 64 nt, Human
uuauuuaaaagcauuuauuaaucuuagucugaaaucaaaauauagauuaauuggcucagcuuua

SEQ ID NO: 331053 - RNA, 64 nt, Human
uuauguguaacuuuuuggaagguuuaaucugauaucaaaauaaucauugaaauacaauuccauu

SEQ ID NO: 331054 - RNA, 64 nt, Human
caauuaugaguuugcccucuuuccccuaccaaguucaaaauauaucuaagaaagauuguaaauc

SEQ ID NO: 331055 - RNA, 64 nt, Human
ugcuuauuucacaacuaaagcuuugucauagacuucaaaauauauauguauauauuuuauuuaa

SEQ ID NO: 331056 - RNA, 64 nt, Human
aaauaaauauuguguugugcagcauuaaaaaaaaucaaaauaaaaauuaaaugugagcaaagaa

SEQ ID NO: 331057 - RNA, 64 nt, Human
uucaugaguaaauguggaucuuuggggaauggcuucaaaauaagucacgaacacaaauucuuug

SEQ ID NO: 331058 - RNA, 64 nt, Human
ccacggagggcugugcuguuaggcugcaucccacucaaaauacaggaaaagcacgaaucaugau

SEQ ID NO: 331059 - RNA, 64 nt, Human
acaaugaucauucugugaccuuuaccauuuuuugucaaaauauuagaaacucucacacucucag

SEQ ID NO: 331060 - RNA, 64 nt, Human
ucaauccccauaaugcuucuuuccucuuaaugucucaaaauaaaaccagaaagaggaauaaaau

SEQ ID NO: 331061 - RNA, 64 nt, Human
uuuauauauguauacauucuguacaguaguuccaucaaaauauguaauaauucacaccaauuuu

SEQ ID NO: 331062 - RNA, 64 nt, Human
acaugacugaaaguccagaguguuagcuuagagcucaaaauacuagcugcuguuucaagcuggc

SEQ ID NO: 331063 - RNA, 64 nt, Human
uaagacaaagguuuuccucuucuauuuuguaaacucaaaauauuuguacauaguuauuuauuua

SEQ ID NO: 331064 - RNA, 64 nt, Human
gugcagauaaaaguacucuugauuuaacacaaaggcagaugauacacuuauaaaacugggaaca

SEQ ID NO: 331065 - RNA, 64 nt, Human
acacugugccagugagaagugcaacauccagugggcagaugaaaaugaugcauggccaaguuca

SEQ ID NO: 331066 - RNA, 64 nt, Human
aggaggagggaagggaauuagaaaagucaacaaugcagaugacuucccuaaucucuucagacag

SEQ ID NO: 331067 - RNA, 64 nt, Human
aaauaccaauuauuuuccuacagcccuuuguacuucaaaauauguuuuuguguccaucaguauu

SEQ ID NO: 331068 - RNA, 64 nt, Human
gcccacaaugagugaguagugauuuuuggauauuucaaaauagucuagaccagcuagugcuucc

SEQ ID NO: 331069 - RNA, 64 nt, Human
cuguuguaaaguuagauuuugcauauuguaucuaucaaaauauguuuggguuuagauuuuaagu

SEQ ID NO: 331070 - RNA, 64 nt, Human
aaaaccuauucuggucuaaauuguguuacuagccucaaaauacaucaaaaaauaaguuaaucag

SEQ ID NO: 331071 - RNA, 64 nt, Human
aaauauuugcucaauucuuuugguuguacagcuuucaaaauauaauuaauuuuguuuuauagau

SEQ ID NO: 331072 - RNA, 64 nt, Human
uuuauuuauuuuugaauccacuaucucuuuccauucaaaauauuuccauucaaaaugugguuca

SEQ ID NO: 331073 - RNA, 64 nt, Human
auguuagcuguguauuguuuuaaaaguuuuaacuucaaaauauguuaugcacagaauguuuauu

SEQ ID NO: 331074 - RNA, 64 nt, Human
cacuuaggucuaauaaaaguacucaauuuguuauucaaaauagaccuaguaauuuauuaaacua

SEQ ID NO: 331075 - RNA, 64 nt, Human
gaaaaaaagcauuuuucuaaaugcucaaauguuaucaaaauacuauauuuauagaaguaaucuu

SEQ ID NO: 331076 - RNA, 64 nt, Human
ugacuguauuaaaucacaguuugaagcauggcguucaaaauacuacacauccuacaaagaugcu

SEQ ID NO: 331077 - RNA, 64 nt, Human
cuuguuaagugcuuuuaaacuggagaggcuaaccucaaaauauuuuuuuuaacugcauucuaua

SEQ ID NO: 331078 - RNA, 64 nt, Human
gccacuguuuuguuggcccacaacuaauaggaccucaaaauaagccaugcugcuuugcacacac

SEQ ID NO: 331079 - RNA, 64 nt, Human
ccaauaggugaucuuaauuacuuucagaauauuuucaaaauagauauauuuuuaaaauccuuac

SEQ ID NO: 331080 - RNA, 64 nt, Human
gagggggucucucccgaagaguuucuguuuuuacucaaaauaauguuauucucagaugcuugau

SEQ ID NO: 331081 - RNA, 64 nt, Human
uauaacugagccuuauuuauaauuagggauauuaucaaaauauguaaccaugaggccccucagg

SEQ ID NO: 331082 - RNA, 64 nt, Human
uccagccacucacagcucuuuuuaaaaaacagcuucaaaauaugcagcaaaaaccaauacaaca

SEQ ID NO: 331083 - RNA, 64 nt, Human
auauguugcaaugcaagugcccauugcuguuccugcagaugagaaauaccagaaacauacccua

SEQ ID NO: 331084 - RNA, 64 nt, Human
ccugaaaaacgcuaagaaaaaaagggaagauagugcagaugaaauaaaguguaauccuuuauua

SEQ ID NO: 331085 - RNA, 61 nt, Human
cuccauucaggguaaccugacugaguccugggcagaugauaacccccgacaccauggccug

SEQ ID NO: 331086 - RNA, 64 nt, Human
ccuaccccuggccguggacugaucagaccagcauucaaaauaaaaguuuguuccaaguugacag

SEQ ID NO: 331087 - RNA, 64 nt, Human
aaggaacauaccccuuacaaaugaaaaauuccacucaaaauagggacuaucuaucuuaauacua

SEQ ID NO: 331088 - RNA, 64 nt, Human
uaggaauuacaaacuuuaaacacuuuuuaaaucuucaaaauauuuaaaacaaauuuaaagggcc

SEQ ID NO: 331089 - RNA, 64 nt, Human
cucuagaugcaaauacauugaguuuaaaagugccucaaaauaauugagaucacauuucaggaca

SEQ ID NO: 331090 - RNA, 64 nt, Human
ccuuuagucguuuuuguuuuguagaaaguaucucucaaaauauauuauagcuagaauuguagaa

SEQ ID NO: 331091 - RNA, 64 nt, Human
auuacaaauaccuuccaaugaaaccaagaauuucucaaaauauuuaaugucacauauuauaaga

SEQ ID NO: 331092 - RNA, 64 nt, Human
guuccuugagagccuuucaggggggacuaugagaucaaaauauuuuuauuauaaugugaagaca

SEQ ID NO: 331093 - RNA, 64 nt, Human
uucuuaauaggccuaaaauagugagcauauauaaucaaaauaauacuucauacaacauauacuu

SEQ ID NO: 331094 - RNA, 64 nt, Human
cuaucauuuggcuggaugggggugaaguaugucuucaaaauauauugaaguaaguucaucaaac

SEQ ID NO: 331095 - RNA, 64 nt, Human
aacaauuuaaaaaugagugugaagggggaacaagucaaaauauuuuuaaaagaucuucaaaagu

SEQ ID NO: 331096 - RNA, 64 nt, Human
gguacuaacuuuuaaaucuguauguaaaaucuuuucaaaauacauuuuuaagcuaauacucuua

SEQ ID NO: 331097 - RNA, 64 nt, Human
auguauguguuuugccucucuuuuggcuacaucuucaaaauauuucuuuugugccuauguacau

SEQ ID NO: 331098 - RNA, 64 nt, Human
ucaggaaaaccggaacuuguugaugaacuuguuuucaaaauaucaucucaucaacgaggccugg

SEQ ID NO: 331099 - RNA, 64 nt, Human
uguggcugauaugauaugauucuuggaauuugcuucaaaauaauaagucuggauguuaagugca

SEQ ID NO: 331100 - RNA, 64 nt, Human
acugacacagcauucaugauguuaccuucacuuuucaaaauauuguagaaggauuuuucucaug

SEQ ID NO: 331101 - RNA, 64 nt, Human
auuugagagcaugaagauauucaugcuuuugaacucaaaauauugaagauacucucaagccugu

SEQ ID NO: 331102 - RNA, 61 nt, Human
gcuauguggcuugcucuuaggacaccaggcugcagaugaucagggauccaauaugacucag

SEQ ID NO: 331103 - RNA, 64 nt, Human
ccuguaaucccagcacuuugggaggccgaggcaggcagaugaccugaguuugggaguuugagac

SEQ ID NO: 331104 - RNA, 64 nt, Human
uuuuaacugcuuugaagccugaagccaugaaaaugcagaugaagcucccaguggauucccacac

SEQ ID NO: 331105 - RNA, 64 nt, Human
uucaguuuuuuuguuguuguuagugagucucccuucaaaauacgcaguagguaguguaaauacu

SEQ ID NO: 331106 - RNA, 64 nt, Human
auugauaccucucuguuuuauuucucucauucuuucaaaauaaaacuuuuugaaauuuggagga

SEQ ID NO: 331107 - RNA, 64 nt, Human
uucuuccauaugacauugagcaaauagaucuguuucaaaauauguucccgcuauguggauaacu

SEQ ID NO: 331108 - RNA, 64 nt, Human
guuuuuugacagguagaccaugucuuaucuuguuucaaaauaaguauuucugauuuuguaaaau

SEQ ID NO: 331109 - RNA, 64 nt, Human
ugcugacaccugcuuguuuccauacaaauugauaucaaaauaaaauuuguauagauuaucacau

SEQ ID NO: 331110 - RNA, 64 nt, Human
accaacaccacugaaaucauaagcuauucacgacucaaaauauucuaaaauauuuuucugacag

SEQ ID NO: 331111 - RNA, 64 nt, Human
aguuacugcauguuuuuauuaaggccauugguuuucaaaauaacaaguccuuacaaaguaugau

SEQ ID NO: 331112 - RNA, 64 nt, Human
uauuuauuuaugcuaauauuuuuaacaagucauuucaaaauauguguaucucaaauucucccua

SEQ ID NO: 331113 - RNA, 64 nt, Human
uuacagaguucaauguuggaaaucauuguaaucuucaaaauaagucaccguguuggauugaaag

SEQ ID NO: 331114 - RNA, 64 nt, Human
uuauucuaucuaggcuguuguaguauaauauucuucaaaauauguaagcuguugucaauuaucu

SEQ ID NO: 331115 - RNA, 64 nt, Human
auuuuuaucagaaaaauggcauauugcugaagugucaaaauaugagaaaagagcaucuucauuu

SEQ ID NO: 331116 - RNA, 64 nt, Human
ggugcuaaagugcuuuuuugaaguuuauucucuuucaaaauaaguuaucauagaaucuugugcu

SEQ ID NO: 331117 - RNA, 64 nt, Human
aaaaaauuccucuccaaacauggguaguuuuaugucaaaauauuggcuuuucaagaacaggacu

SEQ ID NO: 331118 - RNA, 64 nt, Human
uaauuuaauaauauaucuuaugagcccuauauauucaaaauauuauguuaacauguaauccaug

SEQ ID NO: 331119 - RNA, 64 nt, Human
guuuuugagcugacagcagcaaaggcaccauaagucaaaauauugguuuugguggagaugaucg

SEQ ID NO: 331120 - RNA, 64 nt, Human
uucaguuuuuuuguuguuguuagugagucucccuucaaaauacacaguagguaguguaaauacu

SEQ ID NO: 331121 - RNA, 64 nt, Human
cacccucuguguccugguccuucugagggccacugcagaugacucuccuuugaaaugagaaaaa

SEQ ID NO: 331122 - RNA, 64 nt, Human
cuucaaugugaccuaauugggaaauagagucuuugcagaugaucuaguugagaugaggucauug

SEQ ID NO: 331123 - RNA, 64 nt, Human
cgcagauggagcggcagcgccucgcucgagagaagcagaugagggaggaggcugaacgcacgag

SEQ ID NO: 331124 - RNA, 64 nt, Human
uggcaggugguaccacagcucugagagcagauaccagggguacuaagaggugcuuagacaaggg

SEQ ID NO: 331125 - RNA, 64 nt, Human
uccaaagacuaaacugacaagccuucaaggagcccagggguaaguuaacuugucaacggcaugg

SEQ ID NO: 331126 - RNA, 64 nt, Human
uuuuggcugcacacaugucuuuaacccaggagcccagggguagacaaaggaggacuaagguaau

SEQ ID NO: 331127 - RNA, 64 nt, Human
uguuuuucucauuuguugguguguggggugggggcagggguagggcgggagagcgaugcuugga

SEQ ID NO: 331128 - RNA, 64 nt, Human
cuggguguuuaaaggacaaauagcugcuagaauucagggguaaauguaaguguucagaaaacgu

SEQ ID NO: 331129 - RNA, 64 nt, Human
cugagccuccacguucagcagauacuguccaaggcagggguacggcugaccaggaaugaagguu

SEQ ID NO: 331130 - RNA, 64 nt, Human
gcagacucugaucccuucugcccuggcagaauggcagggguaaucugagccuucuucacuccuu

SEQ ID NO: 331131 - RNA, 64 nt, Human
uagaaacguuaaacuuaauuuuuuuccauuuguacagggguaacgcacuguauuaaauauguaa

SEQ ID NO: 331132 - RNA, 64 nt, Human
uguuucuagcauuaucccaucccuuugagccauucagggguacuugugcauuuaaaaaccaaca

SEQ ID NO: 331133 - RNA, 64 nt, Human
ccuugaguaggcccugcuuuaucaggggacaaaccagggguaccaggcacauggcugggggagg

SEQ ID NO: 331134 - RNA, 64 nt, Human
ggugcugaaauggcuguggccccagcaccugaggcagggguacgcuaccugggguagcaguaga

SEQ ID NO: 331135 - RNA, 64 nt, Human
auauaacugaauuucaugagaagauuuauuccaccagggguauuucagcuuugaaaccaaaucu

SEQ ID NO: 331136 - RNA, 64 nt, Human
uuuuccauuuguuugugacaucucuuauuucuuucagggguaucuuguaauucucauuauauau

SEQ ID NO: 331137 - RNA, 64 nt, Human
caauuuuuaauuuuuuuaacuuuuauuuuagauucagggguauaugugcagguuuguuacauag

SEQ ID NO: 331138 - RNA, 64 nt, Human
ccccaaggccuuuccuacaugcccccucccuucacagggguacagaaauuaucccccuacaacc

SEQ ID NO: 331139 - RNA, 64 nt, Human
gcugagaguggaagagguggcggggaccagcugggcagaugagaggcugagccucaucccuaac

SEQ ID NO: 331140 - RNA, 64 nt, Human
cuucuugauagcucccugcacuuuggaacacggagcagaugagagagggucggggcuugcccuc

SEQ ID NO: 331141 - RNA, 64 nt, Human
ggcuguugccuggggaacaggagagcugcugcaggcagaugaccucaugggggguggagggagg

SEQ ID NO: 331142 - RNA, 64 nt, Human
accgucugucuggaggucagagccuguuggaaagcagggguagaggggagcccuggaagcaggg

SEQ ID NO: 331143 - RNA, 64 nt, Human
cucuccuaggcauucuggaccucuggguugggaucagggguaggaauggaaaggauggagcauc

SEQ ID NO: 331144 - RNA, 64 nt, Human
ccaguuccuaccccagaaccaguuaacugugcuucagggguagggcugggcccacagagccugg

SEQ ID NO: 331145 - RNA, 64 nt, Human
ugggcaaagaaaacuggggugcacucagcucucacagggguaaucaucucaagugguauuugua

SEQ ID NO: 331146 - RNA, 64 nt, Human
gaaauuagaauuuauaauaauugcaccuaccucccagggguaacuaaaugaauaaauauaauaa

SEQ ID NO: 331147 - RNA, 64 nt, Human
aaacacauuuacaagaaaaauguuuuaaagaugccagggguacugaaucugcaaagcaaaugag

SEQ ID NO: 331148 - RNA, 64 nt, Human
ggcugaguaaaccgagauccagcguucuguauggcagggguauugcuuaucacagagguucuga

SEQ ID NO: 331149 - RNA, 64 nt, Human
uuaggaacuauuaggaaugucaggacuuuaucagcagggguaaaacuaccaccuggccuagccu

SEQ ID NO: 331150 - RNA, 64 nt, Human
aucaaaagcaagcuaguuacuuccuagauaccaacagggguacagguauugauuaaagacggcu

SEQ ID NO: 331151 - RNA, 64 nt, Human
uuuuauagcugauauaguuacaccucaagccccucagggguaacaacuaacaaacacccaaacu

SEQ ID NO: 331152 - RNA, 64 nt, Human
aggaaagagcagggagaccaagcagagucgugggcagggguagaauggaaggagaggcggcugg

SEQ ID NO: 331153 - RNA, 64 nt, Human
cucgagcucggggcugggggcugcagggcugggucagggguacacagagcuaaggccaaugggc

SEQ ID NO: 331154 - RNA, 64 nt, Human
ccaugggaaacuuucccuuuuguaaguugagggccagggguagggauauuuuuuaguuugugau

SEQ ID NO: 331155 - RNA, 64 nt, Human
gauuuccucacaucauuuccuugugucuggacaucagggguaacaacuguacuuacuuuacagg

SEQ ID NO: 331156 - RNA, 64 nt, Human
uguccagccccucaguauuaccaugucucccucucagggguagcagagacaggguugcuuauag

SEQ ID NO: 331157 - RNA, 64 nt, Human
ucuccgcaaggccagaaagugaucacaaaaagaggcagaugauagacacugggguagggucaua

SEQ ID NO: 331158 - RNA, 64 nt, Human
ggaauggcaggugucauaugacugauuacucagagcagaugaggaaaacuguagucucugaguc

SEQ ID NO: 331159 - RNA, 64 nt, Human
accacgcauugucacagcuaccaaagugugguuugcagaugaucugggcuuguuucuggcagag

SEQ ID NO: 331160 - RNA, 64 nt, Human
cagugccugugauauugaguuuaaggauuugaggcagggguaauuauuaaacauauugcuucua

SEQ ID NO: 331161 - RNA, 64 nt, Human
aggguuugucauagagggaaccucuaaauaauuucagggguaggggagauguugucaauaggaa

SEQ ID NO: 331162 - RNA, 64 nt, Human
cuuugaaaggcguuauguguugaacaguaugcuucagggguaaauuuaaaauagucucuugaag

SEQ ID NO: 331163 - RNA, 64 nt, Human
ugccuacuguauaaugguuaucaaacaguugucucagggguacaaacuuugaaaacaaguguga

SEQ ID NO: 331164 - RNA, 64 nt, Human
aaaagccuuugccuucaugaagcauacauucauucagggguagacacacaaaaaaugaaauaaa

SEQ ID NO: 331165 - RNA, 64 nt, Human
gagccgaggacgcuggguccuccucucugggacacagggguacucacgaaaacugggccgcgug

SEQ ID NO: 331166 - RNA, 64 nt, Human
ugcaaccagucagggcccagaaucaugcaaaucucagggguaugccucucuggggaggagcucc

SEQ ID NO: 331167 - RNA, 64 nt, Human
ucuauucagcgaaaccacaccacuuaguuucucccagggguaaaaaaaacccuugugaauccug

SEQ ID NO: 331168 - RNA, 64 nt, Human
gucaccgcuucuguguagcaaacauuaacgaugacagggguagaaauucuucggugccguucag

SEQ ID NO: 331169 - RNA, 64 nt, Human
acagcugagggccuggccuugggguacugcuggccagggguaggauaguauaggaaguagaagg

SEQ ID NO: 331170 - RNA, 64 nt, Human
ugucuaugggacacucugagcugugccacugccacagggguauucugccuucaggacucugccu

SEQ ID NO: 331171 - RNA, 64 nt, Human
ggcagcccauugcaugcccucaacucuugcuuggcagggguaccagagacugaaagacacggca

SEQ ID NO: 331172 - RNA, 64 nt, Human
uagugaugagcagcugccagcugagcucugucaccagggguacuccacaggaggagcaggugcu

SEQ ID NO: 331173 - RNA, 64 nt, Human
gccacucgauuuguauuucugauuaacaaauaaacagggguauuuccuaaggugaccaugguug

SEQ ID NO: 331174 - RNA, 64 nt, Human
cugaucucaccccauauuacuaaagcaaaauuuccagggguagggacugggacuccagaaccau

SEQ ID NO: 331175 - RNA, 60 nt, Human
cccagcagccauggguacauggguccccagcucaccuauggauucccgccagucugccca

SEQ ID NO: 331176 - RNA, 60 nt, Human
aaugguacuccuauaauuuuugauugugagcucaccuauuuggguuaagcaugccaauuu

SEQ ID NO: 331177 - RNA, 60 nt, Human
ccacaugaacgcacgccugagauuuggccacucaccuauguuuuggguggauugccuagg

SEQ ID NO: 331178 - RNA, 60 nt, Human
agaucccuucuuugucuuacuaguuaaauccucaccuaaucucuuggguaugaauauaaa

SEQ ID NO: 331179 - RNA, 64 nt, Human
ugaguaaccuaagggaagugcugaaugguguuggcagggguauuaaacgugcauuuuuacucaa

SEQ ID NO: 331180 - RNA, 64 nt, Human
aggauuugcuaauuucagugaagucauuuugcuucagggguaaauuauccuaguuaccaagucc

SEQ ID NO: 331181 - RNA, 64 nt, Human
gcccccagccugugccagcagcagcugcccgccacagggguacccaucacacaccagcguuuug

SEQ ID NO: 331182 - RNA, 64 nt, Human
cuguuucuuaaugacucauuuuagccccuauuuucagggguagugagaggguguggcuccacua

SEQ ID NO: 331183 - RNA, 64 nt, Human
auagaaaaauuguaauaguuuuaaucaagauguucagggguauuaaaacagaacuguguacugu

SEQ ID NO: 331184 - RNA, 64 nt, Human
aggcccagcgcacaucgcuggccccacaaacguucagggguacagccauggcagcuccuuccuc

SEQ ID NO: 331185 - RNA, 64 nt, Human
gccugagcucaccagcaaacagaagcaucaagcccagggguaaaggcugaagcuuucacagugc

SEQ ID NO: 331186 - RNA, 64 nt, Human
uagacucgggcagccagagcggcgagcugaguaacagggguaacaccucccugcugccccuccc

SEQ ID NO: 331187 - RNA, 64 nt, Human
aaauuauuguaccuaauuaugucuaaaguuuauucagggguaauuucccugaugucuguauaaa

SEQ ID NO: 331188 - RNA, 64 nt, Human
gggcaaguggggcccgaggaagccucucuggggccagggguagcugagcuuaaaggcccugggu

SEQ ID NO: 331189 - RNA, 64 nt, Human
aaucauuaagaaaggguuucccuuccuuaaagcucagggguacuauuaguuaggaguugacuaa

SEQ ID NO: 331190 - RNA, 64 nt, Human
gguggcucugggaaugggagagggguaggauguacagggguaguuuguuuuagaaccagccgua

SEQ ID NO: 331191 - RNA, 64 nt, Human
uacauauuguaucuguguaacauuuuguauauuccagggguagggccgcccccuguaucauacc

SEQ ID NO: 331192 - RNA, 64 nt, Human
caagcuggcagugggaagggcuagugagaccacacagggguagccccagcagcagcacccugca

SEQ ID NO: 331193 - RNA, 64 nt, Human
cuccugagacaguugaagaagaaauagcacaaaucagggguacucccuucacagcugaugguua

SEQ ID NO: 331194 - RNA, 60 nt, Human
uggccagaaugcugcaggacuugagaagaccucaccuagaaauugacacaaguggaccuu

SEQ ID NO: 331195 - RNA, 60 nt, Human
auaaauuucauccaacuacuugugaucucucucaccuacaucaauuauguauguuaauuu

SEQ ID NO: 331196 - RNA, 60 nt, Human
cacugggacuuuguaaacuuccaagucauucucaccuaaacccucugugaaauuuguaau

SEQ ID NO: 331197 - RNA, 60 nt, Human
acucuuuuuuuuucuuuuuugagacagagucucaccuauugcccagacugaagugcagug

SEQ ID NO: 331198 - RNA, 64 nt, Human
ccacugaugagagauccagccaaagagcugcccccagggguaugagggcaccagcuggguucuc

SEQ ID NO: 331199 - RNA, 64 nt, Human
uccugccccaaucaucucgcuggaugccauugcccagggguagcccuucgguaugggcugggga

SEQ ID NO: 331200 - RNA, 64 nt, Human
gugaucugaaggcaaagccucuaugugugaaacacagggguaccucaaaaauagaacaagagca

SEQ ID NO: 331201 - RNA, 64 nt, Human
caccaaggaacucuacuucagucaauagccauaucagggguacauucuagcugagaagcaaugg

SEQ ID NO: 331202 - RNA, 64 nt, Human
gggcgucgugagcuuggauuguuuaaggagggcucagggguaggaaucgcgauggcuuuauaac

SEQ ID NO: 331203 - RNA, 64 nt, Human
uagcacaugaccuugggauuacauuuuuauggggcagggguaagcaaguuuuuaaaucauuugu

SEQ ID NO: 331204 - RNA, 64 nt, Human
aaucuugggggccaggcacugugcuaggcaccagcagggguaacacgaagaagacccggcccuu

SEQ ID NO: 331205 - RNA, 64 nt, Human
cccagggagagacacagcccacugaacaaggucucagggguauugcuaagccaagaaggaacuu

SEQ ID NO: 331206 - RNA, 64 nt, Human
gcuugggauuucuuagagaaagauuacuuccugacagggguaggggagugacaaucugcaagug

SEQ ID NO: 331207 - RNA, 64 nt, Human
uaugucuguugcagagaaccaauauagcagugcccagggguagagaccauguguuccauacucg

SEQ ID NO: 331208 - RNA, 64 nt, Human
aaauucaaaucaauuucaaggaaaaacaucuggccagggguagcuugauuucgcccccaaaaau

SEQ ID NO: 331209 - RNA, 64 nt, Human
cuugagauaucuaugcuguucuuuaaaucuacagcagggguaaacauucaucugcagugugcau

SEQ ID NO: 331210 - RNA, 64 nt, Human
aaucuuguagaauuucucauucugugguacaacccagggguaaacuauuauuccaguagucagu

SEQ ID NO: 331211 - RNA, 64 nt, Human
cuuccaaaggucauccuuaauaacaacagaucugcagggguauguuuuaccaucugcauccagc

SEQ ID NO: 331212 - RNA, 64 nt, Human
cagugcuuauuuuagugggaaaaacagcuaauaccagggguacaaacauuggcucccaaggaac

SEQ ID NO: 331213 - RNA, 60 nt, Human
uuaguucuguauguauuuuagcaaucucaucucaccuaacugagauguguuucaauuaua

SEQ ID NO: 331214 - RNA, 60 nt, Human
ugugucccaaggaaaucccuguaaauuuaacucaccuacaaaaggcuuuuuccccgccuu

SEQ ID NO: 331215 - RNA, 60 nt, Human
ucaaccguuaaagcagaugcaaaaauucaccucaccuaaauugaacuucuugcauauuuc

SEQ ID NO: 331216 - RNA, 60 nt, Human
agcugguuuugauacugaaugugaacaaggcucaccuaaggaaacugacccagaaaacag

SEQ ID NO: 331217 - RNA, 64 nt, Human
cagcccuauggccuuggcucugggccugaugggacagggguagagggaaggugagcauagcaca

SEQ ID NO: 331218 - RNA, 64 nt, Human
agugcuuccagcccuucuuggagccuucaugguccagggguaggggccccacuggccugagcau

SEQ ID NO: 331219 - RNA, 64 nt, Human
acuuuuucauuuagauuguaaugauuaacagaaacagggguaccuuucccagggguguccacca

SEQ ID NO: 331220 - RNA, 64 nt, Human
uugaauuggccuaggaggaaacccagaaaugaaccagggguaugucaucacuuuuuucauauca

SEQ ID NO: 331221 - RNA, 64 nt, Human
ugugaggguccccagagagaagggagugggugggcagggguagaggagggggccgcuguccacc

SEQ ID NO: 331222 - RNA, 64 nt, Human
gccaauuuuucucucuuagaucuuccagcagccccagggguaggaagcuccucuuaguacuaag

SEQ ID NO: 331223 - RNA, 64 nt, Human
cuguaccccagccuccugucccccaggaaccucacagggguaucaaaaagauguaaacagccca

SEQ ID NO: 331224 - RNA, 64 nt, Human
uauaaauauauacauguguacauauaucuauguacagggguauuauauauauacauauaagaug

SEQ ID NO: 331225 - RNA, 64 nt, Human
aguggggagccaagaggucccauauuccugagugcagggguagucccucucaccugcuuccuca

SEQ ID NO: 331226 - RNA, 64 nt, Human
ccccauccaagauugaacugugaaagagagguuccagggguaucucccucagugccaguuacuu

SEQ ID NO: 331227 - RNA, 64 nt, Human
ucauuguugggagcuuuuagaugagacaucuuuccagggguagaaggguuaguauggaauuggu

SEQ ID NO: 331228 - RNA, 64 nt, Human
augauaauuuauugcccccugguggccucuucaucagggguauugggguuagugaccuggccag

SEQ ID NO: 331229 - RNA, 64 nt, Human
accccucuuccuuaaugaaauguggcaguccucucagggguaccccaccuacuuagggaucuga

SEQ ID NO: 331230 - RNA, 64 nt, Human
agcucucccuaggcugcccacucuccauccuccccagggguagaggcugggggcuccaccccag

SEQ ID NO: 331231 - RNA, 64 nt, Human
uuuuccauacauuguacugaucaaguuauacacccagggguauauacacuuucuucauguuucu

SEQ ID NO: 331232 - RNA, 60 nt, Human
gccacagacuuguaguaaucauuugaaggccucaccuaguguccccuuggugacguaugc

SEQ ID NO: 331233 - RNA, 60 nt, Human
uaacuccaucuccuuucuuuaaagucaaaucucaccuaccuguuugggucagagagaugu

SEQ ID NO: 331234 - RNA, 60 nt, Human
uccuggugcuccaggcggggccguggaccccucaccuacauuccauagugggcccguggg

SEQ ID NO: 331235 - RNA, 60 nt, Human
aaucaguuuauacccuaguuaguguuuugccucaccuaauaggcugggagacugaagacu

SEQ ID NO: 331236 - RNA, 64 nt, Human
ugaguggccaggaaugcuaaauguucugcagugucagggguagucccacauacuaaagauuguc

SEQ ID NO: 331237 - RNA, 64 nt, Human
uugaguugcuugggcuuuacuucugccuacaaaucagggguaaaaauaccuguugggaggagaa

SEQ ID NO: 331238 - RNA, 64 nt, Human
ggaaaguuaguggaauauucaugaaacuucauugcagggguaauagaagaaaaaguaaauuggg

SEQ ID NO: 331239 - RNA, 64 nt, Human
caaaugacccucuaaugaucccugaagaucaaaacagggguaaaugacucccugcaaaacccaa

SEQ ID NO: 331240 - RNA, 64 nt, Human
acauggacgcaccggccuggcugcagcugggcagcagggguagggguagggagccuccccuccc

SEQ ID NO: 331241 - RNA, 64 nt, Human
ugacugccuuugggagcccgcagguggccagaggcagggguagcugaguuccuggagaccccuu

SEQ ID NO: 331242 - RNA, 64 nt, Human
ccuaagagaaccacacccaaaguccucacucuugcagggguagacauuucugguuugguuuguu

SEQ ID NO: 331243 - RNA, 64 nt, Human
cuucuuguuuggagaugagaacuucuccuggaagcagggguaaauguaggggggguggggauug

SEQ ID NO: 331244 - RNA, 64 nt, Human
agcucgguguucugagaccucgggagugaggacgcagggguaugaggcagggagagggugugcc

SEQ ID NO: 331245 - RNA, 64 nt, Human
caugggaccaagcggaaccagaacaaggucccgacagggguagacguuccaccuggggagaucc

SEQ ID NO: 331246 - RNA, 64 nt, Human
ccuccugugucagccaccagaguagcugagacuacagggguaugccaccaugcccagcuggcau

SEQ ID NO: 331247 - RNA, 64 nt, Human
cuuggcugugugcauuuuucaacuccaagcagcccagggguaaguaaacaaaguauggaugaag

SEQ ID NO: 331248 - RNA, 64 nt, Human
aagagauuccuauuacugcaguacauacgucugccagggguaaccuggccacugucccuguccu

SEQ ID NO: 331249 - RNA, 64 nt, Human
cuccucucugagaccagggcugucacuuuucugccagggguacugggucccccucagcacccuc

SEQ ID NO: 331250 - RNA, 64 nt, Human
caaagaguaaaucaacaucuguauacccccuucccagggguaagcacuguuaccaauuuagcau

SEQ ID NO: 331251 - RNA, 60 nt, Human
uguguccagagaguacacuuuuucaaaaugcucaccuacuggaagugugaauuacuugac

SEQ ID NO: 331252 - RNA, 60 nt, Human
cagucaaguuccucggagaucugccucugccucaccuaccccagggaacuuccaaggaag

SEQ ID NO: 331253 - RNA, 60 nt, Human
gaacacagacagggugucuacccaagaagccucaccuauccccaacuuagaauuugcuac

SEQ ID NO: 331254 - RNA, 60 nt, Human
cagcugugggcuucuaccaccacuaagccgcucaccuagaguuguuacuuuuuugauggg

SEQ ID NO: 331255 - RNA, 64 nt, Human
gcacucagagggacuuaugauaaagguucagcuccagggguaguaccugagugugugccaugcc

SEQ ID NO: 331256 - RNA, 64 nt, Human
ggaccacuuugaucggacccacccuuggaaagcucagggguaggcccaggugggaugcucaccc

SEQ ID NO: 331257 - RNA, 64 nt, Human
cuaucuagauucuucugugaaucuaaaagcauuacagggguaaaugcuuugcuauuugacguau

SEQ ID NO: 331258 - RNA, 64 nt, Human
uugaggauuuugaggaaaggaagaaacacugagacagggguauggggaagagcugagcaaagag

SEQ ID NO: 331259 - RNA, 64 nt, Human
cucaccagcagugccugguuccucccccuucccucagggguagacaagggaccuuugauuauuu

SEQ ID NO: 331260 - RNA, 64 nt, Human
uagauccucucauauuuugucuuccucaggguggcagggguacagagagugccugauuggaaaa

SEQ ID NO: 331261 - RNA, 64 nt, Human
aaacuucuuuucauaccauuuuuagcuguguucacagggguagccagggaaacacugucuuccu

SEQ ID NO: 331262 - RNA, 64 nt, Human
cuuagaucugagcccucccucuucccagcacaggcagggguagaagcaaaggcaggaggugggu

SEQ ID NO: 331263 - RNA, 64 nt, Human
gcaaguuuucuaugugggagccacuuuuuuuguacagggguaaguuggggguuuucagggagcc

SEQ ID NO: 331264 - RNA, 64 nt, Human
agccagccuacuccuucuuacauagcuucuccaacagggguagcaaugaccuguccacuucaaa

SEQ ID NO: 331265 - RNA, 64 nt, Human
caccaggcgccaggugagcugguucagaccccuccagggguacuccagagaccucacgugugga

SEQ ID NO: 331266 - RNA, 64 nt, Human
acuccuaguugccacauuggagcacucaguucagcagggguaugcugacuucagcagacaaaga

SEQ ID NO: 331267 - RNA, 64 nt, Human
ucuucccacucagacuccugcguagcugggaccacagggguaugccaccacaccuggcuaauuu

SEQ ID NO: 331268 - RNA, 64 nt, Human
aagggcgccuacauccccaggccuugcuggggugcagggguauaucaacuucccauuagcagga

SEQ ID NO: 331269 - RNA, 64 nt, Human
ggagccagaacccucaccccucucccacccuccccagggguaaccccaggccaagcacagauag

SEQ ID NO: 331270 - RNA, 60 nt, Human
ccuguuaagggggagggccccaggacaccccucaccuacuuucagcuucaaccccaggcc

SEQ ID NO: 331271 - RNA, 60 nt, Human
gcaacugaagcggcuggaaucagucagccgcucaccuaucuacucccacuuuucggagac

SEQ ID NO: 331272 - RNA, 60 nt, Human
ugauucguaaaccuaggggaaaccaucucucucaccuaaugacccgccuuguucugaagc

SEQ ID NO: 331273 - RNA, 60 nt, Human
ucagaaacucaaaagaaggccacuguuugucucaccuacccaugaccugaagccccuccc

SEQ ID NO: 331274 - RNA, 64 nt, Human
gccuggcgucggccagaggggcugcuccagugggcagggguagcuagcgugugccaggcagauc

SEQ ID NO: 331275 - RNA, 64 nt, Human
augaauaauaugaaccuccauuuaugcaggucugcagggguauaacacgccuugaaauuuaaaa

SEQ ID NO: 331276 - RNA, 64 nt, Human
gcugucaaauccucuuuccuucccaauugccucucagggguagugaagcugcagacugacaguu

SEQ ID NO: 331277 - RNA, 64 nt, Human
cucacugacacacccuucccaauugccacaagcgcagggguaucuuacagcacuuuggggaggg

SEQ ID NO: 331278 - RNA, 64 nt, Human
cuugcucagugggggcagagccaccugacucuugcagggguagccugaggugccgccuccuugu

SEQ ID NO: 331279 - RNA, 64 nt, Human
uacacguggcauguugcuccacauuccuuacacacagggguagaggggauugcuuuugugaccc

SEQ ID NO: 331280 - RNA, 64 nt, Human
uuuccucaucugcagaauggggauaauuaugucccagggguauauuuagacccuguuuccuuuc

SEQ ID NO: 331281 - RNA, 64 nt, Human
gagcugcaugcaccacaggggcaaugcaccuuugcagggguaccuucuggccccaacccuugac

SEQ ID NO: 331282 - RNA, 64 nt, Human
gggacacuguggagcucugcccagaugaccuuuucagggguaacaccccagcugcuugagagaa

SEQ ID NO: 331283 - RNA, 64 nt, Human
ccuucucucuccagccaucaccgcugugguuguucagggguagcuuuucaaaaacagggcagag

SEQ ID NO: 331284 - RNA, 64 nt, Human
guuuuugagcuugcucuuacguuuuaagaggugccagggguacauuuuugcacugaaaucuaaa

SEQ ID NO: 331285 - RNA, 64 nt, Human
cauggggcagggaauccauagcggggcccacaggcagggguaugagugcgucccacccaacgca

SEQ ID NO: 331286 - RNA, 64 nt, Human
cuugcuggaaccccugaugcauuuuccuugagagcagggguacuuccgccuugccguuagcuug

SEQ ID NO: 331287 - RNA, 64 nt, Human
gggucuuagccacuccccacccuaggguauaguucagggguauccaauccuuuggcuucccugg

SEQ ID NO: 331288 - RNA, 64 nt, Human
gcaugugccccgcaggggccuagagggugggggccagggguauuugcauucauacauuguguca

SEQ ID NO: 331289 - RNA, 60 nt, Human
aucuuccccacacacaaucauucauaucuacucaccuaacagcaacacuggggagagccu

SEQ ID NO: 331290 - RNA, 60 nt, Human
cucacgaugaugaacaauuaucucccguuacucaccuagcaguaucuaacugucccuaac

SEQ ID NO: 331291 - RNA, 60 nt, Human
gcaucugucacugccgugaggucagcgcuucucaccuaacugccuccuggauugucaucu

SEQ ID NO: 331292 - RNA, 60 nt, Human
ggaccgagagugacauccaguugcaccuuucucaccuacuuugggaccuuugggggugag

SEQ ID NO: 331293 - RNA, 64 nt, Human
uauguggggaaagcucuggugacccugggcuucgcagggguagaucccaggacucggcagugga

SEQ ID NO: 331294 - RNA, 64 nt, Human
cuuaaaauugauuuccugucccucuuccuaaggacagggguaacagucaaagugaaggaaugau

SEQ ID NO: 331295 - RNA, 64 nt, Human
ccuuggcugggacucagcauuuuccagucuuuuucagggguagacaggggagccuggguuaaac

SEQ ID NO: 331296 - RNA, 64 nt, Human
uauagaaagguacugugaaaugaucacuuuguggcagggguacuuuuaaacauaaauguuucua

SEQ ID NO: 331297 - RNA, 64 nt, Human
ccuaaaggcagggauucuuaaccuggauagaagccagggguaaccaugaacuugauggaagaaa

SEQ ID NO: 331298 - RNA, 64 nt, Human
cuggaggccugccugugucuagagcucugggccucagggguaagggaaggaagccagccuuuca

SEQ ID NO: 331299 - RNA, 64 nt, Human
caaggagaccaaagauugaugagaagacccccagcagggguacuggguacccggcaggccagug

SEQ ID NO: 331300 - RNA, 64 nt, Human
aacuaacuguugauacaagaacuugguuguaccucagggguauuauggugaacaaaaaaaaaac

SEQ ID NO: 331301 - RNA, 64 nt, Human
cccgaaacgaauuuucuuacaaaagccuaaguagcagggguaauuuucugcucauuuuuugucu

SEQ ID NO: 331302 - RNA, 64 nt, Human
auuaauuaaggguauuuguaauugcugcuuuuuucagggguaauuuccaacacacauacaugca

SEQ ID NO: 331303 - RNA, 64 nt, Human
guuuuggagccuuccaggaauuccuuguugacaacagggguacacucacacagaccuccaagac

SEQ ID NO: 331304 - RNA, 60 nt, Human
gucagagacauguacugccccucacauuuucucaccuaaaccagcagcaccuccaucuua

SEQ ID NO: 331305 - RNA, 60 nt, Human
ggauacuuuaauauccagugccgguucagacucaccuauguggcaccuuaaacuuaaaua

SEQ ID NO: 331306 - RNA, 60 nt, Human
cuuuucauuugcagaaguuaguaacugcagcucaccuacugcaccaaaguucucgauuuu

SEQ ID NO: 331307 - RNA, 64 nt, Human
cccauccagaccccgacuggccaagaccuccacguccccagaguccagcccuggaaauuccaag

SEQ ID NO: 331308 - RNA, 64 nt, Human
ggcuccagacacuucacggaaggaagaucacauguccccagagaggcacccccaggcaagcucg

SEQ ID NO: 331309 - RNA, 64 nt, Human
cuuuuagccgcugcguucugggagcuccucccccuccccagaaggccaagggaugugggggcug

SEQ ID NO: 331310 - RNA, 64 nt, Human
gcugggcuugggaaggggagguggaggccagguguccccagaccucuaacccuugccccuagca

SEQ ID NO: 331311 - RNA, 64 nt, Human
auuagggacucccacccucuucaaguuauaaauauccccagaaccuuggcuacgugcccggaag

SEQ ID NO: 331312 - RNA, 64 nt, Human
aaucacccuacaaccugcauacuuugagucuccauccccagaauuuccagcuuuugaaaguggc

SEQ ID NO: 331313 - RNA, 64 nt, Human
gugggcugaagcccuuggaaagugacauaggaaguccccagaucuugcccuucucacuccagag

SEQ ID NO: 331314 - RNA, 64 nt, Human
caucuucccugaagcccccaaucuggccccccccuccccagacuuccuccccaaaacaccccag

SEQ ID NO: 331315 - RNA, 64 nt, Human
uggccuggcuggagccaggaacaggagggacacuuccccagaauccgcauguuuccccagugau

SEQ ID NO: 331316 - RNA, 64 nt, Human
uaacauuaccuaaaaggcacuaacaugcucagguuccccagaaagaggcguaagaagggccucu

SEQ ID NO: 331317 - RNA, 64 nt, Human
gagcuucaaggcucacaauggaagcacugucauuuccccagaaaagcuguguucccuaugcuga

SEQ ID NO: 331318 - RNA, 64 nt, Human
gccauacagccccaggcaaugggcacagccuuccuccccagaggacccggccgaccucagcgcc

SEQ ID NO: 331319 - RNA, 64 nt, Human
uguuugguuugacacccagccucuucccuggcccuccccagagaacuuuggguaccuggugggu

SEQ ID NO: 331320 - RNA, 64 nt, Human
uuugcaggggacucaaagcaggauuucaggcaauuccccagaguaaucagaguacuuucgguuc

SEQ ID NO: 331321 - RNA, 64 nt, Human
ccuuucaccuuccucaaaaugaggcauaaucuuauccccagaauugaggagggguuguguuaac

SEQ ID NO: 331322 - RNA, 64 nt, Human
aacgugugaagcucugugucucagacggggcccucccgucgagaagcugguagucagugaguga

SEQ ID NO: 331323 - RNA, 64 nt, Human
uagcuaagucuuucugcaaacaaccucccuuccccccgucgagucauuuggugacuuugauggg

SEQ ID NO: 331324 - RNA, 64 nt, Human
ugugcaacacgaagcuuccagaaccauaaaauaucccgucgauaaggaaagaaaaugucguugu

SEQ ID NO: 331325 - RNA, 64 nt, Human
cucagaugggacaagaagccgccucuggacuaucuccccagaccagcagccugacuugacuuuu

SEQ ID NO: 331326 - RNA, 64 nt, Human
uggguggacagggaccacaaagacucauggggcuuccccagaacuuugugcuugauggagcacc

SEQ ID NO: 331327 - RNA, 64 nt, Human
gcugaugugaaagagauucuggaaauccaaauguuccccagaaauucugauaucaaaacauucc

SEQ ID NO: 331328 - RNA, 64 nt, Human
ggagacuauaaucuccuuauuuuuuuacuccuacuccccagaggggcccuagugccucuguucc

SEQ ID NO: 331329 - RNA, 64 nt, Human
agcccuuaugacaucagcaauacagacuacuucuuccccagauagcuggcuggguggcaccagc

SEQ ID NO: 331330 - RNA, 64 nt, Human
agguacugcauucucucccauccuggggcagcacuccccagagcugugccagcaggggggcugu

SEQ ID NO: 331331 - RNA, 64 nt, Human
ugagcaugcccuuugcuugccacaccauauccuuuccccagauccaccuguccugacacucuag

SEQ ID NO: 331332 - RNA, 64 nt, Human
gaaaucucugcugaaauccacaguuuucauaagcuccccagaugauuccuguguacauuaaauc

SEQ ID NO: 331333 - RNA, 64 nt, Human
aacaugccccugggccaagauggggcuucaccccuccccagaguaagagcuggggcugacaguc

SEQ ID NO: 331334 - RNA, 64 nt, Human
uucuggucaaaaaugaaagguccugguaccaucuuccccagaaacgaucaagaagggcaauggg

SEQ ID NO: 331335 - RNA, 64 nt, Human
acuccuggccucaagugauccucccaccuuggccuccccagagugcugggauuacacacgugag

SEQ ID NO: 331336 - RNA, 64 nt, Human
gagcucuuaucuaugaagacaucuucccagaguguccccagagacaugcaagucaugggucaca

SEQ ID NO: 331337 - RNA, 64 nt, Human
gcagugacuuguucacuaaaaagagagaguccuguccccagacgguuaguacaaagccuuggau

SEQ ID NO: 331338 - RNA, 64 nt, Human
gggccuggggccucuguucugcuguggccugagcuccccagaguccugaggaggagcgccaguu

SEQ ID NO: 331339 - RNA, 64 nt, Human
aucagcuggaagcugccugucaucuccugcccaauccccagaaacccugauucaggucugcagg

SEQ ID NO: 331340 - RNA, 64 nt, Human
aauuuuccaaaacagccuguucucuccucucuccuccccagagcacccccugccaucagggggg

SEQ ID NO: 331341 - RNA, 64 nt, Human
gcuguuuccagucuaaaggaccuccuuugguaaaggugaacaagaccucuccccuaugcuaccc

SEQ ID NO: 331342 - RNA, 64 nt, Human
cugaaacucccagccacagcauuuaucagacugcggugaacauuuccucagcauugaacaauga

SEQ ID NO: 331343 - RNA, 64 nt, Human
cauugcugaaaggccacccuaaccucuguguucaggugaacagcucggagaagcugcagcugca

SEQ ID NO: 331344 - RNA, 64 nt, Human
cucugagcacgggcucuucccgccggguccucccuccccagaccccagagggagaggcccaccc

SEQ ID NO: 331345 - RNA, 64 nt, Human
agcagugugcauagaccauuuccaggagggucuguccccagaugcucugccucccguuccaaaa

SEQ ID NO: 331346 - RNA, 64 nt, Human
ccucagcccugggaagacacauucccuucccuguuccccagagagcccaccuccgcccugggca

SEQ ID NO: 331347 - RNA, 64 nt, Human
ggcagaggcuggcagugcugauucagccuggccauccccagaggugacccaaugcuccuggagg

SEQ ID NO: 331348 - RNA, 64 nt, Human
acccucucuggcgguggccaccaguccuugccaauccccagagcuguucuuccaaagcccccag

SEQ ID NO: 331349 - RNA, 64 nt, Human
auaagcauaaaagcaacguggguggucuccucaguccccagaggaaggaagcacugcagagauu

SEQ ID NO: 331350 - RNA, 64 nt, Human
cugggugcaggccccucaguuggggcucccaccuuccccagacuacuguucuccucacugccuc

SEQ ID NO: 331351 - RNA, 64 nt, Human
uucggugcagaacucggcaaggggcagcuuacccuccccagaacccaggaucauccugucuggc

SEQ ID NO: 331352 - RNA, 64 nt, Human
gacuuggcccugccugaugccaagcaaagacccuuccccagaggccuaccccccauauguccuc

SEQ ID NO: 331353 - RNA, 64 nt, Human
auucucccaccuccucccuuugauggaaccacccuccccagaggcugcauugaggagacuccac

SEQ ID NO: 331354 - RNA, 64 nt, Human
ucugccugcugcccccucucuccucgggaucggguccccagagccaccaucuccugagccuccc

SEQ ID NO: 331355 - RNA, 64 nt, Human
cauccuggcuggcuguguccucuccagcuuucccuccccagaguucuugcacccucauucccuc

SEQ ID NO: 331356 - RNA, 64 nt, Human
gucagaggauguggccaccugacccuaaauagguuccccagaguccugccccucuaaugaauga

SEQ ID NO: 331357 - RNA, 64 nt, Human
caccaccugccuugugaccacaucucccaccacguccccagaucucaagaacgcagcucagcuu

SEQ ID NO: 331358 - RNA, 64 nt, Human
ggucugccucccaccagacccucuccaguguacuuccccagauaggaccagaggaugucuaguu

SEQ ID NO: 331359 - RNA, 64 nt, Human
uuguagcacucaggcucuccauucaauuucaggcuccccagaucauguuuuggugaaaauuagg

SEQ ID NO: 331360 - RNA, 64 nt, Human
agcugccugcagucaggccccagguucuuccaugggugaacagagcaucugacaaaagguccca

SEQ ID NO: 331361 - RNA, 64 nt, Human
ucugcaggccacgauggucugcucuggagcauugggugaacacacaggcuggcugcucugggca

SEQ ID NO: 331362 - RNA, 64 nt, Human
uccccagugccguggcugcucuggggcuaccccaggugaacagagguggugagaugcgcaggga

SEQ ID NO: 331363 - RNA, 64 nt, Human
cucuuaacacucauacuugaaaacuuucugaguuuccccagaagagaauaugggauuuuuuuug

SEQ ID NO: 331364 - RNA, 64 nt, Human
agucagaaugugagcagauggcuaaguucucuccuccccagaauggauuaacagcugcguggaa

SEQ ID NO: 331365 - RNA, 64 nt, Human
auucuguauggaaaagagcccuggagcaucagguuccccagauaggcccccaaauaaagaccug

SEQ ID NO: 331366 - RNA, 64 nt, Human
uaaggguuuccuggguuuuuuuauauacaugcucuccccagaauacaguaaaccacaguuuuag

SEQ ID NO: 331367 - RNA, 64 nt, Human
acaacaguauucuucucuguuccucuuugccuccuccccagaugggccucucagcucccacaau

SEQ ID NO: 331368 - RNA, 64 nt, Human
ggagggagaggaggaagacugagaaaucucugcauccccagaacucagcaacccagcucuuuua

SEQ ID NO: 331369 - RNA, 64 nt, Human
caggaaggugacucugaccuucugccugcuguucuccccagaagcagccauaaaaccugggaag

SEQ ID NO: 331370 - RNA, 64 nt, Human
gagcuggagguuuuccugugggggaucugagcucuccccagaaggcacuucuuguuuuauguac

SEQ ID NO: 331371 - RNA, 64 nt, Human
gagcuagggguuuuccuguggaaggucugagcucuccccagaaggcacuuccugucugaugucc

SEQ ID NO: 331372 - RNA, 64 nt, Human
ugaggaucccaccaguucugccuggcuuccuccauccccagaggcacuaaaagcaguauuuuaa

SEQ ID NO: 331373 - RNA, 64 nt, Human
ccuucccccuggcagguagagacucuacucucuguccccagauccucuuucuagcaugaaugaa

SEQ ID NO: 331374 - RNA, 64 nt, Human
aagaagccaggguguaaucuuguucaugcaugcguccccagagccucgcccagugccuggcaca

SEQ ID NO: 331375 - RNA, 64 nt, Human
ugcucaaguaaaacuagauucacagggcacagauuccccagaaaguuaacacaaucccaccaug

SEQ ID NO: 331376 - RNA, 64 nt, Human
ccagugucaggucuaggaaauuaauggcuauucuuccccagauacauucuggcuuauuugagau

SEQ ID NO: 331377 - RNA, 64 nt, Human
cucacagcugaguuguugagucuguuuuguaaaguccccagagaaagcgcagaugcuagcacau

SEQ ID NO: 331378 - RNA, 64 nt, Human
cuugccgacuugauguugcuguaccagggcuuccuccccagaggugcagcuugcguuuugaggg

SEQ ID NO: 331379 - RNA, 64 nt, Human
uuauagcaaccaaagaaauagggcaagagaggcaggugaacacacaugauaccucaauugacaa

SEQ ID NO: 331380 - RNA, 64 nt, Human
agccuggucgccccccguuagcccagauucaaaaggugaacaucuguuugcagaaucugauuca

SEQ ID NO: 331381 - RNA, 64 nt, Human
auucaauccuaggagaaugauaauccuggacaugggugaacaugaggagaaccagcaaaaucug

SEQ ID NO: 331382 - RNA, 64 nt, Human
aagaugcuuuuugguuuuuauauaaauaaaggaauccccagaaguggucccuaugaugaacucc

SEQ ID NO: 331383 - RNA, 64 nt, Human
ugccaucaaauacuuccuccugccagucaugguuuccccagaaguguaguuccugggacauuca

SEQ ID NO: 331384 - RNA, 64 nt, Human
gauggaaccgccccugguaccugcuggccucccuuccccagaggcugguguccagaacucagga

SEQ ID NO: 331385 - RNA, 64 nt, Human
cuuccauccuauuccccagucacgaaagggcugguccccagagcucacccagaaagcaucuugc

SEQ ID NO: 331386 - RNA, 64 nt, Human
uuuuguuggauacucucauuuuaaacuucuccucuccccagauaccuccuauauuuccauauug

SEQ ID NO: 331387 - RNA, 64 nt, Human
aaccuucaucucaaauugucucuaagcacuaccuuccccagagcuugccagguuggguuuugag

SEQ ID NO: 331388 - RNA, 64 nt, Human
ugccuucugccaugauucuaaguuuccugaggccuccccagaagcagaagcauguaaagcccac

SEQ ID NO: 331389 - RNA, 64 nt, Human
cugagagcgcgcggggagaccggagccggccuguuccccagagcccccggagcccucccagccc

SEQ ID NO: 331390 - RNA, 64 nt, Human
gagaaaguggaaacccagcagucccuaaagcugguccccagaaagcaggacagaaagaaggagg

SEQ ID NO: 331391 - RNA, 64 nt, Human
cccacagagauuuaaugagcgugggccuggaccuuccccagaugcugccaggcagccccucccc

SEQ ID NO: 331392 - RNA, 64 nt, Human
aagucucuaucgcucuuccccucuccucggccacuccccagauaccagaccugaggcaauucac

SEQ ID NO: 331393 - RNA, 64 nt, Human
ucagaaggcuaacuugagagguuuggggccuuguuccccagaggguccccagggacucugcagu

SEQ ID NO: 331394 - RNA, 64 nt, Human
uccuccucuuccuccucuuccuucuccuccuccauccccagaacaaaccgaaaucaggauaccc

SEQ ID NO: 331395 - RNA, 64 nt, Human
uagauuugauaaauauuuuuauuacuaaagaaucuccccagacauuuucuuuuuuuuuucacac

SEQ ID NO: 331396 - RNA, 64 nt, Human
aaaaagcuuaaauauugaaaguguuagccuuuuuuccccagacuuguuggcguaggcuacagag

SEQ ID NO: 331397 - RNA, 64 nt, Human
gggcaggagcuguguccuucuauucaucuuccuauccccagaaccuugcacagauccuggaaug

SEQ ID NO: 331398 - RNA, 64 nt, Human
auaauucucucacaaaguccacuuuacucaaauuggugaacaguguauaggaagaagccagcag

SEQ ID NO: 331399 - RNA, 64 nt, Human
augcuuguaacagaggagaauaaaaaauggcugaggugaacaagguaaaacaacuacauuuuaa

SEQ ID NO: 331400 - RNA, 64 nt, Human
uuauagucuggcgugaucauguagaaucuuuucuggugaacagaucauaaaguucuaucaagga

SEQ ID NO: 331401 - RNA, 64 nt, Human
ucugagcuaccucgacuuuggacagaguaaugacuccccagaaaacgucauauaagacuuuacc

SEQ ID NO: 331402 - RNA, 64 nt, Human
cccaggcguccccagcuguucaccucccagagaguccccagagccccaaagggcugacugagaa

SEQ ID NO: 331403 - RNA, 64 nt, Human
gcuaucccuccccccuccccccaccccacaacaguccccagagugugauguuccccuuccugug

SEQ ID NO: 331404 - RNA, 64 nt, Human
uagacaucaucucugauuguccucagccuccacuuccccagaguaaauucaaauugaaucgagc

SEQ ID NO: 331405 - RNA, 64 nt, Human
uuguuuauaugauuguauuagaaaugcucagacuuccccagaaaugaaccauaaauuuuggaac

SEQ ID NO: 331406 - RNA, 64 nt, Human
ccucuaagcacuuuacacauauuagcucauucaguccccagacagacgggaugaaguagguauu

SEQ ID NO: 331407 - RNA, 64 nt, Human
ugcuuuuuaccuuuugcuguuugcuguggcagauuccccagauaaccaaggaaaaggggccacc

SEQ ID NO: 331408 - RNA, 64 nt, Human
aaaaagccagucuaaaggccucuggauacugggcuccccagaacugcuggccacaggauggugg

SEQ ID NO: 331409 - RNA, 64 nt, Human
ugacgcucucuccugucaccccgccccugcucucuccccagauguguucugagcuggaugccgg

SEQ ID NO: 331410 - RNA, 64 nt, Human
gggugcaggacacuggucgagagccaaaggucccuccccagacaucuggacacugggcauagau

SEQ ID NO: 331411 - RNA, 64 nt, Human
gguuguauguuaccuuuuccaccucucauuguuuuccccagaacauuguagauggggguuggca

SEQ ID NO: 331412 - RNA, 64 nt, Human
aaccuucuguagcuaagagggaauccuggcccccuccccagaagccauuugucaauaaaccauu

SEQ ID NO: 331413 - RNA, 64 nt, Human
caucggaccaaagccugggcacacccugccucucuccccagagcagggucccugccgaggacug

SEQ ID NO: 331414 - RNA, 64 nt, Human
gaguucauagguuauaagagguaaguugaacaauuccccagaugaugcugaugcuccuggucca

SEQ ID NO: 331415 - RNA, 64 nt, Human
aaauucuccacugcauggacccuggugaguggcuuccccagacggagcacuguguccaucugac

SEQ ID NO: 331416 - RNA, 64 nt, Human
acuuaugcaaauuucugcagcuggcuugaauuucuccccagaaaauggguuuuucuuuucuauu

SEQ ID NO: 331417 - RNA, 64 nt, Human
uccuuugagaauugugcgacuucacaaaaugcaaggugaacaccacuuugucucugagaacaga

SEQ ID NO: 331418 - RNA, 64 nt, Human
uugccgaaaucaaagccaucugaagccugucucuggugaacaaacuuccucucuggccucucag

SEQ ID NO: 331419 - RNA, 64 nt, Human
caguuguacuuugaauggugggguggaaguuucaggugaacaauggauaacaaaaagcaaguua

SEQ ID NO: 331420 - RNA, 64 nt, Human
guugcaaugcuuagggcccuuaaagaagaaaaucuccccagaaggcauccaucauguugcuuaa

SEQ ID NO: 331421 - RNA, 64 nt, Human
ggacaaaaccgagucggucaccagcggccccauguccccagagggcucaccuuccaagucuccc

SEQ ID NO: 331422 - RNA, 64 nt, Human
aacgcuuguuaaacaugaggaaaugccucuuucuuccccagacuccaggaugacuuugcacguu

SEQ ID NO: 331423 - RNA, 64 nt, Human
ggccaagcccccaccccaucccacuccccuucccuccccagauauuuaugugaaaugaacugca

SEQ ID NO: 331424 - RNA, 64 nt, Human
uugaaaagcaguuagcauuuccacacaaccgcuguccccagagauaacugcuguuuucauuuua

SEQ ID NO: 331425 - RNA, 64 nt, Human
cauuaaagagaaaggaguagcuuugacauuaagcuccccagaucccugcugcucauacuucugg

SEQ ID NO: 331426 - RNA, 64 nt, Human
ccugaagguugaacccacacacaccccugcagccuccccagaugaaguagguguauuccccugg

SEQ ID NO: 331427 - RNA, 64 nt, Human
ugcaugcaggaguuucuccugggcagcuggucacuccccagagaagcugggccuucauggacac

SEQ ID NO: 331428 - RNA, 64 nt, Human
ccaguacugccaccuuuacaccuaccccugcaaguccccagagggcugcccacgauagaagcug

SEQ ID NO: 331429 - RNA, 64 nt, Human
agcccggagaaauacuuaagauaugggugagaaauccccagacuuuuauacaaaagauuuccac

SEQ ID NO: 331430 - RNA, 64 nt, Human
gacuuuggggggcugugagggaaauauacugggguccccagauucugcucuaagggggccagac

SEQ ID NO: 331431 - RNA, 64 nt, Human
ugugggcuacaugcaggacacggcaugggccugcuccccagaggcaccuguuuggggucuucuu

SEQ ID NO: 331432 - RNA, 64 nt, Human
aaaacaaaccuggcucuuaccuuugaucuuuucuuccccagaaauaguaaacuugcagcugccc

SEQ ID NO: 331433 - RNA, 64 nt, Human
uuuauuaucuuccuaaaucaaggaaaggaaaucauccccagaccauuuaugcugagcuuuggaa

SEQ ID NO: 331434 - RNA, 64 nt, Human
agggaaagaaaaguuggaucacuaguggccagcauccccagaguuccguuaguaaacuuacuuc

SEQ ID NO: 331435 - RNA, 64 nt, Human
acaggccacgaaggucaggcucuuuauauuaaguuccccagaggaagaguaaguugagaaggua

SEQ ID NO: 331436 - RNA, 64 nt, Human
cuuagccaagagccaagacauagcccugugacaaggugaacaguugggugggaaaggagagagg

SEQ ID NO: 331437 - RNA, 64 nt, Human
auauaugguuccagcuaauacaugcaauguggcuggugaacacuucugaauucagaaacuaucc

SEQ ID NO: 331438 - RNA, 64 nt, Human
ugcuugcuucaaccccaugagacucgauagugguggugaacagaacaaaaggucauugguggca

SEQ ID NO: 331439 - RNA, 64 nt, Human
cagguggcaccaaggguccugaguccuggagauguccccagaagcugcugugccucacagcgcu

SEQ ID NO: 331440 - RNA, 64 nt, Human
guaaauuuccuugucauuccuaucucuugaguucuccccagaggcaaucacugcuacugguugu

SEQ ID NO: 331441 - RNA, 64 nt, Human
ugggucugcuggcuucuacacuggguucugcuacuccccagaccucagggacaacugccggggg

SEQ ID NO: 331442 - RNA, 64 nt, Human
guuuucucuguccaggacagcagguaaaaaggaauccccagagcagacgcaaugguaggagccu

SEQ ID NO: 331443 - RNA, 64 nt, Human
agccaguugguggggccaggccaggaccacacaguccccagacucagcuggaagucuaccugcu

SEQ ID NO: 331444 - RNA, 64 nt, Human
aggaagcccgucccuuaucccugguauccacgguuccccagagcuuuggggaccacgcgaaaac

SEQ ID NO: 331445 - RNA, 64 nt, Human
ggcuccaggccagggggccagucccugaggcagguccccagacuccaccaagccuggucagccc

SEQ ID NO: 331446 - RNA, 64 nt, Human
uauguuuagugaguggucaucugaauuuuccagcuccccagaaaauguaugcacugguauagca

SEQ ID NO: 331447 - RNA, 64 nt, Human
gggagaaguuagucugugcuaagauaguacugaguccccagauguuguauacuguaaauuacag

SEQ ID NO: 331448 - RNA, 63 nt, Human
guggcuguaccaucgugugacauagcauggcuguccccagagccugccauucacguuugccaa

SEQ ID NO: 331449 - RNA, 64 nt, Human
gagaccuguugcugcuuucuuguaauuauggggcuccccagagucugcguaacagucucccacu

SEQ ID NO: 331450 - RNA, 64 nt, Human
ccaugaucauugcugaacucagagcuuucuucuauccccagacccacaugggagucucccagca

SEQ ID NO: 331451 - RNA, 64 nt, Human
cuggcgugcccauguugcagauauuuucccgaguuccccagaauggaugguauugaaucucagc

SEQ ID NO: 331452 - RNA, 64 nt, Human
gugcagggccccuccacgcccacucuucccuuguuccccagaaguagagggcucugggugccca

SEQ ID NO: 331453 - RNA, 64 nt, Human
caggagccgaccuggggcugcacaucccugcccauccccagaaagacuguuccugucaggauuu

SEQ ID NO: 331454 - RNA, 64 nt, Human
ccaaaucacaucucaccuccgaacuguucaaguguccccagacccuucuugccugcugggcucc

SEQ ID NO: 331455 - RNA, 64 nt, Human
acuagaaagguuuuuguugcuagucuggaaaacuggugaacacacuguuuauuaugacaaguuu

SEQ ID NO: 331456 - RNA, 64 nt, Human
auuguuuuuuuuuuuuuuucuuuuuggaugugaaggugaacauuccugauuuuugucugaugug

SEQ ID NO: 331457 - RNA, 64 nt, Human
aaauacaaagacgauuuuuucaggcugugauuauggugaacauaacaaaacccaguagucacca

SEQ ID NO: 331458 - RNA, 64 nt, Human
ggccauguccucaaccccaaaucccccgacucccuccccagaucuguccugggggaugcaaaua

SEQ ID NO: 331459 - RNA, 64 nt, Human
auagcucaugaaauuugggcagcagggaggaaaguccccagaaauuaaaaaauuuaaaacucuu

SEQ ID NO: 331460 - RNA, 64 nt, Human
ucuccaagggaaugccuggggauucacccagugguccccagaggugcuccauggaggcaacaag

SEQ ID NO: 331461 - RNA, 64 nt, Human
agaaaucagugccaagcaugcgauauucagagucuccccagaccggcagucaucauggcaguuu

SEQ ID NO: 331462 - RNA, 64 nt, Human
gacugguucagcuagcucuccugagcagggacgcuccccagaaccaacagaaaucagugccaag

SEQ ID NO: 331463 - RNA, 64 nt, Human
gcuaucccucccccaucccccgaccccaccacaguccccagagugugauauuccccuuccugug

SEQ ID NO: 331464 - RNA, 64 nt, Human
uguucucaauacccacugccagacaugccacguguccccagagcuuuacagugccacgacaugg

SEQ ID NO: 331465 - RNA, 64 nt, Human
uugaccccugggcaccuccauccccucccaccuguccccagaucagucucugggauggaggcca

SEQ ID NO: 331466 - RNA, 64 nt, Human
uauuugccuguuaaacagugucuuucauguucucuccccagauuguaaacucuguaagaagcug

SEQ ID NO: 331467 - RNA, 64 nt, Human
cccugaucaggccgcacugucugaagcaaucgguuccccagauuacuuguauuuaauacacaau

SEQ ID NO: 331468 - RNA, 64 nt, Human
ggcagggacuucacuguauuuuguucauaguguauccccagagccuggaccagugcuuggcaca

SEQ ID NO: 331469 - RNA, 64 nt, Human
uaauccaggacauagccguggauacguccaaaaauccccagaaccuagugagcccucuggcucu

SEQ ID NO: 331470 - RNA, 64 nt, Human
aaauuuacugucuaagauuaauagcauucgaagauccccagacuucauagaauacucagggaaa

SEQ ID NO: 331471 - RNA, 64 nt, Human
agccccagcuuucuccuacagggcuuuuccugaguccccagacagcagaguaugaacugcugac

SEQ ID NO: 331472 - RNA, 64 nt, Human
ccuagagaaggguuguuaaggcagaccgcccuguuccccagaguugucccuguagugucuaggu

SEQ ID NO: 331473 - RNA, 64 nt, Human
uguucuuaauaggauaaaaacugguauuugccucuccccagaguacuuuuuuuguuuuuucaua

SEQ ID NO: 331474 - RNA, 64 nt, Human
cucaugagacagaucugggcuccaagccaggaaaggugaacagaaaccacaaguguccagcccu

SEQ ID NO: 331475 - RNA, 64 nt, Human
uugggauggauuugacuaaaucugccccgaggagggugaacaaggugaucucagagaucacuac

SEQ ID NO: 331476 - RNA, 64 nt, Human
ugcauccagccaggcugcagggagugaggcacacggugaacauggccacugacuuuucugccac

SEQ ID NO: 331477 - RNA, 64 nt, Human
aaccacuucccuaaaggcaacauuaaugcaaaaguccccagauggcaauacaaaguauccccug

SEQ ID NO: 331478 - RNA, 64 nt, Human
ggcgggcucagccauucggcuuggggcaccaggcuccccagagacaaugcucaguauucauuca

SEQ ID NO: 331479 - RNA, 64 nt, Human
agcagauuuugaaguaggaaauaaaaugaauugcuccccagauuauuuuuuuaauauuguaugc

SEQ ID NO: 331480 - RNA, 64 nt, Human
uuccacuaucccaaucaaagaauuacaguacacauccccagaauccauaaauguguuccuggcc

SEQ ID NO: 331481 - RNA, 64 nt, Human
caaacacagaaucauaaucauaaugcggcccccuuccccagagcuuaccucgaaugugaaaucc

SEQ ID NO: 331482 - RNA, 64 nt, Human
aacaaacucguuuuuuacaaagcccuuuuauaccuccccagacuccuucaacaauucuaaaaug

SEQ ID NO: 331483 - RNA, 64 nt, Human
ccauucuccuccauacauccccaucccucuacuuuccccagaggaccacaccuuccucccugga

SEQ ID NO: 331484 - RNA, 64 nt, Human
uaauuauaauuauuuuauucauaaauggugauaguccccagaucuguacaccuuuaucacuccc

SEQ ID NO: 331485 - RNA, 64 nt, Human
cucaccaggcaagagucuugcuuauugggcugcauccccagagaggauaugaauuauuuuuuga

SEQ ID NO: 331486 - RNA, 64 nt, Human
uuuguucuuguaguuuucuauccccagucuuugcuccccagauggcaguaguuuuuaguaggaa

SEQ ID NO: 331487 - RNA, 64 nt, Human
cacugccuccaaauauuaguaacuaugacugacguccccagaaguuucugggucuaccacacuc

SEQ ID NO: 331488 - RNA, 64 nt, Human
ugacagaaaucuaaacacacauccgucccaacauuccccagaccauucagaaucacacagcgua

SEQ ID NO: 331489 - RNA, 64 nt, Human
ugucucucucuaggaacagacaacucuaaacucguccccagaggaggacuugaaugaggaaacc

SEQ ID NO: 331490 - RNA, 64 nt, Human
agcccccgcuccaugccucgcggcacugccgguguccccagagcagggacucugucaccucgca

SEQ ID NO: 331491 - RNA, 64 nt, Human
gcccggcuuccacuccccacauaggaauaguccauccccagauucgccauuguucaccccucgc

SEQ ID NO: 331492 - RNA, 64 nt, Human
uccugugcauauguauuuucacuaugugcuccccuccccagaucuuaauuaaaccagauuuugc

SEQ ID NO: 331493 - RNA, 64 nt, Human
uugaaagucagauggauucuuuugcuuucugaggggugaacacagaagacugcaacaagaacca

SEQ ID NO: 331494 - RNA, 64 nt, Human
gugggggucgcuggggguggagagaacacuaagaggugaacauguaugagugugugcacgcgug

SEQ ID NO: 331495 - RNA, 64 nt, Human
cccuggagucggguccuggcaguggggacugccuggugaacacagaugugcuugggaugacggg

SEQ ID NO: 331496 - RNA, 64 nt, Human
aaaggaagugcagaggauuuagaaaaguacaugauccccagaccacaacaaaccaaaacauaaa

SEQ ID NO: 331497 - RNA, 64 nt, Human
gcgaguagaggucaguggugaugccucuugcugcuccccagaccccaucucuccugaagaccug

SEQ ID NO: 331498 - RNA, 64 nt, Human
cugcauugcagguuggcaccuuacuucccugggauccccagaguugguccaaggagggagagug

SEQ ID NO: 331499 - RNA, 64 nt, Human
agacuggugcguuguggucuccgguggggccagauccccagaacagggagagacugcauacaag

SEQ ID NO: 331500 - RNA, 64 nt, Human
ugucucugggcugccggugggaggggaugucgccuccccagagaugccugguccgucuuggguc

SEQ ID NO: 331501 - RNA, 64 nt, Human
cuucuuguugccuagcugagugggagagucauuuuccccagacacuacauuuggauacaggugc

SEQ ID NO: 331502 - RNA, 64 nt, Human
gcuaaaccgacaaggaaggcugugugcuuagcucuccccagagggagggcgagaaggguguggu

SEQ ID NO: 331503 - RNA, 64 nt, Human
gugcagcugcuaauuuuagucccaggaccagacauccccagacuccacagauguaaugaagucc

SEQ ID NO: 331504 - RNA, 64 nt, Human
gugguguauacugccacaucaguguuugagucaguccccagaggagaggggaacccuccuccau

SEQ ID NO: 331505 - RNA, 64 nt, Human
aaggucccgaccccaucccuauccauaguccugguccccagaaacuccaaccccugcccuuccu

SEQ ID NO: 331506 - RNA, 64 nt, Human
gcuguccaauaacugaccuguaacuucaucuaaguccccagauggguacaaugggagcugaguu

SEQ ID NO: 331507 - RNA, 64 nt, Human
ugccucgcugccccaccucccgcuccuuggccuguccccagauuccuucccugguugacuugac

SEQ ID NO: 331508 - RNA, 64 nt, Human
gcuaggcguggacgggcgcaccugcauggagggguccccagagcccccaaccagugccagcaua

SEQ ID NO: 331509 - RNA, 64 nt, Human
cuccccaucuuacugauuuaauuuaauuuuucacuccccagagucuaauauggauucugacucu

SEQ ID NO: 331510 - RNA, 64 nt, Human
gcgacucuuauguuuuaggccaauuucauaucauuccccagaucauauuucaaguccaguaaca

SEQ ID NO: 331511 - RNA, 54 nt, Human
caaaauucuaugaugagugaaccuuccccagacuucucuuucuuauuuuguaau

SEQ ID NO: 331512 - RNA, 64 nt, Human
caccccccauuuuuucaaaccuugguaucuguugggugaacaguauaaucuuuucaucugcuuu

SEQ ID NO: 331513 - RNA, 64 nt, Human
uaaccguagugccaaaauuucaguucaguaauggggugaacaauauggagagagaccugggaaa

SEQ ID NO: 331514 - RNA, 64 nt, Human
cuuacuggugccugcugccagccaucugggagugggugaacagcaccccgccgcuucccccaca

SEQ ID NO: 331515 - RNA, 64 nt, Human
ccuuuuaaauggugggaacccuccccaaaaccuuuccccagacacauucuccugugccccucag

SEQ ID NO: 331516 - RNA, 64 nt, Human
cugcccuggccuggguggaggaacugugccuccauccccagaagaaacagcccccucugcugcu

SEQ ID NO: 331517 - RNA, 64 nt, Human
gcccaaacuccccuucccuggggagcccucaggcuccccagaacuggcugggccccuggggaca

SEQ ID NO: 331518 - RNA, 64 nt, Human
uacauucuccucuggggcucuaccucuccacacuuccccagaagggaaaagggcacccuggauu

SEQ ID NO: 331519 - RNA, 64 nt, Human
gaaaucacuccuuggugggcagcauccugaggcuuccccagaaccaggccucugcucuggcccu

SEQ ID NO: 331520 - RNA, 64 nt, Human
ggcccagccuuccugcugccaccaucucugcuucuccccagaggaacuuagggauuucaccccu

SEQ ID NO: 331521 - RNA, 64 nt, Human
agaagaaaaaaaaaaaaggaggggaaaugcauuuuccccagagauaaaggcugccauuuugggg

SEQ ID NO: 331522 - RNA, 64 nt, Human
ccuucccuucugacucagguuggcagauaaacuguccccagacccugccacacauggaagagac

SEQ ID NO: 331523 - RNA, 64 nt, Human
uuaccgugcacucggccauuucccucuuccuguguccccagauccccacuacagcuccaagagg

SEQ ID NO: 331524 - RNA, 64 nt, Human
guccccuuuaacacuggugaaagcuacgguacucuccccagagauaugucuugucagccucucu

SEQ ID NO: 331525 - RNA, 64 nt, Human
gaucucagcaccgaucggaacuguaaagcuauaauccccagaauuaaaguuuuuauuauuuuuu

SEQ ID NO: 331526 - RNA, 64 nt, Human
auugugaauaaagauuguuugcuuuguagccccuuccccagaugaacugaggugagagcggcug

SEQ ID NO: 331527 - RNA, 64 nt, Human
guugcgguaagauaaccgacagggcuggugaaaguccccagauggcaggauauuugguuucaga

SEQ ID NO: 331528 - RNA, 64 nt, Human
gggcagagcuggaguucucauccagggcugcuuguccccagagcccagguuuauacuaccuccc

SEQ ID NO: 331529 - RNA, 64 nt, Human
ggugggaccagaugcuucccugugcuggcuggaguccccagagauaucagccaccgagucuccu

SEQ ID NO: 331530 - RNA, 64 nt, Human
caucuucauuucccuccuuuuccuguuccuccaauccccagauccaccacuccugcacaugcca

SEQ ID NO: 331531 - RNA, 64 nt, Human
gauuuuuggaaacagguaucaaccuucacaguugggugaacaaguguuguccuacagaugucca

SEQ ID NO: 331532 - RNA, 64 nt, Human
gugcccuaggugacccuuauaaucagggaaguuuggugaacaaaaaucgaacccaugagugaac

SEQ ID NO: 331533 - RNA, 64 nt, Human; identical to SEQ ID NO: 135822

SEQ ID NO: 331534 - RNA, 64 nt, Human
agugucaguuguagauuauugggaugaagcuaaauccccagaaugcagcagcagcugagcaugu

SEQ ID NO: 331535 - RNA, 64 nt, Human
uuauauuauauaauucacuuuguuuuacuuuuguuccccagaugaaagaacucuaaguaaauac

SEQ ID NO: 331536 - RNA, 64 nt, Human
aguucuuucuuagcugcuuuaaggagccccucacuccccagagucaaaaggaaauguaaaaacu

SEQ ID NO: 331537 - RNA, 59 nt, Human
uucaggugguucccuugugacaccguucauccccagaucacugaggccaggccauguuu

SEQ ID NO: 331538 - RNA, 64 nt, Human
cugaaaugauaaagacagccuuuaaucccccuccuccccagaaggaaccucaaaagguagauga

SEQ ID NO: 331539 - RNA, 64 nt, Human
aggagggaaauggguagagccuguuugucuugcuuccccagagauagaaugugaagacacgcgc

SEQ ID NO: 331540 - RNA, 64 nt, Human
cuuuucaaagcaguggaggagcacacggcaccuuuccccagagccccagcaucccuugcucaca

SEQ ID NO: 331541 - RNA, 64 nt, Human
agauaaaugaaauaaaucuauaagguuaaguauguccccagaacugcauggaacaugcuuaauc

SEQ ID NO: 331542 - RNA, 64 nt, Human
gggagcauccagaacugcuaccuuccuagauguuuccccagaccgcuggcugagauucccucac

SEQ ID NO: 331543 - RNA, 64 nt, Human
gcacgggguucgcgcaccaggugucuuuuuccaguccccagaagcagagagcacagccccugcu

SEQ ID NO: 331544 - RNA, 64 nt, Human
ggggcccagagcacuguuggaagucugguuagaguccccagagaguuacucuaaguuaaaauga

SEQ ID NO: 331545 - RNA, 64 nt, Human
cuguccucuuuuuccgcccauucucccucgggucuccccagaggggccggcgggggcuggggag

SEQ ID NO: 331546 - RNA, 64 nt, Human
uccccugcugcgggcgcccccaccccgauuccucuccccagaagcggugggaugggcccccaug

SEQ ID NO: 331547 - RNA, 64 nt, Human
auguggcccaacucuccuggccuggccaucucccuccccagaaacagugugcauggguuauuuu

SEQ ID NO: 331548 - RNA, 64 nt, Human
acagagaaccagugcuuccuucgucagcagcgccuccccagacccacgaggauacucacacugc

SEQ ID NO: 331549 - RNA, 64 nt, Human
ucaaagguuugggggaauuugugacccuggaacauccccagagugaaagauggagcugggccac

SEQ ID NO: 331550 - RNA, 64 nt, Human; identical to SEQ ID NO: 135828

SEQ ID NO: 331551 - RNA, 64 nt, Human; identical to SEQ ID NO: 135834

SEQ ID NO: 331552 - RNA, 64 nt, Human; identical to SEQ ID NO: 135840

SEQ ID NO: 331553 - RNA, 64 nt, Human
uugaaaaggcaaggaaacagauucuccauuagaguccccagaaaggaaugcagccuugcuggca

SEQ ID NO: 331554 - RNA, 64 nt, Human
cuucucauuuaggcccuaagaaaaaauuuaaagcuccccagagcaaggccuuggcagccagcuu

SEQ ID NO: 331555 - RNA, 64 nt, Human
cauggacaccugcucaccccugccucaucuguacuccccagaucuccuggcugcaaaucagccc

SEQ ID NO: 331556 - RNA, 64 nt, Human
ggugggggaggggggagagucaggaauaaggggauccccagaagugcagagcugagcaggcuug

SEQ ID NO: 331557 - RNA, 64 nt, Human
uuuuaacaacauauaaaacuguuucaagcccuccuccccagagcuggcgcucagcagcccuagc

SEQ ID NO: 331558 - RNA, 64 nt, Human
ucccugaaauauucuucuauaaaugaauccuauuuccccagaguguucaaggcauuuuucuacc

SEQ ID NO: 331559 - RNA, 64 nt, Human
auauacuaaaauacugauuaucuuaaucacauuuuccccagagauaaacauugagagaacgaaa

SEQ ID NO: 331560 - RNA, 64 nt, Human
gagcuuccaagccuuuugcuccagcccugcggcuuccccagaagccugggcuuaggguggagau

SEQ ID NO: 331561 - RNA, 64 nt, Human
cccuguggagcagaacgggaaccaccugcagagguccccagacccaaagcaggacgggagacaa

SEQ ID NO: 331562 - RNA, 64 nt, Human
cugugggugagccaggccaacauuggugucccuguccccagagggaggagcaggcaggagagag

SEQ ID NO: 331563 - RNA, 64 nt, Human
aacuacagagcagugugggcagccccaagugugguccccagagagcguuuggcuuuccugucug

SEQ ID NO: 331564 - RNA, 64 nt, Human
cacuuucuucccuagacggacauugagggauccuuccccagaaaauccaccuguuuguugcugc

SEQ ID NO: 331565 - RNA, 64 nt, Human
guaucagagacaaacgggacuuuuagccuugacauccccagaaucucggucuuuggggugggga

SEQ ID NO: 331566 - RNA, 64 nt, Human
gcuaucccuccccccuccccccaccccacaacaguccccagagugugaugauccccuuccugug

SEQ ID NO: 331567 - RNA, 64 nt, Human
gcccaggaucugucccgugccgccgcugcuccccuccccagacaccucuccacgucuccuaccc

SEQ ID NO: 331568 - RNA, 64 nt, Human
gggagaaggaaaugcagggcacaugaucuggcccuccccagaacaaucuggauuucacggagac

SEQ ID NO: 331569 - RNA, 64 nt, Human; identical to SEQ ID NO: 135846

SEQ ID NO: 331570 - RNA, 64 nt, Human; identical to SEQ ID NO: 135853

SEQ ID NO: 331571 - RNA, 64 nt, Human; identical to SEQ ID NO: 135859

SEQ ID NO: 331572 - RNA, 64 nt, Human
gcaagauccucaucugagagugcuuaaaaugggauccccagagaccauuaaccaauacuggaac

SEQ ID NO: 331573 - RNA, 64 nt, Human
aggccagucuugagcagcagggagggcucagcuguccccagauccaggugccucugaccagccu

SEQ ID NO: 331574 - RNA, 64 nt, Human
acagacgcuggaugcccuccuaccgccagacaccuccccagaggccuuggaccuccuuaggcga

SEQ ID NO: 331575 - RNA, 64 nt, Human
cuucaccuggcccucuguuccugccccagccccuuccccagaccccucuccagucuccugcacc

SEQ ID NO: 331576 - RNA, 64 nt, Human
agcucacaugggacugggauaugggggcaucucuuccccagagaggcacucagugagccuccug

SEQ ID NO: 331577 - RNA, 64 nt, Human
cguuggccggcggcuacucuggaauguuuuucccuccccagaaucaagcuuuugcuugauccag

SEQ ID NO: 331578 - RNA, 64 nt, Human
gacucaaacgccgcugacugccacccacacgcccuccccagacuccaccgucagcuguaacccu

SEQ ID NO: 331579 - RNA, 64 nt, Human
auauaaaaagggaugcuuuuauauauuuuucuuuuccccagaauuacuuagauuaauuagaugu

SEQ ID NO: 331580 - RNA, 64 nt, Human
cauuuuagccagcagggaaauaaaucauuuuuaauccccagaagaaagugcuggaaauagcuuc

SEQ ID NO: 331581 - RNA, 64 nt, Human
uuaaggcagccucauagucaaucccaguugcuuuuccccagauuuggugacucaucaauggaua

SEQ ID NO: 331582 - RNA, 64 nt, Human
aagaaaacuugauguauucuguguguaugguuuuuccccagauuagucauacaguucauuugga

SEQ ID NO: 331583 - RNA, 64 nt, Human
cugacaucuauugucauuccauugcuauuuuuuuuccccagagacuuccauaauuuaaaauaaa

SEQ ID NO: 331584 - RNA, 64 nt, Human
cacuaagcccgccccgcuggccgccagcugcccguccccagagccacugcagcaggagucgggc

SEQ ID NO: 331585 - RNA, 64 nt, Human
cuuucuucaaguuucuucaagaagccucuauuguuccccagauaauguucccucaaauagcacg

SEQ ID NO: 331586 - RNA, 64 nt, Human
gauaacuucuagaaaugaacuguacuaaucccuuuccccagauuguaucaugaguagaaucagg

SEQ ID NO: 331587 - RNA, 64 nt, Human
auuaagugauuuucuucgacacuuaauucuagauuccccagaugaauugaaguguauugcugug

SEQ ID NO: 331588 - RNA, 64 nt, Human
ugcgcuggggccaugggguggccccgccggggcagcgggggagcugccugcagaagagccagcu

SEQ ID NO: 331589 - RNA, 64 nt, Human
gcaggggagacugccccuaaccugugucuuuguguccccagaagacacccacugcagaccccca

SEQ ID NO: 331590 - RNA, 64 nt, Human
gagcugagaacucgcuugcuaccucacauccuuuuccccagacuuuuuaucuccuaugcauccc

SEQ ID NO: 331591 - RNA, 64 nt, Human
cacgggggccaccuugcccggggccacugguggcuccccagagccucagacccacacagcccag

SEQ ID NO: 331592 - RNA, 64 nt, Human
ggcaccagcaacccugggucucccucucugcugcuccccagaaccccggggcccuccugcucuc

SEQ ID NO: 331593 - RNA, 64 nt, Human
agcagggagcuuauaaauggaaccagagcagaaguccccagacucaggaagucaacagaguggg

SEQ ID NO: 331594 - RNA, 64 nt, Human
gccugcagaaaggaccugcccugauaaugucccuuccccagauucucaagcagaugcccaaggg

SEQ ID NO: 331595 - RNA, 64 nt, Human
gaggcauggggcauguccuuuccaucuguccacauccccagagcccagcucuugcucucuugug

SEQ ID NO: 331596 - RNA, 64 nt, Human
uggcaugugcaguauacacggucuaacucaucucuccccagaucucucagaaccuugagcuugg

SEQ ID NO: 331597 - RNA, 64 nt, Human
uuccuccucuuccuccuccccuuccucgggaggcuccccagacccuggcaugggaugggcuggg

SEQ ID NO: 331598 - RNA, 63 nt, Human
cgcagcugcaggaguccugacccgcccagacuguccccagacucccccgagaccugccagccc

SEQ ID NO: 331599 - RNA, 64 nt, Human
ugucccuaaguuuaaaggacugauuugaugccucuccccagagcauuugauaagcaagaaagau

SEQ ID NO: 331600 - RNA, 64 nt, Human
gcagauaagguggaauccacaacugacucacacuuccccagacagguaugaaaaucuuuguucc

SEQ ID NO: 331601 - RNA, 64 nt, Human
aaaauuagccaggugugguggugcacgccuguaauccccagauacucgggaggcugaagcagga

SEQ ID NO: 331602 - RNA, 64 nt, Human
gaugggacacaagucacuucaagaagucuggugguccccagagaaacaacuauguuauccaucc

SEQ ID NO: 331603 - RNA, 64 nt, Human
cuucaugcccuagggccccccaagugccugccccuccccagaguauuaacgcuccaagaguauu

SEQ ID NO: 331604 - RNA, 64 nt, Human; identical to SEQ ID NO: 331587

SEQ ID NO: 331605 - RNA, 64 nt, Human
cccggagacgaacacggggacaauugucaaaggagcgggggagggcaaauucaccagcaggggc

SEQ ID NO: 331606 - RNA, 64 nt, Human
uuuagggaggaggguucacaguguuuuugugggggcgggggaaggaagaggcagccccgccccc

SEQ ID NO: 331607 - RNA, 64 nt, Human
ucgcaaggauaagaaauagcgguuagcgggccgggcgggggaucggggguuagggguggagucc

SEQ ID NO: 331608 - RNA, 64 nt, Human
aggaugcaagaccagacugaagaacacgguugaguccccagaaccaaaagggggccuuucugcu

SEQ ID NO: 331609 - RNA, 64 nt, Human
acugcuguccccccuccagcuaggacccagcccauccccagaugccugagccuuuguccaaagu

SEQ ID NO: 331610 - RNA, 64 nt, Human
acaaaauuauuuuaaagugacuggaauuaucuaguccccagauugaucaucuccccuggcaacg

SEQ ID NO: 331611 - RNA, 64 nt, Human
caugucuugcuaaaccuguuucuggugccucccauccccagacccaccagacaccacacagcag

SEQ ID NO: 331612 - RNA, 64 nt, Human
ucccagcccugcauccuccgugcccuagaccugcuccccagaggaggggccuugacccacagga

SEQ ID NO: 331613 - RNA, 64 nt, Human
cggacagcgucaggggcagaggggcacacaacuuuccccagagcaccccaaggacacugugauc

SEQ ID NO: 331614 - RNA, 64 nt, Human
ggcaaugugaccagucacagggacagaucacaucuccccagaguggcaacucuggugaaaccuu

SEQ ID NO: 331615 - RNA, 64 nt, Human
cacaccuguguccuccgggagaggcccccuccucuccccagaccacagggggccucucugccuc

SEQ ID NO: 331616 - RNA, 64 nt, Human
cagggcuguuggacugucauuucaaggcucauuguccccagacagggaucugggcccucagacu

SEQ ID NO: 331617 - RNA, 64 nt, Human
ccuuugacuuuucauguaucucuccugccuuccuuccccagaguggaggaguuagacuugccuc

SEQ ID NO: 331618 - RNA, 64 nt, Human
gagaaaugucuguuuugaggaaagggcuuugaauuccccagauacugaacaauuuguguuugug

SEQ ID NO: 331619 - RNA, 64 nt, Human
gcugaaaagagcuuuguauuauuuuuuaauucccuccccagauaucauuuaggaguauuauaua

SEQ ID NO: 331620 - RNA, 64 nt, Human
caagauggagaagcaugugccccuguagagcgucuccccagaaccagaccccgagccacucgcu

SEQ ID NO: 331621 - RNA, 64 nt, Human
ugggucagguuacgacuuacaacuuuuguucuauuccccagacuccucauuauucaguacauuu

SEQ ID NO: 331622 - RNA, 64 nt, Human
ucagccacccucucucagucugaaacauccaacauccccagaaggcuuagcuccuuuuugaauu

SEQ ID NO: 331623 - RNA, 64 nt, Human
ugucugucugucucugcucuuuccucggccucucuccccagaccuggcccggccgcccugucuc

SEQ ID NO: 331624 - RNA, 64 nt, Human
ggccaagaacaccacccccggggcagcccugccugcgggggagugggggaccgugcagcuacgg

SEQ ID NO: 331625 - RNA, 64 nt, Human
cccgccgcaguugcguuugcuuuggaccuugcgugcgggggagggggugcucgguccgagcccg

SEQ ID NO: 331626 - RNA, 64 nt, Human
uguuuuuuguuuuuuuuguuguuguuuuuuuuuugcgggggaggggaugguacagacuaaacgu

SEQ ID NO: 331627 - RNA, 64 nt, Human
gggagaaugauuagguugccuuaccugcaugguuuccccagaggaugugugccccaagguggcu

SEQ ID NO: 331628 - RNA, 64 nt, Human
auauugaucaccaugaaagaagaauaguuuuuuguccccagagacauucauuuaguugauauaa

SEQ ID NO: 331629 - RNA, 64 nt, Human
aagaaggaaguacccacagaucacugccaucaacuccccagaaguugcacucaagcuagugagc

SEQ ID NO: 331630 - RNA, 64 nt, Human
agucaaucuggggcuuccacugccugcauuccaguccccagagcuugguggucccgaaacggga

SEQ ID NO: 331631 - RNA, 64 nt, Human
cgccugaaugccgagcuaacuguugccacucuccuccccagacuaugaaaucccuggagaauuu

SEQ ID NO: 331632 - RNA, 64 nt, Human
ucacccuggaggcaccugguggccaugcuccucuuccccagacgccuggcugcugaucgccuuc

SEQ ID NO: 331633 - RNA, 64 nt, Human
gugcuuccaauuaucagugaccugccugcaagcauccccagaagcaaacagcagagguagaaga

SEQ ID NO: 331634 - RNA, 64 nt, Human
uaacucaacuaaaacccacuguaggaaguuagcuuccccagacagcuaaugccgagaucuucua

SEQ ID NO: 331635 - RNA, 64 nt, Human
ggcacccgguuccaggcagcacagacguggggcauccccagaaagacuccaucccaggaccagg

SEQ ID NO: 331636 - RNA, 64 nt, Human
ggcggggcgaaguuugggggguguuuuguggggcuccccagacacacucucugccuggugguca

SEQ ID NO: 331637 - RNA, 64 nt, Human
caaguaaaaggcucaucaguuuuagcaucucugcuccccagaaaauuguaagcauccucaccag

SEQ ID NO: 331638 - RNA, 64 nt, Human
cugcucagcaacaaacguacuuccaccagauguguccccagauccacagcaggcacauaucucu

SEQ ID NO: 331639 - RNA, 64 nt, Human
caaggagcugcuucucucuucucccaguucuaccuccccagaagccuuccuccccagguggggc

SEQ ID NO: 331640 - RNA, 64 nt, Human
aauuagaaagagaaucccagcugucauuguuccuuccccagaagcuaagagccagccucagagc

SEQ ID NO: 331641 - RNA, 64 nt, Human
gggaaugugaucuaccugaugcgacccugaguucuccccagagccuccuccugccccaccagcu

SEQ ID NO: 331642 - RNA, 64 nt, Human
ugggaagcaguuagggagauagcgacccggaguuuccccagaagcggggugggagggugugcau

SEQ ID NO: 331643 - RNA, 64 nt, Human
gcauccagauagagugcaguucaugagggagggggcgggggacugaaggggaaagggcguuaaa

SEQ ID NO: 331644 - RNA, 64 nt, Human
agcaacuauauauuuccauagcuuuuggcugggggcgggggacauuuuuauuacaacuugaaau

SEQ ID NO: 331645 - RNA, 64 nt, Human
ccucacgggccgaacggaacaagggguccagcuugcgggggacccuccccagcccauuccugcu

SEQ ID NO: 331646 - RNA, 64 nt, Human
cagccccguucggcucagaccgacccccacuccauccccagaccugcagcacaagugcgcgggc

SEQ ID NO: 331647 - RNA, 64 nt, Human
cacagacccucaugcacucucuuacgugccauucuccccagacuuuuuuuguacuuaauguaug

SEQ ID NO: 331648 - RNA, 64 nt, Human
agcagcgacccgaaccagccccgugccagcccgguccccagacccaagccugaccccauccgag

SEQ ID NO: 331649 - RNA, 64 nt, Human
agagccagccugccagaggcaaaugcaaaagagguccccagaacacagccagcugggcagcccc

SEQ ID NO: 331650 - RNA, 64 nt, Human
cuggagucuccaccauagacucaguggccuggccuccccagaccccagagccaagaacacuaag

SEQ ID NO: 331651 - RNA, 64 nt, Human
gaucugcgguuuccccucuacccugccucccgucuccccagaaugggaauuucuuuuauguuuu

SEQ ID NO: 331652 - RNA, 64 nt, Human
cauccaccuccaccgguccaggucuuugcugcuguccccagaccuccugugacaccacgccaga

SEQ ID NO: 331653 - RNA, 64 nt, Human
ccccgaggccgcgugcgugagaaccgcgccgguguccccagagaccaggcugugucccucuucu

SEQ ID NO: 331654 - RNA, 64 nt, Human
guagaggaccaggacuugugcagacgccacagucuccccagauauggaccaucagugacucaug

SEQ ID NO: 331655 - RNA, 64 nt, Human
ggagcacaugcuuacugguggccucaguuuaccuuccccagauccuagauucuggaugugagga

SEQ ID NO: 331656 - RNA, 64 nt, Human
acaguguuuucaucucuuggucauaauuccgagauccccagagaccacuguuucuggaguaucu

SEQ ID NO: 331657 - RNA, 64 nt, Human
ggagaggagggcccuguccggcauguguggguauuccccagaagcauuugccuccugcugagcc

SEQ ID NO: 331658 - RNA, 64 nt, Human
ggaaggagggagccgggagccuggugggaagccuuccccagagagauggcuuuaggggcuuuau

SEQ ID NO: 331659 - RNA, 64 nt, Human
uugagauagaggccuuuaaauacauuccaugcccuccccagaaaauagucugugggagucaguu

SEQ ID NO: 331660 - RNA, 64 nt, Human
aggaaggggagagacaaagggggacugaguuucauccccagaaguuucucagcuccuuugacag

SEQ ID NO: 331661 - RNA, 64 nt, Human
acaacugggcccuggaccagcaccacuuccgagguccccagacccccugagcccucccagggac

SEQ ID NO: 331662 - RNA, 64 nt, Human
uccccaucugagccucgguguguccaugugucuggcgggggauggguggacuguaugauuucca

SEQ ID NO: 331663 - RNA, 55 nt, Human
aaagcaaagaggcucuuuagaggcagcgggggaggcccgcagagcgcgccccuag

SEQ ID NO: 331664 - RNA, 64 nt, Human
gcuccaguguaucucaaaagaccgggcgccaggggcgggggaccuagggcgacgucuucagagu

SEQ ID NO: 331665 - RNA, 64 nt, Human
cgaacaggagccccccuccacagauguccccccauccccagaggcuggaggaacaacugggccc

SEQ ID NO: 331666 - RNA, 64 nt, Human
cuguagaagcagcuugcugagccccuccgagcgguccccagaauuagcugguucacaaccccca

SEQ ID NO: 331667 - RNA, 64 nt, Human
gcuggggcugcugccccugccuaccuccugccuguccccagaggcugaggagaggggguacugu

SEQ ID NO: 331668 - RNA, 64 nt, Human
ggccacaggugcacccuucccacacccuuuacauuccccagagccaagggaguuuaaguuugca

SEQ ID NO: 331669 - RNA, 64 nt, Human
agaguagaggccuauugccacaacccagugaguuuccccagaucucaccccuguccuaaauacc

SEQ ID NO: 331670 - RNA, 64 nt, Human
agcccagcaagaaggcuggggguugucaagguuguccccagaccuugcuugcagugguuggaga

SEQ ID NO: 331671 - RNA, 64 nt, Human
uccuggugaccugcucucccaagaacagagccuguccccagaugucccaguagcgaugaguaac

SEQ ID NO: 331672 - RNA, 64 nt, Human
gggacaccugaggcagccagcgcccccuccccaguccccagaacugccugcaggugccuuguug

SEQ ID NO: 331673 - RNA, 64 nt, Human
gagauauucuuucuucugccuuggaguucggcccuccccagacuucacuuaugcuagucuaaga

SEQ ID NO: 331674 - RNA, 64 nt, Human
gguaugacauucaaagcuaccagaagcaucaugguccccagacccuguaccugccuguaacucu

SEQ ID NO: 331675 - RNA, 64 nt, Human
agacugguacccauuuccuuuucuuacccugaucuccccagaagccucuuguggugguggcugu

SEQ ID NO: 331676 - RNA, 64 nt, Human
gucagaucagcuccuaagggggugacgccugcccuccccagagcacuggguugcaggggauuga

SEQ ID NO: 331677 - RNA, 64 nt, Human
uggcagucugcccaccugggugcacugggacggguccccagaucugcuggaaugauuguccggg

SEQ ID NO: 331678 - RNA, 64 nt, Human
caucuccccgaccacugcccagcccucugcucccuccccagaggaggcgggagggugggcucua

SEQ ID NO: 331679 - RNA, 64 nt, Human
ugaacaccuaaagauuuucuguagcguagauauuuccccagaggcacgcgaacugucagucuuu

SEQ ID NO: 331680 - RNA, 64 nt, Human
gggacagccuucagcagcagcucacacccuaccuuccccagacuugcacuggggugggauuugg

SEQ ID NO: 331681 - RNA, 64 nt, Human
uucccucccaacccuggugagcuccaaguugguugcgggggagaggggagaauggaguagaguc

SEQ ID NO: 331682 - RNA, 64 nt, Human
gagcuccgaauucuugcguguguguagaugaggggcgggggacgggcgccaggcauuguccaga

SEQ ID NO: 331683 - RNA, 64 nt, Human
aagguggggaaacuguaagugaaccccugugggugcgggggaggguauccggugcgcagggagg

SEQ ID NO: 331684 - RNA, 64 nt, Human
acugccacccucugcuaguccucaugcaacucaguccccagaauggcuccacugggaguggagg

SEQ ID NO: 331685 - RNA, 64 nt, Human
auuucaggagaggcuggcuccuccccaagguuaguccccagacugagaaagugaaaccuuauug

SEQ ID NO: 331686 - RNA, 64 nt, Human
ugguggagaugacaaggacacuguggggucuggguccccagaacucuggagcuacaggccacuc

SEQ ID NO: 331687 - RNA, 64 nt, Human
acucuaggucaggcuccaggagcaugagaauugauccccagaagaaccauuuuaacuccaucug

SEQ ID NO: 331688 - RNA, 64 nt, Human
auugggcagacagagucuucuaagcccacagggauccccagauggauuuuucaggacaaauggc

SEQ ID NO: 331689 - RNA, 64 nt, Human
uuuguucuuguccaaaguugccauuucuuuuuuuuccccagaaauauuuggaaauuauuggagg

SEQ ID NO: 331690 - RNA, 64 nt, Human
gucccuggggggaggcaggaggcacaugugaggguccccagagagaagggagugggugggcagg

SEQ ID NO: 331691 - RNA, 64 nt, Human
agcgccuacaccucccuggaggcccacacuucucuccccagaagcucacacgcagcgucugagg

SEQ ID NO: 331692 - RNA, 64 nt, Human
uccagcaccagccaagcuggugcuccagcgcaccuccccagagcuccccgcacugacggggcug

SEQ ID NO: 331693 - RNA, 64 nt, Human
accaaucugugagggaaguuaggaacccauuuccuccccagaaccagaaugacuggacaaucuu

SEQ ID NO: 331694 - RNA, 64 nt, Human
uucuaggaaagugaguaugguucuaugccuguauuccccagaagccacuagaccuauuuucccc

SEQ ID NO: 331695 - RNA, 64 nt, Human
cugcaggagaagauggccuacuuggaucaaacccuccccagagcccccggccaggcacccccag

SEQ ID NO: 331696 - RNA, 64 nt, Human
agccgucuccaggcucucugucagcauuacaggauccccagaaagcuguugaauaagcccuaag

SEQ ID NO: 331697 - RNA, 64 nt, Human
cuugguuccuaagaguuuccucagagaucauaccuccccagagggaagcaggaaugaggccaaa

SEQ ID NO: 331698 - RNA, 64 nt, Human
ggggaggugucagcugggccccuccugugcuaucuccccagaggacaucccugacuccaccccu

SEQ ID NO: 331699 - RNA, 64 nt, Human
uugucagagugucugaugcggccacucauucggcuccccagaauuccuagacuggguuaauagg

SEQ ID NO: 331700 - RNA, 64 nt, Human
ugcagcagauuccgucguucuuacugagucugcagcgggggagugaacaagugugcagauguaa

SEQ ID NO: 331701 - RNA, 64 nt, Human
cuuuauuuuagucuccuuuucagggaugucgugggcgggggaggggguucuuggugcuacagcc

SEQ ID NO: 331702 - RNA, 64 nt, Human
caggccccucccaccuccugacacccuggccagcgcgggggacuuucucugcaccauguagcau

SEQ ID NO: 331703 - RNA, 64 nt, Human
auguuuucaacucaggaacuauggcaaggaacuuuccccagaucaaauucuauuaacgcugaga

SEQ ID NO: 331704 - RNA, 64 nt, Human
gcauggugcugaauggcugaggaccuucccagucuccccagaguccgugccuuucccuguguga

SEQ ID NO: 331705 - RNA, 64 nt, Human
ucaaacuguccaugggaaggcugaauugagugacuccccagaaugaagaugagaaggugaauau

SEQ ID NO: 331706 - RNA, 64 nt, Human
gggcuuuugagagcagcaccaccccacuggggcauccccagacuugggaaacgugacucuuucu

SEQ ID NO: 331707 - RNA, 64 nt, Human
ucugacucugagccaacagcuggaccgugucucauccccagaacaugccgucuguccccaccgg

SEQ ID NO: 331708 - RNA, 64 nt, Human
caagagccuggccagugacugcugucucagucaguccccagagggaaagaccuugccuuagaag

SEQ ID NO: 331709 - RNA, 64 nt, Human
cucaaagugucacaaugcuccuccugaugacuccuccccagaaaaccaccaaucggcuuucauu

SEQ ID NO: 331710 - RNA, 64 nt, Human
augcuucaugguuaggagucuucaaguuccauguuccccagauuugagauauacuaaagaaaga

SEQ ID NO: 331711 - RNA, 64 nt, Human
guuugauggacagaggcugaggaauuuccuggcuuccccagauaguguccugggacaugguaug

SEQ ID NO: 331712 - RNA, 64 nt, Human
augccaggcuaugggggcagccaguuggcauugcuccccagacugaacagaaaccuggccgccg

SEQ ID NO: 331713 - RNA, 64 nt, Human
ugugccucucagacaaauucugaucucuaagagauccccagaccucacuugccucugccuccau

SEQ ID NO: 331714 - RNA, 64 nt, Human
gggggcaggaucuggcccgagcucuccucagaccuccccagaccugucuucucaucagccaccg

SEQ ID NO: 331715 - RNA, 61 nt, Human
aguuguggcucuuugucuaggacccagaucauccccagagagagcccccacaagcuccuca

SEQ ID NO: 331716 - RNA, 64 nt, Human
gaagacccucuuggcuuucccgugcucuuugggcuccccagagaccugacaguauuagggagug

SEQ ID NO: 331717 - RNA, 64 nt, Human
gaucccucucucccuagugccuuccacccuuuacuccccagagcagcuuggcccagggaggggg

SEQ ID NO: 331718 - RNA, 64 nt, Human
aaccucagccuggccagacacaggcccucccuguuccccagagaaaggggagcccacuguccug

SEQ ID NO: 331719 - RNA, 64 nt, Human
gugccacuggagugugcgugguggucccuggguagcgggggaggguaggcaggauuggggaaga

SEQ ID NO: 331720 - RNA, 64 nt, Human
caggguccuaaguugaaaaugaugucgauugggggcgggggacacuguauuugauauuugugau

SEQ ID NO: 331721 - RNA, 64 nt, Human
uuccccccgcaccuuguggggaagcuucaggggagcgggggagggugauucccaguggugggga

SEQ ID NO: 331722 - RNA, 64 nt, Human
gucccagccuggccuguggcugcccuccaucccuuccccagagauggcuccuugggaugaagag

SEQ ID NO: 331723 - RNA, 64 nt, Human
gucuuucucuuuggaaucauaaaguggaacagaguccccagaacucauguggccauuuccgcca

SEQ ID NO: 331724 - RNA, 64 nt, Human
ccucagagaaggagacaccuccuggaggccccaguccccagacaguuucagccagcgcugagga

SEQ ID NO: 331725 - RNA, 64 nt, Human
caccacacccaucaaccagccacauucacgcuacuccccagaucucuucccccauuccuucuuu

SEQ ID NO: 331726 - RNA, 64 nt, Human
uuuggucuuguugauuuccucugggcauaucccuuccccagaucugcuccuccccuuucacagg

SEQ ID NO: 331727 - RNA, 64 nt, Human
gccuucuguccuccauggugagggcacagaugucuccccagagcccagcgcuggcagaauggau

SEQ ID NO: 331728 - RNA, 64 nt, Human
ucuucuguggagcuuuacccucugagugagacccuccccagagccccgggggccgcagcccgcc

SEQ ID NO: 331729 - RNA, 64 nt, Human
aaacuuauuuuugcauauuucuguaauauugcaguccccagauccagaacaugggaaguuaggg

SEQ ID NO: 331730 - RNA, 64 nt, Human
uaaauuuaaucucuuauguauagggugauaaccuuccccagaaacaacagugauugcgauuguu

SEQ ID NO: 331731 - RNA, 52 nt, Human
acgucuucugcagggagugagcuccccagacccccucgccacuccagcgccc

SEQ ID NO: 331732 - RNA, 64 nt, Human
cugcccagaagaucugaaacuaauaguaggaguuuccccagaagucauuuucagccuuaauucu

SEQ ID NO: 331733 - RNA, 64 nt, Human
ugauaagaauggcacuuuaccucugugguccuccuccccagaacucagaacccaagucugauca

SEQ ID NO: 331734 - RNA, 64 nt, Human
caauggagugacaggugaccugcucaggugccccuccccagaccaaaugucccaggcacacagc

SEQ ID NO: 331735 - RNA, 64 nt, Human
aacaccugccuaggguaaaugggucucucuucuauccccagaaacuuucagaggaagcagcuca

SEQ ID NO: 331736 - RNA, 64 nt, Human
gcagggccacuguccaggcaaaugccaggccuuguccccagaugcccagggcucccuuguugcc

SEQ ID NO: 331737 - RNA, 64 nt, Human
uuguugccuucccuuuugcccuuugggcauuccuuccccagagagggccuggaaauuauaaauc

SEQ ID NO: 331738 - RNA, 64 nt, Human; identical to SEQ ID NO: 218912

SEQ ID NO: 331739 - RNA, 64 nt, Human; identical to SEQ ID NO: 218918

SEQ ID NO: 331740 - RNA, 64 nt, Human; identical to SEQ ID NO: 218924

SEQ ID NO: 331741 - RNA, 64 nt, Human
uucuccauuuucaguucuuaccugggaaccuaauuccccagaagcuaaaaaacuagacauuagu

SEQ ID NO: 331742 - RNA, 64 nt, Human
ugccuucuaccaugaguaaaagcuuccugaggcuuccccagaagcagaugccagugcuaugcuu

SEQ ID NO: 331743 - RNA, 64 nt, Human
gucaccuggccuggaguguguugggcagccaguguccccagagcugcuuguggguuucuggggu

SEQ ID NO: 331744 - RNA, 64 nt, Human
cacaagcucacccacuuuggagcagcauuucuccuccccagaggaccucgaaggcugcaacggc

SEQ ID NO: 331745 - RNA, 64 nt, Human
uaaaguaucuucgcagugcucuguucccuccgucuccccagacaucugacacccuaaaagccau

SEQ ID NO: 331746 - RNA, 64 nt, Human
cugggaaaucaugguuacgcuucaggcauauucuuccccagaguacuacuuacauuuuaaauuu

SEQ ID NO: 331747 - RNA, 64 nt, Human
gaagagcauuugguacacacuugaccuucugucguccccagaccaguagugaccaaucgggagu

SEQ ID NO: 331748 - RNA, 64 nt, Human
cggaccugcccccucagugucucucccucccgaguccccagauggagaccccuuucuacaggau

SEQ ID NO: 331749 - RNA, 64 nt, Human
guugcccagaggcccuguucucaccucaugcugcuccccagaguagacuaacaggcucaguccc

SEQ ID NO: 331750 - RNA, 64 nt, Human
cgggaggcaucgcuauacuccccuccuucaacucuccccagaaauagcccaaccaagcgagugg

SEQ ID NO: 331751 - RNA, 64 nt, Human
caucuuuucucuccccugccuucuccuccuucucuccccagagcccccuugagccccucugccu

SEQ ID NO: 331752 - RNA, 64 nt, Human
cugaggccccucuuggggcacucacugccccucauccccagaaauuauuuuucuacaccaaauu

SEQ ID NO: 331753 - RNA, 64 nt, Human
caguguccaaagcagggucugggcaggacucagcuccccagaguccucuaugaacuauggacgg

SEQ ID NO: 331754 - RNA, 64 nt, Human
ugggaaugaguauggcacagccaaguuacacuccuccccagaugaccccacacccuacucaauu

SEQ ID NO: 331755 - RNA, 64 nt, Human
ugcacuccugcuuuugugggaaaaauuuucuucuuccccagaagaguuaacaguugaguguuca

SEQ ID NO: 331756 - RNA, 64 nt, Human
uuuuauggggagguuugaugagcauuugccuuucuccccagagagcuugaccaaguuacauauu

SEQ ID NO: 331757 - RNA, 64 nt, Human; identical to SEQ ID NO: 218928

SEQ ID NO: 331758 - RNA, 64 nt, Human; identical to SEQ ID NO: 218934

SEQ ID NO: 331759 - RNA, 64 nt, Human; identical to SEQ ID NO: 218939

SEQ ID NO: 331760 - RNA, 64 nt, Human
ccccauugcuuccaugccuggugcugucugaguauccccagagcaagagagaccuggagacacc

SEQ ID NO: 331761 - RNA, 64 nt, Human
guauucgcuguucaauaaacauugagugagcaccuccccagauggagcaugcugguccugggcc

SEQ ID NO: 331762 - RNA, 64 nt, Human
cccucuugggacacacugugggauuuguggcccuuccccagaggaauuguggagacugucccau

SEQ ID NO: 331763 - RNA, 64 nt, Human
agccuggccgagcuggcagcauggagcccucggcuccccagacuuugccgaggggcugcuccgg

SEQ ID NO: 331764 - RNA, 64 nt, Human
agugcucuaaaguagcaguauuauuauuaaacuguccccagaguaacccuguaggccuaaagua

SEQ ID NO: 331765 - RNA, 64 nt, Human
gaagacacugaugggcaacccccagccugcuaauuccccagauugcaacaggcugggcuucagu

SEQ ID NO: 331766 - RNA, 64 nt, Human
gggcaccugcugucuaaaccucugcuugggcuucuccccagaaugcacuuuguggcugagugcu

SEQ ID NO: 331767 - RNA, 64 nt, Human
cucacaggaagugggggugaggagccugcggugcuccccagaaaaggggaaggggcaguggggu

SEQ ID NO: 331768 - RNA, 64 nt, Human
ggcccugacugcuguuaauaauuggcagcagugcuccccagaucccagaaggucccugcuggag

SEQ ID NO: 331769 - RNA, 64 nt, Human
ugaguuccuggagaccccuuuuuugcccccagguuccccagagggcaacgccaucaguagcagu

SEQ ID NO: 331770 - RNA, 60 nt, Human
cagcccgcuuuggucugugagcugaggcuguccccagagaggauggcagcagguauuggg

SEQ ID NO: 331771 - RNA, 64 nt, Human
gaggccguggggccccuagacuggacacgugugcuccccagagggcacccccuauuuaugugua

SEQ ID NO: 331772 - RNA, 64 nt, Human
ggccgagggccaggcagaauggcugcacguagguuccccagagagcaggcaggggcaucugucu

SEQ ID NO: 331773 - RNA, 64 nt, Human
guauuaauuuauugggaaugagcugaggcggauuuccccagagaaacaaaaagguauaacuuua

SEQ ID NO: 331774 - RNA, 64 nt, Human
uucacaccgcaucaguccccaucaucacuacuccuccccagagacauacagauugcccuccccg

SEQ ID NO: 331775 - RNA, 64 nt, Human
uuuuuuaauauuagauaaaacgaguaaacgaaauuccccagaaauuaguaguaaguggggucuu

SEQ ID NO: 331776 - RNA, 64 nt, Human; identical to SEQ ID NO: 218945

SEQ ID NO: 331777 - RNA, 64 nt, Human; identical to SEQ ID NO: 218950

SEQ ID NO: 331778 - RNA, 64 nt, Human; identical to SEQ ID NO: 218958

SEQ ID NO: 331779 - RNA, 64 nt, Human
cacucuaccaggaagcccuaugacauccucaggcuccccagaccugcagcuugcauggggcccc

SEQ ID NO: 331780 - RNA, 64 nt, Human
uugccccccaccccgccccgccccuuccuucuguuccccagaucuaugaacuacaacauuauga

SEQ ID NO: 331781 - RNA, 64 nt, Human
gaugguccaggcugggcaucccucuccuccuccauccccagacaucaccaggucuaauguuuac

SEQ ID NO: 331782 - RNA, 64 nt, Human
gugaggaauuugaagcucagaaagguugaggggcuccccagaggucacacagccugugugcagu

SEQ ID NO: 331783 - RNA, 64 nt, Human
cuagguuuucuagcuuucauuaaauguauuuuuuuccccagagcuaauuugaaaguugauugga

SEQ ID NO: 331784 - RNA, 64 nt, Human
gaacguugcugaagugguaauugaggaaaacaguuccccagauuguuaagaguucacugaagau

SEQ ID NO: 331785 - RNA, 64 nt, Human
ccccuggagcgagggcaggccccuucccucucuuuccccagacaccuacuugagacucaccaau

SEQ ID NO: 331786 - RNA, 64 nt, Human
ugcuaggagaagggaagacgcccgagacgcugcuuccccagaagugcuggggcagggaggccca

SEQ ID NO: 331787 - RNA, 64 nt, Human
aggccggggguggaaggcccaguagagcugcccuuccccagauggaagcuuccuccaaccuuca

SEQ ID NO: 331788 - RNA, 64 nt, Human
ucucccuuauacccuugggucacagcuccaguuguccccagagcacccugggccugggcugagc

SEQ ID NO: 331789 - RNA, 64 nt, Human
cucuuccuucccccauccccuuuccuccccaccuuccccagacucagcuccagaauaccuucuu

SEQ ID NO: 331790 - RNA, 64 nt, Human
acugacacccaaauccagaaucccuggucuugaguccccagaacuuugccucuugacugucccu

SEQ ID NO: 331791 - RNA, 64 nt, Human
aagaaucugcagcuaacuuauuuuccccuagcuuuccccagacacccuguuuuauuuuauuaua

SEQ ID NO: 331792 - RNA, 64 nt, Human
acugccaggaccccaggucaggggcucccuacauuccccagagugggauccacuucuugguucc

SEQ ID NO: 331793 - RNA, 64 nt, Human
aucucccaggaggaaguggaggggacaucgcuguuccccagaaacccacucuauccucacccug

SEQ ID NO: 331794 - RNA, 64 nt, Human
accgggaacagggauuugcccuucacaauucuacuccccagauccucuccccuggacacaggag

SEQ ID NO: 331795 - RNA, 64 nt, Human; identical to SEQ ID NO: 218962

SEQ ID NO: 331796 - RNA, 63 nt, Human
gucguuuuccaaagagccgcgucccggcaaguccggcggaauucaccaguguuccugaagcug

SEQ ID NO: 331797 - RNA, 63 nt, Human
gugaucaccguaggguaacuggagcgucaccaccggcggaaucgcagcuucugagacuggaac

SEQ ID NO: 331798 - RNA, 64 nt, Human
uaggucuccccuccaggcugagggccucucuacuuccccagaugccugggugcaaagaacggcu

SEQ ID NO: 331799 - RNA, 64 nt, Human
uacuuucuauucuccguguuuuuaucacaccugcuccccagauucccacccccucaauguuccu

SEQ ID NO: 331800 - RNA, 64 nt, Human
cugugaggcagccuucugauggccuggcccaccuuccccagaaccaggggaggccugaggcuuc

SEQ ID NO: 331801 - RNA, 64 nt, Human
cuggagagagagccauuggcuggaguugagacuguccccagaacccuuggucuugccacucccc

SEQ ID NO: 331802 - RNA, 64 nt, Human
ugagccgccugcccuuucucuccgcuccagccucuccccagaacggcucuuuuugucacacagg

SEQ ID NO: 331803 - RNA, 64 nt, Human
gcgccacuuuguauauuucaggacugggaccuacuccccagaugccaccugagaggagcuucug

SEQ ID NO: 331804 - RNA, 64 nt, Human
guggagcugugcucccuugagugcacuugagcacuccccagaccagaucacuuuuuggacacac

SEQ ID NO: 331805 - RNA, 64 nt, Human
agccagucucuggcuguggcuccccagaacaggauccccagaagcaggcugaagaggaaaggca

SEQ ID NO: 331806 - RNA, 64 nt, Human
aaggagagcccaggagccagucucuggcuguggcuccccagaacaggauccccagaagcaggcu

SEQ ID NO: 331807 - RNA, 64 nt, Human
aaaaacccagcggcuuagccaagcccuaagccuguccccagaccaacccugggaccuauacaga

SEQ ID NO: 331808 - RNA, 64 nt, Human
cgucaggaagaucagcuguaaauaaacgcugggcuccccagagcaccuguccgcccacugcccu

SEQ ID NO: 331809 - RNA, 64 nt, Human
cuuagcuauuuaauuaucagaagcaaguaaucuuuccccagauaauauuuugcccuagaagaag

SEQ ID NO: 331810 - RNA, 64 nt, Human
uuauugcggggagacagcucucucucccaccuccuccccagaugggaggagagccugaggccca

SEQ ID NO: 331811 - RNA, 64 nt, Human
ccucuucgcccugugagcagcucugugguuugccuccccagauggcggguccccgcucgcaccc

SEQ ID NO: 331812 - RNA, 64 nt, Human
ugucugguaggaaggauaucgggucacugucgaguccccagaaccagcugcagauggagguuuu

SEQ ID NO: 331813 - RNA, 64 nt, Human
ucucuuccuucaucuccaccccaccccacccuacuccccagacccuggggccuggcuggggaag

SEQ ID NO: 331814 - RNA, 63 nt, Human
agagagaaaaaaccucaacuguguauuuugucacggcggaaaaucugcucgcaucgaagcauu

SEQ ID NO: 331815 - RNA, 63 nt, Human
ugcagcuuccugguggcccugaugcagaagaaccggcggaaggaccggaagcuaggggccagu

SEQ ID NO: 331816 - RNA, 64 nt, Human
ggaggccacagauucuuucccaugggggcucucuuccccagaccccagauccaaggucccucac

SEQ ID NO: 331817 - RNA, 64 nt, Human
ugaggcugcaugaugggucuggggccuugcugauuccccagaccccuaauuaaauguuucuugu

SEQ ID NO: 331818 - RNA, 64 nt, Human
aaggguuacaaagugagggagggcaguguccagauccccagagccacacauacauacacauaca

SEQ ID NO: 331819 - RNA, 64 nt, Human
cuguaaacuucuccugcccagccccagcugagcauccccagaugggcagacucccgaugaagcc

SEQ ID NO: 331820 - RNA, 64 nt, Human
cauacuggcaggagggugaggagguucacugagcuccccagaucucccacugcggggagacaga

SEQ ID NO: 331821 - RNA, 64 nt, Human
ugauggaacaggaacucagggugcccuuacccccuccccagaccuguucccuuucuuugacuga

SEQ ID NO: 331822 - RNA, 64 nt, Human
agcaggauaguugcuccgccucugcuggcacauuuccccagaccugagcuccccaccaccccag

SEQ ID NO: 331823 - RNA, 64 nt, Human
ccccagccccacuaucaguguccagcgugcugguuccccagagcacagcucagcaucacacuga

SEQ ID NO: 331824 - RNA, 64 nt, Human
agacaugugccccuuugcugcuggcuaccacucuuccccagagcagcaggccccgagccccuuc

SEQ ID NO: 331825 - RNA, 64 nt, Human
accaaagaagguguguaagugaagugguucucaguccccagacaugugccccuuugcugcuggc

SEQ ID NO: 331826 - RNA, 64 nt, Human
ugugacuugcucaagguccagugagugaccucauuccccagaaaaggcuccucccacaccagag

SEQ ID NO: 331827 - RNA, 64 nt, Human
ggaggcagcagguuugaggcccuggggggcccguuccccagaagcugccagugcuuucagaugc

SEQ ID NO: 331828 - RNA, 64 nt, Human
uggggccuccccuccacuccuucccaaaucugucuccccagaagacacaggaaacaauguauug

SEQ ID NO: 331829 - RNA, 64 nt, Human
aucuguuaaacugaugacagacauaacucaucauuccccagaaaccuuuuuugauuacaguauc

SEQ ID NO: 331830 - RNA, 64 nt, Human
cagcaucgggguggcccacugagucucggcauaguccccagagcucccccguggugccugcaca

SEQ ID NO: 331831 - RNA, 63 nt, Human
gucucuuccuccacagauaaccgggggcuccucuccccagaccaaaaugaauugcaaguugcc

SEQ ID NO: 331832 - RNA, 64 nt, Human
uguguuacaugaggaucuuccacaauuucagaaugcacgccagagcugaagggggaaacuuggu

SEQ ID NO: 331833 - RNA, 64 nt, Human
ucaguucacauccuugguguguguaaguaccgaugcacgccaccaccaugccuguguuacagca

SEQ ID NO: 331834 - RNA, 64 nt, Human
auaccuaauguuaaaugacgaguuacuggaugcagcacgccaacauggcacauguauacauaug

SEQ ID NO: 331835 - RNA, 64 nt, Human
ugggcucccuccccuaaccuuggugccugauccauccccagaccaggacagcagccacucaguu

SEQ ID NO: 331836 - RNA, 64 nt, Human
ggauaaccuguuucauuuuggguuuucuuccucuuccccagacuccaguccucguucuagagga

SEQ ID NO: 331837 - RNA, 64 nt, Human
uccccuccucccagcuggaaagcuagggcaggucuccccagagugcuucugcaccccagccccc

SEQ ID NO: 331838 - RNA, 64 nt, Human
ugauaaaacaacagcucgauccaaauugugcuucuccccagaauucacgccucucccuaggaga

SEQ ID NO: 331839 - RNA, 64 nt, Human
auuguaaucaggcccaaggaauauccuggagugguccccagaagcauccaagaaaagauauuug

SEQ ID NO: 331840 - RNA, 64 nt, Human
cugcagaugagaaauaccagaaacauacccuaaguccccagaaugcuaauccuccaaguggaca

SEQ ID NO: 331841 - RNA, 64 nt, Human
gagaaagcuaacacauagggaaauuagguaacuuuccccagauaacucaguaaacaguggagcu

SEQ ID NO: 331842 - RNA, 64 nt, Human
cgcccggcccagguauccucccugagccucagucuccccagaugucaaaugaagaggccagcug

SEQ ID NO: 331843 - RNA, 64 nt, Human
caaggggcuucccuccugggggcagcuacacucguccccagaggcacauucgugcacauucuca

SEQ ID NO: 331844 - RNA, 64 nt, Human
accaggaggggccagguggcgucggcagcaucuguccccagaaucaggcagaauccacuuccca

SEQ ID NO: 331845 - RNA, 64 nt, Human
uggggcugggacuucucauuggccaaccugccuuuccccagaaggagugauuuuucuaucggca

SEQ ID NO: 331846 - RNA, 50 nt, Human
cagguggagacccuaccugauccccagaccucugucccuguuccccucca

SEQ ID NO: 331847 - RNA, 64 nt, Human
uuccuuuuuucagagguguagguuuccaaagauguccccagaagcuccacauucaaguucuauc

SEQ ID NO: 331848 - RNA, 64 nt, Human
caagagaccagggaugcaggguuaggcagacagguccccagaguccucacccugcuccccagac

SEQ ID NO: 331849 - RNA, 64 nt, Human
uuaggcagacagguccccagaguccucacccugcuccccagacaguagacacagugcccguccu

SEQ ID NO: 331850 - RNA, 64 nt, Human
ugggggcagcgggggccagggaaguccccgaguuuccccagacaccgccacauggcuuccuccu

SEQ ID NO: 331851 - RNA, 64 nt, Human
caagauaggaagcucugccugagcuuuccacuaggcacgccagccagaccaauaaaaagcgucu

SEQ ID NO: 331852 - RNA, 64 nt, Human
ccugaacgcugcugccagccgaugccccagcccugcacgccacccacuaucccggcacgcuccc

SEQ ID NO: 331853 - RNA, 64 nt, Human
auccagaugggguaggagacagcugggaggcuccgcacgccagaggccuugccuuucagaagaa

SEQ ID NO: 331854 - RNA, 64 nt, Human
uggagcuugcaguccagugagguggacagaccuguccccagacagugauggcccaaaaugguca

SEQ ID NO: 331855 - RNA, 64 nt, Human
aguggucgccacacagcauuguacccagagucuguccccagacauugcaccuggcgcuguuagg

SEQ ID NO: 331856 - RNA, 64 nt, Human
ccacacagcuacccacguacgacaucguccuggcuccccagaguaucuucccacugagacacgc

SEQ ID NO: 331857 - RNA, 64 nt, Human
caggauccacccuggccucuuuuuacccacugacuccccagaacaacccuuccaggcuucucuu

SEQ ID NO: 331858 - RNA, 64 nt, Human
cuguggaauagggggaguucaugcaccccuuuuuuccccagaggggcuggacucagguuaguuu

SEQ ID NO: 331859 - RNA, 64 nt, Human
ucuaagaaggugauucccccugcccuugcccccuuccccagaacaaaacauguugaucaugugc

SEQ ID NO: 331860 - RNA, 64 nt, Human
auaugggaggagggggcagauuccuggcccucccuccccagacuugaaggugggggguagguug

SEQ ID NO: 331861 - RNA, 64 nt, Human
cugggccaccagaaggugacacccccagaaucccuccccagagacugcaccagcgcagccagca

SEQ ID NO: 331862 - RNA, 64 nt, Human
gggaugacagccagaggaauaagaacuugcucccuccccagagguaaacacuugguccaaaggu

SEQ ID NO: 331863 - RNA, 64 nt, Human
uuccaaggccugaugcauucauaaguugaagcccuccccagauccccuuggggagccucugccc

SEQ ID NO: 331864 - RNA, 64 nt, Human
uccuuccugucagcugugacccauuugaccuguguccccagaacccaguuuuuuguuuguuugu

SEQ ID NO: 331865 - RNA, 64 nt, Human
aggccggucccuuccuugggccccucucauucccuccccagaauggaggcaacgccagaaucca

SEQ ID NO: 331866 - RNA, 60 nt, Human
caccagcccacccccagugacccuacccuguccccagaugcacuaacagauggggcccag

SEQ ID NO: 331867 - RNA, 64 nt, Human
gcaagcccacggucuuccacuaccagccugggccuccccagauguccugcggacucuugcccag

SEQ ID NO: 331868 - RNA, 64 nt, Human
aguccaagaccccaaaucaccacaaaggacccaauccccagacucaagauauggucugggcgcu

SEQ ID NO: 331869 - RNA, 64 nt, Human
cucuggggauuucugggauauauggaggauucuuuccccagaggcucccaaucagcuuuuguuc

SEQ ID NO: 331870 - RNA, 64 nt, Human
cugccucagccuccgaguagcugggacuacaggugcacgccaccacgccuggcuaauuuuuugu

SEQ ID NO: 331871 - RNA, 64 nt, Human
ccugccucagccucccaaguagcugggaauacaggcacgccaccaugcccagcuaauuuuugua

SEQ ID NO: 331872 - RNA, 52 nt, Human
gguaccagagugaggcguagaggcacgccagccagagccuguggagagacuc

SEQ ID NO: 331873 - RNA, 64 nt, Human
caguaagaccaccaaugccaaaguagcacuucgagcacgccagguucuuauugccucccauuug

SEQ ID NO: 331874 - RNA, 64 nt, Human
cugggagcagccagaggcggugcaagcgcccagcuccccagagcuccccaaccucggaccucac

SEQ ID NO: 331875 - RNA, 64 nt, Human
ggugggaugggaagaggcucuuugcaaacgaggguccccagagaagacuggcggggaccugaug

SEQ ID NO: 331876 - RNA, 64 nt, Human
aagccauaaggggcaggggccaccccacggcaucuccccagaaguacaggccucaggaggaggu

SEQ ID NO: 331877 - RNA, 64 nt, Human
caggaggagguggaacugauguaggggguggcacuccccagagacugcccucacgaggggacug

SEQ ID NO: 331878 - RNA, 64 nt, Human
acccauuaacaacaacucauuccccuucccuacuuccccagaaaugucucaacuauauuucuau

SEQ ID NO: 331879 - RNA, 64 nt, Human
cugcuugagcauccucacggcauggccucugccuuccccagagcaggugaaccaagggagagga

SEQ ID NO: 331880 - RNA, 64 nt, Human
uacccccaggagauccuggacugccugacuccccuccccagacuggcuugggagccugggcccc

SEQ ID NO: 331881 - RNA, 64 nt, Human
gggggguggggggauggugagcaaauaggagugcuccccagaaccagaggaggguggggcacag

SEQ ID NO: 331882 - RNA, 64 nt, Human
caccucuccccuuggugccuaacccaggacuuuguccccagagacccacugugugcccccugga

SEQ ID NO: 331883 - RNA, 64 nt, Human
ucuuccaucccccucccaccuucuaggcgaauaguccccagagcuguguuccuccaaggggucc

SEQ ID NO: 331884 - RNA, 64 nt, Human
ccaccccacccuccaccucaauccccucccaucuuccccagaccuaccucaccuacuaggaccu

SEQ ID NO: 331885 - RNA, 64 nt, Human
aagugugaaauugagcaauaggcaggcaccaccguccccagagcaggucagcgucucgagaggc

SEQ ID NO: 331886 - RNA, 64 nt, Human
agagaagggggauucuggaacugggaaggacugauccccagaagcgauggcugaccagauugaa

SEQ ID NO: 331887 - RNA, 64 nt, Human
cgucgcugcccuucacaccuuuuggugcuaccccuccccagaguuaagcacuggaugucuccug

SEQ ID NO: 331888 - RNA, 64 nt, Human
agugguauaagccugcugaaaacaguauggcagauccccagauuaaaauauagaaauaacauau

SEQ ID NO: 331889 - RNA, 64 nt, Human
caggccacccuagcccagccccugcauugccguuuccccagagguggccccuccaccucugcuc

SEQ ID NO: 331890 - RNA, 64 nt, Human
ccagggcucccuccuggagcaucccaggcgggcggcacgccaacagccccccccuugaaucugc

SEQ ID NO: 331891 - RNA, 64 nt, Human
ccuacgaacacgccaagauggaagagcaacugaggcacgccaaguucaccaucacggagugcuu

SEQ ID NO: 331892 - RNA, 64 nt, Human
gccuaccuguccaccgccaccggggucugcgauggcacgccagugcuggagccgcagccaggcg

SEQ ID NO: 331893 - RNA, 64 nt, Human
acugcaccccaucaggggccugauggcugccccuuccccagacagggcuggacuucuggagcug

SEQ ID NO: 331894 - RNA, 64 nt, Human
aacaccaaacuguacagacucucccaccccaaccuccccagacucugcacggauguccuaggcc

SEQ ID NO: 331895 - RNA, 64 nt, Human
gccaggccaucagcccaccuccaccucuggaggguccccagagacccacgcccgacgcagaccc

SEQ ID NO: 331896 - RNA, 64 nt, Human
ccuucuuaaaaauauuacauguuuuauuauccuguccccagagggugguuuauccagaaaccaa

SEQ ID NO: 331897 - RNA, 64 nt, Human
ccacugucccaccgccuccugccucucuccucucuccccagaacauccagagucuguccccugu

SEQ ID NO: 331898 - RNA, 64 nt, Human
ggaucccucaugacagccuccaugggggauucaguccccagagcaggccguacccugcuguagu

SEQ ID NO: 331899 - RNA, 64 nt, Human
uagcauggauuauauuuucacuaugugcuuccuguccccagagggcagggauagaaaaggaagg

SEQ ID NO: 331900 - RNA, 64 nt, Human
gugaccuccuguccccaugguacgucccacccuguccccagauccccuauucccuccacaauaa

SEQ ID NO: 331901 - RNA, 64 nt, Human
ugccugggacccgagcugggcuccugggccuugguccccagaagauggcggcuagggccucgcc

SEQ ID NO: 331902 - RNA, 64 nt, Human
ggucuccccugauuuuuuuucauaguaauuuuuuuccccagaguuugaauuuuuuggucuucuc

SEQ ID NO: 331903 - RNA, 64 nt, Human
ucagacucagagguccaggcccccaaccccuccuuccccagacccagagguccaggucccagcc

SEQ ID NO: 331904 - RNA, 64 nt, Human
gagguucguguuaauuggccuuagacucucccuguccccagacccaggacgcauguguuuccuu

SEQ ID NO: 331905 - RNA, 64 nt, Human
ucccgggaauucugugaaccaggcugcugucuccuccccagaaagaguccuuaccuuggagagg

SEQ ID NO: 331906 - RNA, 64 nt, Human
cuucccuuuggcccucugugcucuugucugguuuuccccagaaacucucacccucacuccaucu

SEQ ID NO: 331907 - RNA, 64 nt, Human
ggccagaaccacugggccggccggcauuccagccuccccagacugcugcccaccuugggacuca

SEQ ID NO: 331908 - RNA, 64 nt, Human
acuugaucacuuuugcacauucccuggccgcuucuccccagagcugccugcucugugagcccca

SEQ ID NO: 331909 - RNA, 64 nt, Human
uguguguugcagaggucagucucuggcgugggccgcacgccaaccgcucauuucuguguugccu

SEQ ID NO: 331910 - RNA, 64 nt, Human
ccuguuguguggggcgaagugauggacucugccagguggacaugcuguggguggauguucccgg

SEQ ID NO: 331911 - RNA, 64 nt, Human
ucggaguguggccuggauccauccugcuagcaccuccccagacagggcuccagccugucggcca

SEQ ID NO: 331912 - RNA, 64 nt, Human
caagaaaauccccuggaaguacugggggccagguuccccagacagcaggaauugccccuguuca

SEQ ID NO: 331913 - RNA, 64 nt, Human
ccucuccaggagaccuacccuccacaggcacagguccccagaugagaagucugcuacccucauu

SEQ ID NO: 331914 - RNA, 64 nt, Human
ugcagggaccagagaagaccaaagaugccagauguccccagaguuucuugagggcuggguuuca

SEQ ID NO: 331915 - RNA, 64 nt, Human
gaccuccugcagggagccuucugccaccagccccuccccagacucucagguggaggcaacaggg

SEQ ID NO: 331916 - RNA, 64 nt, Human
augucccagauaaaccaggccagacugagaaggcuccccagaggccucuguggccuccacuccg

SEQ ID NO: 331917 - RNA, 64 nt, Human
acagagggagccgguccuugcugcaccugugccguccccagagcuacaggccccaucugguccu

SEQ ID NO: 331918 - RNA, 64 nt, Human
uaaccugugguuuaaagucggcugugaccuccuguccccagagcuguacggcccugcagugggu

SEQ ID NO: 331919 - RNA, 64 nt, Human
aauaaguaauaggaagucaauauaauauagauuauccccagaaaaaaaucaacaaucuucaaac

SEQ ID NO: 331920 - RNA, 64 nt, Human
ggcucacaccaacaaggcaagccaaaggcgccccuccccagagggaucccuaacgugcccagca

SEQ ID NO: 331921 - RNA, 64 nt, Human
ucugccagggagcuugaaaguuuucagaaccucuuccccagaaaggagacuagauugccuuugu

SEQ ID NO: 331922 - RNA, 64 nt, Human
uaacuuggggaggcaagagacugggagccacuucuccccagaaaguguuuaaugguuuuagcuu

SEQ ID NO: 331923 - RNA, 64 nt, Human
agugggcugcagacugagugcugcccuuguagcuuccccagaccccaacucacugcaguucauc

SEQ ID NO: 331924 - RNA, 64 nt, Human
ugaaguuugcguguguuuuuuggugauucauggauccccagaguugauccacaagauaagaaau

SEQ ID NO: 331925 - RNA, 64 nt, Human
gggagcagcuggugccuggccuucggcuccugcguccccagaacccaagggaacgucauggagg

SEQ ID NO: 331926 - RNA, 64 nt, Human
uucccagccucucuuuugccccauucuggaauacuccccagaguuuggggguguucauguuuua

SEQ ID NO: 331927 - RNA, 64 nt, Human
cacccucaugggcauugucucuguuucccagugggguggacaguauaucagauggucagaacaa

SEQ ID NO: 331928 - RNA, 64 nt, Human
uaaugccacuuuaaaugucuuaaauuuguuuccugguggacagccggguaaugcuuuuagcugc

SEQ ID NO: 331929 - RNA, 64 nt, Human
gugacccgcccucuuuaggcugagcuauaagagggguggacacagggugggcugaggucagagg

SEQ ID NO: 331930 - RNA, 64 nt, Human
cuagggacccagaugguuuaaggacaccccagaguccccagaugagcuggcauuugagcugguc

SEQ ID NO: 331931 - RNA, 64 nt, Human
cacauacacgugucugcaggccacaccgugcauguccccagaccugccgccuggcuucuggagu

SEQ ID NO: 331932 - RNA, 64 nt, Human
gagcauccugaaggagccacugcagccgucacuguccccagagccuguggagauagagccuguu

SEQ ID NO: 331933 - RNA, 64 nt, Human
uugucagccucuacgggcagaguccggcauccccuccccagacugccugcugucaaaccacgga

SEQ ID NO: 331934 - RNA, 64 nt, Human
ucauuaggggccagcaucccaggaacuggaccuuuccccagagccuccgccuguggcugugaug

SEQ ID NO: 331935 - RNA, 64 nt, Human
gaguacccauaauacagugagcccacccucgugguccccagacauuucaggaggucgggaaauu

SEQ ID NO: 331936 - RNA, 64 nt, Human
gggucauuuuuaacuacuguauucccacaaggaauccccagauauuuauguaucuugauguuca

SEQ ID NO: 331937 - RNA, 64 nt, Human
aguagcacccucuaaguugugagaacucaaaauguccccagaggaugccagauguccccugggg

SEQ ID NO: 331938 - RNA, 64 nt, Human
ugaaagaccaacacuuuuuaccuaugggaggcaguccccagauuucaaccugaauugugaaaug

SEQ ID NO: 331939 - RNA, 64 nt, Human
accaggguuuuggugaaaaugccggugucccuucuccccagaucccucauuugauacuccaaaa

SEQ ID NO: 331940 - RNA, 64 nt, Human
cccauguccagcaggcgcaggccuggcaacacgguccccagaguccugagcagcaguuaggugc

SEQ ID NO: 331941 - RNA, 64 nt, Human
cauuuucugucgaggcgggccgagucuucccuuauccccagacgccuagcgggcaggguugggc

SEQ ID NO: 331942 - RNA, 64 nt, Human
gccagggugccuccucuaguuaaagucagucaccuccccagaagggccacacuccaggaggagu

SEQ ID NO: 331943 - RNA, 64 nt, Human
guagcacccacaaguggcagacauaucacaagaguccccagacucugccuagaaacaguguuug

SEQ ID NO: 331944 - RNA, 64 nt, Human
uucuggcaccgaguuuauuuuucacuuacuuacuuccccagaccccgggcucgccuccacaaag

SEQ ID NO: 331945 - RNA, 64 nt, Human
ccugaccccugagccucagauuccaauaccucacuccccagagccugaugccggggccccugac

SEQ ID NO: 331946 - RNA, 64 nt, Human
gggguuugcuacuggccuccuacuuuccucccuagguggacagugcuccucuagagagcugcga

SEQ ID NO: 331947 - RNA, 64 nt, Human
uaaaaccaggcaccagcaugaacaccaagcuggggguggacagggcauggauucuucauugcaa

SEQ ID NO: 331948 - RNA, 64 nt, Human
auuauguuugcacuaagauuugcugggagugguagguggacauaucuauauaucaauaaggacu

SEQ ID NO: 331949 - RNA, 64 nt, Human
aauuuuuaugucugauaucaaacacaucuuagacuccccagaauggaauuuaaagauguucagu

SEQ ID NO: 331950 - RNA, 64 nt, Human
ccagauuccuggaugugauggaccagcucagcuguccccagaccccaucccuucuccuuuuccu

SEQ ID NO: 331951 - RNA, 64 nt, Human
gaccuggaacugccagaggauggcggccugggcuuccccagagccaggcgugcgggagagguga

SEQ ID NO: 331952 - RNA, 64 nt, Human
gacacaucuagcugccauugcaaccucacugggcuccccagacucugugugugagaaauuaaac

SEQ ID NO: 331953 - RNA, 64 nt, Human
uccaucaaccagggcagauccaccgugcccugguuccccagacauuccagaaugccccacauca

SEQ ID NO: 331954 - RNA, 64 nt, Human
uccacuuaaggugugucugucacgcaccucauucuccccagacagucuuugaguaacaucuguu

SEQ ID NO: 331955 - RNA, 64 nt, Human
agcaaggugggggucaggcuacaggugccccaccuccccagagcccugcagucacgugaggccc

SEQ ID NO: 331956 - RNA, 64 nt, Human
cuuauuugcacuucaccuuuugaccauaacuguuuccccagagcaggagcuuguggaaauaccu

SEQ ID NO: 331957 - RNA, 64 nt, Human
agcagccaagcccccauucccagagcagacccucuccccagaaggacccgcaggcccuuguuau

SEQ ID NO: 331958 - RNA, 64 nt, Human
cccuagccuuccaaacccagguggccugcccuucuccccagagggaggcggccuccgcccauug

SEQ ID NO: 331959 - RNA, 64 nt, Human
agaagcgggucccugagacgggggguggcugcccuccccagaccaccccggcagccugagcagc

SEQ ID NO: 331960 - RNA, 64 nt, Human
ucucucccaaccuggcugcaaaggagguucauauuccccagauguguccacaaaccuguccagg

SEQ ID NO: 331961 - RNA, 64 nt, Human
agcaagagcagacuguugggccaacaggagaagcuccccagaguaggggagaagguuggggugu

SEQ ID NO: 331962 - RNA, 64 nt, Human
aacuagguacaaugucuaucaggaaagcaaagcuuccccagagacgcucagcuuguauccauug

SEQ ID NO: 331963 - RNA, 64 nt, Human
aaacuacuuaucuuuugaagcuacagcaugugacuccccagagcuccugucuguaggaaguuuc

SEQ ID NO: 331964 - RNA, 64 nt, Human
uauucucuccauagaacagcacuacccuccucucuccccagaugugacuacugaggggaggucu

SEQ ID NO: 331965 - RNA, 64 nt, Human
ccgcccgucucaugcuggacgggaccccugggcggguggacaugagaccacuguuggccaggga

SEQ ID NO: 331966 - RNA, 59 nt, Human
uccuuucugucaagaggugaauaacaguagguggacaaaguuuagggagccacauuuac

SEQ ID NO: 331967 - RNA, 64 nt, Human
auuaaaagcuauauauaaacgguuaacaauauuagguggacauauuuguuugaagagauaggug

SEQ ID NO: 331968 - RNA, 64 nt, Human
uauucucuccauagaacagcacuauccucaucucuccccagaugugacuacugagggcaguucu

SEQ ID NO: 331969 - RNA, 64 nt, Human
cagcuccaagucccucucugagccuuuauugaacuccccagacccacugcucuccuccuuuucc

SEQ ID NO: 331970 - RNA, 64 nt, Human
uauucucugcauagaacagcacuauccucaucucuccccagaugugacuacugagggcaguccu

SEQ ID NO: 331971 - RNA, 64 nt, Human
uuaccucugcauggaacagcauuacccuccucucuccccagaugugacuacugagggcaguucu

SEQ ID NO: 331972 - RNA, 64 nt, Human
agcuccagguguuccaaacucauuaacuaaauucuccccagaaugcuuuuaaauuuuccagggc

SEQ ID NO: 331973 - RNA, 64 nt, Human
gccccagcccauuccucccauucaagauucccacuccccagaggugaccacuuucaacucuuga

SEQ ID NO: 331974 - RNA, 64 nt, Human
gaagucacaaguagagaacauguugcuauaauguuccccagaaaccauuuauuaauugguauga

SEQ ID NO: 331975 - RNA, 64 nt, Human
cguagaugagguacauacacugccgcuucucaaauccccagagccuuuaggaacaggagaguag

SEQ ID NO: 331976 - RNA, 55 nt, Human
cugucuccugggucuauuaggccucuccccagauaucugagcauaacugggagca

SEQ ID NO: 331977 - RNA, 64 nt, Human; identical to SEQ ID NO: 331964

SEQ ID NO: 331978 - RNA, 64 nt, Human
uauucucuccauagaacagcacuacccuccucucuccccagaugugacuacugagggcagaucu

SEQ ID NO: 331979 - RNA, 64 nt, Human
gcuaucccuccccccucccccgaccccaccacaguccccagagugugauauuccccuuccugug

SEQ ID NO: 331980 - RNA, 64 nt, Human
ugugacaugcuuuaaugauaacugcuuuggcaauuccccagacagguauacuucuucauccaaa

SEQ ID NO: 331981 - RNA, 64 nt, Human
gcauggaggggaggaaaggcgucccucuuggcccuccccagaguggcuuuccuggcacccuggc

SEQ ID NO: 331982 - RNA, 64 nt, Human
agccgcggugcccaaccacacuugucggcuccaguccccagaacucugccugcccuuuguccuc

SEQ ID NO: 331983 - RNA, 64 nt, Human
ucucgcucugccugccugcucagaagagguggcuuuggcccagaggcucaggccgggacugaga

SEQ ID NO: 331984 - RNA, 64 nt, Human
aguucaggcuugacacaggagcaaugggcagugagguggacagcccagacccugaaaggacgug

SEQ ID NO: 331985 - RNA, 64 nt, Human
ccaccccuggccugagucccccuccauccgucuugguggacaccuguguggcucucaccugcgu

SEQ ID NO: 331986 - RNA, 64 nt, Human
ccuucacucaaggcauugacagcuuagcugugaggguggacacacauauguguauuuacagugc

SEQ ID NO: 331987 - RNA, 64 nt, Human
ucccacccaccauccugucccccuggggcgggcauuggcccaggugguggagacagagacaggc

SEQ ID NO: 331988 - RNA, 64 nt, Human
gcucagugggcagaauggcaguuagauaugggacuuggcccacagugggggcugcaaaugcugc

SEQ ID NO: 331989 - RNA, 64 nt, Human
ccccgcuuugggcccccuccugugaccucaggguuuggcccauggggcccccccaggccccugc

SEQ ID NO: 331990 - RNA, 64 nt, Human
ugcagagaacucagcuguauguugcccucugaccuuggcccagaccuucagaggcucagucugu

SEQ ID NO: 331991 - RNA, 64 nt, Human
uucuagucugcagcugagcucuggugccuguucuuuggcccacccccuaaucccuaacucuucc

SEQ ID NO: 331992 - RNA, 64 nt, Human
uuguccacaugcuggugaugcugagaaacaauaauuggcccaaaugcagacaucaagaagcagg

SEQ ID NO: 331993 - RNA, 64 nt, Human
cugcauuugagauaaguugccuugauucugacauuuggcccagccuguacuggugugccgcaau

SEQ ID NO: 331994 - RNA, 64 nt, Human
ggaagaauccgaccacuuuccaauccagugccaauuggcccacuaagcauccuaaaggugaaug

SEQ ID NO: 331995 - RNA, 64 nt, Human
uguauuccucaugucaucaaaaccugcgcagucauuggcccaacaagaagguuucuguccuaau

SEQ ID NO: 331996 - RNA, 53 nt, Human
caagacagcuggugccuuaagaauuggcccagccucagauccugucuuuagca

SEQ ID NO: 331997 - RNA, 64 nt, Human
cuauugcuuuuuuguguuuuguuaagcaugucccuuggcccaaauggaagaggaaauguuuaau

SEQ ID NO: 331998 - RNA, 64 nt, Human
agccauguggguacuguaaacacacguuuaucuuuuggcccaaugccauacauaugguaggcau

SEQ ID NO: 331999 - RNA, 64 nt, Human
ggaugaauuguguaaacuuagauccuucucccuuuuggcccaaaagaacccuugauuuaguucc

SEQ ID NO: 332000 - RNA, 64 nt, Human
ggacacuucacgcccuuggccaugggucccauucuuggcccaggauuauugucaaagaagucau

SEQ ID NO: 332001 - RNA, 64 nt, Human
accgaggucuagguacagaacagcuccugagccagguggacaugccagagagaaaagcaguaga

SEQ ID NO: 332002 - RNA, 64 nt, Human
uggacgcccuguugguuuggcuugcuggguuguggguggacacgcaaggaggggauuuuuauuu

SEQ ID NO: 332003 - RNA, 64 nt, Human
aaccgcuaccugugaaaagagcgcagguccaccugguggacacgucugauuagcuuagaaccug

SEQ ID NO: 332004 - RNA, 64 nt, Human
uccagcagccaagugauggccacgcuggggagaagguggacagauuugggaggccccuccugcc

SEQ ID NO: 332005 - RNA, 64 nt, Human
caagggcauuucaggcuccugcugggcugcuucuuuggcccagcugggacuccuauugagacag

SEQ ID NO: 332006 - RNA, 64 nt, Human
gguuggcccucguugggagcagugcccaccuuccuuggcccacagcagauaggucccgagcagc

SEQ ID NO: 332007 - RNA, 64 nt, Human
cccuguuggcagcucuagcuuugcagucguguaauuggcccaagucauuguuuuucucgccuca

SEQ ID NO: 332008 - RNA, 64 nt, Human
cucccacaugaggccaucucaggagauggagggcuuggcccagcgccaaguaaacaggguaccu

SEQ ID NO: 332009 - RNA, 64 nt, Human
ggaguaaaucuuucaauguuauuuucucccauccuuggcccaaggaacuaugcuaagugaaacg

SEQ ID NO: 332010 - RNA, 64 nt, Human
acagaggccaucucucuuccagagagaggcagcauuggcccacaggauaagccucaggcccugg

SEQ ID NO: 332011 - RNA, 64 nt, Human
gaucccacucacuccuggaggcugccccugaggcuuggcccagcucuaggagcaguccccaggg

SEQ ID NO: 332012 - RNA, 64 nt, Human
uuuagagaagugagaguauuuauuuuuggcauguuuggcccaccacacagacucugugugugua

SEQ ID NO: 332013 - RNA, 64 nt, Human
ggcuuuuuuaggcuuagagacagaaacuuuagcauuggcccaguaguggcuucuagcucuaaau

SEQ ID NO: 332014 - RNA, 64 nt, Human
ccucucacaucacaaauucugauaugccaaacauuuggcccaaugagaaugacugauagacuug

SEQ ID NO: 332015 - RNA, 64 nt, Human
uucucccccucacuucaugagucuacaaccuccauuggcccaaagucggcugcaacauugguua

SEQ ID NO: 332016 - RNA, 64 nt, Human
agaggaggcucauaucaccucuucccucuccuacuuggcccagcugcuuggaggaccgacccca

SEQ ID NO: 332017 - RNA, 64 nt, Human
uucccucauagccucuguucucagagaauuggaguuggcccaagaaacauaaacauauaaccac

SEQ ID NO: 332018 - RNA, 64 nt, Human
gaaaagagacuaggauaauacaucuuccacacauuuggcccacugauaauguuaauucucuggc

SEQ ID NO: 332019 - RNA, 64 nt, Human
cuaauuaauggcaggauguuuaggauagucuguagguggacaagaaugcagaucacacaguuuu

SEQ ID NO: 332020 - RNA, 64 nt, Human
agaaaacgcaggagggagacagacuggccaggcugguggacacaggugagaaccaaccccacag

SEQ ID NO: 332021 - RNA, 64 nt, Human
acguuccccuugguuaacugauuuuuuaauccaggguggacauuuuuucaaccuuuauuaaaaa

SEQ ID NO: 332022 - RNA, 64 nt, Human
gguccucuugguaaguguggcccacacccagccugguggacauggaaaggcuucucagccucug

SEQ ID NO: 332023 - RNA, 64 nt, Human
agggcuuaagucauaugugauauuuacaaagcaauuggcccauuuacagagagacauauauaau

SEQ ID NO: 332024 - RNA, 64 nt, Human
gguggauaccaauauucuauuuugcagauagaauuuggcccagagagguuaacuaauauaucca

SEQ ID NO: 332025 - RNA, 64 nt, Human
ggucucaacggcuucccuaaccaccccucuucucuuggcccagccugguuccccccacuuccac

SEQ ID NO: 332026 - RNA, 64 nt, Human
aaggagggggugcuggccaagagccaacacauucuuggcccaggagcauugcuuuucugugaau

SEQ ID NO: 332027 - RNA, 64 nt, Human
cagagaacauuuuauuugcauauaucccuacaaauuggcccauuuuauuggguggggggauaaa

SEQ ID NO: 332028 - RNA, 64 nt, Human
guuugcauuaaugaauaaauucuuccugcauuccuuggcccaguucuggaguuggugaccuuua

SEQ ID NO: 332029 - RNA, 64 nt, Human
ccguagcaccagagcccauucuuccuugucagucuuggcccaaagaugucaccauuccuaguua

SEQ ID NO: 332030 - RNA, 64 nt, Human
ggagaggugagaaaggaagcgucuucuagagacauuggcccaggagcucuguucuuuccuaauc

SEQ ID NO: 332031 - RNA, 64 nt, Human
gcccuugccaacuuuuacccucccaagcaaugcuuuggcccagucgcuggccugaggcuuaccu

SEQ ID NO: 332032 - RNA, 64 nt, Human
uugguuacuucauuuuacaaggaagggguaguaauuggcccacucucuucuuacuggaggcuau

SEQ ID NO: 332033 - RNA, 64 nt, Human
gggagguggucauagagucagggaucuauggcccuuggcccagccccaccuccuucccuuuaau

SEQ ID NO: 332034 - RNA, 64 nt, Human
aguuauggugguggucucaugaagaaaagaccuuuuggcccaaucucugccauaucagugaacc

SEQ ID NO: 332035 - RNA, 64 nt, Human
ucuguuacccaggcuggagugcaguauaccagucuuggcccacuucaaccuccacuucuuaggu

SEQ ID NO: 332036 - RNA, 52 nt, Human
gccuucugcccacucccuagccuuggcccacaccagauccuuggagugaagu

SEQ ID NO: 332037 - RNA, 64 nt, Human
gcucuggcagggggugucuaagccacguccaaaugguggacaguagcuccaacagugacaugac

SEQ ID NO: 332038 - RNA, 64 nt, Human
aguccagucccaccaggacccagacgccucccuggguggacagcaauagaaaagggggcagacg

SEQ ID NO: 332039 - RNA, 64 nt, Human
ugcccccagcacaauuggcagagaugaggcgggugguggacagcugggcugucguggcaggguc

SEQ ID NO: 332040 - RNA, 64 nt, Human
cccacguugugaaugccgcugcaggcaaguuccagguggacacaggugccaaauucuaccgugg

SEQ ID NO: 332041 - RNA, 64 nt, Human
gcugcagugcacuuugaaaugaaguaucuguccuuuggcccagccccugguuugcuuguagaaa

SEQ ID NO: 332042 - RNA, 55 nt, Human
guccuggcacucggacuugaaaagcuuggcccaagggugcgaggggaacuccgag

SEQ ID NO: 332043 - RNA, 64 nt, Human
cccuugaacgugguucaagccaaacuggcagcauuuggcccaaucuccaaauuagagcaaguua

SEQ ID NO: 332044 - RNA, 64 nt, Human
agguuuaggauugcagagaagaugcaagagcacuuuggcccaauucuccagcucaacccagcag

SEQ ID NO: 332045 - RNA, 64 nt, Human
uccuccuuccccacagggcagguggggaagcaguuuggcccagcccaaggagaccccaccuuga

SEQ ID NO: 332046 - RNA, 64 nt, Human
uuucucuuucaagcaucuacaaucuggcaaacccuuggcccaaagacucaccaggugggacgug

SEQ ID NO: 332047 - RNA, 64 nt, Human
cagcuuguguacuaaaguaaugagaauaaaaauguuggcccaaaauuacuuuuauaaauaaaua

SEQ ID NO: 332048 - RNA, 64 nt, Human
cuguguguucgagccauggcaucuuuagagaccauuggcccacugaugaauggaaugaaaaagc

SEQ ID NO: 332049 - RNA, 64 nt, Human
ggggcuggaauaugguguugguuuggcuuucugguuggcccaaucggccuauuggcucaauggg

SEQ ID NO: 332050 - RNA, 64 nt, Human
cuaacugcacugaaaccauuucuaaccacaacccuuggcccaaggacuugguacaggaagggag

SEQ ID NO: 332051 - RNA, 64 nt, Human
gaagggacagugcaucuguucauccauccugcacuuggcccacguugaacuccauggugccuga

SEQ ID NO: 332052 - RNA, 64 nt, Human
ucugucgcccaggcuagaguauaguggugugaucuuggcccacugcaaccucugcuuccuaggu

SEQ ID NO: 332053 - RNA, 64 nt, Human
gucugaccaguggggagauuggaaugggauuacuuuggcccagggaagccccugguucuguccc

SEQ ID NO: 332054 - RNA, 64 nt, Human
cuuucucuuucucucucucuuuuuuuuuccuuuuuuggcccaauguugaagauguagaacuuug

SEQ ID NO: 332055 - RNA, 64 nt, Human
gccaguuugauacccgcuucacacggcagacgccgguggacaguccugaugacacagcccucag

SEQ ID NO: 332056 - RNA, 64 nt, Human
acccuuccaggcagacagccucagcaacgccccugguggacaggaugguucggcaaagcagccu

SEQ ID NO: 332057 - RNA, 64 nt, Human
uuaauuguugugcaguuucauagaugggucaggagguggacaaguuggggccagagaugauggc

SEQ ID NO: 332058 - RNA, 64 nt, Human
uuggcccucuccugucugcccuagggagaaggcagguggacaagggcccaugaaaaaauacagg

SEQ ID NO: 332059 - RNA, 64 nt, Human
cccaggcuggggccacaacccugaauaaacucuguuggcccauaaccuucagcugugagcgggu

SEQ ID NO: 332060 - RNA, 64 nt, Human
agcacuuuuucauacuuuugugaaaguauacauguuggcccagucucucguaucuguaccuuug

SEQ ID NO: 332061 - RNA, 64 nt, Human
aaauguggaggaaaguagaaauuuaccaagguuguuggcccagggcguuaaauucacagauuuu

SEQ ID NO: 332062 - RNA, 64 nt, Human
ucgugaaggcuggcacgugcagcguccuuggcaguuggcccaggaacuggagccacagagcugg

SEQ ID NO: 332063 - RNA, 64 nt, Human
cauaccaggcaguauuaaaaucuaacaggucuguuuggcccauugauagauacucaaauggugu

SEQ ID NO: 332064 - RNA, 64 nt, Human
agagugaaugcuaauuuguagagcgaacuuccauuuggcccauuauuuguaacuguguaacugc

SEQ ID NO: 332065 - RNA, 64 nt, Human
uaacaaucccuuucccagaauuaguuguauaggguuggcccaagagauguaagaaaaaucucgc

SEQ ID NO: 332066 - RNA, 64 nt, Human
uaacagcaucuugccaucuauauguuaguagcaguuggcccagaaaggacaaaaaaaaaaauua

SEQ ID NO: 332067 - RNA, 64 nt, Human
ucacauagacauauuacaucggcuaaaguaagacuuggcccacaaauaccuauuuguugcugaa

SEQ ID NO: 332068 - RNA, 64 nt, Human
uaggcuuauuucuaaaaagucaagucuauuggcuuuggcccaaaagcacugguaucuuuguauu

SEQ ID NO: 332069 - RNA, 64 nt, Human
ugauuaaggauuuauuugaaaauggugggauucauuggcccauagguacauuggaaaauguaua

SEQ ID NO: 332070 - RNA, 64 nt, Human
gguggacagucaccuauccacccucugcauccccuuggcccaucugugcaguaagccuguugga

SEQ ID NO: 332071 - RNA, 64 nt, Human
gcaucuccuaagaguuagggcauuguccuacacauuggcccaguaucacagccaagacgagaag

SEQ ID NO: 332072 - RNA, 64 nt, Human
cacccuguccccauuccaaggggccagcagcacuuuggcccaaaguauuuucuuuaaggugcca

SEQ ID NO: 332073 - RNA, 64 nt, Human
acaaggugcagcuugccaugcagaccuaugagaugguggacaaacacauucggcggcuggacac

SEQ ID NO: 332074 - RNA, 64 nt, Human
cugaaccacguaaagcucgaaccacguggcaagugguggacaaaacuucaacgcaugauauuua

SEQ ID NO: 332075 - RNA, 64 nt, Human
agagccuuucuggaacaaggagaaugccugugcagguggacacacaggccuggccugucgcucu

SEQ ID NO: 332076 - RNA, 64 nt, Human
agacagcagaggggcggcucuguacagugugacugguggacagauggccuuaggcacagguggu

SEQ ID NO: 332077 - RNA, 64 nt, Human
uuacauggauucacaugaacugaaacgccaccacuuggcccaggauguugaaagggugcaaauu

SEQ ID NO: 332078 - RNA, 64 nt, Human
cacggaggacggcgugggcagccugggccugggcuuggcccagggaaacagacggcagacacac

SEQ ID NO: 332079 - RNA, 64 nt, Human
uuuacccccuuacuguguuuugugauuuucauuuuuggcccaauuauuacauaucagguuuucc

SEQ ID NO: 332080 - RNA, 64 nt, Human
auguaaaccugaaauuggugugucugcaaucuguuuggcccaugaccuuuuaccuagucccagu

SEQ ID NO: 332081 - RNA, 64 nt, Human
ccccagcuaggaagaaagaauggcacucuugggcuuggcccagaauuagaguuauuagagcaag

SEQ ID NO: 332082 - RNA, 64 nt, Human
augccuguacuaaggagcaugauuuuaagaggcuuuggcccaaugccuauaaaaugcccauuuc

SEQ ID NO: 332083 - RNA, 64 nt, Human
ugaacgugaggagcagcaguuuuuguucauucauuuggcccaaaaucacguguaggauuugggg

SEQ ID NO: 332084 - RNA, 64 nt, Human
gagcaccaguggcuucgugaguucuugaagcacuuuggcccaaaagaguuaucgcccgggcuag

SEQ ID NO: 332085 - RNA, 64 nt, Human
uaaaaaccuuacaaagaauguauacucaucuuuuuuggcccauuacaauacugcuuucucaggu

SEQ ID NO: 332086 - RNA, 64 nt, Human
aggcaacaaugaaauuaauggauaccgucugcccuuggcccagaauuguuauagcaaaaauuuu

SEQ ID NO: 332087 - RNA, 64 nt, Human
cucaaguucugggcacacaggguuaaugagucucuuggcccacuggucccacuugggggucuag

SEQ ID NO: 332088 - RNA, 64 nt, Human
acuaauuauuagauuauauuuugaaaugaacuuguuggcccaucuauuacaucuacagcugacc

SEQ ID NO: 332089 - RNA, 64 nt, Human
gucacagcugcuguagacagcuguguuccuacaauuggcccagcacccuggggcacgggagaag

SEQ ID NO: 332090 - RNA, 64 nt, Human
cacccaccucccauacgcaaggggauguggauacuuggcccaaaguaacuggugguaggaaucu

SEQ ID NO: 332091 - RNA, 64 nt, Human
ucaucauugaagaguccuaugaguucaagacuacgguggacaaacugaucaagaagacaaaccu

SEQ ID NO: 332092 - RNA, 64 nt, Human
ugugccuugguuuccccaucuguagaauggggaggguggacacuggaaacuagaugacuucuuu

SEQ ID NO: 332093 - RNA, 64 nt, Human
cagccucggagggugggcaaccuggugcuucccggguggacacacaggaccacucaguggggcc

SEQ ID NO: 332094 - RNA, 64 nt, Human
uauccgcuuacgguacaagcugacauucaaccaagguggacagccuuucagcgaaguaggagaa

SEQ ID NO: 332095 - RNA, 64 nt, Human
uuaccaagagaagaagcacauuaucuaugaucuuuuggcccaguucuuauuuagcauuuuuauu

SEQ ID NO: 332096 - RNA, 64 nt, Human
aaguuaaaaaaaaguugaacuuaaaaauaacagauuggcccaugccaaucaaaguauaauagaa

SEQ ID NO: 332097 - RNA, 64 nt, Human
cuggggccccugggcugcguggaaaaagggcucuuuggcccaggagaauugggggguggggggu

SEQ ID NO: 332098 - RNA, 64 nt, Human
auccuggggcccacacaggugugucuugcuccauuuggcccauuguguguuacuuugugaauga

SEQ ID NO: 332099 - RNA, 64 nt, Human
gaaaauccuacuuaguuacugcguuuacaguucuuuggcccagucucugacccuucccaaguau

SEQ ID NO: 332100 - RNA, 64 nt, Human
auagauuuggugugauaccuuguguuugcuuacauuggcccacuauauauacauauauauuuau

SEQ ID NO: 332101 - RNA, 64 nt, Human
uccaaaguuccccggacucaugaauucugggcccuuggcccauucugugcacagccaaggacuu

SEQ ID NO: 332102 - RNA, 64 nt, Human
aacuucucuaagauaagaggccaggccagucaguuuggcccagcaaacauguggguacuucucc

SEQ ID NO: 332103 - RNA, 64 nt, Human
auuuugcucuuucuuugacuucuauagacuaaaguuggcccagcuuuggaaacugguauaacuc

SEQ ID NO: 332104 - RNA, 64 nt, Human
cuuacagaugaacccaacuguggagaugaugcaguuggcccaaccucacugacggugaaaaaau

SEQ ID NO: 332105 - RNA, 64 nt, Human
agacugcauuuuuaaacaaguuaguauuaaugcguuggcccacguagcaaaaagauauuugauu

SEQ ID NO: 332106 - RNA, 64 nt, Human
gagcagauuagacccuccaagaccgccccagggguuggcccaugcuuucccuaacugugcaaaa

SEQ ID NO: 332107 - RNA, 64 nt, Human
acguaaguagcucauuuagcuuuuucugcuguucuuggcccaaguucuuuccaaaaccaacucu

SEQ ID NO: 332108 - RNA, 64 nt, Human
agaaaagcaaaaaugcuaacaagguuuugauagauuggcccaaaauucuaacuugaauauuaag

SEQ ID NO: 332109 - RNA, 64 nt, Human
uguggagucgucacacgccauccagcagcgcuaagguggacaugggauuccucccugcgaugcg

SEQ ID NO: 332110 - RNA, 64 nt, Human
ggugguagauccccuggugucuccaaccugacuagguggacagagcucaaagaggcccucuuac

SEQ ID NO: 332111 - RNA, 52 nt, Human
augacugggucuaugaauaagagguggacacaacagcagucuccuucagcac

SEQ ID NO: 332112 - RNA, 64 nt, Human
cugcccugcaaaaacaccaauggggucuagugcagguggacacuuugaaccacuccucaaaaaa

SEQ ID NO: 332113 - RNA, 64 nt, Human
ugggcaaggaaagaucccuuugcucuaggaaagcuuggcccaaauugauuuucuucuuuuuccc

SEQ ID NO: 332114 - RNA, 64 nt, Human
auuuauuaaaaucaagaauccugugccuguaguguuggcccagagugugguuacugcccugagg

SEQ ID NO: 332115 - RNA, 64 nt, Human
ccgugaauggucucugucaagcgggccgucucccuuggcccagagacggagugugggagugauu

SEQ ID NO: 332116 - RNA, 64 nt, Human
cugcucagcaccgcaagagccauggcugucccuguuggcccagccgggcacucacagggcagaa

SEQ ID NO: 332117 - RNA, 64 nt, Human
cggaagaaggagaaacauugcaguggcuacuguguuggcccaguagaaauugacaguauuuugu

SEQ ID NO: 332118 - RNA, 64 nt, Human
ggacucuaccuguacagagcagcgucccuuugguuuggcccagaggggcgaacaauugcaaggg

SEQ ID NO: 332119 - RNA, 64 nt, Human
ugagaccugacauuuuguccccugccuacauggcuuggcccauggagaaggagcagugaauggg

SEQ ID NO: 332120 - RNA, 64 nt, Human
gggguagucucuuuggcgccaccuaguguccaguuuggcccauggcggggcccauucacggggc

SEQ ID NO: 332121 - RNA, 64 nt, Human
ccguccccggaacugggccacaccacgugcccucuuggcccagccuuccucccagagaggcggc

SEQ ID NO: 332122 - RNA, 64 nt, Human
caauuuucuuuaaauaaucccaaauagaccagaauuggcccauaccauagaagaaagaauuggc

SEQ ID NO: 332123 - RNA, 64 nt, Human
agaaagcagcauuuuuaaauguccguguuaagaauuggcccacugguaccaacucaccucuauu

SEQ ID NO: 332124 - RNA, 64 nt, Human
ugggucaagugcagccagcaauuuauuuucauuguuggcccacgguuaguccauaaucuagagc

SEQ ID NO: 332125 - RNA, 64 nt, Human
auggcauuuucuaacuuaggaagccacaauguucuuggcccaucaugacauuggguagcauuaa

SEQ ID NO: 332126 - RNA, 64 nt, Human
uacucaagugaaccuucaaaaacaaaagccaaauuuggcccacuauggucuuaaugcuaaaugc

SEQ ID NO: 332127 - RNA, 64 nt, Human
uccucuaaccagcaacgugggcagcacagugaaggguggacaaaacucgacugcugcgucuacc

SEQ ID NO: 332128 - RNA, 64 nt, Human
caaugcuaacuuggaccugucaguuaaacucuaagguggacaggguucucaguacuaagcaagg

SEQ ID NO: 332129 - RNA, 64 nt, Human
uugugauuggaagcagucaccugggguuucuggggguggacaguuccucgccacccagcagcac

SEQ ID NO: 332130 - RNA, 64 nt, Human
uguaaauaaggcccaaggaacaugucgggagggggguggacacaaaaaccggccuugcccugca

SEQ ID NO: 332131 - RNA, 64 nt, Human
ccccagccuggcguggcuggggcugggggcagccuuggcccagcuccguggcuguggccugugg

SEQ ID NO: 332132 - RNA, 64 nt, Human
auagacaguaucccuuguccucaagauuuuuaguuuggcccaaguguggccccauuagcgacac

SEQ ID NO: 332133 - RNA, 64 nt, Human
accagugugcacacaaucuggcucaauguauauauuggcccagcaaggcaaagaacugaaguuc

SEQ ID NO: 332134 - RNA, 64 nt, Human
uuuauuuucacauacuuagcuaauuuagcaguaauuggcccaguuuuuucccuaauagaaauac

SEQ ID NO: 332135 - RNA, 64 nt, Human
gacacuaauuucuuuucaacagcgcucaugucucuuggcccagucaggugcugccagguuuaga

SEQ ID NO: 332136 - RNA, 64 nt, Human
caaagucuuaagagugucugaaauccaagacaucuuggcccaauugacacagguucuauauucu

SEQ ID NO: 332137 - RNA, 64 nt, Human
uucuuugcuccuugucagaguugaagaggcugacuuggcccacugcuaagcggcagaggcaggg

SEQ ID NO: 332138 - RNA, 64 nt, Human
gcaaugaggaugaagucacuauccuagaggcugcuuggcccagaagagccaggcacagagcugc

SEQ ID NO: 332139 - RNA, 64 nt, Human
acaguggcugacaagggacuagugagucagcaccuuggcccaggagcucugcgccaggcagagc

SEQ ID NO: 332140 - RNA, 64 nt, Human
accgccaccguggccccgccagcuggccuccccuuuggcccacgccggccgcccccauucucug

SEQ ID NO: 332141 - RNA, 64 nt, Human
ggcggggccugagggugggggcggggccucuucauuggcccagcuuggcgaaagcgaggcacac

SEQ ID NO: 332142 - RNA, 64 nt, Human
cacagguagaaaaaccuauuuaguuaauucuuucuuggcccacagucucccagaaaugauguuu

SEQ ID NO: 332143 - RNA, 64 nt, Human
agcauuaacugaauuuuguuuuucauagacccacuuggcccaaaaccuuucuauauugccugua

SEQ ID NO: 332144 - RNA, 64 nt, Human
cucugggccugcuggcuccucccuuggcuuucccuuggcccacuuccagggcccaggugcugca

SEQ ID NO: 332145 - RNA, 64 nt, Human
gaccugcucucuuccugaagaccuauaagcuggagguggacaacucaauguaaauuucaaggaa

SEQ ID NO: 332146 - RNA, 64 nt, Human
gggaccaggcagguaacauagacgagugacucuggguggacaguggugucaugacccacuucaa

SEQ ID NO: 332147 - RNA, 64 nt, Human
gucaguccagcccaagugcaggggcggaucuggagguggacaaaccuaggucccccuccuagcc

SEQ ID NO: 332148 - RNA, 64 nt, Human
gacaagaucuccuaagaucugugaaugggauuaagguggacaagaucuccuaagaucugaaaag

SEQ ID NO: 332149 - RNA, 64 nt, Human
gccguuugaacuuugagcauuuaucuaaauuaaauuggcccaggguuggcuggugggucaccca

SEQ ID NO: 332150 - RNA, 64 nt, Human
aacuauguuaaaugauccacuaacuuuuuuuuucuuggcccaugauuaauggaauguauguaac

SEQ ID NO: 332151 - RNA, 64 nt, Human
ccaaagcaccauuugcuguccagcugccugucguuuggcccagaccacccucagaaaaaaacca

SEQ ID NO: 332152 - RNA, 64 nt, Human
auuugguauuucagcagcagugugcaauuuuugcuuggcccagagcuucauucuccuggcuuuu

SEQ ID NO: 332153 - RNA, 64 nt, Human
guccuggaacuccccuuggcugccccaggccuccuuggcccaugggugcugggggagguggaug

SEQ ID NO: 332154 - RNA, 64 nt, Human
uucugaucuggcaggcagccaggaucccugacccuuggcccaaccccaccagccuggcccuggg

SEQ ID NO: 332155 - RNA, 64 nt, Human
aguucugagccaacugggguggguggggcagugcuuggcccaggaguuuggccagaagucaagg

SEQ ID NO: 332156 - RNA, 64 nt, Human
ccaaauggaaaaggagaggcuacuucaagugguguuggcccauugagccuauugggcaaacuau

SEQ ID NO: 332157 - RNA, 64 nt, Human
uacaauuucucucuaaagcaagcuuguccaacccuuggcccaggacggcuuugaauauggcccg

SEQ ID NO: 332158 - RNA, 64 nt, Human
aacagggaccagcuccccgggggccaacucacccuuggcccaucccgccuucuccaggcuuccc

SEQ ID NO: 332159 - RNA, 64 nt, Human
aaggucaugggggccuccaguguccugccccugcuuggcccaguuuugauugcuggcaucuugc

SEQ ID NO: 332160 - RNA, 64 nt, Human
ugcaaagaaaggaaaaacacaaauugcccccagauuggcccaguggcaugccauuaggugauuu

SEQ ID NO: 332161 - RNA, 64 nt, Human
gaaguagcacaggcugagugcaggcccacccugcuuggcccagggggcuuccugaggggagaca

SEQ ID NO: 332162 - RNA, 64 nt, Human
aguaacaugugguuuucugccauacuuuucuccauuggcccagguaggcuaauugguaguuguu

SEQ ID NO: 332163 - RNA, 64 nt, Human
uugcacagggguccucugagaccaccuggcgugagguggacacccugggccuuccuggaagccu

SEQ ID NO: 332164 - RNA, 64 nt, Human
uucugcccuggccugcucuggguggugguggauagguggacagacggccagccagccagcugug

SEQ ID NO: 332165 - RNA, 64 nt, Human
ccugcgugcggugaggaggccccgccaagagacugguggacaucugacugugggaugugcucuc

SEQ ID NO: 332166 - RNA, 64 nt, Human
acuuggucugucugucucugucuugguaguugccgguggacagcauggccgugccagccuccca

SEQ ID NO: 332167 - RNA, 64 nt, Human
ccuauguccuaaguuagguguaagguccgaugccuuggcccacacucgagcucucuuuacauug

SEQ ID NO: 332168 - RNA, 64 nt, Human
ggaaccccagcagcuggggcuuuucgagugcuuuuuggcccaagaaucucagagugcuucuaau

SEQ ID NO: 332169 - RNA, 64 nt, Human
ugugauucccuccagugaagcagccuccuuauauuuggcccaaacucaucuugaucaaccaaaa

SEQ ID NO: 332170 - RNA, 64 nt, Human
ucggccccucccuagucccacccacgcucaaccuuuggcccagccaucgccgagauucgagggu

SEQ ID NO: 332171 - RNA, 64 nt, Human
ccaugcuugccgauggaggacagacugcaggaacuuggcccaugugggaaccuagccuguuuug

SEQ ID NO: 332172 - RNA, 64 nt, Human
ucugucccccaggcuggagugcaguggcgcgaucuuggcccaccacgcccgccuaauuuuuugu

SEQ ID NO: 332173 - RNA, 64 nt, Human
gccaggagaaagaaggcuuaacauuaaguauuccuuggcccagcagcggcccagauugcggugu

SEQ ID NO: 332174 - RNA, 64 nt, Human
accucucccaacucuguccagguguucagaccucuuggcccaaccugcucaccccaccggguuc

SEQ ID NO: 332175 - RNA, 64 nt, Human
ccuuguuuugcugucuucaucaucuuaccugugcuuggcccacagucuggcucaugaugugggc

SEQ ID NO: 332176 - RNA, 64 nt, Human
gagauuucucuuugguuuugagguugaagugucuuuggcccauuuguaaguccccaucccuacc

SEQ ID NO: 332177 - RNA, 64 nt, Human
ccuguaucucugaggaagaggagcgaggacaacguuggcccagaugggggcugaaucauucaac

SEQ ID NO: 332178 - RNA, 64 nt, Human
auuagaagccaagacaguggcagcaaaggaagacuuggcccaggaaaaaccuguggguugugcu

SEQ ID NO: 332179 - RNA, 64 nt, Human
ucaggugggguggagucccagagcugcacaggguuuggcccaaguuucuaagggaggcacuucc

SEQ ID NO: 332180 - RNA, 64 nt, Human
uagcauauuuuguuuauuccaagauacauuuuuguuggcccauuugauaucuaugaaaucuaaa

SEQ ID NO: 332181 - RNA, 64 nt, Human
agcuuugggaggucuggggaggagagaggcuuucgguggacacguuugacauuaaaaaaaaaaa

SEQ ID NO: 332182 - RNA, 61 nt, Human
cagcucugcagcuaaugagguccugccacaacggaaagagggaguuaauaaagccauugga

SEQ ID NO: 332183 - RNA, 61 nt, Human
uaugacuguguuaaugaguagugaaaugaugcggaaagacagcuaucaggaagaggaaaua

SEQ ID NO: 332184 - RNA, 61 nt, Human
gauuggaagauagcacucuagaguggacauacggaaagacugugacuuuauuuuguaaugg

SEQ ID NO: 332185 - RNA, 64 nt, Human
guggggaaaggaucugguucauggaauucugaucuuggcccauaggugaaccaccaaaauagug

SEQ ID NO: 332186 - RNA, 64 nt, Human
ucuaauauuaguuauaagguuguggaauuuaugcuuggcccaccuuccaagacuggcacugccc

SEQ ID NO: 332187 - RNA, 63 nt, Human
aggcagcagaaacugaauagguuccagagacuuuuggcccaggaggaauauuuacuuuuagcu

SEQ ID NO: 332188 - RNA, 64 nt, Human
uuuguugucaggcccugagcgcucacagcuucauuuggcccagguugaagacaaggaaagcucu

SEQ ID NO: 332189 - RNA, 64 nt, Human
ucccugaaggcucuaagccuggaacacccugggguuggcccagaaggaggcacaucagucccaa

SEQ ID NO: 332190 - RNA, 64 nt, Human
uggccaggcuggucucgaacuccugaccucgugauuggcccaccucagccucccaaagugcugg

SEQ ID NO: 332191 - RNA, 64 nt, Human
gucggaggcagggagagcaaauuaccacagcuucuuggcccaguucugcccuucuuugcuuugg

SEQ ID NO: 332192 - RNA, 64 nt, Human
ccaggccauggaggcagaauccuggcccucuguguuggcccaagcucuugugguacacacagau

SEQ ID NO: 332193 - RNA, 64 nt, Human
ccaggccccaggcaucuuuccugcccugccuugcuuggcccauccaguccaggcgccuggagca

SEQ ID NO: 332194 - RNA, 64 nt, Human
agcgacccagcagccaccuccuuccugaacacauuuggcccacuccccccaucagccggcucug

SEQ ID NO: 332195 - RNA, 64 nt, Human
cuagugccuuccacccuuuacuccccagagcagcuuggcccagggaggggggaugcugcuuagc

SEQ ID NO: 332196 - RNA, 64 nt, Human
ucugcuggacaaaaggggaacugcaccauggcacuuggcccaugggaaagaggguaugguggug

SEQ ID NO: 332197 - RNA, 64 nt, Human
uuuaugcuugucagagcuggggucucugucuuccuuggcccauguugcauuuaacugaauguca

SEQ ID NO: 332198 - RNA, 64 nt, Human
ggggccccacaggcuccccaggaggcucgugucuuuggcccagagccagccuuaguuugucccu

SEQ ID NO: 332199 - RNA, 64 nt, Human
gaaacuguuuugguauucuugauggaaaaaaacgcagcggaaaugucauuaugaacagauguua

SEQ ID NO: 332200 - RNA, 64 nt, Human
uaugaccucacuuucugcagaugaaguggaugcccagcggaaggaggcaauuaaggcaaaggug

SEQ ID NO: 332201 - RNA, 64 nt, Human
guugguccccuguucagaauggagugcagcccgccagcggaaaguguucauucugcauaggugu

SEQ ID NO: 332202 - RNA, 64 nt, Human
augcauaccucagugcagaaccacagaaucucugcagcggaaacgccgugcaucucuugucugu

SEQ ID NO: 332203 - RNA, 64 nt, Human
ggccaccuugcagggaggacagaaaacuaacauuuuggcccaacuugaucuauacaaaacuuua

SEQ ID NO: 332204 - RNA, 64 nt, Human
uugccaccacagaaagaaagauguuuuuaaaagcuuggcccaaagaauaggaacuuagcuagca

SEQ ID NO: 332205 - RNA, 64 nt, Human
cacugagaggccgucacagccccagaccacccgcuuggcccacgcagcagcagagccgccguuu

SEQ ID NO: 332206 - RNA, 64 nt, Human
uuaacuucuccggucuuguuuuguuuuaaugcucuuggcccagugggugucaagaacacuggcu

SEQ ID NO: 332207 - RNA, 64 nt, Human
aaucccaaaguucccucaaaacugaugugggcacuuggcccagaaguuguuugcuaaugaucag

SEQ ID NO: 332208 - RNA, 64 nt, Human
gagucugggaggaguggaaaucuucaaugaagacuuggcccaaacaccaccugugauguauauu

SEQ ID NO: 332209 - RNA, 64 nt, Human
uuaggcagauucagcuccuuuuaauauuuuucucuuggcccacucucuuugcuuccccugaauc

SEQ ID NO: 332210 - RNA, 64 nt, Human
gccucccagaaccaaggguagccgggcagcugguuuggcccagggccuccuuccacauuaguag

SEQ ID NO: 332211 - RNA, 64 nt, Human
gcuguguguaauggucuugagacaauaucuccauuuggcccacccuggcuucucuaaaaagcaa

SEQ ID NO: 332212 - RNA, 64 nt, Human
guccuuuucuccccaccaccccuccugccccacuuuggcccagaaaccaaaugugaacuuccug

SEQ ID NO: 332213 - RNA, 64 nt, Human
cuucuaaacaagaaauugcagcauauucuucucuuuggcccagagguggguuaaacuguaaggg

SEQ ID NO: 332214 - RNA, 64 nt, Human
aaucugacgucaucuugucucgaagucucuuuuuuuggcccaggccuugaagaauacacuguga

SEQ ID NO: 332215 - RNA, 64 nt, Human
gccaggguauaagaaaagcaucagaacucucagcuuggcccaagguaccuucugugguuccccu

SEQ ID NO: 332216 - RNA, 64 nt, Human
gccuccacuggcauccguguuuccaaaagugccuuuggcccaggcuccacggcgacaguugggc

SEQ ID NO: 332217 - RNA, 64 nt, Human
guguaugcuuuuaacuuugaaauguauaaacacccagcggaaacguauaccuuucagugcauag

SEQ ID NO: 332218 - RNA, 64 nt, Human
acagauguacccacuagcccagguugcugugagucagcggaagcucccguuaugcccuuugcuc

SEQ ID NO: 332219 - RNA, 64 nt, Human
gagcucauccgccguggagagcgaggccacgcaccagcggaagcuccggcagaagcagcugcag

SEQ ID NO: 332220 - RNA, 64 nt, Human
ggaagccaagaaacuggaugccaagaccccaucccagcggaacaaguggcaacagcaggaguua

SEQ ID NO: 332221 - RNA, 64 nt, Human
aggggugccagcaggugcccccacgaguggggccuuggcccaagcagagcuuccccugaaggug

SEQ ID NO: 332222 - RNA, 64 nt, Human
gcagcaacagaagccaagggagaaugcugcugguuuggcccauggcacagccagcuucucugac

SEQ ID NO: 332223 - RNA, 64 nt, Human
agcagauauauuaagugacuguucaagagcacacuuggcccaaguggcagagcuuggacuggau

SEQ ID NO: 332224 - RNA, 64 nt, Human
gagccaggugcaggccauuggagagaaggucuccuuggcccaggccaagauugagaagaucaag

SEQ ID NO: 332225 - RNA, 64 nt, Human
gagcagugcuguuucugcauucauaaugcauuuauuggcccauauuuuuauguaaccuguuaca

SEQ ID NO: 332226 - RNA, 64 nt, Human
ggugcacugccagcgccugucuuacccgguggccuuggcccagaaggagccagaggcagcagcc

SEQ ID NO: 332227 - RNA, 64 nt, Human
gaugcccaggucaccuuacacccagcaacccgccuuggcccacaggcugugcacugcauggucu

SEQ ID NO: 332228 - RNA, 64 nt, Human
uuccaauggauaaguucuaaaacauacgcuaucauuggcccauguugcugaggugcauugugaa

SEQ ID NO: 332229 - RNA, 64 nt, Human
agccugugguggcuacuuuuggucugaaacccacuuggcccaggaaagagaaaagguuguaugu

SEQ ID NO: 332230 - RNA, 64 nt, Human
gacagcaggcauaaggcaccaguuacccugcauguuggcccagaccucaggugcuagggaaggc

SEQ ID NO: 332231 - RNA, 64 nt, Human
uuugucaggucagccucacuugucccuuucacaguuggcccauaaagucauguuucucucccuu

SEQ ID NO: 332232 - RNA, 64 nt, Human
cuuagagacaggacaccuggccaucaaacccaguuuggcccagccugguugggugacuuugugg

SEQ ID NO: 332233 - RNA, 64 nt, Human
gccauggagcuuuucccugcugggugcuccugcuuuggcccagcccaccuuuccuggugcucca

SEQ ID NO: 332234 - RNA, 64 nt, Human
aaaccucugucaacaaagaggggaugaaucacccuuggcccagccuccccacaaagccugaccc

SEQ ID NO: 332235 - RNA, 64 nt, Human
gcagcuuugaguggcagcguggugcuagcagcuucagcggaacagggugagaguuaauuaugca

SEQ ID NO: 332236 - RNA, 64 nt, Human
gggugcucuucccccuccuuauaaauguucaggucagcggaaauguuccuuccucugagagcuc

SEQ ID NO: 332237 - RNA, 64 nt, Human
uuaccauaagucugauucucuuuaacugugugaccagcggaaacaggugugugugaacugggca

SEQ ID NO: 332238 - RNA, 64 nt, Human
cuuccaaggaaacuguuacuucaugucuaacucccagcggaacuggcacgacuccgucaccgcc

SEQ ID NO: 332239 - RNA, 64 nt, Human
aacguccugcgugaaugcagcagccacccccgucuuggcccagguccugggggcugcugaaccc

SEQ ID NO: 332240 - RNA, 64 nt, Human
cugucucccagauccugagacccuggcugagaacuuggcccagccugcugcuuaaaggcaccau

SEQ ID NO: 332241 - RNA, 64 nt, Human
cccguggagacaguauuucuuucugucugucccuuuggcccagacccagccugaccaacgauga

SEQ ID NO: 332242 - RNA, 64 nt, Human
ugggaacgauggcagcugcccaggacccaugugcuuggcccaggcuauguccucgugagaggua

SEQ ID NO: 332243 - RNA, 64 nt, Human
aacuacagggccaaggguccagagaagugauaacuuggcccagggccacacagcagagguagag

SEQ ID NO: 332244 - RNA, 64 nt, Human
cgauaugauucuauaucuagaaaaccccaugaucuuggcccaaaagcuccuagaucugauaaac

SEQ ID NO: 332245 - RNA, 64 nt, Human
uuuuaaucucucgacugaauggacuuugcacacuuuggcccaggguggccacaccucuaucccg

SEQ ID NO: 332246 - RNA, 64 nt, Human
uugucaucuuccagaaaggaaacauauuguauauuuggcccagugugauugauugcuuuaucuu

SEQ ID NO: 332247 - RNA, 64 nt, Human
guuuuccucuguuuuggucucuugggcaacauuuuuggcccaaguuugggcaacauuuggccca

SEQ ID NO: 332248 - RNA, 64 nt, Human
ugggcaacauuuuuggcccaaguuugggcaacauuuggcccaaguuugggcauuuuggcaguag

SEQ ID NO: 332249 - RNA, 64 nt, Human
cccccaggacagggacccucaucugccuuacugguuggcccaagcccugccugacugaccaccc

SEQ ID NO: 332250 - RNA, 64 nt, Human
aacccugaucucucagccccaaacacccacccaauuggcccaacacugucugccccucggggug

SEQ ID NO: 332251 - RNA, 64 nt, Human
gcccugccagggacagguuucucccuggauacucuuggcccaccgcagaucuguagccagucag

SEQ ID NO: 332252 - RNA, 64 nt, Human
uaugcguguccgucugucugucuagugucuggguuuggcccaagacugggcuguaguuacauua

SEQ ID NO: 332253 - RNA, 64 nt, Human
agggagcaacucaggcccccacccaagccugcgucagcggaacuugagugaggggcguugugca

SEQ ID NO: 332254 - RNA, 64 nt, Human
auuaugguaccaaaaauguccaccuucuuuccugcagcggaauaagcuuuuuugaaaugcugag

SEQ ID NO: 332255 - RNA, 61 nt, Human
ccggccacacuuugcauuucaacacucagcccggaaagaugcucguucgguuguuggaccu

SEQ ID NO: 332256 - RNA, 61 nt, Human
cgacuuaaaacuguggagaguggggagaguucggaaagaaauauguuuuuauauauaaaau

SEQ ID NO: 332257 - RNA, 64 nt, Human
ccuccacagggaaaaggcaaggcuuccaggccaguuggcccaggccccuggcagugcucccgga

SEQ ID NO: 332258 - RNA, 64 nt, Human
ggaggggaaauggggaaagcagaacugaagccacuuggcccagaaagcugcggauuggggugau

SEQ ID NO: 332259 - RNA, 64 nt, Human
cugacccuuccacagucauuucuucuagguuuucuuggcccagcacugcccaucccaccccaug

SEQ ID NO: 332260 - RNA, 64 nt, Human
gugagcccucuugcgucuuccaggguagcucagguuggcccaguuugggccaguccauuuuugg

SEQ ID NO: 332261 - RNA, 64 nt, Human
ugagugugacuugggaagcuuucagugcugcuguuuggcccagcucauuacuuucucccuuucu

SEQ ID NO: 332262 - RNA, 64 nt, Human
augccuacugaguauccacuccauaccacagcccuuggcccagccaucugcacccacuuuugcu

SEQ ID NO: 332263 - RNA, 64 nt, Human
agaaggcucguccauuccuccuguguuuuaguauuuggcccagagguuuccuaaaugguugccu

SEQ ID NO: 332264 - RNA, 64 nt, Human
uugcccaugagagccgcugggccuuagagaggccuuggcccagcugaccgguucugaaguaugg

SEQ ID NO: 332265 - RNA, 64 nt, Human
gguggugggaguaccagccccccagcccacccacuuggcccacucagcccauucaccaggcgcu

SEQ ID NO: 332266 - RNA, 64 nt, Human
agaaagaaacccuaugccagguaacaccaaagcuuuggcccagugcccucuguugaaacauccu

SEQ ID NO: 332267 - RNA, 64 nt, Human
cugcccaccugagggcagggagagccugaccccauuggcccaggcccuggcucuguaaccauua

SEQ ID NO: 332268 - RNA, 64 nt, Human
ggccccugucucuggcccccagccucagugccucuuggcccagggccaggcagucgugguugca

SEQ ID NO: 332269 - RNA, 64 nt, Human
agaauguguauccgcggcgcccagaagccucgguuuggcccaccugugaguggggcagggaggg

SEQ ID NO: 332270 - RNA, 64 nt, Human
cucccugggaagccugugccagcaccuuugagccuuggcccacacugaggcuuaggccucucug

SEQ ID NO: 332271 - RNA, 64 nt, Human
gaucccaaaaccccuuuaagaccuuagguuuccucagcggaaaacuguacuuuaaucccaaacc

SEQ ID NO: 332272 - RNA, 61 nt, Human
gucuuuagauuaauacugauuauauagagcacggaaagauaaagaauugaacauuuucuuu

SEQ ID NO: 332273 - RNA, 61 nt, Human
aggagcauuuccucccucugcuauuuauacacggaaagacuuacuacagcgaucuacccau

SEQ ID NO: 332274 - RNA, 61 nt, Human
caaccugcccagcugcugccgcuggaggauccggaaagaguuuccgaagagugaagggcag

SEQ ID NO: 332275 - RNA, 64 nt, Human
gaugguucaaccagaggucugggaaauagcacuguuggcccaaacagaacaggcuuuuagaaga

SEQ ID NO: 332276 - RNA, 64 nt, Human
cuguuuuguguugcgucuuuccuugaauauuuuauuggcccagaguuagccuuucucaauuaug

SEQ ID NO: 332277 - RNA, 64 nt, Human
uggcuguagcacauggcacguuggcuguguggccuuggcccaccugugaguuuaaagcaaggcu

SEQ ID NO: 332278 - RNA, 64 nt, Human
uuuuaaaauagucaaauucauguuuuuaaguaaguuggcccaugcaacauaucucagcauucuu

SEQ ID NO: 332279 - RNA, 64 nt, Human
gccuccaaguuucccugguguagagcuuguguucuuggcccauccuuggagcuuuauaagugac

SEQ ID NO: 332280 - RNA, 64 nt, Human
gggaucucuggagcagggcccuccucucucaggcuuggcccacucccccagacaccuggacacg

SEQ ID NO: 332281 - RNA, 64 nt, Human
ggccguccuuccuucccuucacccucacuggaucuuggcccaaccaaaucccuuguuuuguauu

SEQ ID NO: 332282 - RNA, 64 nt, Human
ucuuccuacugcuuccgucuaucaaaaagcccccuuggcccagguucccugagcugugggauuc

SEQ ID NO: 332283 - RNA, 64 nt, Human
aguuucccagcaaaagucccagggcagacucucauuggcccaaaugggccaugugauuuucucu

SEQ ID NO: 332284 - RNA, 64 nt, Human
gccaaguuggccaccauucuguguaacaccuuuuuuggcccauugggugcuuugauggacauca

SEQ ID NO: 332285 - RNA, 64 nt, Human
uguaagaccuacuggggccagguaagaacaguaauuggcccagacagguaggugugauaaacag

SEQ ID NO: 332286 - RNA, 64 nt, Human
uuccucauccaccgcugcugagucucagaaacacuuggcccaacauagcccuguccagcccagu

SEQ ID NO: 332287 - RNA, 64 nt, Human
agugcauuuauuuuaagcucuuagaagcaacuccuuggcccaggaaugcgugaccccugagaug

SEQ ID NO: 332288 - RNA, 64 nt, Human
uccccggggcucagccucccccugggccgaggccuuggcccacacagcugagggagaggcccag

SEQ ID NO: 332289 - RNA, 64 nt, Human
ccucaugcccuggaauacaacucagagcuccaggcagcggaaccaucuauuguuuuguuugcca

SEQ ID NO: 332290 - RNA, 64 nt, Human
aaggaggcucucgggcugggccuuggagggguggcagcggaaggacagcccagguggcugaggc

SEQ ID NO: 332291 - RNA, 61 nt, Human
cuuggacaugcccgcuugugcccccuaggggcggaaagaagacccgguccugcccgagcuc

SEQ ID NO: 332292 - RNA, 61 nt, Human
gugugacugaguaaagaauuuuuggaucaagcggaaagaguuuaagugucuaacaaacuua

SEQ ID NO: 332293 - RNA, 64 nt, Human
cuccaccuggaccagggauucauguggaguuuccuuggcccagucugugccauuuucucuguga

SEQ ID NO: 332294 - RNA, 64 nt, Human
agaagauggaggaggaaagacauuauacgugggcuuggcccagccccaccgcccacgccugggu

SEQ ID NO: 332295 - RNA, 64 nt, Human
auuuuucuacaacaaauuccaaaagcaaaaguuuuuggcccacauuuucugauuguuacuuuaa

SEQ ID NO: 332296 - RNA, 64 nt, Human
ccuugggcuucccagucuugccuggcucuccuccuuggcccaggagcucaggaucccuggggcu

SEQ ID NO: 332297 - RNA, 64 nt, Human
ugcuggaggggacgcuggcuaaaguggguaggccuuggcccaccugaggccccaggugggaaca

SEQ ID NO: 332298 - RNA, 60 nt, Human
uagguaagcaacguguaugaagaugcugcauuggcccacagaaggcaaaaggugagagga

SEQ ID NO: 332299 - RNA, 64 nt, Human
uuucugaugaguuaggccauggaccugacccaguuuggcccagaggacucugcuggugaccuga

SEQ ID NO: 332300 - RNA, 64 nt, Human
guguucacugcugucuguaguacuuaggaugguguuggcccagaguugguguuugauuaaagua

SEQ ID NO: 332301 - RNA, 64 nt, Human
cagaccucuccuaaaagaauaagaaauucauuguuuggcccauccugaaaggugagguggcgag

SEQ ID NO: 332302 - RNA, 64 nt, Human
uggggaccuaauauagccccacaggacuaugugauuggcccacacaagguuucccaaaaauuug

SEQ ID NO: 332303 - RNA, 64 nt, Human
gcccaguucuaggucguuccccagcaccuccagguuggcccacacagguaccauaagcugccuc

SEQ ID NO: 332304 - RNA, 64 nt, Human
aaaaaagaagaucuaaguaggaugggagaaugauuuggcccacacaaggaagcaacuuuauucu

SEQ ID NO: 332305 - RNA, 64 nt, Human
uacauuucuuccuucaaauccugccacuguuuuguuggcccacaacuaauaggaccucaaaaua

SEQ ID NO: 332306 - RNA, 64 nt, Human
ucagccucuuuggggcacccucucucagccaggcuuggcccacugccaucacccagcaccccag

SEQ ID NO: 332307 - RNA, 61 nt, Human
gugucaucuucacugccaaucaggcaaagaccggaaagauuugcauuuuauuaugucuguc

SEQ ID NO: 332308 - RNA, 61 nt, Human
gauguauauauugugaauuacugcuuaauuacggaaagaguuucuuagguucuaugugaau

SEQ ID NO: 332309 - RNA, 61 nt, Human
ggaaaacaaccaagaaauaacacacggaaaggucagggaauggacagcaauguauuuggag

SEQ ID NO: 332310 - RNA, 64 nt, Human
ugacuacgaccccaguguucacaagcggggauuuuuggcccaagaggaauugcuuccaaaaagg

SEQ ID NO: 332311 - RNA, 64 nt, Human
cccaggccccaaaucagcaauaaugaacaaacccuuggcccagccugggcuggugaccugggca

SEQ ID NO: 332312 - RNA, 64 nt, Human
cugaaagcagaacacuugcucaacaaccuugcuguuggcccaagucuaacacauucuuuaugac

SEQ ID NO: 332313 - RNA, 64 nt, Human
cacccugccuguuagcccugggagaccccuaaccuuggcccaagaccccuuugauucucuaagg

SEQ ID NO: 332314 - RNA, 64 nt, Human
gccugagcugauggaccacuugguguuuugcguuuuggcccauguuugcugccucuaucugguc

SEQ ID NO: 332315 - RNA, 64 nt, Human
ucaugaccacugggccugcuagucugucagggccuuggcccaggggucagcagagcuucagagg

SEQ ID NO: 332316 - RNA, 64 nt, Human
augguagucacuaacauauauaagguaugugcuauuggcccagcuuuuagaaaaugcagucauu

SEQ ID NO: 332317 - RNA, 64 nt, Human
cccgacagcggggcucugggcaucccgggugaccuuggcccaucugccugcauucccacccccu

SEQ ID NO: 332318 - RNA, 64 nt, Human
gcccaccugaauaaacagaaugagcugcagucucuuggcccacagcacuggcuuccccaucuca

SEQ ID NO: 332319 - RNA, 64 nt, Human
cgcccgugggaaggucuuaagcuguaugugcucuuuggcccacaugggccugggguuucguugg

SEQ ID NO: 332320 - RNA, 64 nt, Human
gccaugcuuuuucgguuuguuuuuauuuaucucuuuggcccagccaagcugcccucacuacaga

SEQ ID NO: 332321 - RNA, 64 nt, Human
auagaggguuguggggggucucuaguugaauguuuuggcccaugacuuuggaacauggcuggca

SEQ ID NO: 332322 - RNA, 64 nt, Human
ggcuguuccuucugccaggcaggcccuuccucccuuggcccaaccagcaaagcgccccucaguc

SEQ ID NO: 332323 - RNA, 64 nt, Human
aggaagccacucuuagcccaccagagucugcccuuuggcccaaaauuuaugucugucucaugug

SEQ ID NO: 332324 - RNA, 62 nt, Human
acucucaguaguaaaauaucacacugaauucuuccauacacaggugugcuucuagucagugu

SEQ ID NO: 332325 - RNA, 62 nt, Human
gaggaugguguccuggagucuuguccacccucuccauacaagucucaaaagucauccuccua

SEQ ID NO: 332326 - RNA, 64 nt, Human
accccauuaggaguagauggugcccggccuaucugucagggaggcaaaaaaggcuucaucccau

SEQ ID NO: 332327 - RNA, 64 nt, Human
gaacaucagugcccuaacuuuauccaucauguaggucagggaggacugggcacuauuuggcagg

SEQ ID NO: 332328 - RNA, 64 nt, Human
gacauuggccuggccucguucucucuucuugcccuuggcccagcugggaccaaacucugaucag

SEQ ID NO: 332329 - RNA, 64 nt, Human
cugugucaaccagaagagccaaguguuaucucaauuggcccaguguuucuccaggcuggggacu

SEQ ID NO: 332330 - RNA, 64 nt, Human
aauuuaagucuccaauaauuaauugcauuuuaaauuggcccacuuucaaggcaauuuuuuuugu

SEQ ID NO: 332331 - RNA, 64 nt, Human
ggcuggagcagagcugguuuccuggaauguuccuuuggcccacauaugguucugucccggugag

SEQ ID NO: 332332 - RNA, 64 nt, Human
agucagggucggcuugugaaaaguuguuaaacaacaugcuaaaugugaaaugucaacccucacu

SEQ ID NO: 332333 - RNA, 64 nt, Human
auauauccacaaagcagaugggcaaaaagauuuucaugcuaaucuucaaagguucaugcucaau

SEQ ID NO: 332334 - RNA, 64 nt, Human
auaaagcaccacuucaaggugugguuugacauuacaugcuaaugaacaaacccaguaugcaagu

SEQ ID NO: 332335 - RNA, 64 nt, Human
agcugaucaguaaacgggccauccuacccauuugcaugcuaaaauucucccggccucauccuua

SEQ ID NO: 332336 - RNA, 64 nt, Human
acugauugcccuuuaacagucaauauguuggaggcaugcuaagaauaaacaacuaaauaacugu

SEQ ID NO: 332337 - RNA, 64 nt, Human
uugaccuaagaucaaucugaacuaucuuagcccagucagggagcucugcuuccuagaaaggcau

SEQ ID NO: 332338 - RNA, 64 nt, Human
gcgguaugguauggaaugacuuggaauguaagcugucagggagaaaauguuguuacacuuuugc

SEQ ID NO: 332339 - RNA, 64 nt, Human
aacgugccaggacacuuccugugugccugcaguugucagggaccauuugggaucccgaaucuca

SEQ ID NO: 332340 - RNA, 64 nt, Human
gaugaaccugauuguuacaaggguuacacaaagucaugcuaauucuaucuccaaguaucuugug

SEQ ID NO: 332341 - RNA, 64 nt, Human
guuuauuugauagguaaauauaguuuuauugucacaugcuaaauauugcaugcauauugacuaa

SEQ ID NO: 332342 - RNA, 64 nt, Human
ggauuucuuguucuuaucaagcaagaauuaagcacaugcuaaacgucuuccauuugacuucucu

SEQ ID NO: 332343 - RNA, 64 nt, Human
uuuccccaccccagaaacauguaacgguugguaccaugcuaagcccuugccaugcuaagcccuu

SEQ ID NO: 332344 - RNA, 64 nt, Human
acauguaacgguugguaccaugcuaagcccuugccaugcuaagcccuuuacagucauauccuau

SEQ ID NO: 332345 - RNA, 64 nt, Human
auguguaagaggcaguaucugcacuaauucucaacaugcuaaacauuaacuacaauucacuguu

SEQ ID NO: 332346 - RNA, 64 nt, Human
ugcugaugaacugaaaauuaacaaguaaaaugcacaugcuaagguaguguuuauguguuucuuu

SEQ ID NO: 332347 - RNA, 57 nt, Human
agaagaaagcuucaguuuaacuguuuccaugcuaaacaugauuuauaaccagcucag

SEQ ID NO: 332348 - RNA, 60 nt, Human
agagaaagcagcaaugcuaaaccucuguuucaugcuaaccagacacgccgugcacucguu

SEQ ID NO: 332349 - RNA, 64 nt, Human
cuaguugcuuuuuagcaucucuggucuuaucagccaugcuaaaucacuuuaauuagccuuagug

SEQ ID NO: 332350 - RNA, 64 nt, Human
uaaaacuuaugagugacaucuggaaaguaacaaccaugcuaagauggcaaacacacuggaaaca

SEQ ID NO: 332351 - RNA, 64 nt, Human
gauuauauguacgaaaaucguguaacacuaugcucaugcuaagaaccgacauaacagaauuacu

SEQ ID NO: 332352 - RNA, 64 nt, Human
uccggaggagcaaguccuuuuccaacugggugugcaugcuaaaaaccuguauuuucaugcuuuu

SEQ ID NO: 332353 - RNA, 64 nt, Human
acccugaccaaucacuguggccaggaggaugauacaugcuaauuugcuuauucuauaucaugga

SEQ ID NO: 332354 - RNA, 64 nt, Human
uauuuaacuugagaaagacuaagcgccucuuagugucagggaaguugccucagugcucccagaa

SEQ ID NO: 332355 - RNA, 64 nt, Human
cagaccugagcuggcuuuggaaugagguuaaagugucagggacguugccugagcccaaaugugu

SEQ ID NO: 332356 - RNA, 64 nt, Human
gcaugggaccgugugauuggguccaggcugggcugucagggaagcgcccuggugucuccgacuc

SEQ ID NO: 332357 - RNA, 64 nt, Human
ccuggucuggcugguuuugagggcuugagaaugggucagggacuccaggccaaguccaacagag

SEQ ID NO: 332358 - RNA, 64 nt, Human
caaauaauauuuuccaauccacuucaggccaaaacaugcuaaagauaacacaccagcacauuga

SEQ ID NO: 332359 - RNA, 64 nt, Human
agcugggagaaagagagagcuucuguugcugccucaugcuaagacucaguggggaggggcugug

SEQ ID NO: 332360 - RNA, 64 nt, Human
ucugcuuuuuuucuacuguuuuaauuuauacuggcaugcuaaagccuuccuauuuugcauaaua

SEQ ID NO: 332361 - RNA, 64 nt, Human
uuucugcauucaaaaguguaaugauguacuuauucaugcuaaacuuuuuauaaaaguuuaguug

SEQ ID NO: 332362 - RNA, 64 nt, Human
auuuaguuugacgcuccccaaagugcaugagacacaugcuaaaauuacaaauuaaaauuuuggg

SEQ ID NO: 332363 - RNA, 64 nt, Human
agcaggaaauaccaacugaagucaauuugggggacaugcuaaauaacuauauaagacauuaaga

SEQ ID NO: 332364 - RNA, 64 nt, Human
cagggaaagcaugggcauuuuuguauugcugucacaugcuaacagagguuuguaauuaucuuuu

SEQ ID NO: 332365 - RNA, 64 nt, Human
ugcaugaaaauaguacguugcgggaagaaauugccaugcuaagacuggagcuagacacaaugaa

SEQ ID NO: 332366 - RNA, 64 nt, Human
uuuauuuguggcauuuuuauauaguucucauccacaugcuaaauggaaagacuuuaugaaaucc

SEQ ID NO: 332367 - RNA, 64 nt, Human
ccuagaguuaagagaaccuuaaaagauuaccgcucaugcuaaaaguauguaaagaucccaugua

SEQ ID NO: 332368 - RNA, 64 nt, Human
uugcucccuguauuauuuguuugauacuaggauucaugcuaaacuuuuuaagaauguauuggau

SEQ ID NO: 332369 - RNA, 64 nt, Human
ugcuggaagagguugagaguuuuggaauugauuccaugcuaaaugucaguuaccaguuuggauu

SEQ ID NO: 332370 - RNA, 64 nt, Human
ugaauguucuggcccuucaacaaauucuuuaaaucaugcuaaggaauuucguuuuauguggaca

SEQ ID NO: 332371 - RNA, 64 nt, Human
auaaacauuugcauucuuauucugugccaggcaacaugcuaacugcuguauauauauuauuaua

SEQ ID NO: 332372 - RNA, 64 nt, Human
ugacuggacacccuaugaaaguggguagaccucucagcggaaaauaagaagggcuuuuaccuac

SEQ ID NO: 332373 - RNA, 64 nt, Human
cuuacucacuagaacuucccugugugcugugagccagcggaaccacuuguacaaugccagauuu

SEQ ID NO: 332374 - RNA, 64 nt, Human
cggagacuuagcagguuccaggagugagcgagggcagcggaaaggaguucuuccgggggacacg

SEQ ID NO: 332375 - RNA, 64 nt, Human
guucaccuugccugucgcuagcaagcaucugguucagcggaaaugggaugugagaaugaugaaa

SEQ ID NO: 332376 - RNA, 64 nt, Human
auuccauuuucauguuccaugcauacucgggcaucaugcuaauauguauccuuuuaagcacucu

SEQ ID NO: 332377 - RNA, 64 nt, Human
cugaaaugaauuccuguauacucaacacugugagcaugcuaauguauaugcuggugauucuuau

SEQ ID NO: 332378 - RNA, 64 nt, Human
cacaucuuuaucgccucgaucaaguguggagucacaugcuaaugugugcuaaagaacuguaagu

SEQ ID NO: 332379 - RNA, 64 nt, Human
agauguucucuuacugacugagauguucucuuggcaugcuaaaucauggauaaacugugaacca

SEQ ID NO: 332380 - RNA, 64 nt, Human
ccuccagaguuauguuuacgaauaacaaauugaccaugcuaaacuaaucauguuccaaugaaua

SEQ ID NO: 332381 - RNA, 64 nt, Human
aaggugaaauaagccuacuauaaggaauauaugacaugcuaaauuuuauuuuuaaacgguucuu

SEQ ID NO: 332382 - RNA, 64 nt, Human
gaugcucaccaguuuucuguguacaguaaggcagcaugcuaaaaugcuuuuguucaguucugua

SEQ ID NO: 332383 - RNA, 64 nt, Human
uuacccagauguagaauuuucaucacuaaacaaucaugcuaaagaggaaaggacagugugcuug

SEQ ID NO: 332384 - RNA, 64 nt, Human
auacuuaguacguaggcucacuccuguccuuugucaugcuaaagccaagacacuaguugucaaa

SEQ ID NO: 332385 - RNA, 64 nt, Human
gcaaguaugugguuuaucacauguagcucuuuugcaugcuaaaugaaaauucaaaacuugccaa

SEQ ID NO: 332386 - RNA, 64 nt, Human
caugccacguggccugagaugauucagaacaaaucaugcuaacuuugaauccauccagccacuu

SEQ ID NO: 332387 - RNA, 64 nt, Human
gcucuacuacuugaaugauuuuggaauuuuaugucaugcuaagguauguguuacauauggccaa

SEQ ID NO: 332388 - RNA, 64 nt, Human
auagcuuugcggaggaguuuaauaguuacacauucaugcuaauauacauuuccuuuaaacaucc

SEQ ID NO: 332389 - RNA, 64 nt, Human
uuuuuuucugauagcacuuugaggauauuagauacaugcuaaauauguuuucuacaaagacuua

SEQ ID NO: 332390 - RNA, 64 nt, Human
cgcaaaaacugaagguuugcgcaagagacgaggacagcggaaaguggaccugccaggccgggag

SEQ ID NO: 332391 - RNA, 64 nt, Human
acucguacaguuuuacaaggaucucauggcagaacagcggaagacuugguccguaacucaaggc

SEQ ID NO: 332392 - RNA, 64 nt, Human
uggauggaccgaaucagggacuagaguuuaacugcagcggaacaugucauuucucuauuucugu

SEQ ID NO: 332393 - RNA, 64 nt, Human
auuggcuuggaauguucacaacuugcgugcguggcagcggaagacgauucccauauucuacauu

SEQ ID NO: 332394 - RNA, 64 nt, Human
uaaaaaaauccuuaaugucaacacacuuaaacuacaugcuaaauagucaagaaaaaaauggaaa

SEQ ID NO: 332395 - RNA, 64 nt, Human
cuuuacuaaucaguuguucuaagugugaauauggcaugcuaauuagcuaauuugguagaagcua

SEQ ID NO: 332396 - RNA, 64 nt, Human
gaauacaauaacuuuuaauauugagaagaauguucaugcuaauucuucuuacauuacaaaaggc

SEQ ID NO: 332397 - RNA, 64 nt, Human
cccauauaaaauguaauuuagguuuugcuacuugcaugcuaacauuuuuaauguauuuuaugau

SEQ ID NO: 332398 - RNA, 64 nt, Human
caagucaggaaucauuaauuucaaaauuuaaagccaugcuaaaauuaaaaagaaaauauuaaau

SEQ ID NO: 332399 - RNA, 64 nt, Human
aauuccugguugggauuuggccuccccucucccccaugcuaauuauuuacccuuguaauugugc

SEQ ID NO: 332400 - RNA, 64 nt, Human
cuaagucuuuggaaaauaauuuuucauaauaugucaugcuaauaauaaauauauugauagccaa

SEQ ID NO: 332401 - RNA, 64 nt, Human
ugagauauuuguacauaaaugaaauauguacuuucaugcuaaaauuauauaucaugacugugcu

SEQ ID NO: 332402 - RNA, 64 nt, Human
auuuccaggcugucagcuucuuuguuaauacacccaugcuaaauuucaacagugccacuucugc

SEQ ID NO: 332403 - RNA, 64 nt, Human
uauaggaggagaacaauaaccuaccauccgcaagcaugcuaauuugauggaaguuacaggguau

SEQ ID NO: 332404 - RNA, 64 nt, Human
acugauucucagugaaauuuugugauuaagaggacaugcuaauauuuuguaaagcugggaccag

SEQ ID NO: 332405 - RNA, 64 nt, Human
cauuuuucuaauaaucauaaacuauauucugugacaugcuaauuauuauuaaauguaagucguu

SEQ ID NO: 332406 - RNA, 64 nt, Human
gaacugucugugaacagagagacccuuguggguccaugcuaacaaagacaaaagucugucuuuc

SEQ ID NO: 332407 - RNA, 64 nt, Human
uucaccaaaucuugguugaugccaaaaaaaaauacaugcuaagagaaguagaaaucauagcugg

SEQ ID NO: 332408 - RNA, 64 nt, Human
auauguacuucaauugcuuugcacuuuuccguuucagcggaagaccugaagaguggucagaaca

SEQ ID NO: 332409 - RNA, 64 nt, Human
augcacagacugauaauaaaccucuaaaccugcccagcggaaguguguuuuuuuuuaaauuuaa

SEQ ID NO: 332410 - RNA, 64 nt, Human
cccaucccuccccaguucauugcacuuugauuagcagcggaacaaggagucagacauuuuaaga

SEQ ID NO: 332411 - RNA, 64 nt, Human
uacuuguaagacucuagggguucauuucccauuucagcggaaaguacuucacucaacaacaaua

SEQ ID NO: 332412 - RNA, 64 nt, Human
cagugauuugucaugaaaagccauauaugggggacaugcuaaaauggcuucugaaugaaauacg

SEQ ID NO: 332413 - RNA, 64 nt, Human
cucuuauucccaaacuacagaauaauguguuaaacaugcuaaauaguucuaucaggaaaacaaa

SEQ ID NO: 332414 - RNA, 64 nt, Human
uaauauuucagugccccuugcagaaaaaauauuacaugcuaaauaaauauucuccauauuuuug

SEQ ID NO: 332415 - RNA, 64 nt, Human
aaaguuuuugauauaacuucaauuaauuguaccacaugcuaauccugaagagauguguagaauu

SEQ ID NO: 332416 - RNA, 64 nt, Human
ucagucauuuuccuuagagcuuuauuaaauuaugcaugcuaagauuuaaaggagccccagauaa

SEQ ID NO: 332417 - RNA, 64 nt, Human
cugaggagcuauuucuuaacaugcuuuuauagaccaugcuaaugcuagaccaguauuuaagggc

SEQ ID NO: 332418 - RNA, 64 nt, Human
uguuguuaauauggguaaagugagcccugaaauacaugcuaaacaagacaugaaaugcagaaag

SEQ ID NO: 332419 - RNA, 64 nt, Human
acauguauguucuuguuuguaucauuagcaacaacaugcuaaugacgacaccuagcucuaagag

SEQ ID NO: 332420 - RNA, 64 nt, Human
cagacuucaaaaauuaaagcuagguguauagaaucaugcuaaaagaaaacaugauaacucauag

SEQ ID NO: 332421 - RNA, 64 nt, Human
cuugauacccucugagaugaguggcuuugagugacaugcuaacagcaauuucauaguaaaugua

SEQ ID NO: 332422 - RNA, 64 nt, Human
guacauagggugcuuuauucuccacagagugauacaugcuaagguggguugggcuuggaccgau

SEQ ID NO: 332423 - RNA, 64 nt, Human
uagaucuguguuaauuaguuagcacuccacugcacaugcuaaugacuuccucugacagccacac

SEQ ID NO: 332424 - RNA, 64 nt, Human
gugucuucguuugauuacugccaguuauuuccagcaugcuaaaucccuacccacguuccagccu

SEQ ID NO: 332425 - RNA, 64 nt, Human
guuuauuuaugugauuaaauucuauuaaaauuuacaugcuaaaauaaaauagaccauuuucaaa

SEQ ID NO: 332426 - RNA, 64 nt, Human
caggcaggagccacucaugucuuccccauugcccgacgcccauagacgcuccuuccuguguggg

SEQ ID NO: 332427 - RNA, 64 nt, Human
cagauccuaauuuaugccuaugcaaaaaauaaaugacgcccaagagcugugggauguggcuuuc

SEQ ID NO: 332428 - RNA, 64 nt, Human
cacacacuugcacaccccagcugugagguggcuucagcggaagucugcugaccccuuauauucc

SEQ ID NO: 332429 - RNA, 64 nt, Human
ugcagauggugagagauaagaucuauagccucugcagcggaaucuguucacacccaacuugguu

SEQ ID NO: 332430 - RNA, 64 nt, Human
uggaucaaaauggugcauuacguauuuccugaaacaugcuaaagaagaagacuguaacaucauu

SEQ ID NO: 332431 - RNA, 64 nt, Human
caauaauaugauugauaaaagaauaacauggaaucaugcuaacuuauuuucaaaggaacacuga

SEQ ID NO: 332432 - RNA, 64 nt, Human
gcuguuauggaaaucucuuuuaaagucuugaguacaugcuaaucaauaaucuccacucaugcau

SEQ ID NO: 332433 - RNA, 64 nt, Human
auacaggaaaagaaaagauuuaguaauuucuuaccaugcuaauauguaaaguucaugccaucca

SEQ ID NO: 332434 - RNA, 64 nt, Human
acaucuucccaauauuucaacuuuugaacaaaagcaugcuaaagaaugugguuuaauuuacuau

SEQ ID NO: 332435 - RNA, 64 nt, Human
aguauuuaaaaucauauuuaaauaugaaucuauucaugcuaacauuauuuuucaaaacauacau

SEQ ID NO: 332436 - RNA, 64 nt, Human
agauagcgccugaaauaaacaaaauaugggcaugcaugcuaaagggaaaaugugugcaggucua

SEQ ID NO: 332437 - RNA, 64 nt, Human
ccagcuucuaaagaggaccuucguagccacaaggcaugcuaaaccucuagggucugaugcuguu

SEQ ID NO: 332438 - RNA, 64 nt, Human
cucaaaaagcauguuguaugaagcugacugccaccaugcuaaagcagauucauauuaagaagug

SEQ ID NO: 332439 - RNA, 64 nt, Human
uuuauuuguuguuuucugggggaaaaagccauaucaugcuaaaauucuauagagauagauauug

SEQ ID NO: 332440 - RNA, 64 nt, Human
gcaaaagaugcagauguuauaucacagcaauucucaugcuaaaaauacaacaaaagacaaagca

SEQ ID NO: 332441 - RNA, 64 nt, Human
gacagaucucaauuuuauaguagugggaaagauacaugcuaagaaagcaaauaagcucuauuau

SEQ ID NO: 332442 - RNA, 64 nt, Human
uguauuuauauauaaaaagaaacgucuacguaugcaugcuaaauuauuauuuagcuucucccau

SEQ ID NO: 332443 - RNA, 64 nt, Human
agaaagaaaaaccuacagccuuucuacauucugacaugcuaacagugguuuaaguuucuaaagu

SEQ ID NO: 332444 - RNA, 64 nt, Human
gagcccuucaucgugccgguggagcccgagcggacagcggaauacgaggacuacggcgcagacg

SEQ ID NO: 332445 - RNA, 64 nt, Human
uuagcuuucaauuccguagccagcugcuccccagcagcggaaccgcccaggaucagauugcaug

SEQ ID NO: 332446 - RNA, 64 nt, Human
aggugauggcagggccaggguggccuggggcacccagcggaaugugcuuaguauuuggucacca

SEQ ID NO: 332447 - RNA, 64 nt, Human
ucccccacugcaccccaagagagagagccccagccagcggaacaguuucuauuacccccucccu

SEQ ID NO: 332448 - RNA, 64 nt, Human
acaauuuauauucuuuauugugccuguguguuaccaugcuaagaaugucuuuguuuaaagggaa

SEQ ID NO: 332449 - RNA, 64 nt, Human
ugcaugaaaauagcaugaugcaggaagaaauugccaugcuaagaauagaacuagacacaauaaa

SEQ ID NO: 332450 - RNA, 64 nt, Human
aaaacaucacagcaauaguugcuauacguaagaacaugcuaagcaaauauuuuuccaggcugug

SEQ ID NO: 332451 - RNA, 64 nt, Human
agguguugaaaugcuucucuagcccaaacagcgacaugcuaaaguccccuucuucagagucaau

SEQ ID NO: 332452 - RNA, 64 nt, Human
aaggaaggguagacucacuuagcucagccucacccaugcuaagggcacaugcacacauuuucug

SEQ ID NO: 332453 - RNA, 64 nt, Human
gcuuugcuauggaaaucuuggugguguagcuuuucaugcuaauuuaaagauugcaagagguuuc

SEQ ID NO: 332454 - RNA, 64 nt, Human
gcucaguauuagucuauugcagcuaucucguuuucaugcuaaaauaguuuuuguuaucuugucu

SEQ ID NO: 332455 - RNA, 64 nt, Human
gagacaucaugaccaggagaaaaaugugacuagacaugcuaaccuccagguuuuuauauaugac

SEQ ID NO: 332456 - RNA, 64 nt, Human
acccuuaaacuuuuuuagcauguggucuguuacacaugcuaaaaaauuagucuuacuuguaaca

SEQ ID NO: 332457 - RNA, 64 nt, Human
cuaaaguaauuuccauauccuagauggaaacccucaugcuaaacugucugauuaugcaugguuc

SEQ ID NO: 332458 - RNA, 64 nt, Human
cagacauaaaauuucacuuauuaggaauauguaacaugcuaaaacuuuuuuuuuuuuaaagagu

SEQ ID NO: 332459 - RNA, 64 nt, Human
ugucaguaauaucugcagaaugaaugcagucuuucaugcuaaugaguuagucuggaaaaauaaa

SEQ ID NO: 332460 - RNA, 64 nt, Human
agaaacucccuggguuucccuuuucucuuagccacaugcuaaccaguugcuucucaguguuucu

SEQ ID NO: 332461 - RNA, 64 nt, Human
uaauguuuuguagucacaugggcaagaauuauuacaugcuaagcugguuaguauaaagaaagau

SEQ ID NO: 332462 - RNA, 64 nt, Human
accugcggucagcccuccaugcgcaagacuaaagcagcggaagaggaggugggccucuaggauc

SEQ ID NO: 332463 - RNA, 64 nt, Human
cucagagaaagggggacgggguggggggguggggcagcggaaucuguccuggauggggccagcu

SEQ ID NO: 332464 - RNA, 64 nt, Human
gcacugaauguccccgcgcagagcagagggaaggcagcggaagacgccagcugccagggccugg

SEQ ID NO: 332465 - RNA, 64 nt, Human
guucaccgagaaagggagagggaaucggagggagcagcggaaugcggcgaagacucuggacagc

SEQ ID NO: 332466 - RNA, 64 nt, Human
aagagaagauugaaaaagucuacuguucauaaaccaugcuaacauuuuccuuuuagcuaguuuu

SEQ ID NO: 332467 - RNA, 64 nt, Human
agacugaguaauuuaacaauaaguaaaaaguggacaugcuaaacaaauaugagagacuaccuac

SEQ ID NO: 332468 - RNA, 64 nt, Human
cauaccuuauagcacaggcccagguggaucaucucaugcuaacaccccacaugugcugguggau

SEQ ID NO: 332469 - RNA, 64 nt, Human
agcggggcccagcagcccugggugguuuugccagcaugcuaacucuuguaacucgcagcugcau

SEQ ID NO: 332470 - RNA, 64 nt, Human
gggggagggcuuguuuuauugacauacaacgcagcaugcuaaugggguacaccauugacuucau

SEQ ID NO: 332471 - RNA, 64 nt, Human
gaagaaaguuuacacgacgucaaaaagugacguucaugcuaaguguuuuuccagaaauauuggu

SEQ ID NO: 332472 - RNA, 64 nt, Human
cggagguagguuucaacccagaguuaaugucaagcaugcuaauuuaacuagucacucacagaug

SEQ ID NO: 332473 - RNA, 64 nt, Human
ggaaaacaaacuucaucaagaguaaaugcaguggcaugcuaaguacccaaauaggaguguaugc

SEQ ID NO: 332474 - RNA, 64 nt, Human
agugcuuuguuuacuaaggacuuuggggaggaaccaugcuaagccaugaccagugaggagaagc

SEQ ID NO: 332475 - RNA, 64 nt, Human
ggaucaucaugcagcucaacuuucuguuggauuccaugcuaagcaagcuaaccuuauccugcau

SEQ ID NO: 332476 - RNA, 64 nt, Human
aaaauguucugcuccuauuuuaaauguuuugaaacaugcuaaauauucuuuccuaauuauuuua

SEQ ID NO: 332477 - RNA, 64 nt, Human
cuaugcugauuuuaucaugaaaacugucaugugucaugcuaauggaaaaugucuuauuuguaaa

SEQ ID NO: 332478 - RNA, 64 nt, Human
aguaguaguaguaguuagcagcagcaguaguagucaugcuaauuauauaauauuuuuaauauau

SEQ ID NO: 332479 - RNA, 64 nt, Human
uuuauuacagacauacccucccuuugaaaagggacaugcuaaaagacucauuacuacucagccu

SEQ ID NO: 332480 - RNA, 64 nt, Human
gagcccccaaugaaagccgcaaaccuauacccuugacgcccauaccugccucaguuuccccauc

SEQ ID NO: 332481 - RNA, 64 nt, Human
cacacccucugggcugaguuccuucuuucccuuggacgcccagugcuggccuuggaggacgguc

SEQ ID NO: 332482 - RNA, 64 nt, Human
gacggggcugaggcccugcguggagaugcugcaccagcggaaggcugagacccgcuuaccuuag

SEQ ID NO: 332483 - RNA, 64 nt, Human
cccugcacguugugcacugaccuuugccgaccuccagcggaaccccccagggggcaccagcccc

SEQ ID NO: 332484 - RNA, 64 nt, Human
ucucuccaaauguauuuccauaauguguugaaaacaugcuaacauuuguaugauuuuuauacuu

SEQ ID NO: 332485 - RNA, 64 nt, Human
uucuuuuuuaaaaaagacuauuuuauaugauucacaugcuaaagccaggauuguguuggguuga

SEQ ID NO: 332486 - RNA, 64 nt, Human
agcagaauaaaaacccuacccuuucacuguguaucaugcuaagcugcaucucuacucuugauca

SEQ ID NO: 332487 - RNA, 64 nt, Human
uuuuaaaaguagaaaucaaaaucuggcaccgaagcaugcuaauuguuuacuguaccuugugagg

SEQ ID NO: 332488 - RNA, 64 nt, Human
uugauaggaaggauggcggaaucuuaaagugauacaugcuaacuguagaaaaaaauagaaaaug

SEQ ID NO: 332489 - RNA, 64 nt, Human
aacugggccgccucucugguugacaagcaaaccacaugcuaaggcuuggagcaagagagaauuu

SEQ ID NO: 332490 - RNA, 64 nt, Human
uuaaaaaaucaguauauauuuuaacuuuuugugacaugcuaacacauuuucagaauaauuauug

SEQ ID NO: 332491 - RNA, 64 nt, Human
ccuaggaauucagugagacccugggaaggaccagcaugcuaaucagugucagugaauccacagu

SEQ ID NO: 332492 - RNA, 64 nt, Human
gauauaccauuaucccuuuuauaccuaagaagggcaugcuaauaauuaccacugucaaagaggc

SEQ ID NO: 332493 - RNA, 64 nt, Human
aaguaucucuaauucaauaguugaaagcaaccugcaugcuaaucgugguuucggggugagaaua

SEQ ID NO: 332494 - RNA, 64 nt, Human
aacugccuggcauauacuaaacgcuaaauaaauacaugcuaacugcgaucauuacauuaccuug

SEQ ID NO: 332495 - RNA, 64 nt, Human
cagaacuucaguugaaauuuuuuucacuuuuuagcaugcuaaauauacaucugaguuuaaaugu

SEQ ID NO: 332496 - RNA, 64 nt, Human
uuuuauaacaagguguuuuuuucaagaaauaauccaugcuaaaauggauauuugugauccugaa

SEQ ID NO: 332497 - RNA, 64 nt, Human
acauuuaguaucuaagguuagaaaaccacgcccacaugcuaauauggguguugaaaacuagguu

SEQ ID NO: 332498 - RNA, 64 nt, Human
cugcuccaccccuacucuccucccuugcucccagcagcggaagcgccucugacccuuggcuuga

SEQ ID NO: 332499 - RNA, 64 nt, Human
aaauuuaaguguggcucugugccuaugcucuccccagcggaaagugaccagaagaggugugcag

SEQ ID NO: 332500 - RNA, 54 nt, Human
ugacccugacuuuucagugacugacagcggaaagcccugugcuccauggcugcc

SEQ ID NO: 332501 - RNA, 64 nt, Human
gaaauuaccagaagccucgccuuuuccuaagcaccagcggaaggagcugugccccgggauggag

SEQ ID NO: 332502 - RNA, 64 nt, Human
agacacaagaaucaaaguacaaguugccucaauacaugcuaauaacuaagcuucuauuuucaca

SEQ ID NO: 332503 - RNA, 64 nt, Human
uuuaccugcuugcagcauauuagaacagacgauccaugcuaauauuguauuuucucuuaaaaca

SEQ ID NO: 332504 - RNA, 64 nt, Human
uuuacauucuugguucuauuaagauuuucuuaggcaugcuaacaugccaacaaaaagccaugua

SEQ ID NO: 332505 - RNA, 64 nt, Human
ccuguuuccuccucaauagaauugccacaaacugcaugcuaaauaaagauguaguucuucugga

SEQ ID NO: 332506 - RNA, 64 nt, Human
aaccucuaaaauguuuuuauuuugguaauuuugucaugcuaagcacuuuuguaucugcacaauu

SEQ ID NO: 332507 - RNA, 64 nt, Human
guuaguauuaccuuccuuaaucuuuguucauuaacaugcuaauuccucuucaguguuuauuuuc

SEQ ID NO: 332508 - RNA, 64 nt, Human
aaaggcuauaugggaccuaauaacuuuaaauagacaugcuaauaccgugugcgucagagcuuua

SEQ ID NO: 332509 - RNA, 64 nt, Human
uaacuggaaguaaagcggcaaacagugcuuauuacaugcuaaaguuaccuucucuuuguuuuuu

SEQ ID NO: 332510 - RNA, 64 nt, Human
ugcaugaaaauaguacguugcaggaagaaauugucaugcuaagacuggaacuagacguaaugaa

SEQ ID NO: 332511 - RNA, 64 nt, Human
augauaauaucugagcuuuauuaaguacuuacuacaugcuaagagcuuuuuaagcacuuauuua

SEQ ID NO: 332512 - RNA, 64 nt, Human; identical to SEQ ID NO: 332510

SEQ ID NO: 332513 - RNA, 64 nt, Human
cuuguguuugugugcagagaaguauaugauccaccaugcuaaugacacuugccuuuuuuuccac

SEQ ID NO: 332514 - RNA, 64 nt, Human
agucaggguuggcuugugaaaaguuguuaaacaacaugcuaaaugugaaauguuaacccucuaa

SEQ ID NO: 332515 - RNA, 64 nt, Human
ccuaauuuucaguaagaagugauuaaaauaaugacaugcuaaaaggcaaauuucaagggaagaa

SEQ ID NO: 332516 - RNA, 64 nt, Human
uucaaugugacccuucuggccccucuccuccugacagcggaacaaugacugccccgauagguga

SEQ ID NO: 332517 - RNA, 64 nt, Human
aaggaaugagugcaauuucuaagacuuugaaacucagcggaaucaaucagcuguguuaugccaa

SEQ ID NO: 332518 - RNA, 64 nt, Human
uucuugacuuacuauuuauuuuauccccuuuuaagucagggaugcuuuauucuauuuuaaagca

SEQ ID NO: 332519 - RNA, 64 nt, Human
ucuacauccgcugaagagucucgcuguggccucugucagggaucccugguggaaggggagggga

SEQ ID NO: 332520 - RNA, 64 nt, Human
ucccauacucuguauucgggauccaucugagaugcaugcuaagcuauguguauguuuuuaauuu

SEQ ID NO: 332521 - RNA, 64 nt, Human
aguuuuuguguauauauguguuuauuagacauggcaugcuaagaagguuuuguuuuuuuuuuuu

SEQ ID NO: 332522 - RNA, 64 nt, Human
ccacuccugugucuaccuggccaguggagugguccaugcuaagucuaacacuccugggagcuca

SEQ ID NO: 332523 - RNA, 64 nt, Human
agccagggucgguucaugaaaagcuaugaaacagcaugcuaaaugugaaaugucaacccucacu

SEQ ID NO: 332524 - RNA, 64 nt, Human
ugucuuccaccacaacaacccugggagagaaaaacaugcuaaaggagguaucuuggcuuaauaa

SEQ ID NO: 332525 - RNA, 64 nt, Human
cguucauccacucugccugcuuacacccugcccucaugcuaauauaaguuucuuugcuucacuu

SEQ ID NO: 332526 - RNA, 64 nt, Human
gagaacuggaagccaaccucuaaccuccugaccucaugcuaauaaaaguccccagcuucuggag

SEQ ID NO: 332527 - RNA, 64 nt, Human
aacagcauugccugugcucuccucucaggggcagcaugcuaacggggcgacguccuaauccaac

SEQ ID NO: 332528 - RNA, 64 nt, Human
uugauaacaagcuaaaagcacaacuaaaauuucacaugcuaacgacaacuugaaugaacugcug

SEQ ID NO: 332529 - RNA, 64 nt, Human
aucuacucuauuuacacucccaaauagcgccauacaugcuaaaccguagagaaugagcucgcuu

SEQ ID NO: 332530 - RNA, 64 nt, Human
ugaaagaauggugaacuucucuuagugguauugucaugcuaaaagauguuaauauacaucauaa

SEQ ID NO: 332531 - RNA, 64 nt, Human
agaacuuagacguaugucugagucccugagaucacaugcuaaagucgaugaaaaguaaccacug

SEQ ID NO: 332532 - RNA, 64 nt, Human
aaacuccuuaacucugccuugaccugaggaagaccaugcuaacugguguuauuuuguauguacc

SEQ ID NO: 332533 - RNA, 64 nt, Human
uuuagacaaaaaauagggaugaucacucuuagaccaugcuaauguuacuagagaagaagccuuc

SEQ ID NO: 332534 - RNA, 64 nt, Human
ugcaucggccaaauuggggagggcauggaagauccagcggaaaguugaaaauaaacuggaauga

SEQ ID NO: 332535 - RNA, 64 nt, Human
gacccuucugaagcagagaccggacaagagccugcagcggaagggacucugggcugugccugag

SEQ ID NO: 332536 - RNA, 64 nt, Human
ccuuugaguagagucucccuggaucacauaccaggucagggaggaucuguucuuccucuacguu

SEQ ID NO: 332537 - RNA, 64 nt, Human
uauacuaagaagagcagguauggaaagaucuauugucagggaaucuuagaauucccuacacgag

SEQ ID NO: 332538 - RNA, 64 nt, Human
acaagcucuuguuucuguuuaguccguaaguuaccaugcuaaugaggugcacacaauaacuuag

SEQ ID NO: 332539 - RNA, 64 nt, Human
auugccauccuguugcacugcagcuuguguauagcaugcuaaaauaaauuuuugugugugugug

SEQ ID NO: 332540 - RNA, 64 nt, Human
ugaauguacccugccucugcuuucuccugcaucccaugcuaagcagggucauggucugaacuac

SEQ ID NO: 332541 - RNA, 64 nt, Human
cuucccaacaaugugccccucaccccuugaugcccaugcuaaugguagccacccugguucuugu

SEQ ID NO: 332542 - RNA, 64 nt, Human
aucccccucuccccuuuucugguaacuggaaaagcaugcuaaaaauagucuuauauuuucaccc

SEQ ID NO: 332543 - RNA, 64 nt, Human
uuuuuauauucaacagccaauaaaaaaugcacaacaugcuaagaucaaagcaacaaaaccaacc

SEQ ID NO: 332544 - RNA, 64 nt, Human
ucucauaauuuuaaacagucauugcuuucaagaucaugcuaaacaagaauuaauagagagaaaa

SEQ ID NO: 332545 - RNA, 64 nt, Human
cugaaacagacguuucuuuuaguaagucacaauacaugcuaauuuucauuucuagaauggucac

SEQ ID NO: 332546 - RNA, 64 nt, Human
uaauaaugaccauugacaacuaagaaguagacaccaugcuaaagacuuacauacaaucuccuug

SEQ ID NO: 332547 - RNA, 64 nt, Human
agaauauggcgggugucccaguguucaacaguaucaugcuaauauuccauuugaucgguagucc

SEQ ID NO: 332548 - RNA, 64 nt, Human
agcaucccggacgaugcagagggugggagaacuacaugcuaaauuucuuuuuuuuuuuuuuuga

SEQ ID NO: 332549 - RNA, 64 nt, Human
ggugacagccuggugacuccagaauggagccagucaugcuaaaugccauauacucacacugaaa

SEQ ID NO: 332550 - RNA, 64 nt, Human
uuucgagugugagcuugugcuugugaaagcuaaccaugcuaaccaccaaggcaaagcagcacag

SEQ ID NO: 332551 - RNA, 64 nt, Human
aucacaaguucaagcauucauugacaucagaguccaugcuaaagagaaaucauauacaccuaac

SEQ ID NO: 332552 - RNA, 64 nt, Human
ugucuggugggcauugcucagggucucaaacauggacgcccacuguggggccccagcagcacug

SEQ ID NO: 332553 - RNA, 64 nt, Human
caagcucuggggauggguggggaggggggcgggugacgcccaccuucgggcaguccugugugag

SEQ ID NO: 332554 - RNA, 64 nt, Human
agucuaggauuugaagagucagugaacuuuuagugucagggaauaaacaugguggguagauuag

SEQ ID NO: 332555 - RNA, 64 nt, Human
aaucucucccaccucauccucuggcauggacgcagucagggagucugcuccaagcagacacugg

SEQ ID NO: 332556 - RNA, 64 nt, Human
acaguauuuaaucgcagcaguagcaaacuuuucacaugcuaaugugcagcugagugcacuuuau

SEQ ID NO: 332557 - RNA, 64 nt, Human
gaaauauccauguuguguagaccugugcauacaacaugcuaacuggaaaagaggaaaaaagaaa

SEQ ID NO: 332558 - RNA, 64 nt, Human
aaauagcaacuucugacagcaauaauuuuccaugcaugcuaagccuuuuggccauauuuuguau

SEQ ID NO: 332559 - RNA, 64 nt, Human
uggaugagguugcugugauugagauaguuaaauacaugcuaauuuaaaaaugcagauguuuuac

SEQ ID NO: 332560 - RNA, 64 nt, Human
ugccaucuuggccaccucggccagggcagcccaccaugcuaaaaggaccccaaaugguggucgu

SEQ ID NO: 332561 - RNA, 64 nt, Human
uuuugauagauuuuuguuguuguuguuguugaaacaugcuaaugauugaauuaucuuuuccaaa

SEQ ID NO: 332562 - RNA, 64 nt, Human
uuaccagcccagcuuugccagcccuaauaagaagcaugcuaaagccacagcagcuacugugguu

SEQ ID NO: 332563 - RNA, 64 nt, Human
auucaucugacuguaaaucccaagggccuccgcucaugcuaaauugagaaucuuagggguaaag

SEQ ID NO: 332564 - RNA, 64 nt, Human
gcaaagcacaccucggccgaggccugcgcccugacaugcuaaccucucugaacugcaacacugg

SEQ ID NO: 332565 - RNA, 64 nt, Human
ucacccugcugcacaccaaucuguggcccuucaucaugcuaagaacaagaacugcgccauggcu

SEQ ID NO: 332566 - RNA, 64 nt, Human
gaggcccugagugcaaacucccugggaagagucccaugcuaacaugugcucaaaggagcccucc

SEQ ID NO: 332567 - RNA, 64 nt, Human
ugaaacucccaccuguugcucugagccccacgcgcaugcuaaugcguggaguguaugcgcagag

SEQ ID NO: 332568 - RNA, 64 nt, Human
agauaauuucagcucuuacaacaagaacagaaaacaugcuaauuagaaaaaguccugcuuuaag

SEQ ID NO: 332569 - RNA, 64 nt, Human
agagaaccuucuuuuucucuugacuuugacagcacaugcuaaaaaucucuuccaagaaguaugc

SEQ ID NO: 332570 - RNA, 64 nt, Human
ucugcucugcugcucugaccuuccagagcccaaggucagggaggggcaaccaacugccccaggg

SEQ ID NO: 332571 - RNA, 64 nt, Human
ccauucuuaggccacacuggugucacaagcuccugucagggagcugggguuugggaaugugcuu

SEQ ID NO: 332572 - RNA, 64 nt, Human
gaggucuucacuugcugugaaugacguauccccagucagggacuuaagagaggcacugugauau

SEQ ID NO: 332573 - RNA, 64 nt, Human
gaaguuuucuuuguggggcuggggaggggccggggucagggagagucuuuuuuuuuuuuuuuuu

SEQ ID NO: 332574 - RNA, 64 nt, Human
cagcccacagcccuucauguggacucugucaugacaugcuaacuagacuucaggggagccacuu

SEQ ID NO: 332575 - RNA, 64 nt, Human
cuuguuacauuacucuuugugauuuucuaauaaccaugcuaaguguauuuccacagugagcuuu

SEQ ID NO: 332576 - RNA, 64 nt, Human
aauuuucucucucucucucucauaacauacuauacaugcuaauugccaagauuugaaugaguca

SEQ ID NO: 332577 - RNA, 64 nt, Human
caugccgugggaucaugggcagggaaggcucugggggucggagacaccgcugcuuagcaccccc

SEQ ID NO: 332578 - RNA, 64 nt, Human
cauucaagaaagcaagaggggacaacaaugggaggggucggagcucuuccuuccccucugugga

SEQ ID NO: 332579 - RNA, 64 nt, Human
gucggggcucugugccagcuuacucuucacuccagggucggaugccacgugcuacaggacaugg

SEQ ID NO: 332580 - RNA, 64 nt, Human
agaugccgccagaugcccagccuacagccucucagggucggaucggagcacgccugccucccuc

SEQ ID NO: 332581 - RNA, 64 nt, Human
aagacccagaguuaaaugcagauguccacacgaggggucggaguuaccugaucacaucgagaga

SEQ ID NO: 332582 - RNA, 64 nt, Human
gcuccaugcccgcccauccccuugccgccugacugggucggauggccccaguggguuuagucag

SEQ ID NO: 332583 - RNA, 64 nt, Human
ccccagccuggccagacaagaagacugucaggaagggucggagucuguaaaaccagcauacagu

SEQ ID NO: 332584 - RNA, 64 nt, Human
ccucuucuggcucaaaaagagaauugggggcuuagggucggaacccaagcuuagaacuuuaagc

SEQ ID NO: 332585 - RNA, 64 nt, Human
cuguccucaggacggaacuugggugcagcucagugggucggaagagaaggcgguggccuguggg

SEQ ID NO: 332586 - RNA, 64 nt, Human
ggaaauccugucuuuccaaaaguccaaggagcgcgggucggaggagacaaacucuuuggaaaua

SEQ ID NO: 332587 - RNA, 64 nt, Human
gugcuggcggacgcagcugggugcagaagcuguggggucggagaggcguuuggagaaggucugu

SEQ ID NO: 332588 - RNA, 64 nt, Human
augaaagugaucauacugggcaggcguuggcguggggucggacaccccagcccuuucucccuca

SEQ ID NO: 332589 - RNA, 64 nt, Human
ccagagcugcuggaaaccagcacacgcaaaagaugacgcccagcacagcagcaggacacaccau

SEQ ID NO: 332590 - RNA, 64 nt, Human
uggcccuucuuuacagauguagauagcaggguaggacgcccaggccuucucacaugggcaccau

SEQ ID NO: 332591 - RNA, 64 nt, Human
uucuuuaguuuggaaagaccugugaaguauccuagucagggaaagaaccuguuuucuggaagaa

SEQ ID NO: 332592 - RNA, 64 nt, Human
uccuuauuaauaaaacacacaaugccuagcuggggggucggaaggcaaaugcccuagauggugg

SEQ ID NO: 332593 - RNA, 64 nt, Human
cuuuccauacaacaggugaagauaacgagacuuugggucggaugcaggggcucacaccgguaau

SEQ ID NO: 332594 - RNA, 64 nt, Human
guccgaaaagaaaaggaccuugauucugagcccagggucggaacccauugcuucagaagaguug

SEQ ID NO: 332595 - RNA, 64 nt, Human
gguccuucggggcugcgccgccggcuuccuggaggggucggaggugaggcugcagccccugcgg

SEQ ID NO: 332596 - RNA, 64 nt, Human
cgcuggaacggaggcugcccucugcugccuguuggggucggaagacaaggggcuucugaaaugg

SEQ ID NO: 332597 - RNA, 64 nt, Human
uggcccagcccuggugacagggccccaggggugggggucggagagcgaggagaagguugucacc

SEQ ID NO: 332598 - RNA, 64 nt, Human
gugggaggauacugcccccuugugggggccagacgggucggacacggcugugccccaucugggg

SEQ ID NO: 332599 - RNA, 64 nt, Human
guggaaggaagaacugucacccucuuaaggcccagggucggagcccagggccucucccuuccug

SEQ ID NO: 332600 - RNA, 64 nt, Human
uugucagccuugcuacuugaagguacaccccauagggucggaggugcuguccccacugccccac

SEQ ID NO: 332601 - RNA, 64 nt, Human
aacaagccgaaugaggaguuuuuauaagauugcggggucggagugugggcgcguaauaggaauc

SEQ ID NO: 332602 - RNA, 64 nt, Human
agcccaguaccgcuggaagugaauaaacuccggagggucggacgggaccugggcucucuccacg

SEQ ID NO: 332603 - RNA, 64 nt, Human
gucagccucacccuucgugugcacccgcaugggagggucggagggugcugcccgcccuuggugc

SEQ ID NO: 332604 - RNA, 64 nt, Human
aacagccuuggaacuccagcugccaccacccucugggucggacacugggacccacuggcccagu

SEQ ID NO: 332605 - RNA, 64 nt, Human
gcaggccaggcagcauccacaguguuaguccaaagggucggaccgugucgucagccuagcguuu

SEQ ID NO: 332606 - RNA, 64 nt, Human
cccagacuagaccaaauagccagaaaaaugauaggggucggauggguggguaagcccaggauuu

SEQ ID NO: 332607 - RNA, 64 nt, Human
cuucugccaaaugcagagagggaggccagugucagggucggaguggccuggcucuuagcacuga

SEQ ID NO: 332608 - RNA, 64 nt, Human
agcggguagggcgauaauuuauauauuuuccacagucagggaaggacucucacuuauuuguuuc

SEQ ID NO: 332609 - RNA, 58 nt, Human
uuccucagaagaacucguaagagcagcugucagggaggcccagucacaguccagcaau

SEQ ID NO: 332610 - RNA, 64 nt, Human
gccauuuuaaggagaggaaagagaaaacucuggggucagggagagacccuacccccaccuaauu

SEQ ID NO: 332611 - RNA, 64 nt, Human
cucucccacaucccacuggaucuggcuuacaggggggucggaagccuguccucaccgucucggg

SEQ ID NO: 332612 - RNA, 64 nt, Human
gcucucaacuguccuggagagcagaggcuauuuggggucggaggagcccucgauaccugcgaau

SEQ ID NO: 332613 - RNA, 64 nt, Human
ggguucugccucccauccccucuaccugcagacagggucggagguguuagcgagccuuuggugc

SEQ ID NO: 332614 - RNA, 64 nt, Human
uuuguuuguuuguuuguuuuuaaagaucuccucagggucggacuucauuuuguacugugggcug

SEQ ID NO: 332615 - RNA, 64 nt, Human
aucugcccaguccuugacucguccauggagcugagggucggaggaaccuuccuugggggcagca

SEQ ID NO: 332616 - RNA, 64 nt, Human
ugggugggucccagaagugaucuuugugucgcucgggucggaacucuuuaggccucuggccucc

SEQ ID NO: 332617 - RNA, 64 nt, Human
ugggcaaauucccuuucuuugcauccacaauguggggucggagcuugggggcagguccugggag

SEQ ID NO: 332618 - RNA, 64 nt, Human
uacuucagaaaccaaaucagucuucuauaaucuggggucggagggagucccugugcccaagguc

SEQ ID NO: 332619 - RNA, 64 nt, Human
ccugcccagcccugccuccuggccaugccgggaggggucggauccucuaggcaucgccuucaca

SEQ ID NO: 332620 - RNA, 64 nt, Human
ggccacugcccucuguccaucucuugcagugguggggucggacgccguggacucugcacagucc

SEQ ID NO: 332621 - RNA, 64 nt, Human
ucacccguggugcccacagugccgacccguggcugggucggagcuccauguuccuaagcuaggu

SEQ ID NO: 332622 - RNA, 64 nt, Human
uccagagacccugagccuacagcaaggcuguggugggucggauggucuuuggaugugucagcuu

SEQ ID NO: 332623 - RNA, 64 nt, Human
uggcuugcacugaacccucgaggaccugggcacggggucggauggacacacagccagaccguaa

SEQ ID NO: 332624 - RNA, 64 nt, Human
gaacucuuauccuuccugugguuuggugccgacugggucggaucugggcuuagaguaauagcuu

SEQ ID NO: 332625 - RNA, 64 nt, Human
aguggaauaagccuuacgggugaagcucagagaagggucggaucugagagaauggggaggccug

SEQ ID NO: 332626 - RNA, 64 nt, Human
ugaagagcagagaaugccaugggugggacugugggggucggaucgugggguuguuggcagaggg

SEQ ID NO: 332627 - RNA, 64 nt, Human
guggggaguucuagauugaucucugaaugugaucgacgcccagcaaggacaagcuuuaaaaugu

SEQ ID NO: 332628 - RNA, 64 nt, Human
ggcacgugcacugcuuuaccugugcugccugcaagacgcccauccggaacagggccuucuacau

SEQ ID NO: 332629 - RNA, 64 nt, Human
gagugacugaggcccuagggcaugggagaggagggacgcccaggguggggaggaagagucugca

SEQ ID NO: 332630 - RNA, 64 nt, Human; identical to SEQ ID NO: 128494

SEQ ID NO: 332631 - RNA, 64 nt, Human; identical to SEQ ID NO: 128495

SEQ ID NO: 332632 - RNA, 64 nt, Human; identical to SEQ ID NO: 128496

SEQ ID NO: 332633 - RNA, 64 nt, Human; identical to SEQ ID NO: 128497

SEQ ID NO: 332634 - RNA, 64 nt, Human; identical to SEQ ID NO: 128498

SEQ ID NO: 332635 - RNA, 64 nt, Human; identical to SEQ ID NO: 128499

SEQ ID NO: 332636 - RNA, 64 nt, Human; identical to SEQ ID NO: 128500

SEQ ID NO: 332637 - RNA, 64 nt, Human; identical to SEQ ID NO: 128501

SEQ ID NO: 332638 - RNA, 64 nt, Human; identical to SEQ ID NO: 128502

SEQ ID NO: 332639 - RNA, 64 nt, Human; identical to SEQ ID NO: 128503

SEQ ID NO: 332640 - RNA, 64 nt, Human; identical to SEQ ID NO: 128504

SEQ ID NO: 332641 - RNA, 64 nt, Human; identical to SEQ ID NO: 128505

SEQ ID NO: 332642 - RNA, 64 nt, Human; identical to SEQ ID NO: 128506

SEQ ID NO: 332643 - RNA, 64 nt, Human; identical to SEQ ID NO: 128507

SEQ ID NO: 332644 - RNA, 64 nt, Human; identical to SEQ ID NO: 128508

SEQ ID NO: 332645 - RNA, 64 nt, Human
ggcagggaucccccagaucugucuggucugaauggacgcccagcucaucuaggguggacccagc

SEQ ID NO: 332646 - RNA, 64 nt, Human
agcggcccucacuuguggucaguauaucaguuaugacgcccauugcccagcuucaguccaucca

SEQ ID NO: 332647 - RNA, 64 nt, Human
gccggugagaguagagucggaggcggagagccuggacgcccagaggccggggccaggcucuggg

SEQ ID NO: 332648 - RNA, 64 nt, Human; identical to SEQ ID NO: 128509

SEQ ID NO: 332649 - RNA, 64 nt, Human; identical to SEQ ID NO: 128510

SEQ ID NO: 332650 - RNA, 53 nt, Human; identical to SEQ ID NO: 128511

SEQ ID NO: 332651 - RNA, 64 nt, Human; identical to SEQ ID NO: 128512

SEQ ID NO: 332652 - RNA, 62 nt, Human; identical to SEQ ID NO: 128513

SEQ ID NO: 332653 - RNA, 64 nt, Human; identical to SEQ ID NO: 128514

SEQ ID NO: 332654 - RNA, 64 nt, Human; identical to SEQ ID NO: 128515

SEQ ID NO: 332655 - RNA, 64 nt, Human; identical to SEQ ID NO: 128516

SEQ ID NO: 332656 - RNA, 64 nt, Human; identical to SEQ ID NO: 128517

SEQ ID NO: 332657 - RNA, 64 nt, Human; identical to SEQ ID NO: 128518

SEQ ID NO: 332658 - RNA, 64 nt, Human; identical to SEQ ID NO: 128519

SEQ ID NO: 332659 - RNA, 64 nt, Human; identical to SEQ ID NO: 128520

SEQ ID NO: 332660 - RNA, 64 nt, Human; identical to SEQ ID NO: 128521

SEQ ID NO: 332661 - RNA, 64 nt, Human; identical to SEQ ID NO: 128522

SEQ ID NO: 332662 - RNA, 64 nt, Human; identical to SEQ ID NO: 128523

SEQ ID NO: 332663 - RNA, 64 nt, Human; identical to SEQ ID NO: 128524

SEQ ID NO: 332664 - RNA, 64 nt, Human
ugagggccccgggcaguugcccuggccgcccagugacgcccaccggcucccuccgcucccuccu

SEQ ID NO: 332665 - RNA, 64 nt, Human
ccucccuggguggacagcaauagaaaagggggcagacgcccaggaagugaccuucuccuggaug

SEQ ID NO: 332666 - RNA, 64 nt, Human
uaaaaaugcagaaauuuacccaggcacggcggcggacgcccaucaucccagcuacuugggaggc

SEQ ID NO: 332667 - RNA, 64 nt, Human; identical to SEQ ID NO: 128525

SEQ ID NO: 332668 - RNA, 63 nt, Human; identical to SEQ ID NO: 128526

SEQ ID NO: 332669 - RNA, 64 nt, Human; identical to SEQ ID NO: 128527

SEQ ID NO: 332670 - RNA, 64 nt, Human; identical to SEQ ID NO: 128528

SEQ ID NO: 332671 - RNA, 64 nt, Human; identical to SEQ ID NO: 128529

SEQ ID NO: 332672 - RNA, 64 nt, Human; identical to SEQ ID NO: 128530

SEQ ID NO: 332673 - RNA, 64 nt, Human; identical to SEQ ID NO: 128531

SEQ ID NO: 332674 - RNA, 64 nt, Human; identical to SEQ ID NO: 128532

SEQ ID NO: 332675 - RNA, 64 nt, Human; identical to SEQ ID NO: 128533

SEQ ID NO: 332676 - RNA, 64 nt, Human; identical to SEQ ID NO: 128534

SEQ ID NO: 332677 - RNA, 64 nt, Human; identical to SEQ ID NO: 128535

SEQ ID NO: 332678 - RNA, 64 nt, Human; identical to SEQ ID NO: 128536

SEQ ID NO: 332679 - RNA, 64 nt, Human; identical to SEQ ID NO: 128537

SEQ ID NO: 332680 - RNA, 64 nt, Human; identical to SEQ ID NO: 128538

SEQ ID NO: 332681 - RNA, 64 nt, Human; identical to SEQ ID NO: 128539

SEQ ID NO: 332682 - RNA, 64 nt, Human; identical to SEQ ID NO: 128540

SEQ ID NO: 332683 - RNA, 64 nt, Human
gucaccccauuuccccagccagacacacucccaugacgcccacagcugccccuuugcccccagc

SEQ ID NO: 332684 - RNA, 64 nt, Human
agcuccuggggcguccaggccgcgcccuuuccccgacgcccacccaaccccaagccagcccggc

SEQ ID NO: 332685 - RNA, 64 nt, Human
caccgccugcacugccaugaccuggaggcagacagacgcccaccugcuccccgaccucgaggcc

SEQ ID NO: 332686 - RNA, 64 nt, Human; identical to SEQ ID NO: 128541

SEQ ID NO: 332687 - RNA, 64 nt, Human; identical to SEQ ID NO: 128542

SEQ ID NO: 332688 - RNA, 64 nt, Human; identical to SEQ ID NO: 128543

SEQ ID NO: 332689 - RNA, 64 nt, Human; identical to SEQ ID NO: 128544

SEQ ID NO: 332690 - RNA, 64 nt, Human; identical to SEQ ID NO: 128545

SEQ ID NO: 332691 - RNA, 64 nt, Human; identical to SEQ ID NO: 128546

SEQ ID NO: 332692 - RNA, 64 nt, Human; identical to SEQ ID NO: 128547

SEQ ID NO: 332693 - RNA, 64 nt, Human; identical to SEQ ID NO: 128548

SEQ ID NO: 332694 - RNA, 64 nt, Human; identical to SEQ ID NO: 128549

SEQ ID NO: 332695 - RNA, 64 nt, Human; identical to SEQ ID NO: 128550

SEQ ID NO: 332696 - RNA, 64 nt, Human; identical to SEQ ID NO: 128551

SEQ ID NO: 332697 - RNA, 64 nt, Human; identical to SEQ ID NO: 128552

SEQ ID NO: 332698 - RNA, 64 nt, Human; identical to SEQ ID NO: 128553

SEQ ID NO: 332699 - RNA, 64 nt, Human; identical to SEQ ID NO: 128554

SEQ ID NO: 332700 - RNA, 64 nt, Human; identical to SEQ ID NO: 128555

SEQ ID NO: 332701 - RNA, 64 nt, Human; identical to SEQ ID NO: 128556

SEQ ID NO: 332702 - RNA, 64 nt, Human
cagaaacguauugcucacaguccuggggggcugggacgcccaagaucaagaggccagcagauuc

SEQ ID NO: 332703 - RNA, 64 nt, Human
cugaagccauaauccccaaccauuucccuuggcugacgcccagguacucagcuggcccacucca

SEQ ID NO: 332704 - RNA, 64 nt, Human
guccauccuuuccccaucccugccuccugccccugacgcccauuuccccccuuagagcagcgaa

SEQ ID NO: 332705 - RNA, 64 nt, Human; identical to SEQ ID NO: 128557

SEQ ID NO: 332706 - RNA, 64 nt, Human; identical to SEQ ID NO: 128558

SEQ ID NO: 332707 - RNA, 64 nt, Human; identical to SEQ ID NO: 128559

SEQ ID NO: 332708 - RNA, 64 nt, Human; identical to SEQ ID NO: 128560

SEQ ID NO: 332709 - RNA, 64 nt, Human; identical to SEQ ID NO: 128561

SEQ ID NO: 332710 - RNA, 64 nt, Human; identical to SEQ ID NO: 128562

SEQ ID NO: 332711 - RNA, 64 nt, Human; identical to SEQ ID NO: 128563

SEQ ID NO: 332712 - RNA, 64 nt, Human; identical to SEQ ID NO: 128564

SEQ ID NO: 332713 - RNA, 64 nt, Human; identical to SEQ ID NO: 128565

SEQ ID NO: 332714 - RNA, 64 nt, Human; identical to SEQ ID NO: 128566

SEQ ID NO: 332715 - RNA, 58 nt, Human; identical to SEQ ID NO: 128567

SEQ ID NO: 332716 - RNA, 64 nt, Human; identical to SEQ ID NO: 128568

SEQ ID NO: 332717 - RNA, 64 nt, Human; identical to SEQ ID NO: 128569

SEQ ID NO: 332718 - RNA, 64 nt, Human; identical to SEQ ID NO: 128570

SEQ ID NO: 332719 - RNA, 64 nt, Human; identical to SEQ ID NO: 128571

SEQ ID NO: 332720 - RNA, 64 nt, Human; identical to SEQ ID NO: 128572

SEQ ID NO: 332721 - RNA, 64 nt, Human
acacgcucccuggaagcuggaagacugugcagaagacgcccauucggacugcugugccgcgucc

SEQ ID NO: 332722 - RNA, 64 nt, Human
ucuguucaaauugugggguuuuuguuacaguuaggacgcccaugaagauuuaggggugaaaaaa

SEQ ID NO: 332723 - RNA, 64 nt, Human
gaaggaggcaggacagaggcaccgaggccagggagacgcccaacgaggcagcccugggcucuuc

SEQ ID NO: 332724 - RNA, 64 nt, Human; identical to SEQ ID NO: 128573

SEQ ID NO: 332725 - RNA, 64 nt, Human; identical to SEQ ID NO: 128574

SEQ ID NO: 332726 - RNA, 64 nt, Human; identical to SEQ ID NO: 128575

SEQ ID NO: 332727 - RNA, 64 nt, Human; identical to SEQ ID NO: 128576

SEQ ID NO: 332728 - RNA, 64 nt, Human; identical to SEQ ID NO: 128577

SEQ ID NO: 332729 - RNA, 64 nt, Human; identical to SEQ ID NO: 128578

SEQ ID NO: 332730 - RNA, 64 nt, Human; identical to SEQ ID NO: 128579

SEQ ID NO: 332731 - RNA, 64 nt, Human; identical to SEQ ID NO: 128580

SEQ ID NO: 332732 - RNA, 64 nt, Human; identical to SEQ ID NO: 128581

SEQ ID NO: 332733 - RNA, 64 nt, Human; identical to SEQ ID NO: 128582

SEQ ID NO: 332734 - RNA, 64 nt, Human; identical to SEQ ID NO: 128583

SEQ ID NO: 332735 - RNA, 64 nt, Human; identical to SEQ ID NO: 128584

SEQ ID NO: 332736 - RNA, 64 nt, Human; identical to SEQ ID NO: 128585

SEQ ID NO: 332737 - RNA, 64 nt, Human; identical to SEQ ID NO: 128586

SEQ ID NO: 332738 - RNA, 64 nt, Human; identical to SEQ ID NO: 128587

SEQ ID NO: 332739 - RNA, 64 nt, Human; identical to SEQ ID NO: 128588

SEQ ID NO: 332740 - RNA, 50 nt, Human
gccaggaccccaggauguaggacgcccacuggcucucccuuucuucugag

SEQ ID NO: 332741 - RNA, 64 nt, Human
gacauccccaccagccucagaugagacgggccaggacgcccagccacagcaagcccugucccuu

SEQ ID NO: 332742 - RNA, 64 nt, Human
gagguguccuguugaagcccuugaucccgcugacgacgcccacgucgaggccccaccgccaucc

SEQ ID NO: 332743 - RNA, 64 nt, Human; identical to SEQ ID NO: 128589

SEQ ID NO: 332744 - RNA, 64 nt, Human; identical to SEQ ID NO: 128590

SEQ ID NO: 332745 - RNA, 64 nt, Human; identical to SEQ ID NO: 128591

SEQ ID NO: 332746 - RNA, 64 nt, Human; identical to SEQ ID NO: 128592

SEQ ID NO: 332747 - RNA, 64 nt, Human; identical to SEQ ID NO: 128593

SEQ ID NO: 332748 - RNA, 64 nt, Human; identical to SEQ ID NO: 128594

SEQ ID NO: 332749 - RNA, 64 nt, Human; identical to SEQ ID NO: 128595

SEQ ID NO: 332750 - RNA, 64 nt, Human; identical to SEQ ID NO: 128596

SEQ ID NO: 332751 - RNA, 64 nt, Human; identical to SEQ ID NO: 128597

SEQ ID NO: 332752 - RNA, 64 nt, Human; identical to SEQ ID NO: 128598

SEQ ID NO: 332753 - RNA, 64 nt, Human; identical to SEQ ID NO: 128599

SEQ ID NO: 332754 - RNA, 64 nt, Human; identical to SEQ ID NO: 128600

SEQ ID NO: 332755 - RNA, 64 nt, Human; identical to SEQ ID NO: 128601

SEQ ID NO: 332756 - RNA, 64 nt, Human; identical to SEQ ID NO: 128602

SEQ ID NO: 332757 - RNA, 56 nt, Human; identical to SEQ ID NO: 128603

SEQ ID NO: 332758 - RNA, 64 nt, Human; identical to SEQ ID NO: 128604

SEQ ID NO: 332759 - RNA, 64 nt, Human
aggguuucccaccacagggucuggaagugugugugacgcccauugagcuguuacccgaagucag

SEQ ID NO: 332760 - RNA, 64 nt, Human
aaccaacaacuuuugagauuucccuugcccuguggacgcccagcuccugucauccuuccuuagg

SEQ ID NO: 332761 - RNA, 64 nt, Human
uggcauggaacaggugguaggagagccccagggagacgcccaggagcuggcugaaagccacuuu

SEQ ID NO: 332762 - RNA, 64 nt, Human; identical to SEQ ID NO: 128605

SEQ ID NO: 332763 - RNA, 64 nt, Human; identical to SEQ ID NO: 128606

SEQ ID NO: 332764 - RNA, 64 nt, Human; identical to SEQ ID NO: 128607

SEQ ID NO: 332765 - RNA, 64 nt, Human; identical to SEQ ID NO: 128608

SEQ ID NO: 332766 - RNA, 64 nt, Human; identical to SEQ ID NO: 128609

SEQ ID NO: 332767 - RNA, 64 nt, Human; identical to SEQ ID NO: 128610

SEQ ID NO: 332768 - RNA, 64 nt, Human; identical to SEQ ID NO: 128611

SEQ ID NO: 332769 - RNA, 50 nt, Human; identical to SEQ ID NO: 128612

SEQ ID NO: 332770 - RNA, 64 nt, Human; identical to SEQ ID NO: 128613

SEQ ID NO: 332771 - RNA, 64 nt, Human; identical to SEQ ID NO: 128614

SEQ ID NO: 332772 - RNA, 64 nt, Human; identical to SEQ ID NO: 128615

SEQ ID NO: 332773 - RNA, 64 nt, Human; identical to SEQ ID NO: 128616

SEQ ID NO: 332774 - RNA, 64 nt, Human; identical to SEQ ID NO: 128617

SEQ ID NO: 332775 - RNA, 64 nt, Human; identical to SEQ ID NO: 128618

SEQ ID NO: 332776 - RNA, 64 nt, Human; identical to SEQ ID NO: 128619

SEQ ID NO: 332777 - RNA, 64 nt, Human; identical to SEQ ID NO: 128620

SEQ ID NO: 332778 - RNA, 64 nt, Human
cuaagagagguugggaccaggcuagguuccgggugacgcccaggagaggugguggccuucacac

SEQ ID NO: 332779 - RNA, 64 nt, Human
acagaggcuggacgugggcccagaggcccacagggacgcccaccugccccccacagaggcuggu

SEQ ID NO: 332780 - RNA, 64 nt, Human
gaagaagauuccagaugccagaaaaccucugucagacgcccacuggccccagaucucauccugc

SEQ ID NO: 332781 - RNA, 50 nt, Human; identical to SEQ ID NO: 128621

SEQ ID NO: 332782 - RNA, 64 nt, Human; identical to SEQ ID NO: 128622

SEQ ID NO: 332783 - RNA, 64 nt, Human; identical to SEQ ID NO: 128623

SEQ ID NO: 332784 - RNA, 64 nt, Human; identical to SEQ ID NO: 128624

SEQ ID NO: 332785 - RNA, 64 nt, Human; identical to SEQ ID NO: 128625

SEQ ID NO: 332786 - RNA, 64 nt, Human; identical to SEQ ID NO: 128626

SEQ ID NO: 332787 - RNA, 64 nt, Human; identical to SEQ ID NO: 128627

SEQ ID NO: 332788 - RNA, 64 nt, Human; identical to SEQ ID NO: 128628

SEQ ID NO: 332789 - RNA, 64 nt, Human; identical to SEQ ID NO: 128629

SEQ ID NO: 332790 - RNA, 64 nt, Human; identical to SEQ ID NO: 128630

SEQ ID NO: 332791 - RNA, 64 nt, Human; identical to SEQ ID NO: 128631

SEQ ID NO: 332792 - RNA, 64 nt, Human; identical to SEQ ID NO: 128632

SEQ ID NO: 332793 - RNA, 64 nt, Human; identical to SEQ ID NO: 128633

SEQ ID NO: 332794 - RNA, 64 nt, Human; identical to SEQ ID NO: 128634

SEQ ID NO: 332795 - RNA, 64 nt, Human; identical to SEQ ID NO: 128635

SEQ ID NO: 332796 - RNA, 64 nt, Human; identical to SEQ ID NO: 128636

SEQ ID NO: 332797 - RNA, 64 nt, Human; identical to SEQ ID NO: 128637

SEQ ID NO: 332798 - RNA, 64 nt, Human; identical to SEQ ID NO: 128638

SEQ ID NO: 332799 - RNA, 64 nt, Human; identical to SEQ ID NO: 128639

SEQ ID NO: 332800 - RNA, 64 nt, Human; identical to SEQ ID NO: 128640

SEQ ID NO: 332801 - RNA, 64 nt, Human; identical to SEQ ID NO: 128641

SEQ ID NO: 332802 - RNA, 64 nt, Human; identical to SEQ ID NO: 128642

SEQ ID NO: 332803 - RNA, 64 nt, Human; identical to SEQ ID NO: 128643

SEQ ID NO: 332804 - RNA, 64 nt, Human; identical to SEQ ID NO: 128644

SEQ ID NO: 332805 - RNA, 64 nt, Human; identical to SEQ ID NO: 128645

SEQ ID NO: 332806 - RNA, 64 nt, Human; identical to SEQ ID NO: 128646

SEQ ID NO: 332807 - RNA, 64 nt, Human; identical to SEQ ID NO: 128647

SEQ ID NO: 332808 - RNA, 64 nt, Human; identical to SEQ ID NO: 128648

SEQ ID NO: 332809 - RNA, 64 nt, Human; identical to SEQ ID NO: 128649

SEQ ID NO: 332810 - RNA, 64 nt, Human; identical to SEQ ID NO: 128650

SEQ ID NO: 332811 - RNA, 64 nt, Human; identical to SEQ ID NO: 128651

SEQ ID NO: 332812 - RNA, 64 nt, Human; identical to SEQ ID NO: 128652

SEQ ID NO: 332813 - RNA, 64 nt, Human
cucagcagcuauguucccgccgcaguggggcccugacgcccaccucccaggugccccucgagca

SEQ ID NO: 332814 - RNA, 64 nt, Human
gccugugggucuagugggcgucacagagcuuucagacgcccagaagaagcagcugaaggagcag

SEQ ID NO: 332815 - RNA, 64 nt, Human
accaccccgacaaccacuacagaaccaacauugugacgcccagguugcaacaggauggaauuca

SEQ ID NO: 332816 - RNA, 64 nt, Human; identical to SEQ ID NO: 128653

SEQ ID NO: 332817 - RNA, 64 nt, Human; identical to SEQ ID NO: 128654

SEQ ID NO: 332818 - RNA, 64 nt, Human; identical to SEQ ID NO: 128655

SEQ ID NO: 332819 - RNA, 64 nt, Human; identical to SEQ ID NO: 128656

SEQ ID NO: 332820 - RNA, 52 nt, Human; identical to SEQ ID NO: 128657

SEQ ID NO: 332821 - RNA, 64 nt, Human; identical to SEQ ID NO: 128658

SEQ ID NO: 332822 - RNA, 64 nt, Human; identical to SEQ ID NO: 128659

SEQ ID NO: 332823 - RNA, 64 nt, Human; identical to SEQ ID NO: 128660

SEQ ID NO: 332824 - RNA, 64 nt, Human; identical to SEQ ID NO: 128661

SEQ ID NO: 332825 - RNA, 64 nt, Human; identical to SEQ ID NO: 128662

SEQ ID NO: 332826 - RNA, 64 nt, Human; identical to SEQ ID NO: 128663

SEQ ID NO: 332827 - RNA, 64 nt, Human; identical to SEQ ID NO: 128664

SEQ ID NO: 332828 - RNA, 64 nt, Human; identical to SEQ ID NO: 128665

SEQ ID NO: 332829 - RNA, 64 nt, Human; identical to SEQ ID NO: 128666

SEQ ID NO: 332830 - RNA, 64 nt, Human; identical to SEQ ID NO: 128667

SEQ ID NO: 332831 - RNA, 64 nt, Human; identical to SEQ ID NO: 128668

SEQ ID NO: 332832 - RNA, 64 nt, Human
gaaguuguagcgccuagcgagaguuccagccccagacgcccaccugugccucagggcaccgccu

SEQ ID NO: 332833 - RNA, 64 nt, Human
cuaaacuaaaggaaacaaagcaauagguuugggggacgcccagcccccacccccgucaccccgc

SEQ ID NO: 332834 - RNA, 64 nt, Human
ugcguggugcgagugcgugaauauugggggcccggacgcccaggaccccauggcagugggaaaa

SEQ ID NO: 332835 - RNA, 64 nt, Human; identical to SEQ ID NO: 128669

SEQ ID NO: 332836 - RNA, 64 nt, Human; identical to SEQ ID NO: 128670

SEQ ID NO: 332837 - RNA, 64 nt, Human; identical to SEQ ID NO: 128671

SEQ ID NO: 332838 - RNA, 64 nt, Human; identical to SEQ ID NO: 128672

SEQ ID NO: 332839 - RNA, 64 nt, Human; identical to SEQ ID NO: 128673

SEQ ID NO: 332840 - RNA, 64 nt, Human; identical to SEQ ID NO: 128674

SEQ ID NO: 332841 - RNA, 64 nt, Human; identical to SEQ ID NO: 128675

SEQ ID NO: 332842 - RNA, 64 nt, Human; identical to SEQ ID NO: 128676

SEQ ID NO: 332843 - RNA, 64 nt, Human; identical to SEQ ID NO: 128677

SEQ ID NO: 332844 - RNA, 64 nt, Human; identical to SEQ ID NO: 128678

SEQ ID NO: 332845 - RNA, 64 nt, Human; identical to SEQ ID NO: 128679

SEQ ID NO: 332846 - RNA, 64 nt, Human; identical to SEQ ID NO: 128680

SEQ ID NO: 332847 - RNA, 64 nt, Human; identical to SEQ ID NO: 128681

SEQ ID NO: 332848 - RNA, 64 nt, Human; identical to SEQ ID NO: 128682

SEQ ID NO: 332849 - RNA, 64 nt, Human; identical to SEQ ID NO: 128683

SEQ ID NO: 332850 - RNA, 64 nt, Human; identical to SEQ ID NO: 128684

SEQ ID NO: 332851 - RNA, 64 nt, Human; identical to SEQ ID NO: 31837

SEQ ID NO: 332852 - RNA, 64 nt, Human; identical to SEQ ID NO: 31838

SEQ ID NO: 332853 - RNA, 64 nt, Human; identical to SEQ ID NO: 31839

SEQ ID NO: 332854 - RNA, 64 nt, Human; identical to SEQ ID NO: 128685

SEQ ID NO: 332855 - RNA, 64 nt, Human; identical to SEQ ID NO: 128686

SEQ ID NO: 332856 - RNA, 64 nt, Human; identical to SEQ ID NO: 128687

SEQ ID NO: 332857 - RNA, 64 nt, Human; identical to SEQ ID NO: 128688

SEQ ID NO: 332858 - RNA, 64 nt, Human; identical to SEQ ID NO: 128689

SEQ ID NO: 332859 - RNA, 64 nt, Human; identical to SEQ ID NO: 128690

SEQ ID NO: 332860 - RNA, 64 nt, Human; identical to SEQ ID NO: 128691

SEQ ID NO: 332861 - RNA, 57 nt, Human; identical to SEQ ID NO: 128692

SEQ ID NO: 332862 - RNA, 64 nt, Human; identical to SEQ ID NO: 128693

SEQ ID NO: 332863 - RNA, 64 nt, Human; identical to SEQ ID NO: 128694

SEQ ID NO: 332864 - RNA, 64 nt, Human; identical to SEQ ID NO: 128695

SEQ ID NO: 332865 - RNA, 64 nt, Human; identical to SEQ ID NO: 128696

SEQ ID NO: 332866 - RNA, 64 nt, Human; identical to SEQ ID NO: 128697

SEQ ID NO: 332867 - RNA, 64 nt, Human; identical to SEQ ID NO: 128698

SEQ ID NO: 332868 - RNA, 64 nt, Human; identical to SEQ ID NO: 128699

SEQ ID NO: 332869 - RNA, 64 nt, Human; identical to SEQ ID NO: 128700

SEQ ID NO: 332870 - RNA, 64 nt, Human; identical to SEQ ID NO: 31843

SEQ ID NO: 332871 - RNA, 56 nt, Human; identical to SEQ ID NO: 31844

SEQ ID NO: 332872 - RNA, 64 nt, Human; identical to SEQ ID NO: 31845

SEQ ID NO: 332873 - RNA, 64 nt, Human; identical to SEQ ID NO: 128701

SEQ ID NO: 332874 - RNA, 64 nt, Human; identical to SEQ ID NO: 128702

SEQ ID NO: 332875 - RNA, 64 nt, Human; identical to SEQ ID NO: 128703

SEQ ID NO: 332876 - RNA, 64 nt, Human; identical to SEQ ID NO: 128704

SEQ ID NO: 332877 - RNA, 64 nt, Human; identical to SEQ ID NO: 128705

SEQ ID NO: 332878 - RNA, 64 nt, Human; identical to SEQ ID NO: 128706

SEQ ID NO: 332879 - RNA, 64 nt, Human; identical to SEQ ID NO: 128707

SEQ ID NO: 332880 - RNA, 64 nt, Human; identical to SEQ ID NO: 128708

SEQ ID NO: 332881 - RNA, 64 nt, Human; identical to SEQ ID NO: 128709

SEQ ID NO: 332882 - RNA, 64 nt, Human; identical to SEQ ID NO: 128710

SEQ ID NO: 332883 - RNA, 64 nt, Human; identical to SEQ ID NO: 128711

SEQ ID NO: 332884 - RNA, 64 nt, Human; identical to SEQ ID NO: 128712

SEQ ID NO: 332885 - RNA, 64 nt, Human; identical to SEQ ID NO: 128713

SEQ ID NO: 332886 - RNA, 64 nt, Human; identical to SEQ ID NO: 128714

SEQ ID NO: 332887 - RNA, 58 nt, Human; identical to SEQ ID NO: 128715

SEQ ID NO: 332888 - RNA, 64 nt, Human; identical to SEQ ID NO: 128716

SEQ ID NO: 332889 - RNA, 64 nt, Human; identical to SEQ ID NO: 31846

SEQ ID NO: 332890 - RNA, 64 nt, Human; identical to SEQ ID NO: 31847

SEQ ID NO: 332891 - RNA, 64 nt, Human; identical to SEQ ID NO: 128717

SEQ ID NO: 332892 - RNA, 64 nt, Human; identical to SEQ ID NO: 128718

SEQ ID NO: 332893 - RNA, 51 nt, Human; identical to SEQ ID NO: 128719

SEQ ID NO: 332894 - RNA, 64 nt, Human; identical to SEQ ID NO: 128720

SEQ ID NO: 332895 - RNA, 64 nt, Human; identical to SEQ ID NO: 128721

SEQ ID NO: 332896 - RNA, 64 nt, Human; identical to SEQ ID NO: 128722

SEQ ID NO: 332897 - RNA, 64 nt, Human; identical to SEQ ID NO: 128723

SEQ ID NO: 332898 - RNA, 64 nt, Human; identical to SEQ ID NO: 128724

SEQ ID NO: 332899 - RNA, 64 nt, Human; identical to SEQ ID NO: 128725

SEQ ID NO: 332900 - RNA, 64 nt, Human; identical to SEQ ID NO: 128726

SEQ ID NO: 332901 - RNA, 64 nt, Human; identical to SEQ ID NO: 128727

SEQ ID NO: 332902 - RNA, 64 nt, Human; identical to SEQ ID NO: 128728

SEQ ID NO: 332903 - RNA, 64 nt, Human; identical to SEQ ID NO: 128729

SEQ ID NO: 332904 - RNA, 64 nt, Human; identical to SEQ ID NO: 128730

SEQ ID NO: 332905 - RNA, 64 nt, Human; identical to SEQ ID NO: 128731

SEQ ID NO: 332906 - RNA, 64 nt, Human; identical to SEQ ID NO: 128732

SEQ ID NO: 332907 - RNA, 64 nt, Human
caggggauuucaccacucaaaggccagaccugcagacgcccagauuaugagacacaggaugaag

SEQ ID NO: 332908 - RNA, 64 nt, Human
ucuugacauugcucuguaggugagagaggaccaugacgcccauguuugcagcugauacuuguuu

SEQ ID NO: 332909 - RNA, 64 nt, Human
gcuguucguccacacgccaccaucuaccaguggggacgcccagggccucgggcguacgcuuacc

SEQ ID NO: 332910 - RNA, 64 nt, Human; identical to SEQ ID NO: 128733

SEQ ID NO: 332911 - RNA, 64 nt, Human; identical to SEQ ID NO: 128734

SEQ ID NO: 332912 - RNA, 64 nt, Human; identical to SEQ ID NO: 128735

SEQ ID NO: 332913 - RNA, 64 nt, Human; identical to SEQ ID NO: 128736

SEQ ID NO: 332914 - RNA, 64 nt, Human; identical to SEQ ID NO: 128737

SEQ ID NO: 332915 - RNA, 64 nt, Human; identical to SEQ ID NO: 128738

SEQ ID NO: 332916 - RNA, 64 nt, Human; identical to SEQ ID NO: 128739

SEQ ID NO: 332917 - RNA, 64 nt, Human; identical to SEQ ID NO: 128740

SEQ ID NO: 332918 - RNA, 64 nt, Human; identical to SEQ ID NO: 128741

SEQ ID NO: 332919 - RNA, 64 nt, Human; identical to SEQ ID NO: 128742

SEQ ID NO: 332920 - RNA, 64 nt, Human; identical to SEQ ID NO: 128743

SEQ ID NO: 332921 - RNA, 64 nt, Human; identical to SEQ ID NO: 128744

SEQ ID NO: 332922 - RNA, 64 nt, Human; identical to SEQ ID NO: 128745

SEQ ID NO: 332923 - RNA, 64 nt, Human; identical to SEQ ID NO: 128746

SEQ ID NO: 332924 - RNA, 64 nt, Human; identical to SEQ ID NO: 128747

SEQ ID NO: 332925 - RNA, 64 nt, Human; identical to SEQ ID NO: 128748

SEQ ID NO: 332926 - RNA, 64 nt, Human; identical to SEQ ID NO: 128749

SEQ ID NO: 332927 - RNA, 64 nt, Human; identical to SEQ ID NO: 128750

SEQ ID NO: 332928 - RNA, 64 nt, Human; identical to SEQ ID NO: 128751

SEQ ID NO: 332929 - RNA, 64 nt, Human; identical to SEQ ID NO: 128752

SEQ ID NO: 332930 - RNA, 62 nt, Human; identical to SEQ ID NO: 128753

SEQ ID NO: 332931 - RNA, 64 nt, Human; identical to SEQ ID NO: 128754

SEQ ID NO: 332932 - RNA, 64 nt, Human; identical to SEQ ID NO: 128755

SEQ ID NO: 332933 - RNA, 64 nt, Human; identical to SEQ ID NO: 128756

SEQ ID NO: 332934 - RNA, 64 nt, Human; identical to SEQ ID NO: 128757

SEQ ID NO: 332935 - RNA, 64 nt, Human; identical to SEQ ID NO: 128758

SEQ ID NO: 332936 - RNA, 64 nt, Human; identical to SEQ ID NO: 128759

SEQ ID NO: 332937 - RNA, 64 nt, Human; identical to SEQ ID NO: 128760

SEQ ID NO: 332938 - RNA, 64 nt, Human; identical to SEQ ID NO: 128761

SEQ ID NO: 332939 - RNA, 64 nt, Human; identical to SEQ ID NO: 128762

SEQ ID NO: 332940 - RNA, 64 nt, Human; identical to SEQ ID NO: 128763

SEQ ID NO: 332941 - RNA, 50 nt, Human; identical to SEQ ID NO: 128764

SEQ ID NO: 332942 - RNA, 64 nt, Human; identical to SEQ ID NO: 128765

SEQ ID NO: 332943 - RNA, 64 nt, Human; identical to SEQ ID NO: 128766

SEQ ID NO: 332944 - RNA, 64 nt, Human; identical to SEQ ID NO: 128767

SEQ ID NO: 332945 - RNA, 64 nt, Human; identical to SEQ ID NO: 128768

SEQ ID NO: 332946 - RNA, 64 nt, Human; identical to SEQ ID NO: 128769

SEQ ID NO: 332947 - RNA, 64 nt, Human; identical to SEQ ID NO: 128770

SEQ ID NO: 332948 - RNA, 64 nt, Human; identical to SEQ ID NO: 128771

SEQ ID NO: 332949 - RNA, 64 nt, Human; identical to SEQ ID NO: 128772

SEQ ID NO: 332950 - RNA, 59 nt, Human; identical to SEQ ID NO: 128773

SEQ ID NO: 332951 - RNA, 64 nt, Human; identical to SEQ ID NO: 128774

SEQ ID NO: 332952 - RNA, 64 nt, Human; identical to SEQ ID NO: 128775

SEQ ID NO: 332953 - RNA, 53 nt, Human; identical to SEQ ID NO: 128776

SEQ ID NO: 332954 - RNA, 64 nt, Human; identical to SEQ ID NO: 128777

SEQ ID NO: 332955 - RNA, 64 nt, Human; identical to SEQ ID NO: 128778

SEQ ID NO: 332956 - RNA, 64 nt, Human; identical to SEQ ID NO: 128779

SEQ ID NO: 332957 - RNA, 64 nt, Human; identical to SEQ ID NO: 128780

SEQ ID NO: 332958 - RNA, 64 nt, Human; identical to SEQ ID NO: 128781

SEQ ID NO: 332959 - RNA, 64 nt, Human; identical to SEQ ID NO: 128782

SEQ ID NO: 332960 - RNA, 64 nt, Human; identical to SEQ ID NO: 128783

SEQ ID NO: 332961 - RNA, 64 nt, Human; identical to SEQ ID NO: 128784

SEQ ID NO: 332962 - RNA, 64 nt, Human; identical to SEQ ID NO: 128785

SEQ ID NO: 332963 - RNA, 64 nt, Human; identical to SEQ ID NO: 128786

SEQ ID NO: 332964 - RNA, 64 nt, Human; identical to SEQ ID NO: 128787

SEQ ID NO: 332965 - RNA, 64 nt, Human; identical to SEQ ID NO: 128788

SEQ ID NO: 332966 - RNA, 64 nt, Human; identical to SEQ ID NO: 128789

SEQ ID NO: 332967 - RNA, 64 nt, Human; identical to SEQ ID NO: 128790

SEQ ID NO: 332968 - RNA, 64 nt, Human; identical to SEQ ID NO: 128791

SEQ ID NO: 332969 - RNA, 64 nt, Human; identical to SEQ ID NO: 128792

SEQ ID NO: 332970 - RNA, 64 nt, Human; identical to SEQ ID NO: 128793

SEQ ID NO: 332971 - RNA, 64 nt, Human; identical to SEQ ID NO: 128794

SEQ ID NO: 332972 - RNA, 64 nt, Human; identical to SEQ ID NO: 128795

SEQ ID NO: 332973 - RNA, 64 nt, Human; identical to SEQ ID NO: 128796

SEQ ID NO: 332974 - RNA, 64 nt, Human
cucccgaguagcugggacuacaggugcaugccacgacgcccagcugauuuuuguguuuuuagua

SEQ ID NO: 332975 - RNA, 64 nt, Human
agccaugagacuccuuguggccucaagaaauuuagacgcccacgacagcacuacacagcaucuc

SEQ ID NO: 332976 - RNA, 64 nt, Human
ugcagcgagaaagacacagcccagcagggcuggagacgcccauguccagcaggcgcaggccugg

SEQ ID NO: 332977 - RNA, 64 nt, Human; identical to SEQ ID NO: 128797

SEQ ID NO: 332978 - RNA, 64 nt, Human; identical to SEQ ID NO: 128798

SEQ ID NO: 332979 - RNA, 64 nt, Human; identical to SEQ ID NO: 128799

SEQ ID NO: 332980 - RNA, 64 nt, Human; identical to SEQ ID NO: 128800

SEQ ID NO: 332981 - RNA, 64 nt, Human; identical to SEQ ID NO: 128801

SEQ ID NO: 332982 - RNA, 64 nt, Human; identical to SEQ ID NO: 128802

SEQ ID NO: 332983 - RNA, 64 nt, Human; identical to SEQ ID NO: 128803

SEQ ID NO: 332984 - RNA, 57 nt, Human; identical to SEQ ID NO: 128804

SEQ ID NO: 332985 - RNA, 64 nt, Human; identical to SEQ ID NO: 128805

SEQ ID NO: 332986 - RNA, 64 nt, Human; identical to SEQ ID NO: 128806

SEQ ID NO: 332987 - RNA, 64 nt, Human; identical to SEQ ID NO: 128807

SEQ ID NO: 332988 - RNA, 64 nt, Human; identical to SEQ ID NO: 128808

SEQ ID NO: 332989 - RNA, 64 nt, Human; identical to SEQ ID NO: 128809

SEQ ID NO: 332990 - RNA, 64 nt, Human; identical to SEQ ID NO: 128810

SEQ ID NO: 332991 - RNA, 64 nt, Human; identical to SEQ ID NO: 128811

SEQ ID NO: 332992 - RNA, 64 nt, Human; identical to SEQ ID NO: 128812

SEQ ID NO: 332993 - RNA, 64 nt, Human; identical to SEQ ID NO: 128813

SEQ ID NO: 332994 - RNA, 64 nt, Human; identical to SEQ ID NO: 128814

SEQ ID NO: 332995 - RNA, 64 nt, Human; identical to SEQ ID NO: 128815

SEQ ID NO: 332996 - RNA, 64 nt, Human; identical to SEQ ID NO: 128816

SEQ ID NO: 332997 - RNA, 64 nt, Human; identical to SEQ ID NO: 128817

SEQ ID NO: 332998 - RNA, 64 nt, Human; identical to SEQ ID NO: 128818

SEQ ID NO: 332999 - RNA, 64 nt, Human; identical to SEQ ID NO: 128819

SEQ ID NO: 333000 - RNA, 64 nt, Human; identical to SEQ ID NO: 128820

SEQ ID NO: 333001 - RNA, 64 nt, Human; identical to SEQ ID NO: 128821

SEQ ID NO: 333002 - RNA, 64 nt, Human; identical to SEQ ID NO: 128822

SEQ ID NO: 333003 - RNA, 64 nt, Human; identical to SEQ ID NO: 128823

SEQ ID NO: 333004 - RNA, 64 nt, Human; identical to SEQ ID NO: 128824

SEQ ID NO: 333005 - RNA, 64 nt, Human; identical to SEQ ID NO: 128825

SEQ ID NO: 333006 - RNA, 64 nt, Human; identical to SEQ ID NO: 128826

SEQ ID NO: 333007 - RNA, 64 nt, Human; identical to SEQ ID NO: 128827

SEQ ID NO: 333008 - RNA, 64 nt, Human; identical to SEQ ID NO: 128828

SEQ ID NO: 333009 - RNA, 64 nt, Human
acguccugccuggcacuuacugguccuuaccagagacgcccagccccaucccuguccucaugac

SEQ ID NO: 333010 - RNA, 64 nt, Human; identical to SEQ ID NO: 128829

SEQ ID NO: 333011 - RNA, 64 nt, Human; identical to SEQ ID NO: 128830

SEQ ID NO: 333012 - RNA, 64 nt, Human; identical to SEQ ID NO: 128831

SEQ ID NO: 333013 - RNA, 64 nt, Human; identical to SEQ ID NO: 128832

SEQ ID NO: 333014 - RNA, 54 nt, Human; identical to SEQ ID NO: 128833

SEQ ID NO: 333015 - RNA, 64 nt, Human; identical to SEQ ID NO: 128834

SEQ ID NO: 333016 - RNA, 64 nt, Human; identical to SEQ ID NO: 128835

SEQ ID NO: 333017 - RNA, 64 nt, Human; identical to SEQ ID NO: 128836

SEQ ID NO: 333018 - RNA, 64 nt, Human; identical to SEQ ID NO: 128837

SEQ ID NO: 333019 - RNA, 64 nt, Human; identical to SEQ ID NO: 128838

SEQ ID NO: 333020 - RNA, 64 nt, Human; identical to SEQ ID NO: 128839

SEQ ID NO: 333021 - RNA, 64 nt, Human; identical to SEQ ID NO: 128840

SEQ ID NO: 333022 - RNA, 64 nt, Human; identical to SEQ ID NO: 128841

SEQ ID NO: 333023 - RNA, 64 nt, Human; identical to SEQ ID NO: 128842

SEQ ID NO: 333024 - RNA, 64 nt, Human; identical to SEQ ID NO: 128843

SEQ ID NO: 333025 - RNA, 64 nt, Human; identical to SEQ ID NO: 128844

SEQ ID NO: 333026 - RNA, 64 nt, Human; identical to SEQ ID NO: 128845

SEQ ID NO: 333027 - RNA, 64 nt, Human; identical to SEQ ID NO: 128846

SEQ ID NO: 333028 - RNA, 64 nt, Human; identical to SEQ ID NO: 128847

SEQ ID NO: 333029 - RNA, 64 nt, Human; identical to SEQ ID NO: 128848

SEQ ID NO: 333030 - RNA, 50 nt, Human; identical to SEQ ID NO: 128849

SEQ ID NO: 333031 - RNA, 64 nt, Human; identical to SEQ ID NO: 128850

SEQ ID NO: 333032 - RNA, 64 nt, Human; identical to SEQ ID NO: 128851

SEQ ID NO: 333033 - RNA, 64 nt, Human; identical to SEQ ID NO: 128852

SEQ ID NO: 333034 - RNA, 64 nt, Human; identical to SEQ ID NO: 128853

SEQ ID NO: 333035 - RNA, 64 nt, Human; identical to SEQ ID NO: 128854

SEQ ID NO: 333036 - RNA, 64 nt, Human; identical to SEQ ID NO: 128855

SEQ ID NO: 333037 - RNA, 64 nt, Human; identical to SEQ ID NO: 128856

SEQ ID NO: 333038 - RNA, 64 nt, Human; identical to SEQ ID NO: 128857

SEQ ID NO: 333039 - RNA, 64 nt, Human; identical to SEQ ID NO: 128858

SEQ ID NO: 333040 - RNA, 64 nt, Human; identical to SEQ ID NO: 128859

SEQ ID NO: 333041 - RNA, 64 nt, Human; identical to SEQ ID NO: 128860

SEQ ID NO: 333042 - RNA, 64 nt, Human
cuauagcagaaagaacuuuaaagcucaggagggugacgcccagcuccgccugcugggaagagcu

SEQ ID NO: 333043 - RNA, 64 nt, Human
ugaucaccccuuugagguagauugaccggcuuuagacgcccaccccccacccaccgcaagcuuu

SEQ ID NO: 333044 - RNA, 64 nt, Human; identical to SEQ ID NO: 128861

SEQ ID NO: 333045 - RNA, 64 nt, Human; identical to SEQ ID NO: 128862

SEQ ID NO: 333046 - RNA, 64 nt, Human; identical to SEQ ID NO: 128863

SEQ ID NO: 333047 - RNA, 64 nt, Human; identical to SEQ ID NO: 128864

SEQ ID NO: 333048 - RNA, 64 nt, Human; identical to SEQ ID NO: 128865

SEQ ID NO: 333049 - RNA, 64 nt, Human; identical to SEQ ID NO: 128866

SEQ ID NO: 333050 - RNA, 64 nt, Human; identical to SEQ ID NO: 128867

SEQ ID NO: 333051 - RNA, 64 nt, Human; identical to SEQ ID NO: 128868

SEQ ID NO: 333052 - RNA, 64 nt, Human; identical to SEQ ID NO: 128869

SEQ ID NO: 333053 - RNA, 64 nt, Human; identical to SEQ ID NO: 128870

SEQ ID NO: 333054 - RNA, 64 nt, Human; identical to SEQ ID NO: 128871

SEQ ID NO: 333055 - RNA, 64 nt, Human; identical to SEQ ID NO: 128872

SEQ ID NO: 333056 - RNA, 64 nt, Human; identical to SEQ ID NO: 128873

SEQ ID NO: 333057 - RNA, 64 nt, Human; identical to SEQ ID NO: 128874

SEQ ID NO: 333058 - RNA, 64 nt, Human; identical to SEQ ID NO: 128875

SEQ ID NO: 333059 - RNA, 64 nt, Human; identical to SEQ ID NO: 128876

SEQ ID NO: 333060 - RNA, 64 nt, Human; identical to SEQ ID NO: 31804

SEQ ID NO: 333061 - RNA, 64 nt, Human; identical to SEQ ID NO: 31805

SEQ ID NO: 333062 - RNA, 64 nt, Human; identical to SEQ ID NO: 31806

SEQ ID NO: 333063 - RNA, 64 nt, Human; identical to SEQ ID NO: 128877

SEQ ID NO: 333064 - RNA, 64 nt, Human; identical to SEQ ID NO: 128878

SEQ ID NO: 333065 - RNA, 64 nt, Human; identical to SEQ ID NO: 128867

SEQ ID NO: 333066 - RNA, 64 nt, Human; identical to SEQ ID NO: 128880

SEQ ID NO: 333067 - RNA, 64 nt, Human; identical to SEQ ID NO: 128881

SEQ ID NO: 333068 - RNA, 64 nt, Human; identical to SEQ ID NO: 128882

SEQ ID NO: 333069 - RNA, 64 nt, Human; identical to SEQ ID NO: 128883

SEQ ID NO: 333070 - RNA, 64 nt, Human; identical to SEQ ID NO: 128884

SEQ ID NO: 333071 - RNA, 64 nt, Human; identical to SEQ ID NO: 128885

SEQ ID NO: 333072 - RNA, 64 nt, Human; identical to SEQ ID NO: 128886

SEQ ID NO: 333073 - RNA, 64 nt, Human; identical to SEQ ID NO: 128887

SEQ ID NO: 333074 - RNA, 64 nt, Human; identical to SEQ ID NO: 128888

SEQ ID NO: 333075 - RNA, 64 nt, Human; identical to SEQ ID NO: 128889

SEQ ID NO: 333076 - RNA, 64 nt, Human; identical to SEQ ID NO: 128890

SEQ ID NO: 333077 - RNA, 64 nt, Human; identical to SEQ ID NO: 128891

SEQ ID NO: 333078 - RNA, 64 nt, Human; identical to SEQ ID NO: 128892

SEQ ID NO: 333079 - RNA, 64 nt, Human; identical to SEQ ID NO: 31809

SEQ ID NO: 333080 - RNA, 64 nt, Human; identical to SEQ ID NO: 31810

SEQ ID NO: 333081 - RNA, 64 nt, Human; identical to SEQ ID NO: 31811

SEQ ID NO: 333082 - RNA, 64 nt, Human; identical to SEQ ID NO: 128893

SEQ ID NO: 333083 - RNA, 64 nt, Human; identical to SEQ ID NO: 128894

SEQ ID NO: 333084 - RNA, 64 nt, Human; identical to SEQ ID NO: 128895

SEQ ID NO: 333085 - RNA, 64 nt, Human; identical to SEQ ID NO: 128896

SEQ ID NO: 333086 - RNA, 64 nt, Human; identical to SEQ ID NO: 128897

SEQ ID NO: 333087 - RNA, 53 nt, Human; identical to SEQ ID NO: 128898

SEQ ID NO: 333088 - RNA, 64 nt, Human; identical to SEQ ID NO: 128899

SEQ ID NO: 333089 - RNA, 64 nt, Human; identical to SEQ ID NO: 128900

SEQ ID NO: 333090 - RNA, 64 nt, Human; identical to SEQ ID NO: 128901

SEQ ID NO: 333091 - RNA, 64 nt, Human; identical to SEQ ID NO: 128902

SEQ ID NO: 333092 - RNA, 64 nt, Human; identical to SEQ ID NO: 128903

SEQ ID NO: 333093 - RNA, 64 nt, Human; identical to SEQ ID NO: 31812

SEQ ID NO: 333094 - RNA, 64 nt, Human; identical to SEQ ID NO: 31813

SEQ ID NO: 333095 - RNA, 64 nt, Human; identical to SEQ ID NO: 31815

SEQ ID NO: 333096 - RNA, 64 nt, Human; identical to SEQ ID NO: 31816

SEQ ID NO: 333097 - RNA, 64 nt, Human; identical to SEQ ID NO: 332577

SEQ ID NO: 333098 - RNA, 64 nt, Human; identical to SEQ ID NO: 332578

SEQ ID NO: 333099 - RNA, 64 nt, Human; identical to SEQ ID NO: 332579

SEQ ID NO: 333100 - RNA, 64 nt, Human; identical to SEQ ID NO: 332580

SEQ ID NO: 333101 - RNA, 64 nt, Human; identical to SEQ ID NO: 332581

SEQ ID NO: 333102 - RNA, 64 nt, Human; identical to SEQ ID NO: 332582

SEQ ID NO: 333103 - RNA, 64 nt, Human; identical to SEQ ID NO: 332583

SEQ ID NO: 333104 - RNA, 64 nt, Human; identical to SEQ ID NO: 332584

SEQ ID NO: 333105 - RNA, 64 nt, Human; identical to SEQ ID NO: 332585

SEQ ID NO: 333106 - RNA, 64 nt, Human; identical to SEQ ID NO: 332586

SEQ ID NO: 333107 - RNA, 64 nt, Human; identical to SEQ ID NO: 332587

SEQ ID NO: 333108 - RNA, 64 nt, Human; identical to SEQ ID NO: 332588

SEQ ID NO: 333109 - RNA, 64 nt, Human; identical to SEQ ID NO: 31834

SEQ ID NO: 333110 - RNA, 64 nt, Human; identical to SEQ ID NO: 31835

SEQ ID NO: 333111 - RNA, 64 nt, Human; identical to SEQ ID NO: 31840

SEQ ID NO: 333112 - RNA, 64 nt, Human; identical to SEQ ID NO: 31841

SEQ ID NO: 333113 - RNA, 64 nt, Human; identical to SEQ ID NO: 332592

SEQ ID NO: 333114 - RNA, 64 nt, Human; identical to SEQ ID NO: 332593

SEQ ID NO: 333115 - RNA, 64 nt, Human; identical to SEQ ID NO: 332594

SEQ ID NO: 333116 - RNA, 64 nt, Human; identical to SEQ ID NO: 332595

SEQ ID NO: 333117 - RNA, 64 nt, Human; identical to SEQ ID NO: 332596

SEQ ID NO: 333118 - RNA, 64 nt, Human; identical to SEQ ID NO: 332597

SEQ ID NO: 333119 - RNA, 64 nt, Human; identical to SEQ ID NO: 332598

SEQ ID NO: 333120 - RNA, 64 nt, Human; identical to SEQ ID NO: 332599

SEQ ID NO: 333121 - RNA, 64 nt, Human; identical to SEQ ID NO: 332600

SEQ ID NO: 333122 - RNA, 64 nt, Human; identical to SEQ ID NO: 332601

SEQ ID NO: 333123 - RNA, 64 nt, Human; identical to SEQ ID NO: 332602

SEQ ID NO: 333124 - RNA, 64 nt, Human; identical to SEQ ID NO: 332603

SEQ ID NO: 333125 - RNA, 64 nt, Human; identical to SEQ ID NO: 332604

SEQ ID NO: 333126 - RNA, 64 nt, Human; identical to SEQ ID NO: 332605

SEQ ID NO: 333127 - RNA, 64 nt, Human; identical to SEQ ID NO: 332606

SEQ ID NO: 333128 - RNA, 64 nt, Human; identical to SEQ ID NO: 332607

SEQ ID NO: 333129 - RNA, 64 nt, Human; identical to SEQ ID NO: 31801

SEQ ID NO: 333130 - RNA, 64 nt, Human; identical to SEQ ID NO: 31802

SEQ ID NO: 333131 - RNA, 64 nt, Human; identical to SEQ ID NO: 31819

SEQ ID NO: 333132 - RNA, 64 nt, Human; identical to SEQ ID NO: 332611

SEQ ID NO: 333133 - RNA, 64 nt, Human; identical to SEQ ID NO: 332612

SEQ ID NO: 333134 - RNA, 64 nt, Human; identical to SEQ ID NO: 332613

SEQ ID NO: 333135 - RNA, 64 nt, Human; identical to SEQ ID NO: 332614

SEQ ID NO: 333136 - RNA, 64 nt, Human; identical to SEQ ID NO: 332615

SEQ ID NO: 333137 - RNA, 64 nt, Human; identical to SEQ ID NO: 332616

SEQ ID NO: 333138 - RNA, 64 nt, Human; identical to SEQ ID NO: 332617

SEQ ID NO: 333139 - RNA, 64 nt, Human; identical to SEQ ID NO: 332618

SEQ ID NO: 333140 - RNA, 64 nt, Human; identical to SEQ ID NO: 332619

SEQ ID NO: 333141 - RNA, 64 nt, Human; identical to SEQ ID NO: 332620

SEQ ID NO: 333142 - RNA, 64 nt, Human; identical to SEQ ID NO: 332621

SEQ ID NO: 333143 - RNA, 64 nt, Human; identical to SEQ ID NO: 332622

SEQ ID NO: 333144 - RNA, 64 nt, Human; identical to SEQ ID NO: 332623

SEQ ID NO: 333145 - RNA, 64 nt, Human; identical to SEQ ID NO: 332624

SEQ ID NO: 333146 - RNA, 64 nt, Human; identical to SEQ ID NO: 332625

SEQ ID NO: 333147 - RNA, 64 nt, Human; identical to SEQ ID NO: 332626

SEQ ID NO: 333148 - RNA, 64 nt, Human; identical to SEQ ID NO: 31797

SEQ ID NO: 333149 - RNA, 64 nt, Human; identical to SEQ ID NO: 31798

SEQ ID NO: 333150 - RNA, 64 nt, Human; identical to SEQ ID NO: 31807

SEQ ID NO: 333151 - RNA, 64 nt, Human; identical to SEQ ID NO: 128494

SEQ ID NO: 333152 - RNA, 64 nt, Human; identical to SEQ ID NO: 128495

SEQ ID NO: 333153 - RNA, 64 nt, Human; identical to SEQ ID NO: 128496

SEQ ID NO: 333154 - RNA, 64 nt, Human; identical to SEQ ID NO: 128497

SEQ ID NO: 333155 - RNA, 64 nt, Human; identical to SEQ ID NO: 128498

SEQ ID NO: 333156 - RNA, 64 nt, Human; identical to SEQ ID NO: 128499

SEQ ID NO: 333157 - RNA, 64 nt, Human; identical to SEQ ID NO: 128500

SEQ ID NO: 333158 - RNA, 64 nt, Human; identical to SEQ ID NO: 128501

SEQ ID NO: 333159 - RNA, 64 nt, Human; identical to SEQ ID NO: 128502

SEQ ID NO: 333160 - RNA, 64 nt, Human; identical to SEQ ID NO: 128503

SEQ ID NO: 333161 - RNA, 64 nt, Human; identical to SEQ ID NO: 128504

SEQ ID NO: 333162 - RNA, 64 nt, Human; identical to SEQ ID NO: 128505

SEQ ID NO: 333163 - RNA, 64 nt, Human; identical to SEQ ID NO: 128506

SEQ ID NO: 333164 - RNA, 64 nt, Human; identical to SEQ ID NO: 128507

SEQ ID NO: 333165 - RNA, 64 nt, Human; identical to SEQ ID NO: 128508

SEQ ID NO: 333166 - RNA, 64 nt, Human; identical to SEQ ID NO: 31779

SEQ ID NO: 333167 - RNA, 64 nt, Human; identical to SEQ ID NO: 31780

SEQ ID NO: 333168 - RNA, 64 nt, Human; identical to SEQ ID NO: 31820

SEQ ID NO: 333169 - RNA, 64 nt, Human; identical to SEQ ID NO: 128509

SEQ ID NO: 333170 - RNA, 64 nt, Human; identical to SEQ ID NO: 128510

SEQ ID NO: 333171 - RNA, 53 nt, Human; identical to SEQ ID NO: 128511

SEQ ID NO: 333172 - RNA, 64 nt, Human; identical to SEQ ID NO: 128512

SEQ ID NO: 333173 - RNA, 62 nt, Human; identical to SEQ ID NO: 128513

SEQ ID NO: 333174 - RNA, 64 nt, Human; identical to SEQ ID NO: 128514

SEQ ID NO: 333175 - RNA, 64 nt, Human; identical to SEQ ID NO: 128515

SEQ ID NO: 333176 - RNA, 64 nt, Human; identical to SEQ ID NO: 128516

SEQ ID NO: 333177 - RNA, 64 nt, Human; identical to SEQ ID NO: 128517

SEQ ID NO: 333178 - RNA, 64 nt, Human; identical to SEQ ID NO: 128518

SEQ ID NO: 333179 - RNA, 64 nt, Human; identical to SEQ ID NO: 128519

SEQ ID NO: 333180 - RNA, 64 nt, Human; identical to SEQ ID NO: 128520

SEQ ID NO: 333181 - RNA, 64 nt, Human; identical to SEQ ID NO: 128521

SEQ ID NO: 333182 - RNA, 64 nt, Human; identical to SEQ ID NO: 128522

SEQ ID NO: 333183 - RNA, 64 nt, Human; identical to SEQ ID NO: 128523

SEQ ID NO: 333184 - RNA, 64 nt, Human; identical to SEQ ID NO: 128524

SEQ ID NO: 333185 - RNA, 64 nt, Human; identical to SEQ ID NO: 31793

SEQ ID NO: 333186 - RNA, 64 nt, Human; identical to SEQ ID NO: 31794

SEQ ID NO: 333187 - RNA, 64 nt, Human; identical to SEQ ID NO: 31817

SEQ ID NO: 333188 - RNA, 64 nt, Human; identical to SEQ ID NO: 128525

SEQ ID NO: 333189 - RNA, 63 nt, Human; identical to SEQ ID NO: 128526

SEQ ID NO: 333190 - RNA, 64 nt, Human; identical to SEQ ID NO: 128527

SEQ ID NO: 333191 - RNA, 64 nt, Human; identical to SEQ ID NO: 128528

SEQ ID NO: 333192 - RNA, 64 nt, Human; identical to SEQ ID NO: 128529

SEQ ID NO: 333193 - RNA, 64 nt, Human; identical to SEQ ID NO: 128530

SEQ ID NO: 333194 - RNA, 64 nt, Human; identical to SEQ ID NO: 128531

SEQ ID NO: 333195 - RNA, 64 nt, Human; identical to SEQ ID NO: 128532

SEQ ID NO: 333196 - RNA, 64 nt, Human; identical to SEQ ID NO: 128533

SEQ ID NO: 333197 - RNA, 64 nt, Human; identical to SEQ ID NO: 128534

SEQ ID NO: 333198 - RNA, 64 nt, Human; identical to SEQ ID NO: 128535

SEQ ID NO: 333199 - RNA, 64 nt, Human; identical to SEQ ID NO: 128536

SEQ ID NO: 333200 - RNA, 64 nt, Human; identical to SEQ ID NO: 128537

SEQ ID NO: 333201 - RNA, 64 nt, Human; identical to SEQ ID NO: 128538

SEQ ID NO: 333202 - RNA, 64 nt, Human; identical to SEQ ID NO: 128539

SEQ ID NO: 333203 - RNA, 64 nt, Human; identical to SEQ ID NO: 128540

SEQ ID NO: 333204 - RNA, 64 nt, Human
agggugaaaacaaaaaaaaauaaaaagaaacacagacgcccaggugucagcucuccguuuaaag

SEQ ID NO: 333205 - RNA, 64 nt, Human
guguaggccccuguagugacccacgcguccagcagacgcccacccaccgcuagccguuguuccu

SEQ ID NO: 333206 - RNA, 53 nt, Human
ggaagcucuuuccaggaugaacggacgcccacagaggccugcggggugggggc

SEQ ID NO: 333207 - RNA, 64 nt, Human; identical to SEQ ID NO: 128541

SEQ ID NO: 333208 - RNA, 64 nt, Human; identical to SEQ ID NO: 128542

SEQ ID NO: 333209 - RNA, 64 nt, Human; identical to SEQ ID NO: 128543

SEQ ID NO: 333210 - RNA, 64 nt, Human; identical to SEQ ID NO: 128544

SEQ ID NO: 333211 - RNA, 64 nt, Human; identical to SEQ ID NO: 128545

SEQ ID NO: 333212 - RNA, 64 nt, Human; identical to SEQ ID NO: 128546

SEQ ID NO: 333213 - RNA, 64 nt, Human; identical to SEQ ID NO: 128547

SEQ ID NO: 333214 - RNA, 64 nt, Human; identical to SEQ ID NO: 128548

SEQ ID NO: 333215 - RNA, 64 nt, Human; identical to SEQ ID NO: 128549

SEQ ID NO: 333216 - RNA, 64 nt, Human; identical to SEQ ID NO: 128550

SEQ ID NO: 333217 - RNA, 64 nt, Human; identical to SEQ ID NO: 128551

SEQ ID NO: 333218 - RNA, 64 nt, Human; identical to SEQ ID NO: 128552

SEQ ID NO: 333219 - RNA, 64 nt, Human; identical to SEQ ID NO: 128553

SEQ ID NO: 333220 - RNA, 64 nt, Human; identical to SEQ ID NO: 128554

SEQ ID NO: 333221 - RNA, 64 nt, Human; identical to SEQ ID NO: 128555

SEQ ID NO: 333222 - RNA, 64 nt, Human; identical to SEQ ID NO: 128556

SEQ ID NO: 333223 - RNA, 64 nt, Human; identical to SEQ ID NO: 31822

SEQ ID NO: 333224 - RNA, 64 nt, Human; identical to SEQ ID NO: 31823

SEQ ID NO: 333225 - RNA, 64 nt, Human; identical to SEQ ID NO: 31824

SEQ ID NO: 333226 - RNA, 64 nt, Human; identical to SEQ ID NO: 128557

SEQ ID NO: 333227 - RNA, 64 nt, Human; identical to SEQ ID NO: 128558

SEQ ID NO: 333228 - RNA, 64 nt, Human; identical to SEQ ID NO: 128559

SEQ ID NO: 333229 - RNA, 64 nt, Human; identical to SEQ ID NO: 128560

SEQ ID NO: 333230 - RNA, 64 nt, Human; identical to SEQ ID NO: 128561

SEQ ID NO: 333231 - RNA, 64 nt, Human; identical to SEQ ID NO: 128562

SEQ ID NO: 333232 - RNA, 64 nt, Human; identical to SEQ ID NO: 128563

SEQ ID NO: 333233 - RNA, 64 nt, Human; identical to SEQ ID NO: 128564

SEQ ID NO: 333234 - RNA, 64 nt, Human; identical to SEQ ID NO: 128565

SEQ ID NO: 333235 - RNA, 64 nt, Human; identical to SEQ ID NO: 128566

SEQ ID NO: 333236 - RNA, 58 nt, Human; identical to SEQ ID NO: 128567

SEQ ID NO: 333237 - RNA, 64 nt, Human; identical to SEQ ID NO: 128568

SEQ ID NO: 333238 - RNA, 64 nt, Human; identical to SEQ ID NO: 128569

SEQ ID NO: 333239 - RNA, 64 nt, Human; identical to SEQ ID NO: 128570

SEQ ID NO: 333240 - RNA, 64 nt, Human; identical to SEQ ID NO: 128571

SEQ ID NO: 333241 - RNA, 64 nt, Human; identical to SEQ ID NO: 128572

SEQ ID NO: 333242 - RNA, 64 nt, Human; identical to SEQ ID NO: 31787

SEQ ID NO: 333243 - RNA, 64 nt, Human; identical to SEQ ID NO: 31788

SEQ ID NO: 333244 - RNA, 64 nt, Human; identical to SEQ ID NO: 31825

SEQ ID NO: 333245 - RNA, 64 nt, Human; identical to SEQ ID NO: 128573

SEQ ID NO: 333246 - RNA, 64 nt, Human; identical to SEQ ID NO: 128574

SEQ ID NO: 333247 - RNA, 64 nt, Human; identical to SEQ ID NO: 128575

SEQ ID NO: 333248 - RNA, 64 nt, Human; identical to SEQ ID NO: 128576

SEQ ID NO: 333249 - RNA, 64 nt, Human; identical to SEQ ID NO: 128577

SEQ ID NO: 333250 - RNA, 64 nt, Human; identical to SEQ ID NO: 128578

SEQ ID NO: 333251 - RNA, 64 nt, Human; identical to SEQ ID NO: 128579

SEQ ID NO: 333252 - RNA, 64 nt, Human; identical to SEQ ID NO: 128580

SEQ ID NO: 333253 - RNA, 64 nt, Human; identical to SEQ ID NO: 128581

SEQ ID NO: 333254 - RNA, 64 nt, Human; identical to SEQ ID NO: 128582

SEQ ID NO: 333255 - RNA, 64 nt, Human; identical to SEQ ID NO: 128583

SEQ ID NO: 333256 - RNA, 64 nt, Human; identical to SEQ ID NO: 128584

SEQ ID NO: 333257 - RNA, 64 nt, Human; identical to SEQ ID NO: 128585

SEQ ID NO: 333258 - RNA, 64 nt, Human; identical to SEQ ID NO: 128586

SEQ ID NO: 333259 - RNA, 64 nt, Human; identical to SEQ ID NO: 128587

SEQ ID NO: 333260 - RNA, 64 nt, Human; identical to SEQ ID NO: 128588

SEQ ID NO: 333261 - RNA, 64 nt, Human; identical to SEQ ID NO: 31827

SEQ ID NO: 333262 - RNA, 64 nt, Human; identical to SEQ ID NO: 31828

SEQ ID NO: 333263 - RNA, 64 nt, Human; identical to SEQ ID NO: 31829

SEQ ID NO: 333264 - RNA, 64 nt, Human; identical to SEQ ID NO: 128589

SEQ ID NO: 333265 - RNA, 64 nt, Human; identical to SEQ ID NO: 128590

SEQ ID NO: 333266 - RNA, 64 nt, Human; identical to SEQ ID NO: 128591

SEQ ID NO: 333267 - RNA, 64 nt, Human; identical to SEQ ID NO: 128592

SEQ ID NO: 333268 - RNA, 64 nt, Human; identical to SEQ ID NO: 128593

SEQ ID NO: 333269 - RNA, 64 nt, Human; identical to SEQ ID NO: 128594

SEQ ID NO: 333270 - RNA, 64 nt, Human; identical to SEQ ID NO: 128595

SEQ ID NO: 333271 - RNA, 64 nt, Human; identical to SEQ ID NO: 128596

SEQ ID NO: 333272 - RNA, 64 nt, Human; identical to SEQ ID NO: 128597

SEQ ID NO: 333273 - RNA, 64 nt, Human; identical to SEQ ID NO: 128598

SEQ ID NO: 333274 - RNA, 64 nt, Human; identical to SEQ ID NO: 128599

SEQ ID NO: 333275 - RNA, 64 nt, Human; identical to SEQ ID NO: 128600

SEQ ID NO: 333276 - RNA, 64 nt, Human; identical to SEQ ID NO: 128601

SEQ ID NO: 333277 - RNA, 64 nt, Human; identical to SEQ ID NO: 128602

SEQ ID NO: 333278 - RNA, 56 nt, Human; identical to SEQ ID NO: 128603

SEQ ID NO: 333279 - RNA, 64 nt, Human; identical to SEQ ID NO: 128604

SEQ ID NO: 333280 - RNA, 64 nt, Human; identical to SEQ ID NO: 31759

SEQ ID NO: 333281 - RNA, 64 nt, Human; identical to SEQ ID NO: 31760

SEQ ID NO: 333282 - RNA, 64 nt, Human; identical to SEQ ID NO: 31761

SEQ ID NO: 333283 - RNA, 64 nt, Human; identical to SEQ ID NO: 128605

SEQ ID NO: 333284 - RNA, 64 nt, Human; identical to SEQ ID NO: 128606

SEQ ID NO: 333285 - RNA, 64 nt, Human; identical to SEQ ID NO: 128607

SEQ ID NO: 333286 - RNA, 64 nt, Human; identical to SEQ ID NO: 128608

SEQ ID NO: 333287 - RNA, 64 nt, Human; identical to SEQ ID NO: 128609

SEQ ID NO: 333288 - RNA, 64 nt, Human; identical to SEQ ID NO: 128610

SEQ ID NO: 333289 - RNA, 64 nt, Human; identical to SEQ ID NO: 128611

SEQ ID NO: 333290 - RNA, 50 nt, Human; identical to SEQ ID NO: 128612

SEQ ID NO: 333291 - RNA, 64 nt, Human; identical to SEQ ID NO: 128613

SEQ ID NO: 333292 - RNA, 64 nt, Human; identical to SEQ ID NO: 128614

SEQ ID NO: 333293 - RNA, 64 nt, Human; identical to SEQ ID NO: 128615

SEQ ID NO: 333294 - RNA, 64 nt, Human; identical to SEQ ID NO: 128616

SEQ ID NO: 333295 - RNA, 64 nt, Human; identical to SEQ ID NO: 128617

SEQ ID NO: 333296 - RNA, 64 nt, Human; identical to SEQ ID NO: 128618

SEQ ID NO: 333297 - RNA, 64 nt, Human; identical to SEQ ID NO: 128619

SEQ ID NO: 333298 - RNA, 64 nt, Human; identical to SEQ ID NO: 128620

SEQ ID NO: 333299 - RNA, 64 nt, Human; identical to SEQ ID NO: 31764

SEQ ID NO: 333300 - RNA, 64 nt, Human; identical to SEQ ID NO: 31765

SEQ ID NO: 333301 - RNA, 64 nt, Human; identical to SEQ ID NO: 31766

SEQ ID NO: 333302 - RNA, 50 nt, Human; identical to SEQ ID NO: 128621

SEQ ID NO: 333303 - RNA, 64 nt, Human; identical to SEQ ID NO: 128622

SEQ ID NO: 333304 - RNA, 64 nt, Human; identical to SEQ ID NO: 128623

SEQ ID NO: 333305 - RNA, 64 nt, Human; identical to SEQ ID NO: 128624

SEQ ID NO: 333306 - RNA, 64 nt, Human; identical to SEQ ID NO: 128625

SEQ ID NO: 333307 - RNA, 64 nt, Human; identical to SEQ ID NO: 128626

SEQ ID NO: 333308 - RNA, 64 nt, Human; identical to SEQ ID NO: 128627

SEQ ID NO: 333309 - RNA, 64 nt, Human; identical to SEQ ID NO: 128628

SEQ ID NO: 333310 - RNA, 64 nt, Human; identical to SEQ ID NO: 128629

SEQ ID NO: 333311 - RNA, 64 nt, Human; identical to SEQ ID NO: 128630

SEQ ID NO: 333312 - RNA, 64 nt, Human; identical to SEQ ID NO: 128631

SEQ ID NO: 333313 - RNA, 64 nt, Human; identical to SEQ ID NO: 128632

SEQ ID NO: 333314 - RNA, 64 nt, Human; identical to SEQ ID NO: 128633

SEQ ID NO: 333315 - RNA, 64 nt, Human; identical to SEQ ID NO: 128634

SEQ ID NO: 333316 - RNA, 64 nt, Human; identical to SEQ ID NO: 128635

SEQ ID NO: 333317 - RNA, 64 nt, Human; identical to SEQ ID NO: 128636

SEQ ID NO: 333318 - RNA, 64 nt, Human; identical to SEQ ID NO: 31756

SEQ ID NO: 333319 - RNA, 64 nt, Human; identical to SEQ ID NO: 31757

SEQ ID NO: 333320 - RNA, 64 nt, Human; identical to SEQ ID NO: 31762

SEQ ID NO: 333321 - RNA, 64 nt, Human; identical to SEQ ID NO: 128637

SEQ ID NO: 333322 - RNA, 64 nt, Human; identical to SEQ ID NO: 128638

SEQ ID NO: 333323 - RNA, 64 nt, Human; identical to SEQ ID NO: 128639

SEQ ID NO: 333324 - RNA, 64 nt, Human; identical to SEQ ID NO: 128640

SEQ ID NO: 333325 - RNA, 64 nt, Human; identical to SEQ ID NO: 128641

SEQ ID NO: 333326 - RNA, 64 nt, Human; identical to SEQ ID NO: 128642

SEQ ID NO: 333327 - RNA, 64 nt, Human; identical to SEQ ID NO: 128643

SEQ ID NO: 333328 - RNA, 64 nt, Human; identical to SEQ ID NO: 128644

SEQ ID NO: 333329 - RNA, 64 nt, Human; identical to SEQ ID NO: 128645

SEQ ID NO: 333330 - RNA, 64 nt, Human; identical to SEQ ID NO: 128646

SEQ ID NO: 333331 - RNA, 64 nt, Human; identical to SEQ ID NO: 128647

SEQ ID NO: 333332 - RNA, 64 nt, Human; identical to SEQ ID NO: 128648

SEQ ID NO: 333333 - RNA, 64 nt, Human; identical to SEQ ID NO: 128649

SEQ ID NO: 333334 - RNA, 64 nt, Human; identical to SEQ ID NO: 128650

SEQ ID NO: 333335 - RNA, 64 nt, Human; identical to SEQ ID NO: 128651

SEQ ID NO: 333336 - RNA, 64 nt, Human; identical to SEQ ID NO: 128652

SEQ ID NO: 333337 - RNA, 64 nt, Human; identical to SEQ ID NO: 31750

SEQ ID NO: 333338 - RNA, 64 nt, Human; identical to SEQ ID NO: 31751

SEQ ID NO: 333339 - RNA, 64 nt, Human; identical to SEQ ID NO: 31767

SEQ ID NO: 333340 - RNA, 64 nt, Human; identical to SEQ ID NO: 128653

SEQ ID NO: 333341 - RNA, 64 nt, Human; identical to SEQ ID NO: 128654

SEQ ID NO: 333342 - RNA, 64 nt, Human; identical to SEQ ID NO: 128655

SEQ ID NO: 333343 - RNA, 64 nt, Human; identical to SEQ ID NO: 128656

SEQ ID NO: 333344 - RNA, 52 nt, Human; identical to SEQ ID NO: 128657

SEQ ID NO: 333345 - RNA, 64 nt, Human; identical to SEQ ID NO: 128658

SEQ ID NO: 333346 - RNA, 64 nt, Human; identical to SEQ ID NO: 128659

SEQ ID NO: 333347 - RNA, 64 nt, Human; identical to SEQ ID NO: 128660

SEQ ID NO: 333348 - RNA, 64 nt, Human; identical to SEQ ID NO: 128661

SEQ ID NO: 333349 - RNA, 64 nt, Human; identical to SEQ ID NO: 128662

SEQ ID NO: 333350 - RNA, 64 nt, Human; identical to SEQ ID NO: 128663

SEQ ID NO: 333351 - RNA, 64 nt, Human; identical to SEQ ID NO: 128664

SEQ ID NO: 333352 - RNA, 64 nt, Human; identical to SEQ ID NO: 128665

SEQ ID NO: 333353 - RNA, 64 nt, Human; identical to SEQ ID NO: 128666

SEQ ID NO: 333354 - RNA, 64 nt, Human; identical to SEQ ID NO: 128667

SEQ ID NO: 333355 - RNA, 64 nt, Human; identical to SEQ ID NO: 128668

SEQ ID NO: 333356 - RNA, 64 nt, Human; identical to SEQ ID NO: 31830

SEQ ID NO: 333357 - RNA, 64 nt, Human; identical to SEQ ID NO: 31831

SEQ ID NO: 333358 - RNA, 64 nt, Human; identical to SEQ ID NO: 31833

SEQ ID NO: 333359 - RNA, 64 nt, Human; identical to SEQ ID NO: 128669

SEQ ID NO: 333360 - RNA, 64 nt, Human; identical to SEQ ID NO: 128670

SEQ ID NO: 333361 - RNA, 64 nt, Human; identical to SEQ ID NO: 128671

SEQ ID NO: 333362 - RNA, 64 nt, Human; identical to SEQ ID NO: 128672

SEQ ID NO: 333363 - RNA, 64 nt, Human; identical to SEQ ID NO: 128673

SEQ ID NO: 333364 - RNA, 64 nt, Human; identical to SEQ ID NO: 128674

SEQ ID NO: 333365 - RNA, 64 nt, Human; identical to SEQ ID NO: 128675

SEQ ID NO: 333366 - RNA, 64 nt, Human; identical to SEQ ID NO: 128676

SEQ ID NO: 333367 - RNA, 64 nt, Human; identical to SEQ ID NO: 128677

SEQ ID NO: 333368 - RNA, 64 nt, Human; identical to SEQ ID NO: 128678

SEQ ID NO: 333369 - RNA, 64 nt, Human; identical to SEQ ID NO: 128679

SEQ ID NO: 333370 - RNA, 64 nt, Human; identical to SEQ ID NO: 128680

SEQ ID NO: 333371 - RNA, 64 nt, Human; identical to SEQ ID NO: 128681

SEQ ID NO: 333372 - RNA, 64 nt, Human; identical to SEQ ID NO: 128682

SEQ ID NO: 333373 - RNA, 64 nt, Human; identical to SEQ ID NO: 128683

SEQ ID NO: 333374 - RNA, 64 nt, Human; identical to SEQ ID NO: 128684

SEQ ID NO: 333375 - RNA, 64 nt, Human; identical to SEQ ID NO: 31746

SEQ ID NO: 333376 - RNA, 64 nt, Human; identical to SEQ ID NO: 31747

SEQ ID NO: 333377 - RNA, 64 nt, Human; identical to SEQ ID NO: 31769

SEQ ID NO: 333378 - RNA, 64 nt, Human; identical to SEQ ID NO: 128685

SEQ ID NO: 333379 - RNA, 64 nt, Human; identical to SEQ ID NO: 128686

SEQ ID NO: 333380 - RNA, 64 nt, Human; identical to SEQ ID NO: 128687

SEQ ID NO: 333381 - RNA, 64 nt, Human; identical to SEQ ID NO: 128688

SEQ ID NO: 333382 - RNA, 64 nt, Human; identical to SEQ ID NO: 128689

SEQ ID NO: 333383 - RNA, 64 nt, Human; identical to SEQ ID NO: 128690

SEQ ID NO: 333384 - RNA, 64 nt, Human; identical to SEQ ID NO: 128691

SEQ ID NO: 333385 - RNA, 57 nt, Human; identical to SEQ ID NO: 128692

SEQ ID NO: 333386 - RNA, 64 nt, Human; identical to SEQ ID NO: 128693

SEQ ID NO: 333387 - RNA, 64 nt, Human; identical to SEQ ID NO: 128694

SEQ ID NO: 333388 - RNA, 64 nt, Human; identical to SEQ ID NO: 128695

SEQ ID NO: 333389 - RNA, 64 nt, Human; identical to SEQ ID NO: 128696

SEQ ID NO: 333390 - RNA, 64 nt, Human; identical to SEQ ID NO: 128697

SEQ ID NO: 333391 - RNA, 64 nt, Human; identical to SEQ ID NO: 128698

SEQ ID NO: 333392 - RNA, 64 nt, Human; identical to SEQ ID NO: 128699

SEQ ID NO: 333393 - RNA, 64 nt, Human; identical to SEQ ID NO: 128700

SEQ ID NO: 333394 - RNA, 61 nt, Human; identical to SEQ ID NO: 31727

SEQ ID NO: 333395 - RNA, 64 nt, Human; identical to SEQ ID NO: 31728

SEQ ID NO: 333396 - RNA, 64 nt, Human; identical to SEQ ID NO: 31770

SEQ ID NO: 333397 - RNA, 64 nt, Human; identical to SEQ ID NO: 128701

SEQ ID NO: 333398 - RNA, 64 nt, Human; identical to SEQ ID NO: 128702

SEQ ID NO: 333399 - RNA, 64 nt, Human; identical to SEQ ID NO: 128703

SEQ ID NO: 333400 - RNA, 64 nt, Human; identical to SEQ ID NO: 128704

SEQ ID NO: 333401 - RNA, 64 nt, Human; identical to SEQ ID NO: 128705

SEQ ID NO: 333402 - RNA, 64 nt, Human; identical to SEQ ID NO: 128706

SEQ ID NO: 333403 - RNA, 64 nt, Human; identical to SEQ ID NO: 128707

SEQ ID NO: 333404 - RNA, 64 nt, Human; identical to SEQ ID NO: 128708

SEQ ID NO: 333405 - RNA, 64 nt, Human; identical to SEQ ID NO: 128709

SEQ ID NO: 333406 - RNA, 64 nt, Human; identical to SEQ ID NO: 128710

SEQ ID NO: 333407 - RNA, 64 nt, Human; identical to SEQ ID NO: 128711

SEQ ID NO: 333408 - RNA, 64 nt, Human; identical to SEQ ID NO: 128712

SEQ ID NO: 333409 - RNA, 64 nt, Human; identical to SEQ ID NO: 128713

SEQ ID NO: 333410 - RNA, 64 nt, Human; identical to SEQ ID NO: 128714

SEQ ID NO: 333411 - RNA, 58 nt, Human; identical to SEQ ID NO: 128715

SEQ ID NO: 333412 - RNA, 64 nt, Human; identical to SEQ ID NO: 128716

SEQ ID NO: 333413 - RNA, 64 nt, Human; identical to SEQ ID NO: 31772

SEQ ID NO: 333414 - RNA, 64 nt, Human; identical to SEQ ID NO: 31773

SEQ ID NO: 333415 - RNA, 64 nt, Human; identical to SEQ ID NO: 31774

SEQ ID NO: 333416 - RNA, 64 nt, Human; identical to SEQ ID NO: 128717

SEQ ID NO: 333417 - RNA, 64 nt, Human; identical to SEQ ID NO: 128718

SEQ ID NO: 333418 - RNA, 51 nt, Human; identical to SEQ ID NO: 128719

SEQ ID NO: 333419 - RNA, 64 nt, Human; identical to SEQ ID NO: 128720

SEQ ID NO: 333420 - RNA, 64 nt, Human; identical to SEQ ID NO: 128721

SEQ ID NO: 333421 - RNA, 64 nt, Human; identical to SEQ ID NO: 128722

SEQ ID NO: 333422 - RNA, 64 nt, Human; identical to SEQ ID NO: 128723

SEQ ID NO: 333423 - RNA, 64 nt, Human; identical to SEQ ID NO: 128724

SEQ ID NO: 333424 - RNA, 64 nt, Human; identical to SEQ ID NO: 128725

SEQ ID NO: 333425 - RNA, 64 nt, Human; identical to SEQ ID NO: 128726

SEQ ID NO: 333426 - RNA, 64 nt, Human; identical to SEQ ID NO: 128727

SEQ ID NO: 333427 - RNA, 64 nt, Human; identical to SEQ ID NO: 128728

SEQ ID NO: 333428 - RNA, 64 nt, Human; identical to SEQ ID NO: 128729

SEQ ID NO: 333429 - RNA, 64 nt, Human; identical to SEQ ID NO: 128730

SEQ ID NO: 333430 - RNA, 64 nt, Human; identical to SEQ ID NO: 128731

SEQ ID NO: 333431 - RNA, 64 nt, Human; identical to SEQ ID NO: 128732

SEQ ID NO: 333432 - RNA, 64 nt, Human; identical to SEQ ID NO: 31775

SEQ ID NO: 333433 - RNA, 64 nt, Human; identical to SEQ ID NO: 31776

SEQ ID NO: 333434 - RNA, 64 nt, Human; identical to SEQ ID NO: 31778

SEQ ID NO: 333435 - RNA, 64 nt, Human; identical to SEQ ID NO: 128733

SEQ ID NO: 333436 - RNA, 64 nt, Human; identical to SEQ ID NO: 128734

SEQ ID NO: 333437 - RNA, 64 nt, Human; identical to SEQ ID NO: 128735

SEQ ID NO: 333438 - RNA, 64 nt, Human; identical to SEQ ID NO: 128736

SEQ ID NO: 333439 - RNA, 64 nt, Human; identical to SEQ ID NO: 128737

SEQ ID NO: 333440 - RNA, 64 nt, Human; identical to SEQ ID NO: 128738

SEQ ID NO: 333441 - RNA, 64 nt, Human; identical to SEQ ID NO: 128739

SEQ ID NO: 333442 - RNA, 64 nt, Human; identical to SEQ ID NO: 128740

SEQ ID NO: 333443 - RNA, 64 nt, Human; identical to SEQ ID NO: 128741

SEQ ID NO: 333444 - RNA, 64 nt, Human; identical to SEQ ID NO: 128742

SEQ ID NO: 333445 - RNA, 64 nt, Human; identical to SEQ ID NO: 128743

SEQ ID NO: 333446 - RNA, 64 nt, Human; identical to SEQ ID NO: 128744

SEQ ID NO: 333447 - RNA, 64 nt, Human; identical to SEQ ID NO: 128745

SEQ ID NO: 333448 - RNA, 64 nt, Human; identical to SEQ ID NO: 128746

SEQ ID NO: 333449 - RNA, 64 nt, Human; identical to SEQ ID NO: 128747

SEQ ID NO: 333450 - RNA, 64 nt, Human; identical to SEQ ID NO: 128748

SEQ ID NO: 333451 - RNA, 64 nt, Human; identical to SEQ ID NO: 31739

SEQ ID NO: 333452 - RNA, 64 nt, Human; identical to SEQ ID NO: 31740

SEQ ID NO: 333453 - RNA, 64 nt, Human; identical to SEQ ID NO: 31782

SEQ ID NO: 333454 - RNA, 64 nt, Human; identical to SEQ ID NO: 128749

SEQ ID NO: 333455 - RNA, 64 nt, Human; identical to SEQ ID NO: 128750

SEQ ID NO: 333456 - RNA, 64 nt, Human; identical to SEQ ID NO: 128751

SEQ ID NO: 333457 - RNA, 64 nt, Human; identical to SEQ ID NO: 128752

SEQ ID NO: 333458 - RNA, 62 nt, Human; identical to SEQ ID NO: 128753

SEQ ID NO: 333459 - RNA, 64 nt, Human; identical to SEQ ID NO: 128754

SEQ ID NO: 333460 - RNA, 64 nt, Human; identical to SEQ ID NO: 128755

SEQ ID NO: 333461 - RNA, 64 nt, Human; identical to SEQ ID NO: 128756

SEQ ID NO: 333462 - RNA, 64 nt, Human; identical to SEQ ID NO: 128757

SEQ ID NO: 333463 - RNA, 64 nt, Human; identical to SEQ ID NO: 128758

SEQ ID NO: 333464 - RNA, 64 nt, Human; identical to SEQ ID NO: 128759

SEQ ID NO: 333465 - RNA, 64 nt, Human; identical to SEQ ID NO: 128760

SEQ ID NO: 333466 - RNA, 64 nt, Human; identical to SEQ ID NO: 128761

SEQ ID NO: 333467 - RNA, 64 nt, Human; identical to SEQ ID NO: 128762

SEQ ID NO: 333468 - RNA, 64 nt, Human; identical to SEQ ID NO: 128763

SEQ ID NO: 333469 - RNA, 50 nt, Human; identical to SEQ ID NO: 128764

SEQ ID NO: 333470 - RNA, 64 nt, Human
ccgccgcucagcgccccggcugggcggaggaggagacgcccaugccccucaggggaaaguggag

SEQ ID NO: 333471 - RNA, 64 nt, Human
ccagacagcccacgaccgggucgaccccccaggggacgcccaugccaggcccggggaccugugc

SEQ ID NO: 333472 - RNA, 64 nt, Human
uggagaguuggucaggcugcugcugggagaaauggacgcccacugggccucaacuugaucuucu

SEQ ID NO: 333473 - RNA, 64 nt, Human; identical to SEQ ID NO: 128765

SEQ ID NO: 333474 - RNA, 64 nt, Human; identical to SEQ ID NO: 128766

SEQ ID NO: 333475 - RNA, 64 nt, Human; identical to SEQ ID NO: 128767

SEQ ID NO: 333476 - RNA, 64 nt, Human; identical to SEQ ID NO: 128768

SEQ ID NO: 333477 - RNA, 64 nt, Human; identical to SEQ ID NO: 128769

SEQ ID NO: 333478 - RNA, 64 nt, Human; identical to SEQ ID NO: 128770

SEQ ID NO: 333479 - RNA, 64 nt, Human; identical to SEQ ID NO: 128771

SEQ ID NO: 333480 - RNA, 64 nt, Human; identical to SEQ ID NO: 128772

SEQ ID NO: 333481 - RNA, 59 nt, Human; identical to SEQ ID NO: 128773

SEQ ID NO: 333482 - RNA, 64 nt, Human; identical to SEQ ID NO: 128774

SEQ ID NO: 333483 - RNA, 64 nt, Human; identical to SEQ ID NO: 128775

SEQ ID NO: 333484 - RNA, 53 nt, Human; identical to SEQ ID NO: 128776

SEQ ID NO: 333485 - RNA, 64 nt, Human; identical to SEQ ID NO: 128777

SEQ ID NO: 333486 - RNA, 64 nt, Human; identical to SEQ ID NO: 128778

SEQ ID NO: 333487 - RNA, 64 nt, Human; identical to SEQ ID NO: 128779

SEQ ID NO: 333488 - RNA, 64 nt, Human; identical to SEQ ID NO: 128780

SEQ ID NO: 333489 - RNA, 64 nt, Human; identical to SEQ ID NO: 31783

SEQ ID NO: 333490 - RNA, 64 nt, Human; identical to SEQ ID NO: 31784

SEQ ID NO: 333491 - RNA, 64 nt, Human; identical to SEQ ID NO: 31786

SEQ ID NO: 333492 - RNA, 64 nt, Human; identical to SEQ ID NO: 128781

SEQ ID NO: 333493 - RNA, 64 nt, Human; identical to SEQ ID NO: 128782

SEQ ID NO: 333494 - RNA, 64 nt, Human; identical to SEQ ID NO: 128783

SEQ ID NO: 333495 - RNA, 64 nt, Human; identical to SEQ ID NO: 128784

SEQ ID NO: 333496 - RNA, 64 nt, Human; identical to SEQ ID NO: 128785

SEQ ID NO: 333497 - RNA, 64 nt, Human; identical to SEQ ID NO: 128786

SEQ ID NO: 333498 - RNA, 64 nt, Human; identical to SEQ ID NO: 128787

SEQ ID NO: 333499 - RNA, 64 nt, Human; identical to SEQ ID NO: 128788

SEQ ID NO: 333500 - RNA, 64 nt, Human; identical to SEQ ID NO: 128789

SEQ ID NO: 333501 - RNA, 64 nt, Human; identical to SEQ ID NO: 128790

SEQ ID NO: 333502 - RNA, 64 nt, Human; identical to SEQ ID NO: 128791

SEQ ID NO: 333503 - RNA, 64 nt, Human; identical to SEQ ID NO: 128792

SEQ ID NO: 333504 - RNA, 64 nt, Human; identical to SEQ ID NO: 128793

SEQ ID NO: 333505 - RNA, 64 nt, Human; identical to SEQ ID NO: 128794

SEQ ID NO: 333506 - RNA, 64 nt, Human; identical to SEQ ID NO: 128795

SEQ ID NO: 333507 - RNA, 64 nt, Human; identical to SEQ ID NO: 128796

SEQ ID NO: 333508 - RNA, 64 nt, Human; identical to SEQ ID NO: 304204

SEQ ID NO: 333509 - RNA, 64 nt, Human; identical to SEQ ID NO: 307880

SEQ ID NO: 333510 - RNA, 64 nt, Human; identical to SEQ ID NO: 308091

SEQ ID NO: 333511 - RNA, 64 nt, Human; identical to SEQ ID NO: 128797

SEQ ID NO: 333512 - RNA, 64 nt, Human; identical to SEQ ID NO: 128798

SEQ ID NO: 333513 - RNA, 64 nt, Human; identical to SEQ ID NO: 128799

SEQ ID NO: 333514 - RNA, 64 nt, Human; identical to SEQ ID NO: 128800

SEQ ID NO: 333515 - RNA, 64 nt, Human; identical to SEQ ID NO: 128801

SEQ ID NO: 333516 - RNA, 64 nt, Human; identical to SEQ ID NO: 128802

SEQ ID NO: 333517 - RNA, 64 nt, Human; identical to SEQ ID NO: 128803

SEQ ID NO: 333518 - RNA, 57 nt, Human; identical to SEQ ID NO: 128804

SEQ ID NO: 333519 - RNA, 64 nt, Human; identical to SEQ ID NO: 128805

SEQ ID NO: 333520 - RNA, 64 nt, Human; identical to SEQ ID NO: 128806

SEQ ID NO: 333521 - RNA, 64 nt, Human; identical to SEQ ID NO: 128807

SEQ ID NO: 333522 - RNA, 64 nt, Human; identical to SEQ ID NO: 128808

SEQ ID NO: 333523 - RNA, 64 nt, Human; identical to SEQ ID NO: 128809

SEQ ID NO: 333524 - RNA, 64 nt, Human; identical to SEQ ID NO: 128810

SEQ ID NO: 333525 - RNA, 64 nt, Human; identical to SEQ ID NO: 128811

SEQ ID NO: 333526 - RNA, 64 nt, Human; identical to SEQ ID NO: 128812

SEQ ID NO: 333527 - RNA, 64 nt, Human; identical to SEQ ID NO: 31790

SEQ ID NO: 333528 - RNA, 64 nt, Human; identical to SEQ ID NO: 31791

SEQ ID NO: 333529 - RNA, 64 nt, Human; identical to SEQ ID NO: 31792

SEQ ID NO: 333530 - RNA, 64 nt, Human; identical to SEQ ID NO: 128813

SEQ ID NO: 333531 - RNA, 64 nt, Human; identical to SEQ ID NO: 128814

SEQ ID NO: 333532 - RNA, 64 nt, Human; identical to SEQ ID NO: 128815

SEQ ID NO: 333533 - RNA, 64 nt, Human; identical to SEQ ID NO: 128816

SEQ ID NO: 333534 - RNA, 64 nt, Human; identical to SEQ ID NO: 128817

SEQ ID NO: 333535 - RNA, 64 nt, Human; identical to SEQ ID NO: 128818

SEQ ID NO: 333536 - RNA, 64 nt, Human; identical to SEQ ID NO: 128819

SEQ ID NO: 333537 - RNA, 64 nt, Human; identical to SEQ ID NO: 128820

SEQ ID NO: 333538 - RNA, 64 nt, Human; identical to SEQ ID NO: 128821

SEQ ID NO: 333539 - RNA, 64 nt, Human; identical to SEQ ID NO: 128822

SEQ ID NO: 333540 - RNA, 64 nt, Human; identical to SEQ ID NO: 128823

SEQ ID NO: 333541 - RNA, 64 nt, Human; identical to SEQ ID NO: 128824

SEQ ID NO: 333542 - RNA, 64 nt, Human; identical to SEQ ID NO: 128825

SEQ ID NO: 333543 - RNA, 64 nt, Human; identical to SEQ ID NO: 128826

SEQ ID NO: 333544 - RNA, 64 nt, Human; identical to SEQ ID NO: 128827

SEQ ID NO: 333545 - RNA, 64 nt, Human; identical to SEQ ID NO: 128828

SEQ ID NO: 333546 - RNA, 64 nt, Human; identical to SEQ ID NO: 307862

SEQ ID NO: 333547 - RNA, 64 nt, Human; identical to SEQ ID NO: 307914

SEQ ID NO: 333548 - RNA, 64 nt, Human; identical to SEQ ID NO: 308092

SEQ ID NO: 333549 - RNA, 64 nt, Human; identical to SEQ ID NO: 128829

SEQ ID NO: 333550 - RNA, 64 nt, Human; identical to SEQ ID NO: 128830

SEQ ID NO: 333551 - RNA, 64 nt, Human; identical to SEQ ID NO: 128831

SEQ ID NO: 333552 - RNA, 64 nt, Human; identical to SEQ ID NO: 128832

SEQ ID NO: 333553 - RNA, 54 nt, Human; identical to SEQ ID NO: 128833

SEQ ID NO: 333554 - RNA, 64 nt, Human; identical to SEQ ID NO: 128834

SEQ ID NO: 333555 - RNA, 64 nt, Human; identical to SEQ ID NO: 128835

SEQ ID NO: 333556 - RNA, 64 nt, Human; identical to SEQ ID NO: 128836

SEQ ID NO: 333557 - RNA, 64 nt, Human; identical to SEQ ID NO: 128837

SEQ ID NO: 333558 - RNA, 64 nt, Human; identical to SEQ ID NO: 128838

SEQ ID NO: 333559 - RNA, 64 nt, Human; identical to SEQ ID NO: 128839

SEQ ID NO: 333560 - RNA, 64 nt, Human; identical to SEQ ID NO: 128840

SEQ ID NO: 333561 - RNA, 64 nt, Human; identical to SEQ ID NO: 128841

SEQ ID NO: 333562 - RNA, 64 nt, Human; identical to SEQ ID NO: 128842

SEQ ID NO: 333563 - RNA, 64 nt, Human; identical to SEQ ID NO: 128843

SEQ ID NO: 333564 - RNA, 64 nt, Human; identical to SEQ ID NO: 128844

SEQ ID NO: 333565 - RNA, 64 nt, Human; identical to SEQ ID NO: 307844

SEQ ID NO: 333566 - RNA, 64 nt, Human; identical to SEQ ID NO: 304203

SEQ ID NO: 333567 - RNA, 64 nt, Human; identical to SEQ ID NO: 307896

SEQ ID NO: 333568 - RNA, 64 nt, Human; identical to SEQ ID NO: 128845

SEQ ID NO: 333569 - RNA, 64 nt, Human; identical to SEQ ID NO: 128846

SEQ ID NO: 333570 - RNA, 64 nt, Human; identical to SEQ ID NO: 128847

SEQ ID NO: 333571 - RNA, 64 nt, Human; identical to SEQ ID NO: 128848

SEQ ID NO: 333572 - RNA, 50 nt, Human; identical to SEQ ID NO: 128849

SEQ ID NO: 333573 - RNA, 64 nt, Human; identical to SEQ ID NO: 128850

SEQ ID NO: 333574 - RNA, 64 nt, Human; identical to SEQ ID NO: 128851

SEQ ID NO: 333575 - RNA, 64 nt, Human; identical to SEQ ID NO: 128852

SEQ ID NO: 333576 - RNA, 64 nt, Human; identical to SEQ ID NO: 128853

SEQ ID NO: 333577 - RNA, 64 nt, Human; identical to SEQ ID NO: 128854

SEQ ID NO: 333578 - RNA, 64 nt, Human; identical to SEQ ID NO: 128855

SEQ ID NO: 333579 - RNA, 64 nt, Human; identical to SEQ ID NO: 128856

SEQ ID NO: 333580 - RNA, 64 nt, Human; identical to SEQ ID NO: 128857

SEQ ID NO: 333581 - RNA, 64 nt, Human; identical to SEQ ID NO: 128858

SEQ ID NO: 333582 - RNA, 64 nt, Human; identical to SEQ ID NO: 128859

SEQ ID NO: 333583 - RNA, 64 nt, Human; identical to SEQ ID NO: 128860

SEQ ID NO: 333584 - RNA, 64 nt, Human; identical to SEQ ID NO: 307897

SEQ ID NO: 333585 - RNA, 64 nt, Human; identical to SEQ ID NO: 307898

SEQ ID NO: 333586 - RNA, 64 nt, Human; identical to SEQ ID NO: 307774

SEQ ID NO: 333587 - RNA, 64 nt, Human; identical to SEQ ID NO: 128861

SEQ ID NO: 333588 - RNA, 64 nt, Human; identical to SEQ ID NO: 128862

SEQ ID NO: 333589 - RNA, 64 nt, Human; identical to SEQ ID NO: 128863

SEQ ID NO: 333590 - RNA, 64 nt, Human; identical to SEQ ID NO: 128864

SEQ ID NO: 333591 - RNA, 64 nt, Human; identical to SEQ ID NO: 128865

SEQ ID NO: 333592 - RNA, 64 nt, Human; identical to SEQ ID NO: 128866

SEQ ID NO: 333593 - RNA, 64 nt, Human; identical to SEQ ID NO: 128867

SEQ ID NO: 333594 - RNA, 64 nt, Human; identical to SEQ ID NO: 128868

SEQ ID NO: 333595 - RNA, 64 nt, Human; identical to SEQ ID NO: 128869

SEQ ID NO: 333596 - RNA, 64 nt, Human; identical to SEQ ID NO: 128870

SEQ ID NO: 333597 - RNA, 64 nt, Human; identical to SEQ ID NO: 128871

SEQ ID NO: 333598 - RNA, 64 nt, Human; identical to SEQ ID NO: 128872

SEQ ID NO: 333599 - RNA, 64 nt, Human; identical to SEQ ID NO: 128873

SEQ ID NO: 333600 - RNA, 64 nt, Human; identical to SEQ ID NO: 128874

SEQ ID NO: 333601 - RNA, 64 nt, Human; identical to SEQ ID NO: 128875

SEQ ID NO: 333602 - RNA, 64 nt, Human; identical to SEQ ID NO: 128876

SEQ ID NO: 333603 - RNA, 64 nt, Human; identical to SEQ ID NO: 307825

SEQ ID NO: 333604 - RNA, 64 nt, Human; identical to SEQ ID NO: 307826

SEQ ID NO: 333605 - RNA, 64 nt, Human; identical to SEQ ID NO: 31719

SEQ ID NO: 333606 - RNA, 64 nt, Human; identical to SEQ ID NO: 128877

SEQ ID NO: 333607 - RNA, 64 nt, Human; identical to SEQ ID NO: 128878

SEQ ID NO: 333608 - RNA, 64 nt, Human; identical to SEQ ID NO: 128867

SEQ ID NO: 333609 - RNA, 64 nt, Human; identical to SEQ ID NO: 128880

SEQ ID NO: 333610 - RNA, 64 nt, Human; identical to SEQ ID NO: 128881

SEQ ID NO: 333611 - RNA, 64 nt, Human; identical to SEQ ID NO: 128882

SEQ ID NO: 333612 - RNA, 64 nt, Human; identical to SEQ ID NO: 128883

SEQ ID NO: 333613 - RNA, 64 nt, Human; identical to SEQ ID NO: 128884

SEQ ID NO: 333614 - RNA, 64 nt, Human; identical to SEQ ID NO: 128885

SEQ ID NO: 333615 - RNA, 64 nt, Human; identical to SEQ ID NO: 128886

SEQ ID NO: 333616 - RNA, 64 nt, Human; identical to SEQ ID NO: 128887

SEQ ID NO: 333617 - RNA, 64 nt, Human; identical to SEQ ID NO: 128888

SEQ ID NO: 333618 - RNA, 64 nt, Human; identical to SEQ ID NO: 128889

SEQ ID NO: 333619 - RNA, 64 nt, Human; identical to SEQ ID NO: 128890

SEQ ID NO: 333620 - RNA, 64 nt, Human; identical to SEQ ID NO: 128891

SEQ ID NO: 333621 - RNA, 64 nt, Human; identical to SEQ ID NO: 128892

SEQ ID NO: 333622 - RNA, 64 nt, Human; identical to SEQ ID NO: 31720

SEQ ID NO: 333623 - RNA, 64 nt, Human; identical to SEQ ID NO: 31721

SEQ ID NO: 333624 - RNA, 64 nt, Human; identical to SEQ ID NO: 31796

SEQ ID NO: 333625 - RNA, 64 nt, Human; identical to SEQ ID NO: 128893

SEQ ID NO: 333626 - RNA, 64 nt, Human; identical to SEQ ID NO: 128894

SEQ ID NO: 333627 - RNA, 64 nt, Human; identical to SEQ ID NO: 128895

SEQ ID NO: 333628 - RNA, 64 nt, Human; identical to SEQ ID NO: 128896

SEQ ID NO: 333629 - RNA, 64 nt, Human; identical to SEQ ID NO: 128897

SEQ ID NO: 333630 - RNA, 53 nt, Human; identical to SEQ ID NO: 128898

SEQ ID NO: 333631 - RNA, 64 nt, Human; identical to SEQ ID NO: 128899

SEQ ID NO: 333632 - RNA, 64 nt, Human; identical to SEQ ID NO: 128900

SEQ ID NO: 333633 - RNA, 64 nt, Human; identical to SEQ ID NO: 128901

SEQ ID NO: 333634 - RNA, 64 nt, Human; identical to SEQ ID NO: 128902

SEQ ID NO: 333635 - RNA, 64 nt, Human; identical to SEQ ID NO: 128903

SEQ ID NO: 333636 - RNA, 64 nt, Human; identical to SEQ ID NO: 31723

SEQ ID NO: 333637 - RNA, 64 nt, Human; identical to SEQ ID NO: 31724

SEQ ID NO: 333638 - RNA, 64 nt, Human; identical to SEQ ID NO: 31725

SEQ ID NO: 333639 - RNA, 64 nt, Human; identical to SEQ ID NO: 31726

SEQ ID NO: 333640 - RNA, 64 nt, Human
ugggcgccccaucccccaacagaacucccgggccccaauccaguauacccuaacccuugauguc

SEQ ID NO: 333641 - RNA, 64 nt, Human
gggacguuauuuuuauuuauauauggggccuaggccaauccaggaugguagcuggaauaccuuc

SEQ ID NO: 333642 - RNA, 64 nt, Human
gggaaggaagaagagggaagaauccgaccacuuuccaauccagugccaauuggcccacuaagca

SEQ ID NO: 333643 - RNA, 64 nt, Human
aaucuaauaaauacuaauccaguccaauacuaauccaauccaauacuaauaauacuauugguac

SEQ ID NO: 333644 - RNA, 64 nt, Human
uuccuauauucuucugcaaaucaaacguucuuucccaauccaauccagccuugguuuuauuuua

SEQ ID NO: 333645 - RNA, 64 nt, Human
auauucuucugcaaaucaaacguucuuucccaauccaauccagccuugguuuuauuuuaaauua

SEQ ID NO: 333646 - RNA, 64 nt, Human
gacaucaaggcucuuccguuccacauccacacagccaauccaauuaaucaaaccacuguuauua

SEQ ID NO: 333647 - RNA, 64 nt, Human
cccgggaagcauccuccccaccagagcugccuccccaauccauuuggcagaacugcuggggcug

SEQ ID NO: 333648 - RNA, 64 nt, Human
gacacggcaccccccugggccuggagggagagggccaauccagacacacucacacucucaucuc

SEQ ID NO: 333649 - RNA, 64 nt, Human
cuggaacgucgggggcaaagcauacacacacacuccaauccauccaugcauacauagacacaag

SEQ ID NO: 333650 - RNA, 64 nt, Human
agggucuuuaagaaccuacuuccuaaucucuuccccaauccaaaccauagcugucuguccagug

SEQ ID NO: 333651 - RNA, 64 nt, Human
caucauuuccagcaugugguucaaauaauauuuuccaauccacuucaggccaaaacaugcuaaa

SEQ ID NO: 333652 - RNA, 64 nt, Human
gcuugauuuuaucaucugcagucaaauaacugagccaauccaaauuuaaaugauagaugcuuua

SEQ ID NO: 333653 - RNA, 64 nt, Human; identical to SEQ ID NO: 307790

SEQ ID NO: 333654 - RNA, 64 nt, Human; identical to SEQ ID NO: 307791

SEQ ID NO: 333655 - RNA, 64 nt, Human; identical to SEQ ID NO: 304426

SEQ ID NO: 333656 - RNA, 64 nt, Human
uuugucucugggguccuguuccuuccugcaaagcccaauccaagacuggcauggcucagagguu

SEQ ID NO: 333657 - RNA, 55 nt, Human
aaaacuccagacucauuuaaucaccccaauccagcuccuggaggagggacccagc

SEQ ID NO: 333658 - RNA, 64 nt, Human
cuaagaccugggguuaaguguggguugugcauccccaauccagauaauaaagacuuuguaaaac

SEQ ID NO: 333659 - RNA, 64 nt, Human
gauugauuguuuuaaaaaaaaauacgcacauuguccaauccagugauuuuaaucauacaguuug

SEQ ID NO: 333660 - RNA, 64 nt, Human
uugcacauaguuaccagucacucuguuucugaaaccaauccagaaauucauguuagaacauugu

SEQ ID NO: 333661 - RNA, 64 nt, Human
gaaagauuuuugaaauauaaaaaauaaauuaggcccaauccaagaaauugagugagaaggaaac

SEQ ID NO: 333662 - RNA, 64 nt, Human
uaccuuaccuccuaagaagaaaagccacuuucuuccaauccaagcccacugcagccuuguggau

SEQ ID NO: 333663 - RNA, 59 nt, Human
gagaagauucccgagaguaaaucaucuuuccaauccagaggaacaagcaugucucucug

SEQ ID NO: 333664 - RNA, 64 nt, Human
ugcagauucuauacuugcguuggccucuaacucuccaauccagagccuccugccucuggcguca

SEQ ID NO: 333665 - RNA, 64 nt, Human
accccauaccuugaucuaccauccauccucuuccccaauccaaaccccacagucucuucucucc

SEQ ID NO: 333666 - RNA, 64 nt, Human
ugcugggauuacaggccucagcuaccacgccuggccaauccaggucuuaagagaccucauugcc

SEQ ID NO: 333667 - RNA, 64 nt, Human
ccacacccacaaggcauccaaagucuguuggcuuccaauccauuucuguguccugcuggagguu

SEQ ID NO: 333668 - RNA, 64 nt, Human
uuaagauuauuuaugugauaaaugaaaucuccuaccaauccauccagccuuuaccagggaagaa

SEQ ID NO: 333669 - RNA, 64 nt, Human
augccagaauaauauaguucaagaccugaaguugccaauccaaguuugcacucuucuggccugc

SEQ ID NO: 333670 - RNA, 64 nt, Human
aacugcaaacagacucuuuucugagacuauuuauccaauccacuggucugugaguuuuugaaau

SEQ ID NO: 333671 - RNA, 64 nt, Human
guauaagucauugacaguuuccugaguggcucugccaauccauaccacccuugguacugugaaa

SEQ ID NO: 333672 - RNA, 64 nt, Human; identical to SEQ ID NO: 31730

SEQ ID NO: 333673 - RNA, 64 nt, Human; identical to SEQ ID NO: 31731

SEQ ID NO: 333674 - RNA, 64 nt, Human; identical to SEQ ID NO: 31732

SEQ ID NO: 333675 - RNA, 64 nt, Human; identical to SEQ ID NO: 31733

SEQ ID NO: 333676 - RNA, 64 nt, Human
auuuaauuaaaaucagucuuauaugaaguauguuccaauccaugugggaacuugacucucucau

SEQ ID NO: 333677 - RNA, 64 nt, Human
aaauauaaaauuauauauaaaggguuauuugaaaccaauccauggcaacgcuggugcuugauac

SEQ ID NO: 333678 - RNA, 64 nt, Human
uuuacuuagaguggaaggacugauugagaauguuccaauccaaaugaaugcaucacaacuuaca

SEQ ID NO: 333679 - RNA, 64 nt, Human
ugcuauggugguauacacugccuaugucuuuauuccaauccacauucgccuggcuugggaauuu

SEQ ID NO: 333680 - RNA, 64 nt, Human
agucuuccaggcaauaccuggcucaggcccagccccaauccauccccuuacuuucugccaugga

SEQ ID NO: 333681 - RNA, 64 nt, Human
aagucagaauuuuuaacuguacugaauagguuccccaauccaucguauuaaaaaacaauuaacu

SEQ ID NO: 333682 - RNA, 64 nt, Human
caaacacucuuugagcuucccuuccuaaagguaaccaauccagugaauagaugugcccuuuuau

SEQ ID NO: 333683 - RNA, 64 nt, Human
auuaccuguucuugccuaauaaguuucuuuuaauccaauccacuaacacuuuaguuauauucac

SEQ ID NO: 333684 - RNA, 64 nt, Human
agcuaauguuuggaaaaaauauauacuugaagaaccaauccaagugugugccccuacccccagc

SEQ ID NO: 333685 - RNA, 64 nt, Human
cuuguucauccuuuguuuugaaaaaauuacucaaccaauccauuacagcuuaaccaagauuaaa

SEQ ID NO: 333686 - RNA, 64 nt, Human
aacugcagcuggcugacaauggaagauccaggugccaauccacagccccaccaggccucauuuc

SEQ ID NO: 333687 - RNA, 64 nt, Human
cuguacagcacuuuuuacauuugcgaagugcuuuccaauccauguuaguuacuaguuauuacag

SEQ ID NO: 333688 - RNA, 64 nt, Human
uuagauguaccaacucaccuuaaauuagcauguuccaauccagucggcauugccugaauacagu

SEQ ID NO: 333689 - RNA, 64 nt, Human
augccuucuccaccugcccucccacucuuccaguccaauccacgcugucuucuguugcaggacu

SEQ ID NO: 333690 - RNA, 64 nt, Human
gcccucccugggguccuugcugcaggccggguggccaauccaggugggagagacacucccaggg

SEQ ID NO: 333691 - RNA, 64 nt, Human
gggaugauggcugguguuauuggccaguuuuuagccaauccaacugaccuagugaagguucaga

SEQ ID NO: 333692 - RNA, 64 nt, Human; identical to SEQ ID NO: 31734

SEQ ID NO: 333693 - RNA, 64 nt, Human; identical to SEQ ID NO: 31735

SEQ ID NO: 333694 - RNA, 64 nt, Human; identical to SEQ ID NO: 31737

SEQ ID NO: 333695 - RNA, 64 nt, Human; identical to SEQ ID NO: 31738

SEQ ID NO: 333696 - RNA, 64 nt, Human
aaccuuuuuguuuaacuucucucuucacugcaucccaauccaucuacaggcaugcacacuuauu

SEQ ID NO: 333697 - RNA, 64 nt, Human
ugaaagagcaagucagcuugugccgcauccccaaccaauccacagccuggaguaccuuucaagg

SEQ ID NO: 333698 - RNA, 64 nt, Human
cgucucccguggaccuggcuggauaugguuuuugccaauccacagagccauccugcccugacag

SEQ ID NO: 333699 - RNA, 64 nt, Human
aggcacccugugccugcuucccucagaggaccuuccaauccauuugccccgcaacccuggcugc

SEQ ID NO: 333700 - RNA, 64 nt, Human
gaguuauuuuugauguuccccaauuccccaccagccaauccaagcauuuucuccugggacccgc

SEQ ID NO: 333701 - RNA, 64 nt, Human
gucccagggcaguguggagugacaggcacgccagccaauccaaucggccauuucauacccaaug

SEQ ID NO: 333702 - RNA, 64 nt, Human
aaacacaaaguuuuuaccaacuuuucaaagcccaccaauccacauuuucuccaggaaauuaaau

SEQ ID NO: 333703 - RNA, 64 nt, Human
ugcuucguuuuauaaaaaagccaaaauuuuuuuuccaauccaaacguucaccuguuuccuuucc

SEQ ID NO: 333704 - RNA, 64 nt, Human
ccacacugucuucuguuuaguguauggggaaagaccaauccaacuguccaucuguggcugggac

SEQ ID NO: 333705 - RNA, 64 nt, Human
uuacauuaccuaauauucucacuagcuauguucuccaauccacacugccuuuuauuguaauauc

SEQ ID NO: 333706 - RNA, 64 nt, Human
agaagauaucuuuugugccuagauugcaaaaucuccaauccacacauauuguuuuaaaauaaga

SEQ ID NO: 333707 - RNA, 64 nt, Human
aagcuauccuguuucagauaauaucaauuuauuuccaauccaucagacuaaaaucuaagaaaau

SEQ ID NO: 333708 - RNA, 64 nt, Human
guguugcuguuggaaauagccccaccccauccucccaauccaaaacguaacugaaauauaauca

SEQ ID NO: 333709 - RNA, 64 nt, Human
uuaaauccuuugucagacacacauauucuuucucccaauccaugccuucccuauucauucucug

SEQ ID NO: 333710 - RNA, 64 nt, Human
acagucauguuuaugguuguuggaugugccacuuccaauccaaaagaagcacacuugguaaguc

SEQ ID NO: 333711 - RNA, 64 nt, Human
ccugguuuuucacaccaaugaaguauuauagaugccaauccaaaaccucagaauuucaggcacc

SEQ ID NO: 333712 - RNA, 64 nt, Human; identical to SEQ ID NO: 31742

SEQ ID NO: 333713 - RNA, 64 nt, Human; identical to SEQ ID NO: 31743

SEQ ID NO: 333714 - RNA, 64 nt, Human; identical to SEQ ID NO: 31744

SEQ ID NO: 333715 - RNA, 64 nt, Human; identical to SEQ ID NO: 31745

SEQ ID NO: 333716 - RNA, 64 nt, Human
ggggccagaccacgccccugccugagaccacgguccaauccagccuucuucccccagggucccc

SEQ ID NO: 333717 - RNA, 64 nt, Human
gaauuucuauuuaaccagaccuguaguaguauuaccaauccaguucaauuaaggugauuuuuug

SEQ ID NO: 333718 - RNA, 64 nt, Human
agcucugcccgggcucgugaagccucagauguccccaauccaagggucuggaggggcugccgug

SEQ ID NO: 333719 - RNA, 64 nt, Human
gguggugcugggucauuacuucugagccccagccccaauccagagaagcgcuguugcccgcccu

SEQ ID NO: 333720 - RNA, 64 nt, Human
uuagaucccuucuaacucauauaauuuuucucagccaauccauucacaagcuuggcauugacau

SEQ ID NO: 333721 - RNA, 64 nt, Human
guagccggaguccuagccucccaaauucggaaauccaauccaacggucucaggaauguuuucca

SEQ ID NO: 333722 - RNA, 64 nt, Human
cuuggucugccaggcccccaccacacaucccagcccaauccagguacgcacagacagguuuuca

SEQ ID NO: 333723 - RNA, 64 nt, Human
aucccaaacuuggauagagccaguucaaccucccccaauccauacacauacauaccuaggucau

SEQ ID NO: 333724 - RNA, 64 nt, Human
aaaucugucacguagaacuuggauguaccugcccccaauccaugaaccaagaccauugaauucu

SEQ ID NO: 333725 - RNA, 64 nt, Human
uguauaaaugauuccucuauuugggagagaucuuccaauccagaggagccccucuuggacugcc

SEQ ID NO: 333726 - RNA, 64 nt, Human
uuucucuuaucccaguaacuccucuucccauuuuccaauccauccccagccuuuuuuuuuuuuc

SEQ ID NO: 333727 - RNA, 64 nt, Human
ugaaucuggguucuuuuuugacuuuuuuuuuuucccaauccaacagcauccuuuuuuuuaaaag

SEQ ID NO: 333728 - RNA, 64 nt, Human
aaccugcucaggaagccuuuugauggcaagaucaccaauccagaugguauugcucccucaggau

SEQ ID NO: 333729 - RNA, 64 nt, Human
gguccagccucuauacccgugccccaacgucagcccaauccaccuugcagacacgagccacacg

SEQ ID NO: 333730 - RNA, 64 nt, Human
gagcaguucuuuuucaguucucauccucuccaucccaauccaguauaucaaucaacucuaacuc

SEQ ID NO: 333731 - RNA, 64 nt, Human
acuuaauuacuuacucaaauucaaugaaucaaauccaauccaaucagugagaagaauagcuuau

SEQ ID NO: 333732 - RNA, 64 nt, Human; identical to SEQ ID NO: 304137

SEQ ID NO: 333733 - RNA, 64 nt, Human; identical to SEQ ID NO: 308145

SEQ ID NO: 333734 - RNA, 64 nt, Human; identical to SEQ ID NO: 31800

SEQ ID NO: 333735 - RNA, 64 nt, Human
uggcccagccagcagguucucuccugugagcuccccaauccaacccaugcauggccucccagcc

SEQ ID NO: 333736 - RNA, 64 nt, Human
ccuuuugcaggucaaucuuuguauuugaaaugauccaauccaacuugaagucaauugaauauua

SEQ ID NO: 333737 - RNA, 64 nt, Human
uaaagauguagucuacauagccccagcuugggguccaauccaucugucccuggcaugugccuuc

SEQ ID NO: 333738 - RNA, 64 nt, Human
aaugauguaauugcagcugguaggaugucuggugccaauccaggaagugagagccauuucuuuu

SEQ ID NO: 333739 - RNA, 64 nt, Human
acuuauaaaaaaagaaugauaugugagaagauggccaauccagugcagcuugguucuacauauu

SEQ ID NO: 333740 - RNA, 64 nt, Human
gucugggggucucacccgcccagcgagagcagaaccaauccagucaggaugucacugacucuaa

SEQ ID NO: 333741 - RNA, 64 nt, Human
cuuuuuguuuguuucaguucauacuagucccuucccaauccaucaguaaagaccccaucugccu

SEQ ID NO: 333742 - RNA, 64 nt, Human
gugguggcugaugcuuugaacaucucuuugcugcccaauccauuagcgacaguaggauuuuuca

SEQ ID NO: 333743 - RNA, 64 nt, Human
ggaaguucuuucuacuuccacaggugcagcccucccaauccagucuacccucaaaggagcuggg

SEQ ID NO: 333744 - RNA, 64 nt, Human
gcagggucagggccaaagucuaugcguuccaucuccaauccaggcagugaggaauccugaaaca

SEQ ID NO: 333745 - RNA, 64 nt, Human
cccuggggcucccagggaagugggagcuggggagccaauccacccagacccgcguccaccuggg

SEQ ID NO: 333746 - RNA, 64 nt, Human
aaaagacuaacaggagaaugcacaguggguggagccaauccacuccuuccuuucuaucauuccc

SEQ ID NO: 333747 - RNA, 64 nt, Human
cuucccugccugcagaggaugacucuguucacacccaauccagcgcgguucuaccccacgaaac

SEQ ID NO: 333748 - RNA, 64 nt, Human
guuuuguucgaaagauggcaaguguacaaccaaaccaauccacuugcuuacagaaagaauguuu

SEQ ID NO: 333749 - RNA, 64 nt, Human
aguagcugguggaagagcugcagcuuuaucaggcccaauccaugccauaaugaacagggaccaa

SEQ ID NO: 333750 - RNA, 64 nt, Human
acaagcagggaucagagcaacuccccggggauccccaauccacgcccuucuaguccaacccccc

SEQ ID NO: 333751 - RNA, 64 nt, Human; identical to SEQ ID NO: 308164

SEQ ID NO: 333752 - RNA, 64 nt, Human; identical to SEQ ID NO: 304101

SEQ ID NO: 333753 - RNA, 64 nt, Human; identical to SEQ ID NO: 308037

SEQ ID NO: 333754 - RNA, 64 nt, Human
aaaauuuacauggcaaagagcccauaaauccugaccaauccaacucugaauuuuaaagcaaaag

SEQ ID NO: 333755 - RNA, 64 nt, Human
gauagaaagcaccugaauugugcuucugaauuaaccaauccaggaacugcuuuaccuuuggacu

SEQ ID NO: 333756 - RNA, 64 nt, Human
uuuucauacuuuuuugcauuuuaccuuucaucuaccaauccaugugcauuggauugcacacuaa

SEQ ID NO: 333757 - RNA, 64 nt, Human
ggauggaaccugccccaggucacaaucauucuguccaauccagccaagguucccuccacauaug

SEQ ID NO: 333758 - RNA, 64 nt, Human
aaugccuuaggguuuucuaauuccccuuauggauccaauccaucuccuggcccugccccuuguu

SEQ ID NO: 333759 - RNA, 64 nt, Human
uccaucccuucuuccaucuuuccagcugucaaauccaauccagucucuaaccuaaaugcagauc

SEQ ID NO: 333760 - RNA, 64 nt, Human
agagggaguucuggccaccugagccuuucccuugccaauccagguagacagaggcccugccuuu

SEQ ID NO: 333761 - RNA, 64 nt, Human
cucuuuccacagccacaucagucagggcauggcuccaauccauucuuugcuccaaugucaccuc

SEQ ID NO: 333762 - RNA, 64 nt, Human
ggcccuugaguccccauugaggcuugguuccuucccaauccaguggacuucgcaguccacuucu

SEQ ID NO: 333763 - RNA, 64 nt, Human
gaagacgucuccccuucucugccucaccuggucgccaauccaugcucucuuucuuuucucuguc

SEQ ID NO: 333764 - RNA, 64 nt, Human
gcacccugugucuagcucaguguuugugaaugcaccaauccacacucuguaucuggcuacucug

SEQ ID NO: 333765 - RNA, 64 nt, Human
aaucccacccccacuucaugcccacugccgaugcccaauccaggcccggugaggccaagguuuc

SEQ ID NO: 333766 - RNA, 64 nt, Human
cucuacugcagacccucuaggacuggggguggggccaauccagggcagcccagagggaacaucc

SEQ ID NO: 333767 - RNA, 64 nt, Human
ccccaggaccuuuggcucuguccaucaccagcaaccaauccaccaacagaaugugguuucugcc

SEQ ID NO: 333768 - RNA, 64 nt, Human
agucaguagaagcccuggcuggccccacuugguaccaauccaccaggcagcucagggcuccugc

SEQ ID NO: 333769 - RNA, 64 nt, Human
aaucugccuccugugccucccuuuucuccucuccccaauccaugcuucacucaugcaaacugcu

SEQ ID NO: 333770 - RNA, 64 nt, Human; identical to SEQ ID NO: 307933

SEQ ID NO: 333771 - RNA, 64 nt, Human; identical to SEQ ID NO: 304102

SEQ ID NO: 333772 - RNA, 64 nt, Human; identical to SEQ ID NO: 308055

SEQ ID NO: 333773 - RNA, 64 nt, Human
guguagcacggaagaugcccacgugccugagccaccaauccacccagacaauaaaccauccucu

SEQ ID NO: 333774 - RNA, 64 nt, Human
ucaggcgccaucuguaaagucuccucuggaaaugccaauccauccuucccccagcugcuuccuc

SEQ ID NO: 333775 - RNA, 64 nt, Human
caaagaguuugaugaggcccuccacaccugcggcccaauccaaggugggguggaagcuugggga

SEQ ID NO: 333776 - RNA, 64 nt, Human
cuauuaggagaugcuugaagaacucaacaaaaucccaauccaagucaaacuuugcacauauuua

SEQ ID NO: 333777 - RNA, 64 nt, Human
agcccagaucggaggacaaguuccucucuagaacccaauccaauuuggagccccagcccaacuc

SEQ ID NO: 333778 - RNA, 64 nt, Human
cagggcugaagucggagaagcauagggacuaggcccaauccagccuggaaagucagggaggacu

SEQ ID NO: 333779 - RNA, 64 nt, Human
ucuuccuuugcucugaggucccuucaaggccuccccaauccaggccaaagccccaugugccuug

SEQ ID NO: 333780 - RNA, 64 nt, Human
caaucccaacccugcccccaaucuccccucaacuccaauccauaacccccuucaaaccauccuc

SEQ ID NO: 333781 - RNA, 64 nt, Human
ccaggugccccucgagcaaaaaccucuggcgccuccaauccagacccaccacagcuggagggcc

SEQ ID NO: 333782 - RNA, 64 nt, Human
ucucaggagcaggggcauugcugauuuugucugcccaauccauccugcucaggaaaccacaacc

SEQ ID NO: 333783 - RNA, 64 nt, Human
acccuccaccuuccccuccaugccaauaaaauaaccaauccagaugccagcagccugucaauca

SEQ ID NO: 333784 - RNA, 64 nt, Human
gacucgcugacaggcuacaggacccccaacaaccccaauccacguuuuggaugcacugagaccc

SEQ ID NO: 333785 - RNA, 64 nt, Human
gacuugacccuuaccaaaccacagagaauccaaaccaauccaugauaaugucaguaggagacuu

SEQ ID NO: 333786 - RNA, 64 nt, Human
acugcuggaaauaauauccaaagagcugauucuaccaauccaauuucaccaggaaaauuccauc

SEQ ID NO: 333787 - RNA, 64 nt, Human
uguggccaugccacggagggggcaguggacaaaaccaauccaaagccaagccgggacuggcugc

SEQ ID NO: 333788 - RNA, 64 nt, Human
acguccccgcugcguaagacucuguauuuggaugccaauccacaggccugaagaaacugcuugu

SEQ ID NO: 333789 - RNA, 64 nt, Human; identical to SEQ ID NO: 308056

SEQ ID NO: 333790 - RNA, 64 nt, Human; identical to SEQ ID NO: 308057

SEQ ID NO: 333791 - RNA, 64 nt, Human; identical to SEQ ID NO: 308074

SEQ ID NO: 333792 - RNA, 64 nt, Human
cggggugucaugccccaacgcgugcuagagaggcccaauccaggggcagaaaacagggggccua

SEQ ID NO: 333793 - RNA, 64 nt, Human
cuagggaaccacaacccuuauuguccuggguggaccaauccaaaggcuaagugauagugacuca

SEQ ID NO: 333794 - RNA, 64 nt, Human
ggccuugcuauuccuuaagcaaaucacauucuucccaauccaaagacuuugcacaugcuguugu

SEQ ID NO: 333795 - RNA, 64 nt, Human
cacaacugcagccgggcccucugccuaugggcacccaauccaagcagcugcuccaccuuuguuu

SEQ ID NO: 333796 - RNA, 64 nt, Human
augcaaguuuugugacugagaaauuucugugcuuccaauccacaaugagaugcaugauuuuguu

SEQ ID NO: 333797 - RNA, 64 nt, Human
acagugugacuaucagacagcaucaaauauuugcccaauccaagauuagacuacacaaaagcuu

SEQ ID NO: 333798 - RNA, 64 nt, Human
cuauuggggcuuaaugguuuccuggugauucuuaccaauccacaauaaacauggcccauuggca

SEQ ID NO: 333799 - RNA, 64 nt, Human
acuagaaguaaacacauaaauccuuauaaauuacccaauccaacuuucucauauugcauguaga

SEQ ID NO: 333800 - RNA, 64 nt, Human
auaacauucugccauguuccuagaucuuuaguuaccaauccaccauuacaagauuccuagucau

SEQ ID NO: 333801 - RNA, 64 nt, Human
agccaauuuuuuuuguuucuucauuuccccucccccaauccaugaaagccuaaauguaaaauau

SEQ ID NO: 333802 - RNA, 64 nt, Human
auuauuguacauaauagcaguucuggcuggaauuccaauccacuuucuggggaucauuuugaug

SEQ ID NO: 333803 - RNA, 64 nt, Human
cucuuccucucuucugauaaauuccccauaccucccaauccaaguagcaucuguagcuacauaa

SEQ ID NO: 333804 - RNA, 64 nt, Human
cuccuccaccccugucauucacuuccaauuuuacccaauccaauuuuagcacucaaguuccauu

SEQ ID NO: 333805 - RNA, 64 nt, Human
aagacacaggggacacccagaaacgccacaucccccaauccaucagugccaaacuagccaacgg

SEQ ID NO: 333806 - RNA, 64 nt, Human
cccgugguggcucaagucuggccccacaccagccccaauccaaaacuggcaaggacgcuucaca

SEQ ID NO: 333807 - RNA, 64 nt, Human
aguaaggcgaggccauacugcauuuacaaugggcccaauccagugucccuaugagagacggaag

SEQ ID NO: 333808 - RNA, 64 nt, Human; identical to SEQ ID NO: 308004

SEQ ID NO: 333809 - RNA, 64 nt, Human; identical to SEQ ID NO: 308005

SEQ ID NO: 333810 - RNA, 64 nt, Human; identical to SEQ ID NO: 308182

SEQ ID NO: 333811 - RNA, 64 nt, Human
agaaacgucuucuaaacuuccccaucuucuaaacccaauccaaauggcgucuggaaguccaaug

SEQ ID NO: 333812 - RNA, 64 nt, Human
ucaggacaaggccuugcucacucacucacuccaagaccaccagggucccaggaagccggugccu

SEQ ID NO: 333813 - RNA, 64 nt, Human
gagcuugguccuuuuccucucugcuuggauucuggaccaccaccugggaccaaccuucagcucu

SEQ ID NO: 333814 - RNA, 64 nt, Human
guuguugguuuuuuuuuuuuuuuuuuuaacuugggaccaccaaguuguaaagauguauguuuuu

SEQ ID NO: 333815 - RNA, 64 nt, Human
ugguguaagaguggggaacagggccagcaagacagaccaccagccagaaaucucugauaucaac

SEQ ID NO: 333816 - RNA, 64 nt, Human
ggagcuuuuccuguccugugguuuuccaguuggugaccaccaugggaggucgcuggcucggcuc

SEQ ID NO: 333817 - RNA, 64 nt, Human
aaauaaauaaaaccauuggccugguugagggcgugaccaccaagacauauauguugugcccgug

SEQ ID NO: 333818 - RNA, 64 nt, Human
ugcuuuuuauguuauuauuauuaauuauuacaaugaccaccauuuugcauuuugaaauaaaaaa

SEQ ID NO: 333819 - RNA, 64 nt, Human
ggccaggacgggaggcaggguggggggcaggcuggaccaccaccaucugcccuggcagccuggc

SEQ ID NO: 333820 - RNA, 64 nt, Human
cagugugaacacacaaugccaggccaggaacugggaccaccaucuugcugauggaaggaacaac

SEQ ID NO: 333821 - RNA, 64 nt, Human
gggacaguaaaaauaugguuuuauaaucuucugggaccaccauuguauaugcgguacaucauug

SEQ ID NO: 333822 - RNA, 64 nt, Human
uuuggaaacucacugccuuguucuguuucucucugaccaccagugcaugcagccccugucaugu

SEQ ID NO: 333823 - RNA, 64 nt, Human
gcuggauuuccaagcugagaggacgugaaccugggaccaccaguagccaucuuguuugccacau

SEQ ID NO: 333824 - RNA, 64 nt, Human; identical to SEQ ID NO: 307986

SEQ ID NO: 333825 - RNA, 64 nt, Human; identical to SEQ ID NO: 307987

SEQ ID NO: 333826 - RNA, 64 nt, Human; identical to SEQ ID NO: 308038

SEQ ID NO: 333827 - RNA, 64 nt, Human; identical to SEQ ID NO: 308039

SEQ ID NO: 333828 - RNA, 64 nt, Human
uuucuuggaccuuccacuucuccuccaacuccuugaccaccauccuguauccaaccaucaccac

SEQ ID NO: 333829 - RNA, 64 nt, Human
agccaggacaucugaguaccuaucucacacacuggaccaccagucacaaagucuggaaaaguuu

SEQ ID NO: 333830 - RNA, 64 nt, Human
agacucuagccuggacaguggccaggaccgucgagaccaccagagcuaccuccccggggacagc

SEQ ID NO: 333831 - RNA, 64 nt, Human
auguaaaagauuucuucaagcuccauuuugcagagaccaccacuuagagaaucaaaaaauuccu

SEQ ID NO: 333832 - RNA, 64 nt, Human
uccccugucgaguucggcucugggugggcaguaggaccaccagugugggguucugcugggaccu

SEQ ID NO: 333833 - RNA, 64 nt, Human
uaaaaagaccuccagauaggcagacagacagauggaccaccaaccuggacagacagccaaagcu

SEQ ID NO: 333834 - RNA, 64 nt, Human
agccaacagcuugauagaccagugcagccagagagaccaccaaacagagcccccaaaagacaga

SEQ ID NO: 333835 - RNA, 64 nt, Human
ugugaucccuucggcgccagcagcuccaaaacuggaccaccagagaauggacaccauccaggaa

SEQ ID NO: 333836 - RNA, 64 nt, Human
gcuauaaaaaguauuacuuggaaaugaggcaucagaccaccagauguuaccgcucgguugaaug

SEQ ID NO: 333837 - RNA, 64 nt, Human
cagaggaaauccucagcaaaggccugagccagaugaccaccagugcugacacggauguugauac

SEQ ID NO: 333838 - RNA, 64 nt, Human
uaacagcuuagugaggaggcaagagcuccucugggaccaccacuucuucaggagagggccugug

SEQ ID NO: 333839 - RNA, 64 nt, Human
uucuuucugagccugcuggacaugaagagcagaugaccaccaugcucugugucagccaggacga

SEQ ID NO: 333840 - RNA, 64 nt, Human
aguauuccauuccuaggugucaucagaugaccuugaccaccacaauaccaggcccucuuggaug

SEQ ID NO: 333841 - RNA, 64 nt, Human
uaaacugcagccuuuucugucgccagcaauuaaagaccaccaaucuuguuuguccaucuacaug

SEQ ID NO: 333842 - RNA, 64 nt, Human; identical to SEQ ID NO: 304153

SEQ ID NO: 333843 - RNA, 64 nt, Human; identical to SEQ ID NO: 308199

SEQ ID NO: 333844 - RNA, 64 nt, Human; identical to SEQ ID NO: 31749

SEQ ID NO: 333845 - RNA, 64 nt, Human
cagugugagagcagaggcccggaaggaaggccaugaccaccacugagggcccggagcagggugg

SEQ ID NO: 333846 - RNA, 64 nt, Human
gccuaagguccacuggacaguugggaaaacaccugaccaccauuuaaggacucuaagccagaau

SEQ ID NO: 333847 - RNA, 64 nt, Human
cuaauguauagugggagugguuguguaaugaaaggaccaccaaaauaauaaaaggcagcuaaug

SEQ ID NO: 333848 - RNA, 64 nt, Human
cccagcacugguuggggacaagggccaaauuggugaccaccagucaugccuaggaccuggggcc

SEQ ID NO: 333849 - RNA, 64 nt, Human
cccgacacucucaccccccgaccuggcugagugcgaccaccacuugaugucugaggauaccuuc

SEQ ID NO: 333850 - RNA, 64 nt, Human
gcuacuggacugccaccccccauugaagagacuggaccaccaggaaggucguuucacauucugu

SEQ ID NO: 333851 - RNA, 64 nt, Human
gagggucaggaaggaugagcauuuagggcaaggagaccaccaacagcccucaggucagggugag

SEQ ID NO: 333852 - RNA, 64 nt, Human
uggccacauacagcaacccacuccaggccauggggaccaccacucaggguucggggcuggcagg

SEQ ID NO: 333853 - RNA, 64 nt, Human
auuaaaggcagaaugacugcguuuguaaaagaaggaccaccaacuauacugacauuuauaaaug

SEQ ID NO: 333854 - RNA, 64 nt, Human
cccuuugguuuugauauggcuagugaccagcacugaccaccaucccaagcugggaagagcaauu

SEQ ID NO: 333855 - RNA, 64 nt, Human
ggacaagugaggaacuagcugcagagggaugagugaccaccauccaggcugagacugaaaggag

SEQ ID NO: 333856 - RNA, 52 nt, Human
accccaauuaugaucucuaagugaccaccaggggcucugaacugcagcugau

SEQ ID NO: 333857 - RNA, 64 nt, Human
cuuccaggugggcagcagaggcaggccccagugugaccaccacugcgaccccugagcccacaag

SEQ ID NO: 333858 - RNA, 64 nt, Human
ggcuaagguaggagccagagagcuguagagacaggaccaccaggaugcuucauguccauaacac

SEQ ID NO: 333859 - RNA, 64 nt, Human; identical to SEQ ID NO: 308235

SEQ ID NO: 333860 - RNA, 64 nt, Human; identical to SEQ ID NO: 308236

SEQ ID NO: 333861 - RNA, 64 nt, Human; identical to SEQ ID NO: 307968

SEQ ID NO: 333862 - RNA, 64 nt, Human
cagcacuucggcuccucuaaccugugccacaggugaccaccaauaaaauccucugcugagaagu

SEQ ID NO: 333863 - RNA, 64 nt, Human
ugaggccagcugagguacaggcaggggcaggcaggaccaccagcagggggcugccucugcaccc

SEQ ID NO: 333864 - RNA, 64 nt, Human
cccccugcaacugcagggccgcuucuggggccuggaccaccauggggaggaagagucccacuca

SEQ ID NO: 333865 - RNA, 64 nt, Human
cuuuuuucaggaugcuauagucaauuuaguaagugaccaccaaauuguuauuugcacuaacaaa

SEQ ID NO: 333866 - RNA, 64 nt, Human
ugaggucuuagcacauguacugguggaguuuccagaccaccaguaugaauaaaagcuuguucug

SEQ ID NO: 333867 - RNA, 64 nt, Human
ggcauaccauggagauauuacaggaucaguuccagaccaccauaauaaaguggauaucgcaaua

SEQ ID NO: 333868 - RNA, 64 nt, Human
guggcagaauuggcaccauuacccaggucugacugaccaccagucagaggcacuuuauuuguau

SEQ ID NO: 333869 - RNA, 64 nt, Human
uuguacuugacuucuuaggauggguagcugaaaagaccaccauuuuaagcauuugagaauucuu

SEQ ID NO: 333870 - RNA, 64 nt, Human
gcugaagugggccagccuugcaccagccaggccagaccaccauggugaaggcuucuuuccccac

SEQ ID NO: 333871 - RNA, 64 nt, Human
aauugcuguaacaagcacacuauuuauaugcccugaccaccauaggaugcuagucuuugugacc

SEQ ID NO: 333872 - RNA, 64 nt, Human
gcacuacugcacuccagccugggcgacagagcaagaccaccaucuccaaaaauuauauauauaa

SEQ ID NO: 333873 - RNA, 64 nt, Human
caaaccucggcaggugccgugugaggggcuuaaugaccaccacagggagcucagaccccaaccc

SEQ ID NO: 333874 - RNA, 56 nt, Human
ggugcacauuccugccauagcgcagugaccaccauccaagcucagaucuguguguc

SEQ ID NO: 333875 - RNA, 52 nt, Human
aucaaacugcuacugguuaaaggaccaccauuuaauuaacaugauucgaaag

SEQ ID NO: 333876 - RNA, 64 nt, Human; identical to SEQ ID NO: 304103

SEQ ID NO: 333877 - RNA, 64 nt, Human; identical to SEQ ID NO: 308075

SEQ ID NO: 333878 - RNA, 64 nt, Human; identical to SEQ ID NO: 308147

SEQ ID NO: 333879 - RNA, 64 nt, Human
uccuuccucugaguugaccagcagcaggucugccgaccaccagcaccauccucuccucccagca

SEQ ID NO: 333880 - RNA, 64 nt, Human
uaauacacuaaaauugugguccuuuuccucuugugaccaccacaugucuagugauuauuuuguu

SEQ ID NO: 333881 - RNA, 64 nt, Human
ccggacaggggguagccccuggauucaggcacacgaccaccacacgagcacgugccacgcaugc

SEQ ID NO: 333882 - RNA, 64 nt, Human
ugauuuuuauauuuggggcaucucuauagaaagugaccaccaaggccaguaaguacgggaaaaa

SEQ ID NO: 333883 - RNA, 64 nt, Human
uacaauuaugaagaaguugaagguacuucuuuuagaccaccaguaaauaauccuccuucaaaaa

SEQ ID NO: 333884 - RNA, 64 nt, Human
acuuacagucccagauacacuaaaguuacaaacagaccaccaccaggacugugccugaacaauu

SEQ ID NO: 333885 - RNA, 64 nt, Human
ccccuuucccugggagcucccagaggaaacucuugaccaccaguggcucccugaagggcuuuug

SEQ ID NO: 333886 - RNA, 64 nt, Human
cccacucccuacccccagcuucggaaaauacagagaccaccaccacguacccuguauuccccaa

SEQ ID NO: 333887 - RNA, 64 nt, Human
uaugauguuuucuaaaaugaaacuugauaaaguagaccaccagcugcaccguguuuucuguaaa

SEQ ID NO: 333888 - RNA, 64 nt, Human
aggacuuacaucacuugcugcucuauggaguugagaccaccaaguaaagcauccugggcuagcc

SEQ ID NO: 333889 - RNA, 64 nt, Human
gguggggaggugugcuuuagauuucucauuagaagaccaccaaacugguaauauuuuuauagca

SEQ ID NO: 333890 - RNA, 64 nt, Human
ucaccaggaugagagaggagagaggaauccacaggaccaccagaagggagagggaaccagauau

SEQ ID NO: 333891 - RNA, 64 nt, Human
ucaccaggauguaagaggagagaggaauccacaggaccaccagagaggagagggaaccagauau

SEQ ID NO: 333892 - RNA, 64 nt, Human
ggucggaacccaagcuuagaacuuuaagcaacaagaccaccacuucgaaaccugggauucagga

SEQ ID NO: 333893 - RNA, 64 nt, Human; identical to SEQ ID NO: 308183

SEQ ID NO: 333894 - RNA, 64 nt, Human; identical to SEQ ID NO: 308217

SEQ ID NO: 333895 - RNA, 64 nt, Human; identical to SEQ ID NO: 308218

SEQ ID NO: 333896 - RNA, 64 nt, Human
uucccucaacagccugugccucuggucuaccuuugaccaccacugauaacuaauauauugguca

SEQ ID NO: 333897 - RNA, 64 nt, Human
cagugcauagcagcugaaugccagcccuguaaaagaccaccauaaagagagcuccauguucuuu

SEQ ID NO: 333898 - RNA, 64 nt, Human
acccgaaucuuccaaaaaacagccuacaaucugugaccaccacaagaugugcccugauggcagc

SEQ ID NO: 333899 - RNA, 64 nt, Human
aaugugaauuaugaacuaguaugugacaauaaaugaccaccaaguacuaccugacgggaggcac

SEQ ID NO: 333900 - RNA, 64 nt, Human
cuguuccaacggcucugggccucaguggucacuugaccaccauugucucagagcugcccacuuu

SEQ ID NO: 333901 - RNA, 60 nt, Human
agaaagggaagaucuuuuaaacucucuauugaccaccaguuaacguauuaguugccaaua

SEQ ID NO: 333902 - RNA, 64 nt, Human
ccacaguccagcagcgccagaagcacucauuucugaccaccaggcuaugacguuccugcugcgc

SEQ ID NO: 333903 - RNA, 64 nt, Human
ucuaguuucugucucucaggcacucguaacuaaggaccaccauuggccauugguagauguuuga

SEQ ID NO: 333904 - RNA, 64 nt, Human
ucagaauaggaucugaagagaucaaagcaauggagaccaccaaacugucuugaaggcaugucua

SEQ ID NO: 333905 - RNA, 64 nt, Human
uuucaagagucaccuucaccaggaagucuuccuugaccaccaucauuccugccugauuagaggg

SEQ ID NO: 333906 - RNA, 64 nt, Human
guugugcccgcucuuggggcugaccggcuguagggaccaccagccgcugcuacugugggccgcc

SEQ ID NO: 333907 - RNA, 64 nt, Human
uaaguguacaguucuuucgcauuaaugcacccaugaccaccauucacuuaaauuuuuaaaagaa

SEQ ID NO: 333908 - RNA, 64 nt, Human
caguaucuggaccacaggcaaagaaaaccacuaggaccaccaggagcacacaaccccagaccca

SEQ ID NO: 333909 - RNA, 64 nt, Human
uugucacagaggagggacagaaaggguaucugcugaccaccagccugccuacccaugcccaugu

SEQ ID NO: 333910 - RNA, 64 nt, Human; identical to SEQ ID NO: 308201

SEQ ID NO: 333911 - RNA, 64 nt, Human; identical to SEQ ID NO: 308165

SEQ ID NO: 333912 - RNA, 64 nt, Human; identical to SEQ ID NO: 304154

SEQ ID NO: 333913 - RNA, 64 nt, Human
uugaucauuucugccaugauguuuacaagauggcgaccaccaaagucaaacgacuaaccuaucu

SEQ ID NO: 333914 - RNA, 64 nt, Human
uccugugaguggcuaaugagaagagggacagaccgaccaccagcacaguagggcagaucuggac

SEQ ID NO: 333915 - RNA, 64 nt, Human
uagacuaagcuaccugccuucaaaauaguuuagggaccaccaccauauuuuauuuuguuuuuau

SEQ ID NO: 333916 - RNA, 64 nt, Human
cauccauggugccuccccaaaucauaagaccaaagaccaccaaacgcaggguggacucugcuca

SEQ ID NO: 333917 - RNA, 64 nt, Human
cugugcguuguacauaguucuaaugcauuguauugaccaccaguacuucuauaaugguagauug

SEQ ID NO: 333918 - RNA, 64 nt, Human
uauauuguaauagcuuugccuguauuuauugcaagaccaccagcuccuggaagcugaguuacag

SEQ ID NO: 333919 - RNA, 64 nt, Human
cagcagcacccaguguuggucuguguccaucagugaccaccaacauucuguguucacaugugug

SEQ ID NO: 333920 - RNA, 64 nt, Human
ucugcuauucuccauacucuguaucacuuguauugaccaccacauaugcuaauaccuaucuacu

SEQ ID NO: 333921 - RNA, 64 nt, Human
ggaaccauggugggggcugccuagugggaguuaggaccaccaauggauuguggaaaauggagcc

SEQ ID NO: 333922 - RNA, 64 nt, Human
gcccaaauaugacacuggccauuuuuguaaacgagaccaccaggccuucuucacuaagacuuug

SEQ ID NO: 333923 - RNA, 64 nt, Human
accuuauugcacugguuagcaaccccaauacagagaccaccagaucagguauagacuccugaaa

SEQ ID NO: 333924 - RNA, 64 nt, Human
uuuuuaccuagaaccauuuaaaagccugagcaaggaccaccacccccuccccaccaaauuauuc

SEQ ID NO: 333925 - RNA, 64 nt, Human
uuggugcuaaaaaaaaaaacguccugagguucaugaccaccauccaguuucuggccuuuacaca

SEQ ID NO: 333926 - RNA, 64 nt, Human
ucauccuuggguccuucauuauuauuuauuaacugaccaccauggccugccugcccugccuccg

SEQ ID NO: 333927 - RNA, 64 nt, Human; identical to SEQ ID NO: 31753

SEQ ID NO: 333928 - RNA, 62 nt, Human; identical to SEQ ID NO: 31754

SEQ ID NO: 333929 - RNA, 64 nt, Human; identical to SEQ ID NO: 31755

SEQ ID NO: 333930 - RNA, 64 nt, Human
ugcuaccuagguaguccauaggaaccacccccaugaccaccaccaacaucaacuaaagguucuu

SEQ ID NO: 333931 - RNA, 64 nt, Human
cagcaauuauaagcacaccagauucagggagacugaccaccaagggauaguguaaaaggacauu

SEQ ID NO: 333932 - RNA, 64 nt, Human
acugcucugagcccuuccccaggcccaggcuguagaccaccaugacagcugucgccugcggcug

SEQ ID NO: 333933 - RNA, 64 nt, Human
guagcgugcccgugugcauguccuuugcgccugugaccaccaccccaacaaaccauccagugac

SEQ ID NO: 333934 - RNA, 64 nt, Human
cucagccucccagguagcugguacuacaggcacggaccaccacgccuggcuaauuuuuguauuu

SEQ ID NO: 333935 - RNA, 64 nt, Human
acucacacuuccggauggagggagagguugugcugaccaccaccacacuggcacaggcgggagc

SEQ ID NO: 333936 - RNA, 64 nt, Human
caaaauagcugaggguuguuggcuuguuguagcugaccaccaaaagcagucacugcaaaucuuu

SEQ ID NO: 333937 - RNA, 64 nt, Human
uuaccagucucacaugauuccagccaucaccuuagaccaccaagccuugauugguguugccagu

SEQ ID NO: 333938 - RNA, 64 nt, Human
cuggagagaugggcauaagucaggaacuugggaggaccaccacccuuucagaggcgugaggccc

SEQ ID NO: 333939 - RNA, 58 nt, Human
acauggccuccaaggaguaagaccccuggaccaccagccccagcaagagcacaagagg

SEQ ID NO: 333940 - RNA, 64 nt, Human
gcguuuauuuacugauguaugcggccaccacugugaccaccaucacuuaccgauucaccaaaac

SEQ ID NO: 333941 - RNA, 64 nt, Human
gucccaaauacaguuuccgucgccuugacgacaagaccaccaacguguccuuguacccuggcua

SEQ ID NO: 333942 - RNA, 64 nt, Human
cgccaauauuuaggacaccacguguacaucuguagaccaccagcugcacccaucuccacaaagc

SEQ ID NO: 333943 - RNA, 64 nt, Human
gcuuuguucuuucccugagaaacaguucagcagugaccaccacccacaugacauuucaaagcac

SEQ ID NO: 333944 - RNA, 64 nt, Human; identical to SEQ ID NO: 307808

SEQ ID NO: 333945 - RNA, 64 nt, Human; identical to SEQ ID NO: 307809

SEQ ID NO: 333946 - RNA, 64 nt, Human; identical to SEQ ID NO: 304188

SEQ ID NO: 333947 - RNA, 64 nt, Human
cucuuccugcugcauucucucucucaauuacugggaccaccaagcuaggaaccugggagucauc

SEQ ID NO: 333948 - RNA, 64 nt, Human
guauauacaaauaaguguauuguuuugauuuuuagaccaccacauggcaugcuugacuauuucu

SEQ ID NO: 333949 - RNA, 64 nt, Human
aaauagucucacagguaaaaaacauaacaacaaugaccaccauugucuuugauacauuuauuuu

SEQ ID NO: 333950 - RNA, 64 nt, Human
agccaucuucacuggaggguggggagcuccgugugaccaccaagaugccagcaggauauaccgu

SEQ ID NO: 333951 - RNA, 64 nt, Human
cugacggguccggcuugucauggaagcuggcagggaccaccagccccaggauggcagagggacc

SEQ ID NO: 333952 - RNA, 64 nt, Human
ccaagcaaaugcacucugcuuuuugcugcuguaagaccaccaaaaaugagucagaaacacagaa

SEQ ID NO: 333953 - RNA, 64 nt, Human
ggguuggguugggcuggauaucuuuguagauguggaccaccaagggguuguugaaaacuaauug

SEQ ID NO: 333954 - RNA, 51 nt, Human
cggggcagccccagcccugaggaccaccauucccuggcuacucucuccuuc

SEQ ID NO: 333955 - RNA, 64 nt, Human
ucugccucaccgcuucccuccugcccgccacacagaccaccauccaccgcugcuccacgcgcuu

SEQ ID NO: 333956 - RNA, 64 nt, Human
ucuaugcaauauuaucacauguguagauucaugugaccaccaucacaagagacagaacaguucu

SEQ ID NO: 333957 - RNA, 57 nt, Human
acugccauuucuaccacuagacccuuggaccaccauuggaacaaccaagcagaaugu

SEQ ID NO: 333958 - RNA, 64 nt, Human
ugccucauccucccaagaagcugagauuacagaugaccaccaccacuccuggcuaauuuuuugu

SEQ ID NO: 333959 - RNA, 64 nt, Human
ggaucaccugaagucaggaguucgagaccagccugaccaccauggagaaaccccgucucuacua

SEQ ID NO: 333960 - RNA, 64 nt, Human
ggauacuuccuuggcccuuuuucuuuauugacuagaccaccagaggaggaugugugggauugua

SEQ ID NO: 333961 - RNA, 64 nt, Human; identical to SEQ ID NO: 304120

SEQ ID NO: 333962 - RNA, 64 nt, Human; identical to SEQ ID NO: 308111

SEQ ID NO: 333963 - RNA, 64 nt, Human; identical to SEQ ID NO: 307843

SEQ ID NO: 333964 - RNA, 64 nt, Human
cacagggauguacaaggcgaucccaucuugauaagaccaccaccucagaguauggagcucagag

SEQ ID NO: 333965 - RNA, 64 nt, Human
ccccaccuagagcuuuuaaccaaacaacauugcagaccaccagaguccuuggacucccccuggg

SEQ ID NO: 333966 - RNA, 64 nt, Human
ccuuuguuaaacaauuaacagcagcacacucugggaccaccagcuauuuucccucucuuucuga

SEQ ID NO: 333967 - RNA, 64 nt, Human
agggguggggaggaagccggggcagucaccgagugaccaccaagaggaagacccaccccacggc

SEQ ID NO: 333968 - RNA, 64 nt, Human
gcgucaguguccagcacgucguggccucugguccgaccaccaggcccuagucucggucagggag

SEQ ID NO: 333969 - RNA, 64 nt, Human
ucugaggcaggguugagaagacagaucuagucaggaccaccagccauggucuaaggacauggau

SEQ ID NO: 333970 - RNA, 64 nt, Human
auuuucaggaaggcucuuuccuagugauggagaugaccaccaucagcuccaggcuucuauccug

SEQ ID NO: 333971 - RNA, 64 nt, Human
gagguggaaggggcggggggcggggcagacagcagaccaccaaggguucagggaacaaagacca

SEQ ID NO: 333972 - RNA, 64 nt, Human
gagccccugaacugcuguugggaaccaccacgcagaccaccagcaucgacauguggugaggaga

SEQ ID NO: 333973 - RNA, 64 nt, Human
gcggagugugaauuacugaccccaccacacaccggaccaccaagagagccagggcugcuguuuc

SEQ ID NO: 333974 - RNA, 64 nt, Human
ugucuagaaguccuuggauauuugauauuuaccugaccaccacagacaaagauugggauccugg

SEQ ID NO: 333975 - RNA, 64 nt, Human
cguccaagggacagcccacggucuggaggccgaggaccaccagcaggcagguggacugacugug

SEQ ID NO: 333976 - RNA, 64 nt, Human
cuuuccuuucccucccacaaagccaacacucugugaccaccacacuccaggaggcagccccauc

SEQ ID NO: 333977 - RNA, 64 nt, Human
uugcacaacccauuugugagcaaaagcagaaguggaccaccaucagcucccacccacccagcga

SEQ ID NO: 333978 - RNA, 64 nt, Human; identical to SEQ ID NO: 305638

SEQ ID NO: 333979 - RNA, 64 nt, Human; identical to SEQ ID NO: 304016

SEQ ID NO: 333980 - RNA, 64 nt, Human; identical to SEQ ID NO: 308234

SEQ ID NO: 333981 - RNA, 64 nt, Human
aggagaagucaguggacacauggaaguuacucgugaccaccagcuugcucagauauucuccucc

SEQ ID NO: 333982 - RNA, 64 nt, Human
acauucauccugccacaucugcacugcagcggaugaccaccaggcucucaucugggacauccag

SEQ ID NO: 333983 - RNA, 64 nt, Human
aaguguuauuuuguuuuuccuuccaaugucuggagaccaccagggcaucucugggcuggaugag

SEQ ID NO: 333984 - RNA, 64 nt, Human
ggauuuucccccuuuaugaacuguacuggcuguugaccaccagacaccugaccgcaaauaucuu

SEQ ID NO: 333985 - RNA, 62 nt, Human
cagucuggccgaccaacugauggcaguaaagagaccaccagcagugacaccugccaaugaca

SEQ ID NO: 333986 - RNA, 64 nt, Human
gauggaacuugcugcugagugcaccacuucaagugaccaccaggaggugcuaucgcaccacugu

SEQ ID NO: 333987 - RNA, 64 nt, Human
cacacuagcagagcaggaguaccuuucuccacaugaccaccaucccgcccuggcauggcaaccu

SEQ ID NO: 333988 - RNA, 64 nt, Human
ugaauauucucacagagcuaacucaacucaguaagaccaccaaugccaaaguagcacuucgagc

SEQ ID NO: 333989 - RNA, 64 nt, Human
cuggagcuuccauaccuucugggcucccuuugcugaccaccagcccaagggagcuaagaccagg

SEQ ID NO: 333990 - RNA, 64 nt, Human
auuuccagaagcagcagccacuguugcugccacugaccaccagguagacagcgcaaucugugga

SEQ ID NO: 333991 - RNA, 64 nt, Human
gagaguagggcgggcuugaaggcccugauggguggaccaccagccugggcgcaguggugcuggg

SEQ ID NO: 333992 - RNA, 62 nt, Human
ccccagcgggcaaggauugacacguccugccugaccaccauccugccaccaccuucucuucu

SEQ ID NO: 333993 - RNA, 64 nt, Human
uuccaucucgcugccgucugucccguucugugucgaccaccaagccucuggcuaccucuguccc

SEQ ID NO: 333994 - RNA, 64 nt, Human
ucugccccaggcuaauauuagggacuggggaggggaccaccagaggggagagggaagcugcuua

SEQ ID NO: 333995 - RNA, 64 nt, Human; identical to SEQ ID NO: 307878

SEQ ID NO: 333996 - RNA, 64 nt, Human; identical to SEQ ID NO: 307879

SEQ ID NO: 333997 - RNA, 64 nt, Human; identical to SEQ ID NO: 307861

SEQ ID NO: 333998 - RNA, 57 nt, Human
ucauuuuacaacagaacugagacagacgaccaccauauucacugaggucuaaauuug

SEQ ID NO: 333999 - RNA, 64 nt, Human
cucuuccuggaacugcccacgucugcacagaacagaccaccagacgccagggcugauugguggg

SEQ ID NO: 334000 - RNA, 64 nt, Human
acacaggacuucccuuaacaguuuccggaucagugaccaccaccacguucagguuucugaaugc

SEQ ID NO: 334001 - RNA, 64 nt, Human
ggaguucuuccagacucuuggaccagcccgcccugaccaccagcucuacuucccaacccccacu

SEQ ID NO: 334002 - RNA, 64 nt, Human
aagggggcuccgugaguggccugcuaucugcaaugaccaccauagcuuaaccccauccccaccc

SEQ ID NO: 334003 - RNA, 64 nt, Human
cucgccagacccccagggggccucugacgcucgugaccaccaccucccucaaaccuugagauag

SEQ ID NO: 334004 - RNA, 64 nt, Human
ggcaauggcuccagugcccucccucuguucccuggaccaccaccccacguagcugcucacacca

SEQ ID NO: 334005 - RNA, 64 nt, Human
aaaggggagaaaacuucagcacgucucaacagaagaccaccaaauggccaauaaguaagugaaa

SEQ ID NO: 334006 - RNA, 64 nt, Human
aaacaacucauucccacauucuucagucccuggcgaccaccauauuuuuaagucauuaugacuc

SEQ ID NO: 334007 - RNA, 64 nt, Human
ucagagaguucacacugaugggaaaugaccaugggaccaccaagcucuaggucauccaucucug

SEQ ID NO: 334008 - RNA, 64 nt, Human
cucagaguucagacagguccaaguucaagcccaggaccaccacuuauaggguacaggugggauc

SEQ ID NO: 334009 - RNA, 50 nt, Human
agaucgaccucagugccugagaccaccaacgggacucugggcauggcugg

SEQ ID NO: 334010 - RNA, 64 nt, Human
aggcccaggggguccagggcggaccuggggccccgaccaccaaggacagcucacgacugccccu

SEQ ID NO: 334011 - RNA, 64 nt, Human
ugcccucugaauucagacacacuauauuagaccagaccaccaugugucauugugugugugugug

SEQ ID NO: 334012 - RNA, 64 nt, Human; identical to SEQ ID NO: 308110

SEQ ID NO: 334013 - RNA, 64 nt, Human; identical to SEQ ID NO: 304017

SEQ ID NO: 334014 - RNA, 64 nt, Human; identical to SEQ ID NO: 307985

SEQ ID NO: 334015 - RNA, 64 nt, Human
uugcaaucccuuccugggucccaucuuaccuggugaccaccaucauuguuuuccccauccucuu

SEQ ID NO: 334016 - RNA, 64 nt, Human
caaugaaccccagccagccuggaccccuaacaaagaccaccaggacauccugggaacucuggga

SEQ ID NO: 334017 - RNA, 64 nt, Human
guggaagccauuuuaccucuacugccuggcaggugaccaccagugugcaccacucacccauccc

SEQ ID NO: 334018 - RNA, 64 nt, Human
ccuuauuucuuuuuuaucuccauggugugggugggaccaccaugguuuuacaccccacccuacc

SEQ ID NO: 334019 - RNA, 64 nt, Human
uacuccccuaguuggccacuggggccaccacccugaccaccacugugccccucauuguuacugc

SEQ ID NO: 334020 - RNA, 64 nt, Human
cuggcccaggcuggcccccacccaccuuccuugcgaccaccaacacacaggaacucugugugag

SEQ ID NO: 334021 - RNA, 64 nt, Human
cugaagcugacuuagccggccccuuuucaguguagaccaccagcuccccuccccaucuccuuga

SEQ ID NO: 334022 - RNA, 64 nt, Human
uggucagggagagaagggcagacccauucucaaagaccaccauguccaaggucugacagcuccc

SEQ ID NO: 334023 - RNA, 64 nt, Human
gaagccuaggggucugugccaggccagucacaccgaccaccacccacucccacccacuguagug

SEQ ID NO: 334024 - RNA, 64 nt, Human
aagucauuuucagaaaaucuacaagucucguugagaccaccaccauaccucagaagguaggacu

SEQ ID NO: 334025 - RNA, 64 nt, Human
gcauaccuuggggagggaguagggggacacgggggaccaccagguguccacgguuguccccagc

SEQ ID NO: 334026 - RNA, 64 nt, Human
cagcuugaagaugaugcucaagguacucuucauggaccaccauucgcuguuggcaagaaacggc

SEQ ID NO: 334027 - RNA, 64 nt, Human
ccuuccagcggcuucugccaaccauggggggcuggaccaccauggccacugacccagccccuca

SEQ ID NO: 334028 - RNA, 64 nt, Human
gcccugagggugggguaggcagaugggccaaggugaccaccauucugccucaaucuuuugcaag

SEQ ID NO: 334029 - RNA, 64 nt, Human; identical to SEQ ID NO: 308128

SEQ ID NO: 334030 - RNA, 64 nt, Human; identical to SEQ ID NO: 304018

SEQ ID NO: 334031 - RNA, 64 nt, Human; identical to SEQ ID NO: 308003

SEQ ID NO: 334032 - RNA, 64 nt, Human
cacacggcugucauuuuucaccuggucauucugugaccaccacccccuccccucaccgccuccc

SEQ ID NO: 334033 - RNA, 64 nt, Human
uuucuugcugcuccuggcguggaaacuuaagugagaccaccaaauacauugguccuguccaauu

SEQ ID NO: 334034 - RNA, 64 nt, Human
uaaaagaaaaauauuuugggguuugaauaaaauggaccaccauuucucauuggaacccauuaau

SEQ ID NO: 334035 - RNA, 64 nt, Human
aaaaugagccauagcgggaccacaagggcaaggagaccaccaccuucuccagucucucuucgga

SEQ ID NO: 334036 - RNA, 64 nt, Human
ucuuaauuauuaagaaguguuaccuuauuaaaaugaccaccauucuaaaccauuuuucaguggu

SEQ ID NO: 334037 - RNA, 64 nt, Human
auuaauugauuuacagccuuguugccgcuggccagaccaccagguggcccauuacucgagauga

SEQ ID NO: 334038 - RNA, 64 nt, Human
ccuuacagacaccacugccaccaccaccaaccacgaccaccaccaccaccaccacucaccacca

SEQ ID NO: 334039 - RNA, 64 nt, Human
aguacaggcggauuagcuaucuuccaacaaugcugaccaccagacaauuacugcauuuuuccag

SEQ ID NO: 334040 - RNA, 64 nt, Human; identical to SEQ ID NO: 308246

SEQ ID NO: 334041 - RNA, 64 nt, Human; identical to SEQ ID NO: 308247

SEQ ID NO: 334042 - RNA, 64 nt, Human; identical to SEQ ID NO: 308248

SEQ ID NO: 334043 - RNA, 55 nt, Human
uguggguugucucuucaugaagaaccagcggaacucaaaacugcuguucaagaaa

SEQ ID NO: 334044 - RNA, 64 nt, Human
ccagggaggggaggggaugggaagcaccaccagccagcggaagagcagcccucuggugggcggg

SEQ ID NO: 334045 - RNA, 64 nt, Human
acuccucagccucucccgggaguuccugcggucccagcggaacucagggagucuauuuaugaag

SEQ ID NO: 334046 - RNA, 64 nt, Human
caaccucaacccagcgcaguuacaacuucacuaucagcggaaggggagaaaaaccgauucaaau

SEQ ID NO: 334047 - RNA, 64 nt, Human
ugaucuauuucagugugccucauugcuuggaauucagcggaauauugauuagaaagaaacugcu

SEQ ID NO: 334048 - RNA, 64 nt, Human
cuaaagaacugcugccccacagugagggugggagcagcggaacagggaaugccagacacaggcu

SEQ ID NO: 334049 - RNA, 64 nt, Human
gcagggcaccgucggccacaagauccucagcgggcagcggaagcucgagauggaggggcggcag

SEQ ID NO: 334050 - RNA, 64 nt, Human
uaaaauuaauagcuaaucuuauucuaucuccugaagauuuaauugcuauuguuacccauucgaa

SEQ ID NO: 334051 - RNA, 64 nt, Human
auggcugcaaaggaaacuuugaaggguuaaauagagauuuaaaaaaauaaaauaaaaaggcugg

SEQ ID NO: 334052 - RNA, 64 nt, Human
ucugagguccaaaaccacaaugaaagugcucugaagauuuaauguguuuauucaaauguggucu

SEQ ID NO: 334053 - RNA, 64 nt, Human
aacuaggcuacauuucaaaauucagggcuguuuaagauuuaaaaucacaaacauuaacggcagu

SEQ ID NO: 334054 - RNA, 64 nt, Human
uuuuuuagaagaaaaauuaaguacagaaaagcccagauuuaaauacauuuaauaugucauuuua

SEQ ID NO: 334055 - RNA, 64 nt, Human
cuugaauacuuuuuucauaguuauuuguuuaaaaagauuuaaaaaucauugcacuuuggucaga

SEQ ID NO: 334056 - RNA, 64 nt, Human
acaaugcuaagugguauccgagguucuuaauaugagauuuaaaaucuuaaaauguuucuuauuu

SEQ ID NO: 334057 - RNA, 64 nt, Human
cacuugggacuagaucacaacugaagauaacaagagauuuaaguuuuaagggcauuuaaucagg

SEQ ID NO: 334058 - RNA, 64 nt, Human
aacaggaggaggcagucauccucuccuugccaaaagauuuaaaccuguccacauugguggugau

SEQ ID NO: 334059 - RNA, 64 nt, Human
ugcguauauauguauauauggaucccuuauauuuagauuuaacucguaguuuuauuugaaagua

SEQ ID NO: 334060 - RNA, 64 nt, Human
uucuagaagagaauaaaaacccaagucaguuauuagauuuaaaucaccuucugaaaugcugcua

SEQ ID NO: 334061 - RNA, 64 nt, Human
cacaacaaaugucagauaccaauuuuugcaaauuagauuuaaucuuauuaaauguuuuuaucuu

SEQ ID NO: 334062 - RNA, 64 nt, Human
ucaugcuuuguggggaguucacagcuaagggaucagauuuaagaggauaucuccuggacuuuug

SEQ ID NO: 334063 - RNA, 64 nt, Human
ugugcuauauguugcuuuaacaacccauugagcagucagggaaugugaguaagcuugcugccaa

SEQ ID NO: 334064 - RNA, 64 nt, Human
cagggacaguggcucaaagucagaucagucuggggucagggaucagcgaucagggauaggggca

SEQ ID NO: 334065 - RNA, 55 nt, Human
cuggggagcacagaggcugaccugugucagggagaggaggcggcgagagagguga

SEQ ID NO: 334066 - RNA, 64 nt, Human
auucuaaauguuuucuuguugcuuuaacacuggaagauuuaaagaauaaaaacuccugcauaaa

SEQ ID NO: 334067 - RNA, 64 nt, Human
caccauuuuggugggguaagauaagcuauuauuaagauuuaauccuuauaccauguuggacauu

SEQ ID NO: 334068 - RNA, 64 nt, Human
ggggcauucucauucucugauggagccaucaaugagauuuaacuuagucaaccugugcuagcaa

SEQ ID NO: 334069 - RNA, 64 nt, Human
guuuagaggucaugaagguuuuaaugaucaguaaagauuuaaggguugagauuuuuaagaggca

SEQ ID NO: 334070 - RNA, 64 nt, Human
uuuuuccaggauaaauuaucucugaugcuucuuuagauuuaagaguucauaauuccauccacug

SEQ ID NO: 334071 - RNA, 64 nt, Human
uacuuauuucuucccuaccuguuucacauccguaagauuuaagauauacauuuuuugagaggua

SEQ ID NO: 334072 - RNA, 64 nt, Human
uaauucuaagcacuaaagucuacaucuaagcuauagauuuaagcuugaagcuacagauuauauc

SEQ ID NO: 334073 - RNA, 64 nt, Human
aaguugcugcuuuagguuaacagcguguuuuagaagauuuaaauuucuuuccugucugcacaau

SEQ ID NO: 334074 - RNA, 64 nt, Human
ccaugcacuaauucaaucacagguguuucuaucuagauuuaaauauauuugucaaugaaugugg

SEQ ID NO: 334075 - RNA, 64 nt, Human
agguuucacauauauauucaucaacuauuuuagaagauuuaauucuaucaaaucuuguauuacc

SEQ ID NO: 334076 - RNA, 64 nt, Human
uuguuuuguaugagcgaaauugucuuuacuaaacagauuuaauaguugagaguuuuucuuucuc

SEQ ID NO: 334077 - RNA, 64 nt, Human
aauuugcacaaguuuuuuuaaauuaugggaaucaagauuuaauccuagagauuugguguacaau

SEQ ID NO: 334078 - RNA, 64 nt, Human
ucagcaauguugaucucauaaaaggaaaaacaaaagauuuaaguauucuauauaccaaguuuuu

SEQ ID NO: 334079 - RNA, 64 nt, Human
cccuauuguuggcuccacagccuuaaagugcuauagauuuaaauucauugauuaguuuuaauuu

SEQ ID NO: 334080 - RNA, 64 nt, Human
gagugauaugcuugcugcuuaaucaaaggauuaaagauuuaaagaugucuaugucuucuauuuu

SEQ ID NO: 334081 - RNA, 64 nt, Human
uucaccacauggccuugccucgguggcccugacugucagggagggccagggaggcagagcggga

SEQ ID NO: 334082 - RNA, 64 nt, Human
caaaugcaucaauuauaccagggauguauaguaagucagggaacuaauauaaaugaugacaguc

SEQ ID NO: 334083 - RNA, 64 nt, Human
ucggacaggugaugccagcaguuccugcuccucugucagggaagccaggcagagcccacagagc

SEQ ID NO: 334084 - RNA, 64 nt, Human
ggaacauaaaaauauccaagagagguuagggcuuagauuuaaaagcaucaaaacaacaacaaug

SEQ ID NO: 334085 - RNA, 64 nt, Human
aagauaaaauuauccucucucugaaauacgguaaagauuuaaauagguccugagacuguugaua

SEQ ID NO: 334086 - RNA, 64 nt, Human
ggaaagugaaaaaugugaaaauacaaaauacccaagauuuaagaccggggggaaaaaaccacaa

SEQ ID NO: 334087 - RNA, 64 nt, Human
gaagggcugcauuuugcuuaucagaagaaggugcagauuuaagggaauucauaugagguggcau

SEQ ID NO: 334088 - RNA, 64 nt, Human
cauaccucuuccucaccaacuuuacuaguagcugagauuuaaugggcaccuauuaugcuacaua

SEQ ID NO: 334089 - RNA, 64 nt, Human
ucagaagugagcuaccaaaacuuccacagaugugagauuuaacacuuaauugcagucacgugua

SEQ ID NO: 334090 - RNA, 64 nt, Human
ggauggagacuaugaagggguuuguaguuguaagagauuuaauauucaaaacugaaauauucug

SEQ ID NO: 334091 - RNA, 64 nt, Human
acauagauacacaugauuauguuaagaggcuuuaagauuuaaaaguuucacacaaccauaagua

SEQ ID NO: 334092 - RNA, 64 nt, Human
cuucuaaaaagugaaucuaucagcauuccacaucagauuuaaagcaucaaaugccugugaaaca

SEQ ID NO: 334093 - RNA, 64 nt, Human
ggaacaaguuagaagauaaaauuauuccuagaaaagauuuaaguaaagcaaaaggacaaauggu

SEQ ID NO: 334094 - RNA, 64 nt, Human
aacaagucagaaguagugacauuauuccuagaaaagauuuaaggaaagcaaaaagacaacuggu

SEQ ID NO: 334095 - RNA, 64 nt, Human
acgaaugcaggaguuuuaaauucuucaaaaacucagauuuaacccagaaccagaguaaagucac

SEQ ID NO: 334096 - RNA, 64 nt, Human
gaaaugcuaugucugcaugauaauuuaaaauggaagauuuaaacuuugcacuccaaaagcuuau

SEQ ID NO: 334097 - RNA, 64 nt, Human
ccauacucaaaauacccaguuuagcaagcaacugagauuuaagucucucuggcccuaagagguu

SEQ ID NO: 334098 - RNA, 64 nt, Human
auucuuaacugcuacagauaaccuguaauugagcagauuuaaaauucaggcauacuuuuccauu

SEQ ID NO: 334099 - RNA, 64 nt, Human
gucacaggcgccccaccauucaaccuuccgggaggucagggaccuucuauaugaggcgaguggg

SEQ ID NO: 334100 - RNA, 64 nt, Human
ucucccuucccaacuagacuguaagugccuugcggucagggacugaaucuugcccguuuaugua

SEQ ID NO: 334101 - RNA, 64 nt, Human
aacguugaugccccuucucuuuccucaaaucaaugucagggagucaaaagggcuguagcacagg

SEQ ID NO: 334102 - RNA, 64 nt, Human
uauuuauuguuuauuaguuauggggggagaggggagauuuaaaggaccagggacaugggaacca

SEQ ID NO: 334103 - RNA, 64 nt, Human
cugugugagcaagcauuuauguuuauuuauaagcagauuuaacaauuccaaaggaaucuccagu

SEQ ID NO: 334104 - RNA, 64 nt, Human
uuuuuuuuccuguuccccugucagcuggucugacagauuuaagaacucucauucuuaaaagacu

SEQ ID NO: 334105 - RNA, 64 nt, Human
cauuuaagguuagggguugguccuuaugccagcaagauuuaaccaacuguaaagauaguagucu

SEQ ID NO: 334106 - RNA, 64 nt, Human
aguguuagaaguuugugauucuccaaauaugccuagauuuaaagcugauuuaauuuauggaaaa

SEQ ID NO: 334107 - RNA, 64 nt, Human
uauaauauuguacauauggauuuuuuuauuguuuagauuuaaccagcuuuuaaaucucucuuuu

SEQ ID NO: 334108 - RNA, 64 nt, Human
augacugagugguaugcuuacaauugucaugucuagauuuaaauuuuaagucugagauuuuaaa

SEQ ID NO: 334109 - RNA, 64 nt, Human
ugcuccucuauaugugaggaaaaugagacuagacagauuuaaguaauugacaacuuacuuaaag

SEQ ID NO: 334110 - RNA, 64 nt, Human
auuucuguuugaacccuucauuuaauuuucucauagauuuaaguaaacagauguauuuugcaca

SEQ ID NO: 334111 - RNA, 64 nt, Human
auucuccuauauuugaggggggcaugggauaaaaagauuuaauaauaccuggauagagaaugcu

SEQ ID NO: 334112 - RNA, 64 nt, Human
cccacccuggcucucagggugacgccacccacagagauuuaaugagcgugggccuggaccuucc

SEQ ID NO: 334113 - RNA, 64 nt, Human
ugauauguuaaugaauccaaagaagaugggagagagauuuaacuuuuuugccuugcuaccucau

SEQ ID NO: 334114 - RNA, 64 nt, Human
ucauucuuaauggaaaaucugaaaccuaaauugcagauuuaaaagguacuguacaaccauuaua

SEQ ID NO: 334115 - RNA, 64 nt, Human
uuaaauucauaaguauaccaaauuaaaucuuaauagauuuaaugcaauuuuacagacacaauac

SEQ ID NO: 334116 - RNA, 56 nt, Human
augaauuuuuucaaguauaacuugcaagauuuaaauccuuuuaaaucuugauacca

SEQ ID NO: 334117 - RNA, 64 nt, Human
ucuuagcuugaagggaaaccccagagacucuucugucagggaaaacuagggacucucuucuaga

SEQ ID NO: 334118 - RNA, 64 nt, Human
ggcuuccacaggucagaauaugggacaggacauggucagggagaggacccugugaguuggugac

SEQ ID NO: 334119 - RNA, 64 nt, Human
gggccguggggggcagucucugguaccugugugcgucagggaugcucugcaccugcaaccaggu

SEQ ID NO: 334120 - RNA, 64 nt, Human
aacauuuaaaaauccuuuggguaauucgaauuacagauuuaaaagagcuuaagaucugguguuu

SEQ ID NO: 334121 - RNA, 64 nt, Human
auuugacuguuuaaaauguuggccaaaaaaaucaagauuuaauuuuuuuauuuguacugaaaaa

SEQ ID NO: 334122 - RNA, 64 nt, Human
uccauucucagccagaagcauaaacagaaaagaaagauuuaagaggauucacacucaacagguu

SEQ ID NO: 334123 - RNA, 64 nt, Human
uagguaaaucucacauuuaucugcaacaaaauauagauuuaauuuuuagcuuaaacuuuguuuc

SEQ ID NO: 334124 - RNA, 64 nt, Human
ucuccccagacauuuucuuuuuuuuuucacacauagauuuaaguaucuugauuguuaguagucu

SEQ ID NO: 334125 - RNA, 64 nt, Human
ugugagguacagucaguacacagcugacuuauguagauuuaagcugcuaauaugcuacuuaacc

SEQ ID NO: 334126 - RNA, 64 nt, Human
gugguaaaaggagcggagugcugaagcagagagcagauuuaauauaguaacauuaacaguguau

SEQ ID NO: 334127 - RNA, 64 nt, Human
acucuacuaauuuuuagauauucauuaauaggaaagauuuaauguuacagcaucuacucuuugg

SEQ ID NO: 334128 - RNA, 64 nt, Human
aaaguuguaccuugacccuagaauuccuuuuauaagauuuaauuguaauugucucaaagcauca

SEQ ID NO: 334129 - RNA, 64 nt, Human
acaaaauaaacguccuggggguuacccagaauacagauuuaaaaguuugccuguagagcaaaau

SEQ ID NO: 334130 - RNA, 64 nt, Human
gcuaaaaaguugggucucugagauuucaacuuguagauuuaaaaacaagugccguacguuaaga

SEQ ID NO: 334131 - RNA, 64 nt, Human
ccuuugccuuuguacaaucacagauauccuauggagauuuaaggaugaaagcccugaguuguuc

SEQ ID NO: 334132 - RNA, 64 nt, Human
acuuuuuaauguaaaaguaauuauuguaagaaaaagauuuaauuguuccauguguauuuuauuu

SEQ ID NO: 334133 - RNA, 64 nt, Human
caucuugacccacuagaauuagcaacuuuauuauagauuuaaacuuucuucaugaggaguaaaa

SEQ ID NO: 334134 - RNA, 64 nt, Human
uaaauaagcaguacuaguuacaaaucacaguauaagauuuaagugccugggggaaggauacaau

SEQ ID NO: 334135 - RNA, 64 nt, Human
agggagcagaccaugcccucccaacccuggaguugucagggagggccugcccaucaccucccuc

SEQ ID NO: 334136 - RNA, 64 nt, Human
gcgcagcaucauggaugaggcgccacucacggacgucagggacaucaaggacaccugagggguc

SEQ ID NO: 334137 - RNA, 61 nt, Human
cccuagaaguguggacauaguugaggcccccgucagggagaggucaccagcugcugugccc

SEQ ID NO: 334138 - RNA, 64 nt, Human
gugauuucucucaccguucucuggaaauggcaucagauuuaaggauaauacuccaucauagaaa

SEQ ID NO: 334139 - RNA, 64 nt, Human
ucuugauggauuguuguaauggucucaaaucccaagauuuaaaucacuuaccuauuuaauugug

SEQ ID NO: 334140 - RNA, 64 nt, Human
uuauaauucauugugguaagaaugauugaaaugcagauuuaacaaucuuauaaucuauugaaug

SEQ ID NO: 334141 - RNA, 64 nt, Human
uugugaagaaaguauuuaaauccaacuuuugaacagauuuaacaaacaugaggaacuuuuuuau

SEQ ID NO: 334142 - RNA, 64 nt, Human
acuugucugguuuaucccuuacagaauauuaguaagauuuaaucaauuaaaauauauauauaug

SEQ ID NO: 334143 - RNA, 64 nt, Human
cagaauacucuaaaaacuugauaaaauuaaauauagauuuaauuuaugaaccuuccaucaugau

SEQ ID NO: 334144 - RNA, 64 nt, Human
acaugagaauuuaacuuuauaaccgcgugaguuaagauuuaauucauagguuuugaugucauug

SEQ ID NO: 334145 - RNA, 64 nt, Human
uaacuuagcuuaugaguagcuuauacaauuaugaagauuuaauauuacagauaaaauguaaacu

SEQ ID NO: 334146 - RNA, 64 nt, Human
caugcugaugauguaucaaauucauuuuauagaaagauuuaaaguuuuuuucuggaagugauau

SEQ ID NO: 334147 - RNA, 64 nt, Human
ugaagaauaguugaucgacucugcuuuuacuaacagauuuaacuuauucagguuugaaauucug

SEQ ID NO: 334148 - RNA, 64 nt, Human
guaacaucauaacuuaaaacacuuuuuuggaagaagauuuaaaauauuugcccaugcuacagga

SEQ ID NO: 334149 - RNA, 64 nt, Human
aaagugaguuuaccaaaauuccagaagguaaugaagauuuaaaccaaagagcaauuuucccaag

SEQ ID NO: 334150 - RNA, 64 nt, Human
acaacuuagaggaaccaaggaaauaaagcaaauaagauuuaacaacccaagauuaagaggccag

SEQ ID NO: 334151 - RNA, 64 nt, Human
aauucuuuguaaauugucuuuuuuuuucugcuucagauuuaaauguguuuuuaaaauucuauua

SEQ ID NO: 334152 - RNA, 64 nt, Human
cgaaauaaccaguuuucuugauuagaguuuaagcagauuuaauaccaugaccuugcuuaaccgu

SEQ ID NO: 334153 - RNA, 64 nt, Human
ugacguggacuguccacaguguucaugugcuggagucagggacggccgcaccugccuccgccgg

SEQ ID NO: 334154 - RNA, 64 nt, Human
aauacacguauguuauaaccaucagcccgccagggucagggaaaggacucaccugacuuuggac

SEQ ID NO: 334155 - RNA, 64 nt, Human
ccauuguguugggaccugugaucuccacaccaaagucagggagccuggaagccaaacaaaggcc

SEQ ID NO: 334156 - RNA, 64 nt, Human
aaaaaaaaagucucugaaauuugauucuuacuacagauuuaaaacuuucuacauauuauaugua

SEQ ID NO: 334157 - RNA, 64 nt, Human
uuuuaguauacagagugauuggcaaauauuuucaagauuuaauaugagcaacccauuauuugcc

SEQ ID NO: 334158 - RNA, 64 nt, Human
ucacaucuauagugacaauaaagcgggaaguauaagauuuaauaggagggguuaagguucauga

SEQ ID NO: 334159 - RNA, 64 nt, Human
gcccuucaaaucuauaauuuuacuuugguaaacgagauuuaacaugaugucuuuuaugcuccua

SEQ ID NO: 334160 - RNA, 64 nt, Human
ucaccuuuuaaauccuguugaaaagccauguuuaagauuuaauuugccaaaauaaugucuuguu

SEQ ID NO: 334161 - RNA, 64 nt, Human
uucuaaaucucuucauagauuccaucaacacuccagauuuaauuaucuccucauaguuguuauu

SEQ ID NO: 334162 - RNA, 64 nt, Human
uacaucugacauuaaauuauuuuuccagcauacaagauuuaaauuugggaagggggggaugucc

SEQ ID NO: 334163 - RNA, 64 nt, Human
gagaaccuuucgcagauuucacaugaucuuuuuaagauuuaaauaaagagcuuuccuaaauaaa

SEQ ID NO: 334164 - RNA, 64 nt, Human
auuuaaaauaaauauuagcauuuuuuaaaaugaaagauuuaauguaaaaacaauuuugugaaua

SEQ ID NO: 334165 - RNA, 64 nt, Human
aauuaaaaccuacuuuuuucuagugcuaaagaaaagauuuaagcaccuugucaagcuggguaaa

SEQ ID NO: 334166 - RNA, 64 nt, Human
uuauuauuaccacuuacuuauagaggugauuuacagauuuaaugagaauauaucaaaguacuuu

SEQ ID NO: 334167 - RNA, 64 nt, Human
cuaauggagauagcuuuacacuuucugcuuuaauagauuuaaguggaccccaauauuuauuaaa

SEQ ID NO: 334168 - RNA, 64 nt, Human
gcauuugagaggcacuguuaaaaauuauugggaaagauuuaaagugcaggcugcaauuaaaaca

SEQ ID NO: 334169 - RNA, 64 nt, Human
agaaagcaccugauuugcacuugaaccagauuauagauuuaaaaguauaugacauguauuuugu

SEQ ID NO: 334170 - RNA, 64 nt, Human
acuuuccuaccccaagaggaaguuuucugaaauaagauuuaaaaacaaaacaaaaaaaacacuu

SEQ ID NO: 334171 - RNA, 64 nt, Human
cuugccucuggagaugauaagggccaaaggagcagucagggaggggcggugagccagaguaguc

SEQ ID NO: 334172 - RNA, 64 nt, Human
gacggagcggggccaagggagggguccggagggagucagggauggagggcagagggaguggaug

SEQ ID NO: 334173 - RNA, 64 nt, Human
aagcauagggacuaggcccaauccagccuggaaagucagggaggacuuccuagaggaagggaca

SEQ ID NO: 334174 - RNA, 64 nt, Human
uuccuaaauaacacuacagggauuuugucauauuagauuuaauuuauaauuugaaaaaucaucu

SEQ ID NO: 334175 - RNA, 64 nt, Human
uagcaaaaauagcuuuuuacuucaucaguugcuaagauuuaauacuuuggauucaucaaagugu

SEQ ID NO: 334176 - RNA, 64 nt, Human
ucccaaaaauaaaacuauccuuuuggaaaaaaaaagauuuaaaauaauuccugguuugaagaaa

SEQ ID NO: 334177 - RNA, 64 nt, Human
uggcaaccuuauucaauagguuuucccauauuucagauuuaauaacugaaggccagagagauua

SEQ ID NO: 334178 - RNA, 64 nt, Human
uuuauaaagguuuccuugugccaaauaagugcaaagauuuaauuuacuauuaaaaaccauaagc

SEQ ID NO: 334179 - RNA, 64 nt, Human
aaacuuagaaacauaaaaggaaauguaaguuuccagauuuaaaggacaugcugggugcccagca

SEQ ID NO: 334180 - RNA, 64 nt, Human
acaaucuaagacugguuuguccuugagaaauuucagauuuaaucagagaaaaauguacugauug
